United States Patent 12,606,847 (ENGINEERED VIRAL CAPSID POLYPEPTIDES AND USES THEREOF) - sequence listing, part 2

SEQ ID NO: 22506 - protein, 30 aa, Artificial Sequence
  Description of Artificial Sequence: Synthetic polypeptide
DEYEIRTTNPVATEQYGSVISTNGQREGQT

SEQ ID NO: 22507 - protein, 32 aa, Artificial Sequence
  Description of Artificial Sequence: Synthetic polypeptide
DEEEIRTTNPVATEQYGSVSTDNLTQGTGNSG

SEQ ID NO: 22508 - protein, 32 aa, Artificial Sequence
  Description of Artificial Sequence: Synthetic polypeptide
DEEEIRTTNPVATEQYGSVSTDNLTQEFGNNS

SEQ ID NO: 22509 - protein, 31 aa, Artificial Sequence
  Description of Artificial Sequence: Synthetic polypeptide
DEEEIRTTNPVATEQYGSVSTDNLQYISQRP

SEQ ID NO: 22510 - protein, 30 aa, Artificial Sequence
  Description of Artificial Sequence: Synthetic polypeptide
DEYEIRTTNPVATEQYGSISTNTQREGVLR

SEQ ID NO: 22511 - protein, 29 aa, Artificial Sequence
  Description of Artificial Sequence: Synthetic peptide
DEYEIRTTNPVATEQYGSISTLQQREGLR

SEQ ID NO: 22512 - protein, 32 aa, Artificial Sequence
  Description of Artificial Sequence: Synthetic polypeptide
AEEEIRTTNPVATEQYGSVSTTNNLQDGGNRE

SEQ ID NO: 22513 - protein, 28 aa, Artificial Sequence
  Description of Artificial Sequence: Synthetic peptide
SEEEIRTTNPIATEQWGSVSENLMRGNA

SEQ ID NO: 22514 - protein, 32 aa, Artificial Sequence
  Description of Artificial Sequence: Synthetic polypeptide
DEEEIRTTNPVATEQYGSVSTDNLQRMVEVRI

SEQ ID NO: 22515 - protein, 28 aa, Artificial Sequence
  Description of Artificial Sequence: Synthetic peptide
SEEEIRTTNPIATEQYGDVSENLMRENR

SEQ ID NO: 22516 - protein, 28 aa, Artificial Sequence
  Description of Artificial Sequence: Synthetic peptide
SEEEIRTTNPIATEQYGEASENCQRGNR

SEQ ID NO: 22517 - protein, 32 aa, Artificial Sequence
  Description of Artificial Sequence: Synthetic polypeptide
DEEEIRTTNPVATEQYGSVSKTDVLDQRSQNR

SEQ ID NO: 22518 - protein, 28 aa, Artificial Sequence
  Description of Artificial Sequence: Synthetic peptide
DEEEIRTTNPIATYQYGQVPTDLQRGNL

SEQ ID NO: 22519 - protein, 31 aa, Artificial Sequence
  Description of Artificial Sequence: Synthetic polypeptide
DEEEIRTTNPVATEQYGSGSTNNLQNGEDND

SEQ ID NO: 22520 - protein, 30 aa, Artificial Sequence
  Description of Artificial Sequence: Synthetic polypeptide
DEEEIRTTNPVATEQYGSVSTNLSQVEEAE

SEQ ID NO: 22521 - protein, 28 aa, Artificial Sequence
  Description of Artificial Sequence: Synthetic peptide
AENEIACTNPVATEQYGEASTNLQRGNR

SEQ ID NO: 22522 - protein, 28 aa, Artificial Sequence
  Description of Artificial Sequence: Synthetic peptide
DEDEIATVNPVATEQYGSVSTNLPSGNH

SEQ ID NO: 22523 - protein, 28 aa, Artificial Sequence
  Description of Artificial Sequence: Synthetic peptide
DEYEICTVNPVATEQYGSVSTNLIEGNT

SEQ ID NO: 22524 - protein, 28 aa, Artificial Sequence
  Description of Artificial Sequence: Synthetic peptide
SEEEIRTTNPIATEQYGSVPENLMRENR

SEQ ID NO: 22525 - protein, 29 aa, Artificial Sequence
  Description of Artificial Sequence: Synthetic peptide
DEEEIRATNPVATEQYGAVSTNLQLGDED

SEQ ID NO: 22526 - protein, 28 aa, Artificial Sequence
  Description of Artificial Sequence: Synthetic peptide
SEEEIRTTNPIATEQYGSVPENLQRENK

SEQ ID NO: 22527 - protein, 30 aa, Artificial Sequence
  Description of Artificial Sequence: Synthetic polypeptide
DEEEIRATNPVATEQYGAVSNTNLLQGGNS

SEQ ID NO: 22528 - protein, 29 aa, Artificial Sequence
  Description of Artificial Sequence: Synthetic peptide
DEDEICTTNPVATEAYGSVSTNLQEGEFR

SEQ ID NO: 22529 - protein, 28 aa, Artificial Sequence
  Description of Artificial Sequence: Synthetic peptide
SEEEIRTTNPIATEQYGSVSECLQHENR

SEQ ID NO: 22530 - protein, 29 aa, Artificial Sequence
  Description of Artificial Sequence: Synthetic peptide
SEEEIRTTNPIATEQYGSVSENEMNRGNR

SEQ ID NO: 22531 - protein, 28 aa, Artificial Sequence
  Description of Artificial Sequence: Synthetic peptide
DEEEIRTTNPLATDQYGQVPTGLQRGNF

SEQ ID NO: 22532 - protein, 29 aa, Artificial Sequence
  Description of Artificial Sequence: Synthetic peptide
SEEEIRTTNPIATEQYGSISENIQQRGNR

SEQ ID NO: 22533 - protein, 29 aa, Artificial Sequence
  Description of Artificial Sequence: Synthetic peptide
SEEEIRTTNPIATEQYGSVSENGMRGNPR

SEQ ID NO: 22534 - protein, 30 aa, Artificial Sequence
  Description of Artificial Sequence: Synthetic polypeptide
DEEEIRTTNPVATEQYGSVSTDNLVTGTGG

SEQ ID NO: 22535 - protein, 28 aa, Artificial Sequence
  Description of Artificial Sequence: Synthetic peptide
SEEEIRTTNPIATEQWGSVSENEMRGNR

SEQ ID NO: 22536 - protein, 31 aa, Artificial Sequence
  Description of Artificial Sequence: Synthetic polypeptide
DEYEISTTNPVATEQYGSVSTENLQHFGSNR

SEQ ID NO: 22537 - protein, 29 aa, Artificial Sequence
  Description of Artificial Sequence: Synthetic peptide
DEYEIRTTNPVATQQYGCVSTVNLERGNP

SEQ ID NO: 22538 - protein, 31 aa, Artificial Sequence
  Description of Artificial Sequence: Synthetic polypeptide
DEEEIRATNPVATEQYGCVSYTNLSQGGNNR

SEQ ID NO: 22539 - protein, 28 aa, Artificial Sequence
  Description of Artificial Sequence: Synthetic peptide
SEEEIRSTNPVATEQYGVVSETLMRGNR

SEQ ID NO: 22540 - protein, 30 aa, Artificial Sequence
  Description of Artificial Sequence: Synthetic polypeptide
DEEEIRATNPVATEQYGCVSTNLQQGPNEE

SEQ ID NO: 22541 - protein, 31 aa, Artificial Sequence
  Description of Artificial Sequence: Synthetic polypeptide
DEEEIRATNPVATEQYGCVSSMTNLEQGGNR

SEQ ID NO: 22542 - protein, 31 aa, Artificial Sequence
  Description of Artificial Sequence: Synthetic polypeptide
DEEEIRATNPVATEQYGCVSMTNLDQGIGNR

SEQ ID NO: 22543 - protein, 28 aa, Artificial Sequence
  Description of Artificial Sequence: Synthetic peptide
SEEEIRSTNPVATEQYGVVSSTLQHGNR

SEQ ID NO: 22544 - protein, 30 aa, Artificial Sequence
  Description of Artificial Sequence: Synthetic polypeptide
DEEEIRATNPVATEQYGCVSMTNLDQAGND

SEQ ID NO: 22545 - protein, 31 aa, Artificial Sequence
  Description of Artificial Sequence: Synthetic polypeptide
AEEEIRTTNPVATEQYGSVSTTNNLQNGANY

SEQ ID NO: 22546 - protein, 28 aa, Artificial Sequence
  Description of Artificial Sequence: Synthetic peptide
SEEEIRSTNPVCTEQYGSVSENLMRGNQ

SEQ ID NO: 22547 - protein, 31 aa, Artificial Sequence
  Description of Artificial Sequence: Synthetic polypeptide
DEEEIRTTNPVATEQYGSVSTDNMQNGNGGT

SEQ ID NO: 22548 - protein, 28 aa, Artificial Sequence
  Description of Artificial Sequence: Synthetic peptide
DEEEIRTTNPIATRQYGQVPTDLQRGNM

SEQ ID NO: 22549 - protein, 28 aa, Artificial Sequence
  Description of Artificial Sequence: Synthetic peptide
DEEEIRTTNPVATEQYGSGPELLQVGDR

SEQ ID NO: 22550 - protein, 28 aa, Artificial Sequence
  Description of Artificial Sequence: Synthetic peptide
SEEEIRSTNPVCTEQYGVVSDNLQRGNQ

SEQ ID NO: 22551 - protein, 28 aa, Artificial Sequence
  Description of Artificial Sequence: Synthetic peptide
SEEEIRSVNPVCTEQYGSVSDNLQRGNQ

SEQ ID NO: 22552 - protein, 32 aa, Artificial Sequence
  Description of Artificial Sequence: Synthetic polypeptide
DEEEIRTTNPVATEQYGSVSTNLSQQTGGTNE

SEQ ID NO: 22553 - protein, 31 aa, Artificial Sequence
  Description of Artificial Sequence: Synthetic polypeptide
AEEEIRTTNPVATEQYGSVSTTNNLQGQGIR

SEQ ID NO: 22554 - protein, 31 aa, Artificial Sequence
  Description of Artificial Sequence: Synthetic polypeptide
DEEEIRATNPVATEQYGCVSATNLDQEMGNR

SEQ ID NO: 22555 - protein, 31 aa, Artificial Sequence
  Description of Artificial Sequence: Synthetic polypeptide
DEEEIRTTNPVATEQYGSVSTDNMQEEGNNN

SEQ ID NO: 22556 - protein, 31 aa, Artificial Sequence
  Description of Artificial Sequence: Synthetic polypeptide
DEEEIRTTNPVATEQYGSVSTDNMQDNGNNG

SEQ ID NO: 22557 - protein, 30 aa, Artificial Sequence
  Description of Artificial Sequence: Synthetic polypeptide
DEEEIRATNPVATEQYGCVPATNLDQGGNR

SEQ ID NO: 22558 - protein, 28 aa, Artificial Sequence
  Description of Artificial Sequence: Synthetic peptide
SEEEIRTTNPEATEQFGSVSTNLQLGTI

SEQ ID NO: 22559 - protein, 29 aa, Artificial Sequence
  Description of Artificial Sequence: Synthetic peptide
DEEEIRTTNPIATEQYGTVSAENLMRGND

SEQ ID NO: 22560 - protein, 30 aa, Artificial Sequence
  Description of Artificial Sequence: Synthetic polypeptide
SEEEIRTTNPIATEPYGSVSEENLMQRGNR

SEQ ID NO: 22561 - protein, 32 aa, Artificial Sequence
  Description of Artificial Sequence: Synthetic polypeptide
AEEEIRTTNPVATEQYGSVSTTNNLQEIGENR

SEQ ID NO: 22562 - protein, 28 aa, Artificial Sequence
  Description of Artificial Sequence: Synthetic peptide
SEEEIRSTNPVCTEQYGSVSENLQSGNQ

SEQ ID NO: 22563 - protein, 30 aa, Artificial Sequence
  Description of Artificial Sequence: Synthetic polypeptide
DEEEIRATNPVATEQYGAVSMGNLFQGGNR

SEQ ID NO: 22564 - protein, 28 aa, Artificial Sequence
  Description of Artificial Sequence: Synthetic peptide
SEEEIRTTNPIATEQYGSVSENGNRGNV

SEQ ID NO: 22565 - protein, 30 aa, Artificial Sequence
  Description of Artificial Sequence: Synthetic polypeptide
DEEEIRATNPVATEQYGAVNMTNLFQGGNR

SEQ ID NO: 22566 - protein, 29 aa, Artificial Sequence
  Description of Artificial Sequence: Synthetic peptide
DEDEICTTNPVATEQYGSVSTNLQADNDE

SEQ ID NO: 22567 - protein, 30 aa, Artificial Sequence
  Description of Artificial Sequence: Synthetic polypeptide
SEEEIRTTNPIATEQYGSVSEPNLNRNGNR

SEQ ID NO: 22568 - protein, 30 aa, Artificial Sequence
  Description of Artificial Sequence: Synthetic polypeptide
DEDEICTTNPVATEQYGSVSTNLQGDGNDA

SEQ ID NO: 22569 - protein, 29 aa, Artificial Sequence
  Description of Artificial Sequence: Synthetic peptide
DEAEIYTTNPVATEQYGSVSTNLNGGGNT

SEQ ID NO: 22570 - protein, 29 aa, Artificial Sequence
  Description of Artificial Sequence: Synthetic peptide
DEAEIYTTNPVATEQYGSVSTNLAYGNQA

SEQ ID NO: 22571 - protein, 29 aa, Artificial Sequence
  Description of Artificial Sequence: Synthetic peptide
SEEEIRTTNPIATEQYGSVSSENLNRGNV

SEQ ID NO: 22572 - protein, 29 aa, Artificial Sequence
  Description of Artificial Sequence: Synthetic peptide
DEEEIRTTNPLATEQYGSTVSLNIDRGND

SEQ ID NO: 22573 - protein, 30 aa, Artificial Sequence
  Description of Artificial Sequence: Synthetic polypeptide
AEEEIRTTNPVATEQYGSVSTTNNEGGTNR

SEQ ID NO: 22574 - protein, 31 aa, Artificial Sequence
  Description of Artificial Sequence: Synthetic polypeptide
SEEEIRTTNPIATEQYGSVSTENLPMRNGNR

SEQ ID NO: 22575 - protein, 30 aa, Artificial Sequence
  Description of Artificial Sequence: Synthetic polypeptide
SEEEIRTTNPIATEQYGSVSTNLEDRGNDL

SEQ ID NO: 22576 - protein, 32 aa, Artificial Sequence
  Description of Artificial Sequence: Synthetic polypeptide
DEEEIRTTNPVATEQYGSVSTNLTEVGGLNFR

SEQ ID NO: 22577 - protein, 31 aa, Artificial Sequence
  Description of Artificial Sequence: Synthetic polypeptide
DEEEIRTTNPVATEQYGSVSTDNLQHGSGDI

SEQ ID NO: 22578 - protein, 29 aa, Artificial Sequence
  Description of Artificial Sequence: Synthetic peptide
SEEEIRTTNPIATEQYGSVSENPVERGNR

SEQ ID NO: 22579 - protein, 30 aa, Artificial Sequence
  Description of Artificial Sequence: Synthetic polypeptide
DEVEIRTTNPVATEQYGSVSTVLQHGDGNH

SEQ ID NO: 22580 - protein, 30 aa, Artificial Sequence
  Description of Artificial Sequence: Synthetic polypeptide
DEDEICTTNPVATEQYGVVSTNLQRGENES

SEQ ID NO: 22581 - protein, 31 aa, Artificial Sequence
  Description of Artificial Sequence: Synthetic polypeptide
DEVEIRTTNPVATEQYGSVSTTNLQSGGGNI

SEQ ID NO: 22582 - protein, 28 aa, Artificial Sequence
  Description of Artificial Sequence: Synthetic peptide
DEDEICTTNPVATEQYGVVSTVLQRPND

SEQ ID NO: 22583 - protein, 29 aa, Artificial Sequence
  Description of Artificial Sequence: Synthetic peptide
SEEEIRTTNPTATEMYGSVSEMNLQQGNR

SEQ ID NO: 22584 - protein, 32 aa, Artificial Sequence
  Description of Artificial Sequence: Synthetic polypeptide
DEEEIRTTNPVATEQYGSVSTDNLQEPEGNNS

SEQ ID NO: 22585 - protein, 32 aa, Artificial Sequence
  Description of Artificial Sequence: Synthetic polypeptide
DEEEIRTTNPVATEQYGSVSTDNLQENQGNED

SEQ ID NO: 22586 - protein, 29 aa, Artificial Sequence
  Description of Artificial Sequence: Synthetic peptide
DEEEIRTTNPLATEQYGSVSLNEITRGND

SEQ ID NO: 22587 - protein, 30 aa, Artificial Sequence
  Description of Artificial Sequence: Synthetic polypeptide
SEEEIRTTNPVATEAYGSVSNTNLHRGDPR

SEQ ID NO: 22588 - protein, 31 aa, Artificial Sequence
  Description of Artificial Sequence: Synthetic polypeptide
DEVEIRTTNPVATEQYGSVSTSNGDQRGNDG

SEQ ID NO: 22589 - protein, 31 aa, Artificial Sequence
  Description of Artificial Sequence: Synthetic polypeptide
AEEEIRTTNPVATEQYGSVSTTNLSQTIGNN

SEQ ID NO: 22590 - protein, 31 aa, Artificial Sequence
  Description of Artificial Sequence: Synthetic polypeptide
SEEEIRTTNPVATEAYGSVSNTNLHRGNDQR

SEQ ID NO: 22591 - protein, 30 aa, Artificial Sequence
  Description of Artificial Sequence: Synthetic polypeptide
DEVEIRTTNPVATEQYGSVSTPQGDQDGNR

SEQ ID NO: 22592 - protein, 29 aa, Artificial Sequence
  Description of Artificial Sequence: Synthetic peptide
DEEEIRTTNPLATEQYGSVSANINRGGND

SEQ ID NO: 22593 - protein, 32 aa, Artificial Sequence
  Description of Artificial Sequence: Synthetic polypeptide
DEEEIRTTNPVATEQYGSVSTDNLQIEFGINT

SEQ ID NO: 22594 - protein, 30 aa, Artificial Sequence
  Description of Artificial Sequence: Synthetic polypeptide
SEEEIRTTNPIATEQYGSVSENLPMRNGNR

SEQ ID NO: 22595 - protein, 32 aa, Artificial Sequence
  Description of Artificial Sequence: Synthetic polypeptide
DEEEIRTTNPVATEQYGSVSTDNLQIEVVNRQ

SEQ ID NO: 22596 - protein, 29 aa, Artificial Sequence
  Description of Artificial Sequence: Synthetic peptide
SEEEIRTTNPIATEQYGSVSENLEDRGNL

SEQ ID NO: 22597 - protein, 29 aa, Artificial Sequence
  Description of Artificial Sequence: Synthetic peptide
SEEEIRTTNPIATEQYGSVSENLMDHGNR

SEQ ID NO: 22598 - protein, 29 aa, Artificial Sequence
  Description of Artificial Sequence: Synthetic peptide
DEVEIRTTNPVAYERYGSVSTNLQEGGNQ

SEQ ID NO: 22599 - protein, 28 aa, Artificial Sequence
  Description of Artificial Sequence: Synthetic peptide
SEEEIRTTNPIATEQYGSVSENLMHENR

SEQ ID NO: 22600 - protein, 29 aa, Artificial Sequence
  Description of Artificial Sequence: Synthetic peptide
DEVEIRTTNPVAYEQYGTVSTNLQEGGNT

SEQ ID NO: 22601 - protein, 30 aa, Artificial Sequence
  Description of Artificial Sequence: Synthetic polypeptide
DEEEIRTTNPVATEQYGSVSLALGQGGNQT

SEQ ID NO: 22602 - protein, 28 aa, Artificial Sequence
  Description of Artificial Sequence: Synthetic peptide
DEEEIRTTNPLATEEYGSVATNHHRGNA

SEQ ID NO: 22603 - protein, 28 aa, Artificial Sequence
  Description of Artificial Sequence: Synthetic peptide
DEEEIRTTNPLATEEYGSVATNHVRGNA

SEQ ID NO: 22604 - protein, 28 aa, Artificial Sequence
  Description of Artificial Sequence: Synthetic peptide
SEEEIRTTNPIATEQYGSVSENLMREER

SEQ ID NO: 22605 - protein, 28 aa, Artificial Sequence
  Description of Artificial Sequence: Synthetic peptide
DEDEICTTNPVATEQWGSVATNLQTGNL

SEQ ID NO: 22606 - protein, 29 aa, Artificial Sequence
  Description of Artificial Sequence: Synthetic peptide
DEEEIRTTNPLATEPYGSTCSTNLARGNE

SEQ ID NO: 22607 - protein, 31 aa, Artificial Sequence
  Description of Artificial Sequence: Synthetic polypeptide
DEEEIRTTNPVATEQYGSGVSTNLQTVEERD

SEQ ID NO: 22608 - protein, 30 aa, Artificial Sequence
  Description of Artificial Sequence: Synthetic polypeptide
DEVEIRTTNPVATEWYGSVSTNLQEGGNGD

SEQ ID NO: 22609 - protein, 29 aa, Artificial Sequence
  Description of Artificial Sequence: Synthetic peptide
SEEEIRTTNPIATEQYGSVSENLMREGNG

SEQ ID NO: 22610 - protein, 29 aa, Artificial Sequence
  Description of Artificial Sequence: Synthetic peptide
DEDEICTTNPVATEQYGSVATNLDERGND

SEQ ID NO: 22611 - protein, 29 aa, Artificial Sequence
  Description of Artificial Sequence: Synthetic peptide
SEEEIRTTNPIATEQYGSVSENLMRGEDR

SEQ ID NO: 22612 - protein, 31 aa, Artificial Sequence
  Description of Artificial Sequence: Synthetic polypeptide
DEEEIRATNPVATEQWGSVSTNLQRGEMERT

SEQ ID NO: 22613 - protein, 30 aa, Artificial Sequence
  Description of Artificial Sequence: Synthetic polypeptide
DEVEIRTTNPVATERYGSVSTNLQGGGNEG

SEQ ID NO: 22614 - protein, 31 aa, Artificial Sequence
  Description of Artificial Sequence: Synthetic polypeptide
DEEEIRTTNPVATEQYGSVSTNLTDGTGNES

SEQ ID NO: 22615 - protein, 30 aa, Artificial Sequence
  Description of Artificial Sequence: Synthetic polypeptide
DEVEIRTTNPVATEQYGVVSTNLQEGGNGQ

SEQ ID NO: 22616 - protein, 30 aa, Artificial Sequence
  Description of Artificial Sequence: Synthetic polypeptide
DEVEIRTTNPVATEQYGVVSTNIQHEGGNR

SEQ ID NO: 22617 - protein, 30 aa, Artificial Sequence
  Description of Artificial Sequence: Synthetic polypeptide
DEEEIRATNPVATEQWGSVSTELQRGNDQE

SEQ ID NO: 22618 - protein, 28 aa, Artificial Sequence
  Description of Artificial Sequence: Synthetic peptide
DEAEIYTTNPVATEQYGSVSTNPMNGNT

SEQ ID NO: 22619 - protein, 28 aa, Artificial Sequence
  Description of Artificial Sequence: Synthetic peptide
DEEEIRATNPVATEQWGSVSTELDLGND

SEQ ID NO: 22620 - protein, 29 aa, Artificial Sequence
  Description of Artificial Sequence: Synthetic peptide
DEVEIRTTNPVATEQYGVVSTDLQRENGD

SEQ ID NO: 22621 - protein, 29 aa, Artificial Sequence
  Description of Artificial Sequence: Synthetic peptide
DEEEIRATNPVATEQWGSVSTDLQGGNIP

SEQ ID NO: 22622 - protein, 30 aa, Artificial Sequence
  Description of Artificial Sequence: Synthetic polypeptide
DEVEIRTTNPVATEQYGTVSTNLQDGGNEK

SEQ ID NO: 22623 - protein, 29 aa, Artificial Sequence
  Description of Artificial Sequence: Synthetic peptide
DEECIRTTNPVACEQYGQVSTANVQRGNN

SEQ ID NO: 22624 - protein, 31 aa, Artificial Sequence
  Description of Artificial Sequence: Synthetic polypeptide
DEEEIRTTNPVATEQYGCVGTMNLQQRGFND

SEQ ID NO: 22625 - protein, 29 aa, Artificial Sequence
  Description of Artificial Sequence: Synthetic peptide
DEECIRTTNPVACEQYGQVSTENVQRGNN

SEQ ID NO: 22626 - protein, 28 aa, Artificial Sequence
  Description of Artificial Sequence: Synthetic peptide
SEEEIRCTNPISTEQYGSVSENLMRGNR

SEQ ID NO: 22627 - protein, 28 aa, Artificial Sequence
  Description of Artificial Sequence: Synthetic peptide
SEEEIRCTNPIATEQYGSVSLNVMRGNR

SEQ ID NO: 22628 - protein, 29 aa, Artificial Sequence
  Description of Artificial Sequence: Synthetic peptide
SEEEIRCTNPIATEQYGSVSMENLMRGNR

SEQ ID NO: 22629 - protein, 29 aa, Artificial Sequence
  Description of Artificial Sequence: Synthetic peptide
DSGEICTTNPVATEQYGSVSTNELQLGMR

SEQ ID NO: 22630 - protein, 31 aa, Artificial Sequence
  Description of Artificial Sequence: Synthetic polypeptide
DEEEIRTTNPVATEQYGSVSTENLGAGNQGG

SEQ ID NO: 22631 - protein, 30 aa, Artificial Sequence
  Description of Artificial Sequence: Synthetic polypeptide
DSEVIRTTNPVATEQYGSVSTNLPDNGGNR

SEQ ID NO: 22632 - protein, 29 aa, Artificial Sequence
  Description of Artificial Sequence: Synthetic peptide
SEEEIRCTNPIATEQYGSVSMNLMRNGNR

SEQ ID NO: 22633 - protein, 28 aa, Artificial Sequence
  Description of Artificial Sequence: Synthetic peptide
DSEPIRTTNPVATEQYGIVSTNHQRVNL

SEQ ID NO: 22634 - protein, 28 aa, Artificial Sequence
  Description of Artificial Sequence: Synthetic peptide
DSEEIVTTNPVGTEQWGCVSTNLQRGVR

SEQ ID NO: 22635 - protein, 29 aa, Artificial Sequence
  Description of Artificial Sequence: Synthetic peptide
SEEEIRCTNPIATEQYGSVSMNLMRPGNR

SEQ ID NO: 22636 - protein, 28 aa, Artificial Sequence
  Description of Artificial Sequence: Synthetic peptide
SEEEIRCTNPIATEQYGSVSMNLMRPNR

SEQ ID NO: 22637 - protein, 28 aa, Artificial Sequence
  Description of Artificial Sequence: Synthetic peptide
DSEEISTTNPVATTQYGSVSTNPTAGNR

SEQ ID NO: 22638 - protein, 31 aa, Artificial Sequence
  Description of Artificial Sequence: Synthetic polypeptide
DEEEIRATNPVATEQYGSVSTNLQREPDNPV

SEQ ID NO: 22639 - protein, 32 aa, Artificial Sequence
  Description of Artificial Sequence: Synthetic polypeptide
DEEEIRATNPVATEQYGSVSTNLQRGGENTEE

SEQ ID NO: 22640 - protein, 28 aa, Artificial Sequence
  Description of Artificial Sequence: Synthetic peptide
DSEEISTTNPVATDQYGSVSTNPMNGNR

SEQ ID NO: 22641 - protein, 32 aa, Artificial Sequence
  Description of Artificial Sequence: Synthetic polypeptide
DEEEIRTTNPVATEQYGSVSTENLEQAGSNQV

SEQ ID NO: 22642 - protein, 30 aa, Artificial Sequence
  Description of Artificial Sequence: Synthetic polypeptide
DEEEIRTTNPVATEQYGCVSINLQNFGNDS

SEQ ID NO: 22643 - protein, 31 aa, Artificial Sequence
  Description of Artificial Sequence: Synthetic polypeptide
DEEEIRATNPVATEQYGSVSTNLQQGTNEQG

SEQ ID NO: 22644 - protein, 31 aa, Artificial Sequence
  Description of Artificial Sequence: Synthetic polypeptide
DEEEIRTTNPVATEQYGSVSITNLQTMVNYD

SEQ ID NO: 22645 - protein, 29 aa, Artificial Sequence
  Description of Artificial Sequence: Synthetic peptide
DSEEIRTTNPVSTEQWGMVSTNLQRPGER

SEQ ID NO: 22646 - protein, 31 aa, Artificial Sequence
  Description of Artificial Sequence: Synthetic polypeptide
DEEEIRATNPVATEQYGSVSTNLQQGGPERD

SEQ ID NO: 22647 - protein, 31 aa, Artificial Sequence
  Description of Artificial Sequence: Synthetic polypeptide
DEEEIRTTNPVATEQYGSVSTENHQYRSEDR

SEQ ID NO: 22648 - protein, 28 aa, Artificial Sequence
  Description of Artificial Sequence: Synthetic peptide
SEEEIRCTNPIATEQYGSVSNNLLRGNI

SEQ ID NO: 22649 - protein, 28 aa, Artificial Sequence
  Description of Artificial Sequence: Synthetic peptide
SEEEIRCTNPIATEQYGSVSNNLMRGND

SEQ ID NO: 22650 - protein, 29 aa, Artificial Sequence
  Description of Artificial Sequence: Synthetic peptide
DSEEIRTTNPVGTEQWGWVSTNLQREGDR

SEQ ID NO: 22651 - protein, 28 aa, Artificial Sequence
  Description of Artificial Sequence: Synthetic peptide
SEEEIRCTNPIATEQYGSVSNNLMRGNT

SEQ ID NO: 22652 - protein, 29 aa, Artificial Sequence
  Description of Artificial Sequence: Synthetic peptide
DSEEIRTTNPVGTEQWGVVSTNLQRGTER

SEQ ID NO: 22653 - protein, 29 aa, Artificial Sequence
  Description of Artificial Sequence: Synthetic peptide
SEEEIRCTNPIATEQYGSVSNENLMRGNR

SEQ ID NO: 22654 - protein, 29 aa, Artificial Sequence
  Description of Artificial Sequence: Synthetic peptide
DSEEIRTTNPVGTEQWGVVSTNLQRGEDR

SEQ ID NO: 22655 - protein, 31 aa, Artificial Sequence
  Description of Artificial Sequence: Synthetic polypeptide
DEEEIRTTNPVATEQYGSVSTENLIGGGNTQ

SEQ ID NO: 22656 - protein, 29 aa, Artificial Sequence
  Description of Artificial Sequence: Synthetic peptide
SEEEIRCTNPIATEQYGSVSKENLMRGNR

SEQ ID NO: 22657 - protein, 28 aa, Artificial Sequence
  Description of Artificial Sequence: Synthetic peptide
DTAEIRTTNPVATEQYGTTSTDLQTGNR

SEQ ID NO: 22658 - protein, 28 aa, Artificial Sequence
  Description of Artificial Sequence: Synthetic peptide
DTAEIRTTNPVATEQYGTNSTLLQHGNR

SEQ ID NO: 22659 - protein, 28 aa, Artificial Sequence
  Description of Artificial Sequence: Synthetic peptide
DTAEIRTTNPVATEQYGTCSTQLQIGNR

SEQ ID NO: 22660 - protein, 29 aa, Artificial Sequence
  Description of Artificial Sequence: Synthetic peptide
SEEEIRCTNPIATEQYGSVSGENLMRGNR

SEQ ID NO: 22661 - protein, 28 aa, Artificial Sequence
  Description of Artificial Sequence: Synthetic peptide
DTAEIRTTNPVATEQYGCNSTDLQEGNR

SEQ ID NO: 22662 - protein, 31 aa, Artificial Sequence
  Description of Artificial Sequence: Synthetic polypeptide
DEEEIRTTNPVATEQYGSVSTENLQATSNDY

SEQ ID NO: 22663 - protein, 28 aa, Artificial Sequence
  Description of Artificial Sequence: Synthetic peptide
SEEEIRCTNPIATEQYGSVSGNLMDGNR

SEQ ID NO: 22664 - protein, 28 aa, Artificial Sequence
  Description of Artificial Sequence: Synthetic peptide
SEEEIRCTNPIATEQYGSVSGNLMRGPR

SEQ ID NO: 22665 - protein, 28 aa, Artificial Sequence
  Description of Artificial Sequence: Synthetic peptide
DTAEIRTTNPVATEQYGACSTDLQDGNR

SEQ ID NO: 22666 - protein, 29 aa, Artificial Sequence
  Description of Artificial Sequence: Synthetic peptide
SEEEIRCTNPIATEQYGSVSHENLMRGNR

SEQ ID NO: 22667 - protein, 31 aa, Artificial Sequence
  Description of Artificial Sequence: Synthetic polypeptide
DEEEIRTTNPVATEQYGSVSTENLQAGSEST

SEQ ID NO: 22668 - protein, 29 aa, Artificial Sequence
  Description of Artificial Sequence: Synthetic peptide
SEEEIRCTNPIATEQYGSVSHNLMDRGNR

SEQ ID NO: 22669 - protein, 29 aa, Artificial Sequence
  Description of Artificial Sequence: Synthetic peptide
SEEEIRCTNPIATEQYGSVSLENLMRGNR

SEQ ID NO: 22670 - protein, 31 aa, Artificial Sequence
  Description of Artificial Sequence: Synthetic polypeptide
DEEEIRTTNPVATEQYGCVSMTALQRGSNQS

SEQ ID NO: 22671 - protein, 31 aa, Artificial Sequence
  Description of Artificial Sequence: Synthetic polypeptide
DEEEIRTTNPVATEQYGCVSMSNLQRFGNQG

SEQ ID NO: 22672 - protein, 31 aa, Artificial Sequence
  Description of Artificial Sequence: Synthetic polypeptide
DEEEIRATNPVATEQYGSVSTNLVRGNNGGT

SEQ ID NO: 22673 - protein, 30 aa, Artificial Sequence
  Description of Artificial Sequence: Synthetic polypeptide
DEECIRTTNPVATEAYGSTVSTNLSQAGNE

SEQ ID NO: 22674 - protein, 30 aa, Artificial Sequence
  Description of Artificial Sequence: Synthetic polypeptide
DEEEIRATNPVATEQYGSVSTNLVERGGEW

SEQ ID NO: 22675 - protein, 31 aa, Artificial Sequence
  Description of Artificial Sequence: Synthetic polypeptide
DEEEIRTTNPVATEQYGCVSLTGNHQRFGER

SEQ ID NO: 22676 - protein, 32 aa, Artificial Sequence
  Description of Artificial Sequence: Synthetic polypeptide
DEEEIRTTNPVATEQYGSVSTENLNQNGSNVA

SEQ ID NO: 22677 - protein, 29 aa, Artificial Sequence
  Description of Artificial Sequence: Synthetic peptide
SEEEIRCTNPIATEQYGSVSIENLMRGNR

SEQ ID NO: 22678 - protein, 31 aa, Artificial Sequence
  Description of Artificial Sequence: Synthetic polypeptide
DEEEIRATNPVATEQYGSVSTNLQRPENPEN

SEQ ID NO: 22679 - protein, 28 aa, Artificial Sequence
  Description of Artificial Sequence: Synthetic peptide
SEEEIRCTNPIATEQYGSVSINLMGGNR

SEQ ID NO: 22680 - protein, 31 aa, Artificial Sequence
  Description of Artificial Sequence: Synthetic polypeptide
DEEEIRTTNPVATEQYGSVSTENLINGSNIG

SEQ ID NO: 22681 - protein, 30 aa, Artificial Sequence
  Description of Artificial Sequence: Synthetic polypeptide
DSGEIRTTNPVATEQYGSVSTTNMLQLGMR

SEQ ID NO: 22682 - protein, 28 aa, Artificial Sequence
  Description of Artificial Sequence: Synthetic peptide
SEEEIRCTNPIATEQYGSVSINLMYGNR

SEQ ID NO: 22683 - protein, 31 aa, Artificial Sequence
  Description of Artificial Sequence: Synthetic polypeptide
DEEEIRTTNPVATEQYGSVSTENLQAGSDAA

SEQ ID NO: 22684 - protein, 32 aa, Artificial Sequence
  Description of Artificial Sequence: Synthetic polypeptide
DEEEIRTTNPVATEQYGSVSTENLQEAGSNVA

SEQ ID NO: 22685 - protein, 28 aa, Artificial Sequence
  Description of Artificial Sequence: Synthetic peptide
SEEEIRCTNPIATEQYGSVSNNLMRGQR

SEQ ID NO: 22686 - protein, 28 aa, Artificial Sequence
  Description of Artificial Sequence: Synthetic peptide
SEEEIRCTNPIATEQYGSVSPNHMRGNR

SEQ ID NO: 22687 - protein, 28 aa, Artificial Sequence
  Description of Artificial Sequence: Synthetic peptide
DSEEIRTTNPVGTEQWGMVSTGLQRGER

SEQ ID NO: 22688 - protein, 31 aa, Artificial Sequence
  Description of Artificial Sequence: Synthetic polypeptide
DEEEIRATNPVATEQYGSVSTNLDRGTNPEQ

SEQ ID NO: 22689 - protein, 32 aa, Artificial Sequence
  Description of Artificial Sequence: Synthetic polypeptide
DEEEIRTTNPVATEQYGSVSTENETRFGSNRQ

SEQ ID NO: 22690 - protein, 29 aa, Artificial Sequence
  Description of Artificial Sequence: Synthetic peptide
SEEEIRCTNPIATEQYGSVSSNLERGNRS

SEQ ID NO: 22691 - protein, 28 aa, Artificial Sequence
  Description of Artificial Sequence: Synthetic peptide
SEEEIRCTNPIATEQYGSVSSNLIRGND

SEQ ID NO: 22692 - protein, 31 aa, Artificial Sequence
  Description of Artificial Sequence: Synthetic polypeptide
DEEEIRTTNPVATEQYGCVSDTNTQHSGSNR

SEQ ID NO: 22693 - protein, 28 aa, Artificial Sequence
  Description of Artificial Sequence: Synthetic peptide
DSEEIRTTNPVGTEQWGKVSTNLQRGVM

SEQ ID NO: 22694 - protein, 29 aa, Artificial Sequence
  Description of Artificial Sequence: Synthetic peptide
DEEEIRATNPVATEQYGSVSTNLDDGDGE

SEQ ID NO: 22695 - protein, 29 aa, Artificial Sequence
  Description of Artificial Sequence: Synthetic peptide
DEECIRTTNPVAQEQYGQVSTINGQRGNN

SEQ ID NO: 22696 - protein, 28 aa, Artificial Sequence
  Description of Artificial Sequence: Synthetic peptide
DSEEIRTTNPVGTEQWGIVSTNLQRGEK

SEQ ID NO: 22697 - protein, 28 aa, Artificial Sequence
  Description of Artificial Sequence: Synthetic peptide
DSEEIRTTNPVGTEQWGIVSTNLQRGDA

SEQ ID NO: 22698 - protein, 28 aa, Artificial Sequence
  Description of Artificial Sequence: Synthetic peptide
DSEEIRTTNPVGTEQWGEVSTNDQRGVR

SEQ ID NO: 22699 - protein, 31 aa, Artificial Sequence
  Description of Artificial Sequence: Synthetic polypeptide
DEEEIRATNPVATEQYGSVSTNLIQGEGNGV

SEQ ID NO: 22700 - protein, 30 aa, Artificial Sequence
  Description of Artificial Sequence: Synthetic polypeptide
DEEEIRATNPVATEQYGSVSTNGGQNGEGR

SEQ ID NO: 22701 - protein, 30 aa, Artificial Sequence
  Description of Artificial Sequence: Synthetic polypeptide
DEEEIRATNPVATEQYGSVSTNDQRDNDGA

SEQ ID NO: 22702 - protein, 29 aa, Artificial Sequence
  Description of Artificial Sequence: Synthetic peptide
DSEEIRTTNPVGTEQWGCVSTNLQRGVDR

SEQ ID NO: 22703 - protein, 29 aa, Artificial Sequence
  Description of Artificial Sequence: Synthetic peptide
DEECIRTTNPVALEQYGQVSTINVQRGNC

SEQ ID NO: 22704 - protein, 30 aa, Artificial Sequence
  Description of Artificial Sequence: Synthetic polypeptide
DEEEIRATNPVATEQYGSVSTNDQDGNEHG

SEQ ID NO: 22705 - protein, 29 aa, Artificial Sequence
  Description of Artificial Sequence: Synthetic peptide
DEEEIRTTNPVATEQYGSCSTNYQDTDRQ

SEQ ID NO: 22706 - protein, 30 aa, Artificial Sequence
  Description of Artificial Sequence: Synthetic polypeptide
DEEEIRATNPVATEQYGSVSTINDQRGLAS

SEQ ID NO: 22707 - protein, 28 aa, Artificial Sequence
  Description of Artificial Sequence: Synthetic peptide
SEEEIRCTNPIATEQYGSVSSNLTQGNR

SEQ ID NO: 22708 - protein, 31 aa, Artificial Sequence
  Description of Artificial Sequence: Synthetic polypeptide
DEEEIRATNPVATEQYGSVSTGNPQGGDNRT

SEQ ID NO: 22709 - protein, 31 aa, Artificial Sequence
  Description of Artificial Sequence: Synthetic polypeptide
DEEEIRTTNPVATEQYGSVSTENDQRNQERS

SEQ ID NO: 22710 - protein, 31 aa, Artificial Sequence
  Description of Artificial Sequence: Synthetic polypeptide
DEEEIRTTNPVATEQYGSVSTENDQNRINID

SEQ ID NO: 22711 - protein, 30 aa, Artificial Sequence
  Description of Artificial Sequence: Synthetic polypeptide
SEEEIRCTNPIATEQYGSVSSTNLNRGNPR

SEQ ID NO: 22712 - protein, 28 aa, Artificial Sequence
  Description of Artificial Sequence: Synthetic peptide
DSEEIRTTNPVCTEQWGMVSTELQRGDR

SEQ ID NO: 22713 - protein, 31 aa, Artificial Sequence
  Description of Artificial Sequence: Synthetic polypeptide
DEEEIRATNPVATEQYGSVSTNDQRGENPNQ

SEQ ID NO: 22714 - protein, 29 aa, Artificial Sequence
  Description of Artificial Sequence: Synthetic peptide
SEEEIRCTNPIATEQYGSVSPENLMRGNR

SEQ ID NO: 22715 - protein, 30 aa, Artificial Sequence
  Description of Artificial Sequence: Synthetic polypeptide
DEEEIRTTNPVATEQYGCVSENLDQRGEFI

SEQ ID NO: 22716 - protein, 29 aa, Artificial Sequence
  Description of Artificial Sequence: Synthetic peptide
DSEEIRTTNPVGTEQWGMVSTNLQRFGLR

SEQ ID NO: 22717 - protein, 29 aa, Artificial Sequence
  Description of Artificial Sequence: Synthetic peptide
DSEEIRTTNPVGTEQWGVVSTNLPQRGVR

SEQ ID NO: 22718 - protein, 28 aa, Artificial Sequence
  Description of Artificial Sequence: Synthetic peptide
SEEEIRCTNPIATEQYGSVSPNLMRGNG

SEQ ID NO: 22719 - protein, 28 aa, Artificial Sequence
  Description of Artificial Sequence: Synthetic peptide
DSEEIRTTNPVGTEQWGVVSTALQRGVR

SEQ ID NO: 22720 - protein, 28 aa, Artificial Sequence
  Description of Artificial Sequence: Synthetic peptide
SEEEIRCTNPIATEQYGSVSPNLMRGNQ

SEQ ID NO: 22721 - protein, 28 aa, Artificial Sequence
  Description of Artificial Sequence: Synthetic peptide
DSEEIRTTNPVGTEQWGTVSTNTQRGVR

SEQ ID NO: 22722 - protein, 29 aa, Artificial Sequence
  Description of Artificial Sequence: Synthetic peptide
SEEEIRCTNPIATEQYGSVSQENLMRGNR

SEQ ID NO: 22723 - protein, 29 aa, Artificial Sequence
  Description of Artificial Sequence: Synthetic peptide
SEEEIRCTNPIATEQYGSVSRENLMRGNR

SEQ ID NO: 22724 - protein, 31 aa, Artificial Sequence
  Description of Artificial Sequence: Synthetic polypeptide
DEEEIRTTNPVATEQYGSVSTENHQRGEFQP

SEQ ID NO: 22725 - protein, 30 aa, Artificial Sequence
  Description of Artificial Sequence: Synthetic polypeptide
DEEEIRTTNPVATEQYGCVSGNLIEGDNDR

SEQ ID NO: 22726 - protein, 30 aa, Artificial Sequence
  Description of Artificial Sequence: Synthetic polypeptide
DEEEIRATNPVATEQYGSVSTNLQDGEGME

SEQ ID NO: 22727 - protein, 31 aa, Artificial Sequence
  Description of Artificial Sequence: Synthetic polypeptide
DEEEIRTTNPVATEQYGSVSTENHQAGSNQN

SEQ ID NO: 22728 - protein, 31 aa, Artificial Sequence
  Description of Artificial Sequence: Synthetic polypeptide
DEEEIRATNPVATEQYGSVSTNLQAGENDEE

SEQ ID NO: 22729 - protein, 29 aa, Artificial Sequence
  Description of Artificial Sequence: Synthetic peptide
DEEEIRTTNPVATEQYGCVSENLERIENQ

SEQ ID NO: 22730 - protein, 31 aa, Artificial Sequence
  Description of Artificial Sequence: Synthetic polypeptide
DEEEIRTTNPVATEQYGSVSITNLQTTVNVD

SEQ ID NO: 22731 - protein, 29 aa, Artificial Sequence
  Description of Artificial Sequence: Synthetic peptide
DSEEIRTTNPVGTEQWGTVPSTNLQRGVR

SEQ ID NO: 22732 - protein, 32 aa, Artificial Sequence
  Description of Artificial Sequence: Synthetic polypeptide
DEEEIRTTNPVATEQYGSVSTENGLQRQNNNL

SEQ ID NO: 22733 - protein, 30 aa, Artificial Sequence
  Description of Artificial Sequence: Synthetic polypeptide
DEEEIRATNPVATEQYGSVSTNLQAEPENP

SEQ ID NO: 22734 - protein, 28 aa, Artificial Sequence
  Description of Artificial Sequence: Synthetic peptide
DSEEIRTTNPVGTEQWGNVSTNLQRGEM

SEQ ID NO: 22735 - protein, 29 aa, Artificial Sequence
  Description of Artificial Sequence: Synthetic peptide
DSEEIRTTNPVGTEQWGMVWSTNLQRGER

SEQ ID NO: 22736 - protein, 33 aa, Artificial Sequence
  Description of Artificial Sequence: Synthetic polypeptide
DEEEIRTTNPVATEQYGSVSTENGLQRLSNERT

SEQ ID NO: 22737 - protein, 29 aa, Artificial Sequence
  Description of Artificial Sequence: Synthetic peptide
SEEEIRCTNPIATEQYGSVSSENLMRGNR

SEQ ID NO: 22738 - protein, 31 aa, Artificial Sequence
  Description of Artificial Sequence: Synthetic polypeptide
DEEEIRATNPVATEQYGSVSTNLNRGNNGFG

SEQ ID NO: 22739 - protein, 28 aa, Artificial Sequence
  Description of Artificial Sequence: Synthetic peptide
DSEEIRTTNPVGTEQWGMVSTNLQRNGR

SEQ ID NO: 22740 - protein, 28 aa, Artificial Sequence
  Description of Artificial Sequence: Synthetic peptide
DSEEIRTTNPVGTEQWGMVSTNLQRGTS

SEQ ID NO: 22741 - protein, 29 aa, Artificial Sequence
  Description of Artificial Sequence: Synthetic peptide
DSEEIRTTNPVGTEQWGMVSTNLQRGTRI

SEQ ID NO: 22742 - protein, 29 aa, Artificial Sequence
  Description of Artificial Sequence: Synthetic peptide
DSEEIRTTNPVGTEQWGMVSTNLQRGELR

SEQ ID NO: 22743 - protein, 32 aa, Artificial Sequence
  Description of Artificial Sequence: Synthetic polypeptide
DEEEIRTTNPVATEQYGSVSITNLQVRPGLQE

SEQ ID NO: 22744 - protein, 32 aa, Artificial Sequence
  Description of Artificial Sequence: Synthetic polypeptide
DEEEIRTTNPVATEQYGCVSMTNLNRDGMNRV

SEQ ID NO: 22745 - protein, 28 aa, Artificial Sequence
  Description of Artificial Sequence: Synthetic peptide
DTDEIRTTNPVATEQYGCTSTDLQHGNR

SEQ ID NO: 22746 - protein, 32 aa, Artificial Sequence
  Description of Artificial Sequence: Synthetic polypeptide
DEEEIRTTNPVATEQYGCVSMTNLNRGMNDRN

SEQ ID NO: 22747 - protein, 32 aa, Artificial Sequence
  Description of Artificial Sequence: Synthetic polypeptide
DEEEIRTTNPVATEQYGSVSTENPLQNGSDRS

SEQ ID NO: 22748 - protein, 29 aa, Artificial Sequence
  Description of Artificial Sequence: Synthetic peptide
SEEEIRCTNPIATEQYGSVSENVLMRGNR

SEQ ID NO: 22749 - protein, 31 aa, Artificial Sequence
  Description of Artificial Sequence: Synthetic polypeptide
DEEEIRTTNPVATEQYGSCSTNLQSTAGGER

SEQ ID NO: 22750 - protein, 31 aa, Artificial Sequence
  Description of Artificial Sequence: Synthetic polypeptide
DEEEIRTTNPVATEQYGSVSTENNQYFGSNQ

SEQ ID NO: 22751 - protein, 31 aa, Artificial Sequence
  Description of Artificial Sequence: Synthetic polypeptide
DEEEIRTTNPVATEQYGSCSTNLQTRDNMSP

SEQ ID NO: 22752 - protein, 29 aa, Artificial Sequence
  Description of Artificial Sequence: Synthetic peptide
DTEEIRATNPVATEQYGSVVSTNNQNGTR

SEQ ID NO: 22753 - protein, 30 aa, Artificial Sequence
  Description of Artificial Sequence: Synthetic polypeptide
DTEEIRATNPVATEQYGSVVSTNLSQNGSR

SEQ ID NO: 22754 - protein, 29 aa, Artificial Sequence
  Description of Artificial Sequence: Synthetic peptide
DTEEIRATNPVATEQYGSVVSTNLQSGTY

SEQ ID NO: 22755 - protein, 28 aa, Artificial Sequence
  Description of Artificial Sequence: Synthetic peptide
SEEEIRCTNPIATEQYGSVSENVMRGNR

SEQ ID NO: 22756 - protein, 30 aa, Artificial Sequence
  Description of Artificial Sequence: Synthetic polypeptide
DTEEIRATNPVATEQYGSVVSTNLQQNGER

SEQ ID NO: 22757 - protein, 29 aa, Artificial Sequence
  Description of Artificial Sequence: Synthetic peptide
SEEEIRCTNPIATEQYGSVSENWLMRGNR

SEQ ID NO: 22758 - protein, 29 aa, Artificial Sequence
  Description of Artificial Sequence: Synthetic peptide
DTEEIRATNPVATEQYGSVVSTNLQNGTH

SEQ ID NO: 22759 - protein, 28 aa, Artificial Sequence
  Description of Artificial Sequence: Synthetic peptide
SEEEIRCTNPIATEQYGSVSENTMRGNR

SEQ ID NO: 22760 - protein, 31 aa, Artificial Sequence
  Description of Artificial Sequence: Synthetic polypeptide
DEEEIRTTNPVATEQYGSVSTENNMDRGNMQ

SEQ ID NO: 22761 - protein, 29 aa, Artificial Sequence
  Description of Artificial Sequence: Synthetic peptide
DTEEIRATNPVATEQYGSVVSTNLQNGIS

SEQ ID NO: 22762 - protein, 28 aa, Artificial Sequence
  Description of Artificial Sequence: Synthetic peptide
SEEEIRCTNPIATEQYGSVSENWMRGNR

SEQ ID NO: 22763 - protein, 29 aa, Artificial Sequence
  Description of Artificial Sequence: Synthetic peptide
DEEEIRTTNPVATEQYGSCSTNLTRVDTD

SEQ ID NO: 22764 - protein, 32 aa, Artificial Sequence
  Description of Artificial Sequence: Synthetic polypeptide
DEEEIRTTNPVATEQYGSVSTENNDLQRNENT

SEQ ID NO: 22765 - protein, 29 aa, Artificial Sequence
  Description of Artificial Sequence: Synthetic peptide
SEEEIRCTNPIATEQYGSVSENYLMRGNR

SEQ ID NO: 22766 - protein, 28 aa, Artificial Sequence
  Description of Artificial Sequence: Synthetic peptide
SEEEIRCTNPIATEQYGSVSENYMRGNR

SEQ ID NO: 22767 - protein, 31 aa, Artificial Sequence
  Description of Artificial Sequence: Synthetic polypeptide
DEEEIRTTNPVATEQYGSVSITNLQRTQEPD

SEQ ID NO: 22768 - protein, 28 aa, Artificial Sequence
  Description of Artificial Sequence: Synthetic peptide
SEEEIRCTNPIATEQYGSVSEPLMRGNR

SEQ ID NO: 22769 - protein, 29 aa, Artificial Sequence
  Description of Artificial Sequence: Synthetic peptide
SEEEIRCTNPIATEQYGSVSEPNLMRGNR

SEQ ID NO: 22770 - protein, 29 aa, Artificial Sequence
  Description of Artificial Sequence: Synthetic peptide
SEEEIRCTNPIATEQYGSVSEPNLNRGNR

SEQ ID NO: 22771 - protein, 30 aa, Artificial Sequence
  Description of Artificial Sequence: Synthetic polypeptide
SEEEIRCTNPIATEQYGSVSEPNLQMRGNR

SEQ ID NO: 22772 - protein, 28 aa, Artificial Sequence
  Description of Artificial Sequence: Synthetic peptide
SEEEIRCTNPIATEQYGSVSEQLMRGNR

SEQ ID NO: 22773 - protein, 30 aa, Artificial Sequence
  Description of Artificial Sequence: Synthetic polypeptide
DTEEIRATNPVATEQYGSVVSTNLQNGNTV

SEQ ID NO: 22774 - protein, 29 aa, Artificial Sequence
  Description of Artificial Sequence: Synthetic peptide
SEEEIRCTNPIATEQYGSVSEQNLMRGNR

SEQ ID NO: 22775 - protein, 29 aa, Artificial Sequence
  Description of Artificial Sequence: Synthetic peptide
SEEEIRCTNPIATEQYGSVSENTLMRGNR

SEQ ID NO: 22776 - protein, 28 aa, Artificial Sequence
  Description of Artificial Sequence: Synthetic peptide
SEEEIRCTNPIATEQYGSVSENSMRGNR

SEQ ID NO: 22777 - protein, 30 aa, Artificial Sequence
  Description of Artificial Sequence: Synthetic polypeptide
DTEEIRSTNPVATEQYGSVSTNLQARNEQR

SEQ ID NO: 22778 - protein, 32 aa, Artificial Sequence
  Description of Artificial Sequence: Synthetic polypeptide
DEEEIRTTNPVATEQYGSVSTEPLERFGSNNR

SEQ ID NO: 22779 - protein, 32 aa, Artificial Sequence
  Description of Artificial Sequence: Synthetic polypeptide
DEEEIRTTNPVATEQYGSVSTEPHQRGSNTRA

SEQ ID NO: 22780 - protein, 30 aa, Artificial Sequence
  Description of Artificial Sequence: Synthetic polypeptide
DTEEIRSTNPVATEQYGSKVSTNLQNGTQR

SEQ ID NO: 22781 - protein, 28 aa, Artificial Sequence
  Description of Artificial Sequence: Synthetic peptide
SEEEIRCTNPIATEQYGSVSENMMRGNR

SEQ ID NO: 22782 - protein, 32 aa, Artificial Sequence
  Description of Artificial Sequence: Synthetic polypeptide
DEEEIRTTNPVATEQYGSVSITNLQRQENLGD

SEQ ID NO: 22783 - protein, 29 aa, Artificial Sequence
  Description of Artificial Sequence: Synthetic peptide
SEEEIRCTNPIATEQYGSVSENNLMRGNR

SEQ ID NO: 22784 - protein, 29 aa, Artificial Sequence
  Description of Artificial Sequence: Synthetic peptide
SEEEIRCTNPIATEQYGSVSENNLNRGNR

SEQ ID NO: 22785 - protein, 30 aa, Artificial Sequence
  Description of Artificial Sequence: Synthetic polypeptide
AEEEIRTTNPVATEQYGSVSTTNQQDGNAE

SEQ ID NO: 22786 - protein, 28 aa, Artificial Sequence
  Description of Artificial Sequence: Synthetic peptide
SEEEIRCTNPIATEQYGSVSENNMRGNR

SEQ ID NO: 22787 - protein, 29 aa, Artificial Sequence
  Description of Artificial Sequence: Synthetic peptide
SEEEIRCTNPIATEQYGSVSENPLMRGNR

SEQ ID NO: 22788 - protein, 29 aa, Artificial Sequence
  Description of Artificial Sequence: Synthetic peptide
SEEEIRCTNPIATEQYGSVSENPMQRGNR

SEQ ID NO: 22789 - protein, 28 aa, Artificial Sequence
  Description of Artificial Sequence: Synthetic peptide
SEEEIRCTNPIATEQYGSVSENTDRGNR

SEQ ID NO: 22790 - protein, 28 aa, Artificial Sequence
  Description of Artificial Sequence: Synthetic peptide
SEEEIRCTNPIATEQYGSVSENPMRGNR

SEQ ID NO: 22791 - protein, 32 aa, Artificial Sequence
  Description of Artificial Sequence: Synthetic polypeptide
DEEEIRTTNPVATEQYGSVSTENVPQERDNIR

SEQ ID NO: 22792 - protein, 29 aa, Artificial Sequence
  Description of Artificial Sequence: Synthetic peptide
SEEEIRCTNPIATEQYGSVSENQLMRGNR

SEQ ID NO: 22793 - protein, 30 aa, Artificial Sequence
  Description of Artificial Sequence: Synthetic polypeptide
DTEEIRCTNPVATEQYGSTVSTNLQNDGTR

SEQ ID NO: 22794 - protein, 30 aa, Artificial Sequence
  Description of Artificial Sequence: Synthetic polypeptide
DTEEIRCTNPVATEQYGSTVSTNLQAGETR

SEQ ID NO: 22795 - protein, 30 aa, Artificial Sequence
  Description of Artificial Sequence: Synthetic polypeptide
DTEEIRCTNPVATEQYGSQVSTNLQNIGDR

SEQ ID NO: 22796 - protein, 30 aa, Artificial Sequence
  Description of Artificial Sequence: Synthetic polypeptide
DTEEIRCTNPVATEQYGSQVSTNLQNGENQ

SEQ ID NO: 22797 - protein, 28 aa, Artificial Sequence
  Description of Artificial Sequence: Synthetic peptide
SEEEIRCTNPIATEQYGSVSENQMRGNR

SEQ ID NO: 22798 - protein, 29 aa, Artificial Sequence
  Description of Artificial Sequence: Synthetic peptide
DTEEIRCTNPVATEQYGSIVSTNLQNGEV

SEQ ID NO: 22799 - protein, 30 aa, Artificial Sequence
  Description of Artificial Sequence: Synthetic polypeptide
DTEEIRCTNPVATEQYGSCVSTNLQDHGTR

SEQ ID NO: 22800 - protein, 31 aa, Artificial Sequence
  Description of Artificial Sequence: Synthetic polypeptide
DEEEIRTTNPVATEQYGSVSTENTQAGSNAQ

SEQ ID NO: 22801 - protein, 28 aa, Artificial Sequence
  Description of Artificial Sequence: Synthetic peptide
SEEEIRCTNPIATEQYGSVSENRMRGNR

SEQ ID NO: 22802 - protein, 29 aa, Artificial Sequence
  Description of Artificial Sequence: Synthetic peptide
SEEEIRCTNPIATEQYGSVSENSLMRGNR

SEQ ID NO: 22803 - protein, 30 aa, Artificial Sequence
  Description of Artificial Sequence: Synthetic polypeptide
DTEEIRCTNPVATEQYGSVVSTNLQHDGTR

SEQ ID NO: 22804 - protein, 30 aa, Artificial Sequence
  Description of Artificial Sequence: Synthetic polypeptide
DEEEIRATNPVATEQYGSVSVNQDRGENER

SEQ ID NO: 22805 - protein, 31 aa, Artificial Sequence
  Description of Artificial Sequence: Synthetic polypeptide
DEEEIRTTNPVATEQYGSVSTENLVDPGNII

SEQ ID NO: 22806 - protein, 28 aa, Artificial Sequence
  Description of Artificial Sequence: Synthetic peptide
SEEEIRCTNPIATEQYGSVSERLMRGNR

SEQ ID NO: 22807 - protein, 28 aa, Artificial Sequence
  Description of Artificial Sequence: Synthetic peptide
SEEEIRCTNPIATEQYGSVSEWLMRGNR

SEQ ID NO: 22808 - protein, 28 aa, Artificial Sequence
  Description of Artificial Sequence: Synthetic peptide
DTEEIRATNPVATEQYGSSSTNAQQGNN

SEQ ID NO: 22809 - protein, 29 aa, Artificial Sequence
  Description of Artificial Sequence: Synthetic peptide
DTEEIRATNPVATEQYGDIVSTNLQNGTR

SEQ ID NO: 22810 - protein, 29 aa, Artificial Sequence
  Description of Artificial Sequence: Synthetic peptide
SEEEIRCTNPIATEQYGSVSEWNLMRGNR

SEQ ID NO: 22811 - protein, 28 aa, Artificial Sequence
  Description of Artificial Sequence: Synthetic peptide
SEEEIRCTNPIATEQYGSVSEYLMRGNR

SEQ ID NO: 22812 - protein, 32 aa, Artificial Sequence
  Description of Artificial Sequence: Synthetic polypeptide
DEEEIRTTNPVATEQYGSVSTENLQFNSNFRE

SEQ ID NO: 22813 - protein, 31 aa, Artificial Sequence
  Description of Artificial Sequence: Synthetic polypeptide
DEEEIRTTNPVATEQYGSCSTNPLDQQGQDR

SEQ ID NO: 22814 - protein, 28 aa, Artificial Sequence
  Description of Artificial Sequence: Synthetic peptide
DTEEICTTNPVATTQYGSVSTNPLMGNR

SEQ ID NO: 22815 - protein, 31 aa, Artificial Sequence
  Description of Artificial Sequence: Synthetic polypeptide
DEEEIRTTNPVATEQYGSVSITNLQTEGLTL

SEQ ID NO: 22816 - protein, 29 aa, Artificial Sequence
  Description of Artificial Sequence: Synthetic peptide
DEEEIRTTNPVATEQYGSCSTNPPRNNQQ

SEQ ID NO: 22817 - protein, 29 aa, Artificial Sequence
  Description of Artificial Sequence: Synthetic peptide
DEEEIRTTNPVATEQYGSCSTNPQTGTQF

SEQ ID NO: 22818 - protein, 29 aa, Artificial Sequence
  Description of Artificial Sequence: Synthetic peptide
DTEEIATTNPVATEQYGSVCTNLQQGNQQ

SEQ ID NO: 22819 - protein, 28 aa, Artificial Sequence
  Description of Artificial Sequence: Synthetic peptide
DTEEIRATNPVATEQYGSSSTNQQGGNM

SEQ ID NO: 22820 - protein, 32 aa, Artificial Sequence
  Description of Artificial Sequence: Synthetic polypeptide
DEEEIRTTNPVATEQYGSVSTENLQEPGGNNQ

SEQ ID NO: 22821 - protein, 31 aa, Artificial Sequence
  Description of Artificial Sequence: Synthetic polypeptide
AEEEIRTTNPVATEQYGSVSTTNQLEQQGND

SEQ ID NO: 22822 - protein, 32 aa, Artificial Sequence
  Description of Artificial Sequence: Synthetic polypeptide
DEEEIRTTNPVATEQYGSVSTENLQENGNENE

SEQ ID NO: 22823 - protein, 30 aa, Artificial Sequence
  Description of Artificial Sequence: Synthetic polypeptide
DEEEIRTTNPVATEQYGSCSTNVQEPGNII

SEQ ID NO: 22824 - protein, 32 aa, Artificial Sequence
  Description of Artificial Sequence: Synthetic polypeptide
DEEEIRTTNPVATEQYGSVSTENLQEMGNNQI

SEQ ID NO: 22825 - protein, 29 aa, Artificial Sequence
  Description of Artificial Sequence: Synthetic peptide
SEEEIRCTNPIATEQYGSVSFENLMRGNR

SEQ ID NO: 22826 - protein, 28 aa, Artificial Sequence
  Description of Artificial Sequence: Synthetic peptide
DEDEIATTNPVAYEQYGSVATNGQRGNL

SEQ ID NO: 22827 - protein, 28 aa, Artificial Sequence
  Description of Artificial Sequence: Synthetic peptide
DTEEIACTNPVATEQYGSSSTNMQRGNN

SEQ ID NO: 22828 - protein, 31 aa, Artificial Sequence
  Description of Artificial Sequence: Synthetic polypeptide
DEEEIRATNPVATEQYGSVSTTNLQIGNENG

SEQ ID NO: 22829 - protein, 28 aa, Artificial Sequence
  Description of Artificial Sequence: Synthetic peptide
DTEDIRTTNPVATEQYGKVSTNHQRVNG

SEQ ID NO: 22830 - protein, 31 aa, Artificial Sequence
  Description of Artificial Sequence: Synthetic polypeptide
DEEEIRATNPVATEQYGSVSTTLNLQGDGNE

SEQ ID NO: 22831 - protein, 30 aa, Artificial Sequence
  Description of Artificial Sequence: Synthetic polypeptide
DEEEIRTTNPVATEQYGCVSMTYDQHGSNR

SEQ ID NO: 22832 - protein, 29 aa, Artificial Sequence
  Description of Artificial Sequence: Synthetic peptide
DTDEIRTTNPVATEQYGSVSTNVLQLGDG

SEQ ID NO: 22833 - protein, 29 aa, Artificial Sequence
  Description of Artificial Sequence: Synthetic peptide
SEEEIRCTNPIATEQYGSVSEYNLMRGNR

SEQ ID NO: 22834 - protein, 28 aa, Artificial Sequence
  Description of Artificial Sequence: Synthetic peptide
DTEEIRATNPVATEQYGSTSTNDQMGNN

SEQ ID NO: 22835 - protein, 31 aa, Artificial Sequence
  Description of Artificial Sequence: Synthetic polypeptide
DEEEIRTTNPVATEQYGSVSTENLQGGGEEI

SEQ ID NO: 22836 - protein, 31 aa, Artificial Sequence
  Description of Artificial Sequence: Synthetic polypeptide
DEEEIRTTNPVATEQYGSCSTNPDQRINVRT

SEQ ID NO: 22837 - protein, 31 aa, Artificial Sequence
  Description of Artificial Sequence: Synthetic polypeptide
DEEEIRTTNPVATEQYGSVSTENLTSGEDRE

SEQ ID NO: 22838 - protein, 32 aa, Artificial Sequence
  Description of Artificial Sequence: Synthetic polypeptide
DEEEIRTTNPVATEQYGSVSTENLSQNGSERI

SEQ ID NO: 22839 - protein, 32 aa, Artificial Sequence
  Description of Artificial Sequence: Synthetic polypeptide
DEEEIRTTNPVATEQYGSVSTENLQSQGPNEM

SEQ ID NO: 22840 - protein, 30 aa, Artificial Sequence
  Description of Artificial Sequence: Synthetic polypeptide
DEEEIRTTNPVATEQYGSCSTNLVRDDGHI

SEQ ID NO: 22841 - protein, 30 aa, Artificial Sequence
  Description of Artificial Sequence: Synthetic polypeptide
DEEEIRATNPVATEQYGSVSVNHDRGSNNR

SEQ ID NO: 22842 - protein, 31 aa, Artificial Sequence
  Description of Artificial Sequence: Synthetic polypeptide
DEEEIRATNPVATEQYGSVSVNAQDRGGNTR

SEQ ID NO: 22843 - protein, 28 aa, Artificial Sequence
  Description of Artificial Sequence: Synthetic peptide
SEEEIRCTNPIATEQYGSVSESLMRGNR

SEQ ID NO: 22844 - protein, 29 aa, Artificial Sequence
  Description of Artificial Sequence: Synthetic peptide
SEEEIRCTNPIATEQYGSVSESNLMRGNR

SEQ ID NO: 22845 - protein, 29 aa, Artificial Sequence
  Description of Artificial Sequence: Synthetic peptide
DEEEIRTTNPVATEQYGSCSTNLVRNDAQ

SEQ ID NO: 22846 - protein, 30 aa, Artificial Sequence
  Description of Artificial Sequence: Synthetic polypeptide
DTEEIRATNPVATEQYGSVSTNLQQMNGER

SEQ ID NO: 22847 - protein, 32 aa, Artificial Sequence
  Description of Artificial Sequence: Synthetic polypeptide
DEEEIRTTNPVATEQYGSVSTENLQRQENEVT

SEQ ID NO: 22848 - protein, 31 aa, Artificial Sequence
  Description of Artificial Sequence: Synthetic polypeptide
AEEEIRTTNPVATEQYGSVSTTNQLQIGNDQ

SEQ ID NO: 22849 - protein, 31 aa, Artificial Sequence
  Description of Artificial Sequence: Synthetic polypeptide
AEEEIRTTNPVATEQYGSVSTTNQLQIGNDD

SEQ ID NO: 22850 - protein, 28 aa, Artificial Sequence
  Description of Artificial Sequence: Synthetic peptide
SEEEIRCTNPIATEQYGSVSETLMRGNR

SEQ ID NO: 22851 - protein, 29 aa, Artificial Sequence
  Description of Artificial Sequence: Synthetic peptide
DTEEIRATNPVATEQYGSVSSTVEQRGNN

SEQ ID NO: 22852 - protein, 30 aa, Artificial Sequence
  Description of Artificial Sequence: Synthetic polypeptide
AEEEIRTTNPVATEQYGSVSTTNQLQGNEN

SEQ ID NO: 22853 - protein, 29 aa, Artificial Sequence
  Description of Artificial Sequence: Synthetic peptide
DTEEIRATNPVATEQYGSVSSTNTQAGNN

SEQ ID NO: 22854 - protein, 32 aa, Artificial Sequence
  Description of Artificial Sequence: Synthetic polypeptide
DEEEIRTTNPVATEQYGSVSITNLQSNGGGND

SEQ ID NO: 22855 - protein, 30 aa, Artificial Sequence
  Description of Artificial Sequence: Synthetic polypeptide
DTEEIRATNPVATEQYGSVSSTNNDQRGNN

SEQ ID NO: 22856 - protein, 29 aa, Artificial Sequence
  Description of Artificial Sequence: Synthetic peptide
SEEEIRCTNPIATEQYGSVSETNLMRGQR

SEQ ID NO: 22857 - protein, 29 aa, Artificial Sequence
  Description of Artificial Sequence: Synthetic peptide
DTEEIRATNPVATEQYGSVSSTNMQSGNP

SEQ ID NO: 22858 - protein, 29 aa, Artificial Sequence
  Description of Artificial Sequence: Synthetic peptide
SEEEIRCTNPIATEQYGSVSETSLMRGNR

SEQ ID NO: 22859 - protein, 32 aa, Artificial Sequence
  Description of Artificial Sequence: Synthetic polypeptide
DEEEIRTTNPVATEQYGSVSTENLQNVVGNQD

SEQ ID NO: 22860 - protein, 31 aa, Artificial Sequence
  Description of Artificial Sequence: Synthetic polypeptide
DEEEIRTTNPVATEQYGSVSTENLQNRSMTV

SEQ ID NO: 22861 - protein, 28 aa, Artificial Sequence
  Description of Artificial Sequence: Synthetic peptide
SEEEIRCTNPIATEQYGSVSEVLMRGNR

SEQ ID NO: 22862 - protein, 29 aa, Artificial Sequence
  Description of Artificial Sequence: Synthetic peptide
SEEEIRCTNPIATEQYGSVSEVNLMRGNR

SEQ ID NO: 22863 - protein, 32 aa, Artificial Sequence
  Description of Artificial Sequence: Synthetic polypeptide
DEEEIRTTNPVATEQYGSVSTENLQNFGSNQN

SEQ ID NO: 22864 - protein, 29 aa, Artificial Sequence
  Description of Artificial Sequence: Synthetic peptide
SEEEIRCTNPIATEQYGSVSTDLMREGNR

SEQ ID NO: 22865 - protein, 30 aa, Artificial Sequence
  Description of Artificial Sequence: Synthetic polypeptide
DTEEIRSTNPVATEQYGSVSTNLQPPNGQR

SEQ ID NO: 22866 - protein, 30 aa, Artificial Sequence
  Description of Artificial Sequence: Synthetic polypeptide
DEEEIRTTNPVATEQYGSVSITNMLVRFED

SEQ ID NO: 22867 - protein, 29 aa, Artificial Sequence
  Description of Artificial Sequence: Synthetic peptide
SEEEIRCTNPIATEQYGSVSTENLMAGNR

SEQ ID NO: 22868 - protein, 28 aa, Artificial Sequence
  Description of Artificial Sequence: Synthetic peptide
SEEEIRCTNPIATQQYGSVSENLMRGNR

SEQ ID NO: 22869 - protein, 28 aa, Artificial Sequence
  Description of Artificial Sequence: Synthetic peptide
SEEEIRCTNPIATQQYGSVSGNLMRGNR

SEQ ID NO: 22870 - protein, 31 aa, Artificial Sequence
  Description of Artificial Sequence: Synthetic polypeptide
DEEEIRTTNPVATEQYGSCVETNLQRNEERD

SEQ ID NO: 22871 - protein, 28 aa, Artificial Sequence
  Description of Artificial Sequence: Synthetic peptide
SEEEIRCTNPIATSQYGSVSENLMRGNR

SEQ ID NO: 22872 - protein, 28 aa, Artificial Sequence
  Description of Artificial Sequence: Synthetic peptide
SEEEIRCTNPIATTQYGSVSENLMRGNR

SEQ ID NO: 22873 - protein, 30 aa, Artificial Sequence
  Description of Artificial Sequence: Synthetic polypeptide
DEEEIRTTNPVATEQYGSVSTEIQNGSNLQ

SEQ ID NO: 22874 - protein, 28 aa, Artificial Sequence
  Description of Artificial Sequence: Synthetic peptide
SEEEIRCTNPIATWQYGSVSENLMRGNR

SEQ ID NO: 22875 - protein, 28 aa, Artificial Sequence
  Description of Artificial Sequence: Synthetic peptide
SEEEIRCTNPIATYQYGSVSENLMRGNR

SEQ ID NO: 22876 - protein, 29 aa, Artificial Sequence
  Description of Artificial Sequence: Synthetic peptide
DSEEIATTNPVATTQYGSVSTNPMRTGNR

SEQ ID NO: 22877 - protein, 30 aa, Artificial Sequence
  Description of Artificial Sequence: Synthetic polypeptide
DEEEIRTTNPVATEQYGSVSTEHQHGENQS

SEQ ID NO: 22878 - protein, 28 aa, Artificial Sequence
  Description of Artificial Sequence: Synthetic peptide
SEEEIRCTNPIAVEQYGSVSENLMRGNR

SEQ ID NO: 22879 - protein, 32 aa, Artificial Sequence
  Description of Artificial Sequence: Synthetic polypeptide
DEEEIRTTNPVATEQYGSVSTNLQSNGGDTNI

SEQ ID NO: 22880 - protein, 29 aa, Artificial Sequence
  Description of Artificial Sequence: Synthetic peptide
DEAVIRTTNPVATEQYGCVATNPQDRGNR

SEQ ID NO: 22881 - protein, 28 aa, Artificial Sequence
  Description of Artificial Sequence: Synthetic peptide
DSEDIRTTNPVATEQYGVVSTNIQRVNL

SEQ ID NO: 22882 - protein, 32 aa, Artificial Sequence
  Description of Artificial Sequence: Synthetic polypeptide
DEEEIRTTNPVATEQYGSVSTNLQSNGMGNNQ

SEQ ID NO: 22883 - protein, 31 aa, Artificial Sequence
  Description of Artificial Sequence: Synthetic polypeptide
DEEEIRTTNPVATEQYGSVSTEGQGDGSNDR

SEQ ID NO: 22884 - protein, 29 aa, Artificial Sequence
  Description of Artificial Sequence: Synthetic peptide
DEEEIRTTNPVATEQYGSVSTEGQDGEQS

SEQ ID NO: 22885 - protein, 32 aa, Artificial Sequence
  Description of Artificial Sequence: Synthetic polypeptide
DEEEIRTTNPVATEQYGSCVSTNLQLGENENV

SEQ ID NO: 22886 - protein, 32 aa, Artificial Sequence
  Description of Artificial Sequence: Synthetic polypeptide
DEEEIRTTNPVATEQYGCVQSTNNLQFGSNRS

SEQ ID NO: 22887 - protein, 31 aa, Artificial Sequence
  Description of Artificial Sequence: Synthetic polypeptide
DEEEIRTTNPVATEQYGSVSTNLQSNGTEGN

SEQ ID NO: 22888 - protein, 32 aa, Artificial Sequence
  Description of Artificial Sequence: Synthetic polypeptide
DEEEIRTTNPVATEQYGCVQSTNLQRFMSNNR

SEQ ID NO: 22889 - protein, 32 aa, Artificial Sequence
  Description of Artificial Sequence: Synthetic polypeptide
DEEEIRTTNPVATEQYGSVSTEGLSQRGNQEQ

SEQ ID NO: 22890 - protein, 30 aa, Artificial Sequence
  Description of Artificial Sequence: Synthetic polypeptide
DEEEIRTTNPVATEQYGSCVSVTNLDHGEI

SEQ ID NO: 22891 - protein, 28 aa, Artificial Sequence
  Description of Artificial Sequence: Synthetic peptide
DEEEIRTTNPVATEQYGSCVTMLQRQEQ

SEQ ID NO: 22892 - protein, 31 aa, Artificial Sequence
  Description of Artificial Sequence: Synthetic polypeptide
DEEEIRTTNPVATEQYGSCWPTNLDQRGDRQ

SEQ ID NO: 22893 - protein, 31 aa, Artificial Sequence
  Description of Artificial Sequence: Synthetic polypeptide
DSECIRTTNPVATEQYGSVSTNELSQQGNNR

SEQ ID NO: 22894 - protein, 28 aa, Artificial Sequence
  Description of Artificial Sequence: Synthetic peptide
SEEEIRCTNPIAWEQYGSVSENLMRGNR

SEQ ID NO: 22895 - protein, 30 aa, Artificial Sequence
  Description of Artificial Sequence: Synthetic polypeptide
DEEEIRTTNPVATEQYGCVQSNLQRGSERA

SEQ ID NO: 22896 - protein, 32 aa, Artificial Sequence
  Description of Artificial Sequence: Synthetic polypeptide
DEEEIRTTNPVATEQYGSVSTELDQFFGSNRD

SEQ ID NO: 22897 - protein, 28 aa, Artificial Sequence
  Description of Artificial Sequence: Synthetic peptide
SEEEIRCTNPIATMQYGSVSENLMRGNR

SEQ ID NO: 22898 - protein, 28 aa, Artificial Sequence
  Description of Artificial Sequence: Synthetic peptide
DSEEIRSTNPVATEQWGSISTNDQRGNN

SEQ ID NO: 22899 - protein, 30 aa, Artificial Sequence
  Description of Artificial Sequence: Synthetic polypeptide
DEEEIRTTNPVATEQYGSVSFVDLQRSGDN

SEQ ID NO: 22900 - protein, 32 aa, Artificial Sequence
  Description of Artificial Sequence: Synthetic polypeptide
DEEEIRTTNPVATEQYGSVSTNLQSEGINNFD

SEQ ID NO: 22901 - protein, 30 aa, Artificial Sequence
  Description of Artificial Sequence: Synthetic polypeptide
AEEEIRTTNPVATEQYGSVSTTNNQGFGNT

SEQ ID NO: 22902 - protein, 30 aa, Artificial Sequence
  Description of Artificial Sequence: Synthetic polypeptide
DEEEIRTTNPVATEQYGSCSVNNLNRNGND

SEQ ID NO: 22903 - protein, 30 aa, Artificial Sequence
  Description of Artificial Sequence: Synthetic polypeptide
DEEEIRATNPVATEQYGSVCTNLQEGEGNQ

SEQ ID NO: 22904 - protein, 32 aa, Artificial Sequence
  Description of Artificial Sequence: Synthetic polypeptide
DEEEIRTTNPVATEQYGSVSTELGQARFGSVR

SEQ ID NO: 22905 - protein, 30 aa, Artificial Sequence
  Description of Artificial Sequence: Synthetic polypeptide
DEEEIRATNPVATEQYGSVCTNLDRGNPDP

SEQ ID NO: 22906 - protein, 28 aa, Artificial Sequence
  Description of Artificial Sequence: Synthetic peptide
SEEEIRCTNPIATEWYGSVSENLMRGNR

SEQ ID NO: 22907 - protein, 30 aa, Artificial Sequence
  Description of Artificial Sequence: Synthetic polypeptide
DEEEIRTTNPVATEQYGCVQTELQRGSERF

SEQ ID NO: 22908 - protein, 31 aa, Artificial Sequence
  Description of Artificial Sequence: Synthetic polypeptide
DSEEIRATNPVATEQYGSVSTNLQRGENTEQ

SEQ ID NO: 22909 - protein, 30 aa, Artificial Sequence
  Description of Artificial Sequence: Synthetic polypeptide
AEEEIRTTNPVATEQYGSVSTTNNQAGNSF

SEQ ID NO: 22910 - protein, 31 aa, Artificial Sequence
  Description of Artificial Sequence: Synthetic polypeptide
DEEEIRTTNPVATEQYGSVSTELDQYFGNAD

SEQ ID NO: 22911 - protein, 28 aa, Artificial Sequence
  Description of Artificial Sequence: Synthetic peptide
SEEEIRCTNPIATEYYGSVSENLMRGNR

SEQ ID NO: 22912 - protein, 32 aa, Artificial Sequence
  Description of Artificial Sequence: Synthetic polypeptide
DEEEIRTTNPVATEQYGSVSTNLQSGGENINI

SEQ ID NO: 22913 - protein, 31 aa, Artificial Sequence
  Description of Artificial Sequence: Synthetic polypeptide
DEEEIRTTNPVATEQYGSVSTELEQAGSNAV

SEQ ID NO: 22914 - protein, 31 aa, Artificial Sequence
  Description of Artificial Sequence: Synthetic polypeptide
DEEEIRTTNPVATEQYGSVSTELEIHGSNRV

SEQ ID NO: 22915 - protein, 30 aa, Artificial Sequence
  Description of Artificial Sequence: Synthetic polypeptide
DEEEIRATNPVATEQYGSVCSTENDQRGDY

SEQ ID NO: 22916 - protein, 28 aa, Artificial Sequence
  Description of Artificial Sequence: Synthetic peptide
SEEEIRCTNPIATFQYGSVSENLMRGNR

SEQ ID NO: 22917 - protein, 30 aa, Artificial Sequence
  Description of Artificial Sequence: Synthetic polypeptide
DEEEIRTTNPVATEQYGSCSWINMLQRDNN

SEQ ID NO: 22918 - protein, 28 aa, Artificial Sequence
  Description of Artificial Sequence: Synthetic peptide
SEEEIRCTNPIATHQYGSVSENLMRGNR

SEQ ID NO: 22919 - protein, 28 aa, Artificial Sequence
  Description of Artificial Sequence: Synthetic peptide
SEEEIRCTNPIATLQYGSVSENLMRGNR

SEQ ID NO: 22920 - protein, 30 aa, Artificial Sequence
  Description of Artificial Sequence: Synthetic polypeptide
DSEEIGSTNPVATEQYGSVSTNLQARFGQR

SEQ ID NO: 22921 - protein, 29 aa, Artificial Sequence
  Description of Artificial Sequence: Synthetic peptide
DEEEIRTTNPVATEQYGSCSYNDDRGEMR

SEQ ID NO: 22922 - protein, 28 aa, Artificial Sequence
  Description of Artificial Sequence: Synthetic peptide
SEEEIRCTNPIATMQYGSVSENLGRGNR

SEQ ID NO: 22923 - protein, 32 aa, Artificial Sequence
  Description of Artificial Sequence: Synthetic polypeptide
DEEEIRTTNPVATEQYGSVSTNLQSGGSNGET

SEQ ID NO: 22924 - protein, 30 aa, Artificial Sequence
  Description of Artificial Sequence: Synthetic polypeptide
DSEEIRATNPVATEQYGKVSVTNLSQGGNR

SEQ ID NO: 22925 - protein, 28 aa, Artificial Sequence
  Description of Artificial Sequence: Synthetic peptide
SEEEIRCTNPIATEVYGSVSENLMRGNR

SEQ ID NO: 22926 - protein, 31 aa, Artificial Sequence
  Description of Artificial Sequence: Synthetic polypeptide
DSECIATTNPVATEQYGSVSTNMLSQRGGNR

SEQ ID NO: 22927 - protein, 30 aa, Artificial Sequence
  Description of Artificial Sequence: Synthetic polypeptide
DEEEIRTTNPVATEQYGSCWTMLQEGNQRS

SEQ ID NO: 22928 - protein, 32 aa, Artificial Sequence
  Description of Artificial Sequence: Synthetic polypeptide
DEEEIRTTNPVATEQYGSVSTNLQSVGENVIS

SEQ ID NO: 22929 - protein, 31 aa, Artificial Sequence
  Description of Artificial Sequence: Synthetic polypeptide
DEEEIRTTNPVATEQYGSVSTNLQSVGVTEA

SEQ ID NO: 22930 - protein, 30 aa, Artificial Sequence
  Description of Artificial Sequence: Synthetic polypeptide
DEEEIRTTNPVATEQYGSVSTEDQAGSNQA

SEQ ID NO: 22931 - protein, 30 aa, Artificial Sequence
  Description of Artificial Sequence: Synthetic polypeptide
DQEEIRTTNPVATHQYGSVSTNGVQGGNDR

SEQ ID NO: 22932 - protein, 30 aa, Artificial Sequence
  Description of Artificial Sequence: Synthetic polypeptide
DEEEIRTTNPIATEQWGSVSCNEPQRGENR

SEQ ID NO: 22933 - protein, 30 aa, Artificial Sequence
  Description of Artificial Sequence: Synthetic polypeptide
DQEEIRTTNPVATHQYGSVSTNGVQDGNGR

SEQ ID NO: 22934 - protein, 28 aa, Artificial Sequence
  Description of Artificial Sequence: Synthetic peptide
SEEEIRCTNPIGTEQYGVVSENLQRGNR

SEQ ID NO: 22935 - protein, 31 aa, Artificial Sequence
  Description of Artificial Sequence: Synthetic polypeptide
DEEEIRTTNPVATEQYGSVSTEDQAFGSNRG

SEQ ID NO: 22936 - protein, 28 aa, Artificial Sequence
  Description of Artificial Sequence: Synthetic peptide
SEEEIRCTNPIGTEQYGVVSSNLQRGNR

SEQ ID NO: 22937 - protein, 31 aa, Artificial Sequence
  Description of Artificial Sequence: Synthetic polypeptide
DEEEIRTTNPVATEQYGSVSTEDLTQIGSND

SEQ ID NO: 22938 - protein, 30 aa, Artificial Sequence
  Description of Artificial Sequence: Synthetic polypeptide
DEEEIRTTNPIATEQWGSVSENEPQRGENR

SEQ ID NO: 22939 - protein, 30 aa, Artificial Sequence
  Description of Artificial Sequence: Synthetic polypeptide
DQEEIRTTNPVATHQYGSVSTNGTQNGNSR

SEQ ID NO: 22940 - protein, 28 aa, Artificial Sequence
  Description of Artificial Sequence: Synthetic peptide
SEEEIRCTNPIGTEQYGSVSENLPRGNR

SEQ ID NO: 22941 - protein, 30 aa, Artificial Sequence
  Description of Artificial Sequence: Synthetic polypeptide
DQEEIRTTNPVATHQYGSVSTNGTQNGNMR

SEQ ID NO: 22942 - protein, 28 aa, Artificial Sequence
  Description of Artificial Sequence: Synthetic peptide
SEEEIRCTNPISTEQYGSVSCNLMRGNR

SEQ ID NO: 22943 - protein, 32 aa, Artificial Sequence
  Description of Artificial Sequence: Synthetic polypeptide
DEEEIRTTNPVATEQYGSVSTNLQTEDGNNIG

SEQ ID NO: 22944 - protein, 30 aa, Artificial Sequence
  Description of Artificial Sequence: Synthetic polypeptide
DQEEIRTTNPVATHQYGSVSTNDVQEGNHR

SEQ ID NO: 22945 - protein, 29 aa, Artificial Sequence
  Description of Artificial Sequence: Synthetic peptide
DEEEIRTTNPIATEQWGSVSENLMNRENR

SEQ ID NO: 22946 - protein, 30 aa, Artificial Sequence
  Description of Artificial Sequence: Synthetic polypeptide
DEEEIRTTNPVATEQYGSVSTEDHQRGSQQ

SEQ ID NO: 22947 - protein, 29 aa, Artificial Sequence
  Description of Artificial Sequence: Synthetic peptide
SEEEIRCTNPISTEQYGSVSEENLQRGNR

SEQ ID NO: 22948 - protein, 32 aa, Artificial Sequence
  Description of Artificial Sequence: Synthetic polypeptide
DEEEIRTTNPVATEQYGSVSTNLQTEMGMNTE

SEQ ID NO: 22949 - protein, 32 aa, Artificial Sequence
  Description of Artificial Sequence: Synthetic polypeptide
DEEEIRTTNPVATEQYGSFCSTNLQFGGSNRF

SEQ ID NO: 22950 - protein, 32 aa, Artificial Sequence
  Description of Artificial Sequence: Synthetic polypeptide
DEEEIRTTNPVATEQYGSFCSTNLQRGGSERI

SEQ ID NO: 22951 - protein, 31 aa, Artificial Sequence
  Description of Artificial Sequence: Synthetic polypeptide
DEEEIRTTNPVATEQYGSVSTEALQNGNDQY

SEQ ID NO: 22952 - protein, 32 aa, Artificial Sequence
  Description of Artificial Sequence: Synthetic polypeptide
DEEEIRTTNPVATEQYGSFCSTNLQRGGSNAP

SEQ ID NO: 22953 - protein, 31 aa, Artificial Sequence
  Description of Artificial Sequence: Synthetic polypeptide
DEEEIRTTNPVATEQYGSVSTNLQTEMGTQE

SEQ ID NO: 22954 - protein, 32 aa, Artificial Sequence
  Description of Artificial Sequence: Synthetic polypeptide
DEEEIRTTNPVATEQYGSVSTNLQTAGAIARD

SEQ ID NO: 22955 - protein, 29 aa, Artificial Sequence
  Description of Artificial Sequence: Synthetic peptide
DEAVIGTTNPVATEQWGSVSTDNLQRGNQ

SEQ ID NO: 22956 - protein, 28 aa, Artificial Sequence
  Description of Artificial Sequence: Synthetic peptide
SEEEIRCTNPIGTEQYGSVSENLMRGNR

SEQ ID NO: 22957 - protein, 30 aa, Artificial Sequence
  Description of Artificial Sequence: Synthetic polypeptide
DQEEIRTTNPVATHQYGSVSTNGVQPGNPR

SEQ ID NO: 22958 - protein, 32 aa, Artificial Sequence
  Description of Artificial Sequence: Synthetic polypeptide
DEEEIRTTNPVATEQYGSVSITNNLQRGLLEY

SEQ ID NO: 22959 - protein, 31 aa, Artificial Sequence
  Description of Artificial Sequence: Synthetic polypeptide
DSAEIRTTNPVATEQYGTVSTNLSQRGTNRN

SEQ ID NO: 22960 - protein, 28 aa, Artificial Sequence
  Description of Artificial Sequence: Synthetic peptide
DSAEIRTTNPVATEQYGCCSTVLQMGNR

SEQ ID NO: 22961 - protein, 31 aa, Artificial Sequence
  Description of Artificial Sequence: Synthetic polypeptide
DEEEIRTTNPVATEQYGSVSITNNQGEGNEV

SEQ ID NO: 22962 - protein, 31 aa, Artificial Sequence
  Description of Artificial Sequence: Synthetic polypeptide
DEEEIRTTNPVATEQYGSVSTNLQSQEFNIQ

SEQ ID NO: 22963 - protein, 28 aa, Artificial Sequence
  Description of Artificial Sequence: Synthetic peptide
SEEEIRCTNPIAYEQYGSVSENLMRGNR

SEQ ID NO: 22964 - protein, 29 aa, Artificial Sequence
  Description of Artificial Sequence: Synthetic peptide
DEEEIRTTNPVATEQYGSCYTNLERDDVR

SEQ ID NO: 22965 - protein, 31 aa, Artificial Sequence
  Description of Artificial Sequence: Synthetic polypeptide
DSAEIRTTNPVATEAYGSVSCTNELQRGGNR

SEQ ID NO: 22966 - protein, 31 aa, Artificial Sequence
  Description of Artificial Sequence: Synthetic polypeptide
DEEEIRTTNPVATEQYGSCYTNLQEREGQRI

SEQ ID NO: 22967 - protein, 29 aa, Artificial Sequence
  Description of Artificial Sequence: Synthetic peptide
DEEEIRTTNPVATEQYGSVSTEENQGGQA

SEQ ID NO: 22968 - protein, 29 aa, Artificial Sequence
  Description of Artificial Sequence: Synthetic peptide
DQGEIRTTNPVATEQYGSVSTNLLQDGMM

SEQ ID NO: 22969 - protein, 31 aa, Artificial Sequence
  Description of Artificial Sequence: Synthetic polypeptide
DEEEIRTTNPVATEQYGSVSTEELQRGSVFM

SEQ ID NO: 22970 - protein, 30 aa, Artificial Sequence
  Description of Artificial Sequence: Synthetic polypeptide
DEEEIRTTNPVATEQYGSVSTEDTQGGNQM

SEQ ID NO: 22971 - protein, 32 aa, Artificial Sequence
  Description of Artificial Sequence: Synthetic polypeptide
DEEEIRTTNPVATEQYGCVPSTGNELQRGGNE

SEQ ID NO: 22972 - protein, 28 aa, Artificial Sequence
  Description of Artificial Sequence: Synthetic peptide
DQEEIRTTNPVGTEQWGMVSTNLQRGVI

SEQ ID NO: 22973 - protein, 28 aa, Artificial Sequence
  Description of Artificial Sequence: Synthetic peptide
SEEEIRCTNPICTEQYGSVSENLMRGNR

SEQ ID NO: 22974 - protein, 31 aa, Artificial Sequence
  Description of Artificial Sequence: Synthetic polypeptide
DEEEIRTTNPVATEQYGSVSTEELQHGSENQ

SEQ ID NO: 22975 - protein, 30 aa, Artificial Sequence
  Description of Artificial Sequence: Synthetic polypeptide
DQEEIRTTNPVATYQYGSVSTNGGQNGNHR

SEQ ID NO: 22976 - protein, 30 aa, Artificial Sequence
  Description of Artificial Sequence: Synthetic polypeptide
DQEEIRTTNPVATYQYGSVSTNDVQNGNER

SEQ ID NO: 22977 - protein, 31 aa, Artificial Sequence
  Description of Artificial Sequence: Synthetic polypeptide
DEEEIRTTNPVATEQYGSVSTEEHQSGSNRI

SEQ ID NO: 22978 - protein, 31 aa, Artificial Sequence
  Description of Artificial Sequence: Synthetic polypeptide
DEEEIRTTNPVATEQYGCVLSTGNLQGGSNQ

SEQ ID NO: 22979 - protein, 30 aa, Artificial Sequence
  Description of Artificial Sequence: Synthetic polypeptide
DQEEIRTTNPVATHQYGSVSTNPVQNGNQR

SEQ ID NO: 22980 - protein, 31 aa, Artificial Sequence
  Description of Artificial Sequence: Synthetic polypeptide
DEEEIRTTNPVATEQYGSVSTEEHQRGSQRL

SEQ ID NO: 22981 - protein, 28 aa, Artificial Sequence
  Description of Artificial Sequence: Synthetic peptide
SEEEIRCTNPICTEQYGVVSENLQRGNR

SEQ ID NO: 22982 - protein, 32 aa, Artificial Sequence
  Description of Artificial Sequence: Synthetic polypeptide
DEEEIRTTNPVATEQYGSVSTEEHQRFGSNRG

SEQ ID NO: 22983 - protein, 30 aa, Artificial Sequence
  Description of Artificial Sequence: Synthetic polypeptide
DQEEIRTTNPVATHQYGSVSTNGVQSGNVR

SEQ ID NO: 22984 - protein, 31 aa, Artificial Sequence
  Description of Artificial Sequence: Synthetic polypeptide
DEEEIRTTNPVATEQYGSVSTEELQNGSNSY

SEQ ID NO: 22985 - protein, 28 aa, Artificial Sequence
  Description of Artificial Sequence: Synthetic peptide
SEEEIRCTNPIATETYGSVSENLMRGNR

SEQ ID NO: 22986 - protein, 28 aa, Artificial Sequence
  Description of Artificial Sequence: Synthetic peptide
SEEEIRCTNPIATETYGSVSENLARGNR

SEQ ID NO: 22987 - protein, 28 aa, Artificial Sequence
  Description of Artificial Sequence: Synthetic peptide
SEEEIRCTNPIATESYGSVSENLMRGNR

SEQ ID NO: 22988 - protein, 29 aa, Artificial Sequence
  Description of Artificial Sequence: Synthetic peptide
DEECIRTTNPVAEEQYGQVSTENDQRGNN

SEQ ID NO: 22989 - protein, 29 aa, Artificial Sequence
  Description of Artificial Sequence: Synthetic peptide
SEEEIRCTNPIATEQYGSVTSENLMRGNR

SEQ ID NO: 22990 - protein, 32 aa, Artificial Sequence
  Description of Artificial Sequence: Synthetic polypeptide
DSEEIRTTNPVATEQYGSVSTGNEPQRGGNNR

SEQ ID NO: 22991 - protein, 32 aa, Artificial Sequence
  Description of Artificial Sequence: Synthetic polypeptide
DSEEIRTTNPVATEQYGSVSCTNLSQTTGNRG

SEQ ID NO: 22992 - protein, 31 aa, Artificial Sequence
  Description of Artificial Sequence: Synthetic polypeptide
DSEEIRTTNPVATEQYGSVSCTNLSQRAVNE

SEQ ID NO: 22993 - protein, 28 aa, Artificial Sequence
  Description of Artificial Sequence: Synthetic peptide
SEEEIRCTNPIATEQYGSVVENLMRGNR

SEQ ID NO: 22994 - protein, 33 aa, Artificial Sequence
  Description of Artificial Sequence: Synthetic polypeptide
DSEEIRTTNPVATEQYGSTVSVTGNLSQRPGNR

SEQ ID NO: 22995 - protein, 33 aa, Artificial Sequence
  Description of Artificial Sequence: Synthetic polypeptide
DSEEIRTTNPVATEQYGSTVSTQNLSQRGGNNR

SEQ ID NO: 22996 - protein, 31 aa, Artificial Sequence
  Description of Artificial Sequence: Synthetic polypeptide
DEEEIRTTNPVATEQYGCVSATNLGGGMNDR

SEQ ID NO: 22997 - protein, 31 aa, Artificial Sequence
  Description of Artificial Sequence: Synthetic polypeptide
DSEEIRTTNPVATEQYGSTVSCTNLSQRGSV

SEQ ID NO: 22998 - protein, 29 aa, Artificial Sequence
  Description of Artificial Sequence: Synthetic peptide
SEEEIRCTNPIATEQYGSVVSENLHRGNR

SEQ ID NO: 22999 - protein, 29 aa, Artificial Sequence
  Description of Artificial Sequence: Synthetic peptide
SEEEIRCTNPIATEQYGSVVSENLMRGNR

SEQ ID NO: 23000 - protein, 29 aa, Artificial Sequence
  Description of Artificial Sequence: Synthetic peptide
DEECIRTTNPVAEEQYGQVSTGNVQRGNQ

SEQ ID NO: 23001 - protein, 32 aa, Artificial Sequence
  Description of Artificial Sequence: Synthetic polypeptide
DSEEIRTTNPVATEQYGQVSCTNLSQRGGNER

SEQ ID NO: 23002 - protein, 28 aa, Artificial Sequence
  Description of Artificial Sequence: Synthetic peptide
SEEEIRCTNPIATEQYGSVWENLMRGNR

SEQ ID NO: 23003 - protein, 31 aa, Artificial Sequence
  Description of Artificial Sequence: Synthetic polypeptide
DSEEIRTTNPVATEQYGKVSTNELSQRGGNV

SEQ ID NO: 23004 - protein, 28 aa, Artificial Sequence
  Description of Artificial Sequence: Synthetic peptide
SEEEIRCTNPIATEQYGSVWENLVRGNR

SEQ ID NO: 23005 - protein, 29 aa, Artificial Sequence
  Description of Artificial Sequence: Synthetic peptide
SEEEIRCTNPIATEQYGSVWSENLARGNR

SEQ ID NO: 23006 - protein, 31 aa, Artificial Sequence
  Description of Artificial Sequence: Synthetic polypeptide
DEEEIRATNPVATEQYGSVSETNLQSGENIN

SEQ ID NO: 23007 - protein, 29 aa, Artificial Sequence
  Description of Artificial Sequence: Synthetic peptide
SEEEIRCTNPIATEQYGSVWSENLMRGNR

SEQ ID NO: 23008 - protein, 30 aa, Artificial Sequence
  Description of Artificial Sequence: Synthetic polypeptide
DSEEIRTTNPVATEQWGSVVSTPELQRGTR

SEQ ID NO: 23009 - protein, 31 aa, Artificial Sequence
  Description of Artificial Sequence: Synthetic polypeptide
DEEEIRATNPVATEQYGSVSETNLQESGGNN

SEQ ID NO: 23010 - protein, 30 aa, Artificial Sequence
  Description of Artificial Sequence: Synthetic polypeptide
DSEEIRTTNPVATEQWGSVTSTLLQQRGTR

SEQ ID NO: 23011 - protein, 29 aa, Artificial Sequence
  Description of Artificial Sequence: Synthetic peptide
DSEEIRTTNPVATEQWGSVTSTLLQGGTR

SEQ ID NO: 23012 - protein, 28 aa, Artificial Sequence
  Description of Artificial Sequence: Synthetic peptide
SEEEIRCTNPIATEQYGSVYENLMRGNR

SEQ ID NO: 23013 - protein, 30 aa, Artificial Sequence
  Description of Artificial Sequence: Synthetic polypeptide
DSEEIRTTNPVATEQWGSVTSTELQRGGTR

SEQ ID NO: 23014 - protein, 32 aa, Artificial Sequence
  Description of Artificial Sequence: Synthetic polypeptide
DSEEIRTTNPVATEQYGQSTVSTNLSQRVNNR

SEQ ID NO: 23015 - protein, 29 aa, Artificial Sequence
  Description of Artificial Sequence: Synthetic peptide
DSEEIRTTNPVATEQWGSVTSTDLQRVTR

SEQ ID NO: 23016 - protein, 30 aa, Artificial Sequence
  Description of Artificial Sequence: Synthetic polypeptide
DSEEIRTTNPVATEQYGSVSTNHSTRGNNE

SEQ ID NO: 23017 - protein, 28 aa, Artificial Sequence
  Description of Artificial Sequence: Synthetic peptide
SEEEIRCTNPIATEQYGSVSYNLMRGNI

SEQ ID NO: 23018 - protein, 30 aa, Artificial Sequence
  Description of Artificial Sequence: Synthetic polypeptide
DEEEIRTTNPVATEQYGSCSTPLPRSGNED

SEQ ID NO: 23019 - protein, 30 aa, Artificial Sequence
  Description of Artificial Sequence: Synthetic polypeptide
SEEEIRCTNPIATEQYGSVSTENLMRGMNR

SEQ ID NO: 23020 - protein, 30 aa, Artificial Sequence
  Description of Artificial Sequence: Synthetic polypeptide
DSEEIRTTNPVAYEQYGSVACTNELQDGNR

SEQ ID NO: 23021 - protein, 30 aa, Artificial Sequence
  Description of Artificial Sequence: Synthetic polypeptide
DEEEIRTTNPVATEQYGSCSTPLQNRDNEN

SEQ ID NO: 23022 - protein, 30 aa, Artificial Sequence
  Description of Artificial Sequence: Synthetic polypeptide
DEEEIRTTNPVATEQYGSCSTPLQRVNDDN

SEQ ID NO: 23023 - protein, 30 aa, Artificial Sequence
  Description of Artificial Sequence: Synthetic polypeptide
SEEEIRCTNPIATEQYGSVSTENLNRNGNR

SEQ ID NO: 23024 - protein, 30 aa, Artificial Sequence
  Description of Artificial Sequence: Synthetic polypeptide
DSEEIRTTNPVAYEQYGCVSTNLSQRGNNH

SEQ ID NO: 23025 - protein, 29 aa, Artificial Sequence
  Description of Artificial Sequence: Synthetic peptide
DEEEIRTTNPVATEQYGSVSTENDNVNIR

SEQ ID NO: 23026 - protein, 29 aa, Artificial Sequence
  Description of Artificial Sequence: Synthetic peptide
DEECIRTTNPVAFEQYGQVSTINVQRGNE

SEQ ID NO: 23027 - protein, 30 aa, Artificial Sequence
  Description of Artificial Sequence: Synthetic polypeptide
DSEEIRTTNPVAYEMYGSVSCTNLSQTGNR

SEQ ID NO: 23028 - protein, 31 aa, Artificial Sequence
  Description of Artificial Sequence: Synthetic polypeptide
DEEEIRTTNPVATEQYGSCSTPLQSRGNIID

SEQ ID NO: 23029 - protein, 29 aa, Artificial Sequence
  Description of Artificial Sequence: Synthetic peptide
SEEEIRCTNPIATEQYGSVSVENLMRGNR

SEQ ID NO: 23030 - protein, 28 aa, Artificial Sequence
  Description of Artificial Sequence: Synthetic peptide
SEEEIRCTNPIATEQYGSVTENLMRGNR

SEQ ID NO: 23031 - protein, 30 aa, Artificial Sequence
  Description of Artificial Sequence: Synthetic polypeptide
DSEEIRTTNPVATHQYGSVSTNGIQNGNHR

SEQ ID NO: 23032 - protein, 29 aa, Artificial Sequence
  Description of Artificial Sequence: Synthetic peptide
SEEEIRCTNPIATEQYGSVSWENLMRGNR

SEQ ID NO: 23033 - protein, 31 aa, Artificial Sequence
  Description of Artificial Sequence: Synthetic polypeptide
DSEEIRTTNPVATESYGSVSCTNLSQDGGNR

SEQ ID NO: 23034 - protein, 29 aa, Artificial Sequence
  Description of Artificial Sequence: Synthetic peptide
SEEEIRCTNPIATEQYGSVSWNDLMRGNR

SEQ ID NO: 23035 - protein, 29 aa, Artificial Sequence
  Description of Artificial Sequence: Synthetic peptide
DEECIRTTNPVAFEQYGQVSTDNVQRGNN

SEQ ID NO: 23036 - protein, 29 aa, Artificial Sequence
  Description of Artificial Sequence: Synthetic peptide
DEECIRTTNPVAEEQYGTVSTINVQRGNQ

SEQ ID NO: 23037 - protein, 31 aa, Artificial Sequence
  Description of Artificial Sequence: Synthetic polypeptide
DEEEIRATNPVATEQYGSVSSTNLQNTGNNG

SEQ ID NO: 23038 - protein, 30 aa, Artificial Sequence
  Description of Artificial Sequence: Synthetic polypeptide
DSEEIRTTNPVATEQYGVVSTNSSQRGGNE

SEQ ID NO: 23039 - protein, 29 aa, Artificial Sequence
  Description of Artificial Sequence: Synthetic peptide
SEEEIRCTNPIATEQYGSVSWNLMRGNRL

SEQ ID NO: 23040 - protein, 29 aa, Artificial Sequence
  Description of Artificial Sequence: Synthetic peptide
SEEEIRCTNPIATEQYGSVSWNLMRGTNR

SEQ ID NO: 23041 - protein, 32 aa, Artificial Sequence
  Description of Artificial Sequence: Synthetic polypeptide
DSEEIRTTNPVATEQYGSVVSCTNLSQRGTNE

SEQ ID NO: 23042 - protein, 29 aa, Artificial Sequence
  Description of Artificial Sequence: Synthetic peptide
DEECIRTTNPVAEEQYGQVSTPNHQRGNN

SEQ ID NO: 23043 - protein, 29 aa, Artificial Sequence
  Description of Artificial Sequence: Synthetic peptide
SEEEIRCTNPIATEQYGSVSYENLMRGNR

SEQ ID NO: 23044 - protein, 30 aa, Artificial Sequence
  Description of Artificial Sequence: Synthetic polypeptide
DSEEIRTTNPVATHQYGSVSTNAVQNGNHR

SEQ ID NO: 23045 - protein, 31 aa, Artificial Sequence
  Description of Artificial Sequence: Synthetic polypeptide
DEEEIRTTNPVATEQYGSVSTELQRVDIVRD

SEQ ID NO: 23046 - protein, 31 aa, Artificial Sequence
  Description of Artificial Sequence: Synthetic polypeptide
DEEEIRATNPVATEQYGSVSETENLEREGNP

SEQ ID NO: 23047 - protein, 30 aa, Artificial Sequence
  Description of Artificial Sequence: Synthetic polypeptide
DEEEIRATNPVATEQYGSVSENLQERGDDW

SEQ ID NO: 23048 - protein, 28 aa, Artificial Sequence
  Description of Artificial Sequence: Synthetic peptide
DEAVIRTTNPVATEQYGCVTTNPERGNR

SEQ ID NO: 23049 - protein, 28 aa, Artificial Sequence
  Description of Artificial Sequence: Synthetic peptide
DEEEIRTTNPIATEPYGTVSEDLMRGNR

SEQ ID NO: 23050 - protein, 29 aa, Artificial Sequence
  Description of Artificial Sequence: Synthetic peptide
DEEEIRTTNPIATEPYGTVSEDLQMRGNR

SEQ ID NO: 23051 - protein, 30 aa, Artificial Sequence
  Description of Artificial Sequence: Synthetic polypeptide
DEEEIRATNPVATEQYGSVSANLQEAGNEN

SEQ ID NO: 23052 - protein, 30 aa, Artificial Sequence
  Description of Artificial Sequence: Synthetic polypeptide
DEEEIRTTNPVATEQYGSVSTELQFMSNAY

SEQ ID NO: 23053 - protein, 29 aa, Artificial Sequence
  Description of Artificial Sequence: Synthetic peptide
SEEEIRCTNPIATEQYGVSVSENLMRGNR

SEQ ID NO: 23054 - protein, 31 aa, Artificial Sequence
  Description of Artificial Sequence: Synthetic polypeptide
DEEEIRTTNPVATEQYGSVSTELQFIGGNQP

SEQ ID NO: 23055 - protein, 28 aa, Artificial Sequence
  Description of Artificial Sequence: Synthetic peptide
SEEEIRCTNPIATEQYGVVSENLMRGNR

SEQ ID NO: 23056 - protein, 29 aa, Artificial Sequence
  Description of Artificial Sequence: Synthetic peptide
DEAVIRTTNPVATEQYGCVETNPQRLGNR

SEQ ID NO: 23057 - protein, 30 aa, Artificial Sequence
  Description of Artificial Sequence: Synthetic polypeptide
DSEEIRSTNPVATEQYGSVVSTNLQNTGTR

SEQ ID NO: 23058 - protein, 31 aa, Artificial Sequence
  Description of Artificial Sequence: Synthetic polypeptide
DSEEIRSTNPVATEQYGSVSTNLQERFGGQR

SEQ ID NO: 23059 - protein, 32 aa, Artificial Sequence
  Description of Artificial Sequence: Synthetic polypeptide
DSEEIRSTNPVATEQYGSVSTNLQARNGGENR

SEQ ID NO: 23060 - protein, 31 aa, Artificial Sequence
  Description of Artificial Sequence: Synthetic polypeptide
DEEEIRTTNPVATEQYGSVSTELQHGSENAL

SEQ ID NO: 23061 - protein, 31 aa, Artificial Sequence
  Description of Artificial Sequence: Synthetic polypeptide
DSEEIRSTNPVATEQYGSVSTNLQAGNGQER

SEQ ID NO: 23062 - protein, 28 aa, Artificial Sequence
  Description of Artificial Sequence: Synthetic peptide
SEEEIRCTNPIATEQYGVVSENLQSGNR

SEQ ID NO: 23063 - protein, 29 aa, Artificial Sequence
  Description of Artificial Sequence: Synthetic peptide
DEAVIRTTNPVATEQYGCVETNPQRGINR

SEQ ID NO: 23064 - protein, 31 aa, Artificial Sequence
  Description of Artificial Sequence: Synthetic polypeptide
DEEEIRTTNPVATEQYGSVSTELQFGNSNVS

SEQ ID NO: 23065 - protein, 28 aa, Artificial Sequence
  Description of Artificial Sequence: Synthetic peptide
SEEEIRCTNPIATEQYGVVSSNLMRGNR

SEQ ID NO: 23066 - protein, 28 aa, Artificial Sequence
  Description of Artificial Sequence: Synthetic peptide
SEEEIRCTNPIATEQYGWVSENLMRGNR

SEQ ID NO: 23067 - protein, 29 aa, Artificial Sequence
  Description of Artificial Sequence: Synthetic peptide
DSEEIRSTNPVATEQYGSISTNMVQRGNN

SEQ ID NO: 23068 - protein, 29 aa, Artificial Sequence
  Description of Artificial Sequence: Synthetic peptide
DSEEIRSTNPVATEQYGSISTNMQRGGND

SEQ ID NO: 23069 - protein, 30 aa, Artificial Sequence
  Description of Artificial Sequence: Synthetic polypeptide
DEEEIRTTNPVATEQYGCVQTNLARGSERS

SEQ ID NO: 23070 - protein, 28 aa, Artificial Sequence
  Description of Artificial Sequence: Synthetic peptide
SEEEIRCTNPIATEQYGYVSENLMRGNR

SEQ ID NO: 23071 - protein, 29 aa, Artificial Sequence
  Description of Artificial Sequence: Synthetic peptide
DSEEIRSTNPVATEQYGSISTNFQRGNYN

SEQ ID NO: 23072 - protein, 28 aa, Artificial Sequence
  Description of Artificial Sequence: Synthetic peptide
SEEEIRCTNPIATERYGSVSENLMRGNR

SEQ ID NO: 23073 - protein, 29 aa, Artificial Sequence
  Description of Artificial Sequence: Synthetic peptide
DEEEIRTTNPVATEQYGSCSTWVDQRTND

SEQ ID NO: 23074 - protein, 31 aa, Artificial Sequence
  Description of Artificial Sequence: Synthetic polypeptide
DSEEIRSTNPVATEQYGSVSTNELQARNGER

SEQ ID NO: 23075 - protein, 29 aa, Artificial Sequence
  Description of Artificial Sequence: Synthetic peptide
DSEEIRTTNPCATEHYGSVSFNLQRVNNR

SEQ ID NO: 23076 - protein, 30 aa, Artificial Sequence
  Description of Artificial Sequence: Synthetic polypeptide
DEEEIRTTNPVATEQYGSCSTSLQRSGEDD

SEQ ID NO: 23077 - protein, 28 aa, Artificial Sequence
  Description of Artificial Sequence: Synthetic peptide
SEEEIRCTNPIATEQYGTVSENLNRGNR

SEQ ID NO: 23078 - protein, 31 aa, Artificial Sequence
  Description of Artificial Sequence: Synthetic polypeptide
DEEEIRTTNPVATEQYGSVSTELQRTSETRL

SEQ ID NO: 23079 - protein, 29 aa, Artificial Sequence
  Description of Artificial Sequence: Synthetic peptide
SEEEIRCTNPIATEQYGSVYSENLMRGNR

SEQ ID NO: 23080 - protein, 28 aa, Artificial Sequence
  Description of Artificial Sequence: Synthetic peptide
SEEEIRCTNPIATEQYGSYSENLMRGNR

SEQ ID NO: 23081 - protein, 29 aa, Artificial Sequence
  Description of Artificial Sequence: Synthetic peptide
SEEEIRCTNPIATEQYGSYSENLQMRGNR

SEQ ID NO: 23082 - protein, 29 aa, Artificial Sequence
  Description of Artificial Sequence: Synthetic peptide
SEEEIRCTNPIATEQYGSYVSENLMRGNR

SEQ ID NO: 23083 - protein, 30 aa, Artificial Sequence
  Description of Artificial Sequence: Synthetic polypeptide
DEEEIRTTNPVATEQYGCVQTNLQRGSEDI

SEQ ID NO: 23084 - protein, 31 aa, Artificial Sequence
  Description of Artificial Sequence: Synthetic polypeptide
DSEEIRTTNPVATEPYGSVSCTNLSQPSGNR

SEQ ID NO: 23085 - protein, 29 aa, Artificial Sequence
  Description of Artificial Sequence: Synthetic peptide
SEEEIRCTNPIATEQYGTSVSENLMRGNR

SEQ ID NO: 23086 - protein, 29 aa, Artificial Sequence
  Description of Artificial Sequence: Synthetic peptide
DEEEIRTTNPIATEGYGSCSCTNLARGNE

SEQ ID NO: 23087 - protein, 30 aa, Artificial Sequence
  Description of Artificial Sequence: Synthetic polypeptide
DEEEIRATNPVATEQYGSVSATNLQQPGDL

SEQ ID NO: 23088 - protein, 28 aa, Artificial Sequence
  Description of Artificial Sequence: Synthetic peptide
SEEEIRCTNPIATEQYGTVSEDLQRGNR

SEQ ID NO: 23089 - protein, 31 aa, Artificial Sequence
  Description of Artificial Sequence: Synthetic polypeptide
DSEEIRTTNPVATEAYGSVSTNALTRTGGNR

SEQ ID NO: 23090 - protein, 30 aa, Artificial Sequence
  Description of Artificial Sequence: Synthetic polypeptide
DSEEIRTTNPVATEAYGSVACTNLQSGGNR

SEQ ID NO: 23091 - protein, 29 aa, Artificial Sequence
  Description of Artificial Sequence: Synthetic peptide
DEEEIRTTNPIATEGYGSCSTNLERGNQM

SEQ ID NO: 23092 - protein, 31 aa, Artificial Sequence
  Description of Artificial Sequence: Synthetic polypeptide
DSEEIRTTNPVATEAWGSVSCTNLSQRTGNR

SEQ ID NO: 23093 - protein, 29 aa, Artificial Sequence
  Description of Artificial Sequence: Synthetic peptide
DEEEIRTTNPIATEGYGSCSTNLTRGGND

SEQ ID NO: 23094 - protein, 32 aa, Artificial Sequence
  Description of Artificial Sequence: Synthetic polypeptide
DEEEIRTTNPVATEQYGSVSTELQHIGSNNRT

SEQ ID NO: 23095 - protein, 28 aa, Artificial Sequence
  Description of Artificial Sequence: Synthetic peptide
SEEEIRCTNPIATEQYGTVSENLERGNR

SEQ ID NO: 23096 - protein, 29 aa, Artificial Sequence
  Description of Artificial Sequence: Synthetic peptide
DEEEIRTTNPVATEQYGSCSTSLDRMGEA

SEQ ID NO: 23097 - protein, 30 aa, Artificial Sequence
  Description of Artificial Sequence: Synthetic polypeptide
DEEEIRTTNPVATEQYGSCSTSLNMRGDNE

SEQ ID NO: 23098 - protein, 29 aa, Artificial Sequence
  Description of Artificial Sequence: Synthetic peptide
DEEEIRTTNPVATEQYGSCSTSLQGMNSS

SEQ ID NO: 23099 - protein, 29 aa, Artificial Sequence
  Description of Artificial Sequence: Synthetic peptide
DEEEIRTTNPVATEQYGSCSTSLQIGDST

SEQ ID NO: 23100 - protein, 31 aa, Artificial Sequence
  Description of Artificial Sequence: Synthetic polypeptide
DEEEIRATNPVATEQYGSVSANNQDRGSNDR

SEQ ID NO: 23101 - protein, 28 aa, Artificial Sequence
  Description of Artificial Sequence: Synthetic peptide
SEEEIRCTNPIATEQYGTVSENLFRGNR

SEQ ID NO: 23102 - protein, 29 aa, Artificial Sequence
  Description of Artificial Sequence: Synthetic peptide
DSEEIRTTNPLATEHYGSVVSCNLQRENR

SEQ ID NO: 23103 - protein, 28 aa, Artificial Sequence
  Description of Artificial Sequence: Synthetic peptide
SEEEIRCTNPIATEQYGTVSENLGRGNR

SEQ ID NO: 23104 - protein, 28 aa, Artificial Sequence
  Description of Artificial Sequence: Synthetic peptide
SEEEIRCTNPIATEQYGTVSENLMRGNR

SEQ ID NO: 23105 - protein, 31 aa, Artificial Sequence
  Description of Artificial Sequence: Synthetic polypeptide
DEEEIRTTNPVATEQYGCVSDTALFQRSQNR

SEQ ID NO: 23106 - protein, 31 aa, Artificial Sequence
  Description of Artificial Sequence: Synthetic polypeptide
DEEEIRTTNPVATEQYGSVSTDNDLYRELER

SEQ ID NO: 23107 - protein, 30 aa, Artificial Sequence
  Description of Artificial Sequence: Synthetic polypeptide
HEEEIRTTNPVATEQYGSVSTNVQRNANFN

SEQ ID NO: 23108 - protein, 30 aa, Artificial Sequence
  Description of Artificial Sequence: Synthetic polypeptide
HEEEIRTTNPVATESYGSVSNTNLARGQQR

SEQ ID NO: 23109 - protein, 31 aa, Artificial Sequence
  Description of Artificial Sequence: Synthetic polypeptide
DEEEIRTTNPVATEQYGSVSTNKGQERDEIR

SEQ ID NO: 23110 - protein, 30 aa, Artificial Sequence
  Description of Artificial Sequence: Synthetic polypeptide
QEEEIATTNPVATEQYGSVATNLQGGVNDR

SEQ ID NO: 23111 - protein, 32 aa, Artificial Sequence
  Description of Artificial Sequence: Synthetic polypeptide
DEEEIRTTNPVATEQYGSVSTMNQLQNTGINV

SEQ ID NO: 23112 - protein, 31 aa, Artificial Sequence
  Description of Artificial Sequence: Synthetic polypeptide
DEEEIRTTNPVATEQYGISVSTGNLSDAGKR

SEQ ID NO: 23113 - protein, 31 aa, Artificial Sequence
  Description of Artificial Sequence: Synthetic polypeptide
DEEEIRTTNPCATEQYGSVIETNLQRGVNHD

SEQ ID NO: 23114 - protein, 32 aa, Artificial Sequence
  Description of Artificial Sequence: Synthetic polypeptide
DEEEIRTTNPVATEQYGSVSTMNQLQNSGNIE

SEQ ID NO: 23115 - protein, 32 aa, Artificial Sequence
  Description of Artificial Sequence: Synthetic polypeptide
DEEEIRTTNPVATEQYGISVSTNEHSQRGGNP

SEQ ID NO: 23116 - protein, 32 aa, Artificial Sequence
  Description of Artificial Sequence: Synthetic polypeptide
DEEEIRTTNPVATEQYGSVSTMNQLQNIGNDV

SEQ ID NO: 23117 - protein, 31 aa, Artificial Sequence
  Description of Artificial Sequence: Synthetic polypeptide
DEEEIRTTNPCATEQYGSVIETTNLQRGNPW

SEQ ID NO: 23118 - protein, 29 aa, Artificial Sequence
  Description of Artificial Sequence: Synthetic peptide
QEEEIATTNPVATEQYGSVATNLQDNGNV

SEQ ID NO: 23119 - protein, 28 aa, Artificial Sequence
  Description of Artificial Sequence: Synthetic peptide
QEEEIATTNPVATEQYGSVATNLQDGPP

SEQ ID NO: 23120 - protein, 31 aa, Artificial Sequence
  Description of Artificial Sequence: Synthetic polypeptide
AEEEIRTTNPVATEQYGSVSVSSNLQNNGNR

SEQ ID NO: 23121 - protein, 30 aa, Artificial Sequence
  Description of Artificial Sequence: Synthetic polypeptide
DEEEIRTTNPVATEQYGSVSTMNQRGEDAY

SEQ ID NO: 23122 - protein, 30 aa, Artificial Sequence
  Description of Artificial Sequence: Synthetic polypeptide
DEEEIRTTNPCATEQYGSVIGTNLQNGNNA

SEQ ID NO: 23123 - protein, 29 aa, Artificial Sequence
  Description of Artificial Sequence: Synthetic peptide
QEEEIATTNPVATEQYGSVATNLNRGNNL

SEQ ID NO: 23124 - protein, 31 aa, Artificial Sequence
  Description of Artificial Sequence: Synthetic polypeptide
DEEEIRTTNPVATEQYGSVSTNKHQERSLQR

SEQ ID NO: 23125 - protein, 30 aa, Artificial Sequence
  Description of Artificial Sequence: Synthetic polypeptide
DECEIRTTNPVAYEQYGSVSTNLQPGNGDL

SEQ ID NO: 23126 - protein, 32 aa, Artificial Sequence
  Description of Artificial Sequence: Synthetic polypeptide
DEEEIRTTNPVATEQYGSVSTMNQLQDGEGNV

SEQ ID NO: 23127 - protein, 29 aa, Artificial Sequence
  Description of Artificial Sequence: Synthetic peptide
DEEEIRTTNPCATEAYGSVTSTNLAGGNN

SEQ ID NO: 23128 - protein, 31 aa, Artificial Sequence
  Description of Artificial Sequence: Synthetic polypeptide
DEEEIRTTNPVATEQYGSVSTNKPQERDMQR

SEQ ID NO: 23129 - protein, 29 aa, Artificial Sequence
  Description of Artificial Sequence: Synthetic peptide
DEECIRTTNPVATEQYRWEVSTNGQIGNR

SEQ ID NO: 23130 - protein, 28 aa, Artificial Sequence
  Description of Artificial Sequence: Synthetic peptide
QEEEIATTNPVATEQYGSVATALQDGGR

SEQ ID NO: 23131 - protein, 30 aa, Artificial Sequence
  Description of Artificial Sequence: Synthetic polypeptide
DEEEIRTTNPVATEQYGITISTTELQRGNG

SEQ ID NO: 23132 - protein, 31 aa, Artificial Sequence
  Description of Artificial Sequence: Synthetic polypeptide
DEEEIRTTNPCATEQYGSVIYTNLEQRGNND

SEQ ID NO: 23133 - protein, 31 aa, Artificial Sequence
  Description of Artificial Sequence: Synthetic polypeptide
DEEEIRTTNPVATEQYGSVSTNKTQERMMIR

SEQ ID NO: 23134 - protein, 31 aa, Artificial Sequence
  Description of Artificial Sequence: Synthetic polypeptide
DEEEIRTTNPVATEQYGSVSTNLAEVTPGNS

SEQ ID NO: 23135 - protein, 31 aa, Artificial Sequence
  Description of Artificial Sequence: Synthetic polypeptide
DEEEIRTTNPVATEQYGSVSTNKHQERSIIR

SEQ ID NO: 23136 - protein, 30 aa, Artificial Sequence
  Description of Artificial Sequence: Synthetic polypeptide
DEEEIRTTNPCATEQYGSVNVTNLQGGNGA

SEQ ID NO: 23137 - protein, 28 aa, Artificial Sequence
  Description of Artificial Sequence: Synthetic peptide
QEGEIAPTNPCATEQYGSVSENLQRGNR

SEQ ID NO: 23138 - protein, 29 aa, Artificial Sequence
  Description of Artificial Sequence: Synthetic peptide
QEEEIATTNPVATEQYGSVATNLQNDGNQ

SEQ ID NO: 23139 - protein, 30 aa, Artificial Sequence
  Description of Artificial Sequence: Synthetic polypeptide
QEEEIATTNPVATEQYGSVSGTNLQNGNED

SEQ ID NO: 23140 - protein, 30 aa, Artificial Sequence
  Description of Artificial Sequence: Synthetic polypeptide
QEEEIATTNPVATEQYGSVSENLQHGDNSR

SEQ ID NO: 23141 - protein, 31 aa, Artificial Sequence
  Description of Artificial Sequence: Synthetic polypeptide
DEEEIRTTNPVATEQYGCVTSTNLQRGSDII

SEQ ID NO: 23142 - protein, 30 aa, Artificial Sequence
  Description of Artificial Sequence: Synthetic polypeptide
QEEEIATTNPVATEQYGSVSDTNLEGEGNR

SEQ ID NO: 23143 - protein, 32 aa, Artificial Sequence
  Description of Artificial Sequence: Synthetic polypeptide
DEEEIRTTNPVATEQYGCVTSTNLQRFGSNIM

SEQ ID NO: 23144 - protein, 29 aa, Artificial Sequence
  Description of Artificial Sequence: Synthetic peptide
QEEEIATTNPVATEQYGSVSANLQTGNES

SEQ ID NO: 23145 - protein, 31 aa, Artificial Sequence
  Description of Artificial Sequence: Synthetic polypeptide
DEEEIRTTNPVATEQYGCVTSTNLDQRGSEQ

SEQ ID NO: 23146 - protein, 32 aa, Artificial Sequence
  Description of Artificial Sequence: Synthetic polypeptide
DEEEIRTTNPVATEQYGSVSGTNLQQNNGNES

SEQ ID NO: 23147 - protein, 30 aa, Artificial Sequence
  Description of Artificial Sequence: Synthetic polypeptide
DEEEIRTTNPVATEQYGHVSWDNLNRGMER

SEQ ID NO: 23148 - protein, 30 aa, Artificial Sequence
  Description of Artificial Sequence: Synthetic polypeptide
DEEEIRTTNPVATEQYGHVSWGNLNRTMNR

SEQ ID NO: 23149 - protein, 30 aa, Artificial Sequence
  Description of Artificial Sequence: Synthetic polypeptide
QEEEIATTNPVATEQYGSVSANLQEHGNRD

SEQ ID NO: 23150 - protein, 31 aa, Artificial Sequence
  Description of Artificial Sequence: Synthetic polypeptide
DEEEIRTTNPVATEQYGHVSWTDLNRGMNDR

SEQ ID NO: 23151 - protein, 30 aa, Artificial Sequence
  Description of Artificial Sequence: Synthetic polypeptide
AEEEIRTTNPVATEQYGSVVTTNQLQQGND

SEQ ID NO: 23152 - protein, 31 aa, Artificial Sequence
  Description of Artificial Sequence: Synthetic polypeptide
DEEEIRTTNPVATEQYGCVTSTNEIQENGNR

SEQ ID NO: 23153 - protein, 32 aa, Artificial Sequence
  Description of Artificial Sequence: Synthetic polypeptide
DEEEIRTTNPVATEQYGCVTSTGNLQRGSNIP

SEQ ID NO: 23154 - protein, 33 aa, Artificial Sequence
  Description of Artificial Sequence: Synthetic polypeptide
DEEEIRTTNPVATEQYGHVSWTNLNQRLGMNDR

SEQ ID NO: 23155 - protein, 31 aa, Artificial Sequence
  Description of Artificial Sequence: Synthetic polypeptide
DEEEIRTTNPVATEQYGHVSWTNLNRGMNGI

SEQ ID NO: 23156 - protein, 32 aa, Artificial Sequence
  Description of Artificial Sequence: Synthetic polypeptide
DEEEIRTTNPVATEQYGHVSWTNLNRGMNSRS

SEQ ID NO: 23157 - protein, 32 aa, Artificial Sequence
  Description of Artificial Sequence: Synthetic polypeptide
DEEEIRTTNPVATEQYGSVSGTNLQTEMGANN

SEQ ID NO: 23158 - protein, 33 aa, Artificial Sequence
  Description of Artificial Sequence: Synthetic polypeptide
DEEEIRTTNPVATEQYGISTVSTNALSQRGGPR

SEQ ID NO: 23159 - protein, 31 aa, Artificial Sequence
  Description of Artificial Sequence: Synthetic polypeptide
DEEEIRTTNPVATEQYGCVSWTNLNMGENDR

SEQ ID NO: 23160 - protein, 29 aa, Artificial Sequence
  Description of Artificial Sequence: Synthetic peptide
DECEISTTNPVATEQYGSVSTNLMSGNTN

SEQ ID NO: 23161 - protein, 29 aa, Artificial Sequence
  Description of Artificial Sequence: Synthetic peptide
DECEISTTNPVATEQYGSVSTNLMLGENT

SEQ ID NO: 23162 - protein, 29 aa, Artificial Sequence
  Description of Artificial Sequence: Synthetic peptide
DECEISTTNPVATEQYGSVSTNLMEGNDT

SEQ ID NO: 23163 - protein, 28 aa, Artificial Sequence
  Description of Artificial Sequence: Synthetic peptide
DECEISTTNPVATEQYGSVSTNDMYGNT

SEQ ID NO: 23164 - protein, 29 aa, Artificial Sequence
  Description of Artificial Sequence: Synthetic peptide
QEEEIATTNPVATEQYGSVATNLQQGNNQ

SEQ ID NO: 23165 - protein, 31 aa, Artificial Sequence
  Description of Artificial Sequence: Synthetic polypeptide
DEEEIRTTNPVATEQYGCVTSTNDQRGSNTQ

SEQ ID NO: 23166 - protein, 31 aa, Artificial Sequence
  Description of Artificial Sequence: Synthetic polypeptide
DEEEIRTTNPVATEQYGSVSTMNVIQEGNGT

SEQ ID NO: 23167 - protein, 30 aa, Artificial Sequence
  Description of Artificial Sequence: Synthetic polypeptide
AEEEIRTTNPVATEQYGSVSVQNLNAGNTR

SEQ ID NO: 23168 - protein, 30 aa, Artificial Sequence
  Description of Artificial Sequence: Synthetic polypeptide
AEEEIRTTNPVATEQYGSVSVQGNLQNGNE

SEQ ID NO: 23169 - protein, 28 aa, Artificial Sequence
  Description of Artificial Sequence: Synthetic peptide
DECEIRTTNPVATEQYGVVSTSLQGPNT

SEQ ID NO: 23170 - protein, 28 aa, Artificial Sequence
  Description of Artificial Sequence: Synthetic peptide
DECEIRTTNPVATEQYGVVSTSGQRPND

SEQ ID NO: 23171 - protein, 29 aa, Artificial Sequence
  Description of Artificial Sequence: Synthetic peptide
AEEEIRTTNPVATEQYGSVSVNLQQFGEE

SEQ ID NO: 23172 - protein, 28 aa, Artificial Sequence
  Description of Artificial Sequence: Synthetic peptide
DECEIRTTNPVATEQYGVVSTPLQVPND

SEQ ID NO: 23173 - protein, 29 aa, Artificial Sequence
  Description of Artificial Sequence: Synthetic peptide
DEEEIRTTNPCATEAYGSTSTNLQAGGNE

SEQ ID NO: 23174 - protein, 28 aa, Artificial Sequence
  Description of Artificial Sequence: Synthetic peptide
DECEIRTTNPVATEQYGVVSTPLQVEND

SEQ ID NO: 23175 - protein, 28 aa, Artificial Sequence
  Description of Artificial Sequence: Synthetic peptide
DECEIRTTNPVATEQYGVVSTPLQIPNE

SEQ ID NO: 23176 - protein, 29 aa, Artificial Sequence
  Description of Artificial Sequence: Synthetic peptide
DECEIRTTNPVATEQYGVVSTKLQRMNND

SEQ ID NO: 23177 - protein, 29 aa, Artificial Sequence
  Description of Artificial Sequence: Synthetic peptide
DECEIRTTNPVATEQYGVVSTKLQRDNQD

SEQ ID NO: 23178 - protein, 28 aa, Artificial Sequence
  Description of Artificial Sequence: Synthetic peptide
DECEIRTTNPVATEQYGVVSTKLERENE

SEQ ID NO: 23179 - protein, 28 aa, Artificial Sequence
  Description of Artificial Sequence: Synthetic peptide
DEEEIRTTNPCATEAYGSTSTNLAEGND

SEQ ID NO: 23180 - protein, 29 aa, Artificial Sequence
  Description of Artificial Sequence: Synthetic peptide
DECEIRTTNPVATEQYGVVSTHVLQRMND

SEQ ID NO: 23181 - protein, 32 aa, Artificial Sequence
  Description of Artificial Sequence: Synthetic polypeptide
DEEEIRTTNPVATEQYGKTVSTNELSTRGGNR

SEQ ID NO: 23182 - protein, 29 aa, Artificial Sequence
  Description of Artificial Sequence: Synthetic peptide
QEEEIATTNPVATEPYGSVSANLQENGNR

SEQ ID NO: 23183 - protein, 28 aa, Artificial Sequence
  Description of Artificial Sequence: Synthetic peptide
DECEIRTTNPVATEQYGVVSTGLQMQND

SEQ ID NO: 23184 - protein, 30 aa, Artificial Sequence
  Description of Artificial Sequence: Synthetic polypeptide
AEEEIRTTNPVATEQYGSVSVNLQNDGNIE

SEQ ID NO: 23185 - protein, 29 aa, Artificial Sequence
  Description of Artificial Sequence: Synthetic peptide
QEEEIATTNPVATENYGSVATNLQERGER

SEQ ID NO: 23186 - protein, 30 aa, Artificial Sequence
  Description of Artificial Sequence: Synthetic polypeptide
QEEEIATTNPVATEMYGSVSTNLQQGNSRM

SEQ ID NO: 23187 - protein, 31 aa, Artificial Sequence
  Description of Artificial Sequence: Synthetic polypeptide
QEEEIATTNPVATEMYGSVSTNLQERGNMRN

SEQ ID NO: 23188 - protein, 30 aa, Artificial Sequence
  Description of Artificial Sequence: Synthetic polypeptide
AEEEIRTTNPVATEQYGSVSVNLQMGQNTN

SEQ ID NO: 23189 - protein, 28 aa, Artificial Sequence
  Description of Artificial Sequence: Synthetic peptide
DEEEIRTTNPCATEAYGSCSTNLTTGNS

SEQ ID NO: 23190 - protein, 30 aa, Artificial Sequence
  Description of Artificial Sequence: Synthetic polypeptide
AEEEIRTTNPVATEQYGSVSVNLQMGNNVV

SEQ ID NO: 23191 - protein, 28 aa, Artificial Sequence
  Description of Artificial Sequence: Synthetic peptide
DEEEIRTTNPCATEAYGSCSTNLNLGNT

SEQ ID NO: 23192 - protein, 28 aa, Artificial Sequence
  Description of Artificial Sequence: Synthetic peptide
DEEEIRTTNPCATEAYGSCSTNLLGGNI

SEQ ID NO: 23193 - protein, 29 aa, Artificial Sequence
  Description of Artificial Sequence: Synthetic peptide
QEEEIATTNPVATEHYGSVSTNLQHGNNQ

SEQ ID NO: 23194 - protein, 29 aa, Artificial Sequence
  Description of Artificial Sequence: Synthetic peptide
DECEIRTTNPVATEQYGVVSTALQRPNED

SEQ ID NO: 23195 - protein, 28 aa, Artificial Sequence
  Description of Artificial Sequence: Synthetic peptide
DECEIRTTNPVATEQYGVVSTHLQGPND

SEQ ID NO: 23196 - protein, 30 aa, Artificial Sequence
  Description of Artificial Sequence: Synthetic polypeptide
DEEEIRTTNPVATEQYGCVSWNLQYGSNFT

SEQ ID NO: 23197 - protein, 32 aa, Artificial Sequence
  Description of Artificial Sequence: Synthetic polypeptide
DEEEIRTTNPVATEQYGKTVSTNELSQRGNQE

SEQ ID NO: 23198 - protein, 28 aa, Artificial Sequence
  Description of Artificial Sequence: Synthetic peptide
DECEIRTTNPVATEQYGVVSTVLARPND

SEQ ID NO: 23199 - protein, 30 aa, Artificial Sequence
  Description of Artificial Sequence: Synthetic polypeptide
DEECIRTTNPVATEQYREETVSTNLQNGNR

SEQ ID NO: 23200 - protein, 31 aa, Artificial Sequence
  Description of Artificial Sequence: Synthetic polypeptide
DEECIRTTNPVATEQYNYSVSGNNLQRGDNR

SEQ ID NO: 23201 - protein, 31 aa, Artificial Sequence
  Description of Artificial Sequence: Synthetic polypeptide
AEEEIRTTNPVATEQYGSVSVNTNLQVGNQE

SEQ ID NO: 23202 - protein, 31 aa, Artificial Sequence
  Description of Artificial Sequence: Synthetic polypeptide
AEEEIRTTNPVATEQYGSVSVNTNLQIGNES

SEQ ID NO: 23203 - protein, 30 aa, Artificial Sequence
  Description of Artificial Sequence: Synthetic polypeptide
DEEEIRTTNPVATEQYGCVSWNLQRSNSEA

SEQ ID NO: 23204 - protein, 30 aa, Artificial Sequence
  Description of Artificial Sequence: Synthetic polypeptide
DEEEIRTTNPVATEQYGCVSWNLQRGSDAQ

SEQ ID NO: 23205 - protein, 31 aa, Artificial Sequence
  Description of Artificial Sequence: Synthetic polypeptide
DEEEIRTTNPVATEQYGSVSTMNNVQTGNLY

SEQ ID NO: 23206 - protein, 31 aa, Artificial Sequence
  Description of Artificial Sequence: Synthetic polypeptide
DEEEIRTTNPVATEQYGCVSWNLQHLGSNRN

SEQ ID NO: 23207 - protein, 30 aa, Artificial Sequence
  Description of Artificial Sequence: Synthetic polypeptide
DEEEIRTTNPVATEQYGCVSWNLQGMPNFR

SEQ ID NO: 23208 - protein, 30 aa, Artificial Sequence
  Description of Artificial Sequence: Synthetic polypeptide
AEEEIRTTNPVATEQYGSVSVNNNQRGNIN

SEQ ID NO: 23209 - protein, 31 aa, Artificial Sequence
  Description of Artificial Sequence: Synthetic polypeptide
DEEEIRTTNPVATEQYGCVSWNLFQRSGSER

SEQ ID NO: 23210 - protein, 31 aa, Artificial Sequence
  Description of Artificial Sequence: Synthetic polypeptide
DEEEIRTTNPVATEQYGIVSWTNDLNGGMNR

SEQ ID NO: 23211 - protein, 30 aa, Artificial Sequence
  Description of Artificial Sequence: Synthetic polypeptide
AEEEIRTTNPVATEQYGSVSVNLQQSGQND

SEQ ID NO: 23212 - protein, 32 aa, Artificial Sequence
  Description of Artificial Sequence: Synthetic polypeptide
DEEEIRTTNPVATEQYGSVSGTNLQTIGANED

SEQ ID NO: 23213 - protein, 31 aa, Artificial Sequence
  Description of Artificial Sequence: Synthetic polypeptide
DEEEIRTTNPVATEQYGCVSWMNLIRGSNNR

SEQ ID NO: 23214 - protein, 31 aa, Artificial Sequence
  Description of Artificial Sequence: Synthetic polypeptide
DEEEIRTTNPVATEQYGSVSTMNNLQNVGGE

SEQ ID NO: 23215 - protein, 32 aa, Artificial Sequence
  Description of Artificial Sequence: Synthetic polypeptide
DEEEIRTTNPVATEQYGSVSGTNLQTNGANSV

SEQ ID NO: 23216 - protein, 28 aa, Artificial Sequence
  Description of Artificial Sequence: Synthetic peptide
QEEEIATTNPVATEQYGEASENLQRGER

SEQ ID NO: 23217 - protein, 31 aa, Artificial Sequence
  Description of Artificial Sequence: Synthetic polypeptide
DEEEIRTTNPVATEQYGKTASTGELQRGGNR

SEQ ID NO: 23218 - protein, 32 aa, Artificial Sequence
  Description of Artificial Sequence: Synthetic polypeptide
DEEEIRTTNPVATEQYGKTVCSTNELSQPGNR

SEQ ID NO: 23219 - protein, 32 aa, Artificial Sequence
  Description of Artificial Sequence: Synthetic polypeptide
DEEEIRTTNPVATEQYGSVSGTNLQTSGANNE

SEQ ID NO: 23220 - protein, 30 aa, Artificial Sequence
  Description of Artificial Sequence: Synthetic polypeptide
AEEEIRTTNPVATEQYGSVSVNLSQNGGNV

SEQ ID NO: 23221 - protein, 30 aa, Artificial Sequence
  Description of Artificial Sequence: Synthetic polypeptide
AEEEIRTTNPVATEQYGSVSVNLQYGNGND

SEQ ID NO: 23222 - protein, 31 aa, Artificial Sequence
  Description of Artificial Sequence: Synthetic polypeptide
DEEEIRTTNPVATEQYGSVSGTGNGQEPGNQ

SEQ ID NO: 23223 - protein, 30 aa, Artificial Sequence
  Description of Artificial Sequence: Synthetic polypeptide
DECEIRTTNPVATEQYGVVSTVLQRGPNQD

SEQ ID NO: 23224 - protein, 30 aa, Artificial Sequence
  Description of Artificial Sequence: Synthetic polypeptide
DECEIRTTNPVATEQYGVVSTVLQRGPENQ

SEQ ID NO: 23225 - protein, 31 aa, Artificial Sequence
  Description of Artificial Sequence: Synthetic polypeptide
DEEEIRTTNPVATEQYGKISTNLSQNVGNNR

SEQ ID NO: 23226 - protein, 28 aa, Artificial Sequence
  Description of Artificial Sequence: Synthetic peptide
QEEEIATTNPVATEHYGSVSTNLQDAND

SEQ ID NO: 23227 - protein, 29 aa, Artificial Sequence
  Description of Artificial Sequence: Synthetic peptide
QEEEIATTNPVATEQYGSVSTNDQRDDNA

SEQ ID NO: 23228 - protein, 32 aa, Artificial Sequence
  Description of Artificial Sequence: Synthetic polypeptide
DEEEIRTTNPVATEQYGSVSGTNLQQIGGGNM

SEQ ID NO: 23229 - protein, 30 aa, Artificial Sequence
  Description of Artificial Sequence: Synthetic polypeptide
AEEEIRTTNPVATEQYGSVVTNQLQLGNYA

SEQ ID NO: 23230 - protein, 31 aa, Artificial Sequence
  Description of Artificial Sequence: Synthetic polypeptide
AEEEIRTTNPVATEQYGSVVTNQLQNTGGNR

SEQ ID NO: 23231 - protein, 30 aa, Artificial Sequence
  Description of Artificial Sequence: Synthetic polypeptide
AEEEIRTTNPVATEQYGSVVTNQLQSGAAR

SEQ ID NO: 23232 - protein, 31 aa, Artificial Sequence
  Description of Artificial Sequence: Synthetic polypeptide
AEEEIRTTNPVATEQYGSVSVTNLEQQGNGI

SEQ ID NO: 23233 - protein, 31 aa, Artificial Sequence
  Description of Artificial Sequence: Synthetic polypeptide
DEEEIRTTNPVATEQYGSVSTNAHQERSMDR

SEQ ID NO: 23234 - protein, 29 aa, Artificial Sequence
  Description of Artificial Sequence: Synthetic peptide
QEEGIRTTNPVATEQYGSVSTNLISNDNR

SEQ ID NO: 23235 - protein, 31 aa, Artificial Sequence
  Description of Artificial Sequence: Synthetic polypeptide
DEEEIRTTNPVATEQYGSVSTNAHQERDLGR

SEQ ID NO: 23236 - protein, 31 aa, Artificial Sequence
  Description of Artificial Sequence: Synthetic polypeptide
AEEEIRTTNPVATEQYGSVSVTNLEQAGNVG

SEQ ID NO: 23237 - protein, 30 aa, Artificial Sequence
  Description of Artificial Sequence: Synthetic polypeptide
DEEEIRTTNPVATEQYGFVSTVNLDQRDDQ

SEQ ID NO: 23238 - protein, 31 aa, Artificial Sequence
  Description of Artificial Sequence: Synthetic polypeptide
DEEEIRTTNPVATEQYGSVSTNIHQERDIIR

SEQ ID NO: 23239 - protein, 31 aa, Artificial Sequence
  Description of Artificial Sequence: Synthetic polypeptide
DEEEIRTTNPCATEQYGSVCTNLQRGGNESE

SEQ ID NO: 23240 - protein, 30 aa, Artificial Sequence
  Description of Artificial Sequence: Synthetic polypeptide
AEEEIRTTNPVATEQYGSVSVTNIQEDGNN

SEQ ID NO: 23241 - protein, 29 aa, Artificial Sequence
  Description of Artificial Sequence: Synthetic peptide
AEEEIRTTNPVATEQYGSVVTNQLEQGNG

SEQ ID NO: 23242 - protein, 29 aa, Artificial Sequence
  Description of Artificial Sequence: Synthetic peptide
QEEGIRTTNPVATEQYGSVSTNLSGEDNR

SEQ ID NO: 23243 - protein, 29 aa, Artificial Sequence
  Description of Artificial Sequence: Synthetic peptide
QEEGIRTTNPVATEQYGSVSTNLSNENQR

SEQ ID NO: 23244 - protein, 30 aa, Artificial Sequence
  Description of Artificial Sequence: Synthetic polypeptide
AEEEIRTTNPVATEQYGSVSVTNGGQVGNG

SEQ ID NO: 23245 - protein, 30 aa, Artificial Sequence
  Description of Artificial Sequence: Synthetic polypeptide
AEEEIRTTNPVATEQYGSVSVTNGGQGGNG

SEQ ID NO: 23246 - protein, 31 aa, Artificial Sequence
  Description of Artificial Sequence: Synthetic polypeptide
DEEEIRTTNPVATEQYGSVSTNADQRFGSEQ

SEQ ID NO: 23247 - protein, 30 aa, Artificial Sequence
  Description of Artificial Sequence: Synthetic polypeptide
AEEEIRTTNPVATEQYGSVSVTNEQSGQNA

SEQ ID NO: 23248 - protein, 30 aa, Artificial Sequence
  Description of Artificial Sequence: Synthetic polypeptide
DEEEIRTTNPVATEQYGSVSTNADQDGDDA

SEQ ID NO: 23249 - protein, 31 aa, Artificial Sequence
  Description of Artificial Sequence: Synthetic polypeptide
AEEEIRTTNPVATEQYGSVSVTNDQQSGQNR

SEQ ID NO: 23250 - protein, 31 aa, Artificial Sequence
  Description of Artificial Sequence: Synthetic polypeptide
DEEEIRTTNPVATEQYGSVSTMYLQYSGSNA

SEQ ID NO: 23251 - protein, 30 aa, Artificial Sequence
  Description of Artificial Sequence: Synthetic polypeptide
DEEEIRTTNPVATEQYGSVSTMYGLQGLNE

SEQ ID NO: 23252 - protein, 32 aa, Artificial Sequence
  Description of Artificial Sequence: Synthetic polypeptide
AEEEIRTTNPVATEQYGSVVTSTNLQNNGNNR

SEQ ID NO: 23253 - protein, 28 aa, Artificial Sequence
  Description of Artificial Sequence: Synthetic peptide
DEEEIRTTNPCATEQYGSVDTDLARGEE

SEQ ID NO: 23254 - protein, 29 aa, Artificial Sequence
  Description of Artificial Sequence: Synthetic peptide
QEEGIRTTNPVATEQYGSVSTNLSTGLND

SEQ ID NO: 23255 - protein, 30 aa, Artificial Sequence
  Description of Artificial Sequence: Synthetic polypeptide
AEEEIRTTNPVATEQYGSVSVTNGQNIGNG

SEQ ID NO: 23256 - protein, 32 aa, Artificial Sequence
  Description of Artificial Sequence: Synthetic polypeptide
AEEEIRTTNPVATEQYGSVVTSTNLQQGENNR

SEQ ID NO: 23257 - protein, 32 aa, Artificial Sequence
  Description of Artificial Sequence: Synthetic polypeptide
DEEEIRTTNPVATEQYGSVSTNAHSQKGGSNR

SEQ ID NO: 23258 - protein, 30 aa, Artificial Sequence
  Description of Artificial Sequence: Synthetic polypeptide
AEEEIRTTNPVATEQYGSVSVTNLGNIGNM

SEQ ID NO: 23259 - protein, 32 aa, Artificial Sequence
  Description of Artificial Sequence: Synthetic polypeptide
DEEEIRTTNPVATEQYGSVSTNALQAPGGNNE

SEQ ID NO: 23260 - protein, 30 aa, Artificial Sequence
  Description of Artificial Sequence: Synthetic polypeptide
AEEEIRTTNPVATEQYGSVVSTTNLQNNND

SEQ ID NO: 23261 - protein, 30 aa, Artificial Sequence
  Description of Artificial Sequence: Synthetic polypeptide
DEECIRTTNPVATEQYSACVSTNLQIGGNR

SEQ ID NO: 23262 - protein, 29 aa, Artificial Sequence
  Description of Artificial Sequence: Synthetic peptide
AEEEIRTTNPVATEQYGSVVSTTNQIGNS

SEQ ID NO: 23263 - protein, 30 aa, Artificial Sequence
  Description of Artificial Sequence: Synthetic polypeptide
AEEEIRTTNPVATEQYGSVVSVNNLGNGNR

SEQ ID NO: 23264 - protein, 31 aa, Artificial Sequence
  Description of Artificial Sequence: Synthetic polypeptide
AEEEIRTTNPVATEQYGSVVSVTNLLQNGNL

SEQ ID NO: 23265 - protein, 31 aa, Artificial Sequence
  Description of Artificial Sequence: Synthetic polypeptide
AEEEIRTTNPVATEQYGSVVSVTNNLQLGNF

SEQ ID NO: 23266 - protein, 31 aa, Artificial Sequence
  Description of Artificial Sequence: Synthetic polypeptide
DEEEIRTTNPVATEQYGSVSTNHQNSGENQD

SEQ ID NO: 23267 - protein, 31 aa, Artificial Sequence
  Description of Artificial Sequence: Synthetic polypeptide
DEEEIRTTNPVATEQYGSVSTNHQRFGEDQP

SEQ ID NO: 23268 - protein, 30 aa, Artificial Sequence
  Description of Artificial Sequence: Synthetic polypeptide
AEEEIRTTNPVATEQYGSVSVTNLLNGNLG

SEQ ID NO: 23269 - protein, 31 aa, Artificial Sequence
  Description of Artificial Sequence: Synthetic polypeptide
DEEEIRTTNPVATEQYGSVSTNHQRGSEFQI

SEQ ID NO: 23270 - protein, 30 aa, Artificial Sequence
  Description of Artificial Sequence: Synthetic polypeptide
AEEEIRTTNPVATEQYGSVVTNELNQQGNI

SEQ ID NO: 23271 - protein, 32 aa, Artificial Sequence
  Description of Artificial Sequence: Synthetic polypeptide
DEEEIRTTNPVATEQYGSVSTNHSTRGGNNRC

SEQ ID NO: 23272 - protein, 31 aa, Artificial Sequence
  Description of Artificial Sequence: Synthetic polypeptide
DEEEIRTTNPVATEQYGSVSTNHQRSNSDVP

SEQ ID NO: 23273 - protein, 28 aa, Artificial Sequence
  Description of Artificial Sequence: Synthetic peptide
DEEEIRTTNPCATEEYGSVATNGERGNQ

SEQ ID NO: 23274 - protein, 30 aa, Artificial Sequence
  Description of Artificial Sequence: Synthetic polypeptide
AEEEIRTTNPVATEQYGSVVTNLQDEGIND

SEQ ID NO: 23275 - protein, 30 aa, Artificial Sequence
  Description of Artificial Sequence: Synthetic polypeptide
AEEEIRTTNPVATEQYGSVVTNLQGNGDNG

SEQ ID NO: 23276 - protein, 28 aa, Artificial Sequence
  Description of Artificial Sequence: Synthetic peptide
QEEGIRTTNPVATEQYGSVSTNLGELND

SEQ ID NO: 23277 - protein, 30 aa, Artificial Sequence
  Description of Artificial Sequence: Synthetic polypeptide
DEEEIRTTNPVATEQYGSVSTNHQWASEDR

SEQ ID NO: 23278 - protein, 31 aa, Artificial Sequence
  Description of Artificial Sequence: Synthetic polypeptide
AEEEIRTTNPVATEQYGSVSVTNLGQQGNPN

SEQ ID NO: 23279 - protein, 30 aa, Artificial Sequence
  Description of Artificial Sequence: Synthetic polypeptide
AEEEIRTTNPVATEQYGSVVTNLQQEGTNM

SEQ ID NO: 23280 - protein, 31 aa, Artificial Sequence
  Description of Artificial Sequence: Synthetic polypeptide
AEEEIRTTNPVATEQYGSVSVTNLGQNQNIR

SEQ ID NO: 23281 - protein, 30 aa, Artificial Sequence
  Description of Artificial Sequence: Synthetic polypeptide
AEEEIRTTNPVATEQYGSVVTNLQQIDGNN

SEQ ID NO: 23282 - protein, 33 aa, Artificial Sequence
  Description of Artificial Sequence: Synthetic polypeptide
DEEEIRTTNPVATEQYGSVSTNAHSQRTGGNRW

SEQ ID NO: 23283 - protein, 31 aa, Artificial Sequence
  Description of Artificial Sequence: Synthetic polypeptide
AEEEIRTTNPVATEQYGSVSVTNLGQESGNQ

SEQ ID NO: 23284 - protein, 31 aa, Artificial Sequence
  Description of Artificial Sequence: Synthetic polypeptide
DEEEIRTTNPVATEQYGSVSTNHSQTGGNNV

SEQ ID NO: 23285 - protein, 30 aa, Artificial Sequence
  Description of Artificial Sequence: Synthetic polypeptide
AEEEIRTTNPVATEQYGSVVTNLLQNGNMG

SEQ ID NO: 23286 - protein, 32 aa, Artificial Sequence
  Description of Artificial Sequence: Synthetic polypeptide
DEEEIRTTNPVATEQYGCVVSCTNLSARGSNR

SEQ ID NO: 23287 - protein, 29 aa, Artificial Sequence
  Description of Artificial Sequence: Synthetic peptide
QEEHISTTNPVATEQYGSVSTNINHRGNR

SEQ ID NO: 23288 - protein, 30 aa, Artificial Sequence
  Description of Artificial Sequence: Synthetic polypeptide
DEEEIRTTNPVATEQYGSVSTMYDQRGEQL

SEQ ID NO: 23289 - protein, 29 aa, Artificial Sequence
  Description of Artificial Sequence: Synthetic peptide
DEEEIRTTNPCATECYGSCSTNLDHRGNA

SEQ ID NO: 23290 - protein, 28 aa, Artificial Sequence
  Description of Artificial Sequence: Synthetic peptide
DEEEIRTTNPCATECYGSCSTNLDGGNH

SEQ ID NO: 23291 - protein, 32 aa, Artificial Sequence
  Description of Artificial Sequence: Synthetic polypeptide
QEEEIATTNPVATEQYGSVSTPNLQDRGNERL

SEQ ID NO: 23292 - protein, 30 aa, Artificial Sequence
  Description of Artificial Sequence: Synthetic polypeptide
AEEEIRTTNPVATEQYGSVSVTGNVQEGNE

SEQ ID NO: 23293 - protein, 28 aa, Artificial Sequence
  Description of Artificial Sequence: Synthetic peptide
QEEPICTTNPVATEQYGSVSMNQQRGNS

SEQ ID NO: 23294 - protein, 28 aa, Artificial Sequence
  Description of Artificial Sequence: Synthetic peptide
DECEIYTTNPVATEQYGSCSTNLMYGNT

SEQ ID NO: 23295 - protein, 31 aa, Artificial Sequence
  Description of Artificial Sequence: Synthetic polypeptide
QEEEIATTNPVATEQYGSVSTNQLQPREGNL

SEQ ID NO: 23296 - protein, 30 aa, Artificial Sequence
  Description of Artificial Sequence: Synthetic polypeptide
AEEEIRTTNPVATEQYGSVVTTNLQLGGNG

SEQ ID NO: 23297 - protein, 28 aa, Artificial Sequence
  Description of Artificial Sequence: Synthetic peptide
QEETICTTNPVATEQYGSVSSNSQRGNS

SEQ ID NO: 23298 - protein, 28 aa, Artificial Sequence
  Description of Artificial Sequence: Synthetic peptide
DECEIYTTNPVATEGYGSVSTNLMGGNT

SEQ ID NO: 23299 - protein, 32 aa, Artificial Sequence
  Description of Artificial Sequence: Synthetic polypeptide
DEEEIRTTNPVATEQYGSVSGTNLQQDGGNIG

SEQ ID NO: 23300 - protein, 32 aa, Artificial Sequence
  Description of Artificial Sequence: Synthetic polypeptide
DEEEIRTTNPVATEQYGSVSTMNVQRVGQNEE

SEQ ID NO: 23301 - protein, 28 aa, Artificial Sequence
  Description of Artificial Sequence: Synthetic peptide
DEEEIRTTNPCATECYGSVATNGGRGNY

SEQ ID NO: 23302 - protein, 28 aa, Artificial Sequence
  Description of Artificial Sequence: Synthetic peptide
QEEEIATTNPVATEQYGSVSTNLTDGPM

SEQ ID NO: 23303 - protein, 30 aa, Artificial Sequence
  Description of Artificial Sequence: Synthetic polypeptide
AEEEIRTTNPVATEQYGSVVTTNLQQNENR

SEQ ID NO: 23304 - protein, 30 aa, Artificial Sequence
  Description of Artificial Sequence: Synthetic polypeptide
QEEEIATTNPVATEQYGSVSTNLQRNANES

SEQ ID NO: 23305 - protein, 30 aa, Artificial Sequence
  Description of Artificial Sequence: Synthetic polypeptide
QEEEIATTNPVATEQYGSVSTNLQRDNDTA

SEQ ID NO: 23306 - protein, 32 aa, Artificial Sequence
  Description of Artificial Sequence: Synthetic polypeptide
DEEEIRTTNPVATEQYGSVSTNINQRTGNIQQ

SEQ ID NO: 23307 - protein, 30 aa, Artificial Sequence
  Description of Artificial Sequence: Synthetic polypeptide
QEEEIATTNPVATEQYGSVSTNLQQGDPRM

SEQ ID NO: 23308 - protein, 30 aa, Artificial Sequence
  Description of Artificial Sequence: Synthetic polypeptide
AEEEIRTTNPVATEQYGSVVTTNLQQTVNR

SEQ ID NO: 23309 - protein, 32 aa, Artificial Sequence
  Description of Artificial Sequence: Synthetic polypeptide
DEEEIRTTNPVATEQYGCVVSTNLQHFGSNRP

SEQ ID NO: 23310 - protein, 30 aa, Artificial Sequence
  Description of Artificial Sequence: Synthetic polypeptide
QEEEIATTNPVATEQYGSVSTNLQNNGNEE

SEQ ID NO: 23311 - protein, 29 aa, Artificial Sequence
  Description of Artificial Sequence: Synthetic peptide
QEFEIRTTNPVCTEQYGGVSTNLQRGPDR

SEQ ID NO: 23312 - protein, 30 aa, Artificial Sequence
  Description of Artificial Sequence: Synthetic polypeptide
QEEEIATTNPVATEQYGSVSTNLQHGENTD

SEQ ID NO: 23313 - protein, 31 aa, Artificial Sequence
  Description of Artificial Sequence: Synthetic polypeptide
AEEEIRTTNPVATEQYGSVSVTENLQQGNQA

SEQ ID NO: 23314 - protein, 31 aa, Artificial Sequence
  Description of Artificial Sequence: Synthetic polypeptide
DEEEIRTTNPVATEQYGSVSGTNLQQIENED

SEQ ID NO: 23315 - protein, 30 aa, Artificial Sequence
  Description of Artificial Sequence: Synthetic polypeptide
QEEEIATTNPVATEQYGSVSTNLQRQNDND

SEQ ID NO: 23316 - protein, 30 aa, Artificial Sequence
  Description of Artificial Sequence: Synthetic polypeptide
AEEEIRTTNPVATEQYGSVSVTNDQNMGNQ

SEQ ID NO: 23317 - protein, 31 aa, Artificial Sequence
  Description of Artificial Sequence: Synthetic polypeptide
AEEEIRTTNPVATEQYGSVSVTINLQEGNTG

SEQ ID NO: 23318 - protein, 31 aa, Artificial Sequence
  Description of Artificial Sequence: Synthetic polypeptide
DEEEIRTTNPVATEQYGHVSLWTNLNRGMNG

SEQ ID NO: 23319 - protein, 32 aa, Artificial Sequence
  Description of Artificial Sequence: Synthetic polypeptide
DEEEIRTTNPVATEQYGSVSTMTNLQQGQNGG

SEQ ID NO: 23320 - protein, 29 aa, Artificial Sequence
  Description of Artificial Sequence: Synthetic peptide
DEEEIRTTNPVATEQYGSVSTMTDQGMNT

SEQ ID NO: 23321 - protein, 31 aa, Artificial Sequence
  Description of Artificial Sequence: Synthetic polypeptide
AEEEIRTTNPVATEQYGSVVTSTTNLQNGIR

SEQ ID NO: 23322 - protein, 32 aa, Artificial Sequence
  Description of Artificial Sequence: Synthetic polypeptide
DEEEIRTTNPVATEQYGSVSTMSLQREGNIID

SEQ ID NO: 23323 - protein, 31 aa, Artificial Sequence
  Description of Artificial Sequence: Synthetic polypeptide
DEEEIRTTNPCATEQYGSVIASPNLQRGNID

SEQ ID NO: 23324 - protein, 29 aa, Artificial Sequence
  Description of Artificial Sequence: Synthetic peptide
QEEEIATTNPVATEVYGSVATNLQDRGDR

SEQ ID NO: 23325 - protein, 31 aa, Artificial Sequence
  Description of Artificial Sequence: Synthetic polypeptide
DEEEIRTTNPVATEQYGCVVTNLQEGFGSNR

SEQ ID NO: 23326 - protein, 29 aa, Artificial Sequence
  Description of Artificial Sequence: Synthetic peptide
QEEEIATTNPVATETYGSVSTNLQQGNDT

SEQ ID NO: 23327 - protein, 29 aa, Artificial Sequence
  Description of Artificial Sequence: Synthetic peptide
DECEIYTTNPVATEQYGSVSTNLNEDGNT

SEQ ID NO: 23328 - protein, 32 aa, Artificial Sequence
  Description of Artificial Sequence: Synthetic polypeptide
DEEEIRTTNPVATEQYGSVSGTNLQMGGNNGG

SEQ ID NO: 23329 - protein, 31 aa, Artificial Sequence
  Description of Artificial Sequence: Synthetic polypeptide
DEEEIRTTNPCATEQYGSVIATNELQRGNHD

SEQ ID NO: 23330 - protein, 29 aa, Artificial Sequence
  Description of Artificial Sequence: Synthetic peptide
AEEEIRTTNPVATEQYGSVVTTLQDVGNV

SEQ ID NO: 23331 - protein, 29 aa, Artificial Sequence
  Description of Artificial Sequence: Synthetic peptide
QEEEIATTNPVATEQYGSVSTVLEQGNDR

SEQ ID NO: 23332 - protein, 31 aa, Artificial Sequence
  Description of Artificial Sequence: Synthetic polypeptide
DEEEIRTTNPCATEQYGSVIATNLQRGENGD

SEQ ID NO: 23333 - protein, 31 aa, Artificial Sequence
  Description of Artificial Sequence: Synthetic polypeptide
DEEEIRTTNPCATEQYGSVIATNLQRGENNA

SEQ ID NO: 23334 - protein, 31 aa, Artificial Sequence
  Description of Artificial Sequence: Synthetic polypeptide
DEEEIRTTNPVATEQYGSVSGTNLQNENFTG

SEQ ID NO: 23335 - protein, 31 aa, Artificial Sequence
  Description of Artificial Sequence: Synthetic polypeptide
DEEEIRTTNPVATEQYGSVSGTNLQNEVNEM

SEQ ID NO: 23336 - protein, 31 aa, Artificial Sequence
  Description of Artificial Sequence: Synthetic polypeptide
AEEEIRTTNPVATEQYGSVSVTNAEQGGNER

SEQ ID NO: 23337 - protein, 29 aa, Artificial Sequence
  Description of Artificial Sequence: Synthetic peptide
AEEEIRTTNPVATEQYGSVSVTMGQGGNN

SEQ ID NO: 23338 - protein, 29 aa, Artificial Sequence
  Description of Artificial Sequence: Synthetic peptide
AEEEIRTTNPVATEQYGSVSVTLQMGQNG

SEQ ID NO: 23339 - protein, 29 aa, Artificial Sequence
  Description of Artificial Sequence: Synthetic peptide
DECEIYTTNPVATEQYGSVSTNLMTGNTT

SEQ ID NO: 23340 - protein, 30 aa, Artificial Sequence
  Description of Artificial Sequence: Synthetic polypeptide
DEEEIRTTNPCATEQYGSVICTNLQRGSID

SEQ ID NO: 23341 - protein, 32 aa, Artificial Sequence
  Description of Artificial Sequence: Synthetic polypeptide
DEEEIRTTNPVATEQYGHVSITNLSNRVGNNR

SEQ ID NO: 23342 - protein, 29 aa, Artificial Sequence
  Description of Artificial Sequence: Synthetic peptide
DECEIYTTNPVATEQYGSVSTNLEQGNDT

SEQ ID NO: 23343 - protein, 31 aa, Artificial Sequence
  Description of Artificial Sequence: Synthetic polypeptide
DEEEIRTTNPVATEQYGHVSITNLSNSGGNR

SEQ ID NO: 23344 - protein, 31 aa, Artificial Sequence
  Description of Artificial Sequence: Synthetic polypeptide
DEEEIRTTNPVATEQYGSVSGTNLQNMGTDI

SEQ ID NO: 23345 - protein, 30 aa, Artificial Sequence
  Description of Artificial Sequence: Synthetic polypeptide
AEEEIRTTNPVATEQYGSVSVTNAQQEGNQ

SEQ ID NO: 23346 - protein, 30 aa, Artificial Sequence
  Description of Artificial Sequence: Synthetic polypeptide
QEEEIATTNPVATEHYGSVSTNLQAGENGR

SEQ ID NO: 23347 - protein, 28 aa, Artificial Sequence
  Description of Artificial Sequence: Synthetic peptide
DECEIRTTNPVATEQYGVVSTALQANND

SEQ ID NO: 23348 - protein, 30 aa, Artificial Sequence
  Description of Artificial Sequence: Synthetic polypeptide
AEEEIRTTNPVATEQYGSVSVNLQAGQNVN

SEQ ID NO: 23349 - protein, 30 aa, Artificial Sequence
  Description of Artificial Sequence: Synthetic polypeptide
NSEEIRTTNPVATEQYGVVSTNLSQTGPNR

SEQ ID NO: 23350 - protein, 30 aa, Artificial Sequence
  Description of Artificial Sequence: Synthetic polypeptide
NSEEIRTTNPVATEQYGVVSTNLQNGSNTR

SEQ ID NO: 23351 - protein, 30 aa, Artificial Sequence
  Description of Artificial Sequence: Synthetic polypeptide
NSEEIRTTNPVATEQYGVVSTNLQDGLNNR

SEQ ID NO: 23352 - protein, 30 aa, Artificial Sequence
  Description of Artificial Sequence: Synthetic polypeptide
DEEEIRTTNPVATEQYGCVSTSLQGFGNQE

SEQ ID NO: 23353 - protein, 30 aa, Artificial Sequence
  Description of Artificial Sequence: Synthetic polypeptide
NSEEIRTTNPVATEQYGKVSTNLSQDGLNR

SEQ ID NO: 23354 - protein, 30 aa, Artificial Sequence
  Description of Artificial Sequence: Synthetic polypeptide
NSEEIRTTNPVATEQYGIVVSTNLQDGGNR

SEQ ID NO: 23355 - protein, 29 aa, Artificial Sequence
  Description of Artificial Sequence: Synthetic peptide
DEEEIRTCNPVATEQYGSVSTQLQERNQE

SEQ ID NO: 23356 - protein, 30 aa, Artificial Sequence
  Description of Artificial Sequence: Synthetic polypeptide
NQEEIRTTNPVATEQYGVVSTNLQYSGSNR

SEQ ID NO: 23357 - protein, 30 aa, Artificial Sequence
  Description of Artificial Sequence: Synthetic polypeptide
DEEEIRTTNPVATEQYGCVSTSLEQRDDER

SEQ ID NO: 23358 - protein, 29 aa, Artificial Sequence
  Description of Artificial Sequence: Synthetic peptide
NQEEIRTTNPVATEQYGVVSTNHQNGGNR

SEQ ID NO: 23359 - protein, 29 aa, Artificial Sequence
  Description of Artificial Sequence: Synthetic peptide
NQEEIRTTNPVATEQYGCVSTNLQNGSNQ

SEQ ID NO: 23360 - protein, 32 aa, Artificial Sequence
  Description of Artificial Sequence: Synthetic polypeptide
DEEEIRTTNPVATEQYGSVSTMNLIQEGENDI

SEQ ID NO: 23361 - protein, 31 aa, Artificial Sequence
  Description of Artificial Sequence: Synthetic polypeptide
DEEEIRTTNPVATEQYGSVSTNLDQTGGEID

SEQ ID NO: 23362 - protein, 28 aa, Artificial Sequence
  Description of Artificial Sequence: Synthetic peptide
NQEEIRTTNPVATEQWGTVSTNLQEGNI

SEQ ID NO: 23363 - protein, 28 aa, Artificial Sequence
  Description of Artificial Sequence: Synthetic peptide
NQEEIRTTNPVATEQWGTVSTNLQEGER

SEQ ID NO: 23364 - protein, 31 aa, Artificial Sequence
  Description of Artificial Sequence: Synthetic polypeptide
DEEEIRTTNPVATEQYGSVSTMNLIGGGNTT

SEQ ID NO: 23365 - protein, 29 aa, Artificial Sequence
  Description of Artificial Sequence: Synthetic peptide
DEEEIRTCNPVATEQYGSVSTPLQRNQAE

SEQ ID NO: 23366 - protein, 30 aa, Artificial Sequence
  Description of Artificial Sequence: Synthetic polypeptide
DEEEIRTCNPVATEQYGSVSTPLQGGNNQE

SEQ ID NO: 23367 - protein, 32 aa, Artificial Sequence
  Description of Artificial Sequence: Synthetic polypeptide
DEEEIRTTNPVATEQYGCVSTPNPQERGSNRS

SEQ ID NO: 23368 - protein, 31 aa, Artificial Sequence
  Description of Artificial Sequence: Synthetic polypeptide
DEEEIRTTNPVATEQYGSVSGTNNELQFTND

SEQ ID NO: 23369 - protein, 31 aa, Artificial Sequence
  Description of Artificial Sequence: Synthetic polypeptide
DEEEIRTCNPVATEQYGSVSTNGGQRGNQEI

SEQ ID NO: 23370 - protein, 32 aa, Artificial Sequence
  Description of Artificial Sequence: Synthetic polypeptide
DEEEIRTTNPVATEQYGSVSTMNLGQSGENDI

SEQ ID NO: 23371 - protein, 30 aa, Artificial Sequence
  Description of Artificial Sequence: Synthetic polypeptide
AEEEIRTTNPVATEQYGSVVVTNEQQQGNR

SEQ ID NO: 23372 - protein, 29 aa, Artificial Sequence
  Description of Artificial Sequence: Synthetic peptide
DEEEIRTCNPVATEQYGSVSTMLQRNQEG

SEQ ID NO: 23373 - protein, 28 aa, Artificial Sequence
  Description of Artificial Sequence: Synthetic peptide
DECEIRATNPVATEPYGSVSTNEQQGNL

SEQ ID NO: 23374 - protein, 30 aa, Artificial Sequence
  Description of Artificial Sequence: Synthetic polypeptide
DEEEIRTTNPVATEQYGCVSTPLQNGDNPE

SEQ ID NO: 23375 - protein, 31 aa, Artificial Sequence
  Description of Artificial Sequence: Synthetic polypeptide
AEEEIRTTNPVATEQYGSVVVTENLQGGNQR

SEQ ID NO: 23376 - protein, 32 aa, Artificial Sequence
  Description of Artificial Sequence: Synthetic polypeptide
DEEEIRTTNPVATEQYGSVSGTNNGLQEGGNS

SEQ ID NO: 23377 - protein, 29 aa, Artificial Sequence
  Description of Artificial Sequence: Synthetic peptide
NVEEIRTTNPVATEQYGVVSTNLQDGGNI

SEQ ID NO: 23378 - protein, 29 aa, Artificial Sequence
  Description of Artificial Sequence: Synthetic peptide
DEEEIRTCNPVATEQYGSVSTVDLQRNQE

SEQ ID NO: 23379 - protein, 31 aa, Artificial Sequence
  Description of Artificial Sequence: Synthetic polypeptide
DEEEIRTTNPCATEQYGSVSTNLQPRGDTEQ

SEQ ID NO: 23380 - protein, 30 aa, Artificial Sequence
  Description of Artificial Sequence: Synthetic polypeptide
DEEEIRTTNPCATEQYGSVSTNLQQENDTV

SEQ ID NO: 23381 - protein, 31 aa, Artificial Sequence
  Description of Artificial Sequence: Synthetic polypeptide
DEEEIRTTNPCATEQYGSVSTNLQQQGEERN

SEQ ID NO: 23382 - protein, 28 aa, Artificial Sequence
  Description of Artificial Sequence: Synthetic peptide
DEEEIRTTNCVATEQWGSVSTNIETGQR

SEQ ID NO: 23383 - protein, 30 aa, Artificial Sequence
  Description of Artificial Sequence: Synthetic polypeptide
DEEEIRTTNPCATEQYGSVSTNLQRDTEPA

SEQ ID NO: 23384 - protein, 31 aa, Artificial Sequence
  Description of Artificial Sequence: Synthetic polypeptide
DEEEIRTTNPCATEQYGSVSTNLQREDNGDD

SEQ ID NO: 23385 - protein, 31 aa, Artificial Sequence
  Description of Artificial Sequence: Synthetic polypeptide
DEEEIRTTNPCATEQYGSVSTNLQRESNDAD

SEQ ID NO: 23386 - protein, 31 aa, Artificial Sequence
  Description of Artificial Sequence: Synthetic polypeptide
DEEEIRTTNPCATEQYGSVSTNLQRGGEMDE

SEQ ID NO: 23387 - protein, 28 aa, Artificial Sequence
  Description of Artificial Sequence: Synthetic peptide
QENEIATTNPVATEQYGDVSECLQRGNR

SEQ ID NO: 23388 - protein, 28 aa, Artificial Sequence
  Description of Artificial Sequence: Synthetic peptide
DEEEIRTCNPVAYEQYGSVSTRLQRVPE

SEQ ID NO: 23389 - protein, 30 aa, Artificial Sequence
  Description of Artificial Sequence: Synthetic polypeptide
DEEEIRTTNPCATEQYGSVSTNLQTGEEDL

SEQ ID NO: 23390 - protein, 28 aa, Artificial Sequence
  Description of Artificial Sequence: Synthetic peptide
QDEEIRTTNPVATECYGSVSTNLQHGET

SEQ ID NO: 23391 - protein, 28 aa, Artificial Sequence
  Description of Artificial Sequence: Synthetic peptide
DEEEIRTCNPVATEQYGSVSTTLQNNQE

SEQ ID NO: 23392 - protein, 29 aa, Artificial Sequence
  Description of Artificial Sequence: Synthetic peptide
QAEEICTTNPVATEQYGSVSTNLQHGNDD

SEQ ID NO: 23393 - protein, 31 aa, Artificial Sequence
  Description of Artificial Sequence: Synthetic polypeptide
DEEEIRTTNPVATEQYGSVSTNLDQGQNGGN

SEQ ID NO: 23394 - protein, 31 aa, Artificial Sequence
  Description of Artificial Sequence: Synthetic polypeptide
DEEEIRTTNPVATEQYGSVSTMNLNTDGGNQ

SEQ ID NO: 23395 - protein, 32 aa, Artificial Sequence
  Description of Artificial Sequence: Synthetic polypeptide
DEEEIRTTNPVATEQYGSVSGTNLVQGGGNDQ

SEQ ID NO: 23396 - protein, 32 aa, Artificial Sequence
  Description of Artificial Sequence: Synthetic polypeptide
DEEEIRTTNPVATEQYGSVSTNLDQIGNGNEG

SEQ ID NO: 23397 - protein, 31 aa, Artificial Sequence
  Description of Artificial Sequence: Synthetic polypeptide
DEEEIRTTNPVATEQYGSVSTNLDQQSVNEI

SEQ ID NO: 23398 - protein, 33 aa, Artificial Sequence
  Description of Artificial Sequence: Synthetic polypeptide
DEEEIRTTNPVATEQYGSVSTNLDQRFGSNNLQ

SEQ ID NO: 23399 - protein, 32 aa, Artificial Sequence
  Description of Artificial Sequence: Synthetic polypeptide
DEEEIRTTNPVATEQYGSVSTMNLNQGGSERQ

SEQ ID NO: 23400 - protein, 31 aa, Artificial Sequence
  Description of Artificial Sequence: Synthetic polypeptide
DEECIRTTNPVATEQYGSVSNTNLRDNGQNR

SEQ ID NO: 23401 - protein, 28 aa, Artificial Sequence
  Description of Artificial Sequence: Synthetic peptide
DECEIRTTNPVATDQYGSVNTQLQQGNF

SEQ ID NO: 23402 - protein, 32 aa, Artificial Sequence
  Description of Artificial Sequence: Synthetic polypeptide
DEEEIRTTNPVATEQYGSVSTMNLNQEDFGNF

SEQ ID NO: 23403 - protein, 31 aa, Artificial Sequence
  Description of Artificial Sequence: Synthetic polypeptide
DEEEIRTTNPVATEQYGCVSTTELNQNGSNR

SEQ ID NO: 23404 - protein, 28 aa, Artificial Sequence
  Description of Artificial Sequence: Synthetic peptide
DEEEIRTCNPVATEQYGSVSTVLQNNQK

SEQ ID NO: 23405 - protein, 32 aa, Artificial Sequence
  Description of Artificial Sequence: Synthetic polypeptide
DEEEIRTTNPCATEQYGSVSTNLSQSTGTNNR

SEQ ID NO: 23406 - protein, 28 aa, Artificial Sequence
  Description of Artificial Sequence: Synthetic peptide
QEEEIACTNPIATEQYGSVSENLMRGNR

SEQ ID NO: 23407 - protein, 29 aa, Artificial Sequence
  Description of Artificial Sequence: Synthetic peptide
DEEEIRTCNPVATEQYGSVSTLLQRNEEQ

SEQ ID NO: 23408 - protein, 30 aa, Artificial Sequence
  Description of Artificial Sequence: Synthetic polypeptide
NNEEIRTTNPVATEQYGVVSTNLQQDGVNR

SEQ ID NO: 23409 - protein, 29 aa, Artificial Sequence
  Description of Artificial Sequence: Synthetic peptide
NNEEIRTTNPVATEQYGVVSTNLQDGGNM

SEQ ID NO: 23410 - protein, 30 aa, Artificial Sequence
  Description of Artificial Sequence: Synthetic polypeptide
DEEEIRTTNPVATEQYGSVSTNLDVSTGRI

SEQ ID NO: 23411 - protein, 30 aa, Artificial Sequence
  Description of Artificial Sequence: Synthetic polypeptide
NNEEIRTTNPVATEQYGVVSTNLQDGDNRL

SEQ ID NO: 23412 - protein, 29 aa, Artificial Sequence
  Description of Artificial Sequence: Synthetic peptide
NNEEIRTTNPVATEQYGVVSTNLQDEVNR

SEQ ID NO: 23413 - protein, 32 aa, Artificial Sequence
  Description of Artificial Sequence: Synthetic polypeptide
DEEEIRTTNPVATEQYGSVSTMNLEQGGGNGN

SEQ ID NO: 23414 - protein, 30 aa, Artificial Sequence
  Description of Artificial Sequence: Synthetic polypeptide
DEEEIRTTNPVATEQYGSVSTNLDVTGEEQ

SEQ ID NO: 23415 - protein, 31 aa, Artificial Sequence
  Description of Artificial Sequence: Synthetic polypeptide
AEEEIRTTNPVATEQYGSVVVTNNLQDGNQR

SEQ ID NO: 23416 - protein, 30 aa, Artificial Sequence
  Description of Artificial Sequence: Synthetic polypeptide
DEEEIRTCNPVATEQYGSVSTGDLQRNGQE

SEQ ID NO: 23417 - protein, 31 aa, Artificial Sequence
  Description of Artificial Sequence: Synthetic polypeptide
DEEEIRTTNPVATEQYGSVSTNLDVTGINEG

SEQ ID NO: 23418 - protein, 31 aa, Artificial Sequence
  Description of Artificial Sequence: Synthetic polypeptide
DEEEIRTTNPVATEQYGSVSTNLDVTGNEED

SEQ ID NO: 23419 - protein, 28 aa, Artificial Sequence
  Description of Artificial Sequence: Synthetic peptide
DEEEIRTCNPVATEQYGSVSTELQNNQF

SEQ ID NO: 23420 - protein, 28 aa, Artificial Sequence
  Description of Artificial Sequence: Synthetic peptide
DEEEIRTCNPVATEQYGSVSTDLQSNQE

SEQ ID NO: 23421 - protein, 31 aa, Artificial Sequence
  Description of Artificial Sequence: Synthetic polypeptide
DEEEIRTTNPVATEQYGSVSTNLDVDGSNES

SEQ ID NO: 23422 - protein, 30 aa, Artificial Sequence
  Description of Artificial Sequence: Synthetic polypeptide
DEEEIRTTNPVATEQYGSVSTNLDYLFNGQ

SEQ ID NO: 23423 - protein, 29 aa, Artificial Sequence
  Description of Artificial Sequence: Synthetic peptide
DEEEIRTTNPVATEQYGCVSTPLERNNQA

SEQ ID NO: 23424 - protein, 28 aa, Artificial Sequence
  Description of Artificial Sequence: Synthetic peptide
DEEEIRTCNPVATEQYGSVSTDGQRNQD

SEQ ID NO: 23425 - protein, 30 aa, Artificial Sequence
  Description of Artificial Sequence: Synthetic polypeptide
DEEEIRTTNPVATEQYGSVSTNLDYMQNGQ

SEQ ID NO: 23426 - protein, 29 aa, Artificial Sequence
  Description of Artificial Sequence: Synthetic peptide
DEEEIRTCNPVATEQYGSVSSRLQGGNQE

SEQ ID NO: 23427 - protein, 29 aa, Artificial Sequence
  Description of Artificial Sequence: Synthetic peptide
DEEEIRTCNPVATEQYGSVSCTRLQRPSE

SEQ ID NO: 23428 - protein, 29 aa, Artificial Sequence
  Description of Artificial Sequence: Synthetic peptide
DEEEIRTCNPVATEQYGSVCSTLLQRNQE

SEQ ID NO: 23429 - protein, 28 aa, Artificial Sequence
  Description of Artificial Sequence: Synthetic peptide
QESEIRCTNPIATEQYGSVSENLMRGNR

SEQ ID NO: 23430 - protein, 28 aa, Artificial Sequence
  Description of Artificial Sequence: Synthetic peptide
DEEEIRTTNPCATEQYGSVSVNISDGND

SEQ ID NO: 23431 - protein, 28 aa, Artificial Sequence
  Description of Artificial Sequence: Synthetic peptide
QESEIRCTNPVATEQYGSVSSNLQRGDI

SEQ ID NO: 23432 - protein, 29 aa, Artificial Sequence
  Description of Artificial Sequence: Synthetic peptide
DEEEIRTTNPCATEQYGSVSVNNIFRGND

SEQ ID NO: 23433 - protein, 29 aa, Artificial Sequence
  Description of Artificial Sequence: Synthetic peptide
DEEEIRSVNPVCTEQYGVVSTDNLQRGNQ

SEQ ID NO: 23434 - protein, 30 aa, Artificial Sequence
  Description of Artificial Sequence: Synthetic polypeptide
AEEEIRTTNPVATEQYGSVVVTNNQQGGNR

SEQ ID NO: 23435 - protein, 29 aa, Artificial Sequence
  Description of Artificial Sequence: Synthetic peptide
DEEEIRTCNPVATEQYGSVSTDLQRNDQE

SEQ ID NO: 23436 - protein, 32 aa, Artificial Sequence
  Description of Artificial Sequence: Synthetic polypeptide
DEEEIRTTNPVATEQYGCVSTPLMQRSGSNRT

SEQ ID NO: 23437 - protein, 30 aa, Artificial Sequence
  Description of Artificial Sequence: Synthetic polypeptide
NNEEIRTTNPVATEQYGVVSTNLQDGNNRP

SEQ ID NO: 23438 - protein, 33 aa, Artificial Sequence
  Description of Artificial Sequence: Synthetic polypeptide
DEEEIRTTNPVATEQYGSVSTNLDTRNGENGRG

SEQ ID NO: 23439 - protein, 30 aa, Artificial Sequence
  Description of Artificial Sequence: Synthetic polypeptide
NNEEIRTTNPVATEQYGVVSTNLQNDGTNR

SEQ ID NO: 23440 - protein, 29 aa, Artificial Sequence
  Description of Artificial Sequence: Synthetic peptide
DEEEIRTTNPCATEQYGSVSTYNQIAGND

SEQ ID NO: 23441 - protein, 30 aa, Artificial Sequence
  Description of Artificial Sequence: Synthetic polypeptide
NNEEIRTTNPVATEQYGVVSTNLQIGPNDR

SEQ ID NO: 23442 - protein, 29 aa, Artificial Sequence
  Description of Artificial Sequence: Synthetic peptide
NNEEIRTTNPVATEQYGVVSTNLQIDPNR

SEQ ID NO: 23443 - protein, 30 aa, Artificial Sequence
  Description of Artificial Sequence: Synthetic polypeptide
AEEEIRTTNPVATEQYGSVVVTNLGQTGNE

SEQ ID NO: 23444 - protein, 29 aa, Artificial Sequence
  Description of Artificial Sequence: Synthetic peptide
NNEEIRTTNPVATEQYGVVSTNLQGGANT

SEQ ID NO: 23445 - protein, 29 aa, Artificial Sequence
  Description of Artificial Sequence: Synthetic peptide
QEQEISTTNPVATEQYGDVSAENLQRGNR

SEQ ID NO: 23446 - protein, 30 aa, Artificial Sequence
  Description of Artificial Sequence: Synthetic polypeptide
NNEEIRTTNPVATEQYGVVSTNLQEEGPNR

SEQ ID NO: 23447 - protein, 29 aa, Artificial Sequence
  Description of Artificial Sequence: Synthetic peptide
DECEIHTTNPVATEQYGSVSTNLNYGVNT

SEQ ID NO: 23448 - protein, 28 aa, Artificial Sequence
  Description of Artificial Sequence: Synthetic peptide
DEEEIRTCNPVATEQYGSVSTGNQRNQE

SEQ ID NO: 23449 - protein, 29 aa, Artificial Sequence
  Description of Artificial Sequence: Synthetic peptide
DECEIHTTNPVATEQYGSVSTNLNDGNTQ

SEQ ID NO: 23450 - protein, 30 aa, Artificial Sequence
  Description of Artificial Sequence: Synthetic polypeptide
DEEEIRTTNPVATEQYGCVSTPLIRGSNQA

SEQ ID NO: 23451 - protein, 31 aa, Artificial Sequence
  Description of Artificial Sequence: Synthetic polypeptide
AEEEIRTTNPVATEQYGSVVVTNLQVGGNQR

SEQ ID NO: 23452 - protein, 31 aa, Artificial Sequence
  Description of Artificial Sequence: Synthetic polypeptide
DEEEIRTTNPVATEQYGSVSTMNLFEGINTD

SEQ ID NO: 23453 - protein, 28 aa, Artificial Sequence
  Description of Artificial Sequence: Synthetic peptide
DEEEIRTCNPVATEQYGSVSTGLERNQE

SEQ ID NO: 23454 - protein, 29 aa, Artificial Sequence
  Description of Artificial Sequence: Synthetic peptide
DECEIGTTNPVATEQYGSVSTNLMYEGNM

SEQ ID NO: 23455 - protein, 30 aa, Artificial Sequence
  Description of Artificial Sequence: Synthetic polypeptide
DEEEIRTTNPCATEQYGSVSVNGEQRGERQ

SEQ ID NO: 23456 - protein, 28 aa, Artificial Sequence
  Description of Artificial Sequence: Synthetic peptide
DECEIGTTNPVATEQYGCVSTNLMNGNT

SEQ ID NO: 23457 - protein, 31 aa, Artificial Sequence
  Description of Artificial Sequence: Synthetic polypeptide
DEEEIRTTNPVATEQYGSVSTNLDRSINFQS

SEQ ID NO: 23458 - protein, 28 aa, Artificial Sequence
  Description of Artificial Sequence: Synthetic peptide
DEEEIRTTNPCATEQYGSVSVNGLYGND

SEQ ID NO: 23459 - protein, 28 aa, Artificial Sequence
  Description of Artificial Sequence: Synthetic peptide
DEEEIRTTNPCATEQYGSVSVNIFRVNN

SEQ ID NO: 23460 - protein, 31 aa, Artificial Sequence
  Description of Artificial Sequence: Synthetic polypeptide
DEEEIRTTNPVATEQYGSVSTNLDSNGEDRY

SEQ ID NO: 23461 - protein, 30 aa, Artificial Sequence
  Description of Artificial Sequence: Synthetic polypeptide
AEEEIRTTNPVATEQYGSVVVTNLQQQGNT

SEQ ID NO: 23462 - protein, 28 aa, Artificial Sequence
  Description of Artificial Sequence: Synthetic peptide
DEEEIRTTNPCATEQYGSVSVNIIEGND

SEQ ID NO: 23463 - protein, 30 aa, Artificial Sequence
  Description of Artificial Sequence: Synthetic polypeptide
DEECIRTTNPVATEQYGSVCSTALQRSGEQ

SEQ ID NO: 23464 - protein, 29 aa, Artificial Sequence
  Description of Artificial Sequence: Synthetic peptide
NNEEIRTTNPVATEQYGVVSTNLQDGNNT

SEQ ID NO: 23465 - protein, 29 aa, Artificial Sequence
  Description of Artificial Sequence: Synthetic peptide
AEEEIRTTNPVATEQYGSVVVTNLQEQNV

SEQ ID NO: 23466 - protein, 31 aa, Artificial Sequence
  Description of Artificial Sequence: Synthetic polypeptide
DEEEIRTTNPCATEQYGSVSTNLQNSGSNQQ

SEQ ID NO: 23467 - protein, 28 aa, Artificial Sequence
  Description of Artificial Sequence: Synthetic peptide
QEEEIACTNPVATEGYGSVSENLMRGNR

SEQ ID NO: 23468 - protein, 32 aa, Artificial Sequence
  Description of Artificial Sequence: Synthetic polypeptide
DEEEIRTTNPVATEQYGSVSTNLDQEVGNNDD

SEQ ID NO: 23469 - protein, 28 aa, Artificial Sequence
  Description of Artificial Sequence: Synthetic peptide
DEEEIRTTNPCATEQYGSVPTPLTRGDE

SEQ ID NO: 23470 - protein, 28 aa, Artificial Sequence
  Description of Artificial Sequence: Synthetic peptide
QEEEIASTNPVATEQYGSMSENLMRGNR

SEQ ID NO: 23471 - protein, 28 aa, Artificial Sequence
  Description of Artificial Sequence: Synthetic peptide
DEEEIRTTNPCATEQYGSVPTVLARGEG

SEQ ID NO: 23472 - protein, 28 aa, Artificial Sequence
  Description of Artificial Sequence: Synthetic peptide
DEDEIATTNPVATDQYGSVATTLQRGND

SEQ ID NO: 23473 - protein, 30 aa, Artificial Sequence
  Description of Artificial Sequence: Synthetic polypeptide
DEECIRTTNPVATEQYGSVSTNLQFPSNQY

SEQ ID NO: 23474 - protein, 31 aa, Artificial Sequence
  Description of Artificial Sequence: Synthetic polypeptide
DEEEIRTTNPVATEQYGSVSTMNLQVIDLRS

SEQ ID NO: 23475 - protein, 32 aa, Artificial Sequence
  Description of Artificial Sequence: Synthetic polypeptide
DECEIRTTNPVATEQYGSVSTNLNQDGNGNDR

SEQ ID NO: 23476 - protein, 32 aa, Artificial Sequence
  Description of Artificial Sequence: Synthetic polypeptide
DEEEIRTTNPVATEQYGSVSTMNLQTNGNTDV

SEQ ID NO: 23477 - protein, 28 aa, Artificial Sequence
  Description of Artificial Sequence: Synthetic peptide
QEEEIAPTNPIATEQYGSVSENLMRGNR

SEQ ID NO: 23478 - protein, 32 aa, Artificial Sequence
  Description of Artificial Sequence: Synthetic polypeptide
DEEEIRTTNPVATEQYGSVSTMNLQTEDGTNE

SEQ ID NO: 23479 - protein, 28 aa, Artificial Sequence
  Description of Artificial Sequence: Synthetic peptide
DEEEIRTTNPCATEQYGSVPTWLARGKH

SEQ ID NO: 23480 - protein, 28 aa, Artificial Sequence
  Description of Artificial Sequence: Synthetic peptide
QEGEIATTNPVATEQYGSVATNLQGGER

SEQ ID NO: 23481 - protein, 28 aa, Artificial Sequence
  Description of Artificial Sequence: Synthetic peptide
DEEEIRTTNPCATEQYGSVPTILERGME

SEQ ID NO: 23482 - protein, 28 aa, Artificial Sequence
  Description of Artificial Sequence: Synthetic peptide
DEEEIRTTNPCATEQYGSVPTWLERGVE

SEQ ID NO: 23483 - protein, 32 aa, Artificial Sequence
  Description of Artificial Sequence: Synthetic polypeptide
DEEEIRTTNPVATEQYGSVSTMNLQSGGGNGD

SEQ ID NO: 23484 - protein, 32 aa, Artificial Sequence
  Description of Artificial Sequence: Synthetic polypeptide
DECEIRTTNPVATEQYGSVSTNLEQGGAGNSR

SEQ ID NO: 23485 - protein, 30 aa, Artificial Sequence
  Description of Artificial Sequence: Synthetic polypeptide
DECEIRTTNPVATEQYGSVSTNLDANGNED

SEQ ID NO: 23486 - protein, 30 aa, Artificial Sequence
  Description of Artificial Sequence: Synthetic polypeptide
DEEEIRTTNPVATEQYGCVSTYDQYGSNRF

SEQ ID NO: 23487 - protein, 31 aa, Artificial Sequence
  Description of Artificial Sequence: Synthetic polypeptide
DEEEIRTTNPVATEQYGKVSTNLSQPGGNQE

SEQ ID NO: 23488 - protein, 28 aa, Artificial Sequence
  Description of Artificial Sequence: Synthetic peptide
QEGEIRCTNPCATEQYGSVSENLQSGNR

SEQ ID NO: 23489 - protein, 29 aa, Artificial Sequence
  Description of Artificial Sequence: Synthetic peptide
DECEIRTTNPVATEQYGSVSTNDNSSGER

SEQ ID NO: 23490 - protein, 30 aa, Artificial Sequence
  Description of Artificial Sequence: Synthetic polypeptide
DECEIRTTNPVATEQYGSVSTINQGGNTNR

SEQ ID NO: 23491 - protein, 28 aa, Artificial Sequence
  Description of Artificial Sequence: Synthetic peptide
DEEEIRTTNPAATEQYGSVPTWLPRGEE

SEQ ID NO: 23492 - protein, 28 aa, Artificial Sequence
  Description of Artificial Sequence: Synthetic peptide
QEEEIACTNPVATEQYGSVSENLQHGER

SEQ ID NO: 23493 - protein, 32 aa, Artificial Sequence
  Description of Artificial Sequence: Synthetic polypeptide
DECEIRTTNPVATEQYGSVSTGNLQDHEGNER

SEQ ID NO: 23494 - protein, 28 aa, Artificial Sequence
  Description of Artificial Sequence: Synthetic peptide
QEEEIACTNPVATEQYGSVSECLQRENR

SEQ ID NO: 23495 - protein, 30 aa, Artificial Sequence
  Description of Artificial Sequence: Synthetic polypeptide
DEDEIATTNPVATEAYGSVSTNLQEGDENR

SEQ ID NO: 23496 - protein, 31 aa, Artificial Sequence
  Description of Artificial Sequence: Synthetic polypeptide
DEEEIRTTNPCATEQYGSVSANLQRGDNEHN

SEQ ID NO: 23497 - protein, 28 aa, Artificial Sequence
  Description of Artificial Sequence: Synthetic peptide
DEEEIRTTNPAATEQYGSVSVNIFDGNI

SEQ ID NO: 23498 - protein, 31 aa, Artificial Sequence
  Description of Artificial Sequence: Synthetic polypeptide
DEEEIRTTNPVATEQYGKVSTGNELQRGGSE

SEQ ID NO: 23499 - protein, 30 aa, Artificial Sequence
  Description of Artificial Sequence: Synthetic polypeptide
QEEEIATTNPVATEGYGSVSTNLQGGNDRH

SEQ ID NO: 23500 - protein, 28 aa, Artificial Sequence
  Description of Artificial Sequence: Synthetic peptide
DEEEIRTTNPCATEAYGSCSTNLEAGNG

SEQ ID NO: 23501 - protein, 29 aa, Artificial Sequence
  Description of Artificial Sequence: Synthetic peptide
AEEEIRTTNPVATEQYGSVSVNLGNDGNS

SEQ ID NO: 23502 - protein, 28 aa, Artificial Sequence
  Description of Artificial Sequence: Synthetic peptide
QEEEIATTNPVATECYGDVSENLQRGNL

SEQ ID NO: 23503 - protein, 30 aa, Artificial Sequence
  Description of Artificial Sequence: Synthetic polypeptide
DECEIRTTNPVATEQYGTVSTNLQGGNNNS

SEQ ID NO: 23504 - protein, 29 aa, Artificial Sequence
  Description of Artificial Sequence: Synthetic peptide
AEEEIRTTNPVATEQYGSVSVNIQNGNNS

SEQ ID NO: 23505 - protein, 29 aa, Artificial Sequence
  Description of Artificial Sequence: Synthetic peptide
AEEEIRTTNPVATEQYGSVSVGNQQVGNN

SEQ ID NO: 23506 - protein, 30 aa, Artificial Sequence
  Description of Artificial Sequence: Synthetic polypeptide
AEEEIRTTNPVATEQYGSVSVGNLQNGNSA

SEQ ID NO: 23507 - protein, 31 aa, Artificial Sequence
  Description of Artificial Sequence: Synthetic polypeptide
DEEEIRTTNPVATEQYGSVSTMNNDQQNGNS

SEQ ID NO: 23508 - protein, 28 aa, Artificial Sequence
  Description of Artificial Sequence: Synthetic peptide
QEEEIATTNPIATEQYGDVSECLQRGNR

SEQ ID NO: 23509 - protein, 29 aa, Artificial Sequence
  Description of Artificial Sequence: Synthetic peptide
AEEEIRTTNPVATEQYGSVSVENLVTGNE

SEQ ID NO: 23510 - protein, 31 aa, Artificial Sequence
  Description of Artificial Sequence: Synthetic polypeptide
DECEIRTTNPVATEQYGSVSTNMQEQGDNDR

SEQ ID NO: 23511 - protein, 28 aa, Artificial Sequence
  Description of Artificial Sequence: Synthetic peptide
DEEEIRTTNPAATEQYGSVSVNITGGND

SEQ ID NO: 23512 - protein, 30 aa, Artificial Sequence
  Description of Artificial Sequence: Synthetic polypeptide
DEEEIRTTNPVATEQYGKVACTNLDTGGNR

SEQ ID NO: 23513 - protein, 29 aa, Artificial Sequence
  Description of Artificial Sequence: Synthetic peptide
DEEEIRTTNPVATEQYGCVSWELQRGSEF

SEQ ID NO: 23514 - protein, 32 aa, Artificial Sequence
  Description of Artificial Sequence: Synthetic polypeptide
DEEEIRTTNPVATEQYGSVSTMNLVQQEGEND

SEQ ID NO: 23515 - protein, 32 aa, Artificial Sequence
  Description of Artificial Sequence: Synthetic polypeptide
DEEEIRTTNPVATEQYGKVPSCTGLQNRGGNR

SEQ ID NO: 23516 - protein, 31 aa, Artificial Sequence
  Description of Artificial Sequence: Synthetic polypeptide
DEEEIRTTNPVATEQYGKVPSCTNLSTQGNR

SEQ ID NO: 23517 - protein, 32 aa, Artificial Sequence
  Description of Artificial Sequence: Synthetic polypeptide
DEEEIRTTNPVATEQYGSVSTMNLVQNEIGNQ

SEQ ID NO: 23518 - protein, 32 aa, Artificial Sequence
  Description of Artificial Sequence: Synthetic polypeptide
DEEEIRTTNPVATEQYGKVPSTNLSQPGGNRA

SEQ ID NO: 23519 - protein, 32 aa, Artificial Sequence
  Description of Artificial Sequence: Synthetic polypeptide
DECEIRTTNPVATEQYGSVSTNLQGNEGENDR

SEQ ID NO: 23520 - protein, 32 aa, Artificial Sequence
  Description of Artificial Sequence: Synthetic polypeptide
DEEEIRTTNPVATEQYGKVSCTGNALQDTGNR

SEQ ID NO: 23521 - protein, 32 aa, Artificial Sequence
  Description of Artificial Sequence: Synthetic polypeptide
DEEEIRTTNPVATEQYGSVSTMNLVNQEGGNQ

SEQ ID NO: 23522 - protein, 29 aa, Artificial Sequence
  Description of Artificial Sequence: Synthetic peptide
AEEEIRTTNPVATEQYGSVSVALQIGGNN

SEQ ID NO: 23523 - protein, 28 aa, Artificial Sequence
  Description of Artificial Sequence: Synthetic peptide
DEEEIRTTNPAATETYGSCSTALARGNG

SEQ ID NO: 23524 - protein, 32 aa, Artificial Sequence
  Description of Artificial Sequence: Synthetic polypeptide
DEEEIRTTNPVATEQYGKVSCTNGLQRGGNND

SEQ ID NO: 23525 - protein, 31 aa, Artificial Sequence
  Description of Artificial Sequence: Synthetic polypeptide
DEEEIRTTNPVATEQYGSVSTMNMERGMVRD

SEQ ID NO: 23526 - protein, 28 aa, Artificial Sequence
  Description of Artificial Sequence: Synthetic peptide
DEEEIRTTNPAATEQYGSVPTVLARGKD

SEQ ID NO: 23527 - protein, 30 aa, Artificial Sequence
  Description of Artificial Sequence: Synthetic polypeptide
DECEIRTTNPVATEQYGSVSTGLEDRGSNG

SEQ ID NO: 23528 - protein, 32 aa, Artificial Sequence
  Description of Artificial Sequence: Synthetic polypeptide
DEEEIRTTNPVATEQYGSVSTMNLQREVVNED

SEQ ID NO: 23529 - protein, 29 aa, Artificial Sequence
  Description of Artificial Sequence: Synthetic peptide
DEEEIRTTNPCATEQYGSVSQNAIFRGND

SEQ ID NO: 23530 - protein, 31 aa, Artificial Sequence
  Description of Artificial Sequence: Synthetic polypeptide
AEEEIRTTNPVATEQYGSVVVSTNLQSGVNE

SEQ ID NO: 23531 - protein, 31 aa, Artificial Sequence
  Description of Artificial Sequence: Synthetic polypeptide
AEEEIRTTNPVATEQYGSVVVSTNLQTGTNM

SEQ ID NO: 23532 - protein, 31 aa, Artificial Sequence
  Description of Artificial Sequence: Synthetic polypeptide
AEEEIRTTNPVATEQYGSVVVSTNLQVEGNG

SEQ ID NO: 23533 - protein, 31 aa, Artificial Sequence
  Description of Artificial Sequence: Synthetic polypeptide
DEEEIRTTNPVATEQYGCVSTTNLERIGSNM

SEQ ID NO: 23534 - protein, 28 aa, Artificial Sequence
  Description of Artificial Sequence: Synthetic peptide
DEEEIRTTNPCATEQYGSVSSNIFHGND

SEQ ID NO: 23535 - protein, 31 aa, Artificial Sequence
  Description of Artificial Sequence: Synthetic polypeptide
DEEEIRTTNPVATEQYGCVSTTNLERGNQDE

SEQ ID NO: 23536 - protein, 30 aa, Artificial Sequence
  Description of Artificial Sequence: Synthetic polypeptide
DECEIRTTNPVATEQYGCVSTVLQRGDQRD

SEQ ID NO: 23537 - protein, 31 aa, Artificial Sequence
  Description of Artificial Sequence: Synthetic polypeptide
DEEEIRTTNPVATEQYGSVSTNLDLGNINNS

SEQ ID NO: 23538 - protein, 32 aa, Artificial Sequence
  Description of Artificial Sequence: Synthetic polypeptide
AEEEIRTTNPVATEQYGSVVVSTNNLQEGTNR

SEQ ID NO: 23539 - protein, 30 aa, Artificial Sequence
  Description of Artificial Sequence: Synthetic polypeptide
DEEEIRTTNPVATEQYGSVSTNLDLQTDVV

SEQ ID NO: 23540 - protein, 32 aa, Artificial Sequence
  Description of Artificial Sequence: Synthetic polypeptide
DEEEIRTTNPVATEQYGCVSTTNEQERGQNPR

SEQ ID NO: 23541 - protein, 32 aa, Artificial Sequence
  Description of Artificial Sequence: Synthetic polypeptide
DEEEIRTTNPVATEQYGCVSTTNLQRGDNDQE

SEQ ID NO: 23542 - protein, 31 aa, Artificial Sequence
  Description of Artificial Sequence: Synthetic polypeptide
DEEEIRTTNPVATEQYGSVSTMNLQFGELVS

SEQ ID NO: 23543 - protein, 31 aa, Artificial Sequence
  Description of Artificial Sequence: Synthetic polypeptide
DEEEIRTTNPVATEQYGSVSTNLDMVYGEDR

SEQ ID NO: 23544 - protein, 30 aa, Artificial Sequence
  Description of Artificial Sequence: Synthetic polypeptide
DEEEIRTTNPVATEQYGSVSTNLDNGIGGT

SEQ ID NO: 23545 - protein, 29 aa, Artificial Sequence
  Description of Artificial Sequence: Synthetic peptide
DEEEIRTTNPAATEGYGSCSTNLARGNDD

SEQ ID NO: 23546 - protein, 31 aa, Artificial Sequence
  Description of Artificial Sequence: Synthetic polypeptide
AEEEIRTTNPVATEQYGSVVVSTNQLQNGNQ

SEQ ID NO: 23547 - protein, 30 aa, Artificial Sequence
  Description of Artificial Sequence: Synthetic polypeptide
DEEEIRTTNPVATEQYGSVSTNLDPPGIEQ

SEQ ID NO: 23548 - protein, 29 aa, Artificial Sequence
  Description of Artificial Sequence: Synthetic peptide
DEEEIRTTNPAATECYGSCSTNLGRGNGN

SEQ ID NO: 23549 - protein, 30 aa, Artificial Sequence
  Description of Artificial Sequence: Synthetic polypeptide
DECEIRTTNPVATEPYGSVSTNLQMGEGDR

SEQ ID NO: 23550 - protein, 32 aa, Artificial Sequence
  Description of Artificial Sequence: Synthetic polypeptide
DEEEIRTTNPVATEQYGSVSTMNLQEIIDNRS

SEQ ID NO: 23551 - protein, 32 aa, Artificial Sequence
  Description of Artificial Sequence: Synthetic polypeptide
DEEEIRTTNPVATEQYGSVSTMNLQEGGVNED

SEQ ID NO: 23552 - protein, 31 aa, Artificial Sequence
  Description of Artificial Sequence: Synthetic polypeptide
DEEEIRTTNPCATEQYGSVSTNLQAEDNERD

SEQ ID NO: 23553 - protein, 30 aa, Artificial Sequence
  Description of Artificial Sequence: Synthetic polypeptide
DEEEIRTTNPCATEQYGSVSTNLQGGPEAQ

SEQ ID NO: 23554 - protein, 31 aa, Artificial Sequence
  Description of Artificial Sequence: Synthetic polypeptide
DEEEIRTTNPCATEQYGSVSTNLQGGPEPRP

SEQ ID NO: 23555 - protein, 29 aa, Artificial Sequence
  Description of Artificial Sequence: Synthetic peptide
DECEIRTTNPVATEQYGCVSTELQRFPND

SEQ ID NO: 23556 - protein, 28 aa, Artificial Sequence
  Description of Artificial Sequence: Synthetic peptide
DECEIRTTNPVATEQYGMVSTKLQRNTD

SEQ ID NO: 23557 - protein, 32 aa, Artificial Sequence
  Description of Artificial Sequence: Synthetic polypeptide
DEEEIRTTNPVATEQYGSVSTMNLQGSGGNQQ

SEQ ID NO: 23558 - protein, 31 aa, Artificial Sequence
  Description of Artificial Sequence: Synthetic polypeptide
DECEIRTTNPVATEQYGNVSTNLQRDGDNNS

SEQ ID NO: 23559 - protein, 32 aa, Artificial Sequence
  Description of Artificial Sequence: Synthetic polypeptide
DEEEIRTTNPVATEQYGSVSTMNLQQGVGNTD

SEQ ID NO: 23560 - protein, 32 aa, Artificial Sequence
  Description of Artificial Sequence: Synthetic polypeptide
DEEEIRTTNPVATEQYGSVSTMNLQQGQNGEQ

SEQ ID NO: 23561 - protein, 28 aa, Artificial Sequence
  Description of Artificial Sequence: Synthetic peptide
DEEEIRTTNPCATEQYGSVSENIIAGND

SEQ ID NO: 23562 - protein, 33 aa, Artificial Sequence
  Description of Artificial Sequence: Synthetic polypeptide
DEEEIRTTNPVATEQYGSVSTMNLQQETVGNLR

SEQ ID NO: 23563 - protein, 30 aa, Artificial Sequence
  Description of Artificial Sequence: Synthetic polypeptide
DEECIRTTNPVATEQYGSVSTNLENVGSNV

SEQ ID NO: 23564 - protein, 28 aa, Artificial Sequence
  Description of Artificial Sequence: Synthetic peptide
DEEEIRTTNPAATEQYGSVNYNGTRGND

SEQ ID NO: 23565 - protein, 29 aa, Artificial Sequence
  Description of Artificial Sequence: Synthetic peptide
DEEEIRTTNPCATEQYGSVSINGEFRGND

SEQ ID NO: 23566 - protein, 28 aa, Artificial Sequence
  Description of Artificial Sequence: Synthetic peptide
DEEEIRTTNPCATEQYGSVSININGGND

SEQ ID NO: 23567 - protein, 28 aa, Artificial Sequence
  Description of Artificial Sequence: Synthetic peptide
DEEEIRTTNPCATEQYGSVSININVGND

SEQ ID NO: 23568 - protein, 29 aa, Artificial Sequence
  Description of Artificial Sequence: Synthetic peptide
DEEEIRTTNPCATEQYGSVSNNIDRGNDQ

SEQ ID NO: 23569 - protein, 29 aa, Artificial Sequence
  Description of Artificial Sequence: Synthetic peptide
DEDEIATTNPVATEHYGSVSTNLQQGDRP

SEQ ID NO: 23570 - protein, 31 aa, Artificial Sequence
  Description of Artificial Sequence: Synthetic polypeptide
DEEEIRTTNPCATEQYGSVSNTTNLQQGNSA

SEQ ID NO: 23571 - protein, 29 aa, Artificial Sequence
  Description of Artificial Sequence: Synthetic peptide
DEEEIRTTNPCATEQYGSVSNVNDERGND

SEQ ID NO: 23572 - protein, 30 aa, Artificial Sequence
  Description of Artificial Sequence: Synthetic polypeptide
DEECIRTTNPVATEQYGSVSTNHNDNGQNR

SEQ ID NO: 23573 - protein, 32 aa, Artificial Sequence
  Description of Artificial Sequence: Synthetic polypeptide
DEEEIRTTNPVATEQYGSVSTMNLQNNFGNQN

SEQ ID NO: 23574 - protein, 30 aa, Artificial Sequence
  Description of Artificial Sequence: Synthetic polypeptide
DECEIRTTNPVATEQYGSVATTLGQEGNNR

SEQ ID NO: 23575 - protein, 32 aa, Artificial Sequence
  Description of Artificial Sequence: Synthetic polypeptide
DEEEIRTTNPVATEQYGSVSTMNLQLNIGNTP

SEQ ID NO: 23576 - protein, 30 aa, Artificial Sequence
  Description of Artificial Sequence: Synthetic polypeptide
DEEEIRTTNPAATEQYGSVIATNLQRNNNA

SEQ ID NO: 23577 - protein, 30 aa, Artificial Sequence
  Description of Artificial Sequence: Synthetic polypeptide
DEEEIRTTNPAATEQYGSVIATNLQRGVED

SEQ ID NO: 23578 - protein, 30 aa, Artificial Sequence
  Description of Artificial Sequence: Synthetic polypeptide
DEEEIRTTNPAATEQYGSVIATNLQRGIEA

SEQ ID NO: 23579 - protein, 30 aa, Artificial Sequence
  Description of Artificial Sequence: Synthetic polypeptide
AEEEIRTTNPVATEQYGSVVVSTDNQNGNR

SEQ ID NO: 23580 - protein, 31 aa, Artificial Sequence
  Description of Artificial Sequence: Synthetic polypeptide
DEEEIRTTNPVATEQYGSVSTNLDFGGNNNE

SEQ ID NO: 23581 - protein, 31 aa, Artificial Sequence
  Description of Artificial Sequence: Synthetic polypeptide
DEEEIRTTNPAATEQYGSVIATNLQREGNLA

SEQ ID NO: 23582 - protein, 30 aa, Artificial Sequence
  Description of Artificial Sequence: Synthetic polypeptide
DEEEIRTTNPAATEQYGSVIATDLQRGNDA

SEQ ID NO: 23583 - protein, 28 aa, Artificial Sequence
  Description of Artificial Sequence: Synthetic peptide
DEECIRTTNPVATEQYGSVSTHELRGET

SEQ ID NO: 23584 - protein, 30 aa, Artificial Sequence
  Description of Artificial Sequence: Synthetic polypeptide
DEEEIRTTNPVATEQYGCVSTVDQRIGNES

SEQ ID NO: 23585 - protein, 32 aa, Artificial Sequence
  Description of Artificial Sequence: Synthetic polypeptide
DEEEIRTTNPVATEQYGLVSTNLQLRGNGGGN

SEQ ID NO: 23586 - protein, 31 aa, Artificial Sequence
  Description of Artificial Sequence: Synthetic polypeptide
AEEEIRTTNPVATEQYGSVVSTTNLQEVGNG

SEQ ID NO: 23587 - protein, 31 aa, Artificial Sequence
  Description of Artificial Sequence: Synthetic polypeptide
AEEEIRTTNPVATEQYGSVSVTNLLQVGNTI

SEQ ID NO: 23588 - protein, 31 aa, Artificial Sequence
  Description of Artificial Sequence: Synthetic polypeptide
AEEEIRTTNPVATEQYGSVVSTTNLEQGGNA

SEQ ID NO: 23589 - protein, 31 aa, Artificial Sequence
  Description of Artificial Sequence: Synthetic polypeptide
DEEEIRTTNPVATEQYGSVSTNHQHGGSENA

SEQ ID NO: 23590 - protein, 28 aa, Artificial Sequence
  Description of Artificial Sequence: Synthetic peptide
QEEEIRCTNPVATEQYGVVSSTLQRGDR

SEQ ID NO: 23591 - protein, 28 aa, Artificial Sequence
  Description of Artificial Sequence: Synthetic peptide
QEEEIRCTNPVATEQYGVVSSTLMRGNR

SEQ ID NO: 23592 - protein, 30 aa, Artificial Sequence
  Description of Artificial Sequence: Synthetic polypeptide
QEEEIRCTNPVATEQYGSVSTNLQDRGTPE

SEQ ID NO: 23593 - protein, 29 aa, Artificial Sequence
  Description of Artificial Sequence: Synthetic peptide
DEEEIRTTNPCATEPYGSCSTNELARGNW

SEQ ID NO: 23594 - protein, 30 aa, Artificial Sequence
  Description of Artificial Sequence: Synthetic polypeptide
QEEEIRTTNPVATESYGSVSFTNLPRGDQR

SEQ ID NO: 23595 - protein, 31 aa, Artificial Sequence
  Description of Artificial Sequence: Synthetic polypeptide
DEECIRTTNPVATEQYYASVSSNLQRFGDNR

SEQ ID NO: 23596 - protein, 31 aa, Artificial Sequence
  Description of Artificial Sequence: Synthetic polypeptide
DEEEIRTTNPVATEQYGSVSTNDLLRDQNVV

SEQ ID NO: 23597 - protein, 30 aa, Artificial Sequence
  Description of Artificial Sequence: Synthetic polypeptide
QEEEIRTTNPVATESYGSVSNTNLTRGPQR

SEQ ID NO: 23598 - protein, 31 aa, Artificial Sequence
  Description of Artificial Sequence: Synthetic polypeptide
DEEEIRTTNPVATEQYGSVSTNFHQLRSMIR

SEQ ID NO: 23599 - protein, 31 aa, Artificial Sequence
  Description of Artificial Sequence: Synthetic polypeptide
DEEEIRTTNPCATEQYGSVAATNLQRGNVAV

SEQ ID NO: 23600 - protein, 30 aa, Artificial Sequence
  Description of Artificial Sequence: Synthetic polypeptide
DEEEIRTTNPVATEQYGSVSTNFLELGDEI

SEQ ID NO: 23601 - protein, 28 aa, Artificial Sequence
  Description of Artificial Sequence: Synthetic peptide
QEEEIRCTNPVATEQYGSVASNLMRGNI

SEQ ID NO: 23602 - protein, 30 aa, Artificial Sequence
  Description of Artificial Sequence: Synthetic polypeptide
DEEEIRTTNPCATEQYGSVAATNLQMGNEA

SEQ ID NO: 23603 - protein, 32 aa, Artificial Sequence
  Description of Artificial Sequence: Synthetic polypeptide
DEEEIRTTNPCATEQYGSVASTNLQDRGNNID

SEQ ID NO: 23604 - protein, 30 aa, Artificial Sequence
  Description of Artificial Sequence: Synthetic polypeptide
QEEEIRTTNPVAYEQYGSVATNLQRPGEPR

SEQ ID NO: 23605 - protein, 30 aa, Artificial Sequence
  Description of Artificial Sequence: Synthetic polypeptide
AEEEIRTTNPVATEQYGSVSVTVNLQVENN

SEQ ID NO: 23606 - protein, 28 aa, Artificial Sequence
  Description of Artificial Sequence: Synthetic peptide
QEEEIRCTNPVATEQYGSASENLQRGEK

SEQ ID NO: 23607 - protein, 32 aa, Artificial Sequence
  Description of Artificial Sequence: Synthetic polypeptide
DEEEIRTTNPVATEQYGSVSGTNLQGDGGNGE

SEQ ID NO: 23608 - protein, 28 aa, Artificial Sequence
  Description of Artificial Sequence: Synthetic peptide
DEEEIRTTNPCATEQYGSVATELARGME

SEQ ID NO: 23609 - protein, 28 aa, Artificial Sequence
  Description of Artificial Sequence: Synthetic peptide
QEEEIRCTNPVATEQYGSASENLMRGER

SEQ ID NO: 23610 - protein, 28 aa, Artificial Sequence
  Description of Artificial Sequence: Synthetic peptide
QEEEIRCTNPVATECYGSVSENLMRGER

SEQ ID NO: 23611 - protein, 28 aa, Artificial Sequence
  Description of Artificial Sequence: Synthetic peptide
QEEEIRCTNPIATEQYGVVSSNLMRGNR

SEQ ID NO: 23612 - protein, 32 aa, Artificial Sequence
  Description of Artificial Sequence: Synthetic polypeptide
DEEEIRTTNPVATEQYGSVSGTNLQGEGNGTE

SEQ ID NO: 23613 - protein, 31 aa, Artificial Sequence
  Description of Artificial Sequence: Synthetic polypeptide
AEEEIRTTNPVATEQYGSVSVTVNNLQTGND

SEQ ID NO: 23614 - protein, 28 aa, Artificial Sequence
  Description of Artificial Sequence: Synthetic peptide
QEEEIRCTNPIATEQYGTVSENLMRGNR

SEQ ID NO: 23615 - protein, 31 aa, Artificial Sequence
  Description of Artificial Sequence: Synthetic polypeptide
AEEEIRTTNPVATEQYGSVSVTNNLQSGNTA

SEQ ID NO: 23616 - protein, 29 aa, Artificial Sequence
  Description of Artificial Sequence: Synthetic peptide
QEEEIRTTNPVAYEQYGSVATNLQAGNPM

SEQ ID NO: 23617 - protein, 29 aa, Artificial Sequence
  Description of Artificial Sequence: Synthetic peptide
QEEEIRCTNPIATEQYGSVSENLMRGVNR

SEQ ID NO: 23618 - protein, 32 aa, Artificial Sequence
  Description of Artificial Sequence: Synthetic polypeptide
DEEEIRTTNPVATEQYGSVSTNDLQDEGGNEG

SEQ ID NO: 23619 - protein, 31 aa, Artificial Sequence
  Description of Artificial Sequence: Synthetic polypeptide
DEEEIRTTNPVATEQYGSVSTNDLQDSNSNS

SEQ ID NO: 23620 - protein, 33 aa, Artificial Sequence
  Description of Artificial Sequence: Synthetic polypeptide
DEEEIRTTNPVATEQYGSVSTNELSQRTGNNEF

SEQ ID NO: 23621 - protein, 28 aa, Artificial Sequence
  Description of Artificial Sequence: Synthetic peptide
DEEEIRTTNPCATEQWGSVATNLQDGDQ

SEQ ID NO: 23622 - protein, 31 aa, Artificial Sequence
  Description of Artificial Sequence: Synthetic polypeptide
DEEEIRTTNPVATEQYGSVSTNENQNFGSNQ

SEQ ID NO: 23623 - protein, 31 aa, Artificial Sequence
  Description of Artificial Sequence: Synthetic polypeptide
DEEEIRTTNPVATEQYGSVSTNEQDNGGNEI

SEQ ID NO: 23624 - protein, 28 aa, Artificial Sequence
  Description of Artificial Sequence: Synthetic peptide
DEEEIRTTNPCATEPYGSVATNHGRGND

SEQ ID NO: 23625 - protein, 32 aa, Artificial Sequence
  Description of Artificial Sequence: Synthetic polypeptide
QEEEIRTTNPVATEQYGSVSTNNLQQRVENYR

SEQ ID NO: 23626 - protein, 32 aa, Artificial Sequence
  Description of Artificial Sequence: Synthetic polypeptide
DEEEIRTTNPVATEQYGSVSGTNLQFEGGNGS

SEQ ID NO: 23627 - protein, 28 aa, Artificial Sequence
  Description of Artificial Sequence: Synthetic peptide
QEEEIRTTNPIATEQYGSVSECLMRGNL

SEQ ID NO: 23628 - protein, 31 aa, Artificial Sequence
  Description of Artificial Sequence: Synthetic polypeptide
DEEEIRTTNPVATEQYGSVSTNEQPQGELRY

SEQ ID NO: 23629 - protein, 28 aa, Artificial Sequence
  Description of Artificial Sequence: Synthetic peptide
QEEEIRTTNPIATEQYGDVSENLQREER

SEQ ID NO: 23630 - protein, 32 aa, Artificial Sequence
  Description of Artificial Sequence: Synthetic polypeptide
DEEEIRTTNPVATEQYGSVSTNDLQDSTNDRF

SEQ ID NO: 23631 - protein, 32 aa, Artificial Sequence
  Description of Artificial Sequence: Synthetic polypeptide
QEEEIRTTNPVATEQYGSVSTSNDMQRGENSR

SEQ ID NO: 23632 - protein, 28 aa, Artificial Sequence
  Description of Artificial Sequence: Synthetic peptide
DEEEIRTTNPCATEPYGSCSTNLANGNE

SEQ ID NO: 23633 - protein, 29 aa, Artificial Sequence
  Description of Artificial Sequence: Synthetic peptide
AEEEIRTTNPVATEQYGSVSVTTQQGGNQ

SEQ ID NO: 23634 - protein, 28 aa, Artificial Sequence
  Description of Artificial Sequence: Synthetic peptide
DEEEIRTTNPCATEPYGSVATNGVRGNA

SEQ ID NO: 23635 - protein, 30 aa, Artificial Sequence
  Description of Artificial Sequence: Synthetic polypeptide
AEEEIRTTNPVATEQYGSVSVTNNQGGNLS

SEQ ID NO: 23636 - protein, 33 aa, Artificial Sequence
  Description of Artificial Sequence: Synthetic polypeptide
QEEEIRTTNPVATEQYGSVSTSNLQQREGTNYR

SEQ ID NO: 23637 - protein, 28 aa, Artificial Sequence
  Description of Artificial Sequence: Synthetic peptide
DEEEIRTTNPVATEQYGDVSEDLCHGNA

SEQ ID NO: 23638 - protein, 32 aa, Artificial Sequence
  Description of Artificial Sequence: Synthetic polypeptide
DEEEIRTTNPVATEQYGECVCSTNLQRFGERQ

SEQ ID NO: 23639 - protein, 32 aa, Artificial Sequence
  Description of Artificial Sequence: Synthetic polypeptide
DEEEIRTTNPVATEQYGECVSMTNLQRGSNQG

SEQ ID NO: 23640 - protein, 28 aa, Artificial Sequence
  Description of Artificial Sequence: Synthetic peptide
QEEEIRSTNPVATEQYGVVSSTLQRGDR

SEQ ID NO: 23641 - protein, 28 aa, Artificial Sequence
  Description of Artificial Sequence: Synthetic peptide
QEEEIRSTNPVATEQYGVVASTLQHGNR

SEQ ID NO: 23642 - protein, 31 aa, Artificial Sequence
  Description of Artificial Sequence: Synthetic polypeptide
DEEEIRTTNPVATEQYGDVSDTNLNRGMNGN

SEQ ID NO: 23643 - protein, 29 aa, Artificial Sequence
  Description of Artificial Sequence: Synthetic peptide
DEEEIRTTNPVATEQYGDVSCENLCLGNE

SEQ ID NO: 23644 - protein, 28 aa, Artificial Sequence
  Description of Artificial Sequence: Synthetic peptide
QEEEIRSTNPCATEQYGSVSENLMRGNP

SEQ ID NO: 23645 - protein, 31 aa, Artificial Sequence
  Description of Artificial Sequence: Synthetic polypeptide
DEEEIRTTNPVATEQYGSVSTNDLQDSTERT

SEQ ID NO: 23646 - protein, 31 aa, Artificial Sequence
  Description of Artificial Sequence: Synthetic polypeptide
DEEEIRTTNPVATEQYGDVVSTNLQGIGNNN

SEQ ID NO: 23647 - protein, 29 aa, Artificial Sequence
  Description of Artificial Sequence: Synthetic peptide
DEEEIRTTNPVATEQYGDVSENEMNRGNA

SEQ ID NO: 23648 - protein, 28 aa, Artificial Sequence
  Description of Artificial Sequence: Synthetic peptide
QEEEIRCTNPIATEQYGSVSENLMRGNK

SEQ ID NO: 23649 - protein, 29 aa, Artificial Sequence
  Description of Artificial Sequence: Synthetic peptide
QEEEIRCTNPIATEQYGSVSEGNLMRGNR

SEQ ID NO: 23650 - protein, 30 aa, Artificial Sequence
  Description of Artificial Sequence: Synthetic polypeptide
AEEEIRTTNPVATEQYGSVSVVNLQEGQNQ

SEQ ID NO: 23651 - protein, 31 aa, Artificial Sequence
  Description of Artificial Sequence: Synthetic polypeptide
AEEEIRTTNPVATEQYGSVSVTNNLQQFGND

SEQ ID NO: 23652 - protein, 31 aa, Artificial Sequence
  Description of Artificial Sequence: Synthetic polypeptide
DEEEIRTTNPVATEQYGSVSTNFTQPRGHTF

SEQ ID NO: 23653 - protein, 29 aa, Artificial Sequence
  Description of Artificial Sequence: Synthetic peptide
DEEEIRTTNPCATEQYGSVATNLQDGETP

SEQ ID NO: 23654 - protein, 31 aa, Artificial Sequence
  Description of Artificial Sequence: Synthetic polypeptide
DEEEIRTTNPCATEQYGSVATNLQDRTGNDE

SEQ ID NO: 23655 - protein, 31 aa, Artificial Sequence
  Description of Artificial Sequence: Synthetic polypeptide
DEEEIRTTNPVATEQYGETISTNELQRPGNA

SEQ ID NO: 23656 - protein, 31 aa, Artificial Sequence
  Description of Artificial Sequence: Synthetic polypeptide
DEEEIRTTNPVATEQYGSVSTNGDDRGNNHT

SEQ ID NO: 23657 - protein, 32 aa, Artificial Sequence
  Description of Artificial Sequence: Synthetic polypeptide
AEEEIRTTNPVATEQYGSVSVTNNLQNSGINR

SEQ ID NO: 23658 - protein, 29 aa, Artificial Sequence
  Description of Artificial Sequence: Synthetic peptide
QEEEICTTNPVATEVYGSVATNLQERGVR

SEQ ID NO: 23659 - protein, 30 aa, Artificial Sequence
  Description of Artificial Sequence: Synthetic polypeptide
QEEEICTTNPVATEQYGSVSVNLQREGNDL

SEQ ID NO: 23660 - protein, 31 aa, Artificial Sequence
  Description of Artificial Sequence: Synthetic polypeptide
QEEEICTTNPVATEQYGSVSTPNLQRGDNES

SEQ ID NO: 23661 - protein, 29 aa, Artificial Sequence
  Description of Artificial Sequence: Synthetic peptide
QEEEICTTNPVATEQYGSVSTNVQRDGPE

SEQ ID NO: 23662 - protein, 28 aa, Artificial Sequence
  Description of Artificial Sequence: Synthetic peptide
QEEEIVCTNPVATEQYGSVSTNLQVGEM

SEQ ID NO: 23663 - protein, 30 aa, Artificial Sequence
  Description of Artificial Sequence: Synthetic polypeptide
QEEEICTTNPVATEQYGSVSTNQQAGNIRD

SEQ ID NO: 23664 - protein, 29 aa, Artificial Sequence
  Description of Artificial Sequence: Synthetic peptide
QEEEICTTNPVATEQYGSVSTNNQRGEPE

SEQ ID NO: 23665 - protein, 31 aa, Artificial Sequence
  Description of Artificial Sequence: Synthetic polypeptide
AEEEIRTTNPVATEQYGSVSVTNNLQNQNER

SEQ ID NO: 23666 - protein, 30 aa, Artificial Sequence
  Description of Artificial Sequence: Synthetic polypeptide
QEEEICTTNPVATEQYGSVSTNLSRGDNDQ

SEQ ID NO: 23667 - protein, 32 aa, Artificial Sequence
  Description of Artificial Sequence: Synthetic polypeptide
DEEEIRTTNPVATEQYGSVSGTNLQGGSGNNE

SEQ ID NO: 23668 - protein, 32 aa, Artificial Sequence
  Description of Artificial Sequence: Synthetic polypeptide
AEEEIRTTNPVATEQYGSVSVTNNLQNIDGNR

SEQ ID NO: 23669 - protein, 32 aa, Artificial Sequence
  Description of Artificial Sequence: Synthetic polypeptide
AEEEIRTTNPVATEQYGSVSVTNNLQNAGNQR

SEQ ID NO: 23670 - protein, 31 aa, Artificial Sequence
  Description of Artificial Sequence: Synthetic polypeptide
DEEEIRTTNPVATEQYGSVSGTNLDVEGNES

SEQ ID NO: 23671 - protein, 31 aa, Artificial Sequence
  Description of Artificial Sequence: Synthetic polypeptide
DEEEIRTTNPVATEQYGSVSTNGGQERDEIR

SEQ ID NO: 23672 - protein, 30 aa, Artificial Sequence
  Description of Artificial Sequence: Synthetic polypeptide
QEEEICTTNPVATEQYGSVSTNLQRQNPED

SEQ ID NO: 23673 - protein, 30 aa, Artificial Sequence
  Description of Artificial Sequence: Synthetic polypeptide
QEEEICTTNPVATEQYGSVSTNLQRQNELM

SEQ ID NO: 23674 - protein, 29 aa, Artificial Sequence
  Description of Artificial Sequence: Synthetic peptide
QEEEICTTNPVATEQYGSVSTNLQREMTA

SEQ ID NO: 23675 - protein, 30 aa, Artificial Sequence
  Description of Artificial Sequence: Synthetic polypeptide
QEEEICTTNPVATEQYGSVSTNLQQGNETA

SEQ ID NO: 23676 - protein, 28 aa, Artificial Sequence
  Description of Artificial Sequence: Synthetic peptide
QEEEICTTNPVATEQYGSVSTNPQDGPE

SEQ ID NO: 23677 - protein, 30 aa, Artificial Sequence
  Description of Artificial Sequence: Synthetic polypeptide
DEEEIRTTNPCATEQYGSVATNLDRGNVDN

SEQ ID NO: 23678 - protein, 34 aa, Artificial Sequence
  Description of Artificial Sequence: Synthetic polypeptide
DEEEIRTTNPVATEQYGSVSTNDLDQNRGENERE

SEQ ID NO: 23679 - protein, 31 aa, Artificial Sequence
  Description of Artificial Sequence: Synthetic polypeptide
DEEEIRTTNPVATEQYGSVSGTNLIIGANGN

SEQ ID NO: 23680 - protein, 28 aa, Artificial Sequence
  Description of Artificial Sequence: Synthetic peptide
QEEEIRCTNPIATEQYGSVSECLMRGNR

SEQ ID NO: 23681 - protein, 31 aa, Artificial Sequence
  Description of Artificial Sequence: Synthetic polypeptide
QEEEIRTVNPVATEQYGSVSDTENLQRSGNE

SEQ ID NO: 23682 - protein, 28 aa, Artificial Sequence
  Description of Artificial Sequence: Synthetic peptide
QEEEIRCTNPIATEQYGSVAENLQRGDR

SEQ ID NO: 23683 - protein, 29 aa, Artificial Sequence
  Description of Artificial Sequence: Synthetic peptide
QEEEIRTVNPVATEQYGSVSTNTEEAGNR

SEQ ID NO: 23684 - protein, 30 aa, Artificial Sequence
  Description of Artificial Sequence: Synthetic polypeptide
QEEEIRTVNPVATEQYGSVSTSNLQNFGNG

SEQ ID NO: 23685 - protein, 28 aa, Artificial Sequence
  Description of Artificial Sequence: Synthetic peptide
QEEEIRCTNPIATEGYGSVSENLMRGNR

SEQ ID NO: 23686 - protein, 28 aa, Artificial Sequence
  Description of Artificial Sequence: Synthetic peptide
QEEEIRCTNPCSTEQYGSVSENLMRGNR

SEQ ID NO: 23687 - protein, 28 aa, Artificial Sequence
  Description of Artificial Sequence: Synthetic peptide
QEEEIRCTNPCATEQYGSVSENLMRGTR

SEQ ID NO: 23688 - protein, 32 aa, Artificial Sequence
  Description of Artificial Sequence: Synthetic polypeptide
DEEEIRTTNPVATEQYGSVSGTNLQGETVGNG

SEQ ID NO: 23689 - protein, 28 aa, Artificial Sequence
  Description of Artificial Sequence: Synthetic peptide
QEEEIRCTNPCATEQYGSVSCNLMRGTR

SEQ ID NO: 23690 - protein, 28 aa, Artificial Sequence
  Description of Artificial Sequence: Synthetic peptide
QEEEIRVTNPVATEQYGEVSTNLQHIGR

SEQ ID NO: 23691 - protein, 29 aa, Artificial Sequence
  Description of Artificial Sequence: Synthetic peptide
QEEEIRYTNPVATEQYGQVSTNLQQWGNI

SEQ ID NO: 23692 - protein, 29 aa, Artificial Sequence
  Description of Artificial Sequence: Synthetic peptide
QEEEINTVNPVATEQYGSVSTNLEQRNNF

SEQ ID NO: 23693 - protein, 28 aa, Artificial Sequence
  Description of Artificial Sequence: Synthetic peptide
QEEEISCTNPIATEQYGSVSENLMRGNR

SEQ ID NO: 23694 - protein, 30 aa, Artificial Sequence
  Description of Artificial Sequence: Synthetic polypeptide
DEEEIRTTNPCATEQYGSVATNLDRGVNDD

SEQ ID NO: 23695 - protein, 30 aa, Artificial Sequence
  Description of Artificial Sequence: Synthetic polypeptide
QEEEIRATNPVATEQYGSVSTNLQNGANEE

SEQ ID NO: 23696 - protein, 32 aa, Artificial Sequence
  Description of Artificial Sequence: Synthetic polypeptide
DEEEIRTTNPVATEQYGSVSGTNLQGFGNTGQ

SEQ ID NO: 23697 - protein, 29 aa, Artificial Sequence
  Description of Artificial Sequence: Synthetic peptide
QEEEIRATNPVATEQYGSVSANLQVGQNE

SEQ ID NO: 23698 - protein, 32 aa, Artificial Sequence
  Description of Artificial Sequence: Synthetic polypeptide
DEEEIRTTNPVATEQYGSVSGTNLQGGGNVGG

SEQ ID NO: 23699 - protein, 33 aa, Artificial Sequence
  Description of Artificial Sequence: Synthetic polypeptide
DEEEIRTTNPVATEQYGSVSTNDLDQSGGENER

SEQ ID NO: 23700 - protein, 30 aa, Artificial Sequence
  Description of Artificial Sequence: Synthetic polypeptide
QEEEIRATNPVATEQYGSVATNLQAGVNDR

SEQ ID NO: 23701 - protein, 29 aa, Artificial Sequence
  Description of Artificial Sequence: Synthetic peptide
QEEEIRATNPVATEQYGSVATNLQAGNHH

SEQ ID NO: 23702 - protein, 30 aa, Artificial Sequence
  Description of Artificial Sequence: Synthetic polypeptide
QEEEIRATNPVATEQYGDVSMTNLFQGGNR

SEQ ID NO: 23703 - protein, 29 aa, Artificial Sequence
  Description of Artificial Sequence: Synthetic peptide
QEEEIRATNPVATEPYGSVSTNLQNGDRH

SEQ ID NO: 23704 - protein, 28 aa, Artificial Sequence
  Description of Artificial Sequence: Synthetic peptide
QEEEIRATNPVATEMYGSVSTDLQSGDR

SEQ ID NO: 23705 - protein, 31 aa, Artificial Sequence
  Description of Artificial Sequence: Synthetic polypeptide
AEEEIRTTNPVATEQYGSVSVTNNLQQGNEA

SEQ ID NO: 23706 - protein, 29 aa, Artificial Sequence
  Description of Artificial Sequence: Synthetic peptide
QEEEIRATNPVAYEQYGSVSTNLQHGNHN

SEQ ID NO: 23707 - protein, 29 aa, Artificial Sequence
  Description of Artificial Sequence: Synthetic peptide
QEEEIRTTNPVATEGYGCTSINLQRGNNR

SEQ ID NO: 23708 - protein, 29 aa, Artificial Sequence
  Description of Artificial Sequence: Synthetic peptide
QEEEIRTTNPVATEMYGSVSTNLQNGDSQ

SEQ ID NO: 23709 - protein, 30 aa, Artificial Sequence
  Description of Artificial Sequence: Synthetic polypeptide
AEEEIRTTNPVATEQYGSVSVTTNPQNGNM

SEQ ID NO: 23710 - protein, 32 aa, Artificial Sequence
  Description of Artificial Sequence: Synthetic polypeptide
QEEEIRTTNPVATEQYGSVNTDNLGQRGENYR

SEQ ID NO: 23711 - protein, 32 aa, Artificial Sequence
  Description of Artificial Sequence: Synthetic polypeptide
DEEEIRTTNPVATEQYGSVSGTNLQEIGNGDQ

SEQ ID NO: 23712 - protein, 30 aa, Artificial Sequence
  Description of Artificial Sequence: Synthetic polypeptide
AEEEIRTTNPVATEQYGSVSVTNTEQNGNP

SEQ ID NO: 23713 - protein, 30 aa, Artificial Sequence
  Description of Artificial Sequence: Synthetic polypeptide
AEEEIRTTNPVATEQYGSVSVTTNEQGGNV

SEQ ID NO: 23714 - protein, 28 aa, Artificial Sequence
  Description of Artificial Sequence: Synthetic peptide
DEEEIRTTNPCATEQYGCVSWNIFRGNQ

SEQ ID NO: 23715 - protein, 31 aa, Artificial Sequence
  Description of Artificial Sequence: Synthetic polypeptide
DEEEIRTTNPVATEQYGDVSTLNLQEDGGNP

SEQ ID NO: 23716 - protein, 32 aa, Artificial Sequence
  Description of Artificial Sequence: Synthetic polypeptide
DEEEIRTTNPVATEQYGSVSGTNLQEMGNGVE

SEQ ID NO: 23717 - protein, 31 aa, Artificial Sequence
  Description of Artificial Sequence: Synthetic polypeptide
DEEEIRTTNPVATEQYGDVSTLNLDQEFGND

SEQ ID NO: 23718 - protein, 30 aa, Artificial Sequence
  Description of Artificial Sequence: Synthetic polypeptide
DEEEIRTTNPVATEQYGSVSTNDQNSGSDQ

SEQ ID NO: 23719 - protein, 33 aa, Artificial Sequence
  Description of Artificial Sequence: Synthetic polypeptide
DEEEIRTTNPVATEQYGSVSTNDNLDTRGNSRQ

SEQ ID NO: 23720 - protein, 31 aa, Artificial Sequence
  Description of Artificial Sequence: Synthetic polypeptide
AEEEIRTTNPVATEQYGSVSVTTNLEQGGNQ

SEQ ID NO: 23721 - protein, 31 aa, Artificial Sequence
  Description of Artificial Sequence: Synthetic polypeptide
DEEEIRTTNPVATEQYGSVSTNDNLDRNNSQ

SEQ ID NO: 23722 - protein, 32 aa, Artificial Sequence
  Description of Artificial Sequence: Synthetic polypeptide
QEEEIRTTNPVATEQYGSVNTSNLEQRGENDR

SEQ ID NO: 23723 - protein, 31 aa, Artificial Sequence
  Description of Artificial Sequence: Synthetic polypeptide
DEEEIRTTNPVATEQYGSVSTNDQQENGGNS

SEQ ID NO: 23724 - protein, 32 aa, Artificial Sequence
  Description of Artificial Sequence: Synthetic polypeptide
QEEEIRTTNPVATEQYGSVATSNLVQRGENLR

SEQ ID NO: 23725 - protein, 32 aa, Artificial Sequence
  Description of Artificial Sequence: Synthetic polypeptide
QEEEIRTTNPVATEQYGSVATSNLSQRGENPR

SEQ ID NO: 23726 - protein, 28 aa, Artificial Sequence
  Description of Artificial Sequence: Synthetic peptide
QEEEIRTTNPVATEQYGSVATNLTQGDL

SEQ ID NO: 23727 - protein, 32 aa, Artificial Sequence
  Description of Artificial Sequence: Synthetic polypeptide
DEEEIRTTNPVATEQYGSVSGTNLQESGGNGE

SEQ ID NO: 23728 - protein, 30 aa, Artificial Sequence
  Description of Artificial Sequence: Synthetic polypeptide
QEEEIRTTNPVATEQYGSVATNLQSGDDRN

SEQ ID NO: 23729 - protein, 31 aa, Artificial Sequence
  Description of Artificial Sequence: Synthetic polypeptide
AEEEIRTTNPVATEQYGSVSVTNSLQEGNVN

SEQ ID NO: 23730 - protein, 30 aa, Artificial Sequence
  Description of Artificial Sequence: Synthetic polypeptide
AEEEIRTTNPVATEQYGSVSVTNSEQGQNR

SEQ ID NO: 23731 - protein, 31 aa, Artificial Sequence
  Description of Artificial Sequence: Synthetic polypeptide
AEEEIRTTNPVATEQYGSVSVTTNLQDGNVS

SEQ ID NO: 23732 - protein, 30 aa, Artificial Sequence
  Description of Artificial Sequence: Synthetic polypeptide
AEEEIRTTNPVATEQYGSVSVTNQQVGENQ

SEQ ID NO: 23733 - protein, 32 aa, Artificial Sequence
  Description of Artificial Sequence: Synthetic polypeptide
DEEEIRTTNPVATEQYGSVSTNDMTQRGNNQG

SEQ ID NO: 23734 - protein, 30 aa, Artificial Sequence
  Description of Artificial Sequence: Synthetic polypeptide
QEEEIRTTNPVATEQYGSVATNLQHGENHN

SEQ ID NO: 23735 - protein, 30 aa, Artificial Sequence
  Description of Artificial Sequence: Synthetic polypeptide
DEEEIRTTNPVATEQYGSVSTNDMGGSNQN

SEQ ID NO: 23736 - protein, 31 aa, Artificial Sequence
  Description of Artificial Sequence: Synthetic polypeptide
QEEEIRTTNPVATEQYGSVCSTNLQGFGSDR

SEQ ID NO: 23737 - protein, 32 aa, Artificial Sequence
  Description of Artificial Sequence: Synthetic polypeptide
AEEEIRTTNPVATEQYGSVSVTTNLQNEGNNR

SEQ ID NO: 23738 - protein, 32 aa, Artificial Sequence
  Description of Artificial Sequence: Synthetic polypeptide
QEEEIRTTNPVATEQYGSVNTSNLFQRGENNR

SEQ ID NO: 23739 - protein, 30 aa, Artificial Sequence
  Description of Artificial Sequence: Synthetic polypeptide
DEEEIRTTNPCATEQYGCVIVTNLQRGNNA

SEQ ID NO: 23740 - protein, 30 aa, Artificial Sequence
  Description of Artificial Sequence: Synthetic polypeptide
AEEEIRTTNPVATEQYGSVSVTSNEQQGND

SEQ ID NO: 23741 - protein, 32 aa, Artificial Sequence
  Description of Artificial Sequence: Synthetic polypeptide
DEEEIRTTNPVATEQYGSVSTNDQGNSGENER

SEQ ID NO: 23742 - protein, 31 aa, Artificial Sequence
  Description of Artificial Sequence: Synthetic polypeptide
DEEEIRTTNPVATEQYGSVSTNDQGQSINER

SEQ ID NO: 23743 - protein, 32 aa, Artificial Sequence
  Description of Artificial Sequence: Synthetic polypeptide
AEEEIRTTNPVATEQYGSVSVTSNLQNVGNNR

SEQ ID NO: 23744 - protein, 30 aa, Artificial Sequence
  Description of Artificial Sequence: Synthetic polypeptide
DEEEIRTTNPVATEQYGSVSTNDQGSGDQS

SEQ ID NO: 23745 - protein, 30 aa, Artificial Sequence
  Description of Artificial Sequence: Synthetic polypeptide
DEEEIRTTNPVATEQYGSVSTNDQFFNNAA

SEQ ID NO: 23746 - protein, 30 aa, Artificial Sequence
  Description of Artificial Sequence: Synthetic polypeptide
DEEEIRTTNPVATEQYGSVSTNDQFFNMQG

SEQ ID NO: 23747 - protein, 29 aa, Artificial Sequence
  Description of Artificial Sequence: Synthetic peptide
DEEEIRTTNPVATEQYGSVSTNDQENFEG

SEQ ID NO: 23748 - protein, 30 aa, Artificial Sequence
  Description of Artificial Sequence: Synthetic polypeptide
AEEEIRTTNPVATEQYGSVSVTSNAQQGNI

SEQ ID NO: 23749 - protein, 30 aa, Artificial Sequence
  Description of Artificial Sequence: Synthetic polypeptide
AEEEIRTTNPVATEQYGSVSVTQNEQNGNE

SEQ ID NO: 23750 - protein, 31 aa, Artificial Sequence
  Description of Artificial Sequence: Synthetic polypeptide
DEEEIRTTNPVATEQYGDVSTNLQHGGNGNA

SEQ ID NO: 23751 - protein, 32 aa, Artificial Sequence
  Description of Artificial Sequence: Synthetic polypeptide
DEEEIRTTNPVATEQYGSVSTNDQHRSGEERI

SEQ ID NO: 23752 - protein, 31 aa, Artificial Sequence
  Description of Artificial Sequence: Synthetic polypeptide
DEEEIRTTNPVATEQYGDVSTNLQQVGGNDD

SEQ ID NO: 23753 - protein, 31 aa, Artificial Sequence
  Description of Artificial Sequence: Synthetic polypeptide
DEEEIRTTNPVATEQYGSVSTNDQIATENER

SEQ ID NO: 23754 - protein, 29 aa, Artificial Sequence
  Description of Artificial Sequence: Synthetic peptide
AEEEIRTTNPVATEQYGSVSVTQGGGGNR

SEQ ID NO: 23755 - protein, 29 aa, Artificial Sequence
  Description of Artificial Sequence: Synthetic peptide
AEEEIRTTNPVATEQYGSVSVTQEQGGNS

SEQ ID NO: 23756 - protein, 31 aa, Artificial Sequence
  Description of Artificial Sequence: Synthetic polypeptide
DEEEIRTTNPVATEQYGSVSTNDQISGNGEV

SEQ ID NO: 23757 - protein, 30 aa, Artificial Sequence
  Description of Artificial Sequence: Synthetic polypeptide
AEEEIRTTNPVATEQYGSVSVTSVGQGGNR

SEQ ID NO: 23758 - protein, 30 aa, Artificial Sequence
  Description of Artificial Sequence: Synthetic polypeptide
QEEEIRTTNPVATEQYGSVSAANLDDTGNR

SEQ ID NO: 23759 - protein, 31 aa, Artificial Sequence
  Description of Artificial Sequence: Synthetic polypeptide
DEEEIRTTNPVATEQYGSVSTNDQAFGFNGQ

SEQ ID NO: 23760 - protein, 31 aa, Artificial Sequence
  Description of Artificial Sequence: Synthetic polypeptide
AEEEIRTTNPVATEQYGSVSVTNVLQTGNVG

SEQ ID NO: 23761 - protein, 31 aa, Artificial Sequence
  Description of Artificial Sequence: Synthetic polypeptide
DEEEIRTTNPVATEQYGDVSTNLQQGVGGNT

SEQ ID NO: 23762 - protein, 30 aa, Artificial Sequence
  Description of Artificial Sequence: Synthetic polypeptide
AEEEIRTTNPVATEQYGSVSVTTLQSGSNG

SEQ ID NO: 23763 - protein, 32 aa, Artificial Sequence
  Description of Artificial Sequence: Synthetic polypeptide
QEEEIRTTNPVATEQYGSVQTSNLNQRGENYR

SEQ ID NO: 23764 - protein, 31 aa, Artificial Sequence
  Description of Artificial Sequence: Synthetic polypeptide
AEEEIRTTNPVATEQYGSVSVTNTLQNIGNN

SEQ ID NO: 23765 - protein, 31 aa, Artificial Sequence
  Description of Artificial Sequence: Synthetic polypeptide
DEEEIRTTNPVATEQYGSVSTNDNQEREEIR

SEQ ID NO: 23766 - protein, 30 aa, Artificial Sequence
  Description of Artificial Sequence: Synthetic polypeptide
DEEEIRTTNPVATEQYGSVSTNDQIRNLDI

SEQ ID NO: 23767 - protein, 30 aa, Artificial Sequence
  Description of Artificial Sequence: Synthetic polypeptide
DEEEIRTTNPVATEQYGDVSSTNGGQRGIF

SEQ ID NO: 23768 - protein, 30 aa, Artificial Sequence
  Description of Artificial Sequence: Synthetic polypeptide
QEEEIRTTNPVATEQYGSVATNLQEHGNDQ

SEQ ID NO: 23769 - protein, 29 aa, Artificial Sequence
  Description of Artificial Sequence: Synthetic peptide
QEEEIRTTNPVATEQYGSVATNLQDPDNN

SEQ ID NO: 23770 - protein, 28 aa, Artificial Sequence
  Description of Artificial Sequence: Synthetic peptide
QEEEIRTTNPVATEQYGSAPENCQRENR

SEQ ID NO: 23771 - protein, 31 aa, Artificial Sequence
  Description of Artificial Sequence: Synthetic polypeptide
DEEEIRTTNPVATEQYGDVSTSNLQEFGGNN

SEQ ID NO: 23772 - protein, 32 aa, Artificial Sequence
  Description of Artificial Sequence: Synthetic polypeptide
AEEEIRTTNPVATEQYGSVSVTNQLGQNGNNR

SEQ ID NO: 23773 - protein, 29 aa, Artificial Sequence
  Description of Artificial Sequence: Synthetic peptide
DEEEIRTTNPVATEQYGSVSTNEEWQGTQ

SEQ ID NO: 23774 - protein, 30 aa, Artificial Sequence
  Description of Artificial Sequence: Synthetic polypeptide
QEEEIRTTNPVATEQYGIVSTNLQMGNVDF

SEQ ID NO: 23775 - protein, 32 aa, Artificial Sequence
  Description of Artificial Sequence: Synthetic polypeptide
DEEEIRTTNPVATEQYGSVSTNEHQERDMGTR

SEQ ID NO: 23776 - protein, 32 aa, Artificial Sequence
  Description of Artificial Sequence: Synthetic polypeptide
DEEEIRTTNPVATEQYGSVSTNDLQLQGENNA

SEQ ID NO: 23777 - protein, 31 aa, Artificial Sequence
  Description of Artificial Sequence: Synthetic polypeptide
DEEEIRTTNPVATEQYGDVSTSNLQSFGNEL

SEQ ID NO: 23778 - protein, 31 aa, Artificial Sequence
  Description of Artificial Sequence: Synthetic polypeptide
DEEEIRTTNPVATEQYGDVSTSNLQVDGNGQ

SEQ ID NO: 23779 - protein, 32 aa, Artificial Sequence
  Description of Artificial Sequence: Synthetic polypeptide
DEEEIRTTNPVATEQYGSVSTNEHQERDVGIR

SEQ ID NO: 23780 - protein, 31 aa, Artificial Sequence
  Description of Artificial Sequence: Synthetic polypeptide
DEEEIRTTNPVATEQYGSVSTNDLQGVTNNQ

SEQ ID NO: 23781 - protein, 31 aa, Artificial Sequence
  Description of Artificial Sequence: Synthetic polypeptide
DEEEIRTTNPVATEQYGDVSTSNLQVFGGNN

SEQ ID NO: 23782 - protein, 32 aa, Artificial Sequence
  Description of Artificial Sequence: Synthetic polypeptide
DEEEIRTTNPVATEQYGSVSTNDLQNAGNTIT

SEQ ID NO: 23783 - protein, 31 aa, Artificial Sequence
  Description of Artificial Sequence: Synthetic polypeptide
DEEEIRTTNPVATEQYGDVSTSNLQVGGMNE

SEQ ID NO: 23784 - protein, 31 aa, Artificial Sequence
  Description of Artificial Sequence: Synthetic polypeptide
DEEEIRTTNPVATEQYGDVSTSNLQVNGNGD

SEQ ID NO: 23785 - protein, 28 aa, Artificial Sequence
  Description of Artificial Sequence: Synthetic peptide
QEEEIRTTNPVATEQYGDVSENLMHENR

SEQ ID NO: 23786 - protein, 30 aa, Artificial Sequence
  Description of Artificial Sequence: Synthetic polypeptide
QEEEIRTTNPVATEQYGCVSTNLQRNDNFT

SEQ ID NO: 23787 - protein, 30 aa, Artificial Sequence
  Description of Artificial Sequence: Synthetic polypeptide
QEEEIRTTNPVATEQYGSVSTNLQCNANFY

SEQ ID NO: 23788 - protein, 32 aa, Artificial Sequence
  Description of Artificial Sequence: Synthetic polypeptide
DEEEIRTTNPVATEQYGSVSTNEHSTRGGNQR

SEQ ID NO: 23789 - protein, 29 aa, Artificial Sequence
  Description of Artificial Sequence: Synthetic peptide
QEEEIRTTNPVATEQWGSVSENLQAGNDD

SEQ ID NO: 23790 - protein, 31 aa, Artificial Sequence
  Description of Artificial Sequence: Synthetic polypeptide
DEEEIRTTNPVATEQYGDVSWTNLNPIGMNR

SEQ ID NO: 23791 - protein, 31 aa, Artificial Sequence
  Description of Artificial Sequence: Synthetic polypeptide
DEEEIRTTNPVATEQYGDVSWTNLNRVGMNE

SEQ ID NO: 23792 - protein, 29 aa, Artificial Sequence
  Description of Artificial Sequence: Synthetic peptide
DEEEIRTTNPVATEQYGDVSYELQGFGNQ

SEQ ID NO: 23793 - protein, 30 aa, Artificial Sequence
  Description of Artificial Sequence: Synthetic polypeptide
DEEEIRTTNPVATEQYGDVVDTNLDRGMNG

SEQ ID NO: 23794 - protein, 30 aa, Artificial Sequence
  Description of Artificial Sequence: Synthetic polypeptide
QEEEIRTTNPVATEPYGSVSTNLQNGDDRL

SEQ ID NO: 23795 - protein, 31 aa, Artificial Sequence
  Description of Artificial Sequence: Synthetic polypeptide
QEEEIRTTNPVATEQYGSVSTNLQEAGNEDE

SEQ ID NO: 23796 - protein, 31 aa, Artificial Sequence
  Description of Artificial Sequence: Synthetic polypeptide
DEEEIRTTNPVATEQYGSVSTNEHQNRDPIR

SEQ ID NO: 23797 - protein, 30 aa, Artificial Sequence
  Description of Artificial Sequence: Synthetic polypeptide
DEEEIRTTNPVATEQYGSVSTNDVQDNGDA

SEQ ID NO: 23798 - protein, 28 aa, Artificial Sequence
  Description of Artificial Sequence: Synthetic peptide
QEEEIRTTNPVATEQYGSASEVLQRGEK

SEQ ID NO: 23799 - protein, 30 aa, Artificial Sequence
  Description of Artificial Sequence: Synthetic polypeptide
QEEEIRTTNPVATEQYGSVSTNHQSFGSDR

SEQ ID NO: 23800 - protein, 31 aa, Artificial Sequence
  Description of Artificial Sequence: Synthetic polypeptide
DEEEIRTTNPVATEQYGSVSTNDQRSEEERN

SEQ ID NO: 23801 - protein, 31 aa, Artificial Sequence
  Description of Artificial Sequence: Synthetic polypeptide
DEEEIRTTNPVATEQYGDVSNTNLQGTGGNV

SEQ ID NO: 23802 - protein, 32 aa, Artificial Sequence
  Description of Artificial Sequence: Synthetic polypeptide
AEEEIRTTNPVATEQYGSVSVTTNLQQDGENR

SEQ ID NO: 23803 - protein, 32 aa, Artificial Sequence
  Description of Artificial Sequence: Synthetic polypeptide
DEEEIRTTNPVATEQYGSVSTNDLQRSDNDVF

SEQ ID NO: 23804 - protein, 30 aa, Artificial Sequence
  Description of Artificial Sequence: Synthetic polypeptide
QEEEIRTTNPVATEQYGSVATNLQDGDNND

SEQ ID NO: 23805 - protein, 30 aa, Artificial Sequence
  Description of Artificial Sequence: Synthetic polypeptide
QEEEIRTTNPVATEQYGSVATNLQAGNVNS

SEQ ID NO: 23806 - protein, 31 aa, Artificial Sequence
  Description of Artificial Sequence: Synthetic polypeptide
DEEEIRTTNPVATEQYGDVSGTSNLQDGGNG

SEQ ID NO: 23807 - protein, 32 aa, Artificial Sequence
  Description of Artificial Sequence: Synthetic polypeptide
AEEEIRTTNPVATEQYGSVSVTTNLQQGENNR

SEQ ID NO: 23808 - protein, 31 aa, Artificial Sequence
  Description of Artificial Sequence: Synthetic polypeptide
DEEEIRTTNPVATEQYGSVSTNDQVRDDQRN

SEQ ID NO: 23809 - protein, 32 aa, Artificial Sequence
  Description of Artificial Sequence: Synthetic polypeptide
DEEEIRTTNPVATEQYGSVSTNDQVRDINQRG

SEQ ID NO: 23810 - protein, 30 aa, Artificial Sequence
  Description of Artificial Sequence: Synthetic polypeptide
QEEEIRTTNPVATEQYGSVATNLQAGDNDD

SEQ ID NO: 23811 - protein, 32 aa, Artificial Sequence
  Description of Artificial Sequence: Synthetic polypeptide
DEEEIRTTNPVATEQYGSVSGTNLQAEGNIAT

SEQ ID NO: 23812 - protein, 30 aa, Artificial Sequence
  Description of Artificial Sequence: Synthetic polypeptide
AEEEIRTTNPVATEQYGSVSVTNQQQGNEF

SEQ ID NO: 23813 - protein, 28 aa, Artificial Sequence
  Description of Artificial Sequence: Synthetic peptide
QEEEIRTTNPVATEQYGSVATNLERTPD

SEQ ID NO: 23814 - protein, 30 aa, Artificial Sequence
  Description of Artificial Sequence: Synthetic polypeptide
QEEEIRTTNPVATEQYGSVATNLERPGENN

SEQ ID NO: 23815 - protein, 29 aa, Artificial Sequence
  Description of Artificial Sequence: Synthetic peptide
QEEEIRTTNPVATEQYGSVATNLERGQDN

SEQ ID NO: 23816 - protein, 32 aa, Artificial Sequence
  Description of Artificial Sequence: Synthetic polypeptide
AEEEIRTTNPVATEQYGSVSVTTNLQQNNGNR

SEQ ID NO: 23817 - protein, 31 aa, Artificial Sequence
  Description of Artificial Sequence: Synthetic polypeptide
DEEEIRTTNPVATEQYGSVSTNDLQPGDEDV

SEQ ID NO: 23818 - protein, 30 aa, Artificial Sequence
  Description of Artificial Sequence: Synthetic polypeptide
QEEEIRTTNPVATEQYGSVSTDLQLDNGND

SEQ ID NO: 23819 - protein, 32 aa, Artificial Sequence
  Description of Artificial Sequence: Synthetic polypeptide
QEEEIRTTNPVATEQYGSVATDNLTQRGENDR

SEQ ID NO: 23820 - protein, 29 aa, Artificial Sequence
  Description of Artificial Sequence: Synthetic peptide
QEEEIRTTNPVATEQYGSVATDLQNGDFR

SEQ ID NO: 23821 - protein, 31 aa, Artificial Sequence
  Description of Artificial Sequence: Synthetic polypeptide
DEEEIRTTNPVATEQYGDVSTPNLQSGNNEQ

SEQ ID NO: 23822 - protein, 32 aa, Artificial Sequence
  Description of Artificial Sequence: Synthetic polypeptide
DEEEIRTTNPVATEQYGSVSTNDLQNIGGNET

SEQ ID NO: 23823 - protein, 31 aa, Artificial Sequence
  Description of Artificial Sequence: Synthetic polypeptide
DEEEIRTTNPVATEQYGSVSGTNLNTNSGNF

SEQ ID NO: 23824 - protein, 32 aa, Artificial Sequence
  Description of Artificial Sequence: Synthetic polypeptide
AEEEIRTTNPVATEQYGSVSVTNQLQQANGNR

SEQ ID NO: 23825 - protein, 31 aa, Artificial Sequence
  Description of Artificial Sequence: Synthetic polypeptide
AEEEIRTTNPVATEQYGSVSVTNQLQQAGNP

SEQ ID NO: 23826 - protein, 30 aa, Artificial Sequence
  Description of Artificial Sequence: Synthetic polypeptide
QEEEIRTTNPVATEQYGSCSTHLQPRQGDR

SEQ ID NO: 23827 - protein, 30 aa, Artificial Sequence
  Description of Artificial Sequence: Synthetic polypeptide
QEEEICTTNPVATEQYGSVSTNLQQGENPD

SEQ ID NO: 23828 - protein, 31 aa, Artificial Sequence
  Description of Artificial Sequence: Synthetic polypeptide
DEEEIRTTNPVATEQYGSVSTNLEERGQEDG

SEQ ID NO: 23829 - protein, 30 aa, Artificial Sequence
  Description of Artificial Sequence: Synthetic polypeptide
QEEEICTTNPVATEQYGSVSTNLQPGNMTL

SEQ ID NO: 23830 - protein, 33 aa, Artificial Sequence
  Description of Artificial Sequence: Synthetic polypeptide
DEEEIRTTNPVATEQYGEVPSCTNLSQRGGNER

SEQ ID NO: 23831 - protein, 31 aa, Artificial Sequence
  Description of Artificial Sequence: Synthetic polypeptide
AEEEIRTTNPVATEQYGSVVNSTNLQTGNDG

SEQ ID NO: 23832 - protein, 31 aa, Artificial Sequence
  Description of Artificial Sequence: Synthetic polypeptide
AEEEIRTTNPVATEQYGSVSVTNLQQGSNAS

SEQ ID NO: 23833 - protein, 31 aa, Artificial Sequence
  Description of Artificial Sequence: Synthetic polypeptide
DEEEIRTTNPCATEQYGSVCATNLQRGDNLA

SEQ ID NO: 23834 - protein, 31 aa, Artificial Sequence
  Description of Artificial Sequence: Synthetic polypeptide
AEEEIRTTNPVATEQYGSVSVTNLQQGNASE

SEQ ID NO: 23835 - protein, 31 aa, Artificial Sequence
  Description of Artificial Sequence: Synthetic polypeptide
AEEEIRTTNPVATEQYGSVSVTNLQQGEQNN

SEQ ID NO: 23836 - protein, 31 aa, Artificial Sequence
  Description of Artificial Sequence: Synthetic polypeptide
DEEEIRTTNPVATEQYGEVSTNNQIGGENER

SEQ ID NO: 23837 - protein, 31 aa, Artificial Sequence
  Description of Artificial Sequence: Synthetic polypeptide
AEEEIRTTNPVATEQYGSVSVTNLQQGANTE

SEQ ID NO: 23838 - protein, 31 aa, Artificial Sequence
  Description of Artificial Sequence: Synthetic polypeptide
AEEEIRTTNPVATEQYGSVSVTNLQQESENR

SEQ ID NO: 23839 - protein, 31 aa, Artificial Sequence
  Description of Artificial Sequence: Synthetic polypeptide
DEEEIRTTNPVATEQYGSVSTNAQNGGNEQG

SEQ ID NO: 23840 - protein, 30 aa, Artificial Sequence
  Description of Artificial Sequence: Synthetic polypeptide
DEEEIRTTNPVATEQYGEVSTYDQFGSNRP

SEQ ID NO: 23841 - protein, 30 aa, Artificial Sequence
  Description of Artificial Sequence: Synthetic polypeptide
DEEEIRTTNPVATEQYGEVSWTDMNRGMNR

SEQ ID NO: 23842 - protein, 31 aa, Artificial Sequence
  Description of Artificial Sequence: Synthetic polypeptide
DEEEIRTTNPVATEQYGSVSTNGTQENFGNF

SEQ ID NO: 23843 - protein, 31 aa, Artificial Sequence
  Description of Artificial Sequence: Synthetic polypeptide
AEEEIRTTNPVATEQYGSVSVTNLQQGTNMS

SEQ ID NO: 23844 - protein, 30 aa, Artificial Sequence
  Description of Artificial Sequence: Synthetic polypeptide
AEEEIRTTNPVATEQYGSVVNTTNLQAGNQ

SEQ ID NO: 23845 - protein, 31 aa, Artificial Sequence
  Description of Artificial Sequence: Synthetic polypeptide
DEEEIRTTNPVATEQYGSVSTNAQGGGNQQV

SEQ ID NO: 23846 - protein, 32 aa, Artificial Sequence
  Description of Artificial Sequence: Synthetic polypeptide
DEEEIRTTNPVATEQYGSVSGTNLQGIGQNID

SEQ ID NO: 23847 - protein, 30 aa, Artificial Sequence
  Description of Artificial Sequence: Synthetic polypeptide
AEEEIRTTNPVATEQYGSVVSNNLGNDGNR

SEQ ID NO: 23848 - protein, 29 aa, Artificial Sequence
  Description of Artificial Sequence: Synthetic peptide
AEEEIRTTNPVATEQYGSVVSNNLGQGNQ

SEQ ID NO: 23849 - protein, 30 aa, Artificial Sequence
  Description of Artificial Sequence: Synthetic polypeptide
DEEEIRTTNPCATEQYGSVCATNLQSGNDA

SEQ ID NO: 23850 - protein, 29 aa, Artificial Sequence
  Description of Artificial Sequence: Synthetic peptide
AEEEIRTTNPVATEQYGSVVSNNQGSGNR

SEQ ID NO: 23851 - protein, 31 aa, Artificial Sequence
  Description of Artificial Sequence: Synthetic polypeptide
AEEEIRTTNPVATEQYGSVVSSTNLNQGGNH

SEQ ID NO: 23852 - protein, 30 aa, Artificial Sequence
  Description of Artificial Sequence: Synthetic polypeptide
DEEEIRTTNPVATEQYGSVSTNHDRNNNEE

SEQ ID NO: 23853 - protein, 29 aa, Artificial Sequence
  Description of Artificial Sequence: Synthetic peptide
AEEEIRTTNPVATEQYGSVVSTDNQGGNV

SEQ ID NO: 23854 - protein, 31 aa, Artificial Sequence
  Description of Artificial Sequence: Synthetic polypeptide
AEEEIRTTNPVATEQYGSVSVTNLQNQGNSQ

SEQ ID NO: 23855 - protein, 31 aa, Artificial Sequence
  Description of Artificial Sequence: Synthetic polypeptide
AEEEIRTTNPVATEQYGSVSVTNLQNQGNDA

SEQ ID NO: 23856 - protein, 32 aa, Artificial Sequence
  Description of Artificial Sequence: Synthetic polypeptide
AEEEIRTTNPVATEQYGSVSVTNLQNIQGTNR

SEQ ID NO: 23857 - protein, 31 aa, Artificial Sequence
  Description of Artificial Sequence: Synthetic polypeptide
AEEEIRTTNPVATEQYGSVVQSTNNQQGNGR

SEQ ID NO: 23858 - protein, 31 aa, Artificial Sequence
  Description of Artificial Sequence: Synthetic polypeptide
DEEEIRTTNPVATEQYGSVSTNHEQSGSNQG

SEQ ID NO: 23859 - protein, 31 aa, Artificial Sequence
  Description of Artificial Sequence: Synthetic polypeptide
AEEEIRTTNPVATEQYGSVVNSTNLQGQGNP

SEQ ID NO: 23860 - protein, 32 aa, Artificial Sequence
  Description of Artificial Sequence: Synthetic polypeptide
AEEEIRTTNPVATEQYGSVSVTNLQQLQGTNR

SEQ ID NO: 23861 - protein, 29 aa, Artificial Sequence
  Description of Artificial Sequence: Synthetic peptide
QEEEICTTNPVATEPYGSVSTNLQHGNDL

SEQ ID NO: 23862 - protein, 31 aa, Artificial Sequence
  Description of Artificial Sequence: Synthetic polypeptide
AEEEIRTTNPVATEQYGSVSVTNLQTTGNDD

SEQ ID NO: 23863 - protein, 31 aa, Artificial Sequence
  Description of Artificial Sequence: Synthetic polypeptide
AEEEIRTTNPVATEQYGSVSVTNLQTGNQGQ

SEQ ID NO: 23864 - protein, 30 aa, Artificial Sequence
  Description of Artificial Sequence: Synthetic polypeptide
DEEEIRTTNPVATEQYGSVSTNDDGGENFT

SEQ ID NO: 23865 - protein, 30 aa, Artificial Sequence
  Description of Artificial Sequence: Synthetic polypeptide
QEEEICTTNPVATEMYGSVSTNLQDRGNIQ

SEQ ID NO: 23866 - protein, 30 aa, Artificial Sequence
  Description of Artificial Sequence: Synthetic polypeptide
AEEEIRTTNPVATEQYGSVSVTNLQSGSQN

SEQ ID NO: 23867 - protein, 31 aa, Artificial Sequence
  Description of Artificial Sequence: Synthetic polypeptide
AEEEIRTTNPVATEQYGSVSVTNLQSGSNEF

SEQ ID NO: 23868 - protein, 30 aa, Artificial Sequence
  Description of Artificial Sequence: Synthetic polypeptide
QEEEICTTNPVATEMYGSVATNLQNRGNTR

SEQ ID NO: 23869 - protein, 29 aa, Artificial Sequence
  Description of Artificial Sequence: Synthetic peptide
DEEEIRTTNPVATEQYGSVSTNGQSSMDN

SEQ ID NO: 23870 - protein, 30 aa, Artificial Sequence
  Description of Artificial Sequence: Synthetic polypeptide
QEEEICTTNPVATEGYGSVSTNLQRDGNHS

SEQ ID NO: 23871 - protein, 30 aa, Artificial Sequence
  Description of Artificial Sequence: Synthetic polypeptide
DEEEIRTTNPVATEQYGEVSTMNLQHGDDN

SEQ ID NO: 23872 - protein, 29 aa, Artificial Sequence
  Description of Artificial Sequence: Synthetic peptide
QEEEICTTNPVATEAYGSVSTNLQPGNQL

SEQ ID NO: 23873 - protein, 31 aa, Artificial Sequence
  Description of Artificial Sequence: Synthetic polypeptide
AEEEIRTTNPVATEQYGSVSVTNLQQLNGND

SEQ ID NO: 23874 - protein, 31 aa, Artificial Sequence
  Description of Artificial Sequence: Synthetic polypeptide
AEEEIRTTNPVATEQYGSVSVTNLQQSGSNQ

SEQ ID NO: 23875 - protein, 32 aa, Artificial Sequence
  Description of Artificial Sequence: Synthetic polypeptide
AEEEIRTTNPVATEQYGSVSVTNLQQSGGNNR

SEQ ID NO: 23876 - protein, 31 aa, Artificial Sequence
  Description of Artificial Sequence: Synthetic polypeptide
AEEEIRTTNPVATEQYGSVSVTNLQQSGEQR

SEQ ID NO: 23877 - protein, 32 aa, Artificial Sequence
  Description of Artificial Sequence: Synthetic polypeptide
AEEEIRTTNPVATEQYGSVSVTNLQQQQGVNR

SEQ ID NO: 23878 - protein, 30 aa, Artificial Sequence
  Description of Artificial Sequence: Synthetic polypeptide
AEEEIRTTNPVATEQYGSVSVTNLQQQNSA

SEQ ID NO: 23879 - protein, 31 aa, Artificial Sequence
  Description of Artificial Sequence: Synthetic polypeptide
AEEEIRTTNPVATEQYGSVSVTNLQQQGNST

SEQ ID NO: 23880 - protein, 32 aa, Artificial Sequence
  Description of Artificial Sequence: Synthetic polypeptide
AEEEIRTTNPVATEQYGSVSVTNLQQNNGNQR

SEQ ID NO: 23881 - protein, 31 aa, Artificial Sequence
  Description of Artificial Sequence: Synthetic polypeptide
AEEEIRTTNPVATEQYGSVSVTNLQQNGNPL

SEQ ID NO: 23882 - protein, 30 aa, Artificial Sequence
  Description of Artificial Sequence: Synthetic polypeptide
AEEEIRTTNPVATEQYGSVVATNLQAGNQT

SEQ ID NO: 23883 - protein, 30 aa, Artificial Sequence
  Description of Artificial Sequence: Synthetic polypeptide
DEEEIRTTNPCATEQYGSVCASNLQRGNNA

SEQ ID NO: 23884 - protein, 31 aa, Artificial Sequence
  Description of Artificial Sequence: Synthetic polypeptide
AEEEIRTTNPVATEQYGSVSVTNLQQNAGNG

SEQ ID NO: 23885 - protein, 29 aa, Artificial Sequence
  Description of Artificial Sequence: Synthetic peptide
AEEEIRTTNPVATEQYGSVVNNLQNNGND

SEQ ID NO: 23886 - protein, 29 aa, Artificial Sequence
  Description of Artificial Sequence: Synthetic peptide
AEEEIRTTNPVATEQYGSVVNNLQQEGNQ

SEQ ID NO: 23887 - protein, 31 aa, Artificial Sequence
  Description of Artificial Sequence: Synthetic polypeptide
AEEEIRTTNPVATEQYGSVSVTNLQQSGSNL

SEQ ID NO: 23888 - protein, 30 aa, Artificial Sequence
  Description of Artificial Sequence: Synthetic polypeptide
QEEEICTTNPVATEPYGSVSTNLQNGDNRD

SEQ ID NO: 23889 - protein, 31 aa, Artificial Sequence
  Description of Artificial Sequence: Synthetic polypeptide
AEEEIRTTNPVATEQYGSVVSTNLEQGGNQQ

SEQ ID NO: 23890 - protein, 30 aa, Artificial Sequence
  Description of Artificial Sequence: Synthetic polypeptide
AEEEIRTTNPVATEQYGSVVSTNLGDTGNQ

SEQ ID NO: 23891 - protein, 30 aa, Artificial Sequence
  Description of Artificial Sequence: Synthetic polypeptide
AEEEIRTTNPVATEQYGSVVSTNLQNANND

SEQ ID NO: 23892 - protein, 31 aa, Artificial Sequence
  Description of Artificial Sequence: Synthetic polypeptide
AEEEIRTTNPVATEQYGSVVSTNLQNGNNLG

SEQ ID NO: 23893 - protein, 31 aa, Artificial Sequence
  Description of Artificial Sequence: Synthetic polypeptide
AEEEIRTTNPVATEQYGSVSVTNLQEEGTNE

SEQ ID NO: 23894 - protein, 30 aa, Artificial Sequence
  Description of Artificial Sequence: Synthetic polypeptide
AEEEIRTTNPVATEQYGSVVSTNLQPANHQ

SEQ ID NO: 23895 - protein, 31 aa, Artificial Sequence
  Description of Artificial Sequence: Synthetic polypeptide
AEEEIRTTNPVATEQYGSVVSTNLQQGNGNG

SEQ ID NO: 23896 - protein, 31 aa, Artificial Sequence
  Description of Artificial Sequence: Synthetic polypeptide
AEEEIRTTNPVATEQYGSVVSTNLQQQGTNG

SEQ ID NO: 23897 - protein, 31 aa, Artificial Sequence
  Description of Artificial Sequence: Synthetic polypeptide
AEEEIRTTNPVATEQYGSVVSTNLQTVGNGI

SEQ ID NO: 23898 - protein, 31 aa, Artificial Sequence
  Description of Artificial Sequence: Synthetic polypeptide
AEEEIRTTNPVATEQYGSVSVTNLQAGANNL

SEQ ID NO: 23899 - protein, 30 aa, Artificial Sequence
  Description of Artificial Sequence: Synthetic polypeptide
AEEEIRTTNPVATEQYGSVVSTNLVVTGNG

SEQ ID NO: 23900 - protein, 31 aa, Artificial Sequence
  Description of Artificial Sequence: Synthetic polypeptide
AEEEIRTTNPVATEQYGSVSVTNLNQSGIND

SEQ ID NO: 23901 - protein, 30 aa, Artificial Sequence
  Description of Artificial Sequence: Synthetic polypeptide
DEEEIRTTNPCATEQYGSVCSTNLQGGDQG

SEQ ID NO: 23902 - protein, 30 aa, Artificial Sequence
  Description of Artificial Sequence: Synthetic polypeptide
AEEEIRTTNPVATEQYGSVVSTNNGTVGNR

SEQ ID NO: 23903 - protein, 31 aa, Artificial Sequence
  Description of Artificial Sequence: Synthetic polypeptide
AEEEIRTTNPVATEQYGSVSVTNLQEQGNVE

SEQ ID NO: 23904 - protein, 31 aa, Artificial Sequence
  Description of Artificial Sequence: Synthetic polypeptide
AEEEIRTTNPVATEQYGSVVSTNNLEQGGNV

SEQ ID NO: 23905 - protein, 30 aa, Artificial Sequence
  Description of Artificial Sequence: Synthetic polypeptide
AEEEIRTTNPVATEQYGSVVSTNNLGIGNA

SEQ ID NO: 23906 - protein, 31 aa, Artificial Sequence
  Description of Artificial Sequence: Synthetic polypeptide
AEEEIRTTNPVATEQYGSVSVTNLNQNAGNP

SEQ ID NO: 23907 - protein, 31 aa, Artificial Sequence
  Description of Artificial Sequence: Synthetic polypeptide
DEEEIRTTNPVATEQYGSVSGTNDQTEGGNT

SEQ ID NO: 23908 - protein, 30 aa, Artificial Sequence
  Description of Artificial Sequence: Synthetic polypeptide
DEEEIRTTNPVATEQYGFCSTINPLQRENV

SEQ ID NO: 23909 - protein, 30 aa, Artificial Sequence
  Description of Artificial Sequence: Synthetic polypeptide
AEEEIRTTNPVATEQYGSVVSTNNQDQGNG

SEQ ID NO: 23910 - protein, 32 aa, Artificial Sequence
  Description of Artificial Sequence: Synthetic polypeptide
DEEEIRTTNPVATEQYGSVSTNALQRFGSQQN

SEQ ID NO: 23911 - protein, 29 aa, Artificial Sequence
  Description of Artificial Sequence: Synthetic peptide
AEEEIRTTNPVATEQYGSVVSTNQLEGNI

SEQ ID NO: 23912 - protein, 30 aa, Artificial Sequence
  Description of Artificial Sequence: Synthetic polypeptide
DEEEIRTTNPVATEQYGSVSTNHQFSSNDS

SEQ ID NO: 23913 - protein, 31 aa, Artificial Sequence
  Description of Artificial Sequence: Synthetic polypeptide
AEEEIRTTNPVATEQYGSVVSTNQLQNQGNL

SEQ ID NO: 23914 - protein, 31 aa, Artificial Sequence
  Description of Artificial Sequence: Synthetic polypeptide
AEEEIRTTNPVATEQYGSVSVTNLLTQQGNA

SEQ ID NO: 23915 - protein, 30 aa, Artificial Sequence
  Description of Artificial Sequence: Synthetic polypeptide
AEEEIRTTNPVATEQYGSVVSTNTNQDGNV

SEQ ID NO: 23916 - protein, 30 aa, Artificial Sequence
  Description of Artificial Sequence: Synthetic polypeptide
AEEEIRTTNPVATEQYGSVVSTNTQNVGNG

SEQ ID NO: 23917 - protein, 32 aa, Artificial Sequence
  Description of Artificial Sequence: Synthetic polypeptide
AEEEIRTTNPVATEQYGSVSVTNLNQNESGNR

SEQ ID NO: 23918 - protein, 30 aa, Artificial Sequence
  Description of Artificial Sequence: Synthetic polypeptide
AEEEIRTTNPVATEQYGSVVSTNLEQGSNE

SEQ ID NO: 23919 - protein, 31 aa, Artificial Sequence
  Description of Artificial Sequence: Synthetic polypeptide
AEEEIRTTNPVATEQYGSVVSTNLQENGNNQ

SEQ ID NO: 23920 - protein, 32 aa, Artificial Sequence
  Description of Artificial Sequence: Synthetic polypeptide
AEEEIRTTNPVATEQYGSVSVTNLQGDEGENR

SEQ ID NO: 23921 - protein, 30 aa, Artificial Sequence
  Description of Artificial Sequence: Synthetic polypeptide
AEEEIRTTNPVATEQYGSVSVTNLQNIINT

SEQ ID NO: 23922 - protein, 30 aa, Artificial Sequence
  Description of Artificial Sequence: Synthetic polypeptide
DEEEIRTTNPVATEQYGSVSTNHGDRIEDR

SEQ ID NO: 23923 - protein, 31 aa, Artificial Sequence
  Description of Artificial Sequence: Synthetic polypeptide
AEEEIRTTNPVATEQYGSVVSTNLGGDGNNR

SEQ ID NO: 23924 - protein, 30 aa, Artificial Sequence
  Description of Artificial Sequence: Synthetic polypeptide
DEEEIRTTNPVATEQYGSVSTNHGERGFSE

SEQ ID NO: 23925 - protein, 31 aa, Artificial Sequence
  Description of Artificial Sequence: Synthetic polypeptide
DEEEIRTTNPVATEQYGSVSTNHIHIGSNRA

SEQ ID NO: 23926 - protein, 30 aa, Artificial Sequence
  Description of Artificial Sequence: Synthetic polypeptide
AEEEIRTTNPVATEQYGSVVSTNLGNEGND

SEQ ID NO: 23927 - protein, 30 aa, Artificial Sequence
  Description of Artificial Sequence: Synthetic polypeptide
AEEEIRTTNPVATEQYGSVVSTNLGQGTNY

SEQ ID NO: 23928 - protein, 31 aa, Artificial Sequence
  Description of Artificial Sequence: Synthetic polypeptide
AEEEIRTTNPVATEQYGSVSVTNLQNIGNST

SEQ ID NO: 23929 - protein, 31 aa, Artificial Sequence
  Description of Artificial Sequence: Synthetic polypeptide
AEEEIRTTNPVATEQYGSVVSTNLGQTVGNS

SEQ ID NO: 23930 - protein, 31 aa, Artificial Sequence
  Description of Artificial Sequence: Synthetic polypeptide
AEEEIRTTNPVATEQYGSVSVTNLQNGNPTQ

SEQ ID NO: 23931 - protein, 31 aa, Artificial Sequence
  Description of Artificial Sequence: Synthetic polypeptide
AEEEIRTTNPVATEQYGSVSVTNLQNFGNQT

SEQ ID NO: 23932 - protein, 31 aa, Artificial Sequence
  Description of Artificial Sequence: Synthetic polypeptide
AEEEIRTTNPVATEQYGSVVSTNLLQDEGNG

SEQ ID NO: 23933 - protein, 31 aa, Artificial Sequence
  Description of Artificial Sequence: Synthetic polypeptide
AEEEIRTTNPVATEQYGSVSVTNLQGAGGNE

SEQ ID NO: 23934 - protein, 31 aa, Artificial Sequence
  Description of Artificial Sequence: Synthetic polypeptide
AEEEIRTTNPVATEQYGSVSVTNLQLIGNQG

SEQ ID NO: 23935 - protein, 33 aa, Artificial Sequence
  Description of Artificial Sequence: Synthetic polypeptide
DEEEIRTTNPVATEQYGSVSTNALSQRTGGNIG

SEQ ID NO: 23936 - protein, 32 aa, Artificial Sequence
  Description of Artificial Sequence: Synthetic polypeptide
AEEEIRTTNPVATEQYGSVSVTNLQGTIGTNR

SEQ ID NO: 23937 - protein, 30 aa, Artificial Sequence
  Description of Artificial Sequence: Synthetic polypeptide
AEEEIRTTNPVATEQYGSVVSTNLNEGQNT

SEQ ID NO: 23938 - protein, 31 aa, Artificial Sequence
  Description of Artificial Sequence: Synthetic polypeptide
AEEEIRTTNPVATEQYGSVSVTNLQGGTANN

SEQ ID NO: 23939 - protein, 31 aa, Artificial Sequence
  Description of Artificial Sequence: Synthetic polypeptide
AEEEIRTTNPVATEQYGSVVSTNLNGQTGNS

SEQ ID NO: 23940 - protein, 31 aa, Artificial Sequence
  Description of Artificial Sequence: Synthetic polypeptide
AEEEIRTTNPVATEQYGSVVSTNLNQLGGNE

SEQ ID NO: 23941 - protein, 31 aa, Artificial Sequence
  Description of Artificial Sequence: Synthetic polypeptide
AEEEIRTTNPVATEQYGSVSVTNLQGGGTNT

SEQ ID NO: 23942 - protein, 30 aa, Artificial Sequence
  Description of Artificial Sequence: Synthetic polypeptide
AEEEIRTTNPVATEQYGSVVSTNLNVVGNG

SEQ ID NO: 23943 - protein, 31 aa, Artificial Sequence
  Description of Artificial Sequence: Synthetic polypeptide
AEEEIRTTNPVATEQYGSVSVTNLQGEGMNE

SEQ ID NO: 23944 - protein, 31 aa, Artificial Sequence
  Description of Artificial Sequence: Synthetic polypeptide
AEEEIRTTNPVATEQYGSVVSTNLQAGTNQD

SEQ ID NO: 23945 - protein, 31 aa, Artificial Sequence
  Description of Artificial Sequence: Synthetic polypeptide
AEEEIRTTNPVATEQYGSVVSTNLQDGGNQG

SEQ ID NO: 23946 - protein, 30 aa, Artificial Sequence
  Description of Artificial Sequence: Synthetic polypeptide
AEEEIRTTNPVATEQYGSVVSTNLQDSNNG

SEQ ID NO: 23947 - protein, 31 aa, Artificial Sequence
  Description of Artificial Sequence: Synthetic polypeptide
AEEEIRTTNPVATEQYGSVSVTNLQLGINNA

SEQ ID NO: 23948 - protein, 29 aa, Artificial Sequence
  Description of Artificial Sequence: Synthetic peptide
QEEEICTTNPVATEPYGSVSTNLQNGPRE

SEQ ID NO: 23949 - protein, 31 aa, Artificial Sequence
  Description of Artificial Sequence: Synthetic polypeptide
AEEEIRTTNPVATEQYGSVSVTNLQYGNQNN

SEQ ID NO: 23950 - protein, 29 aa, Artificial Sequence
  Description of Artificial Sequence: Synthetic peptide
QEEEICTTNPVATEPYGSVSTNLQRDSNS

SEQ ID NO: 23951 - protein, 32 aa, Artificial Sequence
  Description of Artificial Sequence: Synthetic polypeptide
DEEEIRTTNPVATEQYGEVSCTNLSQNRGGNS

SEQ ID NO: 23952 - protein, 33 aa, Artificial Sequence
  Description of Artificial Sequence: Synthetic polypeptide
DEEEIRTTNPVATEQYGEVSCTNLSQRGGNNRN

SEQ ID NO: 23953 - protein, 30 aa, Artificial Sequence
  Description of Artificial Sequence: Synthetic polypeptide
DEEEIRTTNPCATEQYGSVATNLQRGDLTA

SEQ ID NO: 23954 - protein, 31 aa, Artificial Sequence
  Description of Artificial Sequence: Synthetic polypeptide
DEEEIRTTNPVATEQYGSVSTNDLDQGGMTD

SEQ ID NO: 23955 - protein, 32 aa, Artificial Sequence
  Description of Artificial Sequence: Synthetic polypeptide
DEEEIRTTNPVATEQYGSVSTNDLARFGSNQN

SEQ ID NO: 23956 - protein, 30 aa, Artificial Sequence
  Description of Artificial Sequence: Synthetic polypeptide
AEEEIRTTNPVATEQYGSVTNTNLQAGGNE

SEQ ID NO: 23957 - protein, 28 aa, Artificial Sequence
  Description of Artificial Sequence: Synthetic peptide
DEEEIRTTNPVATEQYGEVSEVLQHEER

SEQ ID NO: 23958 - protein, 30 aa, Artificial Sequence
  Description of Artificial Sequence: Synthetic polypeptide
AEEEIRTTNPVATEQYGSVTNTNLQGGNQD

SEQ ID NO: 23959 - protein, 31 aa, Artificial Sequence
  Description of Artificial Sequence: Synthetic polypeptide
DEEEIRTTNPCATEQYGSVATNLQRGDNEDD

SEQ ID NO: 23960 - protein, 31 aa, Artificial Sequence
  Description of Artificial Sequence: Synthetic polypeptide
AEEEIRTTNPVATEQYGSVTSATANGQDGNR

SEQ ID NO: 23961 - protein, 31 aa, Artificial Sequence
  Description of Artificial Sequence: Synthetic polypeptide
DEEEIRTTNPVATEQYGSVSTNDLARFGSEL

SEQ ID NO: 23962 - protein, 31 aa, Artificial Sequence
  Description of Artificial Sequence: Synthetic polypeptide
DEEEIRTTNPCATEQYGSVATNLQRGDNLVM

SEQ ID NO: 23963 - protein, 33 aa, Artificial Sequence
  Description of Artificial Sequence: Synthetic polypeptide
DEEEIRTTNPVATEQYGEVSCTGNLSQRGGNDR

SEQ ID NO: 23964 - protein, 31 aa, Artificial Sequence
  Description of Artificial Sequence: Synthetic polypeptide
AEEEIRTTNPVATEQYGSVTSTENLQGGSND

SEQ ID NO: 23965 - protein, 30 aa, Artificial Sequence
  Description of Artificial Sequence: Synthetic polypeptide
AEEEIRTTNPVATEQYGSVTSTNLGGGGNG

SEQ ID NO: 23966 - protein, 31 aa, Artificial Sequence
  Description of Artificial Sequence: Synthetic polypeptide
DEEEIRTTNPVATEQYGEVSGTNLQFGNDGV

SEQ ID NO: 23967 - protein, 32 aa, Artificial Sequence
  Description of Artificial Sequence: Synthetic polypeptide
AEEEIRTTNPVATEQYGSVSVTNNLQAIGTNR

SEQ ID NO: 23968 - protein, 31 aa, Artificial Sequence
  Description of Artificial Sequence: Synthetic polypeptide
AEEEIRTTNPVATEQYGSVTSTNLQANGNNS

SEQ ID NO: 23969 - protein, 30 aa, Artificial Sequence
  Description of Artificial Sequence: Synthetic polypeptide
DEECIRTTNPVATEQYSEVVSTNLQIFGNR

SEQ ID NO: 23970 - protein, 31 aa, Artificial Sequence
  Description of Artificial Sequence: Synthetic polypeptide
DEEEIRTTNPCATEQYGSVATNLQRGENESW

SEQ ID NO: 23971 - protein, 31 aa, Artificial Sequence
  Description of Artificial Sequence: Synthetic polypeptide
AEEEIRTTNPVATEQYGSVTSTNLQNNGVNN

SEQ ID NO: 23972 - protein, 31 aa, Artificial Sequence
  Description of Artificial Sequence: Synthetic polypeptide
DEEEIRTTNPVATEQYGSVSTNGLIETGNLE

SEQ ID NO: 23973 - protein, 31 aa, Artificial Sequence
  Description of Artificial Sequence: Synthetic polypeptide
AEEEIRTTNPVATEQYGSVTSTNLQSGTNNV

SEQ ID NO: 23974 - protein, 32 aa, Artificial Sequence
  Description of Artificial Sequence: Synthetic polypeptide
DEEEIRTTNPVATEQYGSVSTNGLIGRGLNLS

SEQ ID NO: 23975 - protein, 31 aa, Artificial Sequence
  Description of Artificial Sequence: Synthetic polypeptide
DEEEIRTTNPVATEQYGEVSGTNLQQGNTGE

SEQ ID NO: 23976 - protein, 30 aa, Artificial Sequence
  Description of Artificial Sequence: Synthetic polypeptide
AEEEIRTTNPVATEQYGSVTSTNNQQEGNT

SEQ ID NO: 23977 - protein, 31 aa, Artificial Sequence
  Description of Artificial Sequence: Synthetic polypeptide
DEEEIRTTNPVATEQYGSVSTNDLADGNEEY

SEQ ID NO: 23978 - protein, 30 aa, Artificial Sequence
  Description of Artificial Sequence: Synthetic polypeptide
AEEEIRTTNPVATEQYGSVTSTTNLQQANQ

SEQ ID NO: 23979 - protein, 34 aa, Artificial Sequence
  Description of Artificial Sequence: Synthetic polypeptide
DEEEIRTTNPVATEQYGSVSTNGLDQWRMGDNRD

SEQ ID NO: 23980 - protein, 31 aa, Artificial Sequence
  Description of Artificial Sequence: Synthetic polypeptide
QEEEVRTTNPVATEQYGSVSTDNEDQRIGNR

SEQ ID NO: 23981 - protein, 30 aa, Artificial Sequence
  Description of Artificial Sequence: Synthetic polypeptide
QEEEICTTNPVATEQYGSVSTNLQNGNDTQ

SEQ ID NO: 23982 - protein, 29 aa, Artificial Sequence
  Description of Artificial Sequence: Synthetic peptide
QEEEICTTNPVATEQYGSVSTNLQNGMVS

SEQ ID NO: 23983 - protein, 29 aa, Artificial Sequence
  Description of Artificial Sequence: Synthetic peptide
QEEEICTTNPVATEQYGSVSTNLQNDNVE

SEQ ID NO: 23984 - protein, 30 aa, Artificial Sequence
  Description of Artificial Sequence: Synthetic polypeptide
QEEEICTTNPVATEQYGSVSTNLQNDGNAM

SEQ ID NO: 23985 - protein, 30 aa, Artificial Sequence
  Description of Artificial Sequence: Synthetic polypeptide
QEEEICTTNPVATEQYGSVSTNLQMGNENL

SEQ ID NO: 23986 - protein, 33 aa, Artificial Sequence
  Description of Artificial Sequence: Synthetic polypeptide
DEEEIRTTNPVATEQYGEVPSQTNELSQRGGNR

SEQ ID NO: 23987 - protein, 30 aa, Artificial Sequence
  Description of Artificial Sequence: Synthetic polypeptide
QEEEICTTNPVATEQYGSVSTNLQHGNPTM

SEQ ID NO: 23988 - protein, 31 aa, Artificial Sequence
  Description of Artificial Sequence: Synthetic polypeptide
DEEEIRTTNPCATEQYGSVATNLQRDSDNRD

SEQ ID NO: 23989 - protein, 30 aa, Artificial Sequence
  Description of Artificial Sequence: Synthetic polypeptide
QEEEICTTNPVATEQYGSVSTNLQHGNESM

SEQ ID NO: 23990 - protein, 30 aa, Artificial Sequence
  Description of Artificial Sequence: Synthetic polypeptide
QEEEICTTNPVATEQYGSVSTNLQHGENDE

SEQ ID NO: 23991 - protein, 29 aa, Artificial Sequence
  Description of Artificial Sequence: Synthetic peptide
QEEEICTTNPVATEQYGSVSTNLQHDNEH

SEQ ID NO: 23992 - protein, 29 aa, Artificial Sequence
  Description of Artificial Sequence: Synthetic peptide
QEEEICTTNPVATEQYGSVSTNLQGVDDR

SEQ ID NO: 23993 - protein, 33 aa, Artificial Sequence
  Description of Artificial Sequence: Synthetic polypeptide
DEEEIRTTNPVATEQYGSVSTNDLDQHRGEDER

SEQ ID NO: 23994 - protein, 30 aa, Artificial Sequence
  Description of Artificial Sequence: Synthetic polypeptide
QEEEICTTNPVATEQYGSVSTNLQGGNVPL

SEQ ID NO: 23995 - protein, 30 aa, Artificial Sequence
  Description of Artificial Sequence: Synthetic polypeptide
DEEEIRTTNPVATEQYGSVSTNGHGNGERN

SEQ ID NO: 23996 - protein, 33 aa, Artificial Sequence
  Description of Artificial Sequence: Synthetic polypeptide
DEEEIRTTNPVATEQYGEVQSTNELSQRTGGNR

SEQ ID NO: 23997 - protein, 30 aa, Artificial Sequence
  Description of Artificial Sequence: Synthetic polypeptide
QEEEICTTNPVATEQYGSVSTNLDRGPNES

SEQ ID NO: 23998 - protein, 30 aa, Artificial Sequence
  Description of Artificial Sequence: Synthetic polypeptide
QEEEICTTNPVATEQYGSVSTNLDRGDNQT

SEQ ID NO: 23999 - protein, 31 aa, Artificial Sequence
  Description of Artificial Sequence: Synthetic polypeptide
DEEEIRTTNPVATEQYGSVSTNGHQERDMPR

SEQ ID NO: 24000 - protein, 31 aa, Artificial Sequence
  Description of Artificial Sequence: Synthetic polypeptide
DEEEIRTTNPVATEQYGSVSGTNINGQTGNQ

SEQ ID NO: 24001 - protein, 30 aa, Artificial Sequence
  Description of Artificial Sequence: Synthetic polypeptide
QEEEICTTNPVATEQYGSVSTNLDQGGNEQ

SEQ ID NO: 24002 - protein, 31 aa, Artificial Sequence
  Description of Artificial Sequence: Synthetic polypeptide
DEEEIRTTNPVATEQYGSVSTNGHQERDMTR

SEQ ID NO: 24003 - protein, 31 aa, Artificial Sequence
  Description of Artificial Sequence: Synthetic polypeptide
DEEEIRTTNPCATEQYGSVATNLQREANGRF

SEQ ID NO: 24004 - protein, 29 aa, Artificial Sequence
  Description of Artificial Sequence: Synthetic peptide
QEEEICTTNPVATEQYGSVSTNDQNGNTV

SEQ ID NO: 24005 - protein, 31 aa, Artificial Sequence
  Description of Artificial Sequence: Synthetic polypeptide
DEEEIRTTNPVATEQYGSVSTNGHQERIMQR

SEQ ID NO: 24006 - protein, 31 aa, Artificial Sequence
  Description of Artificial Sequence: Synthetic polypeptide
AEEEIRTTNPVATEQYGSVSVTNNLQGGNMV

SEQ ID NO: 24007 - protein, 31 aa, Artificial Sequence
  Description of Artificial Sequence: Synthetic polypeptide
QEEEVRTTNPVATEQYGSVSIENLDQRGGNR

SEQ ID NO: 24008 - protein, 31 aa, Artificial Sequence
  Description of Artificial Sequence: Synthetic polypeptide
AEEEIRTTNPVATEQYGSVTSTTNLQQGNPA

SEQ ID NO: 24009 - protein, 30 aa, Artificial Sequence
  Description of Artificial Sequence: Synthetic polypeptide
AEEEIRTTNPVATEQYGSVTSVTNLQQTNV

SEQ ID NO: 24010 - protein, 33 aa, Artificial Sequence
  Description of Artificial Sequence: Synthetic polypeptide
DEEEIRTTNPVATEQYGSVSTNGLIQRGENVES

SEQ ID NO: 24011 - protein, 31 aa, Artificial Sequence
  Description of Artificial Sequence: Synthetic polypeptide
DEEEIRTTNPVATEQYGSVSTNDEQNGSNLV

SEQ ID NO: 24012 - protein, 33 aa, Artificial Sequence
  Description of Artificial Sequence: Synthetic polypeptide
DEEEIRTTNPVATEQYGSVSTNGLQTDDGNERQ

SEQ ID NO: 24013 - protein, 29 aa, Artificial Sequence
  Description of Artificial Sequence: Synthetic peptide
QEEEICTTNPVATEQYGSVATNLQGGNHQ

SEQ ID NO: 24014 - protein, 32 aa, Artificial Sequence
  Description of Artificial Sequence: Synthetic polypeptide
DEEEIRTTNPVATEQYGSVSTNGLQTDGNEFN

SEQ ID NO: 24015 - protein, 30 aa, Artificial Sequence
  Description of Artificial Sequence: Synthetic polypeptide
AEEEIRTTNPVATEQYGSVTVTNLQQGQNQ

SEQ ID NO: 24016 - protein, 30 aa, Artificial Sequence
  Description of Artificial Sequence: Synthetic polypeptide
AEEEIRTTNPVATEQYGSVTVTNLQSGSNS

SEQ ID NO: 24017 - protein, 29 aa, Artificial Sequence
  Description of Artificial Sequence: Synthetic peptide
QEEGIRTTNPVATEQYGSVSTDLSNLGNR

SEQ ID NO: 24018 - protein, 30 aa, Artificial Sequence
  Description of Artificial Sequence: Synthetic polypeptide
DEEEIRTTNPVATEQYGSVSTNDDRGLQHP

SEQ ID NO: 24019 - protein, 29 aa, Artificial Sequence
  Description of Artificial Sequence: Synthetic peptide
QEEEICTTNPVATEQYGSVATNLQEMGNQ

SEQ ID NO: 24020 - protein, 31 aa, Artificial Sequence
  Description of Artificial Sequence: Synthetic polypeptide
DEEEIRTTNPVATEQYGSVSTNDDQRDDNQG

SEQ ID NO: 24021 - protein, 31 aa, Artificial Sequence
  Description of Artificial Sequence: Synthetic polypeptide
DEEEIRTTNPVATEQYGSVSTNGLVMPEGND

SEQ ID NO: 24022 - protein, 30 aa, Artificial Sequence
  Description of Artificial Sequence: Synthetic polypeptide
DEEEIRTTNPVATEQYGSVSTNGMQNVGEF

SEQ ID NO: 24023 - protein, 31 aa, Artificial Sequence
  Description of Artificial Sequence: Synthetic polypeptide
AEEEIRTTNPVATEQYGSVSVTNNLDQQGNM

SEQ ID NO: 24024 - protein, 29 aa, Artificial Sequence
  Description of Artificial Sequence: Synthetic peptide
QEEGIRTTNPVATEQYGSVSTNGLEGDNR

SEQ ID NO: 24025 - protein, 31 aa, Artificial Sequence
  Description of Artificial Sequence: Synthetic polypeptide
DEEEIRTTNPVATEQYGSVSTNDDQIRDEIR

SEQ ID NO: 24026 - protein, 30 aa, Artificial Sequence
  Description of Artificial Sequence: Synthetic polypeptide
AEEEIRTTNPVATEQYGSVSVTNLVTGNTA

SEQ ID NO: 24027 - protein, 30 aa, Artificial Sequence
  Description of Artificial Sequence: Synthetic polypeptide
DEEEIRTTNPVATEQYGSVSTNDDQIDGDF

SEQ ID NO: 24028 - protein, 28 aa, Artificial Sequence
  Description of Artificial Sequence: Synthetic peptide
DEEEIRTTNPCATEGYGSCSTNLADGND

SEQ ID NO: 24029 - protein, 28 aa, Artificial Sequence
  Description of Artificial Sequence: Synthetic peptide
DEEEIRTTNPCATEGYGSCSTGLARGNW

SEQ ID NO: 24030 - protein, 31 aa, Artificial Sequence
  Description of Artificial Sequence: Synthetic polypeptide
AEEEIRTTNPVATEQYGSVSVTNLVQNIGNV

SEQ ID NO: 24031 - protein, 32 aa, Artificial Sequence
  Description of Artificial Sequence: Synthetic polypeptide
AEEEIRTTNPVATEQYGSVSVTNLVQNGTNRN

SEQ ID NO: 24032 - protein, 29 aa, Artificial Sequence
  Description of Artificial Sequence: Synthetic peptide
QEEEICTTNPVATEQYGSVAANLQRVNQR

SEQ ID NO: 24033 - protein, 28 aa, Artificial Sequence
  Description of Artificial Sequence: Synthetic peptide
DEEEIRTTNPCATEGYGSCSTALARGNW

SEQ ID NO: 24034 - protein, 30 aa, Artificial Sequence
  Description of Artificial Sequence: Synthetic polypeptide
AEEEIRTTNPVATEQYGSVSVTNLTTGNEQ

SEQ ID NO: 24035 - protein, 29 aa, Artificial Sequence
  Description of Artificial Sequence: Synthetic peptide
QEEEICTTNPVATEQWGSVSTNLQHGNTA

SEQ ID NO: 24036 - protein, 32 aa, Artificial Sequence
  Description of Artificial Sequence: Synthetic polypeptide
DEEEIRTTNPVATEQYGSVSGTNLQGIGGNEL

SEQ ID NO: 24037 - protein, 31 aa, Artificial Sequence
  Description of Artificial Sequence: Synthetic polypeptide
DEEEIRTTNPVATEQYGSVSTNGPQDGQILR

SEQ ID NO: 24038 - protein, 31 aa, Artificial Sequence
  Description of Artificial Sequence: Synthetic polypeptide
DEEEIRTTNPVATEQYGSVSTNDEVRDNQRQ

SEQ ID NO: 24039 - protein, 29 aa, Artificial Sequence
  Description of Artificial Sequence: Synthetic peptide
QEEEICTTNPVATEQYGSVATNLQMGNTA

SEQ ID NO: 24040 - protein, 30 aa, Artificial Sequence
  Description of Artificial Sequence: Synthetic polypeptide
DEEEIRTTNPVATEQYGSVSTNDGDEGGNE

SEQ ID NO: 24041 - protein, 30 aa, Artificial Sequence
  Description of Artificial Sequence: Synthetic polypeptide
DEEEIRTTNPCATEQYGSVATNLQRNNDQN

SEQ ID NO: 24042 - protein, 30 aa, Artificial Sequence
  Description of Artificial Sequence: Synthetic polypeptide
AEEEIRTTNPVATEQYGSVTTNLQDGSNGN

SEQ ID NO: 24043 - protein, 32 aa, Artificial Sequence
  Description of Artificial Sequence: Synthetic polypeptide
DEEEIRTTNPVATEQYGSVSTNDHQERGMIRL

SEQ ID NO: 24044 - protein, 32 aa, Artificial Sequence
  Description of Artificial Sequence: Synthetic polypeptide
DEEEIRTTNPVATEQYGSVSTNGLQASLENRI

SEQ ID NO: 24045 - protein, 30 aa, Artificial Sequence
  Description of Artificial Sequence: Synthetic polypeptide
DEEEIRTTNPCATEQYGSVATNLQRNNTLM

SEQ ID NO: 24046 - protein, 29 aa, Artificial Sequence
  Description of Artificial Sequence: Synthetic peptide
AEEEIRTTNPVATEQYGSVTTNLQSGGVQ

SEQ ID NO: 24047 - protein, 30 aa, Artificial Sequence
  Description of Artificial Sequence: Synthetic polypeptide
AEEEIRTTNPVATEQYGSVTTNLQSGNQII

SEQ ID NO: 24048 - protein, 28 aa, Artificial Sequence
  Description of Artificial Sequence: Synthetic peptide
DECVIATTNPVATEQYGCVETNQQRGNR

SEQ ID NO: 24049 - protein, 32 aa, Artificial Sequence
  Description of Artificial Sequence: Synthetic polypeptide
AEEEIRTTNPVATEQYGSVTTSNLVQRGENER

SEQ ID NO: 24050 - protein, 29 aa, Artificial Sequence
  Description of Artificial Sequence: Synthetic peptide
DEEEIRTTNPCATEQYGSVATNLQRNQEM

SEQ ID NO: 24051 - protein, 29 aa, Artificial Sequence
  Description of Artificial Sequence: Synthetic peptide
DEEEIRTTNPCATEQYGSVATNLQRVEEM

SEQ ID NO: 24052 - protein, 31 aa, Artificial Sequence
  Description of Artificial Sequence: Synthetic polypeptide
QEEEVRTTNPVATEQYGSVSTMNLDQRIQNR

SEQ ID NO: 24053 - protein, 30 aa, Artificial Sequence
  Description of Artificial Sequence: Synthetic polypeptide
QEEEICTTNPVATEQYGSVATNLQSGNSRE

SEQ ID NO: 24054 - protein, 32 aa, Artificial Sequence
  Description of Artificial Sequence: Synthetic polypeptide
DEEEIRTTNPVATEQYGSVSTNGLQDGNFEDQ

SEQ ID NO: 24055 - protein, 31 aa, Artificial Sequence
  Description of Artificial Sequence: Synthetic polypeptide
DEEEIRTTNPVATEQYGSVSTNGLQLGIVQN

SEQ ID NO: 24056 - protein, 30 aa, Artificial Sequence
  Description of Artificial Sequence: Synthetic polypeptide
AEEEIRTTNPVATEQYGSVTTTNLQYGNQG

SEQ ID NO: 24057 - protein, 30 aa, Artificial Sequence
  Description of Artificial Sequence: Synthetic polypeptide
QEEEICTTNPVATEQYGSVATNLQRVNERF

SEQ ID NO: 24058 - protein, 30 aa, Artificial Sequence
  Description of Artificial Sequence: Synthetic polypeptide
QEEEICTTNPVATEQYGSVATNLQRVGVRE

SEQ ID NO: 24059 - protein, 29 aa, Artificial Sequence
  Description of Artificial Sequence: Synthetic peptide
DEEEIRTTNPCATEQYGSVATNLQTPNTV

SEQ ID NO: 24060 - protein, 32 aa, Artificial Sequence
  Description of Artificial Sequence: Synthetic polypeptide
DEEEIRTTNPVATEQYGSVSTNGLQNDSLNDR

SEQ ID NO: 24061 - protein, 33 aa, Artificial Sequence
  Description of Artificial Sequence: Synthetic polypeptide
DEEEIRTTNPVATEQYGSVSTNGLQPDGNEDRQ

SEQ ID NO: 24062 - protein, 28 aa, Artificial Sequence
  Description of Artificial Sequence: Synthetic peptide
DEEEIRTTNPCATEMYGSVATNHERGNV

SEQ ID NO: 24063 - protein, 31 aa, Artificial Sequence
  Description of Artificial Sequence: Synthetic polypeptide
QEEEVRTTNPVATEQYGSVSTWNLDQMIGNR

SEQ ID NO: 24064 - protein, 30 aa, Artificial Sequence
  Description of Artificial Sequence: Synthetic polypeptide
QEEEICTTNPVATEQYGSVATNLQRGADRN

SEQ ID NO: 24065 - protein, 30 aa, Artificial Sequence
  Description of Artificial Sequence: Synthetic polypeptide
QEEEICTTNPVATEQYGSVATNLQREANRQ

SEQ ID NO: 24066 - protein, 32 aa, Artificial Sequence
  Description of Artificial Sequence: Synthetic polypeptide
AEEEIRTTNPVATEQYGSVSVTNNLGQEGENR

SEQ ID NO: 24067 - protein, 31 aa, Artificial Sequence
  Description of Artificial Sequence: Synthetic polypeptide
DEEEIRTTNPVATEQYGSVSTNGLQQSTQDR

SEQ ID NO: 24068 - protein, 30 aa, Artificial Sequence
  Description of Artificial Sequence: Synthetic polypeptide
QEEEICTTNPVATEQYGSVSTNLQNNGNDF

SEQ ID NO: 24069 - protein, 30 aa, Artificial Sequence
  Description of Artificial Sequence: Synthetic polypeptide
HEEEIRTTNPVATEQYGSVSTVLQRNNNFY

SEQ ID NO: 24070 - protein, 28 aa, Artificial Sequence
  Description of Artificial Sequence: Synthetic peptide
DEEEIRTTNPCATEQYGSVSVNVVQGND

SEQ ID NO: 24071 - protein, 32 aa, Artificial Sequence
  Description of Artificial Sequence: Synthetic polypeptide
DEEEIRTTNPVATEQYGSVSTMNLEQFEGNME

SEQ ID NO: 24072 - protein, 31 aa, Artificial Sequence
  Description of Artificial Sequence: Synthetic polypeptide
DEEEIRTTNPVATEQYGQSVSTNLQFESNNG

SEQ ID NO: 24073 - protein, 31 aa, Artificial Sequence
  Description of Artificial Sequence: Synthetic polypeptide
DEEEIRTTNPVATEQYGQSVSTNLQFQSNDY

SEQ ID NO: 24074 - protein, 29 aa, Artificial Sequence
  Description of Artificial Sequence: Synthetic peptide
DEEEIRTTNPVATEQYGSVSINLQDLEDI

SEQ ID NO: 24075 - protein, 29 aa, Artificial Sequence
  Description of Artificial Sequence: Synthetic peptide
SEEEICTTNPVATEMYGSVSTNLQIDGNN

SEQ ID NO: 24076 - protein, 30 aa, Artificial Sequence
  Description of Artificial Sequence: Synthetic polypeptide
DEEEIRTTNPCAYEQYGSVATNLQRPNDRM

SEQ ID NO: 24077 - protein, 31 aa, Artificial Sequence
  Description of Artificial Sequence: Synthetic polypeptide
DEEEIRTTNPVATEQYGSVSTMGLQQQSGNF

SEQ ID NO: 24078 - protein, 28 aa, Artificial Sequence
  Description of Artificial Sequence: Synthetic peptide
MEGEIRTTNPVATEQYGSLSTHLQRQER

SEQ ID NO: 24079 - protein, 31 aa, Artificial Sequence
  Description of Artificial Sequence: Synthetic polypeptide
DEEEIRTTNPVATEQYGSVSTMGLQPEGGNQ

SEQ ID NO: 24080 - protein, 31 aa, Artificial Sequence
  Description of Artificial Sequence: Synthetic polypeptide
DEEEIRTTNPVATEQYGSVSINLQNEGLTRP

SEQ ID NO: 24081 - protein, 28 aa, Artificial Sequence
  Description of Artificial Sequence: Synthetic peptide
MEETIRTTNPVATEQYGSVSTNLSSLNQ

SEQ ID NO: 24082 - protein, 29 aa, Artificial Sequence
  Description of Artificial Sequence: Synthetic peptide
MEETIRTTNPVATEQYGSVSTNLSGLNER

SEQ ID NO: 24083 - protein, 29 aa, Artificial Sequence
  Description of Artificial Sequence: Synthetic peptide
MEETIRTTNPVATEQYGSVSTNLSELDNR

SEQ ID NO: 24084 - protein, 33 aa, Artificial Sequence
  Description of Artificial Sequence: Synthetic polypeptide
DEEEIRTTNPVATEQYGQSVSTNLQESGSNTRM

SEQ ID NO: 24085 - protein, 29 aa, Artificial Sequence
  Description of Artificial Sequence: Synthetic peptide
MEEQIRTTNPVATEQYGSVSTNLSNLTNR

SEQ ID NO: 24086 - protein, 29 aa, Artificial Sequence
  Description of Artificial Sequence: Synthetic peptide
MEEQIRTTNPVATEQYGSVSTNLSENLNR

SEQ ID NO: 24087 - protein, 28 aa, Artificial Sequence
  Description of Artificial Sequence: Synthetic peptide
MEEQIRTTNPVATEQYGSVSTGGDRGNT

SEQ ID NO: 24088 - protein, 32 aa, Artificial Sequence
  Description of Artificial Sequence: Synthetic polypeptide
DEEEIRTTNPVATEQYGSVSINLQQRQGNPLD

SEQ ID NO: 24089 - protein, 31 aa, Artificial Sequence
  Description of Artificial Sequence: Synthetic polypeptide
DEEEIRTTNPVATEQYGSVSINLQREGEILD

SEQ ID NO: 24090 - protein, 29 aa, Artificial Sequence
  Description of Artificial Sequence: Synthetic peptide
SEEEICTTNPVATEPYGSVSTNLQIDGNH

SEQ ID NO: 24091 - protein, 31 aa, Artificial Sequence
  Description of Artificial Sequence: Synthetic polypeptide
MEEEVRTTNPVATEQYGSVSTTNLDQNIGNR

SEQ ID NO: 24092 - protein, 31 aa, Artificial Sequence
  Description of Artificial Sequence: Synthetic polypeptide
MEEEVRTTNPVATEQYGSVSTENNDQRIGNR

SEQ ID NO: 24093 - protein, 31 aa, Artificial Sequence
  Description of Artificial Sequence: Synthetic polypeptide
MEEELRTTNPVATEQYGSVSTYNLDQRIGNN

SEQ ID NO: 24094 - protein, 29 aa, Artificial Sequence
  Description of Artificial Sequence: Synthetic peptide
MEEEIYTTNPVATEQYGNVSVTELQGGNR

SEQ ID NO: 24095 - protein, 29 aa, Artificial Sequence
  Description of Artificial Sequence: Synthetic peptide
MEEEIVTTNPVATEQYGNVSVTYLQGGNR

SEQ ID NO: 24096 - protein, 31 aa, Artificial Sequence
  Description of Artificial Sequence: Synthetic polypeptide
DEEEIRTTNPVATEQYGSVSINLQREGVPEG

SEQ ID NO: 24097 - protein, 31 aa, Artificial Sequence
  Description of Artificial Sequence: Synthetic polypeptide
DEEEIRTTNPVATEQYGSVSINLQREMNGGD

SEQ ID NO: 24098 - protein, 31 aa, Artificial Sequence
  Description of Artificial Sequence: Synthetic polypeptide
DEEEIRTTNPVATEQYGSVSTMGLQIEGNTP

SEQ ID NO: 24099 - protein, 31 aa, Artificial Sequence
  Description of Artificial Sequence: Synthetic polypeptide
DEEEIRTTNPVATEQYGCVSTENLQTISNRS

SEQ ID NO: 24100 - protein, 29 aa, Artificial Sequence
  Description of Artificial Sequence: Synthetic peptide
DEEEIRTTNPVATEQYGCVSTEPQSGDRS

SEQ ID NO: 24101 - protein, 29 aa, Artificial Sequence
  Description of Artificial Sequence: Synthetic peptide
SEEEICTTNPVATELYGSVSTNLQIDGNI

SEQ ID NO: 24102 - protein, 31 aa, Artificial Sequence
  Description of Artificial Sequence: Synthetic polypeptide
DEEEIRTTNPVATEQYGSVSTNLQANDPERT

SEQ ID NO: 24103 - protein, 30 aa, Artificial Sequence
  Description of Artificial Sequence: Synthetic polypeptide
MTEEIRTTNPVATDQYGSVSTTNLQRGDNF

SEQ ID NO: 24104 - protein, 28 aa, Artificial Sequence
  Description of Artificial Sequence: Synthetic peptide
MTEEIRTTNPVATDQYGSVSTFLQEGNL

SEQ ID NO: 24105 - protein, 30 aa, Artificial Sequence
  Description of Artificial Sequence: Synthetic polypeptide
DEEEIRTTNPVATEQYGCVSTGLTGVNGNR

SEQ ID NO: 24106 - protein, 31 aa, Artificial Sequence
  Description of Artificial Sequence: Synthetic polypeptide
DEDEIATTNPVATEQYGSVATNLQRDGPNRD

SEQ ID NO: 24107 - protein, 29 aa, Artificial Sequence
  Description of Artificial Sequence: Synthetic peptide
MNEEIRTTNPVATEQYGVVSTNQQDGPNR

SEQ ID NO: 24108 - protein, 28 aa, Artificial Sequence
  Description of Artificial Sequence: Synthetic peptide
MNEEIATTNPVATGQYGSVSTNPMRGNR

SEQ ID NO: 24109 - protein, 31 aa, Artificial Sequence
  Description of Artificial Sequence: Synthetic polypeptide
DEEEIRTTNPVATEQYGQSVSTELQNFGNFP

SEQ ID NO: 24110 - protein, 28 aa, Artificial Sequence
  Description of Artificial Sequence: Synthetic peptide
SEEEICCTNPTATEQYGSVSENLMRGNR

SEQ ID NO: 24111 - protein, 30 aa, Artificial Sequence
  Description of Artificial Sequence: Synthetic polypeptide
DEDEIATTNPVATEQYGSVATNLQRQNTRD

SEQ ID NO: 24112 - protein, 29 aa, Artificial Sequence
  Description of Artificial Sequence: Synthetic peptide
MEQEIRTTNPVATEQYGSVWTNLNQIGSR

SEQ ID NO: 24113 - protein, 33 aa, Artificial Sequence
  Description of Artificial Sequence: Synthetic polypeptide
DEEEIRTTNPVATEQYGQSVSTENPLQFGSNRL

SEQ ID NO: 24114 - protein, 31 aa, Artificial Sequence
  Description of Artificial Sequence: Synthetic polypeptide
DEEEIRTTNPVATEQYGQSVSTNLLQNGSVD

SEQ ID NO: 24115 - protein, 30 aa, Artificial Sequence
  Description of Artificial Sequence: Synthetic polypeptide
DEDEIATTNPVATEQYGSVATNLQRVGDRE

SEQ ID NO: 24116 - protein, 30 aa, Artificial Sequence
  Description of Artificial Sequence: Synthetic polypeptide
DEEEIRTTNPVATEQYGCVSTESHERGSNR

SEQ ID NO: 24117 - protein, 29 aa, Artificial Sequence
  Description of Artificial Sequence: Synthetic peptide
MENEIRTTNPVATEQYGSVSTNLQYGEDT

SEQ ID NO: 24118 - protein, 29 aa, Artificial Sequence
  Description of Artificial Sequence: Synthetic peptide
MENEIRTTNPVATEQYGSVSTNLQGEGEM

SEQ ID NO: 24119 - protein, 31 aa, Artificial Sequence
  Description of Artificial Sequence: Synthetic polypeptide
MENEIRTTNPVATEQYGSVSETNLQNRIGIR

SEQ ID NO: 24120 - protein, 30 aa, Artificial Sequence
  Description of Artificial Sequence: Synthetic polypeptide
DEEEIRTTNPVATEQYGQSVSTNHASFGNQ

SEQ ID NO: 24121 - protein, 30 aa, Artificial Sequence
  Description of Artificial Sequence: Synthetic polypeptide
MENEIRTTNPVATEQYGSIVSSNDQARGNR

SEQ ID NO: 24122 - protein, 32 aa, Artificial Sequence
  Description of Artificial Sequence: Synthetic polypeptide
DEEEIRTTNPVATEQYGQSVSTNHQAGGSNRF

SEQ ID NO: 24123 - protein, 31 aa, Artificial Sequence
  Description of Artificial Sequence: Synthetic polypeptide
DEEEIRTTNPVATEQYGSVSINLGPRGELRY

SEQ ID NO: 24124 - protein, 31 aa, Artificial Sequence
  Description of Artificial Sequence: Synthetic polypeptide
DEEEIRTTNPVATEQYGSVSTNLQASGSELA

SEQ ID NO: 24125 - protein, 30 aa, Artificial Sequence
  Description of Artificial Sequence: Synthetic polypeptide
DEEEIRTTNPVATEQYGQSVSTNLEHGSQD

SEQ ID NO: 24126 - protein, 31 aa, Artificial Sequence
  Description of Artificial Sequence: Synthetic polypeptide
DEEEIRTTNPVATEQYGSVSTNLQATGSEQN

SEQ ID NO: 24127 - protein, 31 aa, Artificial Sequence
  Description of Artificial Sequence: Synthetic polypeptide
DEEEIRTTNPVATEQYGQSVSTNLIGGSNVT

SEQ ID NO: 24128 - protein, 30 aa, Artificial Sequence
  Description of Artificial Sequence: Synthetic polypeptide
AEEEIRTTNPVATEQYGSVSTVNQQPGNGE

SEQ ID NO: 24129 - protein, 30 aa, Artificial Sequence
  Description of Artificial Sequence: Synthetic polypeptide
DEEEIRTTNPVATEQYGQSVSTEHQFFGNQ

SEQ ID NO: 24130 - protein, 32 aa, Artificial Sequence
  Description of Artificial Sequence: Synthetic polypeptide
DEEEIRTTNPVATEQYGQSVSTNPGQFFGNDR

SEQ ID NO: 24131 - protein, 30 aa, Artificial Sequence
  Description of Artificial Sequence: Synthetic polypeptide
MEEEITTTNPVATEIYGSVSTNNLQKGNRI

SEQ ID NO: 24132 - protein, 32 aa, Artificial Sequence
  Description of Artificial Sequence: Synthetic polypeptide
DEEEIRTTNPVATEQYGSVSTMELQCAFGNDR

SEQ ID NO: 24133 - protein, 30 aa, Artificial Sequence
  Description of Artificial Sequence: Synthetic polypeptide
MEEEIRTTNPVATESYGSVSNTNLHRGTQR

SEQ ID NO: 24134 - protein, 31 aa, Artificial Sequence
  Description of Artificial Sequence: Synthetic polypeptide
DEEEIRTTNPVATEQYGQTVCSTNLQRGDQQ

SEQ ID NO: 24135 - protein, 31 aa, Artificial Sequence
  Description of Artificial Sequence: Synthetic polypeptide
DEEEIRTTNPVATEQYGCVSTELQRFMSNQR

SEQ ID NO: 24136 - protein, 29 aa, Artificial Sequence
  Description of Artificial Sequence: Synthetic peptide
SEEEICTTNPVATEQYGSVATNLQRINTA

SEQ ID NO: 24137 - protein, 33 aa, Artificial Sequence
  Description of Artificial Sequence: Synthetic polypeptide
DEEEIRTTNPVATEQYGQTVSCTNLSQRGGNRK

SEQ ID NO: 24138 - protein, 28 aa, Artificial Sequence
  Description of Artificial Sequence: Synthetic peptide
MEEEIRTTNPVATEQYGSVYTALQNGFS

SEQ ID NO: 24139 - protein, 30 aa, Artificial Sequence
  Description of Artificial Sequence: Synthetic polypeptide
MEEEIRTTNPVATEQYGSVVTNLQRFGSEQ

SEQ ID NO: 24140 - protein, 29 aa, Artificial Sequence
  Description of Artificial Sequence: Synthetic peptide
SEEEICTTNPVATEQYGSVATNLQSGERN

SEQ ID NO: 24141 - protein, 30 aa, Artificial Sequence
  Description of Artificial Sequence: Synthetic polypeptide
DEEEIRTTNPVATEQYGSVSTMEGLQRLDE

SEQ ID NO: 24142 - protein, 33 aa, Artificial Sequence
  Description of Artificial Sequence: Synthetic polypeptide
MEEEIRTTNPVATEQYGSVSWTSNLEQRGENMR

SEQ ID NO: 24143 - protein, 30 aa, Artificial Sequence
  Description of Artificial Sequence: Synthetic polypeptide
DEEEIRTTNPVATEQYGSVSTMDQSTENGR

SEQ ID NO: 24144 - protein, 30 aa, Artificial Sequence
  Description of Artificial Sequence: Synthetic polypeptide
DEEEIRTTNPVATEQYGQTISTNEDQDGNR

SEQ ID NO: 24145 - protein, 30 aa, Artificial Sequence
  Description of Artificial Sequence: Synthetic polypeptide
SEEEICTTNPVATEQYGSVSTNLDQNGNEA

SEQ ID NO: 24146 - protein, 30 aa, Artificial Sequence
  Description of Artificial Sequence: Synthetic polypeptide
MEEEIRTTNPVATEQYGSVSTTNLEGGNQE

SEQ ID NO: 24147 - protein, 32 aa, Artificial Sequence
  Description of Artificial Sequence: Synthetic polypeptide
MEEEIRTTNPVATEQYGSVSTSNLQQRGENYG

SEQ ID NO: 24148 - protein, 29 aa, Artificial Sequence
  Description of Artificial Sequence: Synthetic peptide
SEEEICTTNPVATEQYGSVSTNLQDGGDN

SEQ ID NO: 24149 - protein, 32 aa, Artificial Sequence
  Description of Artificial Sequence: Synthetic polypeptide
MEEEIRTTNPVATEQYGSVSTSNLEQRGENSQ

SEQ ID NO: 24150 - protein, 29 aa, Artificial Sequence
  Description of Artificial Sequence: Synthetic peptide
SEEEICTTNPVATEQYGSVSTNLQDGHDD

SEQ ID NO: 24151 - protein, 31 aa, Artificial Sequence
  Description of Artificial Sequence: Synthetic polypeptide
SEEEICTTNPVATEQYGSVSTNLQDRHGNEL

SEQ ID NO: 24152 - protein, 30 aa, Artificial Sequence
  Description of Artificial Sequence: Synthetic polypeptide
DEEEIRTTNPVATEQYGSVSTMDPQLGNDD

SEQ ID NO: 24153 - protein, 30 aa, Artificial Sequence
  Description of Artificial Sequence: Synthetic polypeptide
SEEEICTTNPVATEQYGSVSTNLQGGDPRV

SEQ ID NO: 24154 - protein, 30 aa, Artificial Sequence
  Description of Artificial Sequence: Synthetic polypeptide
SEEEICTTNPVATEQYGSVSTNLQGGDTRM

SEQ ID NO: 24155 - protein, 30 aa, Artificial Sequence
  Description of Artificial Sequence: Synthetic polypeptide
SEEEICTTNPVATEQYGSVSTNLQNPGNMP

SEQ ID NO: 24156 - protein, 30 aa, Artificial Sequence
  Description of Artificial Sequence: Synthetic polypeptide
MEEEIRTTNPVATEQYGSVSTNNLQDGQVQ

SEQ ID NO: 24157 - protein, 30 aa, Artificial Sequence
  Description of Artificial Sequence: Synthetic polypeptide
AEEEIRTTNPVATEQYGSVSTVNNQNIGNE

SEQ ID NO: 24158 - protein, 30 aa, Artificial Sequence
  Description of Artificial Sequence: Synthetic polypeptide
DEEEIRTTNPVATEQYGSVSINLVRVENIG

SEQ ID NO: 24159 - protein, 31 aa, Artificial Sequence
  Description of Artificial Sequence: Synthetic polypeptide
DEEEIRTTNPVATEQYGQSVSTNPTRGSNDS

SEQ ID NO: 24160 - protein, 30 aa, Artificial Sequence
  Description of Artificial Sequence: Synthetic polypeptide
AEEEIRTTNPVATEQYGSVSTVNNQQTGNY

SEQ ID NO: 24161 - protein, 31 aa, Artificial Sequence
  Description of Artificial Sequence: Synthetic polypeptide
DEEEIRTTNPVATEQYGCVSTENHQRNSNRS

SEQ ID NO: 24162 - protein, 31 aa, Artificial Sequence
  Description of Artificial Sequence: Synthetic polypeptide
MEEEISTTNPVATEVYGSVVSTMNLQRNGNR

SEQ ID NO: 24163 - protein, 29 aa, Artificial Sequence
  Description of Artificial Sequence: Synthetic peptide
MEEEISTTNPVATEQYGYVSTNLQVFGNV

SEQ ID NO: 24164 - protein, 32 aa, Artificial Sequence
  Description of Artificial Sequence: Synthetic polypeptide
DEEEIRTTNPVATEQYGQSVSTNTERSGNTRQ

SEQ ID NO: 24165 - protein, 31 aa, Artificial Sequence
  Description of Artificial Sequence: Synthetic polypeptide
DEEEIRTTNPVATEQYGCVSTENLQRSISDR

SEQ ID NO: 24166 - protein, 28 aa, Artificial Sequence
  Description of Artificial Sequence: Synthetic peptide
SEEEICTTNPVATEQYGSVATNDQRSND

SEQ ID NO: 24167 - protein, 32 aa, Artificial Sequence
  Description of Artificial Sequence: Synthetic polypeptide
DEEEIRTTNPVATEQYGCVSTENLQRFNSNSR

SEQ ID NO: 24168 - protein, 30 aa, Artificial Sequence
  Description of Artificial Sequence: Synthetic polypeptide
MEEEISTTNPVATEQYGQCVSQTNLVRGNR

SEQ ID NO: 24169 - protein, 29 aa, Artificial Sequence
  Description of Artificial Sequence: Synthetic peptide
MEEEISTTNPVATEQYGNVSVTMLQDGNR

SEQ ID NO: 24170 - protein, 29 aa, Artificial Sequence
  Description of Artificial Sequence: Synthetic peptide
MEEEISTTNPVATEQYGNVSNTMLQGGNR

SEQ ID NO: 24171 - protein, 32 aa, Artificial Sequence
  Description of Artificial Sequence: Synthetic polypeptide
DEEEIRTTNPVATEQYGSVSTNLQDEEGNIAT

SEQ ID NO: 24172 - protein, 32 aa, Artificial Sequence
  Description of Artificial Sequence: Synthetic polypeptide
DEEEIRTTNPVATEQYGSVSINLQRMTQNARD

SEQ ID NO: 24173 - protein, 31 aa, Artificial Sequence
  Description of Artificial Sequence: Synthetic polypeptide
DEEEIRTTNPVATEQYGSVSTMELQTNGNDD

SEQ ID NO: 24174 - protein, 29 aa, Artificial Sequence
  Description of Artificial Sequence: Synthetic peptide
SEEEICTTNPVATEQYGSVATNLQPGNNQ

SEQ ID NO: 24175 - protein, 32 aa, Artificial Sequence
  Description of Artificial Sequence: Synthetic polypeptide
DEEEIRTTNPVATEQYGCVSTENLQERFGNQA

SEQ ID NO: 24176 - protein, 30 aa, Artificial Sequence
  Description of Artificial Sequence: Synthetic polypeptide
MEEEISTTNPVATEQYGCVNNTTNLQRGNR

SEQ ID NO: 24177 - protein, 30 aa, Artificial Sequence
  Description of Artificial Sequence: Synthetic polypeptide
MEEEISPTNPVATEQYGSIVSETNLQRGNN

SEQ ID NO: 24178 - protein, 30 aa, Artificial Sequence
  Description of Artificial Sequence: Synthetic polypeptide
MEEEIRYTNPVATEQYGQVSTFNLQQRGNI

SEQ ID NO: 24179 - protein, 30 aa, Artificial Sequence
  Description of Artificial Sequence: Synthetic polypeptide
MEEEIRTVNPVATEQYGSVSTSNLQRFFNG

SEQ ID NO: 24180 - protein, 31 aa, Artificial Sequence
  Description of Artificial Sequence: Synthetic polypeptide
DEEEIRTTNPVATEQYGSVSTMELQRTSNQS

SEQ ID NO: 24181 - protein, 30 aa, Artificial Sequence
  Description of Artificial Sequence: Synthetic polypeptide
MEEEIRTVNPVATEQYGSVSDTENLGRGNE

SEQ ID NO: 24182 - protein, 30 aa, Artificial Sequence
  Description of Artificial Sequence: Synthetic polypeptide
MEEEIRTVNPVATEFYGSVSTGNLQRVGNY

SEQ ID NO: 24183 - protein, 28 aa, Artificial Sequence
  Description of Artificial Sequence: Synthetic peptide
MEEEIRTTNRVATEEYGSCSTNLERINR

SEQ ID NO: 24184 - protein, 29 aa, Artificial Sequence
  Description of Artificial Sequence: Synthetic peptide
SEEEICTTNPVATEQYGSVATNLQGGTDR

SEQ ID NO: 24185 - protein, 33 aa, Artificial Sequence
  Description of Artificial Sequence: Synthetic polypeptide
DEEEIRTTNPVATEQYGQSVVPCTNLQRGGNNR

SEQ ID NO: 24186 - protein, 33 aa, Artificial Sequence
  Description of Artificial Sequence: Synthetic polypeptide
DEEEIRTTNPVATEQYGQSVVPSCTNLSGRGNR

SEQ ID NO: 24187 - protein, 30 aa, Artificial Sequence
  Description of Artificial Sequence: Synthetic polypeptide
DEEEIRTTNPVATEQYGSVSINLQTNENIE

SEQ ID NO: 24188 - protein, 30 aa, Artificial Sequence
  Description of Artificial Sequence: Synthetic polypeptide
DEEEIRTTNPVATEQYGSVSTNLQDFSDQD

SEQ ID NO: 24189 - protein, 30 aa, Artificial Sequence
  Description of Artificial Sequence: Synthetic polypeptide
SEEEICTTNPVATEQYGSVSTNLQQGNEPL

SEQ ID NO: 24190 - protein, 31 aa, Artificial Sequence
  Description of Artificial Sequence: Synthetic polypeptide
DEEEIRTTNPVATEQYGQSVSNTNLERGSDD

SEQ ID NO: 24191 - protein, 28 aa, Artificial Sequence
  Description of Artificial Sequence: Synthetic peptide
MTEEIRTTNPVATEQWGTVSTNLQNGND

SEQ ID NO: 24192 - protein, 28 aa, Artificial Sequence
  Description of Artificial Sequence: Synthetic peptide
NEDEIRTTNPVATEQYGSVDTNLVIGSR

SEQ ID NO: 24193 - protein, 31 aa, Artificial Sequence
  Description of Artificial Sequence: Synthetic polypeptide
DEEEIRTTNPVATEQYGQSVCSNTELQNNNR

SEQ ID NO: 24194 - protein, 28 aa, Artificial Sequence
  Description of Artificial Sequence: Synthetic peptide
NEDEIRTTNPVATEQYGSVDTNLQIGIQ

SEQ ID NO: 24195 - protein, 30 aa, Artificial Sequence
  Description of Artificial Sequence: Synthetic polypeptide
DEEEIRTTNPVATEQYGSVSTMLDQVIGIA

SEQ ID NO: 24196 - protein, 31 aa, Artificial Sequence
  Description of Artificial Sequence: Synthetic polypeptide
DEEEIRTTNPVATEQYGSVSTNLPIGDNNEI

SEQ ID NO: 24197 - protein, 29 aa, Artificial Sequence
  Description of Artificial Sequence: Synthetic peptide
DEDEIATTNPVATEQYGSVATNLERGNDL

SEQ ID NO: 24198 - protein, 29 aa, Artificial Sequence
  Description of Artificial Sequence: Synthetic peptide
AEEEIRTTNPVATEQYGVVSTTLQDGNVQ

SEQ ID NO: 24199 - protein, 29 aa, Artificial Sequence
  Description of Artificial Sequence: Synthetic peptide
DEDEIATTNPVATEQYGSVATNLERGNEM

SEQ ID NO: 24200 - protein, 32 aa, Artificial Sequence
  Description of Artificial Sequence: Synthetic polypeptide
DEEEIRTTNPVATEQYGQSVCSSMNLQRGSNA

SEQ ID NO: 24201 - protein, 31 aa, Artificial Sequence
  Description of Artificial Sequence: Synthetic polypeptide
DEEEIRTTNPVATEQYGSVSTNLPNAGTNPT

SEQ ID NO: 24202 - protein, 29 aa, Artificial Sequence
  Description of Artificial Sequence: Synthetic peptide
AEEEIRTTNPVATEQYGVVSTTLQVNGNL

SEQ ID NO: 24203 - protein, 32 aa, Artificial Sequence
  Description of Artificial Sequence: Synthetic polypeptide
DEEEIRTTNPVATEQYGCVSTMNLNQRGSERN

SEQ ID NO: 24204 - protein, 30 aa, Artificial Sequence
  Description of Artificial Sequence: Synthetic polypeptide
DEEEIRTTNPVATEQYGCVSTNDDRGENHG

SEQ ID NO: 24205 - protein, 28 aa, Artificial Sequence
  Description of Artificial Sequence: Synthetic peptide
NEDEIRTTNPVATEQYGSVATNLQIGEM

SEQ ID NO: 24206 - protein, 30 aa, Artificial Sequence
  Description of Artificial Sequence: Synthetic polypeptide
DEEEIRTTNPVATEQYGSVSIEVLQRGQAF

SEQ ID NO: 24207 - protein, 31 aa, Artificial Sequence
  Description of Artificial Sequence: Synthetic polypeptide
DEEEIRTTNPVATEQYGSVSTNLPNDGGNTN

SEQ ID NO: 24208 - protein, 31 aa, Artificial Sequence
  Description of Artificial Sequence: Synthetic polypeptide
DEEEIRTTNPVATEQYGSVSTNLPNIGQNQE

SEQ ID NO: 24209 - protein, 31 aa, Artificial Sequence
  Description of Artificial Sequence: Synthetic polypeptide
DEEEIRTTNPVATEQYGSVSGNLQQNGNNED

SEQ ID NO: 24210 - protein, 31 aa, Artificial Sequence
  Description of Artificial Sequence: Synthetic polypeptide
DEEEIRTTNPVATEQYGCVSTMELQFFGSNR

SEQ ID NO: 24211 - protein, 32 aa, Artificial Sequence
  Description of Artificial Sequence: Synthetic polypeptide
DEEEIRTTNPVATEQYGSVSTNLPQEGGNETG

SEQ ID NO: 24212 - protein, 32 aa, Artificial Sequence
  Description of Artificial Sequence: Synthetic polypeptide
DEEEIRTTNPVATEQYGQSVCSTELQRSGNLP

SEQ ID NO: 24213 - protein, 30 aa, Artificial Sequence
  Description of Artificial Sequence: Synthetic polypeptide
AEEEIRTTNPVATEQYGVVSTTNLQQGNQE

SEQ ID NO: 24214 - protein, 31 aa, Artificial Sequence
  Description of Artificial Sequence: Synthetic polypeptide
DEEEIRTTNPVATEQYGSVSTNLPQGFGSEQ

SEQ ID NO: 24215 - protein, 32 aa, Artificial Sequence
  Description of Artificial Sequence: Synthetic polypeptide
DEEEIRTTNPVATEQYGSVSTNLPQIGGNIQE

SEQ ID NO: 24216 - protein, 29 aa, Artificial Sequence
  Description of Artificial Sequence: Synthetic peptide
DEEEIRTTNPVATEQYGSVSIGPNQRGDD

SEQ ID NO: 24217 - protein, 32 aa, Artificial Sequence
  Description of Artificial Sequence: Synthetic polypeptide
DEEEIRTTNPVATEQYGQSVCSTEWLQRGNDP

SEQ ID NO: 24218 - protein, 29 aa, Artificial Sequence
  Description of Artificial Sequence: Synthetic peptide
NEDEIRTTNPVATEQYGSVATNLQDGGDR

SEQ ID NO: 24219 - protein, 29 aa, Artificial Sequence
  Description of Artificial Sequence: Synthetic peptide
NEAEIRTTNPVATESYGSVSTNLQGDGNQ

SEQ ID NO: 24220 - protein, 28 aa, Artificial Sequence
  Description of Artificial Sequence: Synthetic peptide
NEDEIRTTNPVATEQYGSVITNLQIGEA

SEQ ID NO: 24221 - protein, 31 aa, Artificial Sequence
  Description of Artificial Sequence: Synthetic polypeptide
DEEEIRTTNPVATEQYGQSISLPNMLQRDNR

SEQ ID NO: 24222 - protein, 30 aa, Artificial Sequence
  Description of Artificial Sequence: Synthetic polypeptide
DEEEIRTTNPVATEQYGCVSTNDQSFGSNQ

SEQ ID NO: 24223 - protein, 31 aa, Artificial Sequence
  Description of Artificial Sequence: Synthetic polypeptide
AEEEIRTTNPVATEQYGVVSTNLQLNNGNIR

SEQ ID NO: 24224 - protein, 30 aa, Artificial Sequence
  Description of Artificial Sequence: Synthetic polypeptide
AEEEIRTTNPVATEQYGVVSTNLQLTSGND

SEQ ID NO: 24225 - protein, 29 aa, Artificial Sequence
  Description of Artificial Sequence: Synthetic peptide
AEEEIRTTNPVATEQYGVVSTNLQMGGGI

SEQ ID NO: 24226 - protein, 31 aa, Artificial Sequence
  Description of Artificial Sequence: Synthetic polypeptide
DEEEIRTTNPVATEQYGSVSIELLQRGSQRD

SEQ ID NO: 24227 - protein, 29 aa, Artificial Sequence
  Description of Artificial Sequence: Synthetic peptide
AEEEIRTTNPVATEQYGVVSTNLQSGQDE

SEQ ID NO: 24228 - protein, 30 aa, Artificial Sequence
  Description of Artificial Sequence: Synthetic polypeptide
AEEEIRTTNPVATEQYGVVSTNLQTGGNES

SEQ ID NO: 24229 - protein, 30 aa, Artificial Sequence
  Description of Artificial Sequence: Synthetic polypeptide
AEEEIRTTNPVATEQYGVVSTNLQYGGNQG

SEQ ID NO: 24230 - protein, 30 aa, Artificial Sequence
  Description of Artificial Sequence: Synthetic polypeptide
AEEEIRTTNPVATEQYGVVSTNLVQAGNPG

SEQ ID NO: 24231 - protein, 30 aa, Artificial Sequence
  Description of Artificial Sequence: Synthetic polypeptide
DEEEIRGTNPVATEQYGSVSINQDRGSNTR

SEQ ID NO: 24232 - protein, 29 aa, Artificial Sequence
  Description of Artificial Sequence: Synthetic peptide
DEECIRTTNPVATEQYGCVCSTNDQHGNQ

SEQ ID NO: 24233 - protein, 30 aa, Artificial Sequence
  Description of Artificial Sequence: Synthetic polypeptide
DEEEIRTTNPVATEQYGCVSTNDQFGSIRA

SEQ ID NO: 24234 - protein, 29 aa, Artificial Sequence
  Description of Artificial Sequence: Synthetic peptide
NEDEIRTTNPVATEQYGSVQTNLQIGISR

SEQ ID NO: 24235 - protein, 31 aa, Artificial Sequence
  Description of Artificial Sequence: Synthetic polypeptide
DEEEIRTTNPVATEQYGSVSTNLNRSVENTF

SEQ ID NO: 24236 - protein, 31 aa, Artificial Sequence
  Description of Artificial Sequence: Synthetic polypeptide
DEEEIRTTNPVATEQYGSVSTNLNTDEGENQ

SEQ ID NO: 24237 - protein, 31 aa, Artificial Sequence
  Description of Artificial Sequence: Synthetic polypeptide
DEEEIRTTNPVATEQYGSVSTNLNTDGGNNL

SEQ ID NO: 24238 - protein, 33 aa, Artificial Sequence
  Description of Artificial Sequence: Synthetic polypeptide
DEEEIRTTNPVATEQYGCVSTNDLFQRSGSNRT

SEQ ID NO: 24239 - protein, 31 aa, Artificial Sequence
  Description of Artificial Sequence: Synthetic polypeptide
DEEEIRTTNPVATEQYGSVSTNLNTDIGNEF

SEQ ID NO: 24240 - protein, 31 aa, Artificial Sequence
  Description of Artificial Sequence: Synthetic polypeptide
DEEEIRTTNPVATEQYGSVSTNLNVTMGNPT

SEQ ID NO: 24241 - protein, 31 aa, Artificial Sequence
  Description of Artificial Sequence: Synthetic polypeptide
DEDEIATTNPVATEQYGSVATNLDQRGNDRD

SEQ ID NO: 24242 - protein, 31 aa, Artificial Sequence
  Description of Artificial Sequence: Synthetic polypeptide
DEECIRTTNPVATEQYGCVCSTNALQFGSNR

SEQ ID NO: 24243 - protein, 31 aa, Artificial Sequence
  Description of Artificial Sequence: Synthetic polypeptide
DEEEIRTTNPVATEQYGSVSTNLPDNGNNES

SEQ ID NO: 24244 - protein, 31 aa, Artificial Sequence
  Description of Artificial Sequence: Synthetic polypeptide
DEEEIRTTNPVATEQYGSVSTNLPEFGGNPQ

SEQ ID NO: 24245 - protein, 32 aa, Artificial Sequence
  Description of Artificial Sequence: Synthetic polypeptide
DEEEIRTTNPVATEQYGQCVVSTNLQRFGSER

SEQ ID NO: 24246 - protein, 30 aa, Artificial Sequence
  Description of Artificial Sequence: Synthetic polypeptide
DEEEIRTTNPVATEQYGQLSTINNLQRENN

SEQ ID NO: 24247 - protein, 31 aa, Artificial Sequence
  Description of Artificial Sequence: Synthetic polypeptide
DEEEIRTTNPVATEQYGSVSTNLPETGNNGQ

SEQ ID NO: 24248 - protein, 32 aa, Artificial Sequence
  Description of Artificial Sequence: Synthetic polypeptide
DEEEIRTTNPVATEQYGCVSTNDLQRFGNNQD

SEQ ID NO: 24249 - protein, 31 aa, Artificial Sequence
  Description of Artificial Sequence: Synthetic polypeptide
DEEEIRTTNPVATEQYGQSVSNTNGNQRGDF

SEQ ID NO: 24250 - protein, 29 aa, Artificial Sequence
  Description of Artificial Sequence: Synthetic peptide
DEEEIRTTNPVATEQYGSVSIMDNDRGDR

SEQ ID NO: 24251 - protein, 31 aa, Artificial Sequence
  Description of Artificial Sequence: Synthetic polypeptide
DEEEIRTTNPVATEQYGSVSTNLPQMHGSEE

SEQ ID NO: 24252 - protein, 30 aa, Artificial Sequence
  Description of Artificial Sequence: Synthetic polypeptide
DEEEIRTTNPVATEQYGCVSTGNTQENGNA

SEQ ID NO: 24253 - protein, 29 aa, Artificial Sequence
  Description of Artificial Sequence: Synthetic peptide
SEEEIATTNPVAYEQYGSFASTNLQRGNQ

SEQ ID NO: 24254 - protein, 30 aa, Artificial Sequence
  Description of Artificial Sequence: Synthetic polypeptide
DEDEIATTNPVATEQYGSVATNLQNGNMRQ

SEQ ID NO: 24255 - protein, 29 aa, Artificial Sequence
  Description of Artificial Sequence: Synthetic peptide
NDEEIRTTNPVATEQYGCVSWNLQDGSNR

SEQ ID NO: 24256 - protein, 31 aa, Artificial Sequence
  Description of Artificial Sequence: Synthetic polypeptide
DEEEIRTTNPVATEQYGQSVCSTNLQNSNQV

SEQ ID NO: 24257 - protein, 33 aa, Artificial Sequence
  Description of Artificial Sequence: Synthetic polypeptide
DEEEIRTTNPVATEQYGQSVCSTNLQRFGNNLS

SEQ ID NO: 24258 - protein, 28 aa, Artificial Sequence
  Description of Artificial Sequence: Synthetic peptide
NDEEIGTTNPAATEQYGSVSENLQRGNM

SEQ ID NO: 24259 - protein, 31 aa, Artificial Sequence
  Description of Artificial Sequence: Synthetic polypeptide
DEEEIRTTNPVATEQYGCVSTGNLQVHTENR

SEQ ID NO: 24260 - protein, 30 aa, Artificial Sequence
  Description of Artificial Sequence: Synthetic polypeptide
DEEEIRTTNPVATEQYGSVSINDLQRDQSF

SEQ ID NO: 24261 - protein, 30 aa, Artificial Sequence
  Description of Artificial Sequence: Synthetic polypeptide
NAEEIRTTNPVATEQYGCVSTNLQDPGENR

SEQ ID NO: 24262 - protein, 29 aa, Artificial Sequence
  Description of Artificial Sequence: Synthetic peptide
NAEEIRTTNPVATEQYGCVSTNLQDGGNN

SEQ ID NO: 24263 - protein, 29 aa, Artificial Sequence
  Description of Artificial Sequence: Synthetic peptide
NAEEIRTTNPVATEQYGCVSTNLQAGPNE

SEQ ID NO: 24264 - protein, 31 aa, Artificial Sequence
  Description of Artificial Sequence: Synthetic polypeptide
DEEEIRTTNPVATEQYGQSVCSTNLQAGDQM

SEQ ID NO: 24265 - protein, 29 aa, Artificial Sequence
  Description of Artificial Sequence: Synthetic peptide
NAEEIRATNPVATEQYGVVSTNLQNGPNR

SEQ ID NO: 24266 - protein, 30 aa, Artificial Sequence
  Description of Artificial Sequence: Synthetic polypeptide
DEEEIRTTNPVATEQYGSVSINDLQRDVEM

SEQ ID NO: 24267 - protein, 31 aa, Artificial Sequence
  Description of Artificial Sequence: Synthetic polypeptide
DEEEIRTTNPVATEQYGCVSTGNLQFFSSNR

SEQ ID NO: 24268 - protein, 32 aa, Artificial Sequence
  Description of Artificial Sequence: Synthetic polypeptide
DEEEIRTTNPVATEQYGQSVCSYNLQRGSNLN

SEQ ID NO: 24269 - protein, 30 aa, Artificial Sequence
  Description of Artificial Sequence: Synthetic polypeptide
DEDEIATTNPVATEQYGSVATNLQQGNDRF

SEQ ID NO: 24270 - protein, 28 aa, Artificial Sequence
  Description of Artificial Sequence: Synthetic peptide
SEEEICCTNPIATEQYGSVSENLMRGNR

SEQ ID NO: 24271 - protein, 29 aa, Artificial Sequence
  Description of Artificial Sequence: Synthetic peptide
DEDEIATTNPVATEQYGSVATNLQQGNLT

SEQ ID NO: 24272 - protein, 32 aa, Artificial Sequence
  Description of Artificial Sequence: Synthetic polypeptide
DEEEIRTTNPVATEQYGCVSTGNLEQRGSNQN

SEQ ID NO: 24273 - protein, 30 aa, Artificial Sequence
  Description of Artificial Sequence: Synthetic polypeptide
MTEEIRTTNPVATEQYGVVSTNLQDGDNQR

SEQ ID NO: 24274 - protein, 28 aa, Artificial Sequence
  Description of Artificial Sequence: Synthetic peptide
MTEEIRTTNPVATEQWGVVSTNLQEGNN

SEQ ID NO: 24275 - protein, 31 aa, Artificial Sequence
  Description of Artificial Sequence: Synthetic polypeptide
DEEEIRTTNPVATEQYGQSVSDHLQRGSERQ

SEQ ID NO: 24276 - protein, 33 aa, Artificial Sequence
  Description of Artificial Sequence: Synthetic polypeptide
DEEEIRTTNPVATEQYGQSVSMTEALQRGSNRV

SEQ ID NO: 24277 - protein, 30 aa, Artificial Sequence
  Description of Artificial Sequence: Synthetic polypeptide
DEEEIRTTNPVATEQYGSVSTNLQAMLELS

SEQ ID NO: 24278 - protein, 32 aa, Artificial Sequence
  Description of Artificial Sequence: Synthetic polypeptide
DEEEIRTTNPVATEQYGCVSTGNLQNFGMNRE

SEQ ID NO: 24279 - protein, 29 aa, Artificial Sequence
  Description of Artificial Sequence: Synthetic peptide
DEDEIATTNPVATEQYGSVATNLQADNRN

SEQ ID NO: 24280 - protein, 29 aa, Artificial Sequence
  Description of Artificial Sequence: Synthetic peptide
DEDEIATTNPVATEQYGSVATNLQMGNTP

SEQ ID NO: 24281 - protein, 30 aa, Artificial Sequence
  Description of Artificial Sequence: Synthetic polypeptide
SEEEIATTNPVATEQYGSVSVNLQVGNDRD

SEQ ID NO: 24282 - protein, 32 aa, Artificial Sequence
  Description of Artificial Sequence: Synthetic polypeptide
DEEEIRTTNPVATEQYGSVSTNLPQNGGGNGS

SEQ ID NO: 24283 - protein, 32 aa, Artificial Sequence
  Description of Artificial Sequence: Synthetic polypeptide
DEEEIRTTNPVATEQYGSVSTNLPQNGGNIST

SEQ ID NO: 24284 - protein, 32 aa, Artificial Sequence
  Description of Artificial Sequence: Synthetic polypeptide
DEEEIRTTNPVATEQYGSVSTNLPQNGGNNNS

SEQ ID NO: 24285 - protein, 31 aa, Artificial Sequence
  Description of Artificial Sequence: Synthetic polypeptide
NEAEIRTTNPVATEQYGSVSTNPLQDHGPNR

SEQ ID NO: 24286 - protein, 31 aa, Artificial Sequence
  Description of Artificial Sequence: Synthetic polypeptide
NEAEIRTTNPVATEQYGSVSTNLQGEDGNQR

SEQ ID NO: 24287 - protein, 30 aa, Artificial Sequence
  Description of Artificial Sequence: Synthetic polypeptide
NEAEIRTTNPVATEQYGSVSTNLQGDGNNK

SEQ ID NO: 24288 - protein, 30 aa, Artificial Sequence
  Description of Artificial Sequence: Synthetic polypeptide
NEAEIRTTNPVATEQYGSVSTNLQGDGNGA

SEQ ID NO: 24289 - protein, 30 aa, Artificial Sequence
  Description of Artificial Sequence: Synthetic polypeptide
AEEEIRTTNPVATEQYGSVSTVNTQEGNQN

SEQ ID NO: 24290 - protein, 29 aa, Artificial Sequence
  Description of Artificial Sequence: Synthetic peptide
NEAEIRTTNPVATEQYGSVSTNAQHDGNQ

SEQ ID NO: 24291 - protein, 32 aa, Artificial Sequence
  Description of Artificial Sequence: Synthetic polypeptide
DEEEIRTTNPVATEQYGSVSTNLPQQNNGNET

SEQ ID NO: 24292 - protein, 29 aa, Artificial Sequence
  Description of Artificial Sequence: Synthetic peptide
NEAEIRTTNPVATEQYGAVSTNLQMGGNA

SEQ ID NO: 24293 - protein, 29 aa, Artificial Sequence
  Description of Artificial Sequence: Synthetic peptide
DEEEIRTTNPVATEQYGSVSINDDQREDQ

SEQ ID NO: 24294 - protein, 29 aa, Artificial Sequence
  Description of Artificial Sequence: Synthetic peptide
DEEEIRTTNPVATEQYGCVSTHHQYGSNV

SEQ ID NO: 24295 - protein, 29 aa, Artificial Sequence
  Description of Artificial Sequence: Synthetic peptide
NEAEIRTTNPVATEQYGAVSTNLQHAGNA

SEQ ID NO: 24296 - protein, 29 aa, Artificial Sequence
  Description of Artificial Sequence: Synthetic peptide
DEEEIRTTNPVATEQYGSVSINDDRGFMM

SEQ ID NO: 24297 - protein, 29 aa, Artificial Sequence
  Description of Artificial Sequence: Synthetic peptide
SEEEIATTNPVATEQYGSVSENLMDRGNL

SEQ ID NO: 24298 - protein, 29 aa, Artificial Sequence
  Description of Artificial Sequence: Synthetic peptide
SEEEIATTNPVATEQYGSVSGTPLQDGND

SEQ ID NO: 24299 - protein, 31 aa, Artificial Sequence
  Description of Artificial Sequence: Synthetic polypeptide
DEEEIRTTNPVATEQYGSVSINDLDQITNRD

SEQ ID NO: 24300 - protein, 30 aa, Artificial Sequence
  Description of Artificial Sequence: Synthetic polypeptide
DEDEIATTNPVATEQYGSVATNLQEGNNRP

SEQ ID NO: 24301 - protein, 29 aa, Artificial Sequence
  Description of Artificial Sequence: Synthetic peptide
NEAEIRTTNPAATEQYGSVSTNLEHGNRL

SEQ ID NO: 24302 - protein, 32 aa, Artificial Sequence
  Description of Artificial Sequence: Synthetic polypeptide
DEEEIRTTNPVATEQYGSVSTNLPQSGGNNEM

SEQ ID NO: 24303 - protein, 29 aa, Artificial Sequence
  Description of Artificial Sequence: Synthetic peptide
DEDEIATTNPVATEQYGSVATNLQEGNVQ

SEQ ID NO: 24304 - protein, 29 aa, Artificial Sequence
  Description of Artificial Sequence: Synthetic peptide
DEDEIATTNPVATEQYGSVATNLQEQGNQ

SEQ ID NO: 24305 - protein, 30 aa, Artificial Sequence
  Description of Artificial Sequence: Synthetic polypeptide
SEEEIATTNPVATEQYGSVSTNLQQDGDDR

SEQ ID NO: 24306 - protein, 29 aa, Artificial Sequence
  Description of Artificial Sequence: Synthetic peptide
DEDEIATTNPVATEQYGSVATNLQERGQE

SEQ ID NO: 24307 - protein, 32 aa, Artificial Sequence
  Description of Artificial Sequence: Synthetic polypeptide
SEEEIATTNPVATEQYGSVSTPNLGQRGENDR

SEQ ID NO: 24308 - protein, 33 aa, Artificial Sequence
  Description of Artificial Sequence: Synthetic polypeptide
DEEEIRTTNPVATEQYGQSVCSTNGLTRGSNRA

SEQ ID NO: 24309 - protein, 30 aa, Artificial Sequence
  Description of Artificial Sequence: Synthetic polypeptide
SEEEICTTNPVATEQYGSVSTNLQRNANMN

SEQ ID NO: 24310 - protein, 29 aa, Artificial Sequence
  Description of Artificial Sequence: Synthetic peptide
SEEEICTTNPVATEQYGSVSTNLQSGDDV

SEQ ID NO: 24311 - protein, 29 aa, Artificial Sequence
  Description of Artificial Sequence: Synthetic peptide
SEEEICTTNPVATEQYGSVSTNLQSGDQD

SEQ ID NO: 24312 - protein, 31 aa, Artificial Sequence
  Description of Artificial Sequence: Synthetic polypeptide
AEEEIRTTNPVATEQYGSVSTVNLQNVGNSE

SEQ ID NO: 24313 - protein, 32 aa, Artificial Sequence
  Description of Artificial Sequence: Synthetic polypeptide
DEEEIRTTNPVATEQYGSVSTNLQFFGSVNDY

SEQ ID NO: 24314 - protein, 28 aa, Artificial Sequence
  Description of Artificial Sequence: Synthetic peptide
LEEGICTTNPVATEQYGSVSMNSQRGNL

SEQ ID NO: 24315 - protein, 28 aa, Artificial Sequence
  Description of Artificial Sequence: Synthetic peptide
SEEEIRCTNPAATEQYGSVSENLDRGNI

SEQ ID NO: 24316 - protein, 30 aa, Artificial Sequence
  Description of Artificial Sequence: Synthetic polypeptide
LEEEISTTNPVGTEQYGQSVSTNLQRGNGY

SEQ ID NO: 24317 - protein, 28 aa, Artificial Sequence
  Description of Artificial Sequence: Synthetic peptide
SEEEIRCTNPAATEQYGSVSENLERDNR

SEQ ID NO: 24318 - protein, 31 aa, Artificial Sequence
  Description of Artificial Sequence: Synthetic polypeptide
DEEEIRTTNPVATEQYGSVSTNLQFFNSQVE

SEQ ID NO: 24319 - protein, 29 aa, Artificial Sequence
  Description of Artificial Sequence: Synthetic peptide
SEEEIRCTNPAATEQYGSVSENLFRMGNR

SEQ ID NO: 24320 - protein, 31 aa, Artificial Sequence
  Description of Artificial Sequence: Synthetic polypeptide
DEEEIRTTNPVATEQYGSVSTLNLEDGEGNE

SEQ ID NO: 24321 - protein, 30 aa, Artificial Sequence
  Description of Artificial Sequence: Synthetic polypeptide
DEEEIRTTNPVATEQYGCVSTEGHQRDSNR

SEQ ID NO: 24322 - protein, 28 aa, Artificial Sequence
  Description of Artificial Sequence: Synthetic peptide
SEEEIRCTNPAATEQYGSVSENLVRGER

SEQ ID NO: 24323 - protein, 32 aa, Artificial Sequence
  Description of Artificial Sequence: Synthetic polypeptide
DEEEIRTTNPVATEQYGSVSTLNLAQNGNNNF

SEQ ID NO: 24324 - protein, 29 aa, Artificial Sequence
  Description of Artificial Sequence: Synthetic peptide
SEEEIRCTNPAATEQYGSVSENLDMRGNR

SEQ ID NO: 24325 - protein, 32 aa, Artificial Sequence
  Description of Artificial Sequence: Synthetic polypeptide
LEEEIRTTNPVATEQYGSVNTSNLSQRGENVR

SEQ ID NO: 24326 - protein, 31 aa, Artificial Sequence
  Description of Artificial Sequence: Synthetic polypeptide
DEEEIRTTNPVATEQYGSVSTLNIDQEQGNV

SEQ ID NO: 24327 - protein, 29 aa, Artificial Sequence
  Description of Artificial Sequence: Synthetic peptide
SEEEIRCTNPAATEQYGSVSLNLMRGQNR

SEQ ID NO: 24328 - protein, 29 aa, Artificial Sequence
  Description of Artificial Sequence: Synthetic peptide
SEEEIRCTNPAATEQYGSVSNENLNRGNR

SEQ ID NO: 24329 - protein, 31 aa, Artificial Sequence
  Description of Artificial Sequence: Synthetic polypeptide
DEEEIRTTNPVATEQYGSVSTLNGQGGGNEN

SEQ ID NO: 24330 - protein, 28 aa, Artificial Sequence
  Description of Artificial Sequence: Synthetic peptide
SEEEIRCTNPAATEQYGSVSSNLMRGLR

SEQ ID NO: 24331 - protein, 30 aa, Artificial Sequence
  Description of Artificial Sequence: Synthetic polypeptide
DEEEIRTTNPVATEQYGSVSITALEMRLNG

SEQ ID NO: 24332 - protein, 30 aa, Artificial Sequence
  Description of Artificial Sequence: Synthetic polypeptide
KEQEIRTTNPVATEQYGWVSTNLQSEGNDR

SEQ ID NO: 24333 - protein, 28 aa, Artificial Sequence
  Description of Artificial Sequence: Synthetic peptide
KENEIRTTNPVATEQYGSASTDLQNGER

SEQ ID NO: 24334 - protein, 30 aa, Artificial Sequence
  Description of Artificial Sequence: Synthetic polypeptide
DEEEIRCTNPVATEQYGSVSTNLQQGTPEA

SEQ ID NO: 24335 - protein, 30 aa, Artificial Sequence
  Description of Artificial Sequence: Synthetic polypeptide
DEDEIATTNPVATEQYGSVSTNLGMEGENR

SEQ ID NO: 24336 - protein, 30 aa, Artificial Sequence
  Description of Artificial Sequence: Synthetic polypeptide
KEEEISTTNPVATEEYGSVVSTMNLQRGNT

SEQ ID NO: 24337 - protein, 32 aa, Artificial Sequence
  Description of Artificial Sequence: Synthetic polypeptide
DEEEIRTTNPVATEQYGSVSITDIQRGGNERE

SEQ ID NO: 24338 - protein, 31 aa, Artificial Sequence
  Description of Artificial Sequence: Synthetic polypeptide
DEEEIRTTNPVATEQYGSVSTNLQFFSSNDM

SEQ ID NO: 24339 - protein, 30 aa, Artificial Sequence
  Description of Artificial Sequence: Synthetic polypeptide
DEDEIATTNPVATEQYGSVSTNLQNQGNDG

SEQ ID NO: 24340 - protein, 29 aa, Artificial Sequence
  Description of Artificial Sequence: Synthetic peptide
DEEEIRTTNPVATEQYGCVSTEHQGGNVA

SEQ ID NO: 24341 - protein, 30 aa, Artificial Sequence
  Description of Artificial Sequence: Synthetic polypeptide
DEEEIRTTNPVATEQYGSVSTLNLTVGHEA

SEQ ID NO: 24342 - protein, 30 aa, Artificial Sequence
  Description of Artificial Sequence: Synthetic polypeptide
AEEEIRTTNPVATEQYGSVSTVNLQQTNTA

SEQ ID NO: 24343 - protein, 31 aa, Artificial Sequence
  Description of Artificial Sequence: Synthetic polypeptide
AEEEIRTTNPVATEQYGSVSTVNLQQTGNIA

SEQ ID NO: 24344 - protein, 30 aa, Artificial Sequence
  Description of Artificial Sequence: Synthetic polypeptide
DEEEIRCTNPVATEQYGSVSVNQTRGSNSR

SEQ ID NO: 24345 - protein, 29 aa, Artificial Sequence
  Description of Artificial Sequence: Synthetic peptide
MEEEIATTNPVATEQYGEVSVTMLQGGNR

SEQ ID NO: 24346 - protein, 30 aa, Artificial Sequence
  Description of Artificial Sequence: Synthetic polypeptide
SEEEIRATNPVATEQYGSVSTNLQAGNEDA

SEQ ID NO: 24347 - protein, 31 aa, Artificial Sequence
  Description of Artificial Sequence: Synthetic polypeptide
DEEEIRTTNPVATEQYGSVSTNLQETGSEEE

SEQ ID NO: 24348 - protein, 31 aa, Artificial Sequence
  Description of Artificial Sequence: Synthetic polypeptide
DEEEIRTTNPVATEQYGSVSTNLQETNEQEN

SEQ ID NO: 24349 - protein, 31 aa, Artificial Sequence
  Description of Artificial Sequence: Synthetic polypeptide
DEEEIRTTNPVATEQYGSVSTNLQETNQNLN

SEQ ID NO: 24350 - protein, 31 aa, Artificial Sequence
  Description of Artificial Sequence: Synthetic polypeptide
DEEEIRTTNPDATEQYGSVSTTNLIPRGNEM

SEQ ID NO: 24351 - protein, 30 aa, Artificial Sequence
  Description of Artificial Sequence: Synthetic polypeptide
DEEEIRTTNPVATEQYGSVSTLNQIGGNED

SEQ ID NO: 24352 - protein, 30 aa, Artificial Sequence
  Description of Artificial Sequence: Synthetic polypeptide
DEECIRTTNPVATEQYDYNVSANLQRGDNR

SEQ ID NO: 24353 - protein, 28 aa, Artificial Sequence
  Description of Artificial Sequence: Synthetic peptide
DEEEIRTTNPDATESYGSCSTNLARGGW

SEQ ID NO: 24354 - protein, 28 aa, Artificial Sequence
  Description of Artificial Sequence: Synthetic peptide
DEEEIRTTNPEATAQYGQVPTALQRGNF

SEQ ID NO: 24355 - protein, 31 aa, Artificial Sequence
  Description of Artificial Sequence: Synthetic polypeptide
DEEEIRTTNPVATEQYGSVSTLNNQIIGNEV

SEQ ID NO: 24356 - protein, 28 aa, Artificial Sequence
  Description of Artificial Sequence: Synthetic peptide
MEEAICTTNPVATEQYGSVSMNSQRGNQ

SEQ ID NO: 24357 - protein, 31 aa, Artificial Sequence
  Description of Artificial Sequence: Synthetic polypeptide
DEEEIRTTNPVATEQYGSVSTNLQEVEGEDF

SEQ ID NO: 24358 - protein, 31 aa, Artificial Sequence
  Description of Artificial Sequence: Synthetic polypeptide
DEEEIRTTNPVATEQYGSVSTLNNMDMGNER

SEQ ID NO: 24359 - protein, 30 aa, Artificial Sequence
  Description of Artificial Sequence: Synthetic polypeptide
AEEEIRTTNPVATEQYGVVVSTNLEQGNNR

SEQ ID NO: 24360 - protein, 32 aa, Artificial Sequence
  Description of Artificial Sequence: Synthetic polypeptide
DEEEIRTTNPVATEQYGSVSTNLQEVMGNDGD

SEQ ID NO: 24361 - protein, 32 aa, Artificial Sequence
  Description of Artificial Sequence: Synthetic polypeptide
DEEEIRTTNPVATEQYGSVSTLNNLQLRDTDR

SEQ ID NO: 24362 - protein, 29 aa, Artificial Sequence
  Description of Artificial Sequence: Synthetic peptide
SEEEIRCTNPAATEQYGSVSDNDLMRGNR

SEQ ID NO: 24363 - protein, 30 aa, Artificial Sequence
  Description of Artificial Sequence: Synthetic polypeptide
DEEEIRTTNPDATLQYGSVSTVNQQEIGNR

SEQ ID NO: 24364 - protein, 29 aa, Artificial Sequence
  Description of Artificial Sequence: Synthetic peptide
SEEEIRCTNPAATEQYGSVSEGNLVRGNR

SEQ ID NO: 24365 - protein, 30 aa, Artificial Sequence
  Description of Artificial Sequence: Synthetic polypeptide
DEECIRTTNPVATEQYDCSPSINLQRGDNR

SEQ ID NO: 24366 - protein, 31 aa, Artificial Sequence
  Description of Artificial Sequence: Synthetic polypeptide
DEEEIRTTNPVATEQYGSVSTLNNALQGDNS

SEQ ID NO: 24367 - protein, 30 aa, Artificial Sequence
  Description of Artificial Sequence: Synthetic polypeptide
MAEEIRSTNPVATEQYGSVSTNLQARNGTR

SEQ ID NO: 24368 - protein, 28 aa, Artificial Sequence
  Description of Artificial Sequence: Synthetic peptide
MEEEIACTNPIATEQYGSVSENLMRGNR

SEQ ID NO: 24369 - protein, 29 aa, Artificial Sequence
  Description of Artificial Sequence: Synthetic peptide
MEEEIATTNPVATEQYGNVSNTGLQGGNR

SEQ ID NO: 24370 - protein, 31 aa, Artificial Sequence
  Description of Artificial Sequence: Synthetic polypeptide
DEDEIATTNPVATEQYGSVSTNLQPGQDNDR

SEQ ID NO: 24371 - protein, 31 aa, Artificial Sequence
  Description of Artificial Sequence: Synthetic polypeptide
DEEEIRTTNPVATEQYGSVSTLNDQEEMGND

SEQ ID NO: 24372 - protein, 29 aa, Artificial Sequence
  Description of Artificial Sequence: Synthetic peptide
IEEEIRCTNPIATEQYGSVSNENLPRGNR

SEQ ID NO: 24373 - protein, 28 aa, Artificial Sequence
  Description of Artificial Sequence: Synthetic peptide
SEEEIRCTNPDATEQYGSVSENGMRGNR

SEQ ID NO: 24374 - protein, 29 aa, Artificial Sequence
  Description of Artificial Sequence: Synthetic peptide
IEEEIRCTNPIATEQYGSVSENLMRGNNR

SEQ ID NO: 24375 - protein, 28 aa, Artificial Sequence
  Description of Artificial Sequence: Synthetic peptide
SEEEIRCTNPDATEQYGSVSENLMRGNW

SEQ ID NO: 24376 - protein, 32 aa, Artificial Sequence
  Description of Artificial Sequence: Synthetic polypeptide
DEEEIRTTNPVATEQYGSVSTNLQFGMGNNID

SEQ ID NO: 24377 - protein, 28 aa, Artificial Sequence
  Description of Artificial Sequence: Synthetic peptide
SEEEIRCTNPEATEQYGSVSENLMRGKR

SEQ ID NO: 24378 - protein, 31 aa, Artificial Sequence
  Description of Artificial Sequence: Synthetic polypeptide
DEEEIRTTNPVATEQYGSACSTNLQRTENLI

SEQ ID NO: 24379 - protein, 29 aa, Artificial Sequence
  Description of Artificial Sequence: Synthetic peptide
SEEEIRCTNPEATEQYGSVSENLMRGSNR

SEQ ID NO: 24380 - protein, 29 aa, Artificial Sequence
  Description of Artificial Sequence: Synthetic peptide
HEREIRTTNPVATEQYGSSVCTNLQIGER

SEQ ID NO: 24381 - protein, 28 aa, Artificial Sequence
  Description of Artificial Sequence: Synthetic peptide
SEEEIRCTNPEATEQYGSVSENLMRGVR

SEQ ID NO: 24382 - protein, 28 aa, Artificial Sequence
  Description of Artificial Sequence: Synthetic peptide
SEEEIRCTNPEATEQYGSVSENLVRGND

SEQ ID NO: 24383 - protein, 28 aa, Artificial Sequence
  Description of Artificial Sequence: Synthetic peptide
SEEEIRCTNPEATEQYGSVSENPMRGNR

SEQ ID NO: 24384 - protein, 30 aa, Artificial Sequence
  Description of Artificial Sequence: Synthetic polypeptide
DEECIRTTNPVATEQWGSVGTNNLQLGVNR

SEQ ID NO: 24385 - protein, 29 aa, Artificial Sequence
  Description of Artificial Sequence: Synthetic peptide
SEEEIRCTNPEIATEQYGSVSENLMRGNR

SEQ ID NO: 24386 - protein, 31 aa, Artificial Sequence
  Description of Artificial Sequence: Synthetic polypeptide
DEEEIRTTNPVATEQYGSVSTNLQFMSNPDY

SEQ ID NO: 24387 - protein, 29 aa, Artificial Sequence
  Description of Artificial Sequence: Synthetic peptide
HEEEVRTTNPCATEQYGSVSTNLQPKENR

SEQ ID NO: 24388 - protein, 28 aa, Artificial Sequence
  Description of Artificial Sequence: Synthetic peptide
SEEEIRCTNPFATEQYGSVSENLMEGNR

SEQ ID NO: 24389 - protein, 30 aa, Artificial Sequence
  Description of Artificial Sequence: Synthetic polypeptide
HEEEIRTVNPVATEFYGSVSTGNLQRVGTR

SEQ ID NO: 24390 - protein, 29 aa, Artificial Sequence
  Description of Artificial Sequence: Synthetic peptide
AEEEIRTTNPVATESYGCISANLQREGNR

SEQ ID NO: 24391 - protein, 28 aa, Artificial Sequence
  Description of Artificial Sequence: Synthetic peptide
AEEEIRTTNPVATESYGCYSANLQRDNR

SEQ ID NO: 24392 - protein, 29 aa, Artificial Sequence
  Description of Artificial Sequence: Synthetic peptide
AEEEIRTTNPVATESYGCYSENLDQRGNR

SEQ ID NO: 24393 - protein, 31 aa, Artificial Sequence
  Description of Artificial Sequence: Synthetic polypeptide
DEEEIRTTNPVATEQYGCVSTDNLQTISNRM

SEQ ID NO: 24394 - protein, 28 aa, Artificial Sequence
  Description of Artificial Sequence: Synthetic peptide
SEEEIRCTNPIACEQYGSVSENLMRGNR

SEQ ID NO: 24395 - protein, 31 aa, Artificial Sequence
  Description of Artificial Sequence: Synthetic polypeptide
AEEEIRTTNPVATESYGSVSDTNLQEDGGNR

SEQ ID NO: 24396 - protein, 28 aa, Artificial Sequence
  Description of Artificial Sequence: Synthetic peptide
SEEEIRCTNPIAFEQYGSVSENLMRGNR

SEQ ID NO: 24397 - protein, 30 aa, Artificial Sequence
  Description of Artificial Sequence: Synthetic polypeptide
DEEEIRTTNPVATEQYGCVSTDMQRDNQRQ

SEQ ID NO: 24398 - protein, 30 aa, Artificial Sequence
  Description of Artificial Sequence: Synthetic polypeptide
DEEEIRTTNPVATEQYGSVSTLLQESTQMR

SEQ ID NO: 24399 - protein, 30 aa, Artificial Sequence
  Description of Artificial Sequence: Synthetic polypeptide
DEDEIATTNPVATEQYGSVSTNLQRENTEE

SEQ ID NO: 24400 - protein, 28 aa, Artificial Sequence
  Description of Artificial Sequence: Synthetic peptide
SEEEIRCTNPCATEYYGSVSENLMRGNR

SEQ ID NO: 24401 - protein, 29 aa, Artificial Sequence
  Description of Artificial Sequence: Synthetic peptide
SEEEIRCTNPCATEQYGSVTSENLARGNR

SEQ ID NO: 24402 - protein, 32 aa, Artificial Sequence
  Description of Artificial Sequence: Synthetic polypeptide
DEEEIRTTNPVATEQYGSVSITDNLQRGVLEV

SEQ ID NO: 24403 - protein, 28 aa, Artificial Sequence
  Description of Artificial Sequence: Synthetic peptide
DEEEIRTTNPEATCQYGCVVTDLQRGNF

SEQ ID NO: 24404 - protein, 29 aa, Artificial Sequence
  Description of Artificial Sequence: Synthetic peptide
DEEEIRTTNPVATEQYGSVSTLLTDNGEF

SEQ ID NO: 24405 - protein, 32 aa, Artificial Sequence
  Description of Artificial Sequence: Synthetic polypeptide
DEEEIRTTNPVATEQYGSVSITDPQRGNEDRD

SEQ ID NO: 24406 - protein, 28 aa, Artificial Sequence
  Description of Artificial Sequence: Synthetic peptide
KEEEIRCTNPIATEQYGSVSENLMPGNR

SEQ ID NO: 24407 - protein, 31 aa, Artificial Sequence
  Description of Artificial Sequence: Synthetic polypeptide
DEEEIRTTNPVATEQYGSVSTLLQRVGVEIS

SEQ ID NO: 24408 - protein, 28 aa, Artificial Sequence
  Description of Artificial Sequence: Synthetic peptide
KEEEIRATNPVATECYGSMSTNLQWGNE

SEQ ID NO: 24409 - protein, 28 aa, Artificial Sequence
  Description of Artificial Sequence: Synthetic peptide
KEEEIATTNPVATEQYGSVSENLCRENQ

SEQ ID NO: 24410 - protein, 28 aa, Artificial Sequence
  Description of Artificial Sequence: Synthetic peptide
DEEEIRTTNPEATDQYGQVPTDLQRGNV

SEQ ID NO: 24411 - protein, 29 aa, Artificial Sequence
  Description of Artificial Sequence: Synthetic peptide
KEEEIACTNPVATEPYGSVSTNLQRGNML

SEQ ID NO: 24412 - protein, 29 aa, Artificial Sequence
  Description of Artificial Sequence: Synthetic peptide
INEEIRTTNPVATEQYGDVSTNLQDGNND

SEQ ID NO: 24413 - protein, 31 aa, Artificial Sequence
  Description of Artificial Sequence: Synthetic polypeptide
AEEEIRTTNPVATEQYGSVSTVNLQEGGNET

SEQ ID NO: 24414 - protein, 32 aa, Artificial Sequence
  Description of Artificial Sequence: Synthetic polypeptide
DEEEIRTTNPVATEQYGSVSTNLQFGEPNFNE

SEQ ID NO: 24415 - protein, 28 aa, Artificial Sequence
  Description of Artificial Sequence: Synthetic peptide
DEEEIRTTNPEATECYGSVATNHGRGNA

SEQ ID NO: 24416 - protein, 29 aa, Artificial Sequence
  Description of Artificial Sequence: Synthetic peptide
SEEEIRCTNPCATEQYGSVSENLDRGINR

SEQ ID NO: 24417 - protein, 28 aa, Artificial Sequence
  Description of Artificial Sequence: Synthetic peptide
SEEEIRCTNPCATEQYGSVSENLMRGDR

SEQ ID NO: 24418 - protein, 31 aa, Artificial Sequence
  Description of Artificial Sequence: Synthetic polypeptide
DEEEIRTTNPVATEQYGSVSTLLQRNNNLQD

SEQ ID NO: 24419 - protein, 28 aa, Artificial Sequence
  Description of Artificial Sequence: Synthetic peptide
SEEEIRCTNPCATEQYGSVSENLMRGNK

SEQ ID NO: 24420 - protein, 31 aa, Artificial Sequence
  Description of Artificial Sequence: Synthetic polypeptide
DEEEIRCTNPVATEQYGSVSTNDQQRAGNDQ

SEQ ID NO: 24421 - protein, 28 aa, Artificial Sequence
  Description of Artificial Sequence: Synthetic peptide
DEEEIRTTNPEATEEYGSVATNHARGNA

SEQ ID NO: 24422 - protein, 29 aa, Artificial Sequence
  Description of Artificial Sequence: Synthetic peptide
IEEEISTTNPVATEQYGAVMAPNLQRGNR

SEQ ID NO: 24423 - protein, 29 aa, Artificial Sequence
  Description of Artificial Sequence: Synthetic peptide
SEEEIRCTNPCATEQYGSVSENLMRMGNR

SEQ ID NO: 24424 - protein, 29 aa, Artificial Sequence
  Description of Artificial Sequence: Synthetic peptide
SEEEIRCTNPCATEQYGSVSENVLMRGNR

SEQ ID NO: 24425 - protein, 29 aa, Artificial Sequence
  Description of Artificial Sequence: Synthetic peptide
DEDEIATTNPVATEQYGVVSTNLERGNEQ

SEQ ID NO: 24426 - protein, 29 aa, Artificial Sequence
  Description of Artificial Sequence: Synthetic peptide
DEEEIRTTNPEATEGYGSCSTNLAREGNW

SEQ ID NO: 24427 - protein, 28 aa, Artificial Sequence
  Description of Artificial Sequence: Synthetic peptide
SEEEIRCTNPCATEQYGSVSSNLMRGNA

SEQ ID NO: 24428 - protein, 30 aa, Artificial Sequence
  Description of Artificial Sequence: Synthetic polypeptide
DEEEIRCTNPVATEQYGSVSTNLQEQGTDQ

SEQ ID NO: 24429 - protein, 28 aa, Artificial Sequence
  Description of Artificial Sequence: Synthetic peptide
DEEEIRTTNPDATEQYGSVSTAGQFGEW

SEQ ID NO: 24430 - protein, 31 aa, Artificial Sequence
  Description of Artificial Sequence: Synthetic polypeptide
DEEEIRTTNPVATEQYGSVSTLNTGGQGGNT

SEQ ID NO: 24431 - protein, 29 aa, Artificial Sequence
  Description of Artificial Sequence: Synthetic peptide
MEEEIATTNPVATEQYGNVSVTTLQPGNR

SEQ ID NO: 24432 - protein, 30 aa, Artificial Sequence
  Description of Artificial Sequence: Synthetic polypeptide
DEEEIRTTNPVATEQYGSVSTMDLAHGNDD

SEQ ID NO: 24433 - protein, 28 aa, Artificial Sequence
  Description of Artificial Sequence: Synthetic peptide
SEEEIGCTNPIATEQYGSVSENLMRGNR

SEQ ID NO: 24434 - protein, 28 aa, Artificial Sequence
  Description of Artificial Sequence: Synthetic peptide
DEEEIRTTNPVATEQYGSVSIPLQNMEE

SEQ ID NO: 24435 - protein, 28 aa, Artificial Sequence
  Description of Artificial Sequence: Synthetic peptide
SEEEIHCTNPIATEQYGSVSENLMRGNR

SEQ ID NO: 24436 - protein, 29 aa, Artificial Sequence
  Description of Artificial Sequence: Synthetic peptide
MEEEIRTTNPVATEQYGSVATALQNGFNI

SEQ ID NO: 24437 - protein, 32 aa, Artificial Sequence
  Description of Artificial Sequence: Synthetic polypeptide
DEEEIRTTNPVATEQYGSVSTNLQDTEGVDRD

SEQ ID NO: 24438 - protein, 28 aa, Artificial Sequence
  Description of Artificial Sequence: Synthetic peptide
SEEEIICTNPIATEQYGSVSENLMRGNR

SEQ ID NO: 24439 - protein, 31 aa, Artificial Sequence
  Description of Artificial Sequence: Synthetic polypeptide
MEEEIRTTNPVATEQYGSVASTNLQNNGENT

SEQ ID NO: 24440 - protein, 31 aa, Artificial Sequence
  Description of Artificial Sequence: Synthetic polypeptide
DEEEIRTTNPVATEQYGSVSTMDDQYVGNDR

SEQ ID NO: 24441 - protein, 28 aa, Artificial Sequence
  Description of Artificial Sequence: Synthetic peptide
SEEEIKCTNPIATEQYGSVSDNLMRGNR

SEQ ID NO: 24442 - protein, 31 aa, Artificial Sequence
  Description of Artificial Sequence: Synthetic polypeptide
DEEEIRTTNPVATEQYGSVSTMDDQYGENNR

SEQ ID NO: 24443 - protein, 28 aa, Artificial Sequence
  Description of Artificial Sequence: Synthetic peptide
SEEEIKCTNPIATEQYGSVSENLMRGNR

SEQ ID NO: 24444 - protein, 32 aa, Artificial Sequence
  Description of Artificial Sequence: Synthetic polypeptide
MEEEIRTTNPVATEQYGSVDTSNLQQRGVNYR

SEQ ID NO: 24445 - protein, 28 aa, Artificial Sequence
  Description of Artificial Sequence: Synthetic peptide
SEEEIKCTNPIATEQYGSVSENLTRGNR

SEQ ID NO: 24446 - protein, 30 aa, Artificial Sequence
  Description of Artificial Sequence: Synthetic polypeptide
SEEEIKTTNPVATEQWGMVSCTNLSQRGNR

SEQ ID NO: 24447 - protein, 29 aa, Artificial Sequence
  Description of Artificial Sequence: Synthetic peptide
DEEEIRTTNPDATEGYGSCSTNLATRGNT

SEQ ID NO: 24448 - protein, 32 aa, Artificial Sequence
  Description of Artificial Sequence: Synthetic polypeptide
DEEEIRTTNPVATEQYGSVSTNLQDVTGGNEI

SEQ ID NO: 24449 - protein, 28 aa, Artificial Sequence
  Description of Artificial Sequence: Synthetic peptide
SEEEIMCTNPIATEQYGSVSENLMRGNR

SEQ ID NO: 24450 - protein, 28 aa, Artificial Sequence
  Description of Artificial Sequence: Synthetic peptide
SEEEIMCTNPIATEQYGSVSENLSRGNR

SEQ ID NO: 24451 - protein, 29 aa, Artificial Sequence
  Description of Artificial Sequence: Synthetic peptide
SEEEIMTTNPVATEQYGNVSNTMLQGGNR

SEQ ID NO: 24452 - protein, 29 aa, Artificial Sequence
  Description of Artificial Sequence: Synthetic peptide
SEEEIMTTNPVATEQYGTVSVTDLQGGNR

SEQ ID NO: 24453 - protein, 29 aa, Artificial Sequence
  Description of Artificial Sequence: Synthetic peptide
MEEEIRTTNPVATEGYGCTSINLQRQGNR

SEQ ID NO: 24454 - protein, 28 aa, Artificial Sequence
  Description of Artificial Sequence: Synthetic peptide
SEEEINCTNPIATEQYGSVSENLMRGNR

SEQ ID NO: 24455 - protein, 31 aa, Artificial Sequence
  Description of Artificial Sequence: Synthetic polypeptide
DEEEIRTTNPVATEQYGSVSISLDQRGPEER

SEQ ID NO: 24456 - protein, 30 aa, Artificial Sequence
  Description of Artificial Sequence: Synthetic polypeptide
DEEEIRTTNPVATEQYGSVSTLTQYGSNQM

SEQ ID NO: 24457 - protein, 29 aa, Artificial Sequence
  Description of Artificial Sequence: Synthetic peptide
MEEEIRTTNPVATECYGSVSTDLQEHGNW

SEQ ID NO: 24458 - protein, 31 aa, Artificial Sequence
  Description of Artificial Sequence: Synthetic polypeptide
MEEEIRTTNPVATEQYGCVSTNLQRGSENQS

SEQ ID NO: 24459 - protein, 28 aa, Artificial Sequence
  Description of Artificial Sequence: Synthetic peptide
MEEEIRTTNPVATECYGSVSEELQSGNL

SEQ ID NO: 24460 - protein, 28 aa, Artificial Sequence
  Description of Artificial Sequence: Synthetic peptide
SEEEIECTNPIATEQYGSVSENLMRGNR

SEQ ID NO: 24461 - protein, 30 aa, Artificial Sequence
  Description of Artificial Sequence: Synthetic polypeptide
MEEEIRTTNPVATEQYGSVGTNHQNGSNRS

SEQ ID NO: 24462 - protein, 29 aa, Artificial Sequence
  Description of Artificial Sequence: Synthetic peptide
SEEEICTTNPVATEQYGSVSTNPQGGDDR

SEQ ID NO: 24463 - protein, 31 aa, Artificial Sequence
  Description of Artificial Sequence: Synthetic polypeptide
SEEEICTTNPVATEQYGSVSTNQLQERTGNL

SEQ ID NO: 24464 - protein, 30 aa, Artificial Sequence
  Description of Artificial Sequence: Synthetic polypeptide
SEEEICTTNPVATEQYGSVSTPNLQAGNNS

SEQ ID NO: 24465 - protein, 31 aa, Artificial Sequence
  Description of Artificial Sequence: Synthetic polypeptide
MEEEIRTTNPVATEQYGSVSTNLQPRNANFY

SEQ ID NO: 24466 - protein, 29 aa, Artificial Sequence
  Description of Artificial Sequence: Synthetic peptide
SEEEICTTNPVATEQYGSVSTVLQDGDND

SEQ ID NO: 24467 - protein, 31 aa, Artificial Sequence
  Description of Artificial Sequence: Synthetic polypeptide
MEEEIRTTNPVATEQYGSVSTNLQNFGSEND

SEQ ID NO: 24468 - protein, 29 aa, Artificial Sequence
  Description of Artificial Sequence: Synthetic peptide
SEEEICTTNPVATEQYGSVSVTNLQADNE

SEQ ID NO: 24469 - protein, 32 aa, Artificial Sequence
  Description of Artificial Sequence: Synthetic polypeptide
DEEEIRTTNPVATEQYGSVSTNLQDGTEETRM

SEQ ID NO: 24470 - protein, 31 aa, Artificial Sequence
  Description of Artificial Sequence: Synthetic polypeptide
DEEEIRTTNPVATEQYGSVSTNLQDIKGEDN

SEQ ID NO: 24471 - protein, 33 aa, Artificial Sequence
  Description of Artificial Sequence: Synthetic polypeptide
MEEEIRTTNPVATEQYGSVSTLNLQERFGSNER

SEQ ID NO: 24472 - protein, 30 aa, Artificial Sequence
  Description of Artificial Sequence: Synthetic polypeptide
DEEEIRTTNPVATEQYGSVSTMDLQMGEDD

SEQ ID NO: 24473 - protein, 31 aa, Artificial Sequence
  Description of Artificial Sequence: Synthetic polypeptide
DEEEIRTTNPVATEQYGCVSTELHQRGSERV

SEQ ID NO: 24474 - protein, 29 aa, Artificial Sequence
  Description of Artificial Sequence: Synthetic peptide
DEEEIRTTNPDATEGYGSCSTNLARGNAY

SEQ ID NO: 24475 - protein, 30 aa, Artificial Sequence
  Description of Artificial Sequence: Synthetic polypeptide
DEEEIRTTNPVATEQYGCVSTELERSGNQY

SEQ ID NO: 24476 - protein, 30 aa, Artificial Sequence
  Description of Artificial Sequence: Synthetic polypeptide
DEEEIRTTNPVATEQYGCVSTELERGSNND

SEQ ID NO: 24477 - protein, 30 aa, Artificial Sequence
  Description of Artificial Sequence: Synthetic polypeptide
DEEEIRTTNPVATEQYGSVSINQDDRGNID

SEQ ID NO: 24478 - protein, 29 aa, Artificial Sequence
  Description of Artificial Sequence: Synthetic peptide
DEEEIRTTNPDATEGYGSCSGTNLARGNP

SEQ ID NO: 24479 - protein, 30 aa, Artificial Sequence
  Description of Artificial Sequence: Synthetic polypeptide
AEEEIRTTNPVATEQYGSVSTVNNNQFGNM

SEQ ID NO: 24480 - protein, 28 aa, Artificial Sequence
  Description of Artificial Sequence: Synthetic peptide
DEEEIRTTNPDATEGYGSCSTNLAAGND

SEQ ID NO: 24481 - protein, 29 aa, Artificial Sequence
  Description of Artificial Sequence: Synthetic peptide
DEEEIRTTNPDATEGYGSCSTNLARGENW

SEQ ID NO: 24482 - protein, 28 aa, Artificial Sequence
  Description of Artificial Sequence: Synthetic peptide
SEEEIDCTNPIATEQYGSVSENLMRGNR

SEQ ID NO: 24483 - protein, 28 aa, Artificial Sequence
  Description of Artificial Sequence: Synthetic peptide
DEEEIRCTNPVCTEQYGNVSTNLERGDM

SEQ ID NO: 24484 - protein, 32 aa, Artificial Sequence
  Description of Artificial Sequence: Synthetic polypeptide
MEEEIRTTNPVATEQYGSVNTSNLNQRGTNNR

SEQ ID NO: 24485 - protein, 32 aa, Artificial Sequence
  Description of Artificial Sequence: Synthetic polypeptide
MEEEIRTTNPVATEQYGSVNTMNLPQRGENYR

SEQ ID NO: 24486 - protein, 32 aa, Artificial Sequence
  Description of Artificial Sequence: Synthetic polypeptide
MEEEIRTTNPVATEQYGSVNTGNLMQRGENYR

SEQ ID NO: 24487 - protein, 31 aa, Artificial Sequence
  Description of Artificial Sequence: Synthetic polypeptide
MEEEIRTTNPVATEQYGSVNGSTNLQAGNAN

SEQ ID NO: 24488 - protein, 28 aa, Artificial Sequence
  Description of Artificial Sequence: Synthetic peptide
SEEEICTTNPVAYEPYGSVATNLQRGNE

SEQ ID NO: 24489 - protein, 28 aa, Artificial Sequence
  Description of Artificial Sequence: Synthetic peptide
SEEEIQCTNPIATEQYGSVSENLGRGNR

SEQ ID NO: 24490 - protein, 30 aa, Artificial Sequence
  Description of Artificial Sequence: Synthetic polypeptide
DEEEIRTTNPVATEQYGSVSTLTQNGNEFN

SEQ ID NO: 24491 - protein, 28 aa, Artificial Sequence
  Description of Artificial Sequence: Synthetic peptide
SEEEIQCTNPIATEQYGSVSENLMRGNR

SEQ ID NO: 24492 - protein, 28 aa, Artificial Sequence
  Description of Artificial Sequence: Synthetic peptide
DEEEIRTTNPDATEPYGSVATNQGRGNA

SEQ ID NO: 24493 - protein, 28 aa, Artificial Sequence
  Description of Artificial Sequence: Synthetic peptide
SEEEIRATNPIATEPYGSVSENLMRGNR

SEQ ID NO: 24494 - protein, 29 aa, Artificial Sequence
  Description of Artificial Sequence: Synthetic peptide
SEEEIRATNPIATEQYGSVSEGNLMRGNR

SEQ ID NO: 24495 - protein, 28 aa, Artificial Sequence
  Description of Artificial Sequence: Synthetic peptide
SEEEIRATNPTATEQYGSVSVNLMRGNI

SEQ ID NO: 24496 - protein, 29 aa, Artificial Sequence
  Description of Artificial Sequence: Synthetic peptide
MEEEIKTTNPVATEQYGNVSVTMLQHGNR

SEQ ID NO: 24497 - protein, 28 aa, Artificial Sequence
  Description of Artificial Sequence: Synthetic peptide
SEEEIRATNPVATEGYGVVSTNLQQGNI

SEQ ID NO: 24498 - protein, 31 aa, Artificial Sequence
  Description of Artificial Sequence: Synthetic polypeptide
DEEEIRTTNPVATEQYGSVSTLPNALQEDND

SEQ ID NO: 24499 - protein, 28 aa, Artificial Sequence
  Description of Artificial Sequence: Synthetic peptide
DEEEIRCTNPVATEQYGTVSMDLMQGNR

SEQ ID NO: 24500 - protein, 30 aa, Artificial Sequence
  Description of Artificial Sequence: Synthetic polypeptide
AEEEIRTTNPVATEQYGSVSTVNNEGAGNR

SEQ ID NO: 24501 - protein, 31 aa, Artificial Sequence
  Description of Artificial Sequence: Synthetic polypeptide
DEEEIRTTNPVATEQYGSVSTNLQEIEGEDF

SEQ ID NO: 24502 - protein, 29 aa, Artificial Sequence
  Description of Artificial Sequence: Synthetic peptide
MEEEIHTTNPVATEQYGNVSYTMLQNGNR

SEQ ID NO: 24503 - protein, 29 aa, Artificial Sequence
  Description of Artificial Sequence: Synthetic peptide
MEEEIHTTNPVATEQYGNVSVNDLQGGNR

SEQ ID NO: 24504 - protein, 29 aa, Artificial Sequence
  Description of Artificial Sequence: Synthetic peptide
SEEEIRATNPCATEQYGSVSTENLMVGNR

SEQ ID NO: 24505 - protein, 31 aa, Artificial Sequence
  Description of Artificial Sequence: Synthetic polypeptide
MEEEIGTTNPVATEQYGSVSTNDLQERMGNL

SEQ ID NO: 24506 - protein, 31 aa, Artificial Sequence
  Description of Artificial Sequence: Synthetic polypeptide
DEEEIRTTNPVATEQYGSVSTNLQEMELNVD

SEQ ID NO: 24507 - protein, 32 aa, Artificial Sequence
  Description of Artificial Sequence: Synthetic polypeptide
DEEEIRTTNPVATEQYGQVSYTNLSQRTVGNP

SEQ ID NO: 24508 - protein, 29 aa, Artificial Sequence
  Description of Artificial Sequence: Synthetic peptide
MEEEIGTTNPVATEQYGLVSVTELQGGNR

SEQ ID NO: 24509 - protein, 31 aa, Artificial Sequence
  Description of Artificial Sequence: Synthetic polypeptide
DEEEIRTTNPVATEQYGSVSTNLQENFGDFS

SEQ ID NO: 24510 - protein, 30 aa, Artificial Sequence
  Description of Artificial Sequence: Synthetic polypeptide
DEEEIRTTNPDATEQYGSVIGTILQRGNEQ

SEQ ID NO: 24511 - protein, 31 aa, Artificial Sequence
  Description of Artificial Sequence: Synthetic polypeptide
AEEEIRTTNPVATEQYGSVSTVNLQVGVNNT

SEQ ID NO: 24512 - protein, 29 aa, Artificial Sequence
  Description of Artificial Sequence: Synthetic peptide
AEEEIRTTNPVATEQYGSVSTVNLQTIMG

SEQ ID NO: 24513 - protein, 29 aa, Artificial Sequence
  Description of Artificial Sequence: Synthetic peptide
MEEEICTTNPVATEQYGNVSVTWLQGGNR

SEQ ID NO: 24514 - protein, 30 aa, Artificial Sequence
  Description of Artificial Sequence: Synthetic polypeptide
DEEEIRTTNPDATEQYGSVSETNEQRKEDR

SEQ ID NO: 24515 - protein, 29 aa, Artificial Sequence
  Description of Artificial Sequence: Synthetic peptide
MEEEICTTNPVATEQYGNVSMTMLQGGNR

SEQ ID NO: 24516 - protein, 30 aa, Artificial Sequence
  Description of Artificial Sequence: Synthetic polypeptide
AEEEIRTTNPVATEQYGSVSTVNLQTGIGV

SEQ ID NO: 24517 - protein, 30 aa, Artificial Sequence
  Description of Artificial Sequence: Synthetic polypeptide
DEEEIRCTNPVATEQYGSVSWNEDRGSNNR

SEQ ID NO: 24518 - protein, 29 aa, Artificial Sequence
  Description of Artificial Sequence: Synthetic peptide
SEEEIRATNPVATEQWGSVATNDQRGNDR

SEQ ID NO: 24519 - protein, 29 aa, Artificial Sequence
  Description of Artificial Sequence: Synthetic peptide
MEEEIKTTNPVATEQYGVVSVTMLQGGNR

SEQ ID NO: 24520 - protein, 29 aa, Artificial Sequence
  Description of Artificial Sequence: Synthetic peptide
SEEEIRATNPCATEQYGSVSTENLIRGNM

SEQ ID NO: 24521 - protein, 32 aa, Artificial Sequence
  Description of Artificial Sequence: Synthetic polypeptide
DEEEIRTTNPVATEQYGSVSTNLQEGGGNEEI

SEQ ID NO: 24522 - protein, 31 aa, Artificial Sequence
  Description of Artificial Sequence: Synthetic polypeptide
DEEEIRTTNPVATEQYGQVSTNLSQRTVTNE

SEQ ID NO: 24523 - protein, 31 aa, Artificial Sequence
  Description of Artificial Sequence: Synthetic polypeptide
DEEEIRTTNPVATEQYGSVSTNLQDVTNNFQ

SEQ ID NO: 24524 - protein, 28 aa, Artificial Sequence
  Description of Artificial Sequence: Synthetic peptide
MEEEIRSTNPCATEQYGSVSENLMPGNR

SEQ ID NO: 24525 - protein, 28 aa, Artificial Sequence
  Description of Artificial Sequence: Synthetic peptide
SEEEIRATNPAATEQYGSVSENLMRSNR

SEQ ID NO: 24526 - protein, 28 aa, Artificial Sequence
  Description of Artificial Sequence: Synthetic peptide
DEEEIRTTNPDATEGYGSCSTNLTRTNP

SEQ ID NO: 24527 - protein, 31 aa, Artificial Sequence
  Description of Artificial Sequence: Synthetic polypeptide
DEEEIRTTNPVATEQYGSVSISNLQEMGIND

SEQ ID NO: 24528 - protein, 28 aa, Artificial Sequence
  Description of Artificial Sequence: Synthetic peptide
MEEEIRCTNPIATEQYGSVSENLNRGNN

SEQ ID NO: 24529 - protein, 28 aa, Artificial Sequence
  Description of Artificial Sequence: Synthetic peptide
SEEEIRATNPCATEQYGSVSENLLRGNN

SEQ ID NO: 24530 - protein, 28 aa, Artificial Sequence
  Description of Artificial Sequence: Synthetic peptide
MEEEIRCTNPIATEQYGSVSENLMIGNR

SEQ ID NO: 24531 - protein, 29 aa, Artificial Sequence
  Description of Artificial Sequence: Synthetic peptide
DEEEIRTTNPVATEQYGSVSTLSETIGDR

SEQ ID NO: 24532 - protein, 28 aa, Artificial Sequence
  Description of Artificial Sequence: Synthetic peptide
DEEEIRTTNPVATEQYGCVSTEIQSGED

SEQ ID NO: 24533 - protein, 29 aa, Artificial Sequence
  Description of Artificial Sequence: Synthetic peptide
MEEEINTTNPVATEQYGNVSVTSLQGGNR

SEQ ID NO: 24534 - protein, 29 aa, Artificial Sequence
  Description of Artificial Sequence: Synthetic peptide
MEEEINTTNPVATEQYGNVSVTMLQNGNR

SEQ ID NO: 24535 - protein, 29 aa, Artificial Sequence
  Description of Artificial Sequence: Synthetic peptide
MEEEIMTTNPVATEQYGTVSVTWLQGGNR

SEQ ID NO: 24536 - protein, 29 aa, Artificial Sequence
  Description of Artificial Sequence: Synthetic peptide
MEEEIMTTNPVATEQYGTVSVTILQGGNR

SEQ ID NO: 24537 - protein, 29 aa, Artificial Sequence
  Description of Artificial Sequence: Synthetic peptide
MEEEIMTTNPVATEQYGNVSYTVLQGGNR

SEQ ID NO: 24538 - protein, 31 aa, Artificial Sequence
  Description of Artificial Sequence: Synthetic polypeptide
DEEEIRTTNPVATEQYGSVSTLPNQQQEDNR

SEQ ID NO: 24539 - protein, 31 aa, Artificial Sequence
  Description of Artificial Sequence: Synthetic polypeptide
DEEEIRCTNPVATEQYGWVSMTNLFQGGSNR

SEQ ID NO: 24540 - protein, 29 aa, Artificial Sequence
  Description of Artificial Sequence: Synthetic peptide
MEEEIMTTNPVATEQYGNVSVTMLQGGNR

SEQ ID NO: 24541 - protein, 28 aa, Artificial Sequence
  Description of Artificial Sequence: Synthetic peptide
DEEEIRTTNPVATEQYGCVSTEHQYGDV

SEQ ID NO: 24542 - protein, 32 aa, Artificial Sequence
  Description of Artificial Sequence: Synthetic polypeptide
DEEEIRTTNPVATEQYGSVSTLPNQLQQGDNS

SEQ ID NO: 24543 - protein, 28 aa, Artificial Sequence
  Description of Artificial Sequence: Synthetic peptide
SEEEIRATNPCATEQYGSVSENLNLGNR

SEQ ID NO: 24544 - protein, 29 aa, Artificial Sequence
  Description of Artificial Sequence: Synthetic peptide
AEEEIRTTNPVATEQYGVVSTYLANGNRL

SEQ ID NO: 24545 - protein, 30 aa, Artificial Sequence
  Description of Artificial Sequence: Synthetic polypeptide
DEEEIRCTNPVATEQYGVVSMTNLFQGINR

SEQ ID NO: 24546 - protein, 29 aa, Artificial Sequence
  Description of Artificial Sequence: Synthetic peptide
MEEEIMTTNPVATEQYGNVSTTMLQGGNR

SEQ ID NO: 24547 - protein, 28 aa, Artificial Sequence
  Description of Artificial Sequence: Synthetic peptide
SEEEIRATNPCATEQYGSVSEPLMRGNR

SEQ ID NO: 24548 - protein, 29 aa, Artificial Sequence
  Description of Artificial Sequence: Synthetic peptide
MEEEIMTTNPVATEQYGEVSVTLLQGGNR

SEQ ID NO: 24549 - protein, 28 aa, Artificial Sequence
  Description of Artificial Sequence: Synthetic peptide
SEEEIATTNPVATEQYGSVATGLQNGMR

SEQ ID NO: 24550 - protein, 29 aa, Artificial Sequence
  Description of Artificial Sequence: Synthetic peptide
AEEEIRTTNPVATEQYGVVSTNLQAGIQE

SEQ ID NO: 24551 - protein, 32 aa, Artificial Sequence
  Description of Artificial Sequence: Synthetic polypeptide
DEEEIRTTNPVATEQYGSVSIELLQRGNVARN

SEQ ID NO: 24552 - protein, 31 aa, Artificial Sequence
  Description of Artificial Sequence: Synthetic polypeptide
DEEEIRTTNPVATEQYGSVSTNLNQYSGSDQ

SEQ ID NO: 24553 - protein, 28 aa, Artificial Sequence
  Description of Artificial Sequence: Synthetic peptide
NEEEIRTTNPVAYEQYGSISTHLQRQPR

SEQ ID NO: 24554 - protein, 31 aa, Artificial Sequence
  Description of Artificial Sequence: Synthetic polypeptide
DEEEIRTTNPVATEQYGSVSGTQNVQVGNSG

SEQ ID NO: 24555 - protein, 32 aa, Artificial Sequence
  Description of Artificial Sequence: Synthetic polypeptide
DEEEIRTTNPVATEQYGNSVSDTWLYQRDQNR

SEQ ID NO: 24556 - protein, 31 aa, Artificial Sequence
  Description of Artificial Sequence: Synthetic polypeptide
DEEEIRTTNPVATEQYGSVSGTSNDQDGGNI

SEQ ID NO: 24557 - protein, 28 aa, Artificial Sequence
  Description of Artificial Sequence: Synthetic peptide
SEAEIRATNPVATEQYGSVCTNLQHGNA

SEQ ID NO: 24558 - protein, 28 aa, Artificial Sequence
  Description of Artificial Sequence: Synthetic peptide
SEAEIRATNPVATEQYGSVETNLQHGNA

SEQ ID NO: 24559 - protein, 28 aa, Artificial Sequence
  Description of Artificial Sequence: Synthetic peptide
DEEEIRTTNPCATEQYGSVVTWLARGEE

SEQ ID NO: 24560 - protein, 28 aa, Artificial Sequence
  Description of Artificial Sequence: Synthetic peptide
SEAEIRATNPVATEQYGSVVTNLQAGNN

SEQ ID NO: 24561 - protein, 30 aa, Artificial Sequence
  Description of Artificial Sequence: Synthetic polypeptide
DEEEIRTTNPCATEQYGSVVVTNLQMGNEA

SEQ ID NO: 24562 - protein, 29 aa, Artificial Sequence
  Description of Artificial Sequence: Synthetic peptide
DEEEIRTTNPVATEQYGCVSTNNDRIMNQ

SEQ ID NO: 24563 - protein, 31 aa, Artificial Sequence
  Description of Artificial Sequence: Synthetic polypeptide
DEEEIRTTNPVATEQYGSVSTMNGIQNEGND

SEQ ID NO: 24564 - protein, 32 aa, Artificial Sequence
  Description of Artificial Sequence: Synthetic polypeptide
DEEEIRTTNPVATEQYGSVSGTSNLQDGGNQS

SEQ ID NO: 24565 - protein, 28 aa, Artificial Sequence
  Description of Artificial Sequence: Synthetic peptide
DEEEIRTTNPCATEQYGSVVTALARGEE

SEQ ID NO: 24566 - protein, 31 aa, Artificial Sequence
  Description of Artificial Sequence: Synthetic polypeptide
DEEEIRTTNPVATEQYGSVSTMNGIQDGNDD

SEQ ID NO: 24567 - protein, 28 aa, Artificial Sequence
  Description of Artificial Sequence: Synthetic peptide
SEAEIRCTNPIATEQYGSVSENLVRGNR

SEQ ID NO: 24568 - protein, 31 aa, Artificial Sequence
  Description of Artificial Sequence: Synthetic polypeptide
DEEEIRTTNPVATEQYGSVSTNLFRGEEMDI

SEQ ID NO: 24569 - protein, 31 aa, Artificial Sequence
  Description of Artificial Sequence: Synthetic polypeptide
DEEEIRSTNPVATEQYGEVSMTNLFQGFGNR

SEQ ID NO: 24570 - protein, 28 aa, Artificial Sequence
  Description of Artificial Sequence: Synthetic peptide
SEAEIRQTNPVATEQYGSVATNLQHGNQ

SEQ ID NO: 24571 - protein, 28 aa, Artificial Sequence
  Description of Artificial Sequence: Synthetic peptide
SEAEIRSTNPVATEQYGSVGTNLQHGNQ

SEQ ID NO: 24572 - protein, 32 aa, Artificial Sequence
  Description of Artificial Sequence: Synthetic polypeptide
NEEEIRTTNPVATEQYGSVVTSNLQQRGENYR

SEQ ID NO: 24573 - protein, 31 aa, Artificial Sequence
  Description of Artificial Sequence: Synthetic polypeptide
DEEEIRTTNPVATEQYGSVSGTSNMQDEGNS

SEQ ID NO: 24574 - protein, 32 aa, Artificial Sequence
  Description of Artificial Sequence: Synthetic polypeptide
DEEEIRTTNPVATEQYGSVSGTSNTLQGPGNG

SEQ ID NO: 24575 - protein, 31 aa, Artificial Sequence
  Description of Artificial Sequence: Synthetic polypeptide
DEEEIRTTNPVATEQYGNTISTAELQRGENR

SEQ ID NO: 24576 - protein, 32 aa, Artificial Sequence
  Description of Artificial Sequence: Synthetic polypeptide
NEEEIRTTNPVATEQYGSVSTSNLTQRGENND

SEQ ID NO: 24577 - protein, 31 aa, Artificial Sequence
  Description of Artificial Sequence: Synthetic polypeptide
NEEEIRTTNPVATEQYGSVSTPLSQAGGNRE

SEQ ID NO: 24578 - protein, 30 aa, Artificial Sequence
  Description of Artificial Sequence: Synthetic polypeptide
DEEEIRTTNPVATEQYGNTTSTNELQNGNN

SEQ ID NO: 24579 - protein, 28 aa, Artificial Sequence
  Description of Artificial Sequence: Synthetic peptide
SEAEIRCTNPIATEQYGSVSENLMRGNR

SEQ ID NO: 24580 - protein, 29 aa, Artificial Sequence
  Description of Artificial Sequence: Synthetic peptide
DEEEIRTTNPVATEQYGNVATNLQRPEDG

SEQ ID NO: 24581 - protein, 32 aa, Artificial Sequence
  Description of Artificial Sequence: Synthetic polypeptide
DEEEIRTTNPVATEQYGSVSGTNVLQEAGNTI

SEQ ID NO: 24582 - protein, 32 aa, Artificial Sequence
  Description of Artificial Sequence: Synthetic polypeptide
DEEEIRTTNPVATEQYGSVSTNLFQEGNGNGE

SEQ ID NO: 24583 - protein, 31 aa, Artificial Sequence
  Description of Artificial Sequence: Synthetic polypeptide
DEEEIRTTNPVATEQYGSVSTNLFEHGSNAS

SEQ ID NO: 24584 - protein, 29 aa, Artificial Sequence
  Description of Artificial Sequence: Synthetic peptide
SDEEIRTTNPVATEQWGTVSTNLQFEGNR

SEQ ID NO: 24585 - protein, 30 aa, Artificial Sequence
  Description of Artificial Sequence: Synthetic polypeptide
SDEEIRTTNPVATEQYGCVCSTNLQRGNQA

SEQ ID NO: 24586 - protein, 29 aa, Artificial Sequence
  Description of Artificial Sequence: Synthetic peptide
DEEEIRTTNPCATEQYGSVSYPNIDRGND

SEQ ID NO: 24587 - protein, 28 aa, Artificial Sequence
  Description of Artificial Sequence: Synthetic peptide
NENEIRTTNPVAYEQYGSVNTNLQIGSR

SEQ ID NO: 24588 - protein, 32 aa, Artificial Sequence
  Description of Artificial Sequence: Synthetic polypeptide
DEEEIRTTNPCATEQYGSVSYTNHSQRVGDNR

SEQ ID NO: 24589 - protein, 31 aa, Artificial Sequence
  Description of Artificial Sequence: Synthetic polypeptide
DEEEIRTTNPVATEQYGSVSTMNGNQNNGNM

SEQ ID NO: 24590 - protein, 30 aa, Artificial Sequence
  Description of Artificial Sequence: Synthetic polypeptide
DEEEIRTTNPCATEQYGSVTATDLQRGNID

SEQ ID NO: 24591 - protein, 31 aa, Artificial Sequence
  Description of Artificial Sequence: Synthetic polypeptide
DEEEIRTTNPVATEQYGMVSTSNLQGGTNVG

SEQ ID NO: 24592 - protein, 31 aa, Artificial Sequence
  Description of Artificial Sequence: Synthetic polypeptide
DEEEIRTTNPVATEQYGSVSTNLFEVGGNGQ

SEQ ID NO: 24593 - protein, 28 aa, Artificial Sequence
  Description of Artificial Sequence: Synthetic peptide
NEMEIRTTNPVATEQYGSVWTNLQESSR

SEQ ID NO: 24594 - protein, 32 aa, Artificial Sequence
  Description of Artificial Sequence: Synthetic polypeptide
DEEEIRSTNPVATEQYGSVCSTGNLQHFGSNR

SEQ ID NO: 24595 - protein, 31 aa, Artificial Sequence
  Description of Artificial Sequence: Synthetic polypeptide
DEEEIRTTNPVATEQYGSVSTNLFQGIGGTQ

SEQ ID NO: 24596 - protein, 30 aa, Artificial Sequence
  Description of Artificial Sequence: Synthetic polypeptide
DEEEIRTTNPVATEQYGSVSGTNQNNGNGQ

SEQ ID NO: 24597 - protein, 31 aa, Artificial Sequence
  Description of Artificial Sequence: Synthetic polypeptide
DEEEIRTTNPVATEQYGSVSGTNQQGIGNIS

SEQ ID NO: 24598 - protein, 30 aa, Artificial Sequence
  Description of Artificial Sequence: Synthetic polypeptide
DEEEIRTTNPCATEQYGSVTVTNLQAGNMA

SEQ ID NO: 24599 - protein, 30 aa, Artificial Sequence
  Description of Artificial Sequence: Synthetic polypeptide
DEEEIRTTNPCATEQYGSVTVTNLQQGNGM

SEQ ID NO: 24600 - protein, 29 aa, Artificial Sequence
  Description of Artificial Sequence: Synthetic peptide
NEGEIRTTNPVATEQYGSVVTNLQIGGSR

SEQ ID NO: 24601 - protein, 31 aa, Artificial Sequence
  Description of Artificial Sequence: Synthetic polypeptide
DEEEIRTTNPVATEQYGSVSGTNTQDNGNNG

SEQ ID NO: 24602 - protein, 31 aa, Artificial Sequence
  Description of Artificial Sequence: Synthetic polypeptide
NEEEVRTTNPVATEQYGSVSTWNLDARIGNR

SEQ ID NO: 24603 - protein, 28 aa, Artificial Sequence
  Description of Artificial Sequence: Synthetic peptide
SEAEIATTNPVATEPYGEVSTNLQGGNR

SEQ ID NO: 24604 - protein, 31 aa, Artificial Sequence
  Description of Artificial Sequence: Synthetic polypeptide
DEEEIRTTNPCATEQYGSVVATNLQERGNVA

SEQ ID NO: 24605 - protein, 28 aa, Artificial Sequence
  Description of Artificial Sequence: Synthetic peptide
NEEEIVCTNPIATEQYGSVSENLMRGNR

SEQ ID NO: 24606 - protein, 30 aa, Artificial Sequence
  Description of Artificial Sequence: Synthetic polypeptide
NEEEISTTNPVATEQYGSVATNLQAGNSRE

SEQ ID NO: 24607 - protein, 29 aa, Artificial Sequence
  Description of Artificial Sequence: Synthetic peptide
NEEEIRYTNPVATEQYGQVSTNLQQRGTI

SEQ ID NO: 24608 - protein, 32 aa, Artificial Sequence
  Description of Artificial Sequence: Synthetic polypeptide
DEEEIRTTNPVATEQYGSVSTMNGLEQMGNTI

SEQ ID NO: 24609 - protein, 31 aa, Artificial Sequence
  Description of Artificial Sequence: Synthetic polypeptide
DEEEIRTTNPVATEQYGSVSTNLFLEFSGNG

SEQ ID NO: 24610 - protein, 29 aa, Artificial Sequence
  Description of Artificial Sequence: Synthetic peptide
NEQEIRTTNPVATEQYGSVWTNLQIGSSR

SEQ ID NO: 24611 - protein, 31 aa, Artificial Sequence
  Description of Artificial Sequence: Synthetic polypeptide
NEEEIRTTNPVATEQYGSVSTNLQRNANFYE

SEQ ID NO: 24612 - protein, 32 aa, Artificial Sequence
  Description of Artificial Sequence: Synthetic polypeptide
DEECIRTTNPVATEQYGESVSINLQREGDNER

SEQ ID NO: 24613 - protein, 31 aa, Artificial Sequence
  Description of Artificial Sequence: Synthetic polypeptide
DEEEIRTTNPVATEQYGCVSTNLTQENINRP

SEQ ID NO: 24614 - protein, 31 aa, Artificial Sequence
  Description of Artificial Sequence: Synthetic polypeptide
DEEEIRTTNPVATEQYGCVSTNLSQNTVTNR

SEQ ID NO: 24615 - protein, 28 aa, Artificial Sequence
  Description of Artificial Sequence: Synthetic peptide
DEECIRTTNPVATEQYGCVSTNPQFGEA

SEQ ID NO: 24616 - protein, 30 aa, Artificial Sequence
  Description of Artificial Sequence: Synthetic polypeptide
NEEEIRTTNPVATEQYGSVSAVNLVEFGNR

SEQ ID NO: 24617 - protein, 28 aa, Artificial Sequence
  Description of Artificial Sequence: Synthetic peptide
SEECICTTNPVATEQYGSVSSNHQRGNI

SEQ ID NO: 24618 - protein, 28 aa, Artificial Sequence
  Description of Artificial Sequence: Synthetic peptide
SEECIRCTNPIATEQYGSVSENLMRGNR

SEQ ID NO: 24619 - protein, 32 aa, Artificial Sequence
  Description of Artificial Sequence: Synthetic polypeptide
DEEEIRTTNPVATEQYGSVSTMNDLDQNGNNQ

SEQ ID NO: 24620 - protein, 30 aa, Artificial Sequence
  Description of Artificial Sequence: Synthetic polypeptide
NEEEIRTTNPVATEQYGSVSAMNLDEKGNR

SEQ ID NO: 24621 - protein, 28 aa, Artificial Sequence
  Description of Artificial Sequence: Synthetic peptide
DEEEIRTTNPCATEQYGVVSTELDRGPQ

SEQ ID NO: 24622 - protein, 30 aa, Artificial Sequence
  Description of Artificial Sequence: Synthetic polypeptide
NEEEIRTTNPVATEQYGSVSAINLIEVGNR

SEQ ID NO: 24623 - protein, 30 aa, Artificial Sequence
  Description of Artificial Sequence: Synthetic polypeptide
NEEEIRTTNPVATEQYGSVSAGNLIEHGNR

SEQ ID NO: 24624 - protein, 31 aa, Artificial Sequence
  Description of Artificial Sequence: Synthetic polypeptide
DEEEIRTTNPVATEQYGSVSTNLGVEGSQER

SEQ ID NO: 24625 - protein, 30 aa, Artificial Sequence
  Description of Artificial Sequence: Synthetic polypeptide
DEEEIRTTNPVATEQYGNVSTNLPVGENQA

SEQ ID NO: 24626 - protein, 28 aa, Artificial Sequence
  Description of Artificial Sequence: Synthetic peptide
SEEDIRCTNPIATEQYGSVSENLMRGNR

SEQ ID NO: 24627 - protein, 28 aa, Artificial Sequence
  Description of Artificial Sequence: Synthetic peptide
SEEEIACTNPCATEQYGSVSENLMRGNR

SEQ ID NO: 24628 - protein, 31 aa, Artificial Sequence
  Description of Artificial Sequence: Synthetic polypeptide
DEEEIRTTNPVATEQYGCVSTNLQSGGENIQ

SEQ ID NO: 24629 - protein, 32 aa, Artificial Sequence
  Description of Artificial Sequence: Synthetic polypeptide
DEEEIRTTNPVATEQYGSVSTNLHERGGIDND

SEQ ID NO: 24630 - protein, 31 aa, Artificial Sequence
  Description of Artificial Sequence: Synthetic polypeptide
DEEEIRTTNPVATEQYGCVSTNLQRFMSNFD

SEQ ID NO: 24631 - protein, 30 aa, Artificial Sequence
  Description of Artificial Sequence: Synthetic polypeptide
NEEEIRTTNPVATEQYGSVSAENLDEDGNR

SEQ ID NO: 24632 - protein, 32 aa, Artificial Sequence
  Description of Artificial Sequence: Synthetic polypeptide
DEEEIRTTNPVATEQYGCVSTNLQRFMSNDRE

SEQ ID NO: 24633 - protein, 30 aa, Artificial Sequence
  Description of Artificial Sequence: Synthetic polypeptide
NEEEIRTTNPVATEQYGSVSADNLEENGNR

SEQ ID NO: 24634 - protein, 31 aa, Artificial Sequence
  Description of Artificial Sequence: Synthetic polypeptide
DEEEIRTTNPVATEQYGCVSTNLQRFMSEPR

SEQ ID NO: 24635 - protein, 31 aa, Artificial Sequence
  Description of Artificial Sequence: Synthetic polypeptide
DEEEIRTTNPVATEQYGCVSTNLQPRESNDD

SEQ ID NO: 24636 - protein, 32 aa, Artificial Sequence
  Description of Artificial Sequence: Synthetic polypeptide
NEEEIRTTNPVATEQYGSVNTSNLYQRGENYR

SEQ ID NO: 24637 - protein, 32 aa, Artificial Sequence
  Description of Artificial Sequence: Synthetic polypeptide
NEEEIRTTNPVATEQYGSVNTSNLMQRGENDR

SEQ ID NO: 24638 - protein, 32 aa, Artificial Sequence
  Description of Artificial Sequence: Synthetic polypeptide
NEEEIRTTNPVATEQYGSVNTLNLDQRGENTR

SEQ ID NO: 24639 - protein, 29 aa, Artificial Sequence
  Description of Artificial Sequence: Synthetic peptide
SEEDIRTTNPVATEIYGQVTTNLQRGSNR

SEQ ID NO: 24640 - protein, 28 aa, Artificial Sequence
  Description of Artificial Sequence: Synthetic peptide
SECEIRCTNPIATEQYGSVSENLMRGNR

SEQ ID NO: 24641 - protein, 29 aa, Artificial Sequence
  Description of Artificial Sequence: Synthetic peptide
DEECIRTTNPVATEQYGCVSTNSQFGNND

SEQ ID NO: 24642 - protein, 30 aa, Artificial Sequence
  Description of Artificial Sequence: Synthetic polypeptide
NEEEIRTTNPVATEQYGSVSAWNLNNFGNR

SEQ ID NO: 24643 - protein, 28 aa, Artificial Sequence
  Description of Artificial Sequence: Synthetic peptide
SEDEIRATNPVATEQYGSVVTNLQSGNQ

SEQ ID NO: 24644 - protein, 30 aa, Artificial Sequence
  Description of Artificial Sequence: Synthetic polypeptide
NEEEIRTTNPVATEQYGSVSTNEQDRSGLD

SEQ ID NO: 24645 - protein, 32 aa, Artificial Sequence
  Description of Artificial Sequence: Synthetic polypeptide
DEEEIRTTNPVATEQYGNVCETNLDQERGSNR

SEQ ID NO: 24646 - protein, 28 aa, Artificial Sequence
  Description of Artificial Sequence: Synthetic peptide
SEDEIRCTNPAATEQYGSVSENLMRGNR

SEQ ID NO: 24647 - protein, 32 aa, Artificial Sequence
  Description of Artificial Sequence: Synthetic polypeptide
NEEEIRTTNPVATEQYGSVSTMNLTQRGENYG

SEQ ID NO: 24648 - protein, 29 aa, Artificial Sequence
  Description of Artificial Sequence: Synthetic peptide
DEEEIRTTNPVATEQYGCVSTNMQPINSQ

SEQ ID NO: 24649 - protein, 28 aa, Artificial Sequence
  Description of Artificial Sequence: Synthetic peptide
SEDEIRCTNPIATEQYGSVSENLMRGNR

SEQ ID NO: 24650 - protein, 30 aa, Artificial Sequence
  Description of Artificial Sequence: Synthetic polypeptide
NEEEIRTTNPVATEQYGSVSSWNLVEFGNR

SEQ ID NO: 24651 - protein, 30 aa, Artificial Sequence
  Description of Artificial Sequence: Synthetic polypeptide
DEEEIRTTNPVATEQYGSVSTMNDQIINEE

SEQ ID NO: 24652 - protein, 30 aa, Artificial Sequence
  Description of Artificial Sequence: Synthetic polypeptide
NEEEIRTTNPVATEQYGSVSPWNLPEIGNR

SEQ ID NO: 24653 - protein, 31 aa, Artificial Sequence
  Description of Artificial Sequence: Synthetic polypeptide
DEEEIRTTNPVATEQYGSVSTNLGGNGDNNQ

SEQ ID NO: 24654 - protein, 30 aa, Artificial Sequence
  Description of Artificial Sequence: Synthetic polypeptide
DEECIRTTNPVATEQYGDSISTIELQRGER

SEQ ID NO: 24655 - protein, 30 aa, Artificial Sequence
  Description of Artificial Sequence: Synthetic polypeptide
NEEEIRTTNPVATEQYGSVSAWNLGDFGNR

SEQ ID NO: 24656 - protein, 30 aa, Artificial Sequence
  Description of Artificial Sequence: Synthetic polypeptide
DEEEIRTTNPVATEQYGSVSTNLGNGGEGM

SEQ ID NO: 24657 - protein, 29 aa, Artificial Sequence
  Description of Artificial Sequence: Synthetic peptide
SEDEIRTTNPVATEQYGEVSTNLQGNGNA

SEQ ID NO: 24658 - protein, 29 aa, Artificial Sequence
  Description of Artificial Sequence: Synthetic peptide
SEDEIRTTNPVATEQYGSVATNLQIDGPR

SEQ ID NO: 24659 - protein, 30 aa, Artificial Sequence
  Description of Artificial Sequence: Synthetic polypeptide
NEEEIRTTNPVATEQYGSVSKWNLDGFGNR

SEQ ID NO: 24660 - protein, 30 aa, Artificial Sequence
  Description of Artificial Sequence: Synthetic polypeptide
NEEEIRTTNPVATEQYGSVSINILEEFGNR

SEQ ID NO: 24661 - protein, 30 aa, Artificial Sequence
  Description of Artificial Sequence: Synthetic polypeptide
NEEEIRTTNPVATEQYGSVSGWNLDEKGNR

SEQ ID NO: 24662 - protein, 30 aa, Artificial Sequence
  Description of Artificial Sequence: Synthetic polypeptide
NEEEIRTTNPVATEQYGSVSGVNLDEFGNR

SEQ ID NO: 24663 - protein, 30 aa, Artificial Sequence
  Description of Artificial Sequence: Synthetic polypeptide
NEEEIRTTNPVATEQYGSVSFFNLDEFGNR

SEQ ID NO: 24664 - protein, 30 aa, Artificial Sequence
  Description of Artificial Sequence: Synthetic polypeptide
NEEEIRTTNPVATEQYGSVSEDNLDEFGNR

SEQ ID NO: 24665 - protein, 28 aa, Artificial Sequence
  Description of Artificial Sequence: Synthetic peptide
SEDEIRVTNPVATEQYGSVPTNLQHGNQ

SEQ ID NO: 24666 - protein, 30 aa, Artificial Sequence
  Description of Artificial Sequence: Synthetic polypeptide
DEEEIRTTNPVATEQYGCVSTNLTRGSDEQ

SEQ ID NO: 24667 - protein, 28 aa, Artificial Sequence
  Description of Artificial Sequence: Synthetic peptide
SEEAIRCTNPIATEQYGSVSENLMRGNR

SEQ ID NO: 24668 - protein, 30 aa, Artificial Sequence
  Description of Artificial Sequence: Synthetic polypeptide
NEEEIRTTNPVATEQYGSVSAWNLTEFGNR

SEQ ID NO: 24669 - protein, 31 aa, Artificial Sequence
  Description of Artificial Sequence: Synthetic polypeptide
DEEEIRTTNPVATEQYGSVSGNMQRSGSDRI

SEQ ID NO: 24670 - protein, 28 aa, Artificial Sequence
  Description of Artificial Sequence: Synthetic peptide
DECEICTVNPVATEQYGSVSTNLFEGNS

SEQ ID NO: 24671 - protein, 28 aa, Artificial Sequence
  Description of Artificial Sequence: Synthetic peptide
DECEICTVNPVATEQYGSVSTNLIEGNN

SEQ ID NO: 24672 - protein, 31 aa, Artificial Sequence
  Description of Artificial Sequence: Synthetic polypeptide
DEEEIRTTNPVATEQYGSVSTNLFAHGSNQS

SEQ ID NO: 24673 - protein, 29 aa, Artificial Sequence
  Description of Artificial Sequence: Synthetic peptide
REAEIRTTNPVCTEQYGSVSTNLQCVGND

SEQ ID NO: 24674 - protein, 31 aa, Artificial Sequence
  Description of Artificial Sequence: Synthetic polypeptide
DEEEIRTTNPCATEQYGSVSVTNLQQAGNSA

SEQ ID NO: 24675 - protein, 32 aa, Artificial Sequence
  Description of Artificial Sequence: Synthetic polypeptide
DEEEIRTTNPVATEQYGSVSGTNNLQAGEGNG

SEQ ID NO: 24676 - protein, 29 aa, Artificial Sequence
  Description of Artificial Sequence: Synthetic peptide
NETEIRTTNPVATEQYGSVWTNLQDEGSR

SEQ ID NO: 24677 - protein, 32 aa, Artificial Sequence
  Description of Artificial Sequence: Synthetic polypeptide
DEEEIRTTNPVATEQYGSVSTNLEQAGTNLGF

SEQ ID NO: 24678 - protein, 32 aa, Artificial Sequence
  Description of Artificial Sequence: Synthetic polypeptide
DEEEIRTTNPVATEQYGSVSTMNLDQTEGNNG

SEQ ID NO: 24679 - protein, 32 aa, Artificial Sequence
  Description of Artificial Sequence: Synthetic polypeptide
DEEEIRTTNPVATEQYGSVSTNLEQERFNNNW

SEQ ID NO: 24680 - protein, 30 aa, Artificial Sequence
  Description of Artificial Sequence: Synthetic polypeptide
NETEIRTTNPVATEQYGSVSTNLQHQGNDL

SEQ ID NO: 24681 - protein, 28 aa, Artificial Sequence
  Description of Artificial Sequence: Synthetic peptide
REEEIRCTNPIATEQYGSVPYNLERGNR

SEQ ID NO: 24682 - protein, 28 aa, Artificial Sequence
  Description of Artificial Sequence: Synthetic peptide
REEEIRCTNPIATEQYGSVSENLMRGNQ

SEQ ID NO: 24683 - protein, 32 aa, Artificial Sequence
  Description of Artificial Sequence: Synthetic polypeptide
DEEEIRTTNPVATEQYGSVSTMNLDQSGNQGN

SEQ ID NO: 24684 - protein, 29 aa, Artificial Sequence
  Description of Artificial Sequence: Synthetic peptide
NETEIRTTNPVATEPYGSVSTNLQMGNDE

SEQ ID NO: 24685 - protein, 30 aa, Artificial Sequence
  Description of Artificial Sequence: Synthetic polypeptide
DEEEIRTTNPVATEQYGMVGSTNLQQGEGN

SEQ ID NO: 24686 - protein, 31 aa, Artificial Sequence
  Description of Artificial Sequence: Synthetic polypeptide
DEEEIRTTNPVATEQYGMVSGTNLQGGGNEA

SEQ ID NO: 24687 - protein, 32 aa, Artificial Sequence
  Description of Artificial Sequence: Synthetic polypeptide
DEEEIRTTNPVATEQYGSVSTMNLDQSGNIIV

SEQ ID NO: 24688 - protein, 32 aa, Artificial Sequence
  Description of Artificial Sequence: Synthetic polypeptide
DEEEIRTTNPVATEQYGSVSTMNLDQSGNEDQ

SEQ ID NO: 24689 - protein, 32 aa, Artificial Sequence
  Description of Artificial Sequence: Synthetic polypeptide
DEEEIRTTNPVATEQYGSVSTMNLDQSGGNDD

SEQ ID NO: 24690 - protein, 31 aa, Artificial Sequence
  Description of Artificial Sequence: Synthetic polypeptide
DEEEIRTTNPVATEQYGCVSTNTQHFGSNRP

SEQ ID NO: 24691 - protein, 29 aa, Artificial Sequence
  Description of Artificial Sequence: Synthetic peptide
REEEIRTTNPVATEQYGSVATALQNGEDR

SEQ ID NO: 24692 - protein, 30 aa, Artificial Sequence
  Description of Artificial Sequence: Synthetic polypeptide
DEEEIRTTNPVATEQYGMVSTDLQFGINNQ

SEQ ID NO: 24693 - protein, 29 aa, Artificial Sequence
  Description of Artificial Sequence: Synthetic peptide
REEEIRTTNPVATEQYGSVATALQNGETR

SEQ ID NO: 24694 - protein, 32 aa, Artificial Sequence
  Description of Artificial Sequence: Synthetic polypeptide
DEEEIRTTNPVATEQYGSVSTNLEQMDGFNGQ

SEQ ID NO: 24695 - protein, 32 aa, Artificial Sequence
  Description of Artificial Sequence: Synthetic polypeptide
DEEEIRTTNPVATEQYGSVSTNLEQQFGNEQD

SEQ ID NO: 24696 - protein, 28 aa, Artificial Sequence
  Description of Artificial Sequence: Synthetic peptide
REEEIRTTNPVATEQYGSVETAQQNGER

SEQ ID NO: 24697 - protein, 28 aa, Artificial Sequence
  Description of Artificial Sequence: Synthetic peptide
REEEIRTTNPVATEQYGSVLTGQQNGFR

SEQ ID NO: 24698 - protein, 30 aa, Artificial Sequence
  Description of Artificial Sequence: Synthetic polypeptide
AEEEIRTTNPVATEQYGSVVVTTNLQQQNR

SEQ ID NO: 24699 - protein, 32 aa, Artificial Sequence
  Description of Artificial Sequence: Synthetic polypeptide
DEEEIRTTNPVATEQYGSVSTMNLDQSGNNET

SEQ ID NO: 24700 - protein, 30 aa, Artificial Sequence
  Description of Artificial Sequence: Synthetic polypeptide
DEEEIRTTNPVATEQYGMVSTDNTQNGNID

SEQ ID NO: 24701 - protein, 31 aa, Artificial Sequence
  Description of Artificial Sequence: Synthetic polypeptide
DEEEIRTTNPCATEQYGSVSVTNLQEGTNGA

SEQ ID NO: 24702 - protein, 32 aa, Artificial Sequence
  Description of Artificial Sequence: Synthetic polypeptide
DEEEIRTTNPVATEQYGSVSTNLEQAFGSNQL

SEQ ID NO: 24703 - protein, 30 aa, Artificial Sequence
  Description of Artificial Sequence: Synthetic polypeptide
DEEEIRTTNPVATEQYGSVSTNLEEYNGEF

SEQ ID NO: 24704 - protein, 31 aa, Artificial Sequence
  Description of Artificial Sequence: Synthetic polypeptide
DEEEIRTTNPVATEQYGSVSTNLEGGGGNDQ

SEQ ID NO: 24705 - protein, 32 aa, Artificial Sequence
  Description of Artificial Sequence: Synthetic polypeptide
DEEEIRTTNPVATEQYGSVSTMNLEQEFGNQD

SEQ ID NO: 24706 - protein, 32 aa, Artificial Sequence
  Description of Artificial Sequence: Synthetic polypeptide
DEEEIRTTNPVATEQYGSVSTMNLEQDTGNNG

SEQ ID NO: 24707 - protein, 31 aa, Artificial Sequence
  Description of Artificial Sequence: Synthetic polypeptide
DEEEIRTTNPVATEQYGSVSTNLEGNGINGD

SEQ ID NO: 24708 - protein, 30 aa, Artificial Sequence
  Description of Artificial Sequence: Synthetic polypeptide
NNEEIRTTNPVATEQYGQVSTNLQDSGMNR

SEQ ID NO: 24709 - protein, 30 aa, Artificial Sequence
  Description of Artificial Sequence: Synthetic polypeptide
NNEEIRTTNPVATEQYGNVVSTNLQDGTNR

SEQ ID NO: 24710 - protein, 30 aa, Artificial Sequence
  Description of Artificial Sequence: Synthetic polypeptide
NNEEIRTTNPVATEQYGLVSTNLQDGPNRD

SEQ ID NO: 24711 - protein, 32 aa, Artificial Sequence
  Description of Artificial Sequence: Synthetic polypeptide
DEEEIRTTNPVATEQYGSVSTMNLEQAGTNLP

SEQ ID NO: 24712 - protein, 31 aa, Artificial Sequence
  Description of Artificial Sequence: Synthetic polypeptide
DEEEIRTTNPVATEQYGSVSTMNLEMGQNQD

SEQ ID NO: 24713 - protein, 29 aa, Artificial Sequence
  Description of Artificial Sequence: Synthetic peptide
QETEIRTTNPVATEQYGSISTNLQRDNGF

SEQ ID NO: 24714 - protein, 30 aa, Artificial Sequence
  Description of Artificial Sequence: Synthetic polypeptide
DEEEIRTTNPVATEQYGSVSTNLENFGDAF

SEQ ID NO: 24715 - protein, 29 aa, Artificial Sequence
  Description of Artificial Sequence: Synthetic peptide
QQEEIRTTNPVATEQWGTVSTNLTQEGNR

SEQ ID NO: 24716 - protein, 31 aa, Artificial Sequence
  Description of Artificial Sequence: Synthetic polypeptide
QETEIRTTNPVATEQYGSVSTTLQRDGDNDR

SEQ ID NO: 24717 - protein, 29 aa, Artificial Sequence
  Description of Artificial Sequence: Synthetic peptide
NNEEICTTNPVATEQYGVVSTNLQDGSNR

SEQ ID NO: 24718 - protein, 29 aa, Artificial Sequence
  Description of Artificial Sequence: Synthetic peptide
NNEEIATTNPVATEQYGVVSTNLQGGPNR

SEQ ID NO: 24719 - protein, 30 aa, Artificial Sequence
  Description of Artificial Sequence: Synthetic polypeptide
NMEEIRTTNPVATEQYGVVSTNNLQDGTNR

SEQ ID NO: 24720 - protein, 30 aa, Artificial Sequence
  Description of Artificial Sequence: Synthetic polypeptide
NMEEIRTTNPVATEQYGVVSTNLQDNGSNR

SEQ ID NO: 24721 - protein, 31 aa, Artificial Sequence
  Description of Artificial Sequence: Synthetic polypeptide
DEEEIRTTNPVATEQYGMVGSTNLNQVGGNV

SEQ ID NO: 24722 - protein, 31 aa, Artificial Sequence
  Description of Artificial Sequence: Synthetic polypeptide
DEEEIRTTNPVATEQYGSVSTMNLEEGGNVQ

SEQ ID NO: 24723 - protein, 30 aa, Artificial Sequence
  Description of Artificial Sequence: Synthetic polypeptide
DEEEIRTTNPVATEQYGMVGSTNLQDGGED

SEQ ID NO: 24724 - protein, 29 aa, Artificial Sequence
  Description of Artificial Sequence: Synthetic peptide
NEYEIRTTNPVATEQYGSVWTNLQIGSER

SEQ ID NO: 24725 - protein, 28 aa, Artificial Sequence
  Description of Artificial Sequence: Synthetic peptide
NEYEIRMTNPVATEQYGSVETNLQHGNQ

SEQ ID NO: 24726 - protein, 30 aa, Artificial Sequence
  Description of Artificial Sequence: Synthetic polypeptide
DEEEIRTTNPCATEQYGSVSVTNILQGNDT

SEQ ID NO: 24727 - protein, 28 aa, Artificial Sequence
  Description of Artificial Sequence: Synthetic peptide
NEYEIRCTNPIATEQYGSVSENLMRGNR

SEQ ID NO: 24728 - protein, 29 aa, Artificial Sequence
  Description of Artificial Sequence: Synthetic peptide
NETEIRTTNPVAYEQYGSVSTNLQDGNTM

SEQ ID NO: 24729 - protein, 29 aa, Artificial Sequence
  Description of Artificial Sequence: Synthetic peptide
NNEEIRTTNPVATEQWGCVSTNLQDGPNR

SEQ ID NO: 24730 - protein, 29 aa, Artificial Sequence
  Description of Artificial Sequence: Synthetic peptide
NETEIRTTNPVATEHYGSVSTNLQMGDND

SEQ ID NO: 24731 - protein, 29 aa, Artificial Sequence
  Description of Artificial Sequence: Synthetic peptide
NETEIRTTNPVATEHYGSVSTNLQDGNTD

SEQ ID NO: 24732 - protein, 31 aa, Artificial Sequence
  Description of Artificial Sequence: Synthetic polypeptide
DEEEIRSTNPVATEQYGSVSVNEQDRGGNER

SEQ ID NO: 24733 - protein, 28 aa, Artificial Sequence
  Description of Artificial Sequence: Synthetic peptide
SAEEIRTTNPVATEQWGTVSTNLQEGTR

SEQ ID NO: 24734 - protein, 29 aa, Artificial Sequence
  Description of Artificial Sequence: Synthetic peptide
SAEEIRTTNPVATEQWGTVSTNLQHGNRD

SEQ ID NO: 24735 - protein, 31 aa, Artificial Sequence
  Description of Artificial Sequence: Synthetic polypeptide
DEEEIRTTNPVATEQYGMVSTNLVQEQGNVD

SEQ ID NO: 24736 - protein, 29 aa, Artificial Sequence
  Description of Artificial Sequence: Synthetic peptide
NEREIRTTNPVATEQYGSVWTNLQNGQRA

SEQ ID NO: 24737 - protein, 28 aa, Artificial Sequence
  Description of Artificial Sequence: Synthetic peptide
SCEEIRCTNPIATEQYGSVSENLMRGNR

SEQ ID NO: 24738 - protein, 29 aa, Artificial Sequence
  Description of Artificial Sequence: Synthetic peptide
NEREIRTTNPVATEQYGSVWTNLQIGARE

SEQ ID NO: 24739 - protein, 31 aa, Artificial Sequence
  Description of Artificial Sequence: Synthetic polypeptide
DEEEIRTTNPVATEQYGSVSTNLERSVNEDF

SEQ ID NO: 24740 - protein, 29 aa, Artificial Sequence
  Description of Artificial Sequence: Synthetic peptide
SCEEIRTTNPVATEQHGTVSTNLQENGNR

SEQ ID NO: 24741 - protein, 31 aa, Artificial Sequence
  Description of Artificial Sequence: Synthetic polypeptide
DEEEIRTTNPVATEQYGSVSTNLESGGEDND

SEQ ID NO: 24742 - protein, 32 aa, Artificial Sequence
  Description of Artificial Sequence: Synthetic polypeptide
DEEEIRTTNPVATEQYGSVSTMNGQQERGNID

SEQ ID NO: 24743 - protein, 30 aa, Artificial Sequence
  Description of Artificial Sequence: Synthetic polypeptide
DEEEIRSTNPVATEQYGSVSMNQDRGSNSR

SEQ ID NO: 24744 - protein, 29 aa, Artificial Sequence
  Description of Artificial Sequence: Synthetic peptide
NEREIRTTNPVATEQYGSVITTNLQIGSR

SEQ ID NO: 24745 - protein, 29 aa, Artificial Sequence
  Description of Artificial Sequence: Synthetic peptide
SAEEIRTTNPVATDQYGSVSTELQRGMNF

SEQ ID NO: 24746 - protein, 29 aa, Artificial Sequence
  Description of Artificial Sequence: Synthetic peptide
NEREIRTTNPVATEQYGSVGTNLQIGQRQ

SEQ ID NO: 24747 - protein, 28 aa, Artificial Sequence
  Description of Artificial Sequence: Synthetic peptide
NEREIRTTNPVATEQYGSVGLNLQIGSR

SEQ ID NO: 24748 - protein, 28 aa, Artificial Sequence
  Description of Artificial Sequence: Synthetic peptide
NEREIRTTNPVATEQYGSVFTNLQNGDA

SEQ ID NO: 24749 - protein, 29 aa, Artificial Sequence
  Description of Artificial Sequence: Synthetic peptide
NEREIRTTNPVATEQYGSVFTNLQIGSSR

SEQ ID NO: 24750 - protein, 28 aa, Artificial Sequence
  Description of Artificial Sequence: Synthetic peptide
NEREIRTTNPVATEQYGSVFTNDQIGQR

SEQ ID NO: 24751 - protein, 31 aa, Artificial Sequence
  Description of Artificial Sequence: Synthetic polypeptide
DEEEIRTTNPVATEQYGSVSTNLEVGGGNNQ

SEQ ID NO: 24752 - protein, 31 aa, Artificial Sequence
  Description of Artificial Sequence: Synthetic polypeptide
DEEEIRTTNPVATEQYGMVSTNNLNQGGGNE

SEQ ID NO: 24753 - protein, 28 aa, Artificial Sequence
  Description of Artificial Sequence: Synthetic peptide
SDEEIRCTNPIATEQYGSVSENLMRGNR

SEQ ID NO: 24754 - protein, 33 aa, Artificial Sequence
  Description of Artificial Sequence: Synthetic polypeptide
DEEEIRTTNPVATEQYGSVSGTNNNLQRGGNNP

SEQ ID NO: 24755 - protein, 29 aa, Artificial Sequence
  Description of Artificial Sequence: Synthetic peptide
NEREIRTTNPVATEQYGSSVCTNLQGGSR

SEQ ID NO: 24756 - protein, 29 aa, Artificial Sequence
  Description of Artificial Sequence: Synthetic peptide
DEEEIRTTNPCATEQYGSVSYNIVVRGND

SEQ ID NO: 24757 - protein, 28 aa, Artificial Sequence
  Description of Artificial Sequence: Synthetic peptide
SDEEIRCTNPVATEQYGNVSENLMRGNR

SEQ ID NO: 24758 - protein, 29 aa, Artificial Sequence
  Description of Artificial Sequence: Synthetic peptide
SDEEIRTTNPVATDQYGSVSTALQRGNNF

SEQ ID NO: 24759 - protein, 29 aa, Artificial Sequence
  Description of Artificial Sequence: Synthetic peptide
SDEEIRCTNPIATEQYGSVSENLMQRGNR

SEQ ID NO: 24760 - protein, 28 aa, Artificial Sequence
  Description of Artificial Sequence: Synthetic peptide
SAEEIRCTNPIATEQYGSVSENLMRGNR

SEQ ID NO: 24761 - protein, 29 aa, Artificial Sequence
  Description of Artificial Sequence: Synthetic peptide
NESEIRTTNPVATEQYGSVETMNLQKGSR

SEQ ID NO: 24762 - protein, 31 aa, Artificial Sequence
  Description of Artificial Sequence: Synthetic polypeptide
DEECIRTTNPVATEQYGSAVQSNTNLQNGND

SEQ ID NO: 24763 - protein, 32 aa, Artificial Sequence
  Description of Artificial Sequence: Synthetic polypeptide
DEEEIRTTNPVATEQYGSVSTNLEQSFGSNLV

SEQ ID NO: 24764 - protein, 30 aa, Artificial Sequence
  Description of Artificial Sequence: Synthetic polypeptide
DEEEIRTTNPVATEQYGMVSTGNGQGGNDE

SEQ ID NO: 24765 - protein, 30 aa, Artificial Sequence
  Description of Artificial Sequence: Synthetic polypeptide
DEEEIRTTNPVATEQYGCVSTNPQYNSNRT

SEQ ID NO: 24766 - protein, 32 aa, Artificial Sequence
  Description of Artificial Sequence: Synthetic polypeptide
DEEEIRTTNPVATEQYGSVSTMNLDQNIGNNM

SEQ ID NO: 24767 - protein, 31 aa, Artificial Sequence
  Description of Artificial Sequence: Synthetic polypeptide
DEEEIRTTNPVATEQYGCVSTNPQYFGSNRT

SEQ ID NO: 24768 - protein, 31 aa, Artificial Sequence
  Description of Artificial Sequence: Synthetic polypeptide
DEEEIRSTNPVATEQYGSVSTNLQPGDNFGN

SEQ ID NO: 24769 - protein, 32 aa, Artificial Sequence
  Description of Artificial Sequence: Synthetic polypeptide
DEEEIRTTNPVATEQYGSVSTMNLDQNIGNDE

SEQ ID NO: 24770 - protein, 30 aa, Artificial Sequence
  Description of Artificial Sequence: Synthetic polypeptide
DEEEIRTTNPVATEQYGCVSTNPLQHGEQS

SEQ ID NO: 24771 - protein, 32 aa, Artificial Sequence
  Description of Artificial Sequence: Synthetic polypeptide
DEEEIRTTNPVATEQYGSVSTMNLDQGEGGNT

SEQ ID NO: 24772 - protein, 29 aa, Artificial Sequence
  Description of Artificial Sequence: Synthetic peptide
DEEEIRTTNPCATEQYGSVSWNIFRFGND

SEQ ID NO: 24773 - protein, 31 aa, Artificial Sequence
  Description of Artificial Sequence: Synthetic polypeptide
DEEEIRTTNPVATEQYGMVSTNLIQGGNEED

SEQ ID NO: 24774 - protein, 31 aa, Artificial Sequence
  Description of Artificial Sequence: Synthetic polypeptide
DEEEIRSTNPVATEQYGSVSTDNLQQGINED

SEQ ID NO: 24775 - protein, 31 aa, Artificial Sequence
  Description of Artificial Sequence: Synthetic polypeptide
DEEEIRTTNPVATEQYGSVSTMNLDNEGNID

SEQ ID NO: 24776 - protein, 32 aa, Artificial Sequence
  Description of Artificial Sequence: Synthetic polypeptide
DEEEIRTTNPVATEQYGMVSTNLNQRFGSNQT

SEQ ID NO: 24777 - protein, 28 aa, Artificial Sequence
  Description of Artificial Sequence: Synthetic peptide
DEEEIRTTNPCATEQYGSVSYNIARGDD

SEQ ID NO: 24778 - protein, 32 aa, Artificial Sequence
  Description of Artificial Sequence: Synthetic polypeptide
DEEEIRTTNPVATEQYGSVSGTNNLQFGNNGP

SEQ ID NO: 24779 - protein, 28 aa, Artificial Sequence
  Description of Artificial Sequence: Synthetic peptide
NESEIVTTNPVATEQYGSVATNLQIGER

SEQ ID NO: 24780 - protein, 29 aa, Artificial Sequence
  Description of Artificial Sequence: Synthetic peptide
DEEEIRTTNPCATEQYGSVSYNIDRGMND

SEQ ID NO: 24781 - protein, 29 aa, Artificial Sequence
  Description of Artificial Sequence: Synthetic peptide
DEEEIRTTNPCATEQYGSVSYNIERGNDD

SEQ ID NO: 24782 - protein, 29 aa, Artificial Sequence
  Description of Artificial Sequence: Synthetic peptide
NESEIRTTNPVATEQYGSVWTDNLQDGER

SEQ ID NO: 24783 - protein, 31 aa, Artificial Sequence
  Description of Artificial Sequence: Synthetic polypeptide
DEEEIRTTNPVATEQYGMVSTNLQFDGVNNS

SEQ ID NO: 24784 - protein, 29 aa, Artificial Sequence
  Description of Artificial Sequence: Synthetic peptide
NESEIRTTNPVATEQYGSVVTNLQIGSDR

SEQ ID NO: 24785 - protein, 29 aa, Artificial Sequence
  Description of Artificial Sequence: Synthetic peptide
NESEIRTTNPVATEQYGSVTTNLQIGGSR

SEQ ID NO: 24786 - protein, 28 aa, Artificial Sequence
  Description of Artificial Sequence: Synthetic peptide
DEEEIRTTNPCATEQYGSVSYNIFRGSD

SEQ ID NO: 24787 - protein, 29 aa, Artificial Sequence
  Description of Artificial Sequence: Synthetic peptide
NESEIRTTNPVATEQYGSVTTNLQHGESR

SEQ ID NO: 24788 - protein, 31 aa, Artificial Sequence
  Description of Artificial Sequence: Synthetic polypeptide
DEEEIRTTNPVATEQYGMVSTNLQNDGGNNI

SEQ ID NO: 24789 - protein, 30 aa, Artificial Sequence
  Description of Artificial Sequence: Synthetic polypeptide
DEEEIRTTNPVATEQYGMVSTNLQQNAGTT

SEQ ID NO: 24790 - protein, 32 aa, Artificial Sequence
  Description of Artificial Sequence: Synthetic polypeptide
NEEEIRTTNPVATEQYGSVNTFNLEQRGENYR

SEQ ID NO: 24791 - protein, 29 aa, Artificial Sequence
  Description of Artificial Sequence: Synthetic peptide
DEEEIRTTNPVATEQYGCVSTPLEGGNQF

SEQ ID NO: 24792 - protein, 31 aa, Artificial Sequence
  Description of Artificial Sequence: Synthetic polypeptide
DEEEIRTTNPVATEQYGNVSTQNLQESGNNP

SEQ ID NO: 24793 - protein, 30 aa, Artificial Sequence
  Description of Artificial Sequence: Synthetic polypeptide
DEEEIRTTNPVATEQYGCVSTNLQNLDNPE

SEQ ID NO: 24794 - protein, 29 aa, Artificial Sequence
  Description of Artificial Sequence: Synthetic peptide
NEEEIATTNPVATEQYGSVATNLQSGDRQ

SEQ ID NO: 24795 - protein, 30 aa, Artificial Sequence
  Description of Artificial Sequence: Synthetic polypeptide
NEEEIATTNPVATEQYGSVATNLQRGENLN

SEQ ID NO: 24796 - protein, 28 aa, Artificial Sequence
  Description of Artificial Sequence: Synthetic peptide
DEEEIRTTNPCATTQYGTVATDLQRGNV

SEQ ID NO: 24797 - protein, 31 aa, Artificial Sequence
  Description of Artificial Sequence: Synthetic polypeptide
NEEEIATTNPVATEQYGSVATNLQRAGENPR

SEQ ID NO: 24798 - protein, 31 aa, Artificial Sequence
  Description of Artificial Sequence: Synthetic polypeptide
DEEEIRTTNPVATEQYGCVSTNLEQEGGNQD

SEQ ID NO: 24799 - protein, 30 aa, Artificial Sequence
  Description of Artificial Sequence: Synthetic polypeptide
DEEEIRTTNPVATEQYGCVSTNLENRGVDG

SEQ ID NO: 24800 - protein, 30 aa, Artificial Sequence
  Description of Artificial Sequence: Synthetic polypeptide
DEEEIRTTNPVATEQYGSVSTNLLTNGSED

SEQ ID NO: 24801 - protein, 32 aa, Artificial Sequence
  Description of Artificial Sequence: Synthetic polypeptide
DEEEIRTTNPVATEQYGSVSTNLLVQNGGNVT

SEQ ID NO: 24802 - protein, 29 aa, Artificial Sequence
  Description of Artificial Sequence: Synthetic peptide
NEEEIATTNPVATEQYGSVATNLQFGDER

SEQ ID NO: 24803 - protein, 32 aa, Artificial Sequence
  Description of Artificial Sequence: Synthetic polypeptide
DEEEIRTTNPVATEQYGQCVCSTNLQRGNNQA

SEQ ID NO: 24804 - protein, 31 aa, Artificial Sequence
  Description of Artificial Sequence: Synthetic polypeptide
DEEEIRTTNPVATEQYGSVSTMLQEIGNGEL

SEQ ID NO: 24805 - protein, 30 aa, Artificial Sequence
  Description of Artificial Sequence: Synthetic polypeptide
DEEEIRTTNPVATEQYGSVSTNLMDEFNDV

SEQ ID NO: 24806 - protein, 31 aa, Artificial Sequence
  Description of Artificial Sequence: Synthetic polypeptide
DEEEIRTTNPVATEQYGSVSTMLQFGGENIP

SEQ ID NO: 24807 - protein, 31 aa, Artificial Sequence
  Description of Artificial Sequence: Synthetic polypeptide
DEEEIRTTNPVATEQYGSVSTMLQEGSGNFG

SEQ ID NO: 24808 - protein, 28 aa, Artificial Sequence
  Description of Artificial Sequence: Synthetic peptide
SEEEIACTNPVCTEQYGSVSENLQRGNQ

SEQ ID NO: 24809 - protein, 30 aa, Artificial Sequence
  Description of Artificial Sequence: Synthetic polypeptide
DEEEIRTTNPVATEQYGCVSTNLDVRIENQ

SEQ ID NO: 24810 - protein, 32 aa, Artificial Sequence
  Description of Artificial Sequence: Synthetic polypeptide
AEEEIRTTNPVATEQYGSVWTDNLKQRGENHR

SEQ ID NO: 24811 - protein, 33 aa, Artificial Sequence
  Description of Artificial Sequence: Synthetic polypeptide
DEEEIRTTNPVATEQYGCVSTNLDQRSGSNNRT

SEQ ID NO: 24812 - protein, 28 aa, Artificial Sequence
  Description of Artificial Sequence: Synthetic peptide
SEEEIAPTNPCATEQYGSVSENLMRGNR

SEQ ID NO: 24813 - protein, 31 aa, Artificial Sequence
  Description of Artificial Sequence: Synthetic polypeptide
DEEEIRTTNPVATEQYGSVSTNLMVIGSQER

SEQ ID NO: 24814 - protein, 28 aa, Artificial Sequence
  Description of Artificial Sequence: Synthetic peptide
SEEEIASTNPIATEQYGSVSENLMRGNR

SEQ ID NO: 24815 - protein, 31 aa, Artificial Sequence
  Description of Artificial Sequence: Synthetic polypeptide
DEEEIRTTNPVATEQYGQCVQTNLQRGSNQG

SEQ ID NO: 24816 - protein, 31 aa, Artificial Sequence
  Description of Artificial Sequence: Synthetic polypeptide
DEEEIRTTNPVATEQYGSVSTNLNDGEDQRY

SEQ ID NO: 24817 - protein, 30 aa, Artificial Sequence
  Description of Artificial Sequence: Synthetic polypeptide
DEEEIRTTNPVATEQYGSVSTMLQDNIVER

SEQ ID NO: 24818 - protein, 32 aa, Artificial Sequence
  Description of Artificial Sequence: Synthetic polypeptide
DEEEIRTTNPVATEQYGQCVSMTNEQRGSNRN

SEQ ID NO: 24819 - protein, 31 aa, Artificial Sequence
  Description of Artificial Sequence: Synthetic polypeptide
DEEEIRTTNPVATEQYGSVSTMLQDNGDNGD

SEQ ID NO: 24820 - protein, 30 aa, Artificial Sequence
  Description of Artificial Sequence: Synthetic polypeptide
DEEEIRTTNPVATEQYGCVSTNLEIFGNQS

SEQ ID NO: 24821 - protein, 31 aa, Artificial Sequence
  Description of Artificial Sequence: Synthetic polypeptide
DEEEIRTTNPVATEQYGSVSTMLQDNEGNTD

SEQ ID NO: 24822 - protein, 32 aa, Artificial Sequence
  Description of Artificial Sequence: Synthetic polypeptide
DEEEIRTTNPVATEQYGSVSTNLLQVEGNEEI

SEQ ID NO: 24823 - protein, 28 aa, Artificial Sequence
  Description of Artificial Sequence: Synthetic peptide
SEEEIACTNPVATEQYGSVSENLMHGNR

SEQ ID NO: 24824 - protein, 32 aa, Artificial Sequence
  Description of Artificial Sequence: Synthetic polypeptide
DEEEIRTTNPVATEQYGSVSTNLLIRSGVNEE

SEQ ID NO: 24825 - protein, 29 aa, Artificial Sequence
  Description of Artificial Sequence: Synthetic peptide
NEEEIATTNPVAYEQYGSVSTNLQNGNTE

SEQ ID NO: 24826 - protein, 28 aa, Artificial Sequence
  Description of Artificial Sequence: Synthetic peptide
DEEEIRTTNPCATESYGSVATNDNRGNA

SEQ ID NO: 24827 - protein, 32 aa, Artificial Sequence
  Description of Artificial Sequence: Synthetic polypeptide
DEEEIRTTNPVATEQYGSVSTNLLQDEGNNEF

SEQ ID NO: 24828 - protein, 31 aa, Artificial Sequence
  Description of Artificial Sequence: Synthetic polypeptide
DEEEIRTTNPVATEQYGSVSTMLQNIGENIA

SEQ ID NO: 24829 - protein, 31 aa, Artificial Sequence
  Description of Artificial Sequence: Synthetic polypeptide
DEEEIRTTNPVATEQYGSVSTMLQMGGNNEQ

SEQ ID NO: 24830 - protein, 28 aa, Artificial Sequence
  Description of Artificial Sequence: Synthetic peptide
DEEEIRTTNPCATESYGSVCTNHGRGNA

SEQ ID NO: 24831 - protein, 33 aa, Artificial Sequence
  Description of Artificial Sequence: Synthetic polypeptide
DEEEIRTTNPVATEQYGCVSTNLGQERSGSNRA

SEQ ID NO: 24832 - protein, 31 aa, Artificial Sequence
  Description of Artificial Sequence: Synthetic polypeptide
DEEEIRTTNPVATEQYGSVSTMLQIAGNGNI

SEQ ID NO: 24833 - protein, 31 aa, Artificial Sequence
  Description of Artificial Sequence: Synthetic polypeptide
DEEEIRTTNPVATEQYGCVSTNLGAGDNGRP

SEQ ID NO: 24834 - protein, 31 aa, Artificial Sequence
  Description of Artificial Sequence: Synthetic polypeptide
DEEEIRTTNPVATEQYGSVSTMLQGNGNGDN

SEQ ID NO: 24835 - protein, 31 aa, Artificial Sequence
  Description of Artificial Sequence: Synthetic polypeptide
DEEEIRTTNPVATEQYGSVSTMLQGIGQNPN

SEQ ID NO: 24836 - protein, 29 aa, Artificial Sequence
  Description of Artificial Sequence: Synthetic peptide
SEEEIACTNPVATEQYGSVSTNLQAGNEA

SEQ ID NO: 24837 - protein, 31 aa, Artificial Sequence
  Description of Artificial Sequence: Synthetic polypeptide
DEEEIRTTNPVATEQYGSVSTNLLQNGSDAL

SEQ ID NO: 24838 - protein, 30 aa, Artificial Sequence
  Description of Artificial Sequence: Synthetic polypeptide
DEEEIRTTNPVATEQYGCVSTNLERNSNQD

SEQ ID NO: 24839 - protein, 32 aa, Artificial Sequence
  Description of Artificial Sequence: Synthetic polypeptide
DEEEIRTTNPVATEQYGSVSTNLLQNTEGNEF

SEQ ID NO: 24840 - protein, 28 aa, Artificial Sequence
  Description of Artificial Sequence: Synthetic peptide
DEEEIRTTNPCATQQYGQVPTDLQRGNA

SEQ ID NO: 24841 - protein, 32 aa, Artificial Sequence
  Description of Artificial Sequence: Synthetic polypeptide
DEEEIRTTNPVATEQYGSVSTNLLQQIGENEL

SEQ ID NO: 24842 - protein, 32 aa, Artificial Sequence
  Description of Artificial Sequence: Synthetic polypeptide
DEEEIRTTNPVATEQYGSVSTNLLQQRAVNEL

SEQ ID NO: 24843 - protein, 30 aa, Artificial Sequence
  Description of Artificial Sequence: Synthetic polypeptide
NEEEIATTNPVATEQYGSVSTPNLQDGNDQ

SEQ ID NO: 24844 - protein, 28 aa, Artificial Sequence
  Description of Artificial Sequence: Synthetic peptide
DEEEIRTTNPCATRQYGQVPTELQRGNF

SEQ ID NO: 24845 - protein, 28 aa, Artificial Sequence
  Description of Artificial Sequence: Synthetic peptide
SEEEIACTNPVATEQYGSVSENIMRGNR

SEQ ID NO: 24846 - protein, 30 aa, Artificial Sequence
  Description of Artificial Sequence: Synthetic polypeptide
NEEEIATTNPVATEQYGSVSTNLDRGDNED

SEQ ID NO: 24847 - protein, 28 aa, Artificial Sequence
  Description of Artificial Sequence: Synthetic peptide
DEEEIRTTNPCATTQYGNVVTGLQRGNV

SEQ ID NO: 24848 - protein, 28 aa, Artificial Sequence
  Description of Artificial Sequence: Synthetic peptide
DEEEIRTTNPCATTQYGQVYTTLQRGNV

SEQ ID NO: 24849 - protein, 32 aa, Artificial Sequence
  Description of Artificial Sequence: Synthetic polypeptide
DEEEIRTTNPVATEQYGSVSTMLQFREGIEDR

SEQ ID NO: 24850 - protein, 28 aa, Artificial Sequence
  Description of Artificial Sequence: Synthetic peptide
DEEEIRTTNPCATGQYGTVATTLQRGNQ

SEQ ID NO: 24851 - protein, 30 aa, Artificial Sequence
  Description of Artificial Sequence: Synthetic polypeptide
NEEEIATTNPVAYEQYGSVSTNLQRNGDDR

SEQ ID NO: 24852 - protein, 28 aa, Artificial Sequence
  Description of Artificial Sequence: Synthetic peptide
SEEEIASTNPVATEQYGVVSDNLQSGNR

SEQ ID NO: 24853 - protein, 30 aa, Artificial Sequence
  Description of Artificial Sequence: Synthetic polypeptide
DEEEIRTTNPVATEQYGSVSTMLQDGGGEE

SEQ ID NO: 24854 - protein, 29 aa, Artificial Sequence
  Description of Artificial Sequence: Synthetic peptide
NEEEIATTNPVATEHYGSVSTNQQSGNRD

SEQ ID NO: 24855 - protein, 32 aa, Artificial Sequence
  Description of Artificial Sequence: Synthetic polypeptide
DEEEIRTTNPVATEQYGSVSIANLQREGNPQD

SEQ ID NO: 24856 - protein, 30 aa, Artificial Sequence
  Description of Artificial Sequence: Synthetic polypeptide
NEEEIATTNPVATEHYGSVSTNLQGGNDRM

SEQ ID NO: 24857 - protein, 29 aa, Artificial Sequence
  Description of Artificial Sequence: Synthetic peptide
NEEEIATTNPVATEAYGSVSTNLQQGDRQ

SEQ ID NO: 24858 - protein, 30 aa, Artificial Sequence
  Description of Artificial Sequence: Synthetic polypeptide
DEEEIRTTNPVATEQYGCVSTNHFQSGNQN

SEQ ID NO: 24859 - protein, 28 aa, Artificial Sequence
  Description of Artificial Sequence: Synthetic peptide
SEEEIATTNPVATEMYGSVSTNEQEGNQ

SEQ ID NO: 24860 - protein, 29 aa, Artificial Sequence
  Description of Artificial Sequence: Synthetic peptide
SEEEIATTNPVATEMYGSVSTNLQQGNDF

SEQ ID NO: 24861 - protein, 32 aa, Artificial Sequence
  Description of Artificial Sequence: Synthetic polypeptide
DEEEIRTTNPVATEQYGSVSTNLNQNFGSNNV

SEQ ID NO: 24862 - protein, 32 aa, Artificial Sequence
  Description of Artificial Sequence: Synthetic polypeptide
DEEEIRTTNPVATEQYGCVSTNHEQRSGSNRT

SEQ ID NO: 24863 - protein, 32 aa, Artificial Sequence
  Description of Artificial Sequence: Synthetic polypeptide
DEEEIRTTNPVATEQYGSVSTNLNQNRGLPDD

SEQ ID NO: 24864 - protein, 32 aa, Artificial Sequence
  Description of Artificial Sequence: Synthetic polypeptide
DEEEIRTTNPVATEQYGSVSTNLNQNRGLPIY

SEQ ID NO: 24865 - protein, 31 aa, Artificial Sequence
  Description of Artificial Sequence: Synthetic polypeptide
DEEEIRTTNPVATEQYGCVSTNGLQRGDMDN

SEQ ID NO: 24866 - protein, 30 aa, Artificial Sequence
  Description of Artificial Sequence: Synthetic polypeptide
DEEEIRTTNPVATEQYGCVSTNHNQRGSDL

SEQ ID NO: 24867 - protein, 29 aa, Artificial Sequence
  Description of Artificial Sequence: Synthetic peptide
SEEEIATTNPVATEQWGSVSTNLQDQGDR

SEQ ID NO: 24868 - protein, 28 aa, Artificial Sequence
  Description of Artificial Sequence: Synthetic peptide
NEEEIACTNPVATEQYGSVATNLQEGNL

SEQ ID NO: 24869 - protein, 30 aa, Artificial Sequence
  Description of Artificial Sequence: Synthetic polypeptide
AEEEIRTTNPVATEQYGVVSNTNLQIGNVE

SEQ ID NO: 24870 - protein, 29 aa, Artificial Sequence
  Description of Artificial Sequence: Synthetic peptide
SEEEIATTNPVATEQYGSASTNLQDGGRN

SEQ ID NO: 24871 - protein, 30 aa, Artificial Sequence
  Description of Artificial Sequence: Synthetic polypeptide
AEEEIRTTNPVATEQYGVVSSTNLQLGGNG

SEQ ID NO: 24872 - protein, 29 aa, Artificial Sequence
  Description of Artificial Sequence: Synthetic peptide
AEEEIRTTNPVATEQYGVVSSTNLQQGQE

SEQ ID NO: 24873 - protein, 30 aa, Artificial Sequence
  Description of Artificial Sequence: Synthetic polypeptide
AEEEIRTTNPVATEQYGVVSSTNLQTGNVT

SEQ ID NO: 24874 - protein, 29 aa, Artificial Sequence
  Description of Artificial Sequence: Synthetic peptide
DEEEIRTTNPVATEQYGCVSTNEQNGDQT

SEQ ID NO: 24875 - protein, 32 aa, Artificial Sequence
  Description of Artificial Sequence: Synthetic polypeptide
DEEEIRTTNPVATEQYGSVSTNLNQTNGGGNI

SEQ ID NO: 24876 - protein, 32 aa, Artificial Sequence
  Description of Artificial Sequence: Synthetic polypeptide
DEEEIRTTNPVATEQYGSVSTNLNQVAGNIIE

SEQ ID NO: 24877 - protein, 29 aa, Artificial Sequence
  Description of Artificial Sequence: Synthetic peptide
AEEEIRTTNPVATEQYGVVSTNLDESGNL

SEQ ID NO: 24878 - protein, 30 aa, Artificial Sequence
  Description of Artificial Sequence: Synthetic polypeptide
AEEEIRTTNPVATEQYGVVSTNLEQQGGNG

SEQ ID NO: 24879 - protein, 29 aa, Artificial Sequence
  Description of Artificial Sequence: Synthetic peptide
AEEEIRTTNPVATEQYGVVSTNLNMGGNQ

SEQ ID NO: 24880 - protein, 30 aa, Artificial Sequence
  Description of Artificial Sequence: Synthetic polypeptide
DEEEIRTTNPVATEQYGSVSIEELQRGVGI

SEQ ID NO: 24881 - protein, 31 aa, Artificial Sequence
  Description of Artificial Sequence: Synthetic polypeptide
DEEEIRTTNPVATEQYGSVSTNLNGMGGNQD

SEQ ID NO: 24882 - protein, 32 aa, Artificial Sequence
  Description of Artificial Sequence: Synthetic polypeptide
DEEEIRTTNPVATEQYGSVSTNLNQMNFGENI

SEQ ID NO: 24883 - protein, 29 aa, Artificial Sequence
  Description of Artificial Sequence: Synthetic peptide
NEEEIATTNPVATEMYGSVSTNLQQGDRA

SEQ ID NO: 24884 - protein, 30 aa, Artificial Sequence
  Description of Artificial Sequence: Synthetic polypeptide
AEEEIRTTNPVATEQYGSVYVNLQQEGNER

SEQ ID NO: 24885 - protein, 31 aa, Artificial Sequence
  Description of Artificial Sequence: Synthetic polypeptide
DEEEIRTTNPVATEQYGSVSTNLNMGGNNGT

SEQ ID NO: 24886 - protein, 32 aa, Artificial Sequence
  Description of Artificial Sequence: Synthetic polypeptide
DEEEIRTTNPVATEQYGSVSTNLNQEDFGGNQ

SEQ ID NO: 24887 - protein, 31 aa, Artificial Sequence
  Description of Artificial Sequence: Synthetic polypeptide
DEEEIRTTNPVATEQYGSVSTMLPQIEGNGP

SEQ ID NO: 24888 - protein, 32 aa, Artificial Sequence
  Description of Artificial Sequence: Synthetic polypeptide
DEEEIRTTNPVATEQYGSVSTNLNQEDFGNGT

SEQ ID NO: 24889 - protein, 31 aa, Artificial Sequence
  Description of Artificial Sequence: Synthetic polypeptide
DEEEIRGTNPVATEQYGSVSVNEQDRGSNAR

SEQ ID NO: 24890 - protein, 32 aa, Artificial Sequence
  Description of Artificial Sequence: Synthetic polypeptide
AEEEIRTTNPVATEQYGTTVSCTNLQRGGNNR

SEQ ID NO: 24891 - protein, 32 aa, Artificial Sequence
  Description of Artificial Sequence: Synthetic polypeptide
DEEEIRTTNPVATEQYGSVSTNLNQEGFGNEG

SEQ ID NO: 24892 - protein, 32 aa, Artificial Sequence
  Description of Artificial Sequence: Synthetic polypeptide
DEEEIRTTNPVATEQYGSVSTNLNQEGFGNQE

SEQ ID NO: 24893 - protein, 30 aa, Artificial Sequence
  Description of Artificial Sequence: Synthetic polypeptide
DEEEIRTTNPVATEQYGCVSTNHQRFGEQS

SEQ ID NO: 24894 - protein, 28 aa, Artificial Sequence
  Description of Artificial Sequence: Synthetic peptide
SEEEIATTNPIATEQYGDVSENLMRGNR

SEQ ID NO: 24895 - protein, 30 aa, Artificial Sequence
  Description of Artificial Sequence: Synthetic polypeptide
DEEEIRTTNPVATEQYGSVSHTNGGQDGKF

SEQ ID NO: 24896 - protein, 29 aa, Artificial Sequence
  Description of Artificial Sequence: Synthetic peptide
SEEEIATTNPVATEHYGSVSTNLQQGNDL

SEQ ID NO: 24897 - protein, 31 aa, Artificial Sequence
  Description of Artificial Sequence: Synthetic polypeptide
DEEEIRTTNPVATEQYGSVSTMLNDRGENVE

SEQ ID NO: 24898 - protein, 30 aa, Artificial Sequence
  Description of Artificial Sequence: Synthetic polypeptide
AEEEIRTTNPVATEQYGTVSTNLQTNGGNS

SEQ ID NO: 24899 - protein, 28 aa, Artificial Sequence
  Description of Artificial Sequence: Synthetic peptide
AEEEIRTTNPVATEQYGTVSTQQQGGNV

SEQ ID NO: 24900 - protein, 30 aa, Artificial Sequence
  Description of Artificial Sequence: Synthetic polypeptide
AEEEIRTTNPVATEQYGTVSTTNLQGGGNS

SEQ ID NO: 24901 - protein, 29 aa, Artificial Sequence
  Description of Artificial Sequence: Synthetic peptide
AEEEIRTTNPVATEQYGTVSTTNLQSNNN

SEQ ID NO: 24902 - protein, 28 aa, Artificial Sequence
  Description of Artificial Sequence: Synthetic peptide
SEEEIATTNPIATEQYGSVSENLMRGER

SEQ ID NO: 24903 - protein, 31 aa, Artificial Sequence
  Description of Artificial Sequence: Synthetic polypeptide
DEEEIRTTNPVATEQYGSVSTNLNQMEMNGG

SEQ ID NO: 24904 - protein, 31 aa, Artificial Sequence
  Description of Artificial Sequence: Synthetic polypeptide
DEEEIRTTNPVATEQYGSVSTNLNQMEQNGE

SEQ ID NO: 24905 - protein, 28 aa, Artificial Sequence
  Description of Artificial Sequence: Synthetic peptide
DEEEIRTTNPVATEQYGSVSIADQREDV

SEQ ID NO: 24906 - protein, 31 aa, Artificial Sequence
  Description of Artificial Sequence: Synthetic polypeptide
DEEEIRTTNPVATEQYGSVSTMLIQSGGENT

SEQ ID NO: 24907 - protein, 31 aa, Artificial Sequence
  Description of Artificial Sequence: Synthetic polypeptide
DEEEIRTTNPVATEQYGSVSTMLIQNQEGNG

SEQ ID NO: 24908 - protein, 29 aa, Artificial Sequence
  Description of Artificial Sequence: Synthetic peptide
NEEEIATTNPVATEPYGEVSTNLQVGDNR

SEQ ID NO: 24909 - protein, 31 aa, Artificial Sequence
  Description of Artificial Sequence: Synthetic polypeptide
DEEEIRTTNPVATEQYGSVSTMLIQGGENTS

SEQ ID NO: 24910 - protein, 33 aa, Artificial Sequence
  Description of Artificial Sequence: Synthetic polypeptide
DEEEIRTTNPVATEQYGSVSHTNLPQRQGVNDE

SEQ ID NO: 24911 - protein, 29 aa, Artificial Sequence
  Description of Artificial Sequence: Synthetic peptide
NEEEICTTNPVATEPYGSVSTNLQQGDRM

SEQ ID NO: 24912 - protein, 29 aa, Artificial Sequence
  Description of Artificial Sequence: Synthetic peptide
NEEEICTTNPVATEQYGSVATNLQQGNLQ

SEQ ID NO: 24913 - protein, 31 aa, Artificial Sequence
  Description of Artificial Sequence: Synthetic polypeptide
DEEEIRTTNPVATEQYGSVSTMLQNQSGNDQ

SEQ ID NO: 24914 - protein, 30 aa, Artificial Sequence
  Description of Artificial Sequence: Synthetic polypeptide
DEEEIRTTNPVATEQYGSVSTNLINGSDAG

SEQ ID NO: 24915 - protein, 28 aa, Artificial Sequence
  Description of Artificial Sequence: Synthetic peptide
SEEEIACTNPIATEQYGSVSSNLARGNR

SEQ ID NO: 24916 - protein, 31 aa, Artificial Sequence
  Description of Artificial Sequence: Synthetic polypeptide
DEEEIRTTNPVATEQYGSVSTMLQSNGENEI

SEQ ID NO: 24917 - protein, 32 aa, Artificial Sequence
  Description of Artificial Sequence: Synthetic polypeptide
DEEEIRTTNPVATEQYGSVSTNLIQGEGNFTG

SEQ ID NO: 24918 - protein, 30 aa, Artificial Sequence
  Description of Artificial Sequence: Synthetic polypeptide
DEEEIRTTNPVATEQYGCVSTNLQNGDEPN

SEQ ID NO: 24919 - protein, 28 aa, Artificial Sequence
  Description of Artificial Sequence: Synthetic peptide
NEEEIRTTNPVATEQYGSLSTHLQRQMT

SEQ ID NO: 24920 - protein, 29 aa, Artificial Sequence
  Description of Artificial Sequence: Synthetic peptide
NEEEIRTTNPVATEQYGSLSTHLQRQGTD

SEQ ID NO: 24921 - protein, 31 aa, Artificial Sequence
  Description of Artificial Sequence: Synthetic polypeptide
DEEEIRTTNPVATEQYGSVSTMLQSGGDNED

SEQ ID NO: 24922 - protein, 29 aa, Artificial Sequence
  Description of Artificial Sequence: Synthetic peptide
NEEEIRTTNPVATEQYGSLSTHLQRQERM

SEQ ID NO: 24923 - protein, 32 aa, Artificial Sequence
  Description of Artificial Sequence: Synthetic polypeptide
DEEEIRTTNPVATEQYGSVSTNLIQMGENDQL

SEQ ID NO: 24924 - protein, 31 aa, Artificial Sequence
  Description of Artificial Sequence: Synthetic polypeptide
DEEEIRTTNPVATEQYGSVSTMLQSFGGNTP

SEQ ID NO: 24925 - protein, 28 aa, Artificial Sequence
  Description of Artificial Sequence: Synthetic peptide
SEEEIACTNPICTEQYGSVSENLQRGNR

SEQ ID NO: 24926 - protein, 30 aa, Artificial Sequence
  Description of Artificial Sequence: Synthetic polypeptide
NEEEIRTTNPVATEQYGSLSVTHLQRQNDR

SEQ ID NO: 24927 - protein, 30 aa, Artificial Sequence
  Description of Artificial Sequence: Synthetic polypeptide
DEEEIRTTNPVATEQYGSVSTMLQRNSLQD

SEQ ID NO: 24928 - protein, 31 aa, Artificial Sequence
  Description of Artificial Sequence: Synthetic polypeptide
DEEEIRTTNPVATEQYGCVSTNLQNEGDNPQ

SEQ ID NO: 24929 - protein, 28 aa, Artificial Sequence
  Description of Artificial Sequence: Synthetic peptide
NEEEIRTTNPVATEQYGSLSTHEQRQPR

SEQ ID NO: 24930 - protein, 29 aa, Artificial Sequence
  Description of Artificial Sequence: Synthetic peptide
NEEEIRTTNPVATEQYGSLSTGLQRQMGR

SEQ ID NO: 24931 - protein, 30 aa, Artificial Sequence
  Description of Artificial Sequence: Synthetic polypeptide
DEEEIRTTNPVATEQYGCVSTNLQNEDNVF

SEQ ID NO: 24932 - protein, 30 aa, Artificial Sequence
  Description of Artificial Sequence: Synthetic polypeptide
DEEEIRTTNPVATEQYGCVSTNLQMNNDEY

SEQ ID NO: 24933 - protein, 30 aa, Artificial Sequence
  Description of Artificial Sequence: Synthetic polypeptide
DEEEIRTTNPVATEQYGCVSTNLQMLNDEI

SEQ ID NO: 24934 - protein, 31 aa, Artificial Sequence
  Description of Artificial Sequence: Synthetic polypeptide
DEEEIRTTNPVATEQYGSVSTMLQQVGNGET

SEQ ID NO: 24935 - protein, 29 aa, Artificial Sequence
  Description of Artificial Sequence: Synthetic peptide
DEECIRTTNPVATEQYGCVSTNDQFGGNF

SEQ ID NO: 24936 - protein, 29 aa, Artificial Sequence
  Description of Artificial Sequence: Synthetic peptide
SEEEIACTNPVATEAYGSVSTNLQAGNRQ

SEQ ID NO: 24937 - protein, 31 aa, Artificial Sequence
  Description of Artificial Sequence: Synthetic polypeptide
DEEEIRTTNPVATEQYGNVTISTNENQGGNR

SEQ ID NO: 24938 - protein, 29 aa, Artificial Sequence
  Description of Artificial Sequence: Synthetic peptide
NEEEIRTTNPVATEQYGSITSTYLQRQGR

SEQ ID NO: 24939 - protein, 30 aa, Artificial Sequence
  Description of Artificial Sequence: Synthetic polypeptide
DEEEIRTTNPVATEQYGCVSTNLQHSGELS

SEQ ID NO: 24940 - protein, 31 aa, Artificial Sequence
  Description of Artificial Sequence: Synthetic polypeptide
DEEEIRTTNPVATEQYGCVSTNLQNFGQPRG

SEQ ID NO: 24941 - protein, 31 aa, Artificial Sequence
  Description of Artificial Sequence: Synthetic polypeptide
NEEEIRTTNPVATEQYGSISTHLSQREGSNR

SEQ ID NO: 24942 - protein, 29 aa, Artificial Sequence
  Description of Artificial Sequence: Synthetic peptide
DEECIRTTNPVATEQYGCVSTNDQNFGNQ

SEQ ID NO: 24943 - protein, 31 aa, Artificial Sequence
  Description of Artificial Sequence: Synthetic polypeptide
DEEEIRTTNPVATEQYGCVSTNLQNGDNDKF

SEQ ID NO: 24944 - protein, 31 aa, Artificial Sequence
  Description of Artificial Sequence: Synthetic polypeptide
DEEEIRTTNPVATEQYGNVSWTELDRQGMNR

SEQ ID NO: 24945 - protein, 29 aa, Artificial Sequence
  Description of Artificial Sequence: Synthetic peptide
DEECIRTTNPVATEQYGCVSTNGQFTGNE

SEQ ID NO: 24946 - protein, 28 aa, Artificial Sequence
  Description of Artificial Sequence: Synthetic peptide
SEEEIACTNPIATEQYGSVSDNLMRGNR

SEQ ID NO: 24947 - protein, 28 aa, Artificial Sequence
  Description of Artificial Sequence: Synthetic peptide
SEEEIACTNPIATEQYGSVSENLERGNR

SEQ ID NO: 24948 - protein, 30 aa, Artificial Sequence
  Description of Artificial Sequence: Synthetic polypeptide
DEEEIRTTNPVATEQYGNVSWTELNRDMNR

SEQ ID NO: 24949 - protein, 29 aa, Artificial Sequence
  Description of Artificial Sequence: Synthetic peptide
NEEEIRTTNPVATEQYGSVLSTDLQRQGY

SEQ ID NO: 24950 - protein, 31 aa, Artificial Sequence
  Description of Artificial Sequence: Synthetic polypeptide
DEEEIRTTNPVATEQYGSVSTNLIMGGENIG

SEQ ID NO: 24951 - protein, 28 aa, Artificial Sequence
  Description of Artificial Sequence: Synthetic peptide
NEEEIRTTNPVATEQYGSVDTDWQQGNS

SEQ ID NO: 24952 - protein, 31 aa, Artificial Sequence
  Description of Artificial Sequence: Synthetic polypeptide
DEEEIRTTNPVATEQYGCVSTNLQNGDNQDP

SEQ ID NO: 24953 - protein, 31 aa, Artificial Sequence
  Description of Artificial Sequence: Synthetic polypeptide
DEEEIRTTNPVATEQYGSVSTNLIMGGSNGE

SEQ ID NO: 24954 - protein, 31 aa, Artificial Sequence
  Description of Artificial Sequence: Synthetic polypeptide
DEEEIRTTNPVATEQYGSVSTMLQTNGVNQD

SEQ ID NO: 24955 - protein, 29 aa, Artificial Sequence
  Description of Artificial Sequence: Synthetic peptide
NEEEIRTTNPVATEQYGSVATNLQSGDDV

SEQ ID NO: 24956 - protein, 31 aa, Artificial Sequence
  Description of Artificial Sequence: Synthetic polypeptide
DEEEIRTTNPVATEQYGSVSGNLQTVIGNLD

SEQ ID NO: 24957 - protein, 31 aa, Artificial Sequence
  Description of Artificial Sequence: Synthetic polypeptide
NEEEIRTTNPVATEQYGSVATNLQRGENGEL

SEQ ID NO: 24958 - protein, 29 aa, Artificial Sequence
  Description of Artificial Sequence: Synthetic peptide
NEEEIRTTNPVATEQYGSVATNLQEGDQN

SEQ ID NO: 24959 - protein, 29 aa, Artificial Sequence
  Description of Artificial Sequence: Synthetic peptide
NEEEIRTTNPVATEQYGSVATALQRDEGR

SEQ ID NO: 24960 - protein, 28 aa, Artificial Sequence
  Description of Artificial Sequence: Synthetic peptide
NEEEIRTTNPVATEQYGSVATALQNGDP

SEQ ID NO: 24961 - protein, 31 aa, Artificial Sequence
  Description of Artificial Sequence: Synthetic polypeptide
DEEEIRTTNPVATEQYGSVSTMLQTGIGNDD

SEQ ID NO: 24962 - protein, 31 aa, Artificial Sequence
  Description of Artificial Sequence: Synthetic polypeptide
NEEEIRTTNPVATEQYGSTVSATNLTEFGNR

SEQ ID NO: 24963 - protein, 29 aa, Artificial Sequence
  Description of Artificial Sequence: Synthetic peptide
SEEEIACTNPIATEQYGSVSENLQSRGNR

SEQ ID NO: 24964 - protein, 28 aa, Artificial Sequence
  Description of Artificial Sequence: Synthetic peptide
NEEEIRTTNPVATEQYGSTSTHLTRVGR

SEQ ID NO: 24965 - protein, 28 aa, Artificial Sequence
  Description of Artificial Sequence: Synthetic peptide
NEEEIRTTNPVATEQYGSTSTHLQRQGD

SEQ ID NO: 24966 - protein, 28 aa, Artificial Sequence
  Description of Artificial Sequence: Synthetic peptide
NEEEIRTTNPVATEQYGSTSTGLQGQGR

SEQ ID NO: 24967 - protein, 31 aa, Artificial Sequence
  Description of Artificial Sequence: Synthetic polypeptide
DEEEIRTTNPVATEQYGCVSTNLQNGDNMEF

SEQ ID NO: 24968 - protein, 28 aa, Artificial Sequence
  Description of Artificial Sequence: Synthetic peptide
NEEEIRTTNPVATEQYGSSSTHLQNQDR

SEQ ID NO: 24969 - protein, 30 aa, Artificial Sequence
  Description of Artificial Sequence: Synthetic polypeptide
NEEEIRTTNPVATEQYGSSSTGLQRQDGER

SEQ ID NO: 24970 - protein, 28 aa, Artificial Sequence
  Description of Artificial Sequence: Synthetic peptide
SEEEIACTNPIATEQYGSVSENLMRGNR

SEQ ID NO: 24971 - protein, 29 aa, Artificial Sequence
  Description of Artificial Sequence: Synthetic peptide
DEECIRTTNPVATEQYGCVSTNAQFGSNQ

SEQ ID NO: 24972 - protein, 29 aa, Artificial Sequence
  Description of Artificial Sequence: Synthetic peptide
DEEEIRTTNPVATEQYGCVSTNLQFFSDA

SEQ ID NO: 24973 - protein, 31 aa, Artificial Sequence
  Description of Artificial Sequence: Synthetic polypeptide
NEEEIRTTNPVATEQYGSISCTHLQRQGSNR

SEQ ID NO: 24974 - protein, 28 aa, Artificial Sequence
  Description of Artificial Sequence: Synthetic peptide
SEEEIACTNPVATEQYGSASENLQRGGR

SEQ ID NO: 24975 - protein, 28 aa, Artificial Sequence
  Description of Artificial Sequence: Synthetic peptide
NEEEIRTTNPVATEQYGCVAELLQRGNM

SEQ ID NO: 24976 - protein, 28 aa, Artificial Sequence
  Description of Artificial Sequence: Synthetic peptide
NEEEIRTTNPVATEQYGCSSTALQRQDR

SEQ ID NO: 24977 - protein, 32 aa, Artificial Sequence
  Description of Artificial Sequence: Synthetic polypeptide
DEEEIRTTNPVATEQYGCVSTNLNQRSGSNQA

SEQ ID NO: 24978 - protein, 32 aa, Artificial Sequence
  Description of Artificial Sequence: Synthetic polypeptide
DEEEIRTTNPVATEQYGCVSTNLNQRSGSDRM

SEQ ID NO: 24979 - protein, 31 aa, Artificial Sequence
  Description of Artificial Sequence: Synthetic polypeptide
DEEEIRTTNPVATEQYGSVSTNLLDFGNGEE

SEQ ID NO: 24980 - protein, 30 aa, Artificial Sequence
  Description of Artificial Sequence: Synthetic polypeptide
DEDEIATTNPVATEQYGCVSTNLQERGNEN

SEQ ID NO: 24981 - protein, 29 aa, Artificial Sequence
  Description of Artificial Sequence: Synthetic peptide
NEEEIRTTNPVATEQWGSCSTALQRQGDR

SEQ ID NO: 24982 - protein, 31 aa, Artificial Sequence
  Description of Artificial Sequence: Synthetic polypeptide
DEEEIRTTNPVATEQYGSVSTNLLEMGGNQG

SEQ ID NO: 24983 - protein, 29 aa, Artificial Sequence
  Description of Artificial Sequence: Synthetic peptide
DEEEIRTTNPCATESYGSCSTNELARGNE

SEQ ID NO: 24984 - protein, 28 aa, Artificial Sequence
  Description of Artificial Sequence: Synthetic peptide
DEDEIATTNPVATEQYGCVSTNLQQGDV

SEQ ID NO: 24985 - protein, 32 aa, Artificial Sequence
  Description of Artificial Sequence: Synthetic polypeptide
DEEEIRTTNPVATEQYGSVSTNLLEQGGENQS

SEQ ID NO: 24986 - protein, 30 aa, Artificial Sequence
  Description of Artificial Sequence: Synthetic polypeptide
DEEEIRTTNPVATEQYGCVSTNLQDGDGTA

SEQ ID NO: 24987 - protein, 30 aa, Artificial Sequence
  Description of Artificial Sequence: Synthetic polypeptide
DEEEIRTTNPVATEQYGCVSTNLLQNGDTD

SEQ ID NO: 24988 - protein, 31 aa, Artificial Sequence
  Description of Artificial Sequence: Synthetic polypeptide
DEEEIRTTNPVATEQYGCVSTNLIREGSNPQ

SEQ ID NO: 24989 - protein, 29 aa, Artificial Sequence
  Description of Artificial Sequence: Synthetic peptide
NEEEIRCTNPIATEQYGSVSENLMRGNMR

SEQ ID NO: 24990 - protein, 28 aa, Artificial Sequence
  Description of Artificial Sequence: Synthetic peptide
NEEEIRCTNPIATEQYGSVSENLMRGND

SEQ ID NO: 24991 - protein, 29 aa, Artificial Sequence
  Description of Artificial Sequence: Synthetic peptide
NEEEIRCTNPIATEQYGSVSENLMRGINR

SEQ ID NO: 24992 - protein, 30 aa, Artificial Sequence
  Description of Artificial Sequence: Synthetic polypeptide
NEEEIRATNPVATEQYGSVSTNLQRNPNED

SEQ ID NO: 24993 - protein, 29 aa, Artificial Sequence
  Description of Artificial Sequence: Synthetic peptide
NEEEIRATNPVATEQYGSVATPNLQAGNV

SEQ ID NO: 24994 - protein, 30 aa, Artificial Sequence
  Description of Artificial Sequence: Synthetic polypeptide
NEEEIRATNPVATEQYGSVATNLQRGENAE

SEQ ID NO: 24995 - protein, 31 aa, Artificial Sequence
  Description of Artificial Sequence: Synthetic polypeptide
DEDEIATTNPVATEQYGEVSTNLQRDGNGER

SEQ ID NO: 24996 - protein, 30 aa, Artificial Sequence
  Description of Artificial Sequence: Synthetic polypeptide
NEEEIRATNPVATEQYGSVATNLERGNDRL

SEQ ID NO: 24997 - protein, 32 aa, Artificial Sequence
  Description of Artificial Sequence: Synthetic polypeptide
DEEEIRTTNPVATEQYGQCQVSTNLQRGSNIQ

SEQ ID NO: 24998 - protein, 29 aa, Artificial Sequence
  Description of Artificial Sequence: Synthetic peptide
DEEEIRTTNPVATEQYGCVSTNLHDIQNQ

SEQ ID NO: 24999 - protein, 29 aa, Artificial Sequence
  Description of Artificial Sequence: Synthetic peptide
NEEEIRATNPVATEGYGSVSTNLQAGNNH

SEQ ID NO: 25000 - protein, 28 aa, Artificial Sequence
  Description of Artificial Sequence: Synthetic peptide
NEEEIRCTNPVGTEQYGDVSTNVQRGNA

SEQ ID NO: 25001 - protein, 30 aa, Artificial Sequence
  Description of Artificial Sequence: Synthetic polypeptide
DEEEIRPTNPVATEQYGSVSVNQDRGTNYR

SEQ ID NO: 25002 - protein, 31 aa, Artificial Sequence
  Description of Artificial Sequence: Synthetic polypeptide
DEEEIRTTNPVATEQYGSVSTNLITGNNIIG

SEQ ID NO: 25003 - protein, 30 aa, Artificial Sequence
  Description of Artificial Sequence: Synthetic polypeptide
DEEEIRTTNPVATEQYGCVSTNLQDGEGDN

SEQ ID NO: 25004 - protein, 28 aa, Artificial Sequence
  Description of Artificial Sequence: Synthetic peptide
SEEEIACTNPVATECYGSVSENLQRGER

SEQ ID NO: 25005 - protein, 31 aa, Artificial Sequence
  Description of Artificial Sequence: Synthetic polypeptide
DEEEIRTTNPVATEQYGSVSTMLQQGVNGEP

SEQ ID NO: 25006 - protein, 29 aa, Artificial Sequence
  Description of Artificial Sequence: Synthetic peptide
NEEEIRTTNPVATEQYGSFSTALQRQGRS

SEQ ID NO: 25007 - protein, 30 aa, Artificial Sequence
  Description of Artificial Sequence: Synthetic polypeptide
DEECIRTTNPVATEQYGCVSTGNLQNGNQA

SEQ ID NO: 25008 - protein, 30 aa, Artificial Sequence
  Description of Artificial Sequence: Synthetic polypeptide
DEEEIRQTNPVATEQFGSVWSTNNGQRGER

SEQ ID NO: 25009 - protein, 31 aa, Artificial Sequence
  Description of Artificial Sequence: Synthetic polypeptide
DEEEIRTTNPVATEQYGCVSTNLQERITERM

SEQ ID NO: 25010 - protein, 28 aa, Artificial Sequence
  Description of Artificial Sequence: Synthetic peptide
NEEEIRTTNPVATEQYGSCSTHLQRQGS

SEQ ID NO: 25011 - protein, 31 aa, Artificial Sequence
  Description of Artificial Sequence: Synthetic polypeptide
AEEEIRTTNPVATEQYGSVSTVTNLQSNGNT

SEQ ID NO: 25012 - protein, 30 aa, Artificial Sequence
  Description of Artificial Sequence: Synthetic polypeptide
DEEEIRTTNPVATEQYGCVSTNLQEGTEGM

SEQ ID NO: 25013 - protein, 28 aa, Artificial Sequence
  Description of Artificial Sequence: Synthetic peptide
NEEEIRTTNPVATEQYGSCSTDLQRQGV

SEQ ID NO: 25014 - protein, 30 aa, Artificial Sequence
  Description of Artificial Sequence: Synthetic polypeptide
NEEEIRTTNPVATEQYGSCSTDLQRHQGDR

SEQ ID NO: 25015 - protein, 29 aa, Artificial Sequence
  Description of Artificial Sequence: Synthetic peptide
NEEEIRTTNPVATEQYGSCSTALQRQSGR

SEQ ID NO: 25016 - protein, 28 aa, Artificial Sequence
  Description of Artificial Sequence: Synthetic peptide
NEEEIRTTNPVATEQYGSCSTALQRQGE

SEQ ID NO: 25017 - protein, 31 aa, Artificial Sequence
  Description of Artificial Sequence: Synthetic polypeptide
DEEEIRTTNPVATEQYGSVSTMLQQGQGENI

SEQ ID NO: 25018 - protein, 31 aa, Artificial Sequence
  Description of Artificial Sequence: Synthetic polypeptide
DEEEIRTTNPVATEQYGSVSTNLIRGEEVVD

SEQ ID NO: 25019 - protein, 31 aa, Artificial Sequence
  Description of Artificial Sequence: Synthetic polypeptide
DEEEIRTTNPVATEQYGNVTTSTNELQVGNS

SEQ ID NO: 25020 - protein, 30 aa, Artificial Sequence
  Description of Artificial Sequence: Synthetic polypeptide
NEEEIRTTNPVATEQYGSASTQLQRGQGER

SEQ ID NO: 25021 - protein, 28 aa, Artificial Sequence
  Description of Artificial Sequence: Synthetic peptide
NEEEIRTTNPVATEQYGSASTQLQHQGR

SEQ ID NO: 25022 - protein, 31 aa, Artificial Sequence
  Description of Artificial Sequence: Synthetic polypeptide
DEEEIRTTNPVATEQYGCVSTNLQEETGTNV

SEQ ID NO: 25023 - protein, 28 aa, Artificial Sequence
  Description of Artificial Sequence: Synthetic peptide
SEEEIACTNPVATEPYGSVSTNLQRQDR

SEQ ID NO: 25024 - protein, 29 aa, Artificial Sequence
  Description of Artificial Sequence: Synthetic peptide
NEEEIRTTNPVATEQYGSASITHLQRQGR

SEQ ID NO: 25025 - protein, 30 aa, Artificial Sequence
  Description of Artificial Sequence: Synthetic polypeptide
DEEEIRTTNPVATEQYGSVSTNLIRTEFVT

SEQ ID NO: 25026 - protein, 31 aa, Artificial Sequence
  Description of Artificial Sequence: Synthetic polypeptide
DEEEIRTTNPVATEQYGCVSTNLQDRPDNDE

SEQ ID NO: 25027 - protein, 30 aa, Artificial Sequence
  Description of Artificial Sequence: Synthetic polypeptide
DEEEIRTTNPVATEQYGCVSTNLQDLNDEA

SEQ ID NO: 25028 - protein, 31 aa, Artificial Sequence
  Description of Artificial Sequence: Synthetic polypeptide
DEEEIRTTNPVATEQYGSVSTNLISGTGVNQ

SEQ ID NO: 25029 - protein, 31 aa, Artificial Sequence
  Description of Artificial Sequence: Synthetic polypeptide
DEEEIRTTNPVATEQYGSVSTNLITGGGNIG

SEQ ID NO: 25030 - protein, 31 aa, Artificial Sequence
  Description of Artificial Sequence: Synthetic polypeptide
DEEEIRTTNPVATEQYGCVSTNLQDGPGDRP

SEQ ID NO: 25031 - protein, 31 aa, Artificial Sequence
  Description of Artificial Sequence: Synthetic polypeptide
DEEEIRTTNPVATEQYGSVSTNLIGFGNTGE

SEQ ID NO: 25032 - protein, 30 aa, Artificial Sequence
  Description of Artificial Sequence: Synthetic polypeptide
DEEEIRTTNPMATEQYGSVAATDLQRGNGA

SEQ ID NO: 25033 - protein, 31 aa, Artificial Sequence
  Description of Artificial Sequence: Synthetic polypeptide
DEEEIRTTNPVATEQYGSVCEPNLQPRVGER

SEQ ID NO: 25034 - protein, 31 aa, Artificial Sequence
  Description of Artificial Sequence: Synthetic polypeptide
DEEEICTTNPVATEQYGSVCCTNHSQRGNNR

SEQ ID NO: 25035 - protein, 29 aa, Artificial Sequence
  Description of Artificial Sequence: Synthetic peptide
AEEEIRTTNPVATEQYGSVSTNPQQVVNL

SEQ ID NO: 25036 - protein, 30 aa, Artificial Sequence
  Description of Artificial Sequence: Synthetic polypeptide
DEEEIRTTNPVATEQYGSVATNLNHGENMD

SEQ ID NO: 25037 - protein, 30 aa, Artificial Sequence
  Description of Artificial Sequence: Synthetic polypeptide
DESEIRTTNPVATEQYGVVSTDLQRDIGND

SEQ ID NO: 25038 - protein, 30 aa, Artificial Sequence
  Description of Artificial Sequence: Synthetic polypeptide
AEEEIRTTNPVATEQYGSVSTNLLGSGENI

SEQ ID NO: 25039 - protein, 30 aa, Artificial Sequence
  Description of Artificial Sequence: Synthetic polypeptide
AEEEIRTTNPVATEQYGSVSTNPQQGNNEN

SEQ ID NO: 25040 - protein, 28 aa, Artificial Sequence
  Description of Artificial Sequence: Synthetic peptide
DEAEIRTTNSVAYCEYGSVSTNLQRGDR

SEQ ID NO: 25041 - protein, 30 aa, Artificial Sequence
  Description of Artificial Sequence: Synthetic polypeptide
AEEEIRTTNPVATEQYGSVSTNLLGSGNGN

SEQ ID NO: 25042 - protein, 29 aa, Artificial Sequence
  Description of Artificial Sequence: Synthetic peptide
DEAEIRTTNSVAYAQYGSVSTNMLQRGDR

SEQ ID NO: 25043 - protein, 30 aa, Artificial Sequence
  Description of Artificial Sequence: Synthetic polypeptide
AEEEIRTTNPVATEQYGSVSTNLLNNGNSG

SEQ ID NO: 25044 - protein, 29 aa, Artificial Sequence
  Description of Artificial Sequence: Synthetic peptide
DESEIRTTNPVATEQYGVTVSTYLQRPND

SEQ ID NO: 25045 - protein, 30 aa, Artificial Sequence
  Description of Artificial Sequence: Synthetic polypeptide
SEEEIRTTNPVATEWYGSVSNTNLDRGDQR

SEQ ID NO: 25046 - protein, 30 aa, Artificial Sequence
  Description of Artificial Sequence: Synthetic polypeptide
DESEIRTTNPVATEQYGTVSTNNGNQLGNR

SEQ ID NO: 25047 - protein, 30 aa, Artificial Sequence
  Description of Artificial Sequence: Synthetic polypeptide
DESEIRTTNPVATEQYGTVSTNLQPDGNAQ

SEQ ID NO: 25048 - protein, 31 aa, Artificial Sequence
  Description of Artificial Sequence: Synthetic polypeptide
DEEEIRTTNPVATEQYGSVSTQNDGQANGND

SEQ ID NO: 25049 - protein, 29 aa, Artificial Sequence
  Description of Artificial Sequence: Synthetic peptide
DEEEIRTTNPVATEQYGSVATNLERTETD

SEQ ID NO: 25050 - protein, 31 aa, Artificial Sequence
  Description of Artificial Sequence: Synthetic polypeptide
DEEEIRTTNPVATEQYGSVATNLERQENERE

SEQ ID NO: 25051 - protein, 29 aa, Artificial Sequence
  Description of Artificial Sequence: Synthetic peptide
DEEEIRTTNPVATEQYGSVATNLERPPDH

SEQ ID NO: 25052 - protein, 32 aa, Artificial Sequence
  Description of Artificial Sequence: Synthetic polypeptide
DEEEIRTTNPVATEQYGSVSSTNLQMIGGNEF

SEQ ID NO: 25053 - protein, 29 aa, Artificial Sequence
  Description of Artificial Sequence: Synthetic peptide
AEEEIRTTNPVATEQYGSVSTNNVLGTFR

SEQ ID NO: 25054 - protein, 32 aa, Artificial Sequence
  Description of Artificial Sequence: Synthetic polypeptide
DEEEIRTTNPVATEQYGSVSENLQRMGMNVIT

SEQ ID NO: 25055 - protein, 31 aa, Artificial Sequence
  Description of Artificial Sequence: Synthetic polypeptide
DEEEIRTTNPVATEQYGSVSTPLQVEGVNDV

SEQ ID NO: 25056 - protein, 31 aa, Artificial Sequence
  Description of Artificial Sequence: Synthetic polypeptide
DEEEIRTTNPVATEQYGSVSETNLQNGQMVD

SEQ ID NO: 25057 - protein, 29 aa, Artificial Sequence
  Description of Artificial Sequence: Synthetic peptide
DESEIRTTNPVATEQYGVVSTDLQRMEND

SEQ ID NO: 25058 - protein, 31 aa, Artificial Sequence
  Description of Artificial Sequence: Synthetic polypeptide
AEEEIRTTNPVATEQYGSVSTNQLQQGVGNN

SEQ ID NO: 25059 - protein, 31 aa, Artificial Sequence
  Description of Artificial Sequence: Synthetic polypeptide
AEEEIRTTNPVATEQYGSVSTNQLQNEGNIE

SEQ ID NO: 25060 - protein, 30 aa, Artificial Sequence
  Description of Artificial Sequence: Synthetic polypeptide
DESEIRTTNPVATERYGSVSTNLQEGGNMG

SEQ ID NO: 25061 - protein, 29 aa, Artificial Sequence
  Description of Artificial Sequence: Synthetic peptide
DEEEIRTTNPVATEQYGSVATNLNRTTPE

SEQ ID NO: 25062 - protein, 30 aa, Artificial Sequence
  Description of Artificial Sequence: Synthetic polypeptide
AEEEIRTTNPVATEQYGSVSTNQLNTNGNA

SEQ ID NO: 25063 - protein, 31 aa, Artificial Sequence
  Description of Artificial Sequence: Synthetic polypeptide
AEEEIRTTNPVATEQYGSVSTNQLIQTVGNH

SEQ ID NO: 25064 - protein, 31 aa, Artificial Sequence
  Description of Artificial Sequence: Synthetic polypeptide
DEEEIRTTNPVATEQYGSVSENLQRIMVNIT

SEQ ID NO: 25065 - protein, 31 aa, Artificial Sequence
  Description of Artificial Sequence: Synthetic polypeptide
DEEEIRTTNPVATEQYGSVSTPLQSDGNNQG

SEQ ID NO: 25066 - protein, 32 aa, Artificial Sequence
  Description of Artificial Sequence: Synthetic polypeptide
DESEIRTTNPVATERYGSTVSTNLSQRGGNRW

SEQ ID NO: 25067 - protein, 32 aa, Artificial Sequence
  Description of Artificial Sequence: Synthetic polypeptide
DEEEIRTTNPVATEQYGSVSETNLQMGGNNGM

SEQ ID NO: 25068 - protein, 30 aa, Artificial Sequence
  Description of Artificial Sequence: Synthetic polypeptide
DEEEIRTTNPVATEQYGSVATNLNRGDTLM

SEQ ID NO: 25069 - protein, 28 aa, Artificial Sequence
  Description of Artificial Sequence: Synthetic peptide
DEAEIRTTNVVAYMQYGSVSTNLQRGDV

SEQ ID NO: 25070 - protein, 30 aa, Artificial Sequence
  Description of Artificial Sequence: Synthetic polypeptide
DEDEIRTTNPVATEAYGSVSTNLQGDGNAN

SEQ ID NO: 25071 - protein, 28 aa, Artificial Sequence
  Description of Artificial Sequence: Synthetic peptide
DEAEIRTTNVVAYCQYGSVSTNQQRGDR

SEQ ID NO: 25072 - protein, 33 aa, Artificial Sequence
  Description of Artificial Sequence: Synthetic polypeptide
DEEEICTTNPVATEQYGSVVSTNALSQRGGNNR

SEQ ID NO: 25073 - protein, 29 aa, Artificial Sequence
  Description of Artificial Sequence: Synthetic peptide
DESEIRTTNPVATEQYGVVSTTLQREDND

SEQ ID NO: 25074 - protein, 29 aa, Artificial Sequence
  Description of Artificial Sequence: Synthetic peptide
DESEIRTTNPVATEQYGVVSTILQRPNND

SEQ ID NO: 25075 - protein, 30 aa, Artificial Sequence
  Description of Artificial Sequence: Synthetic polypeptide
DEEEIRTTNPVATEQYGSVSTPLQTDNNDF

SEQ ID NO: 25076 - protein, 29 aa, Artificial Sequence
  Description of Artificial Sequence: Synthetic peptide
DESEIRTTNPVATEQYGVVSTFLQRTPND

SEQ ID NO: 25077 - protein, 30 aa, Artificial Sequence
  Description of Artificial Sequence: Synthetic polypeptide
SEEEIRTTNPVATETYGSVSNTNLHRGPQR

SEQ ID NO: 25078 - protein, 30 aa, Artificial Sequence
  Description of Artificial Sequence: Synthetic polypeptide
AEEEIRTTNPVATEQYGSVSTNQIQGGNDD

SEQ ID NO: 25079 - protein, 30 aa, Artificial Sequence
  Description of Artificial Sequence: Synthetic polypeptide
AEEEIRTTNPVATEQYGSVSTNLLEGGGND

SEQ ID NO: 25080 - protein, 31 aa, Artificial Sequence
  Description of Artificial Sequence: Synthetic polypeptide
DEEEICTTNPVATEQYGSVSTTQLQERMGNL

SEQ ID NO: 25081 - protein, 32 aa, Artificial Sequence
  Description of Artificial Sequence: Synthetic polypeptide
DEEEIRTTNPVATEQYGSVATNLERPGGNPRE

SEQ ID NO: 25082 - protein, 30 aa, Artificial Sequence
  Description of Artificial Sequence: Synthetic polypeptide
AEEEIRTTNPVATEQYGSVSTNLLQGQNQD

SEQ ID NO: 25083 - protein, 31 aa, Artificial Sequence
  Description of Artificial Sequence: Synthetic polypeptide
DEEEIRTTNPVATEQYGSVSTPNDLQNNQNM

SEQ ID NO: 25084 - protein, 30 aa, Artificial Sequence
  Description of Artificial Sequence: Synthetic polypeptide
AEEEIRTTNPVATEQYGSVSTNNQSEQGNS

SEQ ID NO: 25085 - protein, 31 aa, Artificial Sequence
  Description of Artificial Sequence: Synthetic polypeptide
DESEIRTTNPVATEQYGSVSTYLIRSGSNTR

SEQ ID NO: 25086 - protein, 32 aa, Artificial Sequence
  Description of Artificial Sequence: Synthetic polypeptide
DEEEICTTNPVATEQYGSVSTNQLQERPGNDL

SEQ ID NO: 25087 - protein, 30 aa, Artificial Sequence
  Description of Artificial Sequence: Synthetic polypeptide
AEEEIRTTNPVATEQYGSVSTNNQQTNGNV

SEQ ID NO: 25088 - protein, 31 aa, Artificial Sequence
  Description of Artificial Sequence: Synthetic polypeptide
DEEEIRTTNPVATEQYGSVATNLERNGDPRL

SEQ ID NO: 25089 - protein, 30 aa, Artificial Sequence
  Description of Artificial Sequence: Synthetic polypeptide
AEEEIRTTNPVATEQYGSVSTNNQQTGTNM

SEQ ID NO: 25090 - protein, 31 aa, Artificial Sequence
  Description of Artificial Sequence: Synthetic polypeptide
DEEEIRTTNPVATEQYGSVSTPNDLTQNQNQ

SEQ ID NO: 25091 - protein, 30 aa, Artificial Sequence
  Description of Artificial Sequence: Synthetic polypeptide
AEEEIRTTNPVATEQYGSVSTNNQQTGIRT

SEQ ID NO: 25092 - protein, 31 aa, Artificial Sequence
  Description of Artificial Sequence: Synthetic polypeptide
DEEEICTTNPVATEQYGSVSTNQLQEEQGNL

SEQ ID NO: 25093 - protein, 30 aa, Artificial Sequence
  Description of Artificial Sequence: Synthetic polypeptide
DEEEIRTTNPVATEQYGSVATNLERIGEEF

SEQ ID NO: 25094 - protein, 31 aa, Artificial Sequence
  Description of Artificial Sequence: Synthetic polypeptide
DEEEIRTTNPVATEQYGSVSTALQQEQGTNQ

SEQ ID NO: 25095 - protein, 29 aa, Artificial Sequence
  Description of Artificial Sequence: Synthetic peptide
DESEIRTTNPVATEQYGSVSTSLTTGGNP

SEQ ID NO: 25096 - protein, 30 aa, Artificial Sequence
  Description of Artificial Sequence: Synthetic polypeptide
DESEIRTTNPVATEQYGSVSTQNEEQAGNY

SEQ ID NO: 25097 - protein, 30 aa, Artificial Sequence
  Description of Artificial Sequence: Synthetic polypeptide
AEEEIRTTNPVATEQYGSVSTNNQQPGNSA

SEQ ID NO: 25098 - protein, 30 aa, Artificial Sequence
  Description of Artificial Sequence: Synthetic polypeptide
AEEEIRTTNPVATEQYGSVSTNNQQNDGNF

SEQ ID NO: 25099 - protein, 30 aa, Artificial Sequence
  Description of Artificial Sequence: Synthetic polypeptide
DEEEIRTTNPVATEQYGSVATNLERGPTDI

SEQ ID NO: 25100 - protein, 31 aa, Artificial Sequence
  Description of Artificial Sequence: Synthetic polypeptide
DEEEIRTTNPVATEQYGSVSTALQNQGNNNA

SEQ ID NO: 25101 - protein, 31 aa, Artificial Sequence
  Description of Artificial Sequence: Synthetic polypeptide
DEEEIRTTNPVATEQYGSVSTPNDDQRDIER

SEQ ID NO: 25102 - protein, 30 aa, Artificial Sequence
  Description of Artificial Sequence: Synthetic polypeptide
DESEIRTTNPVATEQYGSVSWPLQRGDQRD

SEQ ID NO: 25103 - protein, 31 aa, Artificial Sequence
  Description of Artificial Sequence: Synthetic polypeptide
DEEEIRTTNPVATEQYGSVSTQLVQNFGGNA

SEQ ID NO: 25104 - protein, 31 aa, Artificial Sequence
  Description of Artificial Sequence: Synthetic polypeptide
DEEEICTTNPVATEQYGSVSTNSLYQVRGEF

SEQ ID NO: 25105 - protein, 32 aa, Artificial Sequence
  Description of Artificial Sequence: Synthetic polypeptide
DEEEIRTTNPVATEQYGSVSTPMLQREGVNID

SEQ ID NO: 25106 - protein, 31 aa, Artificial Sequence
  Description of Artificial Sequence: Synthetic polypeptide
DESEIRTTNPVATEQYGSVVSTTNLEVGNIR

SEQ ID NO: 25107 - protein, 30 aa, Artificial Sequence
  Description of Artificial Sequence: Synthetic polypeptide
DESEIRTTNPVATEQYGSVVSTSNLQQGDF

SEQ ID NO: 25108 - protein, 29 aa, Artificial Sequence
  Description of Artificial Sequence: Synthetic peptide
DEECIMTTNPVATEPYGSVNTNTLQRGNM

SEQ ID NO: 25109 - protein, 30 aa, Artificial Sequence
  Description of Artificial Sequence: Synthetic polypeptide
AEEEIRTTNPVATEQYGSVSTNNTQGTNNR

SEQ ID NO: 25110 - protein, 30 aa, Artificial Sequence
  Description of Artificial Sequence: Synthetic polypeptide
DEEEIRTTNPVATEQYGSVSENLQSPENYT

SEQ ID NO: 25111 - protein, 29 aa, Artificial Sequence
  Description of Artificial Sequence: Synthetic peptide
DEQEIATTNPIATEQYGSVSATDLMRGNR

SEQ ID NO: 25112 - protein, 30 aa, Artificial Sequence
  Description of Artificial Sequence: Synthetic polypeptide
DEEEIRTTNPVATEQYGSVSENLQSSENYV

SEQ ID NO: 25113 - protein, 31 aa, Artificial Sequence
  Description of Artificial Sequence: Synthetic polypeptide
DEEEIRTTNPVATEQYGSVSTALQQGMNEQE

SEQ ID NO: 25114 - protein, 32 aa, Artificial Sequence
  Description of Artificial Sequence: Synthetic polypeptide
DEEEIRTTNPVATEQYGSVSTQNALSQTGGNE

SEQ ID NO: 25115 - protein, 32 aa, Artificial Sequence
  Description of Artificial Sequence: Synthetic polypeptide
DESEIRTTNPVATEQYGSVVSTGNLSQRSGSR

SEQ ID NO: 25116 - protein, 30 aa, Artificial Sequence
  Description of Artificial Sequence: Synthetic polypeptide
DESEIRTTNPVATEQYGSVVSTGLQTGNQP

SEQ ID NO: 25117 - protein, 30 aa, Artificial Sequence
  Description of Artificial Sequence: Synthetic polypeptide
DEAEIRTTNPVSTEQYGSVSTNLQGGNDQL

SEQ ID NO: 25118 - protein, 32 aa, Artificial Sequence
  Description of Artificial Sequence: Synthetic polypeptide
DEEEIRTTNPVATEQYGSVSSTNLQNGGGNED

SEQ ID NO: 25119 - protein, 29 aa, Artificial Sequence
  Description of Artificial Sequence: Synthetic peptide
DEECIRTTNPVAYEQYGQVSTINHQRGNQ

SEQ ID NO: 25120 - protein, 31 aa, Artificial Sequence
  Description of Artificial Sequence: Synthetic polypeptide
DEEEIRTTNPVATEQYGSVSTALQQGENGGE

SEQ ID NO: 25121 - protein, 31 aa, Artificial Sequence
  Description of Artificial Sequence: Synthetic polypeptide
DEEEIRTTNPVATEQYGSVATNLERNGENPY

SEQ ID NO: 25122 - protein, 28 aa, Artificial Sequence
  Description of Artificial Sequence: Synthetic peptide
DEQEIATTNPVATECYGSVSTDLQHGNL

SEQ ID NO: 25123 - protein, 29 aa, Artificial Sequence
  Description of Artificial Sequence: Synthetic peptide
SEEEIRTTNPVATEYYGSVSTNLSDEGNN

SEQ ID NO: 25124 - protein, 29 aa, Artificial Sequence
  Description of Artificial Sequence: Synthetic peptide
DEECIRTTNPVAYEQYGQVSTINIQRGNN

SEQ ID NO: 25125 - protein, 31 aa, Artificial Sequence
  Description of Artificial Sequence: Synthetic polypeptide
DEEEIRTTNPVATEQYGSVATNLERPGDNYY

SEQ ID NO: 25126 - protein, 31 aa, Artificial Sequence
  Description of Artificial Sequence: Synthetic polypeptide
AEEEIRTTNPVATEQYGSVSTNLLQNDGNTE

SEQ ID NO: 25127 - protein, 31 aa, Artificial Sequence
  Description of Artificial Sequence: Synthetic polypeptide
AEEEIRTTNPVATEQYGSVSTNQLQTGGTNT

SEQ ID NO: 25128 - protein, 30 aa, Artificial Sequence
  Description of Artificial Sequence: Synthetic polypeptide
AEEEIRTTNPVATEQYGSVSTNLLDNIGNT

SEQ ID NO: 25129 - protein, 28 aa, Artificial Sequence
  Description of Artificial Sequence: Synthetic peptide
DESEIRTTNPVAYAQYGCVSTNLERGNP

SEQ ID NO: 25130 - protein, 28 aa, Artificial Sequence
  Description of Artificial Sequence: Synthetic peptide
DESEIRTTNPVAYAHYGSVSTNLQRENM

SEQ ID NO: 25131 - protein, 29 aa, Artificial Sequence
  Description of Artificial Sequence: Synthetic peptide
DESEIRTTNPVAVEQYGSYSTNLERNPNR

SEQ ID NO: 25132 - protein, 29 aa, Artificial Sequence
  Description of Artificial Sequence: Synthetic peptide
DESEIRTTNPVAVEQYGSVISTNLETNNR

SEQ ID NO: 25133 - protein, 30 aa, Artificial Sequence
  Description of Artificial Sequence: Synthetic polypeptide
AEEEIRTTNPVATEQYGSVSTNQQTGNQEQ

SEQ ID NO: 25134 - protein, 30 aa, Artificial Sequence
  Description of Artificial Sequence: Synthetic polypeptide
AEEEIRTTNPVATEQYGSVSTNQQSNDGND

SEQ ID NO: 25135 - protein, 28 aa, Artificial Sequence
  Description of Artificial Sequence: Synthetic peptide
DEECIRCTNPVATEQYGDVSWNIQRGNC

SEQ ID NO: 25136 - protein, 31 aa, Artificial Sequence
  Description of Artificial Sequence: Synthetic polypeptide
DEEEIRTTNPVATEQYGSVSTANEQELGNTN

SEQ ID NO: 25137 - protein, 29 aa, Artificial Sequence
  Description of Artificial Sequence: Synthetic peptide
AEEEIRTTNPVATEQYGSVSTNQQQNGEL

SEQ ID NO: 25138 - protein, 29 aa, Artificial Sequence
  Description of Artificial Sequence: Synthetic peptide
DESEIRTTNPVATTPYGSVSTNLQRTNIM

SEQ ID NO: 25139 - protein, 28 aa, Artificial Sequence
  Description of Artificial Sequence: Synthetic peptide
DESEIRTTNPVATTNYGSVSTNLQLTNM

SEQ ID NO: 25140 - protein, 31 aa, Artificial Sequence
  Description of Artificial Sequence: Synthetic polypeptide
DEEEIRTTNPVATEQYGSVSTANDQNGNEME

SEQ ID NO: 25141 - protein, 31 aa, Artificial Sequence
  Description of Artificial Sequence: Synthetic polypeptide
DEPEISTTNPVATEQYGSVSTENLQRFGSND

SEQ ID NO: 25142 - protein, 28 aa, Artificial Sequence
  Description of Artificial Sequence: Synthetic peptide
DESEIRTTNPVATTIYGSVNTNLQRTNM

SEQ ID NO: 25143 - protein, 30 aa, Artificial Sequence
  Description of Artificial Sequence: Synthetic polypeptide
AEEEIRTTNPVATEQYGSVSTNLINGENGG

SEQ ID NO: 25144 - protein, 29 aa, Artificial Sequence
  Description of Artificial Sequence: Synthetic peptide
DESEIRTTNPVATTHYGSVSTNLQRENMQ

SEQ ID NO: 25145 - protein, 29 aa, Artificial Sequence
  Description of Artificial Sequence: Synthetic peptide
DESEIRTTNPVATTAYGSVVSTNLQRVNM

SEQ ID NO: 25146 - protein, 31 aa, Artificial Sequence
  Description of Artificial Sequence: Synthetic polypeptide
CEEEIRTTNPVATEAYGSVVSTNMLSQRGNQ

SEQ ID NO: 25147 - protein, 28 aa, Artificial Sequence
  Description of Artificial Sequence: Synthetic peptide
DEEEIATTNPVCTEQYGSVSEDLQHGNA

SEQ ID NO: 25148 - protein, 32 aa, Artificial Sequence
  Description of Artificial Sequence: Synthetic polypeptide
DEEEIRTTNPVATEQYGSTVSTALSQNRGGSR

SEQ ID NO: 25149 - protein, 34 aa, Artificial Sequence
  Description of Artificial Sequence: Synthetic polypeptide
DEEEIRTTNPVATEQYGSTVSMTENLSQRDGDNR

SEQ ID NO: 25150 - protein, 29 aa, Artificial Sequence
  Description of Artificial Sequence: Synthetic peptide
DESEIRTTNPVAYDHYGSVSTNLQREGNM

SEQ ID NO: 25151 - protein, 29 aa, Artificial Sequence
  Description of Artificial Sequence: Synthetic peptide
AEEEIRTTNPVATEQYGSVSTNQQVVNVT

SEQ ID NO: 25152 - protein, 30 aa, Artificial Sequence
  Description of Artificial Sequence: Synthetic polypeptide
SEEEIRTTNPVATESYGSVSPTNLERGPQR

SEQ ID NO: 25153 - protein, 31 aa, Artificial Sequence
  Description of Artificial Sequence: Synthetic polypeptide
DEEEIRTTNPVATEQYGSVSETNLQQGEEEP

SEQ ID NO: 25154 - protein, 33 aa, Artificial Sequence
  Description of Artificial Sequence: Synthetic polypeptide
DEEEIRTTNPVATEQYGSTVSCTNLSQRSGSRP

SEQ ID NO: 25155 - protein, 31 aa, Artificial Sequence
  Description of Artificial Sequence: Synthetic polypeptide
DEEEIRTTNPVATEQYGSVSTPLQETNGENI

SEQ ID NO: 25156 - protein, 31 aa, Artificial Sequence
  Description of Artificial Sequence: Synthetic polypeptide
DEEEIRTTNPVATEQYGSVSTPLQEVGGNGN

SEQ ID NO: 25157 - protein, 30 aa, Artificial Sequence
  Description of Artificial Sequence: Synthetic polypeptide
SEEEIRTTNPVATESYGSVSPTNLGRGDQR

SEQ ID NO: 25158 - protein, 31 aa, Artificial Sequence
  Description of Artificial Sequence: Synthetic polypeptide
DEEEIRTTNPVATEQYGSVSTPLQFEGNNQE

SEQ ID NO: 25159 - protein, 30 aa, Artificial Sequence
  Description of Artificial Sequence: Synthetic polypeptide
SEEEIRTTNPVATESYGSVSPTNLMRGDQR

SEQ ID NO: 25160 - protein, 31 aa, Artificial Sequence
  Description of Artificial Sequence: Synthetic polypeptide
DEEEIRTTNPVATEQYGSVSTPLQFGGGNGQ

SEQ ID NO: 25161 - protein, 28 aa, Artificial Sequence
  Description of Artificial Sequence: Synthetic peptide
DESEIRTTNPVATTAYGSVSTNLQVTNF

SEQ ID NO: 25162 - protein, 31 aa, Artificial Sequence
  Description of Artificial Sequence: Synthetic polypeptide
DEEEIRTTNPVATEQYGSVSTPLQFGGNNQE

SEQ ID NO: 25163 - protein, 32 aa, Artificial Sequence
  Description of Artificial Sequence: Synthetic polypeptide
DEEEIRTTNPVATEQYGSVSTPLQGGSINDRG

SEQ ID NO: 25164 - protein, 29 aa, Artificial Sequence
  Description of Artificial Sequence: Synthetic peptide
DESEIRTTNPVAYEQWGSVSTNLQGDGNH

SEQ ID NO: 25165 - protein, 31 aa, Artificial Sequence
  Description of Artificial Sequence: Synthetic polypeptide
DEEEIRTTNPVATEQYGSVSTPLQGRMIQRS

SEQ ID NO: 25166 - protein, 32 aa, Artificial Sequence
  Description of Artificial Sequence: Synthetic polypeptide
DEEEIRTTNPVATEQYGSTVSCTNMLQRVTNM

SEQ ID NO: 25167 - protein, 31 aa, Artificial Sequence
  Description of Artificial Sequence: Synthetic polypeptide
DEEEIRTTNPVATEQYGCVCSTNLQHGSNIP

SEQ ID NO: 25168 - protein, 29 aa, Artificial Sequence
  Description of Artificial Sequence: Synthetic peptide
AEEEIRTTNPVATEQYGSVSTNLILGIEQ

SEQ ID NO: 25169 - protein, 30 aa, Artificial Sequence
  Description of Artificial Sequence: Synthetic polypeptide
SEEEIRTTNPVATESYGSVSTTNLARGFQR

SEQ ID NO: 25170 - protein, 30 aa, Artificial Sequence
  Description of Artificial Sequence: Synthetic polypeptide
AEEEIRTTNPVATEQYGSVSTNQTQDLGNN

SEQ ID NO: 25171 - protein, 32 aa, Artificial Sequence
  Description of Artificial Sequence: Synthetic polypeptide
DEEEIRTTNPVATEQYGSTVSDTNALSQTGMR

SEQ ID NO: 25172 - protein, 30 aa, Artificial Sequence
  Description of Artificial Sequence: Synthetic polypeptide
AEEEIRTTNPVATEQYGSVSTNSTIQQGNV

SEQ ID NO: 25173 - protein, 30 aa, Artificial Sequence
  Description of Artificial Sequence: Synthetic polypeptide
AEEEIRTTNPVATEQYGSVSTNLLDTGNNN

SEQ ID NO: 25174 - protein, 33 aa, Artificial Sequence
  Description of Artificial Sequence: Synthetic polypeptide
DEEEIRTTNPVATEQYGSTVSTGNLSQSGGNYR

SEQ ID NO: 25175 - protein, 33 aa, Artificial Sequence
  Description of Artificial Sequence: Synthetic polypeptide
DEEEIRTTNPVATEQYGSTVSTGSLSQRGGNNR

SEQ ID NO: 25176 - protein, 30 aa, Artificial Sequence
  Description of Artificial Sequence: Synthetic polypeptide
DEEEIRTTNPVATEQYGSVATNLQAENPGQ

SEQ ID NO: 25177 - protein, 30 aa, Artificial Sequence
  Description of Artificial Sequence: Synthetic polypeptide
DEEEIRTTNPVATEQYGSVSTQNDNLIGNG

SEQ ID NO: 25178 - protein, 30 aa, Artificial Sequence
  Description of Artificial Sequence: Synthetic polypeptide
AEEEIRTTNPVATEQYGSVSTNQNQQGNSA

SEQ ID NO: 25179 - protein, 33 aa, Artificial Sequence
  Description of Artificial Sequence: Synthetic polypeptide
DEEEIRTTNPVATEQYGSTVSTNELSQRPGGPR

SEQ ID NO: 25180 - protein, 32 aa, Artificial Sequence
  Description of Artificial Sequence: Synthetic polypeptide
CEEEIRTTNPVATEAYGSVSCTNNLSQRGNNR

SEQ ID NO: 25181 - protein, 30 aa, Artificial Sequence
  Description of Artificial Sequence: Synthetic polypeptide
SEEEIRTTNPVATESYGSVSVTNLHRVDNR

SEQ ID NO: 25182 - protein, 31 aa, Artificial Sequence
  Description of Artificial Sequence: Synthetic polypeptide
AEEEIRTTNPVATEQYGSVSTNLIQLGNGGE

SEQ ID NO: 25183 - protein, 30 aa, Artificial Sequence
  Description of Artificial Sequence: Synthetic polypeptide
SEEEIRTTNPVATESYGSVSVTNLVRGDQR

SEQ ID NO: 25184 - protein, 32 aa, Artificial Sequence
  Description of Artificial Sequence: Synthetic polypeptide
CEEEIRTTNPVATEAYGSTVSTNMLSQRGNNR

SEQ ID NO: 25185 - protein, 32 aa, Artificial Sequence
  Description of Artificial Sequence: Synthetic polypeptide
DEEEIRTTNPVATEQYGSTVSTNGSQTGGNRH

SEQ ID NO: 25186 - protein, 30 aa, Artificial Sequence
  Description of Artificial Sequence: Synthetic polypeptide
AEEEIRTTNPVATEQYGSVSTNLIQNENNG

SEQ ID NO: 25187 - protein, 28 aa, Artificial Sequence
  Description of Artificial Sequence: Synthetic peptide
DESEIRTTNPVATKGYGSVSTNLARTND

SEQ ID NO: 25188 - protein, 30 aa, Artificial Sequence
  Description of Artificial Sequence: Synthetic polypeptide
AEEEIRTTNPVATEQYGSVSTNLIQNGTTT

SEQ ID NO: 25189 - protein, 28 aa, Artificial Sequence
  Description of Artificial Sequence: Synthetic peptide
DESEIRTTNPVATKGYGSVSTNIQRTNG

SEQ ID NO: 25190 - protein, 31 aa, Artificial Sequence
  Description of Artificial Sequence: Synthetic polypeptide
AEEEIRTTNPVATEQYGSVSTNQNLQIGTNE

SEQ ID NO: 25191 - protein, 30 aa, Artificial Sequence
  Description of Artificial Sequence: Synthetic polypeptide
AEEEIRTTNPVATEQYGSVSTNQNLQETND

SEQ ID NO: 25192 - protein, 31 aa, Artificial Sequence
  Description of Artificial Sequence: Synthetic polypeptide
AEEEIRTTNPVATEQYGSVSTNLIQQQGNNV

SEQ ID NO: 25193 - protein, 32 aa, Artificial Sequence
  Description of Artificial Sequence: Synthetic polypeptide
DEEEIRTTNPVATEQYGSVATNLPQNRNGNEP

SEQ ID NO: 25194 - protein, 31 aa, Artificial Sequence
  Description of Artificial Sequence: Synthetic polypeptide
DEEEIRTTNPVATEQYGSVSTPLQRNINNQS

SEQ ID NO: 25195 - protein, 29 aa, Artificial Sequence
  Description of Artificial Sequence: Synthetic peptide
DESEIRTTNPVATKHYGSVSTNLSQRVNG

SEQ ID NO: 25196 - protein, 29 aa, Artificial Sequence
  Description of Artificial Sequence: Synthetic peptide
DEQAICTTNPVATEQYGSVASTNLIIGNR

SEQ ID NO: 25197 - protein, 33 aa, Artificial Sequence
  Description of Artificial Sequence: Synthetic polypeptide
DEEEIRTTNPVATEQYGSTVSTNELSQNTGNNR

SEQ ID NO: 25198 - protein, 30 aa, Artificial Sequence
  Description of Artificial Sequence: Synthetic polypeptide
DEEEIRTTNPVATEQYGSVATNLQAGEDGN

SEQ ID NO: 25199 - protein, 32 aa, Artificial Sequence
  Description of Artificial Sequence: Synthetic polypeptide
DEEEIRTTNPVATEQYGSTVSTHLSGRGGNNR

SEQ ID NO: 25200 - protein, 31 aa, Artificial Sequence
  Description of Artificial Sequence: Synthetic polypeptide
DEEEIRTTNPVATEQYGSVSTANDQGNGNVT

SEQ ID NO: 25201 - protein, 30 aa, Artificial Sequence
  Description of Artificial Sequence: Synthetic polypeptide
DEDEIRTTNPVATEAYGAVSTNLQIDGNER

SEQ ID NO: 25202 - protein, 28 aa, Artificial Sequence
  Description of Artificial Sequence: Synthetic peptide
DESEIRTTNPVATQQYGKVSTNLESGNP

SEQ ID NO: 25203 - protein, 30 aa, Artificial Sequence
  Description of Artificial Sequence: Synthetic polypeptide
AEEEIRTTNPVATEQYGSVSTNQQQGNETQ

SEQ ID NO: 25204 - protein, 29 aa, Artificial Sequence
  Description of Artificial Sequence: Synthetic peptide
DESEIRTTNPVATQQYGCVSCTNLGRGNP

SEQ ID NO: 25205 - protein, 28 aa, Artificial Sequence
  Description of Artificial Sequence: Synthetic peptide
DESEIRTTNPVATQQWGCVSTNLERGNE

SEQ ID NO: 25206 - protein, 30 aa, Artificial Sequence
  Description of Artificial Sequence: Synthetic polypeptide
AEEEIRTTNPVATEQYGSVSTNQQNGETNL

SEQ ID NO: 25207 - protein, 28 aa, Artificial Sequence
  Description of Artificial Sequence: Synthetic peptide
DESEIRTTNPVATQHYGSVSTNLQLMNM

SEQ ID NO: 25208 - protein, 31 aa, Artificial Sequence
  Description of Artificial Sequence: Synthetic polypeptide
CEEEIRTTNPVATEAYGSVSTNLQRFGSERP

SEQ ID NO: 25209 - protein, 28 aa, Artificial Sequence
  Description of Artificial Sequence: Synthetic peptide
DESEIRTTNPVATQHYGSVSTNLERTNM

SEQ ID NO: 25210 - protein, 28 aa, Artificial Sequence
  Description of Artificial Sequence: Synthetic peptide
DEDEIRTTNPVATEAYGKTSTNLQRGDS

SEQ ID NO: 25211 - protein, 30 aa, Artificial Sequence
  Description of Artificial Sequence: Synthetic polypeptide
AEEEIRTTNPVATEQYGSVSTNLIQEITNS

SEQ ID NO: 25212 - protein, 28 aa, Artificial Sequence
  Description of Artificial Sequence: Synthetic peptide
DESEIRTTNPVATLHYGSVSTNLERTNE

SEQ ID NO: 25213 - protein, 32 aa, Artificial Sequence
  Description of Artificial Sequence: Synthetic polypeptide
DEDEIRTTNPVATEAYGSVPSCTNSLSQRGNR

SEQ ID NO: 25214 - protein, 32 aa, Artificial Sequence
  Description of Artificial Sequence: Synthetic polypeptide
DEEEIRTTNPVATEQYGSTVSTNELSGRGGER

SEQ ID NO: 25215 - protein, 30 aa, Artificial Sequence
  Description of Artificial Sequence: Synthetic polypeptide
AEEEIRTTNPVATEQYGSVSTNQQEGNNQN

SEQ ID NO: 25216 - protein, 28 aa, Artificial Sequence
  Description of Artificial Sequence: Synthetic peptide
DEPEIYTTNPVATEQYGSVSTNLMEGMT

SEQ ID NO: 25217 - protein, 29 aa, Artificial Sequence
  Description of Artificial Sequence: Synthetic peptide
AEEEIRTTNPVATEQYGSVSTNQQEDTNG

SEQ ID NO: 25218 - protein, 30 aa, Artificial Sequence
  Description of Artificial Sequence: Synthetic polypeptide
DEEEIRTTNPVATEQYGCVCSTNLQGISNA

SEQ ID NO: 25219 - protein, 31 aa, Artificial Sequence
  Description of Artificial Sequence: Synthetic polypeptide
AEEEIRTTNPVATEQYGSVSTNQQLQAGNEQ

SEQ ID NO: 25220 - protein, 31 aa, Artificial Sequence
  Description of Artificial Sequence: Synthetic polypeptide
DEEEIRTTNPVATEQYGSVSTALQMDGNGQE

SEQ ID NO: 25221 - protein, 31 aa, Artificial Sequence
  Description of Artificial Sequence: Synthetic polypeptide
DESEIRTTNPVATEQYGSVSTNNQHDEGNNR

SEQ ID NO: 25222 - protein, 31 aa, Artificial Sequence
  Description of Artificial Sequence: Synthetic polypeptide
DESEIRTTNPVATEQYGSVSTNNNLQIGNSL

SEQ ID NO: 25223 - protein, 31 aa, Artificial Sequence
  Description of Artificial Sequence: Synthetic polypeptide
DEEEIRTTNPVATEQYGSVATNLEQGGGNPD

SEQ ID NO: 25224 - protein, 32 aa, Artificial Sequence
  Description of Artificial Sequence: Synthetic polypeptide
DEEEIRTTNPVATEQYGSVATNLEQGGDNPRD

SEQ ID NO: 25225 - protein, 32 aa, Artificial Sequence
  Description of Artificial Sequence: Synthetic polypeptide
DEEEIRTTNPVATEQYGSVSSTNLQPDGGNGM

SEQ ID NO: 25226 - protein, 30 aa, Artificial Sequence
  Description of Artificial Sequence: Synthetic polypeptide
DEEEIRTTNPVATEQYGSVATNLEEGDNDI

SEQ ID NO: 25227 - protein, 31 aa, Artificial Sequence
  Description of Artificial Sequence: Synthetic polypeptide
DEEEIRTTNPVATEQYGSVSTAIQRGSEGRN

SEQ ID NO: 25228 - protein, 30 aa, Artificial Sequence
  Description of Artificial Sequence: Synthetic polypeptide
DESEIRTTNPVATEQYGSVSNTNLQNGDIQ

SEQ ID NO: 25229 - protein, 30 aa, Artificial Sequence
  Description of Artificial Sequence: Synthetic polypeptide
AEEEIRTTNPVATEQYGSVSTNNNQNGNLF

SEQ ID NO: 25230 - protein, 30 aa, Artificial Sequence
  Description of Artificial Sequence: Synthetic polypeptide
DEDEIRTTNPVATECYGSVSTELQKGDNQR

SEQ ID NO: 25231 - protein, 30 aa, Artificial Sequence
  Description of Artificial Sequence: Synthetic polypeptide
AEEEIRTTNPVATEQYGSVSTNNNQNAGNH

SEQ ID NO: 25232 - protein, 30 aa, Artificial Sequence
  Description of Artificial Sequence: Synthetic polypeptide
DESEIRTTNPVATEQYGSVSMNNDRGENRD

SEQ ID NO: 25233 - protein, 31 aa, Artificial Sequence
  Description of Artificial Sequence: Synthetic polypeptide
DESEIRTTNPVATEQYGSVSDTWLEQRTQNR

SEQ ID NO: 25234 - protein, 28 aa, Artificial Sequence
  Description of Artificial Sequence: Synthetic peptide
DEEEIRTTNPVATEQYGSVATNLEDPTD

SEQ ID NO: 25235 - protein, 31 aa, Artificial Sequence
  Description of Artificial Sequence: Synthetic polypeptide
DEEEIRTTNPVATEQYGSVSLNLQRGFQAIE

SEQ ID NO: 25236 - protein, 28 aa, Artificial Sequence
  Description of Artificial Sequence: Synthetic peptide
SEHEIRCTNPIATEQYGSVSENLMRGNR

SEQ ID NO: 25237 - protein, 32 aa, Artificial Sequence
  Description of Artificial Sequence: Synthetic polypeptide
DEEEIRTTNPVATEQYGSVSSTNLQPGGGNTT

SEQ ID NO: 25238 - protein, 30 aa, Artificial Sequence
  Description of Artificial Sequence: Synthetic polypeptide
DEDEIRTTNPVATECYGSVSTNLQDAGNLQ

SEQ ID NO: 25239 - protein, 30 aa, Artificial Sequence
  Description of Artificial Sequence: Synthetic polypeptide
DEDEIRTTNPVATECYGSVSTNLQDGGMNQ

SEQ ID NO: 25240 - protein, 28 aa, Artificial Sequence
  Description of Artificial Sequence: Synthetic peptide
SEHEIRATNPVATEQYGSVFTNLQHGNQ

SEQ ID NO: 25241 - protein, 30 aa, Artificial Sequence
  Description of Artificial Sequence: Synthetic polypeptide
DESEIRTTNPVATEQYGSVSCQNLTRNMNR

SEQ ID NO: 25242 - protein, 29 aa, Artificial Sequence
  Description of Artificial Sequence: Synthetic peptide
DESEIRTTNPVATEQYGSVSQALERNMNR

SEQ ID NO: 25243 - protein, 30 aa, Artificial Sequence
  Description of Artificial Sequence: Synthetic polypeptide
DEEEICTTNPVATEQYGSVSTNNQDNGNMP

SEQ ID NO: 25244 - protein, 30 aa, Artificial Sequence
  Description of Artificial Sequence: Synthetic polypeptide
DESEIRTTNPVATEQYGSVSQNHSFRVGNR

SEQ ID NO: 25245 - protein, 29 aa, Artificial Sequence
  Description of Artificial Sequence: Synthetic peptide
DESEIRTTNPVATEQYGSVSQNLFGNLNR

SEQ ID NO: 25246 - protein, 29 aa, Artificial Sequence
  Description of Artificial Sequence: Synthetic peptide
DEQEIATTNPVATEQYGSVATNLQMGNDV

SEQ ID NO: 25247 - protein, 28 aa, Artificial Sequence
  Description of Artificial Sequence: Synthetic peptide
SEEEISCTNPIATEQYGSVSENLMRGNR

SEQ ID NO: 25248 - protein, 30 aa, Artificial Sequence
  Description of Artificial Sequence: Synthetic polypeptide
DESEIRTTNPVATEQYGSVSTENNQSGNFV

SEQ ID NO: 25249 - protein, 32 aa, Artificial Sequence
  Description of Artificial Sequence: Synthetic polypeptide
DESEIRTTNPVATEQYGSVSTEELQRFGSNRY

SEQ ID NO: 25250 - protein, 31 aa, Artificial Sequence
  Description of Artificial Sequence: Synthetic polypeptide
DESEIRTTNPVATEQYGSVSTEDNGQGGNGR

SEQ ID NO: 25251 - protein, 31 aa, Artificial Sequence
  Description of Artificial Sequence: Synthetic polypeptide
DEEEIRTTNPVATEQYGSVSTALDQGGGTNI

SEQ ID NO: 25252 - protein, 30 aa, Artificial Sequence
  Description of Artificial Sequence: Synthetic polypeptide
DEEEICTTNPVATEQYGSVSTNPGQNEGNH

SEQ ID NO: 25253 - protein, 29 aa, Artificial Sequence
  Description of Artificial Sequence: Synthetic peptide
DEEEIRTTNPVAFEQYGSVGTNLQQFDIR

SEQ ID NO: 25254 - protein, 30 aa, Artificial Sequence
  Description of Artificial Sequence: Synthetic polypeptide
AEEEIRTTNPVATEQYGSVSTNLNDSGNEN

SEQ ID NO: 25255 - protein, 28 aa, Artificial Sequence
  Description of Artificial Sequence: Synthetic peptide
SEEEITCTNPIATEQYGSVSENLMRGNR

SEQ ID NO: 25256 - protein, 30 aa, Artificial Sequence
  Description of Artificial Sequence: Synthetic polypeptide
DESEIRTTNPVATEQYGSVSSTNLQSGDIQ

SEQ ID NO: 25257 - protein, 31 aa, Artificial Sequence
  Description of Artificial Sequence: Synthetic polypeptide
DESEIRTTNPVATEQYGSVSQNLTRTNGNNR

SEQ ID NO: 25258 - protein, 30 aa, Artificial Sequence
  Description of Artificial Sequence: Synthetic polypeptide
DEDEIRTTNPVATECWGSVSTNLQGGGDNR

SEQ ID NO: 25259 - protein, 29 aa, Artificial Sequence
  Description of Artificial Sequence: Synthetic peptide
DESEIRTTNPVATEQYGSVSQNLPDNMNR

SEQ ID NO: 25260 - protein, 30 aa, Artificial Sequence
  Description of Artificial Sequence: Synthetic polypeptide
AEEEIRTTNPVATEQYGSVSTNNNQQEGNL

SEQ ID NO: 25261 - protein, 31 aa, Artificial Sequence
  Description of Artificial Sequence: Synthetic polypeptide
DEEEIRTTNPVATEQYGSVSTQLQNRMSNDH

SEQ ID NO: 25262 - protein, 29 aa, Artificial Sequence
  Description of Artificial Sequence: Synthetic peptide
AEEEIRTTNPVATEQYGSVSTNLNEGAEN

SEQ ID NO: 25263 - protein, 31 aa, Artificial Sequence
  Description of Artificial Sequence: Synthetic polypeptide
DEEEIRTTNPVATEQYGSVSTQLQNIGNVTD

SEQ ID NO: 25264 - protein, 29 aa, Artificial Sequence
  Description of Artificial Sequence: Synthetic peptide
DEEEIRTTNPVAFEQYGSVGTNLQVIDQR

SEQ ID NO: 25265 - protein, 28 aa, Artificial Sequence
  Description of Artificial Sequence: Synthetic peptide
DEQEIATTNPVATEQYGSVATPLERGND

SEQ ID NO: 25266 - protein, 29 aa, Artificial Sequence
  Description of Artificial Sequence: Synthetic peptide
SEEEISTTNPVATEQYGSVFTDLERGNRS

SEQ ID NO: 25267 - protein, 30 aa, Artificial Sequence
  Description of Artificial Sequence: Synthetic polypeptide
DESEIRTTNPVATEQYGSVSTGLGQDEQNR

SEQ ID NO: 25268 - protein, 29 aa, Artificial Sequence
  Description of Artificial Sequence: Synthetic peptide
DEEEIRTTNPVATEQYGSVATNLDRTTEE

SEQ ID NO: 25269 - protein, 31 aa, Artificial Sequence
  Description of Artificial Sequence: Synthetic polypeptide
DEEEICTTNPVATEQYGSVSTNLQSNDGNDN

SEQ ID NO: 25270 - protein, 33 aa, Artificial Sequence
  Description of Artificial Sequence: Synthetic polypeptide
DEEEIRTTNPVATEQYGSVSTPNGLQTRGINEI

SEQ ID NO: 25271 - protein, 29 aa, Artificial Sequence
  Description of Artificial Sequence: Synthetic peptide
DEEEIRTTNPVAIEQYGCVSTNLQNLSNQ

SEQ ID NO: 25272 - protein, 30 aa, Artificial Sequence
  Description of Artificial Sequence: Synthetic polypeptide
DEEEICTTNPVATEQYGSVSTNLQNDGDMQ

SEQ ID NO: 25273 - protein, 28 aa, Artificial Sequence
  Description of Artificial Sequence: Synthetic peptide
SEEEIWCTNPIATEQYGSVSENLMRGNR

SEQ ID NO: 25274 - protein, 31 aa, Artificial Sequence
  Description of Artificial Sequence: Synthetic polypeptide
DEEEIRTTNPVATEQYGSVSTQLQFNGNNEE

SEQ ID NO: 25275 - protein, 30 aa, Artificial Sequence
  Description of Artificial Sequence: Synthetic polypeptide
AEEEIRTTNPVATEQYGSVSTNLNLGINQE

SEQ ID NO: 25276 - protein, 28 aa, Artificial Sequence
  Description of Artificial Sequence: Synthetic peptide
SEGEIRCTNPIATEQYGSVSENLQRGTR

SEQ ID NO: 25277 - protein, 28 aa, Artificial Sequence
  Description of Artificial Sequence: Synthetic peptide
SEGEIRCTNPIATEQYGSVSENLMRGNR

SEQ ID NO: 25278 - protein, 31 aa, Artificial Sequence
  Description of Artificial Sequence: Synthetic polypeptide
DEEEICTTNPVATEQYGSVSTNLQHQGGNDS

SEQ ID NO: 25279 - protein, 31 aa, Artificial Sequence
  Description of Artificial Sequence: Synthetic polypeptide
DEEEIRTTNPVATEQYGSVSTQLQEIGNFTQ

SEQ ID NO: 25280 - protein, 28 aa, Artificial Sequence
  Description of Artificial Sequence: Synthetic peptide
DESEIRTTNPVATEQYGSVETNVHREER

SEQ ID NO: 25281 - protein, 28 aa, Artificial Sequence
  Description of Artificial Sequence: Synthetic peptide
SEEEIYCTNPIATEQYGSVSENLMRGNR

SEQ ID NO: 25282 - protein, 28 aa, Artificial Sequence
  Description of Artificial Sequence: Synthetic peptide
SEEEIYCTNPIATEQYGSVSENLNRGNR

SEQ ID NO: 25283 - protein, 31 aa, Artificial Sequence
  Description of Artificial Sequence: Synthetic polypeptide
DEEEIRTTNPVATEQYGSVSTQLQEGGNEED

SEQ ID NO: 25284 - protein, 31 aa, Artificial Sequence
  Description of Artificial Sequence: Synthetic polypeptide
DESEIRTTNPVATEQYGSVCSWNLQERGERI

SEQ ID NO: 25285 - protein, 28 aa, Artificial Sequence
  Description of Artificial Sequence: Synthetic peptide
DEEEIATVNPVATEQYGSVSTVLQRDQE

SEQ ID NO: 25286 - protein, 30 aa, Artificial Sequence
  Description of Artificial Sequence: Synthetic polypeptide
DESEIRTTNPVATEQYGSVCSTPLQNGNQP

SEQ ID NO: 25287 - protein, 32 aa, Artificial Sequence
  Description of Artificial Sequence: Synthetic polypeptide
DESEIRTTNPVATEQYGSVCSTNPPQRFGSNR

SEQ ID NO: 25288 - protein, 28 aa, Artificial Sequence
  Description of Artificial Sequence: Synthetic peptide
SEGEIRCTNPIATEQYGSVSENLGRGNR

SEQ ID NO: 25289 - protein, 31 aa, Artificial Sequence
  Description of Artificial Sequence: Synthetic polypeptide
DEEEIRTTNPVATEQYGSVSTQLQGNGGNEG

SEQ ID NO: 25290 - protein, 29 aa, Artificial Sequence
  Description of Artificial Sequence: Synthetic peptide
DESEIRTTNPVATEQYGSVNWNDERGNDR

SEQ ID NO: 25291 - protein, 30 aa, Artificial Sequence
  Description of Artificial Sequence: Synthetic polypeptide
DESEIRTTNPVATEQYGSVNWNLERGNERN

SEQ ID NO: 25292 - protein, 32 aa, Artificial Sequence
  Description of Artificial Sequence: Synthetic polypeptide
DESEIRTTNPVATEQYGSVPSCTNELQQGNNR

SEQ ID NO: 25293 - protein, 29 aa, Artificial Sequence
  Description of Artificial Sequence: Synthetic peptide
DESEIRTTNPVATEQYGSVSCNEPMRGNG

SEQ ID NO: 25294 - protein, 29 aa, Artificial Sequence
  Description of Artificial Sequence: Synthetic peptide
DEECIRTTNPVAYEQYGQVSTWNVQRGND

SEQ ID NO: 25295 - protein, 29 aa, Artificial Sequence
  Description of Artificial Sequence: Synthetic peptide
SEEEIVCTNPIATEQYGSVCSTNLMRGNR

SEQ ID NO: 25296 - protein, 31 aa, Artificial Sequence
  Description of Artificial Sequence: Synthetic polypeptide
DEEEIRTTNPVATEQYGSVSTQLQNDGGNEQ

SEQ ID NO: 25297 - protein, 30 aa, Artificial Sequence
  Description of Artificial Sequence: Synthetic polypeptide
DEDEIRTTNPVATECYGSVSTNNQRDGDNS

SEQ ID NO: 25298 - protein, 30 aa, Artificial Sequence
  Description of Artificial Sequence: Synthetic polypeptide
AEEEIRTTNPVATEQYGSVSTNLNETATNR

SEQ ID NO: 25299 - protein, 31 aa, Artificial Sequence
  Description of Artificial Sequence: Synthetic polypeptide
DEEEIRTTNPVATEQYGSVSTQLQMNGNNEV

SEQ ID NO: 25300 - protein, 28 aa, Artificial Sequence
  Description of Artificial Sequence: Synthetic peptide
SEEEIVCTNPIATEQYGSVSENLMRGNR

SEQ ID NO: 25301 - protein, 28 aa, Artificial Sequence
  Description of Artificial Sequence: Synthetic peptide
SEEEIVCTNPIATEQYGSVSSNLMRGNR

SEQ ID NO: 25302 - protein, 29 aa, Artificial Sequence
  Description of Artificial Sequence: Synthetic peptide
DEEEIRTTNPVATEQYGSVATNLDRTTDD

SEQ ID NO: 25303 - protein, 28 aa, Artificial Sequence
  Description of Artificial Sequence: Synthetic peptide
SEGEIRYTNPVATEQYGSVETNLQHGNQ

SEQ ID NO: 25304 - protein, 30 aa, Artificial Sequence
  Description of Artificial Sequence: Synthetic polypeptide
AEEEIRTTNPVATEQYGSVSTNNNQGGNSM

SEQ ID NO: 25305 - protein, 32 aa, Artificial Sequence
  Description of Artificial Sequence: Synthetic polypeptide
DEEEIRTTNPVATEQYGSVSTPNEQSPGNQRT

SEQ ID NO: 25306 - protein, 33 aa, Artificial Sequence
  Description of Artificial Sequence: Synthetic polypeptide
DEEEIRTTNPVATEQYGSVSTPNGDQRGGNERG

SEQ ID NO: 25307 - protein, 30 aa, Artificial Sequence
  Description of Artificial Sequence: Synthetic polypeptide
DEEEIRTTNPVATEQYGSVATNLDDSGDND

SEQ ID NO: 25308 - protein, 30 aa, Artificial Sequence
  Description of Artificial Sequence: Synthetic polypeptide
AEEEIRTTNPVATEQYGSVSTNLNIEEGNN

SEQ ID NO: 25309 - protein, 29 aa, Artificial Sequence
  Description of Artificial Sequence: Synthetic peptide
DEEEIRTTNPVATEQYGSVATNGQRNPED

SEQ ID NO: 25310 - protein, 32 aa, Artificial Sequence
  Description of Artificial Sequence: Synthetic polypeptide
DEEEIRTTNPVATEQYGSVSSTNLQQIGNDIP

SEQ ID NO: 25311 - protein, 30 aa, Artificial Sequence
  Description of Artificial Sequence: Synthetic polypeptide
DEEEIRTTNPVATEQYGSVSENLQVGEIES

SEQ ID NO: 25312 - protein, 29 aa, Artificial Sequence
  Description of Artificial Sequence: Synthetic peptide
DEDEIRTTNPVATECYGVVSTNLQRDGDA

SEQ ID NO: 25313 - protein, 31 aa, Artificial Sequence
  Description of Artificial Sequence: Synthetic polypeptide
DEEEIRTTNPVATEQYGSVSTPNEQRVMVRD

SEQ ID NO: 25314 - protein, 30 aa, Artificial Sequence
  Description of Artificial Sequence: Synthetic polypeptide
DEEEIRTTNPVATEQYGSVATNLERAEERM

SEQ ID NO: 25315 - protein, 31 aa, Artificial Sequence
  Description of Artificial Sequence: Synthetic polypeptide
DEEEICTTNPVATEQYGSVSTNPLQEHMGNL

SEQ ID NO: 25316 - protein, 30 aa, Artificial Sequence
  Description of Artificial Sequence: Synthetic polypeptide
DEEEICTTNPVATEQYGSVSTNPQNGGNNH

SEQ ID NO: 25317 - protein, 31 aa, Artificial Sequence
  Description of Artificial Sequence: Synthetic polypeptide
DESEIRTTNPVATEQYGSVSTNLQMGGGNTI

SEQ ID NO: 25318 - protein, 31 aa, Artificial Sequence
  Description of Artificial Sequence: Synthetic polypeptide
DESEIRTTNPVATEQYGSVSTNLQMGGDNET

SEQ ID NO: 25319 - protein, 31 aa, Artificial Sequence
  Description of Artificial Sequence: Synthetic polypeptide
DEEEIRTTNPVATEQYGSVSLNLQQTVENRA

SEQ ID NO: 25320 - protein, 29 aa, Artificial Sequence
  Description of Artificial Sequence: Synthetic peptide
CEEEIRCTNPIATEQYGSVSENLMNRGNR

SEQ ID NO: 25321 - protein, 31 aa, Artificial Sequence
  Description of Artificial Sequence: Synthetic polypeptide
SEEEIRTTNPVCTEQYGSVASTENLQRAGER

SEQ ID NO: 25322 - protein, 29 aa, Artificial Sequence
  Description of Artificial Sequence: Synthetic peptide
SEEEIRTTNPVCTEQYGSVSTNGLQTGTA

SEQ ID NO: 25323 - protein, 29 aa, Artificial Sequence
  Description of Artificial Sequence: Synthetic peptide
CEEEIRCTNPIATEQYGSVSENLEMRGNR

SEQ ID NO: 25324 - protein, 31 aa, Artificial Sequence
  Description of Artificial Sequence: Synthetic polypeptide
DESEIRTTNPVATEQYGSVSTNLQHQGNDGS

SEQ ID NO: 25325 - protein, 30 aa, Artificial Sequence
  Description of Artificial Sequence: Synthetic polypeptide
AEEEIRTTNPVATEQYGSVSTNNQLEGVER

SEQ ID NO: 25326 - protein, 31 aa, Artificial Sequence
  Description of Artificial Sequence: Synthetic polypeptide
DESEIRTTNPVATEQYGSVSTNLQHNGDNNQ

SEQ ID NO: 25327 - protein, 31 aa, Artificial Sequence
  Description of Artificial Sequence: Synthetic polypeptide
DEEEIRTTNPVATEQYGSVSTALQDQGNIQE

SEQ ID NO: 25328 - protein, 30 aa, Artificial Sequence
  Description of Artificial Sequence: Synthetic polypeptide
AEEEIRTTNPVATEQYGSVSTNNQGQGNLN

SEQ ID NO: 25329 - protein, 31 aa, Artificial Sequence
  Description of Artificial Sequence: Synthetic polypeptide
AEEEIRTTNPVATEQYGSVSTNNQGGTVGNR

SEQ ID NO: 25330 - protein, 31 aa, Artificial Sequence
  Description of Artificial Sequence: Synthetic polypeptide
AEEEIRTTNPVATEQYGSVSTNLLQNIGNEF

SEQ ID NO: 25331 - protein, 32 aa, Artificial Sequence
  Description of Artificial Sequence: Synthetic polypeptide
DEEEIRTTNPVATEQYGSVSSTNLQNGINFTT

SEQ ID NO: 25332 - protein, 29 aa, Artificial Sequence
  Description of Artificial Sequence: Synthetic peptide
AEEEIRTTNPVATEQYGSVSTNNQFGIAA

SEQ ID NO: 25333 - protein, 31 aa, Artificial Sequence
  Description of Artificial Sequence: Synthetic polypeptide
DESEIRTTNPVATEQYGSVSTNLQGQQGNMG

SEQ ID NO: 25334 - protein, 32 aa, Artificial Sequence
  Description of Artificial Sequence: Synthetic polypeptide
DEEEIRTTNPVATEQYGCVCSTNLQENGSNRQ

SEQ ID NO: 25335 - protein, 29 aa, Artificial Sequence
  Description of Artificial Sequence: Synthetic peptide
DEQEIATTNPVATEMYGSVSTNLQQGNDQ

SEQ ID NO: 25336 - protein, 32 aa, Artificial Sequence
  Description of Artificial Sequence: Synthetic polypeptide
DESEIRTTNPVATEQYGSVSTNLQNDNGGNDR

SEQ ID NO: 25337 - protein, 31 aa, Artificial Sequence
  Description of Artificial Sequence: Synthetic polypeptide
DEEEIRTTNPVATEQYGSVSTALQERMGSEQ

SEQ ID NO: 25338 - protein, 31 aa, Artificial Sequence
  Description of Artificial Sequence: Synthetic polypeptide
DESEIRTTNPVATEQYGSVSTNLQPNGNENE

SEQ ID NO: 25339 - protein, 30 aa, Artificial Sequence
  Description of Artificial Sequence: Synthetic polypeptide
AEEEIRTTNPVATEQYGSVSTNLLQNGSDD

SEQ ID NO: 25340 - protein, 31 aa, Artificial Sequence
  Description of Artificial Sequence: Synthetic polypeptide
DEEEIRTTNPVATEQYGSVSTPNDQEGQNIN

SEQ ID NO: 25341 - protein, 31 aa, Artificial Sequence
  Description of Artificial Sequence: Synthetic polypeptide
DESEIRTTNPVATEQYGSVSTNNNLQDGNSS

SEQ ID NO: 25342 - protein, 29 aa, Artificial Sequence
  Description of Artificial Sequence: Synthetic peptide
DESEIRTTNPVATEQYGSVSTNNDEGNEE

SEQ ID NO: 25343 - protein, 30 aa, Artificial Sequence
  Description of Artificial Sequence: Synthetic polypeptide
DESEIRTTNPVATEQYGSVSTNNDEEGNRG

SEQ ID NO: 25344 - protein, 31 aa, Artificial Sequence
  Description of Artificial Sequence: Synthetic polypeptide
DESEIRTTNPVATEQYGSVSTNLQSGGNGNM

SEQ ID NO: 25345 - protein, 30 aa, Artificial Sequence
  Description of Artificial Sequence: Synthetic polypeptide
DEEEIRTTNPVATEQYGSVSTALQIRTDQD

SEQ ID NO: 25346 - protein, 32 aa, Artificial Sequence
  Description of Artificial Sequence: Synthetic polypeptide
DEEEIRTTNPVATEQYGSVSSTNLQNGGNVTT

SEQ ID NO: 25347 - protein, 30 aa, Artificial Sequence
  Description of Artificial Sequence: Synthetic polypeptide
DEEEIRTTNPVATEQYGSVATNLERGPMDN

SEQ ID NO: 25348 - protein, 31 aa, Artificial Sequence
  Description of Artificial Sequence: Synthetic polypeptide
DEEEIRTTNPVATEQYGSVSTALQGEGNISE

SEQ ID NO: 25349 - protein, 31 aa, Artificial Sequence
  Description of Artificial Sequence: Synthetic polypeptide
DESEIRTTNPVATEQYGSVSTNLQGNGNGNA

SEQ ID NO: 25350 - protein, 31 aa, Artificial Sequence
  Description of Artificial Sequence: Synthetic polypeptide
DEEEIRTTNPVATEQYGSVSTALQFNGGNED

SEQ ID NO: 25351 - protein, 28 aa, Artificial Sequence
  Description of Artificial Sequence: Synthetic peptide
CEEEIRCTNPIATEQYGSVSENLMRGSR

SEQ ID NO: 25352 - protein, 30 aa, Artificial Sequence
  Description of Artificial Sequence: Synthetic polypeptide
SEEEIRTTNPVAYEQYGSVSTNLQHGNEIE

SEQ ID NO: 25353 - protein, 31 aa, Artificial Sequence
  Description of Artificial Sequence: Synthetic polypeptide
AEEEIRTTNPVATEQYGSVSTNLLQNGNPTG

SEQ ID NO: 25354 - protein, 30 aa, Artificial Sequence
  Description of Artificial Sequence: Synthetic polypeptide
AEEEIRTTNPVATEQYGSVSTNNQLQGNTE

SEQ ID NO: 25355 - protein, 31 aa, Artificial Sequence
  Description of Artificial Sequence: Synthetic polypeptide
AEEEIRTTNPVATEQYGSVSTNNQLQGNNRT

SEQ ID NO: 25356 - protein, 31 aa, Artificial Sequence
  Description of Artificial Sequence: Synthetic polypeptide
AEEEIRTTNPVATEQYGSVSTNNQLQGGNMN

SEQ ID NO: 25357 - protein, 28 aa, Artificial Sequence
  Description of Artificial Sequence: Synthetic peptide
CEEEIRCTNPIATEQYGSVSENLMRGNK

SEQ ID NO: 25358 - protein, 30 aa, Artificial Sequence
  Description of Artificial Sequence: Synthetic polypeptide
AEEEIRTTNPVATEQYGSVSTNNQLQGERG

SEQ ID NO: 25359 - protein, 31 aa, Artificial Sequence
  Description of Artificial Sequence: Synthetic polypeptide
AEEEIRTTNPVATEQYGSVSTNNQLQEGNFN

SEQ ID NO: 25360 - protein, 31 aa, Artificial Sequence
  Description of Artificial Sequence: Synthetic polypeptide
DEEEIRTTNPVATEQYGSVSTALQFGQNNEP

SEQ ID NO: 25361 - protein, 29 aa, Artificial Sequence
  Description of Artificial Sequence: Synthetic peptide
DEEEIRTTNPVATEQYGSVSENLQVEEEL

SEQ ID NO: 25362 - protein, 31 aa, Artificial Sequence
  Description of Artificial Sequence: Synthetic polypeptide
DESEIRTTNPVATEQYGSVSTNLQGMGGNEG

SEQ ID NO: 25363 - protein, 31 aa, Artificial Sequence
  Description of Artificial Sequence: Synthetic polypeptide
DEEEIRTTNPVATEQYGSVATNLERGGNDSD

SEQ ID NO: 25364 - protein, 31 aa, Artificial Sequence
  Description of Artificial Sequence: Synthetic polypeptide
DEEEIRTTNPVATEQYGSVSTPNDQLDSNVR

SEQ ID NO: 25365 - protein, 32 aa, Artificial Sequence
  Description of Artificial Sequence: Synthetic polypeptide
DEEEIRTTNPVATEQYGSVATNLERDGPNPRP

SEQ ID NO: 25366 - protein, 31 aa, Artificial Sequence
  Description of Artificial Sequence: Synthetic polypeptide
DESEIRTTNPVATEQYGSVSTNLGQEGNNNA

SEQ ID NO: 25367 - protein, 30 aa, Artificial Sequence
  Description of Artificial Sequence: Synthetic polypeptide
DESEIRTTNPVATEQYGSVSTNLGGSGNNN

SEQ ID NO: 25368 - protein, 31 aa, Artificial Sequence
  Description of Artificial Sequence: Synthetic polypeptide
DEEEIRTTNPVATEQYGSVSTALQAEGNNNV

SEQ ID NO: 25369 - protein, 30 aa, Artificial Sequence
  Description of Artificial Sequence: Synthetic polypeptide
AEEEIRTTNPVATEQYGSVSTNLMNQGNNS

SEQ ID NO: 25370 - protein, 30 aa, Artificial Sequence
  Description of Artificial Sequence: Synthetic polypeptide
DEEEIRTTNPVATEQYGSVATNLERANLQM

SEQ ID NO: 25371 - protein, 31 aa, Artificial Sequence
  Description of Artificial Sequence: Synthetic polypeptide
DEEEIRTTNPVATEQYGSVSTALPNRNGMNV

SEQ ID NO: 25372 - protein, 30 aa, Artificial Sequence
  Description of Artificial Sequence: Synthetic polypeptide
DESEIRTTNPVATEQYGSVSTNLDGGNGNK

SEQ ID NO: 25373 - protein, 31 aa, Artificial Sequence
  Description of Artificial Sequence: Synthetic polypeptide
DESEIRTTNPVATEQYGSVSTNLNQGMDGNG

SEQ ID NO: 25374 - protein, 31 aa, Artificial Sequence
  Description of Artificial Sequence: Synthetic polypeptide
DESEIRTTNPVATEQYGSVSTNLAQINGENA

SEQ ID NO: 25375 - protein, 30 aa, Artificial Sequence
  Description of Artificial Sequence: Synthetic polypeptide
DESEIRTTNPVATEQYGSVSTNGQHEGNEG

SEQ ID NO: 25376 - protein, 28 aa, Artificial Sequence
  Description of Artificial Sequence: Synthetic peptide
SEEEIRTVNPVATEQYGSVSTVLQREQE

SEQ ID NO: 25377 - protein, 29 aa, Artificial Sequence
  Description of Artificial Sequence: Synthetic peptide
SEEEIRYTNPIATEQYGSVSENLDREGNR

SEQ ID NO: 25378 - protein, 29 aa, Artificial Sequence
  Description of Artificial Sequence: Synthetic peptide
SEEEIRYTNPIATEQYGSVSVNLMRGNRD

SEQ ID NO: 25379 - protein, 30 aa, Artificial Sequence
  Description of Artificial Sequence: Synthetic polypeptide
SEEEIRYTNPVATEQYGSVESTNLQLVGNQ

SEQ ID NO: 25380 - protein, 29 aa, Artificial Sequence
  Description of Artificial Sequence: Synthetic peptide
DEQEIATTNPVATEQYGSVATNGQRGNDA

SEQ ID NO: 25381 - protein, 33 aa, Artificial Sequence
  Description of Artificial Sequence: Synthetic polypeptide
DEEEIRTTNPVATEQYGCVCSTNLGQRSGSNRM

SEQ ID NO: 25382 - protein, 29 aa, Artificial Sequence
  Description of Artificial Sequence: Synthetic peptide
CEEEICTTNPVATEQYGSVSTNLQHGDSM

SEQ ID NO: 25383 - protein, 29 aa, Artificial Sequence
  Description of Artificial Sequence: Synthetic peptide
CEEEICTTNPVATEQYGSVATNLQRNEQR

SEQ ID NO: 25384 - protein, 32 aa, Artificial Sequence
  Description of Artificial Sequence: Synthetic polypeptide
DEEEIRTTNPVATEQYGCVCSTNLLQFGSNRL

SEQ ID NO: 25385 - protein, 28 aa, Artificial Sequence
  Description of Artificial Sequence: Synthetic peptide
SEKEIRCTNPIATEQYGSVSENLMRGNR

SEQ ID NO: 25386 - protein, 31 aa, Artificial Sequence
  Description of Artificial Sequence: Synthetic polypeptide
DESEIRTTNPVATEQYGSVSTNLQADGNGNM

SEQ ID NO: 25387 - protein, 30 aa, Artificial Sequence
  Description of Artificial Sequence: Synthetic polypeptide
DEEEIRTTNPVATEQYGSVATNLERDGTGE

SEQ ID NO: 25388 - protein, 31 aa, Artificial Sequence
  Description of Artificial Sequence: Synthetic polypeptide
DESEIRTTNPVATEQYGSVSTNLQGEDGGPR

SEQ ID NO: 25389 - protein, 30 aa, Artificial Sequence
  Description of Artificial Sequence: Synthetic polypeptide
AEEEIRTTNPVATEQYGSVSTNLLQQNNNF

SEQ ID NO: 25390 - protein, 31 aa, Artificial Sequence
  Description of Artificial Sequence: Synthetic polypeptide
DESEIRTTNPVATEQYGSVSTNLQGDQGNGM

SEQ ID NO: 25391 - protein, 30 aa, Artificial Sequence
  Description of Artificial Sequence: Synthetic polypeptide
AEEEIRTTNPVATEQYGSVSTNLLQQNNTL

SEQ ID NO: 25392 - protein, 30 aa, Artificial Sequence
  Description of Artificial Sequence: Synthetic polypeptide
AEEEIRTTNPVATEQYGSVSTNLLQQTTNY

SEQ ID NO: 25393 - protein, 30 aa, Artificial Sequence
  Description of Artificial Sequence: Synthetic polypeptide
DESEIRTTNPVATEQYGSVSTNLQGDNNEE

SEQ ID NO: 25394 - protein, 31 aa, Artificial Sequence
  Description of Artificial Sequence: Synthetic polypeptide
DESEIRTTNPVATEQYGSVSTNLQGDMGNQN

SEQ ID NO: 25395 - protein, 31 aa, Artificial Sequence
  Description of Artificial Sequence: Synthetic polypeptide
DESEIRTTNPVATEQYGSVSTNLQGDAGNNT

SEQ ID NO: 25396 - protein, 30 aa, Artificial Sequence
  Description of Artificial Sequence: Synthetic polypeptide
DEEEIRTTNPVATEQYGSVATNLERGDPLN

SEQ ID NO: 25397 - protein, 31 aa, Artificial Sequence
  Description of Artificial Sequence: Synthetic polypeptide
DEEEIRTTNPVATEQYGSVSTALQAQGGNNI

SEQ ID NO: 25398 - protein, 31 aa, Artificial Sequence
  Description of Artificial Sequence: Synthetic polypeptide
AEEEIRTTNPVATEQYGSVSTNLLQVNIGNT

SEQ ID NO: 25399 - protein, 32 aa, Artificial Sequence
  Description of Artificial Sequence: Synthetic polypeptide
DEEEIRTTNPVATEQYGCVCSTNLQEFGGNRQ

SEQ ID NO: 25400 - protein, 30 aa, Artificial Sequence
  Description of Artificial Sequence: Synthetic polypeptide
DEEEIRTTNPVATEQYGSVATNLERGDDTL

SEQ ID NO: 25401 - protein, 31 aa, Artificial Sequence
  Description of Artificial Sequence: Synthetic polypeptide
DESEIRTTNPVATEQYGSVSTNLQEGNGNGE

SEQ ID NO: 25402 - protein, 31 aa, Artificial Sequence
  Description of Artificial Sequence: Synthetic polypeptide
DESEIRTTNPVATEQYGSVSTNLQEGGHNDQ

SEQ ID NO: 25403 - protein, 30 aa, Artificial Sequence
  Description of Artificial Sequence: Synthetic polypeptide
AEEEIRTTNPVATEQYGSVSTNNNQTGNNA

SEQ ID NO: 25404 - protein, 31 aa, Artificial Sequence
  Description of Artificial Sequence: Synthetic polypeptide
DESEIRTTNPVATEQYGSVSTNLQDGGQNGN

SEQ ID NO: 25405 - protein, 30 aa, Artificial Sequence
  Description of Artificial Sequence: Synthetic polypeptide
DEEEIRTTNPVATEQYGSVATNLERENMDM

SEQ ID NO: 25406 - protein, 31 aa, Artificial Sequence
  Description of Artificial Sequence: Synthetic polypeptide
AEEEIRTTNPVATEQYGSVSTNLLVQNGNQT

SEQ ID NO: 25407 - protein, 31 aa, Artificial Sequence
  Description of Artificial Sequence: Synthetic polypeptide
AEEEIRTTNPVATEQYGSVSTNNNQRGNNSG

SEQ ID NO: 25408 - protein, 31 aa, Artificial Sequence
  Description of Artificial Sequence: Synthetic polypeptide
DEEEIRTTNPVATEQYGSVSTALQDGGNESE

SEQ ID NO: 25409 - protein, 32 aa, Artificial Sequence
  Description of Artificial Sequence: Synthetic polypeptide
DEEEIRTTNPVATEQYGSVSSTNLQFTGNEFG

SEQ ID NO: 25410 - protein, 33 aa, Artificial Sequence
  Description of Artificial Sequence: Synthetic polypeptide
DEEEIRTTNPVATEQYGSTVSCTNLAQRSGSNL

SEQ ID NO: 25411 - protein, 32 aa, Artificial Sequence
  Description of Artificial Sequence: Synthetic polypeptide
DEEEIRTTNPVATEQYGSTVSCTNLAPGGNNR

SEQ ID NO: 25412 - protein, 30 aa, Artificial Sequence
  Description of Artificial Sequence: Synthetic polypeptide
DEEEIRTTNPVATEQYGSVSENLQDQNLES

SEQ ID NO: 25413 - protein, 30 aa, Artificial Sequence
  Description of Artificial Sequence: Synthetic polypeptide
AEEEIRTTNPVATEQYGSVSTNLDNQGNAQ

SEQ ID NO: 25414 - protein, 31 aa, Artificial Sequence
  Description of Artificial Sequence: Synthetic polypeptide
DEEEIRTTNPVATEQYGSVSTNVVQPRDMIR

SEQ ID NO: 25415 - protein, 30 aa, Artificial Sequence
  Description of Artificial Sequence: Synthetic polypeptide
AEEEIRTTNPVATEQYGSVSTSLQSNGNIE

SEQ ID NO: 25416 - protein, 31 aa, Artificial Sequence
  Description of Artificial Sequence: Synthetic polypeptide
DEEEIRTTNPVATEQYGSVSENLQEVGGNDI

SEQ ID NO: 25417 - protein, 31 aa, Artificial Sequence
  Description of Artificial Sequence: Synthetic polypeptide
AEEEIRTTNPVATEQYGSVSTNLDNQIGTNT

SEQ ID NO: 25418 - protein, 30 aa, Artificial Sequence
  Description of Artificial Sequence: Synthetic polypeptide
DETEIATTNPVATEQYGSVSTNLQHDGNTS

SEQ ID NO: 25419 - protein, 29 aa, Artificial Sequence
  Description of Artificial Sequence: Synthetic peptide
AEEEIRTTNPVATEQYGSVSTNLDNSVNT

SEQ ID NO: 25420 - protein, 31 aa, Artificial Sequence
  Description of Artificial Sequence: Synthetic polypeptide
DETEIATTNPVATEQYGSVSTNLQHDGGENR

SEQ ID NO: 25421 - protein, 29 aa, Artificial Sequence
  Description of Artificial Sequence: Synthetic peptide
DEECIRTTNPVAYEQYGEVSTINVQRGNN

SEQ ID NO: 25422 - protein, 29 aa, Artificial Sequence
  Description of Artificial Sequence: Synthetic peptide
DEEEIRTTNPVACEQYGSVWTNLQVFDVR

SEQ ID NO: 25423 - protein, 33 aa, Artificial Sequence
  Description of Artificial Sequence: Synthetic polypeptide
DEEEIRTTNPVATEQYGSVSTNWLDQRFGSNAN

SEQ ID NO: 25424 - protein, 31 aa, Artificial Sequence
  Description of Artificial Sequence: Synthetic polypeptide
DETEIATTNPVATEQYGSVSTNLNQEGDENR

SEQ ID NO: 25425 - protein, 32 aa, Artificial Sequence
  Description of Artificial Sequence: Synthetic polypeptide
DEEEIRTTNPVATEQYGSVSTANLQSVGENGG

SEQ ID NO: 25426 - protein, 30 aa, Artificial Sequence
  Description of Artificial Sequence: Synthetic polypeptide
AEEEIRTTNPVATEQYGSVSTSLQQEGGIR

SEQ ID NO: 25427 - protein, 29 aa, Artificial Sequence
  Description of Artificial Sequence: Synthetic peptide
DETEIATTNPVATEQYGSVSTNLERGEDP

SEQ ID NO: 25428 - protein, 30 aa, Artificial Sequence
  Description of Artificial Sequence: Synthetic polypeptide
DETEIATTNPVATEQYGSVSTDNLQSGGNS

SEQ ID NO: 25429 - protein, 29 aa, Artificial Sequence
  Description of Artificial Sequence: Synthetic peptide
SEEEIRTTNPVATESYGSVATNLQGGDRA

SEQ ID NO: 25430 - protein, 31 aa, Artificial Sequence
  Description of Artificial Sequence: Synthetic polypeptide
DEEEIRTTNPVATEQYGCVCSTNLQYFGNMA

SEQ ID NO: 25431 - protein, 32 aa, Artificial Sequence
  Description of Artificial Sequence: Synthetic polypeptide
DEEEIRTTNPVATEQYGSVATNLQEREGNNNI

SEQ ID NO: 25432 - protein, 31 aa, Artificial Sequence
  Description of Artificial Sequence: Synthetic polypeptide
DEEEIRTTNPVATEQYGSVSTNVTNQQGGND

SEQ ID NO: 25433 - protein, 32 aa, Artificial Sequence
  Description of Artificial Sequence: Synthetic polypeptide
DEEEIRTTNPVATEQYGSVSTANLQVEGGNGG

SEQ ID NO: 25434 - protein, 32 aa, Artificial Sequence
  Description of Artificial Sequence: Synthetic polypeptide
DEEEIRTTNPVATEQYGSVSTANLQVGDENQG

SEQ ID NO: 25435 - protein, 31 aa, Artificial Sequence
  Description of Artificial Sequence: Synthetic polypeptide
DEEEIRTTNPVATEQYGSVSTANMNNQIGNE

SEQ ID NO: 25436 - protein, 33 aa, Artificial Sequence
  Description of Artificial Sequence: Synthetic polypeptide
DEEEIRTTNPVATEQYGSTSQTENPLSQRIGNR

SEQ ID NO: 25437 - protein, 31 aa, Artificial Sequence
  Description of Artificial Sequence: Synthetic polypeptide
DEEEIRTTNPVATEQYGSVSTNVQRQVQLRT

SEQ ID NO: 25438 - protein, 30 aa, Artificial Sequence
  Description of Artificial Sequence: Synthetic polypeptide
DEEEIGTTNPCATEQYGSVPTNLQNQGNGR

SEQ ID NO: 25439 - protein, 28 aa, Artificial Sequence
  Description of Artificial Sequence: Synthetic peptide
DETEIATTNPVATNQYGTVSTALQRGNT

SEQ ID NO: 25440 - protein, 31 aa, Artificial Sequence
  Description of Artificial Sequence: Synthetic polypeptide
AEEEIRTTNPVATEQYGSVSTSNGNLQEGND

SEQ ID NO: 25441 - protein, 32 aa, Artificial Sequence
  Description of Artificial Sequence: Synthetic polypeptide
DEEEIRTTNPVATEQYGSTSSTENLSQGNGNR

SEQ ID NO: 25442 - protein, 30 aa, Artificial Sequence
  Description of Artificial Sequence: Synthetic polypeptide
AEEEIRTTNPVATEQYGSVSTSNEQAGNNQ

SEQ ID NO: 25443 - protein, 29 aa, Artificial Sequence
  Description of Artificial Sequence: Synthetic peptide
DEPEIRTTNPVATEQYGETSTNLQRGDGS

SEQ ID NO: 25444 - protein, 30 aa, Artificial Sequence
  Description of Artificial Sequence: Synthetic polypeptide
AEEEIRTTNPVATEQYGSVSTSGNEQAGNQ

SEQ ID NO: 25445 - protein, 32 aa, Artificial Sequence
  Description of Artificial Sequence: Synthetic polypeptide
DEEEIRTTNPVATEQYGSVSTNVQVFGENERQ

SEQ ID NO: 25446 - protein, 31 aa, Artificial Sequence
  Description of Artificial Sequence: Synthetic polypeptide
DEEEIRTTNPVATEQYGSVSTANLVEVGNEA

SEQ ID NO: 25447 - protein, 32 aa, Artificial Sequence
  Description of Artificial Sequence: Synthetic polypeptide
DEEEIRTTNPVATEQYGSVSTANLTQEGGNTM

SEQ ID NO: 25448 - protein, 32 aa, Artificial Sequence
  Description of Artificial Sequence: Synthetic polypeptide
DEEEIRTTNPVATEQYGSVSTNVQVRVGDNEE

SEQ ID NO: 25449 - protein, 29 aa, Artificial Sequence
  Description of Artificial Sequence: Synthetic peptide
DEPEIRTTNPVATEQYGETSTNLQRGDII

SEQ ID NO: 25450 - protein, 30 aa, Artificial Sequence
  Description of Artificial Sequence: Synthetic polypeptide
DETEIATTNPVATEQYGSVSTNPQRGNGET

SEQ ID NO: 25451 - protein, 30 aa, Artificial Sequence
  Description of Artificial Sequence: Synthetic polypeptide
DETEIATTNPVATEQYGSVSTNPQGEGNTR

SEQ ID NO: 25452 - protein, 30 aa, Artificial Sequence
  Description of Artificial Sequence: Synthetic polypeptide
AEEEIRTTNPVATEQYGSVSTSNEEQGGNQ

SEQ ID NO: 25453 - protein, 30 aa, Artificial Sequence
  Description of Artificial Sequence: Synthetic polypeptide
DEEEIRTTNPVATEQYGSVSTNVQVTINNQ

SEQ ID NO: 25454 - protein, 29 aa, Artificial Sequence
  Description of Artificial Sequence: Synthetic peptide
DETEIATTNPVATEQYGSVSTNLSTYGNT

SEQ ID NO: 25455 - protein, 31 aa, Artificial Sequence
  Description of Artificial Sequence: Synthetic polypeptide
DEEEIRTTNPVATEQYGSVSLNLHRSGQEDR

SEQ ID NO: 25456 - protein, 33 aa, Artificial Sequence
  Description of Artificial Sequence: Synthetic polypeptide
DEEEIRTTNPVATEQYGSTSPTENLGQRDGDNR

SEQ ID NO: 25457 - protein, 30 aa, Artificial Sequence
  Description of Artificial Sequence: Synthetic polypeptide
DEEEIGATNPVATEQYGCVSTTNLFQGGNR

SEQ ID NO: 25458 - protein, 31 aa, Artificial Sequence
  Description of Artificial Sequence: Synthetic polypeptide
DEEEIRTTNPVATEQYGSVATNLQEAGNDDV

SEQ ID NO: 25459 - protein, 29 aa, Artificial Sequence
  Description of Artificial Sequence: Synthetic peptide
AEEEIRTTNPVATEQYGSVSTQNNEGGNE

SEQ ID NO: 25460 - protein, 32 aa, Artificial Sequence
  Description of Artificial Sequence: Synthetic polypeptide
DEEEIRTTNPVATEQYGSVSTANLQNNGGNEF

SEQ ID NO: 25461 - protein, 31 aa, Artificial Sequence
  Description of Artificial Sequence: Synthetic polypeptide
AEEEIRTTNPVATEQYGSVSTQNLQVNGNND

SEQ ID NO: 25462 - protein, 30 aa, Artificial Sequence
  Description of Artificial Sequence: Synthetic polypeptide
AEEEIRTTNPVATEQYGSVSTQNLQQQNND

SEQ ID NO: 25463 - protein, 31 aa, Artificial Sequence
  Description of Artificial Sequence: Synthetic polypeptide
DEEEIRTTNPVATEQYGSVATNLQDPGNDNL

SEQ ID NO: 25464 - protein, 31 aa, Artificial Sequence
  Description of Artificial Sequence: Synthetic polypeptide
AEEEIRTTNPVATEQYGSVSTQNLQQIQGNN

SEQ ID NO: 25465 - protein, 31 aa, Artificial Sequence
  Description of Artificial Sequence: Synthetic polypeptide
AEEEIRTTNPVATEQYGSVSTQNLQQGINDN

SEQ ID NO: 25466 - protein, 31 aa, Artificial Sequence
  Description of Artificial Sequence: Synthetic polypeptide
DEPEIRTTNPVATEQYGSVITNLEIRGVNRT

SEQ ID NO: 25467 - protein, 30 aa, Artificial Sequence
  Description of Artificial Sequence: Synthetic polypeptide
DEEEIRTTNPVATEQYGSVATNLQDPGDMH

SEQ ID NO: 25468 - protein, 28 aa, Artificial Sequence
  Description of Artificial Sequence: Synthetic peptide
DETEIATTNPVATEHYGSVSTNLQHGDV

SEQ ID NO: 25469 - protein, 31 aa, Artificial Sequence
  Description of Artificial Sequence: Synthetic polypeptide
AEEEIRTTNPVATEQYGSVSTQNLQNGNEQV

SEQ ID NO: 25470 - protein, 32 aa, Artificial Sequence
  Description of Artificial Sequence: Synthetic polypeptide
DEEEIRTTNPVATEQYGSVSTANLQGTGGNGE

SEQ ID NO: 25471 - protein, 30 aa, Artificial Sequence
  Description of Artificial Sequence: Synthetic polypeptide
AEEEIRTTNPVATEQYGSVSTQNLQGQGTS

SEQ ID NO: 25472 - protein, 30 aa, Artificial Sequence
  Description of Artificial Sequence: Synthetic polypeptide
AEEEIRTTNPVATEQYGSVSTQNLIGGGNN

SEQ ID NO: 25473 - protein, 30 aa, Artificial Sequence
  Description of Artificial Sequence: Synthetic polypeptide
AEEEIRTTNPVATEQYGSVSTQNGTQNGNQ

SEQ ID NO: 25474 - protein, 30 aa, Artificial Sequence
  Description of Artificial Sequence: Synthetic polypeptide
AEEEIRTTNPVATEQYGSVSTQNEQEGNIS

SEQ ID NO: 25475 - protein, 30 aa, Artificial Sequence
  Description of Artificial Sequence: Synthetic polypeptide
DEEEIETTNPDATEQYGSVSTNDDDRGLNR

SEQ ID NO: 25476 - protein, 30 aa, Artificial Sequence
  Description of Artificial Sequence: Synthetic polypeptide
AEEEIRTTNPVATEQYGSVSTQNAQEGNNN

SEQ ID NO: 25477 - protein, 29 aa, Artificial Sequence
  Description of Artificial Sequence: Synthetic peptide
AEEEIRTTNPVATEQYGSVSTQLTQGANA

SEQ ID NO: 25478 - protein, 31 aa, Artificial Sequence
  Description of Artificial Sequence: Synthetic polypeptide
DEEEIRTTNPVATEQYGSVSTNWQQERLMIR

SEQ ID NO: 25479 - protein, 30 aa, Artificial Sequence
  Description of Artificial Sequence: Synthetic polypeptide
AEEEIRTTNPVATEQYGSVSTQNNGQTGNL

SEQ ID NO: 25480 - protein, 31 aa, Artificial Sequence
  Description of Artificial Sequence: Synthetic polypeptide
AEEEIRTTNPVATEQYGSVSTNLDQEGGNNQ

SEQ ID NO: 25481 - protein, 30 aa, Artificial Sequence
  Description of Artificial Sequence: Synthetic polypeptide
DETEIATTNPVATEQYGCVSTNLQAGGNAR

SEQ ID NO: 25482 - protein, 30 aa, Artificial Sequence
  Description of Artificial Sequence: Synthetic polypeptide
SEEEIRTTNPVATESYGSVSGTNLGRGDQR

SEQ ID NO: 25483 - protein, 32 aa, Artificial Sequence
  Description of Artificial Sequence: Synthetic polypeptide
DEEEIRTTNPVATEQYGSVSTANLQPTGGNIT

SEQ ID NO: 25484 - protein, 31 aa, Artificial Sequence
  Description of Artificial Sequence: Synthetic polypeptide
DEEEIRTTNPVATEQYGSVSSTNLNTDGNED

SEQ ID NO: 25485 - protein, 30 aa, Artificial Sequence
  Description of Artificial Sequence: Synthetic polypeptide
DEPEIRTTNPVATEQYGSVETNLEERGVSR

SEQ ID NO: 25486 - protein, 30 aa, Artificial Sequence
  Description of Artificial Sequence: Synthetic polypeptide
DEPEIRTTNPVATEQYGSVETNLPERGEVR

SEQ ID NO: 25487 - protein, 30 aa, Artificial Sequence
  Description of Artificial Sequence: Synthetic polypeptide
AEEEIRTTNPVATEQYGSVSTQNQQDGNND

SEQ ID NO: 25488 - protein, 30 aa, Artificial Sequence
  Description of Artificial Sequence: Synthetic polypeptide
DEPEIRTTNPVATEQYGSVETNLQRGDGQN

SEQ ID NO: 25489 - protein, 32 aa, Artificial Sequence
  Description of Artificial Sequence: Synthetic polypeptide
DEEEIRTTNPVATEQYGSVSTANLQPEGGNEQ

SEQ ID NO: 25490 - protein, 32 aa, Artificial Sequence
  Description of Artificial Sequence: Synthetic polypeptide
DEEEIRTTNPVATEQYGSVSTANLQNVGTNIG

SEQ ID NO: 25491 - protein, 30 aa, Artificial Sequence
  Description of Artificial Sequence: Synthetic polypeptide
SEEEIRTTNPVATESYGSVSDTNLHRGPQR

SEQ ID NO: 25492 - protein, 32 aa, Artificial Sequence
  Description of Artificial Sequence: Synthetic polypeptide
DEEEIRTTNPVATEQYGSVSTANLQNSNGNQF

SEQ ID NO: 25493 - protein, 32 aa, Artificial Sequence
  Description of Artificial Sequence: Synthetic polypeptide
DEEEIRTTNPVATEQYGSVSTANLQNSGVNEN

SEQ ID NO: 25494 - protein, 29 aa, Artificial Sequence
  Description of Artificial Sequence: Synthetic peptide
DEAEIRTTNPVAYEQWGSVSTNLQEGDAR

SEQ ID NO: 25495 - protein, 30 aa, Artificial Sequence
  Description of Artificial Sequence: Synthetic polypeptide
DEEEIRTTNPVATEQYGSVSTNWPQSFGEQ

SEQ ID NO: 25496 - protein, 30 aa, Artificial Sequence
  Description of Artificial Sequence: Synthetic polypeptide
DETEIATTNPVATEQYGIVSTNLQGGGGNR

SEQ ID NO: 25497 - protein, 30 aa, Artificial Sequence
  Description of Artificial Sequence: Synthetic polypeptide
DETEIATTNPVATEQYGEVSTNLQGPGNER

SEQ ID NO: 25498 - protein, 31 aa, Artificial Sequence
  Description of Artificial Sequence: Synthetic polypeptide
DEPEIRTTNPVATEQYGSVETNLQRGVDGRA

SEQ ID NO: 25499 - protein, 30 aa, Artificial Sequence
  Description of Artificial Sequence: Synthetic polypeptide
DETEIATTNPVATEQYGDVSTNLQGGGNER

SEQ ID NO: 25500 - protein, 32 aa, Artificial Sequence
  Description of Artificial Sequence: Synthetic polypeptide
DEEEIRTTNPVATEQYGSVSTANLQNSGNEIA

SEQ ID NO: 25501 - protein, 29 aa, Artificial Sequence
  Description of Artificial Sequence: Synthetic peptide
DEEEIRTTNPVATEQYGSVATNLQDTHPD

SEQ ID NO: 25502 - protein, 29 aa, Artificial Sequence
  Description of Artificial Sequence: Synthetic peptide
DETEIATTNPVATEQYGQVSTNLQPDGNS

SEQ ID NO: 25503 - protein, 33 aa, Artificial Sequence
  Description of Artificial Sequence: Synthetic polypeptide
AEEEIRTTNPVATEQYGSVSTSNLDQRGENDRD

SEQ ID NO: 25504 - protein, 29 aa, Artificial Sequence
  Description of Artificial Sequence: Synthetic peptide
DEPEIRTTNPVATEQYGETSETNLQRGGS

SEQ ID NO: 25505 - protein, 30 aa, Artificial Sequence
  Description of Artificial Sequence: Synthetic polypeptide
AEEEIRTTNPVATEQYGSVSTSNLENNGNT

SEQ ID NO: 25506 - protein, 32 aa, Artificial Sequence
  Description of Artificial Sequence: Synthetic polypeptide
AEEEIRTTNPVATEQYGSVSTSNLTQRGENGI

SEQ ID NO: 25507 - protein, 28 aa, Artificial Sequence
  Description of Artificial Sequence: Synthetic peptide
DETEIRTTNPVACAQYGCVSTNLERGND

SEQ ID NO: 25508 - protein, 30 aa, Artificial Sequence
  Description of Artificial Sequence: Synthetic polypeptide
DEEEIRTTNPVATEQYGSVSTQNIIGDGND

SEQ ID NO: 25509 - protein, 28 aa, Artificial Sequence
  Description of Artificial Sequence: Synthetic peptide
DEECIRCTNPVATEQYGSVACNFQRGNL

SEQ ID NO: 25510 - protein, 32 aa, Artificial Sequence
  Description of Artificial Sequence: Synthetic polypeptide
DEEEIRTTNPVATEQYGSVSTASLEQRDNDER

SEQ ID NO: 25511 - protein, 28 aa, Artificial Sequence
  Description of Artificial Sequence: Synthetic peptide
DETEICTVNPVATEQYGSVSTNLGTGNH

SEQ ID NO: 25512 - protein, 30 aa, Artificial Sequence
  Description of Artificial Sequence: Synthetic polypeptide
AEEEIRTTNPVATEQYGSVSTNLADNGGNT

SEQ ID NO: 25513 - protein, 28 aa, Artificial Sequence
  Description of Artificial Sequence: Synthetic peptide
DETEICTVNPVATEQYGSVSTNLFGGNA

SEQ ID NO: 25514 - protein, 31 aa, Artificial Sequence
  Description of Artificial Sequence: Synthetic polypeptide
DEEEIRTTNPVATEQYGSVSTAPQRSGSDRP

SEQ ID NO: 25515 - protein, 30 aa, Artificial Sequence
  Description of Artificial Sequence: Synthetic polypeptide
DEEEIRTTNPVATEQYGSVSTNTQFFSNDY

SEQ ID NO: 25516 - protein, 32 aa, Artificial Sequence
  Description of Artificial Sequence: Synthetic polypeptide
AEEEIRTTNPVATEQYGSVSTSNLTQGGENPR

SEQ ID NO: 25517 - protein, 29 aa, Artificial Sequence
  Description of Artificial Sequence: Synthetic peptide
DETEICTTNPVAYEQYGSVSTNPQEDGNR

SEQ ID NO: 25518 - protein, 30 aa, Artificial Sequence
  Description of Artificial Sequence: Synthetic polypeptide
DEEEIRTTNPVATEQYGSVATNLQHGEDSS

SEQ ID NO: 25519 - protein, 29 aa, Artificial Sequence
  Description of Artificial Sequence: Synthetic peptide
DETEICTTNPVAYEQYGSVSTNLQDGNGE

SEQ ID NO: 25520 - protein, 33 aa, Artificial Sequence
  Description of Artificial Sequence: Synthetic polypeptide
DEEEIRTTNPVATEQYGSTSMTENLDQRMGNDR

SEQ ID NO: 25521 - protein, 32 aa, Artificial Sequence
  Description of Artificial Sequence: Synthetic polypeptide
DEEEIRTTNPVATEQYGSTSMTENLEQRIINR

SEQ ID NO: 25522 - protein, 28 aa, Artificial Sequence
  Description of Artificial Sequence: Synthetic peptide
DEECIKTVNPVATEWYGSVSDNLHRGNR

SEQ ID NO: 25523 - protein, 29 aa, Artificial Sequence
  Description of Artificial Sequence: Synthetic peptide
DEPEIRTTNPVATDQYGSVNTQLQRNGNQ

SEQ ID NO: 25524 - protein, 31 aa, Artificial Sequence
  Description of Artificial Sequence: Synthetic polypeptide
DEEEIRTTNPVATEQYGSVSTNTQQGNGTNQ

SEQ ID NO: 25525 - protein, 28 aa, Artificial Sequence
  Description of Artificial Sequence: Synthetic peptide
DETEIRTTNPVATDQYGCVSTNDERGNP

SEQ ID NO: 25526 - protein, 32 aa, Artificial Sequence
  Description of Artificial Sequence: Synthetic polypeptide
AEEEIRTTNPVATEQYGSVSTSNLVQIGNNQR

SEQ ID NO: 25527 - protein, 30 aa, Artificial Sequence
  Description of Artificial Sequence: Synthetic polypeptide
DEEEIRTTNPVATEQYGSTSLPNMSQRDNR

SEQ ID NO: 25528 - protein, 29 aa, Artificial Sequence
  Description of Artificial Sequence: Synthetic peptide
DETEIRTTNPVATDQYGSVNNTGLQRGND

SEQ ID NO: 25529 - protein, 32 aa, Artificial Sequence
  Description of Artificial Sequence: Synthetic polypeptide
DEEEIRTTNPVATEQYGSTSCTENLSQRTGSR

SEQ ID NO: 25530 - protein, 32 aa, Artificial Sequence
  Description of Artificial Sequence: Synthetic polypeptide
DETEIRTTNPVATEAYGSVVPSCTNLSQRGNR

SEQ ID NO: 25531 - protein, 31 aa, Artificial Sequence
  Description of Artificial Sequence: Synthetic polypeptide
DEEEIRTTNPVATEQYGSVSETPNWVQTDNR

SEQ ID NO: 25532 - protein, 31 aa, Artificial Sequence
  Description of Artificial Sequence: Synthetic polypeptide
DETEIRTTNPVATEAYGEVSTNLQRDGENDR

SEQ ID NO: 25533 - protein, 30 aa, Artificial Sequence
  Description of Artificial Sequence: Synthetic polypeptide
AEEEIRTTNPVATEQYGSVSTNIQNDGNNS

SEQ ID NO: 25534 - protein, 29 aa, Artificial Sequence
  Description of Artificial Sequence: Synthetic peptide
DETEIRTTNPVATDSYGSVSTNLQRITNM

SEQ ID NO: 25535 - protein, 29 aa, Artificial Sequence
  Description of Artificial Sequence: Synthetic peptide
DETEIRTTNPVATDQYGSVTTQLQRGTND

SEQ ID NO: 25536 - protein, 29 aa, Artificial Sequence
  Description of Artificial Sequence: Synthetic peptide
DETEIRTTNPVATDQYGSVNTQLQRGNGV

SEQ ID NO: 25537 - protein, 32 aa, Artificial Sequence
  Description of Artificial Sequence: Synthetic polypeptide
DEEEIRTTNPVATEQYGSTSFTEPLSQRIGNR

SEQ ID NO: 25538 - protein, 31 aa, Artificial Sequence
  Description of Artificial Sequence: Synthetic polypeptide
DEEEIRTTNPVATEQYGSVSTANTQGQGNEM

SEQ ID NO: 25539 - protein, 30 aa, Artificial Sequence
  Description of Artificial Sequence: Synthetic polypeptide
SEEEIRTTNPVATEQYGSVVTTNIQTGNRV

SEQ ID NO: 25540 - protein, 30 aa, Artificial Sequence
  Description of Artificial Sequence: Synthetic polypeptide
DETEIRTTNPVATDQYGSVNTNVLQRGNDQ

SEQ ID NO: 25541 - protein, 30 aa, Artificial Sequence
  Description of Artificial Sequence: Synthetic polypeptide
AEEEIRTTNPVATEQYGSVSTNIQNGGTNF

SEQ ID NO: 25542 - protein, 29 aa, Artificial Sequence
  Description of Artificial Sequence: Synthetic peptide
DEPEIRTTNPVATDQYGCVSTNLQEGGNP

SEQ ID NO: 25543 - protein, 30 aa, Artificial Sequence
  Description of Artificial Sequence: Synthetic polypeptide
AEEEIRTTNPVATEQYGSVSTNIQTNDGNA

SEQ ID NO: 25544 - protein, 29 aa, Artificial Sequence
  Description of Artificial Sequence: Synthetic peptide
DETEIRTTNPVATDQYGSVNTLLQRGNVD

SEQ ID NO: 25545 - protein, 32 aa, Artificial Sequence
  Description of Artificial Sequence: Synthetic polypeptide
DEEEIRTTNPVATEQYGSVSTNTLQTEMGNID

SEQ ID NO: 25546 - protein, 30 aa, Artificial Sequence
  Description of Artificial Sequence: Synthetic polypeptide
DEEEIRTTNPVATEQYGSVSTCDQQCNGNF

SEQ ID NO: 25547 - protein, 31 aa, Artificial Sequence
  Description of Artificial Sequence: Synthetic polypeptide
DEEEIRTTNPVATEQYGSVSTNTMQGNGGNP

SEQ ID NO: 25548 - protein, 30 aa, Artificial Sequence
  Description of Artificial Sequence: Synthetic polypeptide
AEEEIRTTNPVATEQYGSVSTSNNEDGGNR

SEQ ID NO: 25549 - protein, 28 aa, Artificial Sequence
  Description of Artificial Sequence: Synthetic peptide
DETEIRTTNPVATDQYGSVNTQDQRGNQ

SEQ ID NO: 25550 - protein, 30 aa, Artificial Sequence
  Description of Artificial Sequence: Synthetic polypeptide
SEEEIRTTNPVATEQYGTVCSTNPVERGNR

SEQ ID NO: 25551 - protein, 29 aa, Artificial Sequence
  Description of Artificial Sequence: Synthetic peptide
SEEEIRTTNPVATEQYGTVSENLVEFGNR

SEQ ID NO: 25552 - protein, 29 aa, Artificial Sequence
  Description of Artificial Sequence: Synthetic peptide
SEEEIRTTNPVATEQYGTVSENPVERGNR

SEQ ID NO: 25553 - protein, 32 aa, Artificial Sequence
  Description of Artificial Sequence: Synthetic polypeptide
DEEEIRTTNPVATEQYGSVATNLQERGTNNDI

SEQ ID NO: 25554 - protein, 31 aa, Artificial Sequence
  Description of Artificial Sequence: Synthetic polypeptide
DEEEIRTTNPVATEQYGSVSTANNQISGNEG

SEQ ID NO: 25555 - protein, 30 aa, Artificial Sequence
  Description of Artificial Sequence: Synthetic polypeptide
AEEEIRTTNPVATEQYGSVSTNLDEGNNQE

SEQ ID NO: 25556 - protein, 33 aa, Artificial Sequence
  Description of Artificial Sequence: Synthetic polypeptide
DEEEIRTTNPVATEQYGSTSMTMNLSQRIGQNR

SEQ ID NO: 25557 - protein, 29 aa, Artificial Sequence
  Description of Artificial Sequence: Synthetic peptide
DEPEIRTTNPVATEQYGEATSTNLQRGDQ

SEQ ID NO: 25558 - protein, 32 aa, Artificial Sequence
  Description of Artificial Sequence: Synthetic polypeptide
AEEEIRTTNPVATEQYGSVSTSNLNQTGENTR

SEQ ID NO: 25559 - protein, 32 aa, Artificial Sequence
  Description of Artificial Sequence: Synthetic polypeptide
AEEEIRTTNPVATEQYGSVSTSNLNQRGENAG

SEQ ID NO: 25560 - protein, 29 aa, Artificial Sequence
  Description of Artificial Sequence: Synthetic peptide
DEECIRCTNPVATEQYGSIVSWNQQRGNL

SEQ ID NO: 25561 - protein, 33 aa, Artificial Sequence
  Description of Artificial Sequence: Synthetic polypeptide
DEEEIRTTNPVATEQYGSTSMTSNLSQRIGNNR

SEQ ID NO: 25562 - protein, 28 aa, Artificial Sequence
  Description of Artificial Sequence: Synthetic peptide
DEPEIRTTNPVATDWYGSVSTNLQRTEQ

SEQ ID NO: 25563 - protein, 30 aa, Artificial Sequence
  Description of Artificial Sequence: Synthetic polypeptide
DEEEIRTTNPVATEQYGSTSNGNMLQGTNR

SEQ ID NO: 25564 - protein, 31 aa, Artificial Sequence
  Description of Artificial Sequence: Synthetic polypeptide
DEEEIRTTNPVATEQYGSVSTNVQQGVGNGQ

SEQ ID NO: 25565 - protein, 31 aa, Artificial Sequence
  Description of Artificial Sequence: Synthetic polypeptide
AEEEIRTTNPVATEQYGSVSTSNLGQQGNNM

SEQ ID NO: 25566 - protein, 30 aa, Artificial Sequence
  Description of Artificial Sequence: Synthetic polypeptide
AEEEIRTTNPVATEQYGSVSTNLDEQGNNP

SEQ ID NO: 25567 - protein, 30 aa, Artificial Sequence
  Description of Artificial Sequence: Synthetic polypeptide
DEEEIRTTNPVATEQYGSTSNPNQLQNDNR

SEQ ID NO: 25568 - protein, 30 aa, Artificial Sequence
  Description of Artificial Sequence: Synthetic polypeptide
SEEEIRTTNPVATEQYGVVVSTNQLQNENR

SEQ ID NO: 25569 - protein, 29 aa, Artificial Sequence
  Description of Artificial Sequence: Synthetic peptide
DEEEIRTTNPVACEQYGSVTTNLQVMDSR

SEQ ID NO: 25570 - protein, 30 aa, Artificial Sequence
  Description of Artificial Sequence: Synthetic polypeptide
DEEEIRTTNPVATEQYGSTSNPNVLQGSNR

SEQ ID NO: 25571 - protein, 32 aa, Artificial Sequence
  Description of Artificial Sequence: Synthetic polypeptide
DEEEIRTTNPVATEQYGSTSNTENLNQEEGNR

SEQ ID NO: 25572 - protein, 33 aa, Artificial Sequence
  Description of Artificial Sequence: Synthetic polypeptide
DEEEIRTTNPVATEQYGSTSPTENLDQRDGNER

SEQ ID NO: 25573 - protein, 31 aa, Artificial Sequence
  Description of Artificial Sequence: Synthetic polypeptide
DEEEIRTTNPVATEQYGSVSTNVQQGMGNEG

SEQ ID NO: 25574 - protein, 31 aa, Artificial Sequence
  Description of Artificial Sequence: Synthetic polypeptide
DEEEIRTTNPVATEQYGSVSTNYHQFGNNVE

SEQ ID NO: 25575 - protein, 29 aa, Artificial Sequence
  Description of Artificial Sequence: Synthetic peptide
DEPEIRTTNPVATDTYGSVSTNLQRTNDM

SEQ ID NO: 25576 - protein, 29 aa, Artificial Sequence
  Description of Artificial Sequence: Synthetic peptide
DETEICTTNPVATEQYGSVSTNLGGGDND

SEQ ID NO: 25577 - protein, 30 aa, Artificial Sequence
  Description of Artificial Sequence: Synthetic polypeptide
SEEEIRTTNPVATEQYGTVSTNLQRNSNFL

SEQ ID NO: 25578 - protein, 29 aa, Artificial Sequence
  Description of Artificial Sequence: Synthetic peptide
SEEEIRTTNPVATEQYGTVSTNLVEFGND

SEQ ID NO: 25579 - protein, 32 aa, Artificial Sequence
  Description of Artificial Sequence: Synthetic polypeptide
DEEEIRTTNPVACEQYGSVSTQNDLLQNGNIR

SEQ ID NO: 25580 - protein, 31 aa, Artificial Sequence
  Description of Artificial Sequence: Synthetic polypeptide
DEEEIRTTNPVATEQYGSVSTNTSQERETIR

SEQ ID NO: 25581 - protein, 32 aa, Artificial Sequence
  Description of Artificial Sequence: Synthetic polypeptide
DEEEIRTTNPVATEQYGSTSMTENLSQNSGNR

SEQ ID NO: 25582 - protein, 31 aa, Artificial Sequence
  Description of Artificial Sequence: Synthetic polypeptide
DEEEIRTTNPVATEQYGSVATNLQGGDEGRP

SEQ ID NO: 25583 - protein, 29 aa, Artificial Sequence
  Description of Artificial Sequence: Synthetic peptide
DEPEIRTTNPVATDQYGTVSTNLERGNTP

SEQ ID NO: 25584 - protein, 32 aa, Artificial Sequence
  Description of Artificial Sequence: Synthetic polypeptide
DEEEIRTTNPVATEQYGSTSMTENLSQREGNE

SEQ ID NO: 25585 - protein, 31 aa, Artificial Sequence
  Description of Artificial Sequence: Synthetic polypeptide
DEEEIRTTNPVATEQYGSVSTNTVQERDMFR

SEQ ID NO: 25586 - protein, 31 aa, Artificial Sequence
  Description of Artificial Sequence: Synthetic polypeptide
DEEEIRTTNPVATEQYGSVSTNVNQNSGNEV

SEQ ID NO: 25587 - protein, 31 aa, Artificial Sequence
  Description of Artificial Sequence: Synthetic polypeptide
DEEEIRTTNPVATEQYGSVSTNTVQNNFGNL

SEQ ID NO: 25588 - protein, 32 aa, Artificial Sequence
  Description of Artificial Sequence: Synthetic polypeptide
DEEEIRTTNPVACEQYGSVSTTNDLLQRGETR

SEQ ID NO: 25589 - protein, 32 aa, Artificial Sequence
  Description of Artificial Sequence: Synthetic polypeptide
DEEEIRTTNPVATEQYGSTSMTENQEQRMGNR

SEQ ID NO: 25590 - protein, 29 aa, Artificial Sequence
  Description of Artificial Sequence: Synthetic peptide
DEPEIRTTNPVATDQYGVVSTNLDERGNP

SEQ ID NO: 25591 - protein, 29 aa, Artificial Sequence
  Description of Artificial Sequence: Synthetic peptide
DETEICTTNPVATEQYGSVSTNLGNGNEN

SEQ ID NO: 25592 - protein, 29 aa, Artificial Sequence
  Description of Artificial Sequence: Synthetic peptide
DEPEIRTTNPVATDQYGVVSTNLERGNDD

SEQ ID NO: 25593 - protein, 31 aa, Artificial Sequence
  Description of Artificial Sequence: Synthetic polypeptide
DEEEIRTTNPVATEQYGSVSTANQQNQGNIN

SEQ ID NO: 25594 - protein, 33 aa, Artificial Sequence
  Description of Artificial Sequence: Synthetic polypeptide
DEEEIRTTNPVATEQYGSTSMTENVLEQRIGNR

SEQ ID NO: 25595 - protein, 30 aa, Artificial Sequence
  Description of Artificial Sequence: Synthetic polypeptide
DEEEIRTTNPVATEQYGSVATNLQFEGVAG

SEQ ID NO: 25596 - protein, 32 aa, Artificial Sequence
  Description of Artificial Sequence: Synthetic polypeptide
DEEEIRTTNPVATEQYGSTSMTEVLSQRVGNR

SEQ ID NO: 25597 - protein, 29 aa, Artificial Sequence
  Description of Artificial Sequence: Synthetic peptide
DETEICTTNPVATEQYGSVSTNLNGNGNH

SEQ ID NO: 25598 - protein, 31 aa, Artificial Sequence
  Description of Artificial Sequence: Synthetic polypeptide
DESEIRTTNPVATEQYGSVCSTNLQSNSNRM

SEQ ID NO: 25599 - protein, 28 aa, Artificial Sequence
  Description of Artificial Sequence: Synthetic peptide
DETCIRTTNPLATEQFGSVSPNLQDGNR

SEQ ID NO: 25600 - protein, 28 aa, Artificial Sequence
  Description of Artificial Sequence: Synthetic peptide
DETCIRTTNPLATEQFGSVSDNLQSGNR

SEQ ID NO: 25601 - protein, 31 aa, Artificial Sequence
  Description of Artificial Sequence: Synthetic polypeptide
SEEEIRTTNPVATESYGSVSNTNLQIRGGQR

SEQ ID NO: 25602 - protein, 30 aa, Artificial Sequence
  Description of Artificial Sequence: Synthetic polypeptide
SEEEIRTTNPVATESYGSVSNTNLSRGDIR

SEQ ID NO: 25603 - protein, 31 aa, Artificial Sequence
  Description of Artificial Sequence: Synthetic polypeptide
DEEEIRTTNPVATEQYGCVCSTNLQRSNEQA

SEQ ID NO: 25604 - protein, 34 aa, Artificial Sequence
  Description of Artificial Sequence: Synthetic polypeptide
DEEEIRTTNPVATEQYGSTVQSCTGNLSQRPGNR

SEQ ID NO: 25605 - protein, 29 aa, Artificial Sequence
  Description of Artificial Sequence: Synthetic peptide
AETEIRNTNPVATEQYGSVSTNLQGPGND

SEQ ID NO: 25606 - protein, 31 aa, Artificial Sequence
  Description of Artificial Sequence: Synthetic polypeptide
AEEEIRTTNPVATEQYGSVSTNLGQQGGNSE

SEQ ID NO: 25607 - protein, 32 aa, Artificial Sequence
  Description of Artificial Sequence: Synthetic polypeptide
DEEEIRTTNPVATEQYGCVCSTNLQRGSNNIY

SEQ ID NO: 25608 - protein, 34 aa, Artificial Sequence
  Description of Artificial Sequence: Synthetic polypeptide
DEEEIRTTNPVATEQYGSTVQSTPNLSQNRGGNR

SEQ ID NO: 25609 - protein, 32 aa, Artificial Sequence
  Description of Artificial Sequence: Synthetic polypeptide
DEEEIRTTNPVATEQYGSVATNLQARPGDNPD

SEQ ID NO: 25610 - protein, 32 aa, Artificial Sequence
  Description of Artificial Sequence: Synthetic polypeptide
DEEEIRTTNPVATEQYGSVSTANLNQNIGNEF

SEQ ID NO: 25611 - protein, 33 aa, Artificial Sequence
  Description of Artificial Sequence: Synthetic polypeptide
DEEEIRTTNPVATEQYGSTVSCANLAQRTVGNR

SEQ ID NO: 25612 - protein, 30 aa, Artificial Sequence
  Description of Artificial Sequence: Synthetic polypeptide
AEEEIRTTNPVATEQYGSVSTNLGQTDGVN

SEQ ID NO: 25613 - protein, 32 aa, Artificial Sequence
  Description of Artificial Sequence: Synthetic polypeptide
DEEEIRTTNPVATEQYGSTVSCLNLQRGTNSA

SEQ ID NO: 25614 - protein, 31 aa, Artificial Sequence
  Description of Artificial Sequence: Synthetic polypeptide
DEEEIRTTNPVATEQYGSTVSCLNSSQRGNS

SEQ ID NO: 25615 - protein, 32 aa, Artificial Sequence
  Description of Artificial Sequence: Synthetic polypeptide
DEEEIRTTNPVATEQYGSTVSCTALSGRGSNR

SEQ ID NO: 25616 - protein, 31 aa, Artificial Sequence
  Description of Artificial Sequence: Synthetic polypeptide
DEEEIRTTNPVATEQYGSVSTPLGQTGNNIM

SEQ ID NO: 25617 - protein, 33 aa, Artificial Sequence
  Description of Artificial Sequence: Synthetic polypeptide
DEEEIRTTNPVATEQYGSTVSCTANLQRGGNNE

SEQ ID NO: 25618 - protein, 31 aa, Artificial Sequence
  Description of Artificial Sequence: Synthetic polypeptide
DEEEIRTTNPVATEQYGSVATNLQAPGEPRN

SEQ ID NO: 25619 - protein, 31 aa, Artificial Sequence
  Description of Artificial Sequence: Synthetic polypeptide
DEEEIRTTNPVATEQYGSVSTANLNINFGND

SEQ ID NO: 25620 - protein, 30 aa, Artificial Sequence
  Description of Artificial Sequence: Synthetic polypeptide
SEEEIRTTNPVATESYGSVSNTNLPRGAQR

SEQ ID NO: 25621 - protein, 32 aa, Artificial Sequence
  Description of Artificial Sequence: Synthetic polypeptide
DEEEIRTTNPVATEQYGSTVPSYTNLSQMGNQ

SEQ ID NO: 25622 - protein, 30 aa, Artificial Sequence
  Description of Artificial Sequence: Synthetic polypeptide
DEEEIRTTNPVATEQYGSVSTPLARSSIRS

SEQ ID NO: 25623 - protein, 32 aa, Artificial Sequence
  Description of Artificial Sequence: Synthetic polypeptide
DEEEIRTTNPVATEQYGSVSTANLQDEGGNEG

SEQ ID NO: 25624 - protein, 29 aa, Artificial Sequence
  Description of Artificial Sequence: Synthetic peptide
DEEEIRTTNPVATEQYGSVATNLQDAVDM

SEQ ID NO: 25625 - protein, 32 aa, Artificial Sequence
  Description of Artificial Sequence: Synthetic polypeptide
DEEEIRTTNPVATEQYGSTVPSTNESSQRGNH

SEQ ID NO: 25626 - protein, 29 aa, Artificial Sequence
  Description of Artificial Sequence: Synthetic peptide
DEEEIRTTNPVATEQYGSVSTPHGQGGDD

SEQ ID NO: 25627 - protein, 30 aa, Artificial Sequence
  Description of Artificial Sequence: Synthetic polypeptide
SEEEIRTTNPVATESYGSVSNTNLHRGEGR

SEQ ID NO: 25628 - protein, 32 aa, Artificial Sequence
  Description of Artificial Sequence: Synthetic polypeptide
DEEEIRTTNPVATEQYGSVSTANLQEGINTGD

SEQ ID NO: 25629 - protein, 29 aa, Artificial Sequence
  Description of Artificial Sequence: Synthetic peptide
DESEISTTNPVATEQYGSVSTNLDYGANT

SEQ ID NO: 25630 - protein, 32 aa, Artificial Sequence
  Description of Artificial Sequence: Synthetic polypeptide
DEEEIRTTNPVATEQYGSVSTANLQEEGINNM

SEQ ID NO: 25631 - protein, 30 aa, Artificial Sequence
  Description of Artificial Sequence: Synthetic polypeptide
DESEISTTNPVATEQYGSVATNLQGGDNRP

SEQ ID NO: 25632 - protein, 28 aa, Artificial Sequence
  Description of Artificial Sequence: Synthetic peptide
DESEISTTNPVATEQYGSVAMNLERGND

SEQ ID NO: 25633 - protein, 31 aa, Artificial Sequence
  Description of Artificial Sequence: Synthetic polypeptide
DEEEIRTTNPVATEQYGSVSTANLNDEGNED

SEQ ID NO: 25634 - protein, 30 aa, Artificial Sequence
  Description of Artificial Sequence: Synthetic polypeptide
DEEEIRTTNPVATEQYGSVSTPIGQRGDQD

SEQ ID NO: 25635 - protein, 31 aa, Artificial Sequence
  Description of Artificial Sequence: Synthetic polypeptide
AEEEIRTTNPVATEQYGSVSTNLGQGGTNVE

SEQ ID NO: 25636 - protein, 32 aa, Artificial Sequence
  Description of Artificial Sequence: Synthetic polypeptide
DEEEIRTTNPVATEQYGSTVPSTNLSQPTGNQ

SEQ ID NO: 25637 - protein, 32 aa, Artificial Sequence
  Description of Artificial Sequence: Synthetic polypeptide
DEEEIRTTNPVATEQYGSTVPSTNLTDGGNNR

SEQ ID NO: 25638 - protein, 33 aa, Artificial Sequence
  Description of Artificial Sequence: Synthetic polypeptide
DEEEIRTTNPVATEQYGSTVPSTNWLSQRGGER

SEQ ID NO: 25639 - protein, 32 aa, Artificial Sequence
  Description of Artificial Sequence: Synthetic polypeptide
DEEEIRTTNPVATEQYGSVSSTNLQFGTNEGQ

SEQ ID NO: 25640 - protein, 30 aa, Artificial Sequence
  Description of Artificial Sequence: Synthetic polypeptide
SEEEIRTTNPVATESYGSVSNTNLNYGDNR

SEQ ID NO: 25641 - protein, 28 aa, Artificial Sequence
  Description of Artificial Sequence: Synthetic peptide
CEEEIRTTNPVATELYGQISINQQRGNR

SEQ ID NO: 25642 - protein, 34 aa, Artificial Sequence
  Description of Artificial Sequence: Synthetic polypeptide
DEEEIRTTNPVATEQYGSTVPSTPNELSQRGTNR

SEQ ID NO: 25643 - protein, 33 aa, Artificial Sequence
  Description of Artificial Sequence: Synthetic polypeptide
DEEEIRTTNPVATEQYGSTVPSTPNQSQRGGNR

SEQ ID NO: 25644 - protein, 32 aa, Artificial Sequence
  Description of Artificial Sequence: Synthetic polypeptide
DEEEIRTTNPVATEQYGSTVPSTNLSQMSGNQ

SEQ ID NO: 25645 - protein, 30 aa, Artificial Sequence
  Description of Artificial Sequence: Synthetic polypeptide
AEEEIRTTNPVATEQYGSVSTNTNQVGNGD

SEQ ID NO: 25646 - protein, 31 aa, Artificial Sequence
  Description of Artificial Sequence: Synthetic polypeptide
DEEEIRTTNPVATEQYGSVSTPLHEEGNNRD

SEQ ID NO: 25647 - protein, 29 aa, Artificial Sequence
  Description of Artificial Sequence: Synthetic peptide
DESEIRTTNPVAYEQYGSVSTNNQGDGNT

SEQ ID NO: 25648 - protein, 29 aa, Artificial Sequence
  Description of Artificial Sequence: Synthetic peptide
DEEEICTTNPVAYEPYGSVATNLQRGNDV

SEQ ID NO: 25649 - protein, 30 aa, Artificial Sequence
  Description of Artificial Sequence: Synthetic polypeptide
DESEIRTTNPVAYEQYGSVAATNLQRGNDQ

SEQ ID NO: 25650 - protein, 32 aa, Artificial Sequence
  Description of Artificial Sequence: Synthetic polypeptide
DESEIRTTNPVAYEQYGSTVSVTNELQRTGNR

SEQ ID NO: 25651 - protein, 34 aa, Artificial Sequence
  Description of Artificial Sequence: Synthetic polypeptide
DEEEIRTTNPVATEQYGSTVSCTNALSQRGQDNR

SEQ ID NO: 25652 - protein, 30 aa, Artificial Sequence
  Description of Artificial Sequence: Synthetic polypeptide
DEPEIRTTNPVATEQYGSVSVNLQRGVIQD

SEQ ID NO: 25653 - protein, 30 aa, Artificial Sequence
  Description of Artificial Sequence: Synthetic polypeptide
DEEEIRTTNPVATEQYGSVSTQNDNLSGND

SEQ ID NO: 25654 - protein, 32 aa, Artificial Sequence
  Description of Artificial Sequence: Synthetic polypeptide
DEEEIRTTNPVATEQYGSVSSTNLQFTGGNTQ

SEQ ID NO: 25655 - protein, 31 aa, Artificial Sequence
  Description of Artificial Sequence: Synthetic polypeptide
DEEEIRTTNPVATEQYGSVATNLQAGPEPRT

SEQ ID NO: 25656 - protein, 32 aa, Artificial Sequence
  Description of Artificial Sequence: Synthetic polypeptide
DEEEIRTTNPVATEQYGSTVSCTNELDRTGNE

SEQ ID NO: 25657 - protein, 31 aa, Artificial Sequence
  Description of Artificial Sequence: Synthetic polypeptide
DEEEIRTTNPVATEQYGSVSTPLQARDINEE

SEQ ID NO: 25658 - protein, 33 aa, Artificial Sequence
  Description of Artificial Sequence: Synthetic polypeptide
DEEEIRTTNPVATEQYGSTVSCTNELSGRGNNR

SEQ ID NO: 25659 - protein, 29 aa, Artificial Sequence
  Description of Artificial Sequence: Synthetic peptide
DESEIRTTNPVAYEQYGSISTNHQREGDR

SEQ ID NO: 25660 - protein, 30 aa, Artificial Sequence
  Description of Artificial Sequence: Synthetic polypeptide
AEEEIRTTNPVATEQYGSVSTNLIEEGGNS

SEQ ID NO: 25661 - protein, 30 aa, Artificial Sequence
  Description of Artificial Sequence: Synthetic polypeptide
AEEEIRTTNPVATEQYGSVSTNTILGNERV

SEQ ID NO: 25662 - protein, 33 aa, Artificial Sequence
  Description of Artificial Sequence: Synthetic polypeptide
DEEEIRTTNPVATEQYGSTVSCTNELSQRGTER

SEQ ID NO: 25663 - protein, 32 aa, Artificial Sequence
  Description of Artificial Sequence: Synthetic polypeptide
DEEEIRTTNPVATEQYGSTVSCTNGQRTVGNQ

SEQ ID NO: 25664 - protein, 32 aa, Artificial Sequence
  Description of Artificial Sequence: Synthetic polypeptide
DESEIRTTNPVAYEQYGQSVSTNNLSQRGGNR

SEQ ID NO: 25665 - protein, 28 aa, Artificial Sequence
  Description of Artificial Sequence: Synthetic peptide
DEPEIRTTNPVATEQYGVVSTVLQRPED

SEQ ID NO: 25666 - protein, 31 aa, Artificial Sequence
  Description of Artificial Sequence: Synthetic polypeptide
DEEEIRTTNPVATEQYGSVSTPLQEGSNEEG

SEQ ID NO: 25667 - protein, 33 aa, Artificial Sequence
  Description of Artificial Sequence: Synthetic polypeptide
DEEEIRTTNPVATEQYGSTVSCTNALQRVGDDR

SEQ ID NO: 25668 - protein, 29 aa, Artificial Sequence
  Description of Artificial Sequence: Synthetic peptide
DEEEIRTTNPVATEQYGSVSTPLPNRTDD

SEQ ID NO: 25669 - protein, 31 aa, Artificial Sequence
  Description of Artificial Sequence: Synthetic polypeptide
DEEEIRTTNPVATEQYGSVSTPLNQNQGNNQ

SEQ ID NO: 25670 - protein, 30 aa, Artificial Sequence
  Description of Artificial Sequence: Synthetic polypeptide
AEEEIRTTNPVATEQYGSVSTNTLGVQGND

SEQ ID NO: 25671 - protein, 32 aa, Artificial Sequence
  Description of Artificial Sequence: Synthetic polypeptide
DEEEIRTTNPVATEQYGSTVSCTGNELTPGNR

SEQ ID NO: 25672 - protein, 30 aa, Artificial Sequence
  Description of Artificial Sequence: Synthetic polypeptide
DESEIRTTNPVAYEQYGSVSTNLQQDMNQR

SEQ ID NO: 25673 - protein, 32 aa, Artificial Sequence
  Description of Artificial Sequence: Synthetic polypeptide
DEEEIRTTNPVATEQYGSVSTANLGQEIGNDD

SEQ ID NO: 25674 - protein, 31 aa, Artificial Sequence
  Description of Artificial Sequence: Synthetic polypeptide
AEEEIRTTNPVATEQYGSVSTNTLQGGNQTS

SEQ ID NO: 25675 - protein, 30 aa, Artificial Sequence
  Description of Artificial Sequence: Synthetic polypeptide
AEEEIRTTNPVATEQYGSVSTNTLNNGGNA

SEQ ID NO: 25676 - protein, 29 aa, Artificial Sequence
  Description of Artificial Sequence: Synthetic peptide
DESEIRTTNPVAYEQYGSVSTNGQGMGDR

SEQ ID NO: 25677 - protein, 30 aa, Artificial Sequence
  Description of Artificial Sequence: Synthetic polypeptide
DEEEIRTTNPVATEQYGCVCSTNLQNGQAE

SEQ ID NO: 25678 - protein, 29 aa, Artificial Sequence
  Description of Artificial Sequence: Synthetic peptide
AETEIRTTNPVATEQYGSVATNLQIGNST

SEQ ID NO: 25679 - protein, 29 aa, Artificial Sequence
  Description of Artificial Sequence: Synthetic peptide
AETEIRTTNPVATEQYGSVNTNLQIGDSR

SEQ ID NO: 25680 - protein, 30 aa, Artificial Sequence
  Description of Artificial Sequence: Synthetic polypeptide
DEEEIRTTNPVATEQYGCVCSTNLQNINME

SEQ ID NO: 25681 - protein, 32 aa, Artificial Sequence
  Description of Artificial Sequence: Synthetic polypeptide
DEEEIRTTNPVATEQYGSVSETNLQQVFGTRQ

SEQ ID NO: 25682 - protein, 33 aa, Artificial Sequence
  Description of Artificial Sequence: Synthetic polypeptide
DEEEIRTTNPVATEQYGSTVSCTGNLQRTPGNE

SEQ ID NO: 25683 - protein, 29 aa, Artificial Sequence
  Description of Artificial Sequence: Synthetic peptide
AETEIRTTNPVATEQYGSVTTNLQIAGSR

SEQ ID NO: 25684 - protein, 30 aa, Artificial Sequence
  Description of Artificial Sequence: Synthetic polypeptide
DEEEIRTTNPVATEQYGSVSENLQQVGEID

SEQ ID NO: 25685 - protein, 29 aa, Artificial Sequence
  Description of Artificial Sequence: Synthetic peptide
AETEIRTTNPVATEQYGSVVTNLQIGSVR

SEQ ID NO: 25686 - protein, 28 aa, Artificial Sequence
  Description of Artificial Sequence: Synthetic peptide
AETEIRTTNPVSTEQYGSVSTNLMRGTQ

SEQ ID NO: 25687 - protein, 30 aa, Artificial Sequence
  Description of Artificial Sequence: Synthetic polypeptide
DESEIRTTNPVAYEQYGSVSTENLQPDGNA

SEQ ID NO: 25688 - protein, 31 aa, Artificial Sequence
  Description of Artificial Sequence: Synthetic polypeptide
AEEEIRTTNPVATEQYGSVSTNLGQTNGDNN

SEQ ID NO: 25689 - protein, 29 aa, Artificial Sequence
  Description of Artificial Sequence: Synthetic peptide
DESEIRTTNPVAYEQYGSVSTELQPDGNH

SEQ ID NO: 25690 - protein, 34 aa, Artificial Sequence
  Description of Artificial Sequence: Synthetic polypeptide
DEEEIRTTNPVATEQYGSTVSCTGNLSQRGLNNR

SEQ ID NO: 25691 - protein, 29 aa, Artificial Sequence
  Description of Artificial Sequence: Synthetic peptide
AETEIRTTNPVATEQYGSVSTTNLQIGSQ

SEQ ID NO: 25692 - protein, 31 aa, Artificial Sequence
  Description of Artificial Sequence: Synthetic polypeptide
DEPEIRTTNPVATEQYGSVSTNLVRGVNEVD

SEQ ID NO: 25693 - protein, 32 aa, Artificial Sequence
  Description of Artificial Sequence: Synthetic polypeptide
DEEEIRTTNPVATEQYGSTVPSTNALSQRGEA

SEQ ID NO: 25694 - protein, 34 aa, Artificial Sequence
  Description of Artificial Sequence: Synthetic polypeptide
DEEEIRTTNPVATEQYGSTVPSTNALQHRTGNYR

SEQ ID NO: 25695 - protein, 32 aa, Artificial Sequence
  Description of Artificial Sequence: Synthetic polypeptide
DEEEIRTTNPVATEQYGSTSVTENLSQRTGND

SEQ ID NO: 25696 - protein, 29 aa, Artificial Sequence
  Description of Artificial Sequence: Synthetic peptide
DEECIRTTNPVAYEQYGKVSTGNVQRGNN

SEQ ID NO: 25697 - protein, 29 aa, Artificial Sequence
  Description of Artificial Sequence: Synthetic peptide
DEECIRTTNPVAYEQYGKVSTINVQRGNM

SEQ ID NO: 25698 - protein, 30 aa, Artificial Sequence
  Description of Artificial Sequence: Synthetic polypeptide
DEPEIRTTNPVATEQYGSVSIGNLARNVNR

SEQ ID NO: 25699 - protein, 29 aa, Artificial Sequence
  Description of Artificial Sequence: Synthetic peptide
DEPEIRTTNPVATEQYGSVSINDARNVNR

SEQ ID NO: 25700 - protein, 30 aa, Artificial Sequence
  Description of Artificial Sequence: Synthetic polypeptide
DEEEIRTTNPVATEQYGSVSLNLQIGELQS

SEQ ID NO: 25701 - protein, 29 aa, Artificial Sequence
  Description of Artificial Sequence: Synthetic peptide
DESVIRTTNPVATEVYGQVATNLQRGDNR

SEQ ID NO: 25702 - protein, 30 aa, Artificial Sequence
  Description of Artificial Sequence: Synthetic polypeptide
DEEEIRTTNPVATEQYGSVATNLQDGSDAL

SEQ ID NO: 25703 - protein, 30 aa, Artificial Sequence
  Description of Artificial Sequence: Synthetic polypeptide
DESVIRTTNPVATEQYGSVSTNLGDNGQNR

SEQ ID NO: 25704 - protein, 31 aa, Artificial Sequence
  Description of Artificial Sequence: Synthetic polypeptide
DEPEIRTTNPVATEQYGSVSINLQRQGMERG

SEQ ID NO: 25705 - protein, 31 aa, Artificial Sequence
  Description of Artificial Sequence: Synthetic polypeptide
AEEEIRTTNPVATEQYGSVSTNLDQQGNNTG

SEQ ID NO: 25706 - protein, 31 aa, Artificial Sequence
  Description of Artificial Sequence: Synthetic polypeptide
DEEEIRTTNPVATEQYGSVSENLQMDGNEES

SEQ ID NO: 25707 - protein, 31 aa, Artificial Sequence
  Description of Artificial Sequence: Synthetic polypeptide
DEEEIRTTNPVATEQYGSVATNLQDGPNGEL

SEQ ID NO: 25708 - protein, 30 aa, Artificial Sequence
  Description of Artificial Sequence: Synthetic polypeptide
AEEEIRTTNPVATEQYGSVSTPNQEQGGNM

SEQ ID NO: 25709 - protein, 30 aa, Artificial Sequence
  Description of Artificial Sequence: Synthetic polypeptide
DEEEIRTTNPVATEQYGSVATNLQDGPGMN

SEQ ID NO: 25710 - protein, 30 aa, Artificial Sequence
  Description of Artificial Sequence: Synthetic polypeptide
DEEEIRTTNPVATEQYGSVATNLQDGPADM

SEQ ID NO: 25711 - protein, 31 aa, Artificial Sequence
  Description of Artificial Sequence: Synthetic polypeptide
AEEEIRTTNPVATEQYGSVSTNLDQQQGNNG

SEQ ID NO: 25712 - protein, 28 aa, Artificial Sequence
  Description of Artificial Sequence: Synthetic peptide
DESVIRTTNPVATEQYGCVGTNPQAGNR

SEQ ID NO: 25713 - protein, 30 aa, Artificial Sequence
  Description of Artificial Sequence: Synthetic polypeptide
AEEEIRTTNPVATEQYGSVSTNLEEGGNMT

SEQ ID NO: 25714 - protein, 30 aa, Artificial Sequence
  Description of Artificial Sequence: Synthetic polypeptide
AEEEIRTTNPVATEQYGSVSTQLGQIVGNN

SEQ ID NO: 25715 - protein, 32 aa, Artificial Sequence
  Description of Artificial Sequence: Synthetic polypeptide
DEEEIRTTNPVATEQYGSVSETNNLQGGGNND

SEQ ID NO: 25716 - protein, 32 aa, Artificial Sequence
  Description of Artificial Sequence: Synthetic polypeptide
DEEEIRTTNPVATEQYGSTSTTQNLSQETGNR

SEQ ID NO: 25717 - protein, 30 aa, Artificial Sequence
  Description of Artificial Sequence: Synthetic polypeptide
DEPEIRTTNPVATEQYGSVSFNLARNVNER

SEQ ID NO: 25718 - protein, 30 aa, Artificial Sequence
  Description of Artificial Sequence: Synthetic polypeptide
AEEEIRTTNPVATEQYGSVSTQLQQQGNNQ

SEQ ID NO: 25719 - protein, 29 aa, Artificial Sequence
  Description of Artificial Sequence: Synthetic peptide
DEPEIRTTNPVATEQYGSVNTNDQIGDNQ

SEQ ID NO: 25720 - protein, 31 aa, Artificial Sequence
  Description of Artificial Sequence: Synthetic polypeptide
DEEEIRTTNPVATEQYGSVSTANLQGEFNTD

SEQ ID NO: 25721 - protein, 29 aa, Artificial Sequence
  Description of Artificial Sequence: Synthetic peptide
AEEEIRTTNPVATEQYGSVSTQLQQANQN

SEQ ID NO: 25722 - protein, 29 aa, Artificial Sequence
  Description of Artificial Sequence: Synthetic peptide
AEEEIRTTNPVATEQYGSVSTQLQQANED

SEQ ID NO: 25723 - protein, 30 aa, Artificial Sequence
  Description of Artificial Sequence: Synthetic polypeptide
AEEEIRTTNPVATEQYGSVSTQLQQAGNQL

SEQ ID NO: 25724 - protein, 31 aa, Artificial Sequence
  Description of Artificial Sequence: Synthetic polypeptide
DEEEIRTTNPVATEQYGSTSTNNLQENFSNR

SEQ ID NO: 25725 - protein, 29 aa, Artificial Sequence
  Description of Artificial Sequence: Synthetic peptide
AEEEIRTTNPVATEQYGSVSTQLQLGAIA

SEQ ID NO: 25726 - protein, 32 aa, Artificial Sequence
  Description of Artificial Sequence: Synthetic polypeptide
DEEEIRTTNPVATEQYGSTSTTENLQQSTGNR

SEQ ID NO: 25727 - protein, 30 aa, Artificial Sequence
  Description of Artificial Sequence: Synthetic polypeptide
AEEEIRTTNPVATEQYGSVSTPNLQNQGEQ

SEQ ID NO: 25728 - protein, 32 aa, Artificial Sequence
  Description of Artificial Sequence: Synthetic polypeptide
DEEEIRTTNPVATEQYGSTSTTENLSQIIGNR

SEQ ID NO: 25729 - protein, 29 aa, Artificial Sequence
  Description of Artificial Sequence: Synthetic peptide
DEPEIRTTNPVATEQYGSVSAPLARNVNR

SEQ ID NO: 25730 - protein, 30 aa, Artificial Sequence
  Description of Artificial Sequence: Synthetic polypeptide
DEEEIRTTNPVATEQYGSVATNLQDNGEME

SEQ ID NO: 25731 - protein, 30 aa, Artificial Sequence
  Description of Artificial Sequence: Synthetic polypeptide
AEEEIRTTNPVATEQYGSVSTQLQISGNIG

SEQ ID NO: 25732 - protein, 30 aa, Artificial Sequence
  Description of Artificial Sequence: Synthetic polypeptide
DEEEIRTTNPVATEQYGSVATNLQDGTGDE

SEQ ID NO: 25733 - protein, 30 aa, Artificial Sequence
  Description of Artificial Sequence: Synthetic polypeptide
AEEEIRTTNPVATEQYGSVSTQLQILGNIN

SEQ ID NO: 25734 - protein, 30 aa, Artificial Sequence
  Description of Artificial Sequence: Synthetic polypeptide
AEEEIRTTNPVATEQYGSVSTQLQIIEGNN

SEQ ID NO: 25735 - protein, 31 aa, Artificial Sequence
  Description of Artificial Sequence: Synthetic polypeptide
DEPEIRTTNPVATEQYGSVSENLQRIGMNIT

SEQ ID NO: 25736 - protein, 30 aa, Artificial Sequence
  Description of Artificial Sequence: Synthetic polypeptide
AEEEIRTTNPVATEQYGSVSTQLQESGNVN

SEQ ID NO: 25737 - protein, 29 aa, Artificial Sequence
  Description of Artificial Sequence: Synthetic peptide
AEEEIRTTNPVATEQYGSVSTQLQEANLQ

SEQ ID NO: 25738 - protein, 31 aa, Artificial Sequence
  Description of Artificial Sequence: Synthetic polypeptide
DEEEIRTTNPVATEQYGSVATNLQDNGNEND

SEQ ID NO: 25739 - protein, 30 aa, Artificial Sequence
  Description of Artificial Sequence: Synthetic polypeptide
DEEEIRTTNPVATEQYGSVATNLQDGGDMP

SEQ ID NO: 25740 - protein, 30 aa, Artificial Sequence
  Description of Artificial Sequence: Synthetic polypeptide
DEEEIRTTNPVATEQYGSVSETNLQVNEIP

SEQ ID NO: 25741 - protein, 30 aa, Artificial Sequence
  Description of Artificial Sequence: Synthetic polypeptide
AEEEIRTTNPVATEQYGSVSTNLELGNQNQ

SEQ ID NO: 25742 - protein, 31 aa, Artificial Sequence
  Description of Artificial Sequence: Synthetic polypeptide
DEEEICTTNPVAYEQYGSVCCTNLSQRGSNR

SEQ ID NO: 25743 - protein, 30 aa, Artificial Sequence
  Description of Artificial Sequence: Synthetic polypeptide
AEEEIRTTNPVATEQYGSVSTNTVNQGNNR

SEQ ID NO: 25744 - protein, 30 aa, Artificial Sequence
  Description of Artificial Sequence: Synthetic polypeptide
AEEEIRTTNPVATEQYGSVSTNLGEAGNAS

SEQ ID NO: 25745 - protein, 31 aa, Artificial Sequence
  Description of Artificial Sequence: Synthetic polypeptide
DEPEIRTTNPVATEQYGSVSTNLQRQGIIQD

SEQ ID NO: 25746 - protein, 30 aa, Artificial Sequence
  Description of Artificial Sequence: Synthetic polypeptide
AEEEIRTTNPVATEQYGSVSTNTQVGIGND

SEQ ID NO: 25747 - protein, 32 aa, Artificial Sequence
  Description of Artificial Sequence: Synthetic polypeptide
DEEEIRTTNPVATEQYGSVSETNLQRIGVTEA

SEQ ID NO: 25748 - protein, 30 aa, Artificial Sequence
  Description of Artificial Sequence: Synthetic polypeptide
AEEEIRTTNPVATEQYGSVSTNTQQSGNLG

SEQ ID NO: 25749 - protein, 30 aa, Artificial Sequence
  Description of Artificial Sequence: Synthetic polypeptide
SEEEIRTTNPVATESYGSVSNTNLERGEQR

SEQ ID NO: 25750 - protein, 31 aa, Artificial Sequence
  Description of Artificial Sequence: Synthetic polypeptide
DEEEICTTNPVAYEQYGSTVSTNELQIGGNR

SEQ ID NO: 25751 - protein, 30 aa, Artificial Sequence
  Description of Artificial Sequence: Synthetic polypeptide
DEEEIRTTNPVATEQYGSVSTPFDLQNQNT

SEQ ID NO: 25752 - protein, 30 aa, Artificial Sequence
  Description of Artificial Sequence: Synthetic polypeptide
SEEEIRTTNPVATESYGSVSNTNLERGVQR

SEQ ID NO: 25753 - protein, 31 aa, Artificial Sequence
  Description of Artificial Sequence: Synthetic polypeptide
DEEEIRTTNPVATEQYGSVSTPGLQNAGNSD

SEQ ID NO: 25754 - protein, 30 aa, Artificial Sequence
  Description of Artificial Sequence: Synthetic polypeptide
AEEEIRTTNPVATEQYGSVSTNLGGTEGNN

SEQ ID NO: 25755 - protein, 32 aa, Artificial Sequence
  Description of Artificial Sequence: Synthetic polypeptide
DEEEIRTTNPVATEQYGSVSETNLQRGELVGN

SEQ ID NO: 25756 - protein, 30 aa, Artificial Sequence
  Description of Artificial Sequence: Synthetic polypeptide
DEEEIRTTNPVATEQYGSVSTPGLQSNGDE

SEQ ID NO: 25757 - protein, 28 aa, Artificial Sequence
  Description of Artificial Sequence: Synthetic peptide
DESSIRTTNPLATEQFGSVSCNLQSGNR

SEQ ID NO: 25758 - protein, 30 aa, Artificial Sequence
  Description of Artificial Sequence: Synthetic polypeptide
AEEEIRTTNPVATEQYGSVSTNTQGVEGNG

SEQ ID NO: 25759 - protein, 30 aa, Artificial Sequence
  Description of Artificial Sequence: Synthetic polypeptide
AEEEIRTTNPVATEQYGSVSTNTQGGGNVD

SEQ ID NO: 25760 - protein, 32 aa, Artificial Sequence
  Description of Artificial Sequence: Synthetic polypeptide
DEEEIRTTNPVATEQYGSVSTPGNLQRSEQRD

SEQ ID NO: 25761 - protein, 32 aa, Artificial Sequence
  Description of Artificial Sequence: Synthetic polypeptide
DEEEIRTTNPVATEQYGSVSSTNLQFEGDNEF

SEQ ID NO: 25762 - protein, 31 aa, Artificial Sequence
  Description of Artificial Sequence: Synthetic polypeptide
CEEEIRTTNPVATEQWGSVNTNALSQRGGNR

SEQ ID NO: 25763 - protein, 29 aa, Artificial Sequence
  Description of Artificial Sequence: Synthetic peptide
DEEEIRTTNPVATEQYGSVATNLQDPAED

SEQ ID NO: 25764 - protein, 30 aa, Artificial Sequence
  Description of Artificial Sequence: Synthetic polypeptide
AEEEIRTTNPVATEQYGSVSTNLGDEFGNN

SEQ ID NO: 25765 - protein, 32 aa, Artificial Sequence
  Description of Artificial Sequence: Synthetic polypeptide
DEEEIRTTNPVATEQYGSVSTANLQESGNEFQ

SEQ ID NO: 25766 - protein, 30 aa, Artificial Sequence
  Description of Artificial Sequence: Synthetic polypeptide
AESEIRTTNPVATEQYGEVSCNLQDRGENR

SEQ ID NO: 25767 - protein, 28 aa, Artificial Sequence
  Description of Artificial Sequence: Synthetic peptide
AESEIRTTNPVATEQYGSVVTNLQIGSA

SEQ ID NO: 25768 - protein, 30 aa, Artificial Sequence
  Description of Artificial Sequence: Synthetic polypeptide
CEEEIRTTNPVATEQYGCVCQTNLQRGSNV

SEQ ID NO: 25769 - protein, 28 aa, Artificial Sequence
  Description of Artificial Sequence: Synthetic peptide
DESVIRTTNPVATEQYGCVATNPQDGNR

SEQ ID NO: 25770 - protein, 31 aa, Artificial Sequence
  Description of Artificial Sequence: Synthetic polypeptide
DEEEIRTTNPVATEQYGSVSTQNDQEVGNSQ

SEQ ID NO: 25771 - protein, 31 aa, Artificial Sequence
  Description of Artificial Sequence: Synthetic polypeptide
AEEEIRTTNPVATEQYGSVSTNLELQEGNIN

SEQ ID NO: 25772 - protein, 30 aa, Artificial Sequence
  Description of Artificial Sequence: Synthetic polypeptide
DEPEIRTTNPVATEQYGSVSTIALARNVNR

SEQ ID NO: 25773 - protein, 29 aa, Artificial Sequence
  Description of Artificial Sequence: Synthetic peptide
AEEEIRTTNPVATEQYGSVSTNLEMGESE

SEQ ID NO: 25774 - protein, 30 aa, Artificial Sequence
  Description of Artificial Sequence: Synthetic polypeptide
DEEEIRTTNPVATEQYGSVATNLQDGEGAP

SEQ ID NO: 25775 - protein, 29 aa, Artificial Sequence
  Description of Artificial Sequence: Synthetic peptide
AEEEIRTTNPVATEQYGSVSTNVDELGNE

SEQ ID NO: 25776 - protein, 30 aa, Artificial Sequence
  Description of Artificial Sequence: Synthetic polypeptide
AEEEIRTTNPVATEQYGSVSTPNEQNGNGN

SEQ ID NO: 25777 - protein, 30 aa, Artificial Sequence
  Description of Artificial Sequence: Synthetic polypeptide
DEEEIRTTNPVATEQYGSVATNLQDDDGRN

SEQ ID NO: 25778 - protein, 32 aa, Artificial Sequence
  Description of Artificial Sequence: Synthetic polypeptide
DEEEIRTTNPVATEQYGSVSSTNLQFAGNENT

SEQ ID NO: 25779 - protein, 30 aa, Artificial Sequence
  Description of Artificial Sequence: Synthetic polypeptide
DEEEIRTTNPVATEQYGSVSTPDNDMGNER

SEQ ID NO: 25780 - protein, 30 aa, Artificial Sequence
  Description of Artificial Sequence: Synthetic polypeptide
AEEEIRTTNPVATEQYGSVSTPNEEQNGNE

SEQ ID NO: 25781 - protein, 29 aa, Artificial Sequence
  Description of Artificial Sequence: Synthetic peptide
AEEEIRTTNPVATEQYGSVSTNLETGGET

SEQ ID NO: 25782 - protein, 33 aa, Artificial Sequence
  Description of Artificial Sequence: Synthetic polypeptide
DEEEIRTTNPVATEQYGSVSTPEGLQRGSNGRQ

SEQ ID NO: 25783 - protein, 30 aa, Artificial Sequence
  Description of Artificial Sequence: Synthetic polypeptide
DEEEIRTTNPVATEQYGSVSTPEMLGMGDR

SEQ ID NO: 25784 - protein, 31 aa, Artificial Sequence
  Description of Artificial Sequence: Synthetic polypeptide
DEEEICTTNPVAYEQYGSVSCTHELQRGNNR

SEQ ID NO: 25785 - protein, 33 aa, Artificial Sequence
  Description of Artificial Sequence: Synthetic polypeptide
DEEEIRTTNPVATEQYGSTVCSCTNLSTQLGNR

SEQ ID NO: 25786 - protein, 28 aa, Artificial Sequence
  Description of Artificial Sequence: Synthetic peptide
DEPEIRTTNPVATEQYGSVSTNLESTGQ

SEQ ID NO: 25787 - protein, 30 aa, Artificial Sequence
  Description of Artificial Sequence: Synthetic polypeptide
AEEEIRTTNPVATEQYGSVSTNINQQNGNL

SEQ ID NO: 25788 - protein, 31 aa, Artificial Sequence
  Description of Artificial Sequence: Synthetic polypeptide
SEEELRTTNPVATEQYGSVSTVNLDQRIGNP

SEQ ID NO: 25789 - protein, 28 aa, Artificial Sequence
  Description of Artificial Sequence: Synthetic peptide
SEGEIRCTNPCATEQYGSVSENLMRGNR

SEQ ID NO: 25790 - protein, 31 aa, Artificial Sequence
  Description of Artificial Sequence: Synthetic polypeptide
DEEEIRTTNPVATEQYGSVSTPNLQVGELEF

SEQ ID NO: 25791 - protein, 30 aa, Artificial Sequence
  Description of Artificial Sequence: Synthetic polypeptide
DEEEIRTTNPVATEQYGSVSETLVQNGERN

SEQ ID NO: 25792 - protein, 32 aa, Artificial Sequence
  Description of Artificial Sequence: Synthetic polypeptide
DEEEIRTTNPVATEQYGSVASTNLVQTGGNGN

SEQ ID NO: 25793 - protein, 32 aa, Artificial Sequence
  Description of Artificial Sequence: Synthetic polypeptide
DEEEIRTTNPVATEQYGSVSTPNLQVEGGNNI

SEQ ID NO: 25794 - protein, 30 aa, Artificial Sequence
  Description of Artificial Sequence: Synthetic polypeptide
AEEEIRTTNPVATEQYGSVSTNLQLGGAAI

SEQ ID NO: 25795 - protein, 29 aa, Artificial Sequence
  Description of Artificial Sequence: Synthetic peptide
DEDEIRTTNPVATEQWGSVATNLQNGNEE

SEQ ID NO: 25796 - protein, 32 aa, Artificial Sequence
  Description of Artificial Sequence: Synthetic polypeptide
DEQEIRTTNPVATEQYGSVSNTNLQREGSNEE

SEQ ID NO: 25797 - protein, 32 aa, Artificial Sequence
  Description of Artificial Sequence: Synthetic polypeptide
DEEEIRTTNPVATEQYGSVSTPNLQTSGQNNP

SEQ ID NO: 25798 - protein, 30 aa, Artificial Sequence
  Description of Artificial Sequence: Synthetic polypeptide
DEEEIRTTNPVATEQYGSVSETLVERGERM

SEQ ID NO: 25799 - protein, 32 aa, Artificial Sequence
  Description of Artificial Sequence: Synthetic polypeptide
DEEEIRTTNPVATEQYGSVSTPNLQAQGGNET

SEQ ID NO: 25800 - protein, 29 aa, Artificial Sequence
  Description of Artificial Sequence: Synthetic peptide
DEQEIRTTNPVATEQYGSVSQNLFSNENR

SEQ ID NO: 25801 - protein, 28 aa, Artificial Sequence
  Description of Artificial Sequence: Synthetic peptide
SEESIRCTNPIATEQYGSVSENLMRGNR

SEQ ID NO: 25802 - protein, 30 aa, Artificial Sequence
  Description of Artificial Sequence: Synthetic polypeptide
AEEEIRTTNPVATEQYGSVSTNLQVTGDGG

SEQ ID NO: 25803 - protein, 31 aa, Artificial Sequence
  Description of Artificial Sequence: Synthetic polypeptide
AEEEIRTTNPVATEQYGSVSTNLQVNGNVNN

SEQ ID NO: 25804 - protein, 28 aa, Artificial Sequence
  Description of Artificial Sequence: Synthetic peptide
DESEIATTNPVATEQWGSVSVNLQQGNL

SEQ ID NO: 25805 - protein, 31 aa, Artificial Sequence
  Description of Artificial Sequence: Synthetic polypeptide
DEEEIRTTNPVATEQYGSVSLTNLIRGMQDQ

SEQ ID NO: 25806 - protein, 31 aa, Artificial Sequence
  Description of Artificial Sequence: Synthetic polypeptide
DEEEIRTTNPVATEQYGSVADTWLAQREHNR

SEQ ID NO: 25807 - protein, 29 aa, Artificial Sequence
  Description of Artificial Sequence: Synthetic peptide
DEAEIRTTNPVAYEQYGSCSTNLGRPNRP

SEQ ID NO: 25808 - protein, 28 aa, Artificial Sequence
  Description of Artificial Sequence: Synthetic peptide
DEAEIRTTNPVAYEQYGSCSTNDERPNR

SEQ ID NO: 25809 - protein, 29 aa, Artificial Sequence
  Description of Artificial Sequence: Synthetic peptide
DESEIATTNPVATEQYGSTVSTNLMHGNT

SEQ ID NO: 25810 - protein, 28 aa, Artificial Sequence
  Description of Artificial Sequence: Synthetic peptide
DEQEIRTTNPVATEQYGSVSENLMRMQQ

SEQ ID NO: 25811 - protein, 32 aa, Artificial Sequence
  Description of Artificial Sequence: Synthetic polypeptide
DEEEIRTTNPVATEQYGSVSTPNLQAGGNING

SEQ ID NO: 25812 - protein, 29 aa, Artificial Sequence
  Description of Artificial Sequence: Synthetic peptide
DESEIATTNPVATEQYGSVATNLDRGNDV

SEQ ID NO: 25813 - protein, 28 aa, Artificial Sequence
  Description of Artificial Sequence: Synthetic peptide
DEAEIRTTNPVAYEQYGSISTNLDSPNR

SEQ ID NO: 25814 - protein, 31 aa, Artificial Sequence
  Description of Artificial Sequence: Synthetic polypeptide
AEEEIRTTNPVATEQYGSVSTNLQYGGNNNI

SEQ ID NO: 25815 - protein, 31 aa, Artificial Sequence
  Description of Artificial Sequence: Synthetic polypeptide
DEEEIRTTNPVATEQYGSVACTNDLQEAENR

SEQ ID NO: 25816 - protein, 30 aa, Artificial Sequence
  Description of Artificial Sequence: Synthetic polypeptide
AEEEIRTTNPVATEQYGSVSTNLQYGEQEE

SEQ ID NO: 25817 - protein, 30 aa, Artificial Sequence
  Description of Artificial Sequence: Synthetic polypeptide
DEEEICTTNPVATEHYGSVSTNLQGDGNAD

SEQ ID NO: 25818 - protein, 30 aa, Artificial Sequence
  Description of Artificial Sequence: Synthetic polypeptide
DEEEICTTNPVATEHYGSVSTNLQDGNDLE

SEQ ID NO: 25819 - protein, 32 aa, Artificial Sequence
  Description of Artificial Sequence: Synthetic polypeptide
DEEEIRTTNPVATEQYGSVSTPNLQVGIGGNQ

SEQ ID NO: 25820 - protein, 33 aa, Artificial Sequence
  Description of Artificial Sequence: Synthetic polypeptide
DEEEIRTTNPVATEQYGSVACTNMLQRTGGNRP

SEQ ID NO: 25821 - protein, 30 aa, Artificial Sequence
  Description of Artificial Sequence: Synthetic polypeptide
AEEEIRTTNPVATEQYGSVSTNLQIGGQET

SEQ ID NO: 25822 - protein, 31 aa, Artificial Sequence
  Description of Artificial Sequence: Synthetic polypeptide
DEEEIRTTNPVATEQYGSVADTWLQQRQDNR

SEQ ID NO: 25823 - protein, 31 aa, Artificial Sequence
  Description of Artificial Sequence: Synthetic polypeptide
AEEEIRTTNPVATEQYGSVSTNLQIGNEDNG

SEQ ID NO: 25824 - protein, 31 aa, Artificial Sequence
  Description of Artificial Sequence: Synthetic polypeptide
DEEEIRTTNPVATEQYGSVASTNNQIGGNEV

SEQ ID NO: 25825 - protein, 28 aa, Artificial Sequence
  Description of Artificial Sequence: Synthetic peptide
DEAEIRTTNPVAYEQYGSISTALERDNR

SEQ ID NO: 25826 - protein, 30 aa, Artificial Sequence
  Description of Artificial Sequence: Synthetic polypeptide
AEEEIRTTNPVATEQYGSVSTNLQVTGQEE

SEQ ID NO: 25827 - protein, 31 aa, Artificial Sequence
  Description of Artificial Sequence: Synthetic polypeptide
DEEEIRTTNPVATEQYGSVASTNMQRGLTLL

SEQ ID NO: 25828 - protein, 32 aa, Artificial Sequence
  Description of Artificial Sequence: Synthetic polypeptide
DEEEIRTTNPVATEQYGSVASTNMGSQSGGNR

SEQ ID NO: 25829 - protein, 31 aa, Artificial Sequence
  Description of Artificial Sequence: Synthetic polypeptide
DEEEIRTTNPVATEQYGSVSETNDDRGNQHI

SEQ ID NO: 25830 - protein, 30 aa, Artificial Sequence
  Description of Artificial Sequence: Synthetic polypeptide
AEEEIRTTNPVATEQYGSVSTNLQLEDNAT

SEQ ID NO: 25831 - protein, 31 aa, Artificial Sequence
  Description of Artificial Sequence: Synthetic polypeptide
DEEEIRTTNPVATEQYGSVSTPNLQAGEQEA

SEQ ID NO: 25832 - protein, 31 aa, Artificial Sequence
  Description of Artificial Sequence: Synthetic polypeptide
DEEEIRTTNPVATEQYGSVACTNSSQRVGNT

SEQ ID NO: 25833 - protein, 28 aa, Artificial Sequence
  Description of Artificial Sequence: Synthetic peptide
DEAEIRTTNPVAYEQYGSISTNEERSNR

SEQ ID NO: 25834 - protein, 31 aa, Artificial Sequence
  Description of Artificial Sequence: Synthetic polypeptide
DEEEIRTTNPVATEQYGSVAATSLQPGENRE

SEQ ID NO: 25835 - protein, 29 aa, Artificial Sequence
  Description of Artificial Sequence: Synthetic peptide
DEEEIRTTNPVATEQYGSVAEGLQRGLIQ

SEQ ID NO: 25836 - protein, 31 aa, Artificial Sequence
  Description of Artificial Sequence: Synthetic polypeptide
AEEEIRTTNPVATEQYGSVSTNLQVGETNNG

SEQ ID NO: 25837 - protein, 32 aa, Artificial Sequence
  Description of Artificial Sequence: Synthetic polypeptide
DEEEIRTTNPVATEQYGSVSSTTLQRGGNNEG

SEQ ID NO: 25838 - protein, 31 aa, Artificial Sequence
  Description of Artificial Sequence: Synthetic polypeptide
DEEEIRTTNPVATEQYGSVAGTNDQRNGPMR

SEQ ID NO: 25839 - protein, 31 aa, Artificial Sequence
  Description of Artificial Sequence: Synthetic polypeptide
AEEEIRTTNPVATEQYGSVSTNLQLVGNTTT

SEQ ID NO: 25840 - protein, 30 aa, Artificial Sequence
  Description of Artificial Sequence: Synthetic polypeptide
AEEEIRTTNPVATEQYGSVSTNLQMGEQIE

SEQ ID NO: 25841 - protein, 30 aa, Artificial Sequence
  Description of Artificial Sequence: Synthetic polypeptide
DEEEIRTTNPVATEQYGSVAGTNLQDGPMI

SEQ ID NO: 25842 - protein, 30 aa, Artificial Sequence
  Description of Artificial Sequence: Synthetic polypeptide
AEEEIRTTNPVATEQYGSVSTNLQMGEQVS

SEQ ID NO: 25843 - protein, 31 aa, Artificial Sequence
  Description of Artificial Sequence: Synthetic polypeptide
AEEEIRTTNPVATEQYGSVSTNLQTGNGNDE

SEQ ID NO: 25844 - protein, 30 aa, Artificial Sequence
  Description of Artificial Sequence: Synthetic polypeptide
DEEEIRTTNPVATEQYGSVAGTNPERGNDQ

SEQ ID NO: 25845 - protein, 31 aa, Artificial Sequence
  Description of Artificial Sequence: Synthetic polypeptide
DEEEIRTTNPVATEQYGSVASTNLQNIGGED

SEQ ID NO: 25846 - protein, 31 aa, Artificial Sequence
  Description of Artificial Sequence: Synthetic polypeptide
DEEEIRTTNPVATEQYGSVAISANLQNRVNS

SEQ ID NO: 25847 - protein, 31 aa, Artificial Sequence
  Description of Artificial Sequence: Synthetic polypeptide
DEEEIRTTNPVATEQYGSVAISANLQRPMNN

SEQ ID NO: 25848 - protein, 32 aa, Artificial Sequence
  Description of Artificial Sequence: Synthetic polypeptide
DEEEIRTTNPVATEQYGSVSTPNLQFEVGNTP

SEQ ID NO: 25849 - protein, 32 aa, Artificial Sequence
  Description of Artificial Sequence: Synthetic polypeptide
DEEEIRTTNPVATEQYGSVASTNLQDGGGNEI

SEQ ID NO: 25850 - protein, 31 aa, Artificial Sequence
  Description of Artificial Sequence: Synthetic polypeptide
DEEEIRTTNPVATEQYGSVAISANLQRVNPV

SEQ ID NO: 25851 - protein, 31 aa, Artificial Sequence
  Description of Artificial Sequence: Synthetic polypeptide
DEEEIRTTNPVATEQYGSVSTPNLQSNDNGE

SEQ ID NO: 25852 - protein, 30 aa, Artificial Sequence
  Description of Artificial Sequence: Synthetic polypeptide
DEQEIRTTNPVATEQYGSVSTNDNSSMGNR

SEQ ID NO: 25853 - protein, 30 aa, Artificial Sequence
  Description of Artificial Sequence: Synthetic polypeptide
DEEEIRTTNPVATEQYGSVAITNLQDNNDQ

SEQ ID NO: 25854 - protein, 31 aa, Artificial Sequence
  Description of Artificial Sequence: Synthetic polypeptide
AEEEIRTTNPVATEQYGSVSTNLQTGIGNGN

SEQ ID NO: 25855 - protein, 31 aa, Artificial Sequence
  Description of Artificial Sequence: Synthetic polypeptide
AEEEIRTTNPVATEQYGSVSTNLQNEGINQV

SEQ ID NO: 25856 - protein, 30 aa, Artificial Sequence
  Description of Artificial Sequence: Synthetic polypeptide
DEEEIRTTNPVATEQYGSVAGTNDQRGPME

SEQ ID NO: 25857 - protein, 31 aa, Artificial Sequence
  Description of Artificial Sequence: Synthetic polypeptide
DEQEIRTTNPVATEQYGSVSTGNDLQEGNHG

SEQ ID NO: 25858 - protein, 32 aa, Artificial Sequence
  Description of Artificial Sequence: Synthetic polypeptide
DEEEIRTTNPVATEQYGSVSTPNLQTEGNNLI

SEQ ID NO: 25859 - protein, 30 aa, Artificial Sequence
  Description of Artificial Sequence: Synthetic polypeptide
DEEEIRTTNPVATEQYGSVSLTNLGDNENQ

SEQ ID NO: 25860 - protein, 32 aa, Artificial Sequence
  Description of Artificial Sequence: Synthetic polypeptide
DEEEIRTTNPVATEQYGSVSTPNLQTEMGENE

SEQ ID NO: 25861 - protein, 28 aa, Artificial Sequence
  Description of Artificial Sequence: Synthetic peptide
DESEIATTNPVATEPYGSVSVNLQQGNL

SEQ ID NO: 25862 - protein, 31 aa, Artificial Sequence
  Description of Artificial Sequence: Synthetic polypeptide
AEEEIRTTNPVATEQYGSVSTNLQLLGANNN

SEQ ID NO: 25863 - protein, 30 aa, Artificial Sequence
  Description of Artificial Sequence: Synthetic polypeptide
AEEEIRTTNPVATEQYGSVSTNLQVGDGTE

SEQ ID NO: 25864 - protein, 30 aa, Artificial Sequence
  Description of Artificial Sequence: Synthetic polypeptide
AEEEIRTTNPVATEQYGSVSTNLQVEGQGQ

SEQ ID NO: 25865 - protein, 31 aa, Artificial Sequence
  Description of Artificial Sequence: Synthetic polypeptide
AEEEIRTTNPVATEQYGSVSTNLQVDTNNNR

SEQ ID NO: 25866 - protein, 31 aa, Artificial Sequence
  Description of Artificial Sequence: Synthetic polypeptide
AEEEIRTTNPVATEQYGSVSTNLQLLGNNSE

SEQ ID NO: 25867 - protein, 28 aa, Artificial Sequence
  Description of Artificial Sequence: Synthetic peptide
DEQEIRTTNPVATEQYGSVSTDDEGGER

SEQ ID NO: 25868 - protein, 30 aa, Artificial Sequence
  Description of Artificial Sequence: Synthetic polypeptide
AEEEIRTTNPVATEQYGSVSTNLQLNDQNA

SEQ ID NO: 25869 - protein, 28 aa, Artificial Sequence
  Description of Artificial Sequence: Synthetic peptide
DEAEIRTTNPVAYEQYGSCATNLPRPNR

SEQ ID NO: 25870 - protein, 30 aa, Artificial Sequence
  Description of Artificial Sequence: Synthetic polypeptide
AEEEIRTTNPVATEQYGSVSTNLQLNGTGE

SEQ ID NO: 25871 - protein, 30 aa, Artificial Sequence
  Description of Artificial Sequence: Synthetic polypeptide
DEEEIRTTNPVATEQYGSVSETLQDSGNEL

SEQ ID NO: 25872 - protein, 29 aa, Artificial Sequence
  Description of Artificial Sequence: Synthetic peptide
AEEEIRTTNPVATEQYGSVSTNLQLNSTA

SEQ ID NO: 25873 - protein, 29 aa, Artificial Sequence
  Description of Artificial Sequence: Synthetic peptide
DESEIATTNPVATECYGSASEINLQRGNR

SEQ ID NO: 25874 - protein, 32 aa, Artificial Sequence
  Description of Artificial Sequence: Synthetic polypeptide
DEEEIRTTNPVATEQYGSVSETLGLPQPGNER

SEQ ID NO: 25875 - protein, 30 aa, Artificial Sequence
  Description of Artificial Sequence: Synthetic polypeptide
AEEEIRTTNPVATEQYGSVSTNLQTVEANE

SEQ ID NO: 25876 - protein, 30 aa, Artificial Sequence
  Description of Artificial Sequence: Synthetic polypeptide
DEQEIRTTNPVATEQYGSVSTDLQDQGNDS

SEQ ID NO: 25877 - protein, 30 aa, Artificial Sequence
  Description of Artificial Sequence: Synthetic polypeptide
DESEIATTNPVATEAYGSVSTNLQRGENNQ

SEQ ID NO: 25878 - protein, 29 aa, Artificial Sequence
  Description of Artificial Sequence: Synthetic peptide
DEQEIRTTNPVATEQYGSVSTDTDQRGEF

SEQ ID NO: 25879 - protein, 28 aa, Artificial Sequence
  Description of Artificial Sequence: Synthetic peptide
SEESICTTNPVATEQYGSVSMNSQRGNS

SEQ ID NO: 25880 - protein, 31 aa, Artificial Sequence
  Description of Artificial Sequence: Synthetic polypeptide
DEEEIRTTNPVATEQYGSVAETGLQRDVNER

SEQ ID NO: 25881 - protein, 28 aa, Artificial Sequence
  Description of Artificial Sequence: Synthetic peptide
DEECIRCTNPVATEPYGSVSSNSQRGNL

SEQ ID NO: 25882 - protein, 31 aa, Artificial Sequence
  Description of Artificial Sequence: Synthetic polypeptide
DEEEIRTTNPVATEQYGSVAATNPQRGGERG

SEQ ID NO: 25883 - protein, 32 aa, Artificial Sequence
  Description of Artificial Sequence: Synthetic polypeptide
DEEEIRTTNPVATEQYGSVSLTENLQRELGPI

SEQ ID NO: 25884 - protein, 30 aa, Artificial Sequence
  Description of Artificial Sequence: Synthetic polypeptide
DEEEIRTTNPVATEQYGSVAANLQRENEQF

SEQ ID NO: 25885 - protein, 29 aa, Artificial Sequence
  Description of Artificial Sequence: Synthetic peptide
DESEICTTNPVATEPYGSVSANLQRGNDA

SEQ ID NO: 25886 - protein, 30 aa, Artificial Sequence
  Description of Artificial Sequence: Synthetic polypeptide
DEEEIRTTNPVATEQYGSVAANLQREPGDL

SEQ ID NO: 25887 - protein, 32 aa, Artificial Sequence
  Description of Artificial Sequence: Synthetic polypeptide
DEEEIRTTNPVATEQYGSVSTPNLNQEDGNDT

SEQ ID NO: 25888 - protein, 31 aa, Artificial Sequence
  Description of Artificial Sequence: Synthetic polypeptide
AEEEIRTTNPVATEQYGSVSTNLTNGIGNNR

SEQ ID NO: 25889 - protein, 30 aa, Artificial Sequence
  Description of Artificial Sequence: Synthetic polypeptide
DESEICTTNPVATECYGSVSTNLQRGNVAE

SEQ ID NO: 25890 - protein, 29 aa, Artificial Sequence
  Description of Artificial Sequence: Synthetic peptide
DEEEIRTTNPVATEQYGSVAANLQRPDQY

SEQ ID NO: 25891 - protein, 32 aa, Artificial Sequence
  Description of Artificial Sequence: Synthetic polypeptide
DEEEIRTTNPVATEQYGSVSTPNLNQREVNSE

SEQ ID NO: 25892 - protein, 30 aa, Artificial Sequence
  Description of Artificial Sequence: Synthetic polypeptide
DEQEIRTTNPVATEQYGSCVDATNLQCGNG

SEQ ID NO: 25893 - protein, 30 aa, Artificial Sequence
  Description of Artificial Sequence: Synthetic polypeptide
AEEEIRTTNPVATEQYGSVSTNLTGGGNDT

SEQ ID NO: 25894 - protein, 30 aa, Artificial Sequence
  Description of Artificial Sequence: Synthetic polypeptide
DEEEIRTTNPVATEQYGSVAATNDDTRGER

SEQ ID NO: 25895 - protein, 29 aa, Artificial Sequence
  Description of Artificial Sequence: Synthetic peptide
DEAEIRTTNPVAYEQYGSVATNDQRGNEE

SEQ ID NO: 25896 - protein, 30 aa, Artificial Sequence
  Description of Artificial Sequence: Synthetic polypeptide
AEEEIRTTNPVATEQYGSVSTNLSTSGNLE

SEQ ID NO: 25897 - protein, 32 aa, Artificial Sequence
  Description of Artificial Sequence: Synthetic polypeptide
DEEEIRTTNPVATEQYGSVSLTNLIRIGENNT

SEQ ID NO: 25898 - protein, 33 aa, Artificial Sequence
  Description of Artificial Sequence: Synthetic polypeptide
DEEEIRTTNPVATEQYGSVSTPNLPNMRNGMNR

SEQ ID NO: 25899 - protein, 29 aa, Artificial Sequence
  Description of Artificial Sequence: Synthetic peptide
DEEEIRTTNPVATEQYGSVAATNDIRPDR

SEQ ID NO: 25900 - protein, 30 aa, Artificial Sequence
  Description of Artificial Sequence: Synthetic polypeptide
DEAEIRTTNPVAYEQYGSTISTNLDRPGNR

SEQ ID NO: 25901 - protein, 30 aa, Artificial Sequence
  Description of Artificial Sequence: Synthetic polypeptide
DEEEIRTTNPVATEQYGSVAATNDQHGNSV

SEQ ID NO: 25902 - protein, 31 aa, Artificial Sequence
  Description of Artificial Sequence: Synthetic polypeptide
AEEEIRTTNPVATEQYGSVSTNLQGQGNETA

SEQ ID NO: 25903 - protein, 30 aa, Artificial Sequence
  Description of Artificial Sequence: Synthetic polypeptide
AEEEIRTTNPVATEQYGSVSTNLTQGTNVQ

SEQ ID NO: 25904 - protein, 30 aa, Artificial Sequence
  Description of Artificial Sequence: Synthetic polypeptide
AEEEIRTTNPVATEQYGSVSTNLTQNGTIM

SEQ ID NO: 25905 - protein, 31 aa, Artificial Sequence
  Description of Artificial Sequence: Synthetic polypeptide
AEEEIRTTNPVATEQYGSVSTNLTQNVGNNE

SEQ ID NO: 25906 - protein, 31 aa, Artificial Sequence
  Description of Artificial Sequence: Synthetic polypeptide
AEEEIRTTNPVATEQYGSVSTNLQGNVGNDD

SEQ ID NO: 25907 - protein, 28 aa, Artificial Sequence
  Description of Artificial Sequence: Synthetic peptide
DESEICTTNPVATEQYGSVATNLERGVD

SEQ ID NO: 25908 - protein, 30 aa, Artificial Sequence
  Description of Artificial Sequence: Synthetic polypeptide
DEEEICTTNPMATEQYGSVPTNLQNDGNNR

SEQ ID NO: 25909 - protein, 29 aa, Artificial Sequence
  Description of Artificial Sequence: Synthetic peptide
DEQEIRTTNPVATEQYGDVSTTLQRPNDE

SEQ ID NO: 25910 - protein, 30 aa, Artificial Sequence
  Description of Artificial Sequence: Synthetic polypeptide
AEEEIRTTNPVATEQYGSVSTNLVQGQNVE

SEQ ID NO: 25911 - protein, 30 aa, Artificial Sequence
  Description of Artificial Sequence: Synthetic polypeptide
DEAEIRTTNPVAYEQYGSVSTENDQMGENR

SEQ ID NO: 25912 - protein, 29 aa, Artificial Sequence
  Description of Artificial Sequence: Synthetic peptide
DESEICTTNPVATEQYGSVATNLERGNEH

SEQ ID NO: 25913 - protein, 30 aa, Artificial Sequence
  Description of Artificial Sequence: Synthetic polypeptide
DEEEIRTTNPVATEQYGSVSTPNLNHSGDI

SEQ ID NO: 25914 - protein, 31 aa, Artificial Sequence
  Description of Artificial Sequence: Synthetic polypeptide
AEEEIRTTNPVATEQYGSVSTNLQGGVANDG

SEQ ID NO: 25915 - protein, 30 aa, Artificial Sequence
  Description of Artificial Sequence: Synthetic polypeptide
DEEEICTTNPMATEQYGSVPTNLQNNGNGR

SEQ ID NO: 25916 - protein, 30 aa, Artificial Sequence
  Description of Artificial Sequence: Synthetic polypeptide
DEEEIRTTNPVATEQYGSVAATNEQRAEER

SEQ ID NO: 25917 - protein, 31 aa, Artificial Sequence
  Description of Artificial Sequence: Synthetic polypeptide
AEEEIRTTNPVATEQYGSVSTNLQGNDGNEF

SEQ ID NO: 25918 - protein, 29 aa, Artificial Sequence
  Description of Artificial Sequence: Synthetic peptide
DEAEIRTTNPVAYEQYGSVSSNLQDNGNV

SEQ ID NO: 25919 - protein, 29 aa, Artificial Sequence
  Description of Artificial Sequence: Synthetic peptide
DEAEIRTTNPVAYEQYGSVSSNLQDNGNL

SEQ ID NO: 25920 - protein, 29 aa, Artificial Sequence
  Description of Artificial Sequence: Synthetic peptide
DESEICTTNPVATEQYGSVATNLDRGNGD

SEQ ID NO: 25921 - protein, 28 aa, Artificial Sequence
  Description of Artificial Sequence: Synthetic peptide
DESEICTTNPVATEQYGKVSTNLMSGNT

SEQ ID NO: 25922 - protein, 31 aa, Artificial Sequence
  Description of Artificial Sequence: Synthetic polypeptide
AEEEIRTTNPVATEQYGSVSTNLQGNIANER

SEQ ID NO: 25923 - protein, 30 aa, Artificial Sequence
  Description of Artificial Sequence: Synthetic polypeptide
AEEEIRTTNPVATEQYGSVSTNLTQTGEVN

SEQ ID NO: 25924 - protein, 28 aa, Artificial Sequence
  Description of Artificial Sequence: Synthetic peptide
DESEICTTNPVATEQYGETSTNLQRGDS

SEQ ID NO: 25925 - protein, 31 aa, Artificial Sequence
  Description of Artificial Sequence: Synthetic polypeptide
DEEEIRTTNPVATEQYGSVSTPNMQTGLVRD

SEQ ID NO: 25926 - protein, 31 aa, Artificial Sequence
  Description of Artificial Sequence: Synthetic polypeptide
DEEEICTTNPMATEQYGSVPTNLQQGRGNGR

SEQ ID NO: 25927 - protein, 29 aa, Artificial Sequence
  Description of Artificial Sequence: Synthetic peptide
DESEICTTNPVATEQYGSVATNLERGENH

SEQ ID NO: 25928 - protein, 30 aa, Artificial Sequence
  Description of Artificial Sequence: Synthetic polypeptide
DEEEIRTTNPVATEQYGSVAATNPQESGVR

SEQ ID NO: 25929 - protein, 32 aa, Artificial Sequence
  Description of Artificial Sequence: Synthetic polypeptide
DEEEIRTTNPVATEQYGSVSTPNLPQNIGNTT

SEQ ID NO: 25930 - protein, 33 aa, Artificial Sequence
  Description of Artificial Sequence: Synthetic polypeptide
DEEEIRTTNPVATEQYGSVSTPNMLQERGNEGQ

SEQ ID NO: 25931 - protein, 29 aa, Artificial Sequence
  Description of Artificial Sequence: Synthetic peptide
DEAEIRTTNPVAYEQYGSISTNLTRPNRA

SEQ ID NO: 25932 - protein, 30 aa, Artificial Sequence
  Description of Artificial Sequence: Synthetic polypeptide
AEEEIRTTNPVATEQYGSVSTNLQYTNINE

SEQ ID NO: 25933 - protein, 28 aa, Artificial Sequence
  Description of Artificial Sequence: Synthetic peptide
DEQEIRTTNPVATEQYGSVQTALINNNR

SEQ ID NO: 25934 - protein, 28 aa, Artificial Sequence
  Description of Artificial Sequence: Synthetic peptide
DEAEIRTTNPVAYEQYGSISTNLNRPDR

SEQ ID NO: 25935 - protein, 29 aa, Artificial Sequence
  Description of Artificial Sequence: Synthetic peptide
DEAEIRTTNPVAYEQYGSISTNLGRPNRP

SEQ ID NO: 25936 - protein, 28 aa, Artificial Sequence
  Description of Artificial Sequence: Synthetic peptide
DEQEIRTTNPVATEQYGSVQTALTDMNR

SEQ ID NO: 25937 - protein, 30 aa, Artificial Sequence
  Description of Artificial Sequence: Synthetic polypeptide
DEEEICTTNPMATEQYGSVPTVLQPRGNGR

SEQ ID NO: 25938 - protein, 28 aa, Artificial Sequence
  Description of Artificial Sequence: Synthetic peptide
DEAEIRTTNPVAYEQYGSISTNLERPND

SEQ ID NO: 25939 - protein, 30 aa, Artificial Sequence
  Description of Artificial Sequence: Synthetic polypeptide
DEEEICTTNPMATEQYGSVTTNLQHPGNGR

SEQ ID NO: 25940 - protein, 31 aa, Artificial Sequence
  Description of Artificial Sequence: Synthetic polypeptide
DESEIATTNPVATEQYGSVSTNLQDGGNQRN

SEQ ID NO: 25941 - protein, 29 aa, Artificial Sequence
  Description of Artificial Sequence: Synthetic peptide
DEAEIRTTNPVAYEQYGSISTNLENPGNR

SEQ ID NO: 25942 - protein, 29 aa, Artificial Sequence
  Description of Artificial Sequence: Synthetic peptide
DESEIATTNPVATEQYGSVSTNLMSTGNT

SEQ ID NO: 25943 - protein, 28 aa, Artificial Sequence
  Description of Artificial Sequence: Synthetic peptide
DEAEIRTTNPVAYEQYGSISTNLEIPNR

SEQ ID NO: 25944 - protein, 28 aa, Artificial Sequence
  Description of Artificial Sequence: Synthetic peptide
DEAEIRTTNPVAYEQYGSISTNLEAENR

SEQ ID NO: 25945 - protein, 31 aa, Artificial Sequence
  Description of Artificial Sequence: Synthetic polypeptide
AEEEIRTTNPVATEQYGSVSTNLQYGNQNNN

SEQ ID NO: 25946 - protein, 31 aa, Artificial Sequence
  Description of Artificial Sequence: Synthetic polypeptide
DEEEIRTTNPVATEQYGSVAATNLQRVEPMR

SEQ ID NO: 25947 - protein, 30 aa, Artificial Sequence
  Description of Artificial Sequence: Synthetic polypeptide
DEEEICTTNPVATENYGSVSTNLQNDGNMG

SEQ ID NO: 25948 - protein, 32 aa, Artificial Sequence
  Description of Artificial Sequence: Synthetic polypeptide
DEEEIRTTNPVATEQYGSVSTPNLQVGIGNTA

SEQ ID NO: 25949 - protein, 30 aa, Artificial Sequence
  Description of Artificial Sequence: Synthetic polypeptide
DEEEICTTNPMATEQYGSVWTNLQHPGNAR

SEQ ID NO: 25950 - protein, 31 aa, Artificial Sequence
  Description of Artificial Sequence: Synthetic polypeptide
DEEEIRTTNPVATEQYGSVSETDNMLQREDI

SEQ ID NO: 25951 - protein, 32 aa, Artificial Sequence
  Description of Artificial Sequence: Synthetic polypeptide
DEEEIRTTNPVATEQYGSVSTPNLSQRPENLL

SEQ ID NO: 25952 - protein, 31 aa, Artificial Sequence
  Description of Artificial Sequence: Synthetic polypeptide
DEEEICTTNPMATEQYGSVPTNMLQYRGNNR

SEQ ID NO: 25953 - protein, 31 aa, Artificial Sequence
  Description of Artificial Sequence: Synthetic polypeptide
DEEEICTTNPVATEPYGSVATNLQRGDNMRD

SEQ ID NO: 25954 - protein, 32 aa, Artificial Sequence
  Description of Artificial Sequence: Synthetic polypeptide
DEEEIRTTNPVATEQYGSVAATNLERPGENRN

SEQ ID NO: 25955 - protein, 30 aa, Artificial Sequence
  Description of Artificial Sequence: Synthetic polypeptide
DEEEIRTTNPVATEQYGSVAATNLQANEER

SEQ ID NO: 25956 - protein, 29 aa, Artificial Sequence
  Description of Artificial Sequence: Synthetic peptide
DEEEIRTTNPVATEQYGSVSTPNLTETED

SEQ ID NO: 25957 - protein, 31 aa, Artificial Sequence
  Description of Artificial Sequence: Synthetic polypeptide
DEEEIRTTNPVATEQYGSVSETNGGQRGVVF

SEQ ID NO: 25958 - protein, 31 aa, Artificial Sequence
  Description of Artificial Sequence: Synthetic polypeptide
DEEEICTTNPVATEQWGSVACTNLSQRGNQR

SEQ ID NO: 25959 - protein, 28 aa, Artificial Sequence
  Description of Artificial Sequence: Synthetic peptide
DESEIATTNPVAYDQYGQVSTALQRGNR

SEQ ID NO: 25960 - protein, 31 aa, Artificial Sequence
  Description of Artificial Sequence: Synthetic polypeptide
DEEEIRTTNPVATEQYGSVAATNLQDGNGNL

SEQ ID NO: 25961 - protein, 28 aa, Artificial Sequence
  Description of Artificial Sequence: Synthetic peptide
DESEIATTNPVATYHYGSVSTNLQRSNM

SEQ ID NO: 25962 - protein, 31 aa, Artificial Sequence
  Description of Artificial Sequence: Synthetic polypeptide
DEEEIRTTNPVATEQYGSVSTPNLQAEGELI

SEQ ID NO: 25963 - protein, 28 aa, Artificial Sequence
  Description of Artificial Sequence: Synthetic peptide
DEAEIRTTNPVAYEQYGSSSTNLERPNA

SEQ ID NO: 25964 - protein, 29 aa, Artificial Sequence
  Description of Artificial Sequence: Synthetic peptide
DEAEIRTTNPVAYEQYGSISTVNLERPNR

SEQ ID NO: 25965 - protein, 29 aa, Artificial Sequence
  Description of Artificial Sequence: Synthetic peptide
DEQEIRTTNPVATEQYGSVETDLQRGEDG

SEQ ID NO: 25966 - protein, 29 aa, Artificial Sequence
  Description of Artificial Sequence: Synthetic peptide
DEQEIRTTNPVATEQYGSVETDNQRGNEI

SEQ ID NO: 25967 - protein, 30 aa, Artificial Sequence
  Description of Artificial Sequence: Synthetic polypeptide
DESEIATTNPVATERYGSVSTNLQRDGNDS

SEQ ID NO: 25968 - protein, 31 aa, Artificial Sequence
  Description of Artificial Sequence: Synthetic polypeptide
DEEEIRTTNPVATEQYGSVAATNLQERGAQA

SEQ ID NO: 25969 - protein, 31 aa, Artificial Sequence
  Description of Artificial Sequence: Synthetic polypeptide
DEQEIRTTNPVATEQYGSVISTNTQQREGLR

SEQ ID NO: 25970 - protein, 32 aa, Artificial Sequence
  Description of Artificial Sequence: Synthetic polypeptide
DEEEIRTTNPVATEQYGSVAATNLQERGNNQI

SEQ ID NO: 25971 - protein, 29 aa, Artificial Sequence
  Description of Artificial Sequence: Synthetic peptide
AEEEIRTTNPVATEQYGSVSTNLSEQVNT

SEQ ID NO: 25972 - protein, 30 aa, Artificial Sequence
  Description of Artificial Sequence: Synthetic polypeptide
AEEEIRTTNPVATEQYGSVSTNLSEQGNVE

SEQ ID NO: 25973 - protein, 28 aa, Artificial Sequence
  Description of Artificial Sequence: Synthetic peptide
DEAEIRTTNPVAYEQYGSISTNLVRPSR

SEQ ID NO: 25974 - protein, 32 aa, Artificial Sequence
  Description of Artificial Sequence: Synthetic polypeptide
DEEEIRTTNPVATEQYGSVAATNLQDRGDHNM

SEQ ID NO: 25975 - protein, 32 aa, Artificial Sequence
  Description of Artificial Sequence: Synthetic polypeptide
DEEEIRTTNPVATEQYGSVAITNLQQGPNSRD

SEQ ID NO: 25976 - protein, 28 aa, Artificial Sequence
  Description of Artificial Sequence: Synthetic peptide
DEQEIRTTNPVATEQYGSVSTNDQMDEA

SEQ ID NO: 25977 - protein, 31 aa, Artificial Sequence
  Description of Artificial Sequence: Synthetic polypeptide
DEQEIRTTNPVATEQYGSVSTNGDQDDGNNR

SEQ ID NO: 25978 - protein, 30 aa, Artificial Sequence
  Description of Artificial Sequence: Synthetic polypeptide
DEEEIRTTNPVATEQYGSVAQTMLQRGQQT

SEQ ID NO: 25979 - protein, 32 aa, Artificial Sequence
  Description of Artificial Sequence: Synthetic polypeptide
DEEEIRTTNPVATEQYGSVSSTSNLQQGVGNT

SEQ ID NO: 25980 - protein, 30 aa, Artificial Sequence
  Description of Artificial Sequence: Synthetic polypeptide
DEEEIRTTNPVATEQYGSVAQTNLQINENQ

SEQ ID NO: 25981 - protein, 31 aa, Artificial Sequence
  Description of Artificial Sequence: Synthetic polypeptide
AEEEIRTTNPVATEQYGSVSTNLQQNNGNQF

SEQ ID NO: 25982 - protein, 28 aa, Artificial Sequence
  Description of Artificial Sequence: Synthetic peptide
DEQEIVTTNPVATEWYGSVSTNLCHGNQ

SEQ ID NO: 25983 - protein, 33 aa, Artificial Sequence
  Description of Artificial Sequence: Synthetic polypeptide
DEEEIRTTNPVATEQYGSVSTPNLQRFGSNTAQ

SEQ ID NO: 25984 - protein, 31 aa, Artificial Sequence
  Description of Artificial Sequence: Synthetic polypeptide
DEEEIRTTNPVATEQYGSVSLTNLEMRLVNA

SEQ ID NO: 25985 - protein, 30 aa, Artificial Sequence
  Description of Artificial Sequence: Synthetic polypeptide
AEEEIRTTNPVATEQYGSVSTNLQPTTAND

SEQ ID NO: 25986 - protein, 32 aa, Artificial Sequence
  Description of Artificial Sequence: Synthetic polypeptide
DEEEIRTTNPVATEQYGSVSSTSNLQLGGGNT

SEQ ID NO: 25987 - protein, 32 aa, Artificial Sequence
  Description of Artificial Sequence: Synthetic polypeptide
DEEEIRTTNPVATEQYGSVSSTSNLQGSGNTA

SEQ ID NO: 25988 - protein, 31 aa, Artificial Sequence
  Description of Artificial Sequence: Synthetic polypeptide
DEEEIRTTNPVATEQYGSVSTPNLQNNGMED

SEQ ID NO: 25989 - protein, 30 aa, Artificial Sequence
  Description of Artificial Sequence: Synthetic polypeptide
DEEEIRTTNPVAHEQYGSVNTNLQGGDDQR

SEQ ID NO: 25990 - protein, 28 aa, Artificial Sequence
  Description of Artificial Sequence: Synthetic peptide
DEQEISTTNPVATEQYGSVSTNLDYANT

SEQ ID NO: 25991 - protein, 30 aa, Artificial Sequence
  Description of Artificial Sequence: Synthetic polypeptide
AEEEIRTTNPVATEQYGSVSTNLQQMNTNV

SEQ ID NO: 25992 - protein, 30 aa, Artificial Sequence
  Description of Artificial Sequence: Synthetic polypeptide
DEQEISTTNPVATEQYGSVATNLQDGNDRM

SEQ ID NO: 25993 - protein, 31 aa, Artificial Sequence
  Description of Artificial Sequence: Synthetic polypeptide
AEEEIRTTNPVATEQYGSVSTNLQQDGNENA

SEQ ID NO: 25994 - protein, 32 aa, Artificial Sequence
  Description of Artificial Sequence: Synthetic polypeptide
DEEEIRTTNPVATEQYGSVSTPNLQRDGIGFE

SEQ ID NO: 25995 - protein, 30 aa, Artificial Sequence
  Description of Artificial Sequence: Synthetic polypeptide
DEEEICTTNPSATEQYGSVPTNLQQRGNGD

SEQ ID NO: 25996 - protein, 28 aa, Artificial Sequence
  Description of Artificial Sequence: Synthetic peptide
DEQEIRTTNPVCTEVYGSVSDNLQTGNY

SEQ ID NO: 25997 - protein, 28 aa, Artificial Sequence
  Description of Artificial Sequence: Synthetic peptide
DEQTIRTTNPVATEQYGCVTTNPQRGNT

SEQ ID NO: 25998 - protein, 29 aa, Artificial Sequence
  Description of Artificial Sequence: Synthetic peptide
DEEEIRTTNPVAHEQYGSVNTNLQVTDSR

SEQ ID NO: 25999 - protein, 31 aa, Artificial Sequence
  Description of Artificial Sequence: Synthetic polypeptide
DEQEIRTTNPVATEQYGSVSTSNLQVDGNIA

SEQ ID NO: 26000 - protein, 31 aa, Artificial Sequence
  Description of Artificial Sequence: Synthetic polypeptide
DEEEIRTTNPVATEQYGSVSTPNLQNLGSDQ

SEQ ID NO: 26001 - protein, 30 aa, Artificial Sequence
  Description of Artificial Sequence: Synthetic polypeptide
DEDEIRTTNPVATEQWGEVSTNLEQHGGNR

SEQ ID NO: 26002 - protein, 29 aa, Artificial Sequence
  Description of Artificial Sequence: Synthetic peptide
AEEEIRTTNPVATEQYGSVSTNLQNTDEE

SEQ ID NO: 26003 - protein, 28 aa, Artificial Sequence
  Description of Artificial Sequence: Synthetic peptide
DEREIATTNPVATIQYGAVSTALERGNR

SEQ ID NO: 26004 - protein, 31 aa, Artificial Sequence
  Description of Artificial Sequence: Synthetic polypeptide
DEEEIRTTNPVATEQYGSVASTNLGDGGNGP

SEQ ID NO: 26005 - protein, 28 aa, Artificial Sequence
  Description of Artificial Sequence: Synthetic peptide
DEREIATTNPVATCQYGCVSTALQRGNA

SEQ ID NO: 26006 - protein, 31 aa, Artificial Sequence
  Description of Artificial Sequence: Synthetic polypeptide
DEQEIRTTNPVATEQYGSVSTNNQDDGGNER

SEQ ID NO: 26007 - protein, 30 aa, Artificial Sequence
  Description of Artificial Sequence: Synthetic polypeptide
AEEEIRTTNPVATEQYGSVSTNLQQQEGLN

SEQ ID NO: 26008 - protein, 28 aa, Artificial Sequence
  Description of Artificial Sequence: Synthetic peptide
DEQVIRTTNPVATEQYGVVETNPQLGNR

SEQ ID NO: 26009 - protein, 32 aa, Artificial Sequence
  Description of Artificial Sequence: Synthetic polypeptide
DEEEIRTTNPVATEQYGSVSETENLQRILNTG

SEQ ID NO: 26010 - protein, 31 aa, Artificial Sequence
  Description of Artificial Sequence: Synthetic polypeptide
DEQEIRTTNPVATEQYGSVSVTDLQSGENRA

SEQ ID NO: 26011 - protein, 31 aa, Artificial Sequence
  Description of Artificial Sequence: Synthetic polypeptide
DEQEIRTTNPVATEQYGSVSTNNQNDDGENR

SEQ ID NO: 26012 - protein, 31 aa, Artificial Sequence
  Description of Artificial Sequence: Synthetic polypeptide
AEEEIRTTNPVATEQYGSVSTNLQQQEGENN

SEQ ID NO: 26013 - protein, 29 aa, Artificial Sequence
  Description of Artificial Sequence: Synthetic peptide
DEEEIRTTNPVATEQYGSVAPNHQRDDNN

SEQ ID NO: 26014 - protein, 30 aa, Artificial Sequence
  Description of Artificial Sequence: Synthetic polypeptide
DEEEIRTTNPVATEQYGSVAPNLQRGVLTN

SEQ ID NO: 26015 - protein, 30 aa, Artificial Sequence
  Description of Artificial Sequence: Synthetic polypeptide
DEQEIRTTNPVATEQYGSVSTNQQVRLNLV

SEQ ID NO: 26016 - protein, 30 aa, Artificial Sequence
  Description of Artificial Sequence: Synthetic polypeptide
AEEEIRTTNPVATEQYGSVSTNLQNVNNNF

SEQ ID NO: 26017 - protein, 32 aa, Artificial Sequence
  Description of Artificial Sequence: Synthetic polypeptide
DEAEIRTTNPVAYEQYGISVSTNALQRTGNNR

SEQ ID NO: 26018 - protein, 31 aa, Artificial Sequence
  Description of Artificial Sequence: Synthetic polypeptide
AEEEIRTTNPVATEQYGSVSTNLQNVQGENL

SEQ ID NO: 26019 - protein, 32 aa, Artificial Sequence
  Description of Artificial Sequence: Synthetic polypeptide
DEQEIRTTNPVATEQYGSVSTPNLEQRMINER

SEQ ID NO: 26020 - protein, 31 aa, Artificial Sequence
  Description of Artificial Sequence: Synthetic polypeptide
AEEEIRTTNPVATEQYGSVSTNLQQNVGNLF

SEQ ID NO: 26021 - protein, 30 aa, Artificial Sequence
  Description of Artificial Sequence: Synthetic polypeptide
AEEEIRTTNPVATEQYGSVSTNLQNVNGIL

SEQ ID NO: 26022 - protein, 30 aa, Artificial Sequence
  Description of Artificial Sequence: Synthetic polypeptide
DEEEIRTTNPVATEQYGSVAPNDQRGNSIM

SEQ ID NO: 26023 - protein, 31 aa, Artificial Sequence
  Description of Artificial Sequence: Synthetic polypeptide
DEEEIRTTNPVATEQYGSVSSTSLQRGDTSQ

SEQ ID NO: 26024 - protein, 31 aa, Artificial Sequence
  Description of Artificial Sequence: Synthetic polypeptide
AEEEIRTTNPVATEQYGSVSTNLQQLNGGNT

SEQ ID NO: 26025 - protein, 31 aa, Artificial Sequence
  Description of Artificial Sequence: Synthetic polypeptide
DEEEICTTNPTATEQYGSVPTNLQHRGNDRP

SEQ ID NO: 26026 - protein, 32 aa, Artificial Sequence
  Description of Artificial Sequence: Synthetic polypeptide
DEEEIRTTNPVATEQYGSVSTPNLQQTGENSQ

SEQ ID NO: 26027 - protein, 31 aa, Artificial Sequence
  Description of Artificial Sequence: Synthetic polypeptide
AEEEIRTTNPVATEQYGSVSTNLQQGNGNDN

SEQ ID NO: 26028 - protein, 31 aa, Artificial Sequence
  Description of Artificial Sequence: Synthetic polypeptide
AEEEIRTTNPVATEQYGSVSTNLQQGIINNI

SEQ ID NO: 26029 - protein, 31 aa, Artificial Sequence
  Description of Artificial Sequence: Synthetic polypeptide
AEEEIRTTNPVATEQYGSVSTNLQQGGNNMN

SEQ ID NO: 26030 - protein, 31 aa, Artificial Sequence
  Description of Artificial Sequence: Synthetic polypeptide
AEEEIRTTNPVATEQYGSVSTNLQQGGNNIA

SEQ ID NO: 26031 - protein, 31 aa, Artificial Sequence
  Description of Artificial Sequence: Synthetic polypeptide
AEEEIRTTNPVATEQYGSVSTNLQQGGINGV

SEQ ID NO: 26032 - protein, 30 aa, Artificial Sequence
  Description of Artificial Sequence: Synthetic polypeptide
DEQEIRTTNPVATEQYGSVSYTNLEQRSEQ

SEQ ID NO: 26033 - protein, 28 aa, Artificial Sequence
  Description of Artificial Sequence: Synthetic peptide
DEQEIRTTNPVATEQYGVVSTGLQREAD

SEQ ID NO: 26034 - protein, 30 aa, Artificial Sequence
  Description of Artificial Sequence: Synthetic polypeptide
AEEEIRTTNPVATEQYGSVSTNLQQEGQSG

SEQ ID NO: 26035 - protein, 31 aa, Artificial Sequence
  Description of Artificial Sequence: Synthetic polypeptide
AEEEIRTTNPVATEQYGSVSTNLQQEGTNAN

SEQ ID NO: 26036 - protein, 30 aa, Artificial Sequence
  Description of Artificial Sequence: Synthetic polypeptide
AEEEIRTTNPVATEQYGSVSTNLQQGGGLG

SEQ ID NO: 26037 - protein, 30 aa, Artificial Sequence
  Description of Artificial Sequence: Synthetic polypeptide
DEEEIRTTNPVATEQYGSVSTPNLQQDVIL

SEQ ID NO: 26038 - protein, 28 aa, Artificial Sequence
  Description of Artificial Sequence: Synthetic peptide
SEEQIRCTNPIATEQYGSVSENLMRGNR

SEQ ID NO: 26039 - protein, 30 aa, Artificial Sequence
  Description of Artificial Sequence: Synthetic polypeptide
DEEEICTTNPTAYEQYGSVPTNLQTRGNER

SEQ ID NO: 26040 - protein, 31 aa, Artificial Sequence
  Description of Artificial Sequence: Synthetic polypeptide
DEEEIRTTNPVATEQYGSVSTPNLQQFLNVT

SEQ ID NO: 26041 - protein, 30 aa, Artificial Sequence
  Description of Artificial Sequence: Synthetic polypeptide
AEEEIRTTNPVATEQYGSVSTNLQQENFNG

SEQ ID NO: 26042 - protein, 30 aa, Artificial Sequence
  Description of Artificial Sequence: Synthetic polypeptide
DEQEIRTTNPVATEQYGSVWVTLLQERGDR

SEQ ID NO: 26043 - protein, 30 aa, Artificial Sequence
  Description of Artificial Sequence: Synthetic polypeptide
DEEEIRTTNPVATEQYGSVASPTNLQQVVA

SEQ ID NO: 26044 - protein, 31 aa, Artificial Sequence
  Description of Artificial Sequence: Synthetic polypeptide
AEEEIRTTNPVATEQYGSVSTNLQQGNNEIG

SEQ ID NO: 26045 - protein, 30 aa, Artificial Sequence
  Description of Artificial Sequence: Synthetic polypeptide
AEEEIRTTNPVATEQYGSVSTNLQQEGEGQ

SEQ ID NO: 26046 - protein, 31 aa, Artificial Sequence
  Description of Artificial Sequence: Synthetic polypeptide
DEEEICTTNPTATEQYGSVPTNLQDRGNERM

SEQ ID NO: 26047 - protein, 32 aa, Artificial Sequence
  Description of Artificial Sequence: Synthetic polypeptide
DEEEIRTTNPVATEQYGSVSTPNLQNTGNQNE

SEQ ID NO: 26048 - protein, 31 aa, Artificial Sequence
  Description of Artificial Sequence: Synthetic polypeptide
DEEEIRTTNPVATEQYGSVSTPNLQNSGGQG

SEQ ID NO: 26049 - protein, 31 aa, Artificial Sequence
  Description of Artificial Sequence: Synthetic polypeptide
DEEEICTTNPTATEQYGSVATNLQDRGDNRM

SEQ ID NO: 26050 - protein, 31 aa, Artificial Sequence
  Description of Artificial Sequence: Synthetic polypeptide
DEEEIRTTNPVATEQYGSVSSTQNLGQGTNM

SEQ ID NO: 26051 - protein, 31 aa, Artificial Sequence
  Description of Artificial Sequence: Synthetic polypeptide
AEEEIRTTNPVATEQYGSVSTNLQQEEGNVG

SEQ ID NO: 26052 - protein, 31 aa, Artificial Sequence
  Description of Artificial Sequence: Synthetic polypeptide
AEEEIRTTNPVATEQYGSVSTNLQQLGNYGN

SEQ ID NO: 26053 - protein, 28 aa, Artificial Sequence
  Description of Artificial Sequence: Synthetic peptide
DEQEIRTTNPVAVEQYGTISTNLERNNR

SEQ ID NO: 26054 - protein, 30 aa, Artificial Sequence
  Description of Artificial Sequence: Synthetic polypeptide
DEQEIRTTNPVAVEQYGSVISTNLERDNRD

SEQ ID NO: 26055 - protein, 28 aa, Artificial Sequence
  Description of Artificial Sequence: Synthetic peptide
DEQEIRTTNPVAVEQYGSTSTNLEVNNR

SEQ ID NO: 26056 - protein, 31 aa, Artificial Sequence
  Description of Artificial Sequence: Synthetic polypeptide
AEEEIRTTNPVATEQYGSVSTNLQQIQGNNT

SEQ ID NO: 26057 - protein, 29 aa, Artificial Sequence
  Description of Artificial Sequence: Synthetic peptide
DEQEIRTTNPVAYEQYGSVFTNSSQRGNA

SEQ ID NO: 26058 - protein, 32 aa, Artificial Sequence
  Description of Artificial Sequence: Synthetic polypeptide
DEEEIRTTNPVATEQYGSVSTPNLQNSGINGN

SEQ ID NO: 26059 - protein, 31 aa, Artificial Sequence
  Description of Artificial Sequence: Synthetic polypeptide
AEEEIRTTNPVATEQYGSVSTNLQQIGTNMI

SEQ ID NO: 26060 - protein, 32 aa, Artificial Sequence
  Description of Artificial Sequence: Synthetic polypeptide
DEEEIRTTNPVATEQYGSVSTPNLQQVTGNGV

SEQ ID NO: 26061 - protein, 32 aa, Artificial Sequence
  Description of Artificial Sequence: Synthetic polypeptide
DEEEIRTTNPVATEQYGSVASGTNLIQEDGNG

SEQ ID NO: 26062 - protein, 30 aa, Artificial Sequence
  Description of Artificial Sequence: Synthetic polypeptide
DEQEIRTTNPVATEQYGSVSVTVLDEGNDR

SEQ ID NO: 26063 - protein, 31 aa, Artificial Sequence
  Description of Artificial Sequence: Synthetic polypeptide
AEEEIRTTNPVATEQYGSVSTNLQQIAGNIP

SEQ ID NO: 26064 - protein, 29 aa, Artificial Sequence
  Description of Artificial Sequence: Synthetic peptide
DEEEIRTTNPVATEQYGSVASNLERFGTI

SEQ ID NO: 26065 - protein, 32 aa, Artificial Sequence
  Description of Artificial Sequence: Synthetic polypeptide
DEEEIRTTNPVATEQYGSVSTPNLQNTGDNEN

SEQ ID NO: 26066 - protein, 29 aa, Artificial Sequence
  Description of Artificial Sequence: Synthetic peptide
AEEEIRTTNPVATEQYGSVSTNLQQEEVG

SEQ ID NO: 26067 - protein, 28 aa, Artificial Sequence
  Description of Artificial Sequence: Synthetic peptide
SEEPIRCTNPIATEQYGSVSENLMRGNR

SEQ ID NO: 26068 - protein, 32 aa, Artificial Sequence
  Description of Artificial Sequence: Synthetic polypeptide
DEQEIRTTNPVATEQYGSVSVTNLQQETVGNR

SEQ ID NO: 26069 - protein, 29 aa, Artificial Sequence
  Description of Artificial Sequence: Synthetic peptide
DEDEIRTTNPVATEQWGEVSTNLGGEGNR

SEQ ID NO: 26070 - protein, 30 aa, Artificial Sequence
  Description of Artificial Sequence: Synthetic polypeptide
AEEEIRTTNPVATEQYGSVSTNLQNSGGII

SEQ ID NO: 26071 - protein, 32 aa, Artificial Sequence
  Description of Artificial Sequence: Synthetic polypeptide
DEEEIRTTNPVATEQYGSVSTPNLQRQGVFSF

SEQ ID NO: 26072 - protein, 31 aa, Artificial Sequence
  Description of Artificial Sequence: Synthetic polypeptide
DEEEIRTTNPVATEQYGSVANNLQEAGNSRD

SEQ ID NO: 26073 - protein, 31 aa, Artificial Sequence
  Description of Artificial Sequence: Synthetic polypeptide
AEEEIRTTNPVATEQYGSVSTNLQSIGTNPW

SEQ ID NO: 26074 - protein, 30 aa, Artificial Sequence
  Description of Artificial Sequence: Synthetic polypeptide
DEQEIRTTNPVATEQYGSVSTNLQEGDEQD

SEQ ID NO: 26075 - protein, 31 aa, Artificial Sequence
  Description of Artificial Sequence: Synthetic polypeptide
AEEEIRTTNPVATEQYGSVSTNLQSGVNNIL

SEQ ID NO: 26076 - protein, 32 aa, Artificial Sequence
  Description of Artificial Sequence: Synthetic polypeptide
DEEEIRTTNPVATEQYGSVSSTPALQMRGMNV

SEQ ID NO: 26077 - protein, 30 aa, Artificial Sequence
  Description of Artificial Sequence: Synthetic polypeptide
DEEEIRTTNPVATEQYGSVANNLQHGDNNA

SEQ ID NO: 26078 - protein, 30 aa, Artificial Sequence
  Description of Artificial Sequence: Synthetic polypeptide
DEEEIRTTNPVATEQYGSVANNLQHGENTV

SEQ ID NO: 26079 - protein, 31 aa, Artificial Sequence
  Description of Artificial Sequence: Synthetic polypeptide
AEEEIRTTNPVATEQYGSVSTNLQNNGNNDF

SEQ ID NO: 26080 - protein, 31 aa, Artificial Sequence
  Description of Artificial Sequence: Synthetic polypeptide
DEEEIRTTNPVATEQYGSVSETGNLQRSTIN

SEQ ID NO: 26081 - protein, 31 aa, Artificial Sequence
  Description of Artificial Sequence: Synthetic polypeptide
AEEEIRTTNPVATEQYGSVSTNLQSGNANFG

SEQ ID NO: 26082 - protein, 32 aa, Artificial Sequence
  Description of Artificial Sequence: Synthetic polypeptide
DEEEIRTTNPVATEQYGSVSTPNLQFNGNFEA

SEQ ID NO: 26083 - protein, 31 aa, Artificial Sequence
  Description of Artificial Sequence: Synthetic polypeptide
AEEEIRTTNPVATEQYGSVSTNLQRTNANFD

SEQ ID NO: 26084 - protein, 31 aa, Artificial Sequence
  Description of Artificial Sequence: Synthetic polypeptide
DEEEIRTTNPVATEQYGSVSTPNLQFNGTTN

SEQ ID NO: 26085 - protein, 29 aa, Artificial Sequence
  Description of Artificial Sequence: Synthetic peptide
DEEEIRTTNPVAHEQYGSVRTNLQEFDSR

SEQ ID NO: 26086 - protein, 32 aa, Artificial Sequence
  Description of Artificial Sequence: Synthetic polypeptide
DEEEIRTTNPVATEQYGSVSTPNLQSEGMNND

SEQ ID NO: 26087 - protein, 31 aa, Artificial Sequence
  Description of Artificial Sequence: Synthetic polypeptide
DEDEIRTTNPVATEQWGEVSTNLQRDGNDSR

SEQ ID NO: 26088 - protein, 32 aa, Artificial Sequence
  Description of Artificial Sequence: Synthetic polypeptide
DEEEIRTTNPVATEQYGSVSTPNLQGGTGENN

SEQ ID NO: 26089 - protein, 32 aa, Artificial Sequence
  Description of Artificial Sequence: Synthetic polypeptide
DEEEIRTTNPVATEQYGSVSTPNLQGTGNNEF

SEQ ID NO: 26090 - protein, 28 aa, Artificial Sequence
  Description of Artificial Sequence: Synthetic peptide
SEENIRCTNPIATEQYGSVSENLMRGNR

SEQ ID NO: 26091 - protein, 31 aa, Artificial Sequence
  Description of Artificial Sequence: Synthetic polypeptide
AEEEIRTTNPVATEQYGSVSTNLQNNGDNIE

SEQ ID NO: 26092 - protein, 31 aa, Artificial Sequence
  Description of Artificial Sequence: Synthetic polypeptide
DEEEIRTTNPVATEQYGSVSLTNLERGGEDM

SEQ ID NO: 26093 - protein, 32 aa, Artificial Sequence
  Description of Artificial Sequence: Synthetic polypeptide
DEEEIRTTNPVATEQYGSVSTPNLQSFGSNEM

SEQ ID NO: 26094 - protein, 28 aa, Artificial Sequence
  Description of Artificial Sequence: Synthetic peptide
DEEEIRTTNPVATEQYGSVANNLNDGTQ

SEQ ID NO: 26095 - protein, 31 aa, Artificial Sequence
  Description of Artificial Sequence: Synthetic polypeptide
DEEEIRTTNPVATEQYGSVAITNPQNQGNRD

SEQ ID NO: 26096 - protein, 32 aa, Artificial Sequence
  Description of Artificial Sequence: Synthetic polypeptide
DEEEIRTTNPVATEQYGSVSTPNLQFGGNEDS

SEQ ID NO: 26097 - protein, 30 aa, Artificial Sequence
  Description of Artificial Sequence: Synthetic polypeptide
DEEEIRTTNPVATEQYGSVAMNDQRGNNMV

SEQ ID NO: 26098 - protein, 28 aa, Artificial Sequence
  Description of Artificial Sequence: Synthetic peptide
DEECIRCTNPVATEGYGSVSMNEQRGNL

SEQ ID NO: 26099 - protein, 30 aa, Artificial Sequence
  Description of Artificial Sequence: Synthetic polypeptide
DEQEIRTTNPVATEQYGSVSTNGGQGEGND

SEQ ID NO: 26100 - protein, 31 aa, Artificial Sequence
  Description of Artificial Sequence: Synthetic polypeptide
AEEEIRTTNPVATEQYGSVSTNLQTGGGNLQ

SEQ ID NO: 26101 - protein, 29 aa, Artificial Sequence
  Description of Artificial Sequence: Synthetic peptide
DESEEISTTNPVAYEPYGSVATNLQRGND

SEQ ID NO: 26102 - protein, 31 aa, Artificial Sequence
  Description of Artificial Sequence: Synthetic polypeptide
DEQEIRTTNPVATEQYGSVSTNLEDREGENL

SEQ ID NO: 26103 - protein, 31 aa, Artificial Sequence
  Description of Artificial Sequence: Synthetic polypeptide
AEEEIRTTNPVATEQYGSVSTNLQNGGGNIY

SEQ ID NO: 26104 - protein, 29 aa, Artificial Sequence
  Description of Artificial Sequence: Synthetic peptide
DEDEIRTTNPVATEQWGEVSTNLGQQGNM

SEQ ID NO: 26105 - protein, 30 aa, Artificial Sequence
  Description of Artificial Sequence: Synthetic polypeptide
DEEEIRTTNPVATEQYGSVAMNLDTRGENW

SEQ ID NO: 26106 - protein, 29 aa, Artificial Sequence
  Description of Artificial Sequence: Synthetic peptide
DEEEIRTTNPVATEQYGSVAMNLQTDGTQ

SEQ ID NO: 26107 - protein, 29 aa, Artificial Sequence
  Description of Artificial Sequence: Synthetic peptide
DEEEIRTTNPVATEQYGSVANANLQDGPE

SEQ ID NO: 26108 - protein, 30 aa, Artificial Sequence
  Description of Artificial Sequence: Synthetic polypeptide
AEEEIRTTNPVATEQYGSVSTNLQNGIGSE

SEQ ID NO: 26109 - protein, 30 aa, Artificial Sequence
  Description of Artificial Sequence: Synthetic polypeptide
DEEEIRTTNPVATEQYGSVANNDQNRGNVD

SEQ ID NO: 26110 - protein, 30 aa, Artificial Sequence
  Description of Artificial Sequence: Synthetic polypeptide
AEEEIRTTNPVATEQYGSVSTNLQSVNMIL

SEQ ID NO: 26111 - protein, 28 aa, Artificial Sequence
  Description of Artificial Sequence: Synthetic peptide
DESCIRCTNPVATEQYGSVSWNPQRGNQ

SEQ ID NO: 26112 - protein, 31 aa, Artificial Sequence
  Description of Artificial Sequence: Synthetic polypeptide
AEEEIRTTNPVATEQYGSVSTNLQNIGNEES

SEQ ID NO: 26113 - protein, 31 aa, Artificial Sequence
  Description of Artificial Sequence: Synthetic polypeptide
AEEEIRTTNPVATEQYGSVSTNLQNLGNIAQ

SEQ ID NO: 26114 - protein, 32 aa, Artificial Sequence
  Description of Artificial Sequence: Synthetic polypeptide
DEEEIRTTNPVATEQYGSVSTPNLQSGGENQS

SEQ ID NO: 26115 - protein, 31 aa, Artificial Sequence
  Description of Artificial Sequence: Synthetic polypeptide
AEEEIRTTNPVATEQYGSVSTNLQNGGNNSN

SEQ ID NO: 26116 - protein, 30 aa, Artificial Sequence
  Description of Artificial Sequence: Synthetic polypeptide
AEEEIRTTNPVATEQYGSVSTNLQQVTANM

SEQ ID NO: 26117 - protein, 31 aa, Artificial Sequence
  Description of Artificial Sequence: Synthetic polypeptide
AEEEIRTTNPVATEQYGSVSTNLQNNVGNFG

SEQ ID NO: 26118 - protein, 31 aa, Artificial Sequence
  Description of Artificial Sequence: Synthetic polypeptide
AEEEIRTTNPVATEQYGSVSTNLQNQGGNIE

SEQ ID NO: 26119 - protein, 29 aa, Artificial Sequence
  Description of Artificial Sequence: Synthetic peptide
DEEEIRTTNPVAHEQYGSVCTNLQNFDSR

SEQ ID NO: 26120 - protein, 30 aa, Artificial Sequence
  Description of Artificial Sequence: Synthetic polypeptide
AEEEIRTTNPVATEQYGSVSTNLQNQIANL

SEQ ID NO: 26121 - protein, 29 aa, Artificial Sequence
  Description of Artificial Sequence: Synthetic peptide
DEDEIRTTNPVATEPYGTVSTNQQHDGNR

SEQ ID NO: 26122 - protein, 29 aa, Artificial Sequence
  Description of Artificial Sequence: Synthetic peptide
DEEEIRTTNPVAHEQYGSVGTNLQVMDER

SEQ ID NO: 26123 - protein, 31 aa, Artificial Sequence
  Description of Artificial Sequence: Synthetic polypeptide
DEREIRTTNPVATEQYGCVCSTNWLQFGSNR

SEQ ID NO: 26124 - protein, 31 aa, Artificial Sequence
  Description of Artificial Sequence: Synthetic polypeptide
AEEEIRTTNPVATEQYGSVSTNLQQQLGNGA

SEQ ID NO: 26125 - protein, 30 aa, Artificial Sequence
  Description of Artificial Sequence: Synthetic polypeptide
AEEEIRTTNPVATEQYGSVSTNLQQQITNN

SEQ ID NO: 26126 - protein, 31 aa, Artificial Sequence
  Description of Artificial Sequence: Synthetic polypeptide
AEEEIRTTNPVATEQYGSVSTNLQQQGNNLD

SEQ ID NO: 26127 - protein, 31 aa, Artificial Sequence
  Description of Artificial Sequence: Synthetic polypeptide
DEQEIRTTNPVATEQYGSVSTNLQVGVDPRV

SEQ ID NO: 26128 - protein, 28 aa, Artificial Sequence
  Description of Artificial Sequence: Synthetic peptide
DEECIRATNPVATEQYGSVSSVTQRGNL

SEQ ID NO: 26129 - protein, 29 aa, Artificial Sequence
  Description of Artificial Sequence: Synthetic peptide
DEEEIRTTNPVAHEQYGSVQTNLQVFDQR

SEQ ID NO: 26130 - protein, 28 aa, Artificial Sequence
  Description of Artificial Sequence: Synthetic peptide
DEECIRATNPVATEQYGSVSNNTQYGNL

SEQ ID NO: 26131 - protein, 28 aa, Artificial Sequence
  Description of Artificial Sequence: Synthetic peptide
DEDEIRTTNPVATEQFGGVSTNPQLGNI

SEQ ID NO: 26132 - protein, 32 aa, Artificial Sequence
  Description of Artificial Sequence: Synthetic polypeptide
DEEEIRTTNPVATEQYGSVSTPNLQRSNNTLF

SEQ ID NO: 26133 - protein, 29 aa, Artificial Sequence
  Description of Artificial Sequence: Synthetic peptide
DEREIRTTNPVATCQYGSVNTQLQRFGND

SEQ ID NO: 26134 - protein, 30 aa, Artificial Sequence
  Description of Artificial Sequence: Synthetic polypeptide
DEQEIRTTNPVATEQYGSVSTNLQVSEDRM

SEQ ID NO: 26135 - protein, 31 aa, Artificial Sequence
  Description of Artificial Sequence: Synthetic polypeptide
DEQEIRTTNPVATEQYGSVSTNLQVVGVFRD

SEQ ID NO: 26136 - protein, 30 aa, Artificial Sequence
  Description of Artificial Sequence: Synthetic polypeptide
DEREIKTTNPVATEQYGCVSTENLQHGNRV

SEQ ID NO: 26137 - protein, 31 aa, Artificial Sequence
  Description of Artificial Sequence: Synthetic polypeptide
DEEEIRTTNPVATEQYGSVANTTNTEQRLNR

SEQ ID NO: 26138 - protein, 31 aa, Artificial Sequence
  Description of Artificial Sequence: Synthetic polypeptide
DEEEIRTTNPVATEQYGSVASTNLGTDGVNI

SEQ ID NO: 26139 - protein, 31 aa, Artificial Sequence
  Description of Artificial Sequence: Synthetic polypeptide
AEEEIRTTNPVATEQYGSVSTNLQQQGNEAA

SEQ ID NO: 26140 - protein, 30 aa, Artificial Sequence
  Description of Artificial Sequence: Synthetic polypeptide
AEEEIRTTNPVATEQYGSVSTNLVQGTNVC

SEQ ID NO: 26141 - protein, 31 aa, Artificial Sequence
  Description of Artificial Sequence: Synthetic polypeptide
DEQEIRTTNPVATEQYGSVSTNLQRPIDGDF

SEQ ID NO: 26142 - protein, 29 aa, Artificial Sequence
  Description of Artificial Sequence: Synthetic peptide
DEEEIRTTNPVAHEQYGSVCTNLQLFDQR

SEQ ID NO: 26143 - protein, 31 aa, Artificial Sequence
  Description of Artificial Sequence: Synthetic polypeptide
AEEEIRTTNPVATEQYGSVSTNLQQTGGNLS

SEQ ID NO: 26144 - protein, 31 aa, Artificial Sequence
  Description of Artificial Sequence: Synthetic polypeptide
AEEEIRTTNPVATEQYGSVSTNLQQSNGNQM

SEQ ID NO: 26145 - protein, 31 aa, Artificial Sequence
  Description of Artificial Sequence: Synthetic polypeptide
DEEEIRTTNPVATEQYGSVSLTGGLQRGVLE

SEQ ID NO: 26146 - protein, 31 aa, Artificial Sequence
  Description of Artificial Sequence: Synthetic polypeptide
AEEEIRTTNPVATEQYGSVSTNLQNQGNNEE

SEQ ID NO: 26147 - protein, 30 aa, Artificial Sequence
  Description of Artificial Sequence: Synthetic polypeptide
AEEEIRTTNPVATEQYGSVSTNLQQSGGDA

SEQ ID NO: 26148 - protein, 32 aa, Artificial Sequence
  Description of Artificial Sequence: Synthetic polypeptide
DEEEIRTTNPVATEQYGSVSTPNLQIEGNIAT

SEQ ID NO: 26149 - protein, 30 aa, Artificial Sequence
  Description of Artificial Sequence: Synthetic polypeptide
DEDEIRTTNPVATEQWGEVSTNLGQGGNNR

SEQ ID NO: 26150 - protein, 31 aa, Artificial Sequence
  Description of Artificial Sequence: Synthetic polypeptide
AEEEIRTTNPVATEQYGSVSTNLQNQGVNIT

SEQ ID NO: 26151 - protein, 31 aa, Artificial Sequence
  Description of Artificial Sequence: Synthetic polypeptide
DEEEIRTTNPVATEQYGSVSTPNLQIREEEE

SEQ ID NO: 26152 - protein, 31 aa, Artificial Sequence
  Description of Artificial Sequence: Synthetic polypeptide
DEREIRTTNPVATEQYGSVCSTNLQSGSENQ

SEQ ID NO: 26153 - protein, 31 aa, Artificial Sequence
  Description of Artificial Sequence: Synthetic polypeptide
DEEEIRTTNPVATEQYGSVANTFNLGGRGTR

SEQ ID NO: 26154 - protein, 31 aa, Artificial Sequence
  Description of Artificial Sequence: Synthetic polypeptide
AEEEIRTTNPVATEQYGSVSTNLQNQGVNVD

SEQ ID NO: 26155 - protein, 31 aa, Artificial Sequence
  Description of Artificial Sequence: Synthetic polypeptide
DEEEIRTTNPVATEQYGSVSTPNLQLTGDIL

SEQ ID NO: 26156 - protein, 30 aa, Artificial Sequence
  Description of Artificial Sequence: Synthetic polypeptide
DEEEIRTTNPVATEQYGSVSTPNLQMTSDI

SEQ ID NO: 26157 - protein, 28 aa, Artificial Sequence
  Description of Artificial Sequence: Synthetic peptide
DEDEIRTTNPVATEPYGETSTNLQRGDG

SEQ ID NO: 26158 - protein, 30 aa, Artificial Sequence
  Description of Artificial Sequence: Synthetic polypeptide
AEEEIRTTNPVATEQYGSVSTNLQQQTDND

SEQ ID NO: 26159 - protein, 31 aa, Artificial Sequence
  Description of Artificial Sequence: Synthetic polypeptide
DEEEIRTTNPVATEQYGSVSLTLLQRGELMN

SEQ ID NO: 26160 - protein, 30 aa, Artificial Sequence
  Description of Artificial Sequence: Synthetic polypeptide
DEREIRTTNPVATEQYGSVSTENLQNFGEQ

SEQ ID NO: 26161 - protein, 31 aa, Artificial Sequence
  Description of Artificial Sequence: Synthetic polypeptide
DEREIRTTNPVATEQYGSVSTEDLQRFGSER

SEQ ID NO: 26162 - protein, 32 aa, Artificial Sequence
  Description of Artificial Sequence: Synthetic polypeptide
DEQEIRTTNPVATEQYGSVSTNLQRPGVDGRN

SEQ ID NO: 26163 - protein, 31 aa, Artificial Sequence
  Description of Artificial Sequence: Synthetic polypeptide
DEQEIRTTNPVATEQYGSVSTNLQRPDDPRL

SEQ ID NO: 26164 - protein, 30 aa, Artificial Sequence
  Description of Artificial Sequence: Synthetic polypeptide
DEAEIRTTNPVAYEQYGSVSTENLQAGNEN

SEQ ID NO: 26165 - protein, 29 aa, Artificial Sequence
  Description of Artificial Sequence: Synthetic peptide
DEQEIRTTNPVATEQYGDTSTNLQRGVDS

SEQ ID NO: 26166 - protein, 30 aa, Artificial Sequence
  Description of Artificial Sequence: Synthetic polypeptide
DEEEICTTNPMATEQYGSVPTNLQERGNNT

SEQ ID NO: 26167 - protein, 30 aa, Artificial Sequence
  Description of Artificial Sequence: Synthetic polypeptide
DEQEIATTNPVATEQYGSVSTNLQNGQNNS

SEQ ID NO: 26168 - protein, 31 aa, Artificial Sequence
  Description of Artificial Sequence: Synthetic polypeptide
AEEEIRTTNPVATEQYGSVSTNLNQNAGNEF

SEQ ID NO: 26169 - protein, 32 aa, Artificial Sequence
  Description of Artificial Sequence: Synthetic polypeptide
DEEEIRTTNPVATEQYGSTVSTNSHSQRGGER

SEQ ID NO: 26170 - protein, 34 aa, Artificial Sequence
  Description of Artificial Sequence: Synthetic polypeptide
DEEEIRTTNPVATEQYGSTVSTNSLSQRTGGNDR

SEQ ID NO: 26171 - protein, 33 aa, Artificial Sequence
  Description of Artificial Sequence: Synthetic polypeptide
DEEEIRTTNPVATEQYGSTVSTQNEHSQRGGNR

SEQ ID NO: 26172 - protein, 30 aa, Artificial Sequence
  Description of Artificial Sequence: Synthetic polypeptide
DESEIRTTNPVATECYGSASEINLQREGNR

SEQ ID NO: 26173 - protein, 31 aa, Artificial Sequence
  Description of Artificial Sequence: Synthetic polypeptide
AEEEIRTTNPVATEQYGSVSTNNLQNIGNIA

SEQ ID NO: 26174 - protein, 30 aa, Artificial Sequence
  Description of Artificial Sequence: Synthetic polypeptide
CEEEIATTNPVATEQYGSVSTPNLQQGDRM

SEQ ID NO: 26175 - protein, 28 aa, Artificial Sequence
  Description of Artificial Sequence: Synthetic peptide
SEEVISTTNPVATEQYGSVSSNHQRGNQ

SEQ ID NO: 26176 - protein, 33 aa, Artificial Sequence
  Description of Artificial Sequence: Synthetic polypeptide
DEEEIRTTNPVATEQYGSTVSTQNLSQPGGNER

SEQ ID NO: 26177 - protein, 29 aa, Artificial Sequence
  Description of Artificial Sequence: Synthetic peptide
DEEEIRTTNPVAHEQYGSVVTNLQVFDMR

SEQ ID NO: 26178 - protein, 31 aa, Artificial Sequence
  Description of Artificial Sequence: Synthetic polypeptide
DEEEIRTTNPVATEQYGSVSSTNNGQTGGNT

SEQ ID NO: 26179 - protein, 33 aa, Artificial Sequence
  Description of Artificial Sequence: Synthetic polypeptide
DEEEIRTTNPVATEQYGSTVSTQNLSQRGGNQS

SEQ ID NO: 26180 - protein, 30 aa, Artificial Sequence
  Description of Artificial Sequence: Synthetic polypeptide
AEEEIRTTNPVATEQYGSVSTNLNQQANTD

SEQ ID NO: 26181 - protein, 31 aa, Artificial Sequence
  Description of Artificial Sequence: Synthetic polypeptide
AEEEIRTTNPVATEQYGSVSTNNLQLQGNAN

SEQ ID NO: 26182 - protein, 28 aa, Artificial Sequence
  Description of Artificial Sequence: Synthetic peptide
SEEVIRCTNPIATEQYGSVSENLMRGNR

SEQ ID NO: 26183 - protein, 31 aa, Artificial Sequence
  Description of Artificial Sequence: Synthetic polypeptide
DEEEIRTTNPVATEQYGSVATNDDQPRQNRD

SEQ ID NO: 26184 - protein, 31 aa, Artificial Sequence
  Description of Artificial Sequence: Synthetic polypeptide
DEEEIRTTNPVATEQYGSVATNASSQRVGNQ

SEQ ID NO: 26185 - protein, 29 aa, Artificial Sequence
  Description of Artificial Sequence: Synthetic peptide
DEEEIRTTNPVATEQYGSVATLDQRINEN

SEQ ID NO: 26186 - protein, 30 aa, Artificial Sequence
  Description of Artificial Sequence: Synthetic polypeptide
DEEEIRTTNPVATEQYGSVSSTVLDVGERF

SEQ ID NO: 26187 - protein, 32 aa, Artificial Sequence
  Description of Artificial Sequence: Synthetic polypeptide
DEEEIRTTNPVATEQYGSTVSTNMLSQSGGER

SEQ ID NO: 26188 - protein, 32 aa, Artificial Sequence
  Description of Artificial Sequence: Synthetic polypeptide
DEEEIRTTNPVATEQYGSTVSTNMLSQRVTNP

SEQ ID NO: 26189 - protein, 31 aa, Artificial Sequence
  Description of Artificial Sequence: Synthetic polypeptide
AEEEIRTTNPVATEQYGSVSTNLNQMNTNIR

SEQ ID NO: 26190 - protein, 31 aa, Artificial Sequence
  Description of Artificial Sequence: Synthetic polypeptide
DEEEIRTTNPVATEQYGSVSSTVLQGGNNFD

SEQ ID NO: 26191 - protein, 31 aa, Artificial Sequence
  Description of Artificial Sequence: Synthetic polypeptide
AEEEIRTTNPVATEQYGSVSTNNLQQQGQNT

SEQ ID NO: 26192 - protein, 32 aa, Artificial Sequence
  Description of Artificial Sequence: Synthetic polypeptide
DEEEIRTTNPVATEQYGSTVSTNMLSQRGTEQ

SEQ ID NO: 26193 - protein, 30 aa, Artificial Sequence
  Description of Artificial Sequence: Synthetic polypeptide
AEEEIRTTNPVATEQYGSVSTNNLQQNVNF

SEQ ID NO: 26194 - protein, 34 aa, Artificial Sequence
  Description of Artificial Sequence: Synthetic polypeptide
DEEEIRTTNPVATEQYGSTVSTNMLSQRVGGNPR

SEQ ID NO: 26195 - protein, 31 aa, Artificial Sequence
  Description of Artificial Sequence: Synthetic polypeptide
DEEEICTTNPVATEQYGSVSTGNELQGGNAG

SEQ ID NO: 26196 - protein, 31 aa, Artificial Sequence
  Description of Artificial Sequence: Synthetic polypeptide
AEEEIRTTNPVATEQYGSVSTNNLQQGNEDA

SEQ ID NO: 26197 - protein, 29 aa, Artificial Sequence
  Description of Artificial Sequence: Synthetic peptide
DEEEIRTTNPVATEQYGSVSENPQFGPDI

SEQ ID NO: 26198 - protein, 31 aa, Artificial Sequence
  Description of Artificial Sequence: Synthetic polypeptide
AEEEIRTTNPVATEQYGSVSTNNLQQGNDSG

SEQ ID NO: 26199 - protein, 30 aa, Artificial Sequence
  Description of Artificial Sequence: Synthetic polypeptide
DEDEIRTTNPVATEHYGAVSTNLQADGNQR

SEQ ID NO: 26200 - protein, 30 aa, Artificial Sequence
  Description of Artificial Sequence: Synthetic polypeptide
DEEEICTTNPVATEQYGSVSTGLQGEGNDE

SEQ ID NO: 26201 - protein, 31 aa, Artificial Sequence
  Description of Artificial Sequence: Synthetic polypeptide
DEEEIRTTNPVATEQYGSVSTPNLDSEFGNA

SEQ ID NO: 26202 - protein, 30 aa, Artificial Sequence
  Description of Artificial Sequence: Synthetic polypeptide
AEEEIRTTNPVATEQYGSVSTNNLQQGIGF

SEQ ID NO: 26203 - protein, 31 aa, Artificial Sequence
  Description of Artificial Sequence: Synthetic polypeptide
AEEEIRTTNPVATEQYGSVSTNNLQQGGNND

SEQ ID NO: 26204 - protein, 29 aa, Artificial Sequence
  Description of Artificial Sequence: Synthetic peptide
DEQEIATTNPVATEQYGSVSTNLQHGEDL

SEQ ID NO: 26205 - protein, 29 aa, Artificial Sequence
  Description of Artificial Sequence: Synthetic peptide
DEQEIATTNPVATEQYGSVSTNLQHGGDL

SEQ ID NO: 26206 - protein, 30 aa, Artificial Sequence
  Description of Artificial Sequence: Synthetic polypeptide
DESEIRTTNPVATECYGSVSCNEQDREGNR

SEQ ID NO: 26207 - protein, 31 aa, Artificial Sequence
  Description of Artificial Sequence: Synthetic polypeptide
AEEEIRTTNPVATEQYGSVSTNLNQLQGENE

SEQ ID NO: 26208 - protein, 31 aa, Artificial Sequence
  Description of Artificial Sequence: Synthetic polypeptide
AEEEIRTTNPVATEQYGSVSTNLNQLQGNGN

SEQ ID NO: 26209 - protein, 30 aa, Artificial Sequence
  Description of Artificial Sequence: Synthetic polypeptide
DEEEICTTNPVATEQYGSVSTGLQGDGGNE

SEQ ID NO: 26210 - protein, 30 aa, Artificial Sequence
  Description of Artificial Sequence: Synthetic polypeptide
DESEIRTTNPVATECYGSVSDNLPQDRGNQ

SEQ ID NO: 26211 - protein, 30 aa, Artificial Sequence
  Description of Artificial Sequence: Synthetic polypeptide
DEQEIATTNPVATEQYGSVSTNLQHDGGNV

SEQ ID NO: 26212 - protein, 31 aa, Artificial Sequence
  Description of Artificial Sequence: Synthetic polypeptide
DEEEICTTNPVATEQYGSVSTDNLQDGNDNA

SEQ ID NO: 26213 - protein, 29 aa, Artificial Sequence
  Description of Artificial Sequence: Synthetic peptide
DEEEIRTTNPVATEQYGSVATLDQAPNDR

SEQ ID NO: 26214 - protein, 30 aa, Artificial Sequence
  Description of Artificial Sequence: Synthetic polypeptide
DEEEICTTNPAATEQYGSVPTNLQHRGNGE

SEQ ID NO: 26215 - protein, 31 aa, Artificial Sequence
  Description of Artificial Sequence: Synthetic polypeptide
AEEEIRTTNPVATEQYGSVSTNLNQQNGENT

SEQ ID NO: 26216 - protein, 28 aa, Artificial Sequence
  Description of Artificial Sequence: Synthetic peptide
DESEIRTTNPVATEAYGSVSTTLTQGNL

SEQ ID NO: 26217 - protein, 30 aa, Artificial Sequence
  Description of Artificial Sequence: Synthetic polypeptide
DEEEICTTNPAATEQYGSVPTNLQMRGNEG

SEQ ID NO: 26218 - protein, 31 aa, Artificial Sequence
  Description of Artificial Sequence: Synthetic polypeptide
AEEEIRTTNPVATEQYGSVSTNNLLQVGNTD

SEQ ID NO: 26219 - protein, 31 aa, Artificial Sequence
  Description of Artificial Sequence: Synthetic polypeptide
DEDEIRTTNPVATEHYGSVSTNLQGDGGNGR

SEQ ID NO: 26220 - protein, 28 aa, Artificial Sequence
  Description of Artificial Sequence: Synthetic peptide
SEEIIRCTNPIATEQYGSVSENLMRGNR

SEQ ID NO: 26221 - protein, 28 aa, Artificial Sequence
  Description of Artificial Sequence: Synthetic peptide
SEEKIRCTNPIATEQYGSVSENLGRGNR

SEQ ID NO: 26222 - protein, 31 aa, Artificial Sequence
  Description of Artificial Sequence: Synthetic polypeptide
DEDEIRTTNPVATEHYGSVSTNLQGEGNDRN

SEQ ID NO: 26223 - protein, 32 aa, Artificial Sequence
  Description of Artificial Sequence: Synthetic polypeptide
DEEEIRTTNPVATEQYGSVATGNLSQRGGNET

SEQ ID NO: 26224 - protein, 32 aa, Artificial Sequence
  Description of Artificial Sequence: Synthetic polypeptide
DEEEIRTTNPVATEQYGSVSTPNLEQIIGFNE

SEQ ID NO: 26225 - protein, 31 aa, Artificial Sequence
  Description of Artificial Sequence: Synthetic polypeptide
AEEEIRTTNPVATEQYGSVSTNNLGQQADNR

SEQ ID NO: 26226 - protein, 31 aa, Artificial Sequence
  Description of Artificial Sequence: Synthetic polypeptide
AEEEIRTTNPVATEQYGSVSTNNLGQEGNQT

SEQ ID NO: 26227 - protein, 31 aa, Artificial Sequence
  Description of Artificial Sequence: Synthetic polypeptide
DESEIRTTNPVATEAYGSVSCTNLQGGGSNR

SEQ ID NO: 26228 - protein, 28 aa, Artificial Sequence
  Description of Artificial Sequence: Synthetic peptide
SEETIRCTNPIATEQYGSVSENLMRGNR

SEQ ID NO: 26229 - protein, 32 aa, Artificial Sequence
  Description of Artificial Sequence: Synthetic polypeptide
DEEEIRTTNPVATEQYGSVATGNLQARGNDSV

SEQ ID NO: 26230 - protein, 30 aa, Artificial Sequence
  Description of Artificial Sequence: Synthetic polypeptide
DEEEIRTTNPVATEQYGSVATGLERDENER

SEQ ID NO: 26231 - protein, 30 aa, Artificial Sequence
  Description of Artificial Sequence: Synthetic polypeptide
DEDEIRTTNPVATEHYGSVSTNLQGGDNNN

SEQ ID NO: 26232 - protein, 31 aa, Artificial Sequence
  Description of Artificial Sequence: Synthetic polypeptide
DEEEIRTTNPVATEQYGSVSTPNLETGVNII

SEQ ID NO: 26233 - protein, 30 aa, Artificial Sequence
  Description of Artificial Sequence: Synthetic polypeptide
DESEIRTTNPVATEAYGSVSYTNLSQYGMR

SEQ ID NO: 26234 - protein, 30 aa, Artificial Sequence
  Description of Artificial Sequence: Synthetic polypeptide
DEEEICTTNPAATEQYGSVPTNDQMRGNTR

SEQ ID NO: 26235 - protein, 32 aa, Artificial Sequence
  Description of Artificial Sequence: Synthetic polypeptide
DEEEIRTTNPVATEQYGSVSTPNLEQGDGNEQ

SEQ ID NO: 26236 - protein, 30 aa, Artificial Sequence
  Description of Artificial Sequence: Synthetic polypeptide
DEDEIRTTNPVATEHYGSVSTNLQDNGDRN

SEQ ID NO: 26237 - protein, 31 aa, Artificial Sequence
  Description of Artificial Sequence: Synthetic polypeptide
DEEEIRTTNPVATEQYGSVSTPNLDVEGNTN

SEQ ID NO: 26238 - protein, 33 aa, Artificial Sequence
  Description of Artificial Sequence: Synthetic polypeptide
DEEEIRTTNPVATEQYGSTVSTTNAHSQRGNYR

SEQ ID NO: 26239 - protein, 31 aa, Artificial Sequence
  Description of Artificial Sequence: Synthetic polypeptide
AEEEIRTTNPVATEQYGSVSTNNLQEGGNQA

SEQ ID NO: 26240 - protein, 34 aa, Artificial Sequence
  Description of Artificial Sequence: Synthetic polypeptide
DEEEIRTTNPVATEQYGSTVSTTQNLSQRGGNTR

SEQ ID NO: 26241 - protein, 31 aa, Artificial Sequence
  Description of Artificial Sequence: Synthetic polypeptide
DEEEIRTTNPVATEQYGSTVSTVLSGRVNNR

SEQ ID NO: 26242 - protein, 31 aa, Artificial Sequence
  Description of Artificial Sequence: Synthetic polypeptide
DEEEIRTTNPVATEQYGSTVSVSGNLQRVNQ

SEQ ID NO: 26243 - protein, 33 aa, Artificial Sequence
  Description of Artificial Sequence: Synthetic polypeptide
DEEEIRTTNPVATEQYGSTVSVTNLSQIGNDRI

SEQ ID NO: 26244 - protein, 31 aa, Artificial Sequence
  Description of Artificial Sequence: Synthetic polypeptide
DEEEICTTNPVATEQYGSVSCTNHSARGNNR

SEQ ID NO: 26245 - protein, 31 aa, Artificial Sequence
  Description of Artificial Sequence: Synthetic polypeptide
AEEEIRTTNPVATEQYGSVSTNNLQAGENES

SEQ ID NO: 26246 - protein, 30 aa, Artificial Sequence
  Description of Artificial Sequence: Synthetic polypeptide
DEEEICTTNPVATEQYGSVSTDNGQDAGNS

SEQ ID NO: 26247 - protein, 33 aa, Artificial Sequence
  Description of Artificial Sequence: Synthetic polypeptide
DEEEICTTNPVATEQYGSVSCTGNLSQRGTNNR

SEQ ID NO: 26248 - protein, 30 aa, Artificial Sequence
  Description of Artificial Sequence: Synthetic polypeptide
AEEEIRTTNPVATEQYGSVSTNNLNQQGGI

SEQ ID NO: 26249 - protein, 31 aa, Artificial Sequence
  Description of Artificial Sequence: Synthetic polypeptide
AEEEIRTTNPVATEQYGSVSTNLNQQGGNNM

SEQ ID NO: 26250 - protein, 30 aa, Artificial Sequence
  Description of Artificial Sequence: Synthetic polypeptide
DEEEICTTNPVATEQYGSVSANLQESGDRL

SEQ ID NO: 26251 - protein, 29 aa, Artificial Sequence
  Description of Artificial Sequence: Synthetic peptide
DEEEICTTNPVATEQYGSVSANLQENDNS

SEQ ID NO: 26252 - protein, 30 aa, Artificial Sequence
  Description of Artificial Sequence: Synthetic polypeptide
DEEEICTTNPVATEQYGSVSANLQDNDGNS

SEQ ID NO: 26253 - protein, 33 aa, Artificial Sequence
  Description of Artificial Sequence: Synthetic polypeptide
DEEEIRTTNPVATEQYGSTVSVTPNLSQRGGPR

SEQ ID NO: 26254 - protein, 31 aa, Artificial Sequence
  Description of Artificial Sequence: Synthetic polypeptide
DEEEIRTTNPVATEQYGSVSTPVLQRGVFVD

SEQ ID NO: 26255 - protein, 30 aa, Artificial Sequence
  Description of Artificial Sequence: Synthetic polypeptide
DEDEIRTTNPVATEHYGSVSTNLQAGGEDR

SEQ ID NO: 26256 - protein, 32 aa, Artificial Sequence
  Description of Artificial Sequence: Synthetic polypeptide
DEEEIRTTNPVATEQYGSVSTPNLEQDTGENG

SEQ ID NO: 26257 - protein, 31 aa, Artificial Sequence
  Description of Artificial Sequence: Synthetic polypeptide
DEEEIRTTNPVATEQYGSVSTPNLELEGNEA

SEQ ID NO: 26258 - protein, 30 aa, Artificial Sequence
  Description of Artificial Sequence: Synthetic polypeptide
DEEEIRTTNPVATEQYGSVSTPNLDQGTTE

SEQ ID NO: 26259 - protein, 32 aa, Artificial Sequence
  Description of Artificial Sequence: Synthetic polypeptide
DEEEIRTTNPVATEQYGSVSETNLQFNEGNGD

SEQ ID NO: 26260 - protein, 32 aa, Artificial Sequence
  Description of Artificial Sequence: Synthetic polypeptide
DEEEIRTTNPVATEQYGSVSTPNLDQGIGQNQ

SEQ ID NO: 26261 - protein, 30 aa, Artificial Sequence
  Description of Artificial Sequence: Synthetic polypeptide
DEEEIRTTNPVATEQYGSVATNDQGNGNPA

SEQ ID NO: 26262 - protein, 30 aa, Artificial Sequence
  Description of Artificial Sequence: Synthetic polypeptide
DEEEIRTTNPVATEQYGCVCSTNHQRFNDA

SEQ ID NO: 26263 - protein, 30 aa, Artificial Sequence
  Description of Artificial Sequence: Synthetic polypeptide
DEEEIRTTNPVATEQYGSVATNDQDEGDND

SEQ ID NO: 26264 - protein, 31 aa, Artificial Sequence
  Description of Artificial Sequence: Synthetic polypeptide
DESEIRTTNPVATEQYGKVSCTNALSQTGNR

SEQ ID NO: 26265 - protein, 31 aa, Artificial Sequence
  Description of Artificial Sequence: Synthetic polypeptide
DEEEICTTNPVATEQYGSVSTNLQGDAGNEQ

SEQ ID NO: 26266 - protein, 31 aa, Artificial Sequence
  Description of Artificial Sequence: Synthetic polypeptide
DESEIRTTNPVATEQYGKTVSCTNLSQNGNR

SEQ ID NO: 26267 - protein, 31 aa, Artificial Sequence
  Description of Artificial Sequence: Synthetic polypeptide
DEEEIRTTNPVATEQYGSVSTQLIQGFGNGG

SEQ ID NO: 26268 - protein, 28 aa, Artificial Sequence
  Description of Artificial Sequence: Synthetic peptide
SEEEVRCTNPVATEQYGSVSETIQRGNR

SEQ ID NO: 26269 - protein, 31 aa, Artificial Sequence
  Description of Artificial Sequence: Synthetic polypeptide
DEEEICTTNPVATEQYGSVSTNLQENPGDNA

SEQ ID NO: 26270 - protein, 31 aa, Artificial Sequence
  Description of Artificial Sequence: Synthetic polypeptide
DEEEICTTNPVATEQYGSVSTNLQDRPQNEI

SEQ ID NO: 26271 - protein, 30 aa, Artificial Sequence
  Description of Artificial Sequence: Synthetic polypeptide
DEEEIRTTNPVATEQYGSVSSTYLERNQER

SEQ ID NO: 26272 - protein, 30 aa, Artificial Sequence
  Description of Artificial Sequence: Synthetic polypeptide
DEEEIRTTNPVATEQYGCVCSTNHQNGNMA

SEQ ID NO: 26273 - protein, 29 aa, Artificial Sequence
  Description of Artificial Sequence: Synthetic peptide
DEEEIRTTNPVAFEQYGSVWTNLQQFDSR

SEQ ID NO: 26274 - protein, 29 aa, Artificial Sequence
  Description of Artificial Sequence: Synthetic peptide
DEEEIRTTNPVAFEQYGSVWTNLQYFDQR

SEQ ID NO: 26275 - protein, 29 aa, Artificial Sequence
  Description of Artificial Sequence: Synthetic peptide
DESEIRTTNPVATEQYGEVSTNGQGQGDR

SEQ ID NO: 26276 - protein, 30 aa, Artificial Sequence
  Description of Artificial Sequence: Synthetic polypeptide
DEEEICTTNPVATEQYGSVSTNLQDGGDQG

SEQ ID NO: 26277 - protein, 31 aa, Artificial Sequence
  Description of Artificial Sequence: Synthetic polypeptide
SEEEVRTTNPVATEQYGSVSTENLDQAIGNR

SEQ ID NO: 26278 - protein, 29 aa, Artificial Sequence
  Description of Artificial Sequence: Synthetic peptide
DEEEIRTTNPVAHEQYGSVWTNLQPADSR

SEQ ID NO: 26279 - protein, 31 aa, Artificial Sequence
  Description of Artificial Sequence: Synthetic polypeptide
DEEEIRTTNPVATEQYGSVSSTYLDQDRNNE

SEQ ID NO: 26280 - protein, 29 aa, Artificial Sequence
  Description of Artificial Sequence: Synthetic peptide
DEQEIATTNPVATEQYGSVSSNDQRDNRD

SEQ ID NO: 26281 - protein, 30 aa, Artificial Sequence
  Description of Artificial Sequence: Synthetic polypeptide
DESEIRTTNPVATEQYGQSVSTNLQNFGEQ

SEQ ID NO: 26282 - protein, 31 aa, Artificial Sequence
  Description of Artificial Sequence: Synthetic polypeptide
DEEEICTTNPVATEQYGSVSTNLQGDEGNQP

SEQ ID NO: 26283 - protein, 30 aa, Artificial Sequence
  Description of Artificial Sequence: Synthetic polypeptide
DEEEIRTTNPVATEQYGSVSLNLQRNSEMD

SEQ ID NO: 26284 - protein, 32 aa, Artificial Sequence
  Description of Artificial Sequence: Synthetic polypeptide
DESEIRTTNPVATEQYGSVCSTDNLQRGGDER

SEQ ID NO: 26285 - protein, 32 aa, Artificial Sequence
  Description of Artificial Sequence: Synthetic polypeptide
DESEIRTTNPVATEQYGSVCSGDNLQRGDNDR

SEQ ID NO: 26286 - protein, 28 aa, Artificial Sequence
  Description of Artificial Sequence: Synthetic peptide
SEGEIAPTNPIATEQYGSVSENLQRGNR

SEQ ID NO: 26287 - protein, 28 aa, Artificial Sequence
  Description of Artificial Sequence: Synthetic peptide
SEEEVACTNPVATEQYGSVSENIQRGNR

SEQ ID NO: 26288 - protein, 28 aa, Artificial Sequence
  Description of Artificial Sequence: Synthetic peptide
SEEEVACTNPVATEQYGSVSNNIQRGNR

SEQ ID NO: 26289 - protein, 31 aa, Artificial Sequence
  Description of Artificial Sequence: Synthetic polypeptide
DEEEIRTTNPVATEQYGSVSETNLQIGMQGQ

SEQ ID NO: 26290 - protein, 31 aa, Artificial Sequence
  Description of Artificial Sequence: Synthetic polypeptide
DEEEICTTNPVATEQYGSVSTNLQGNGDNSP

SEQ ID NO: 26291 - protein, 31 aa, Artificial Sequence
  Description of Artificial Sequence: Synthetic polypeptide
DEEEIRTTNPVATEQYGSVSETNLQIGITQN

SEQ ID NO: 26292 - protein, 29 aa, Artificial Sequence
  Description of Artificial Sequence: Synthetic peptide
DEEEIRTTNPVATEQYGSVATNDSRENDD

SEQ ID NO: 26293 - protein, 29 aa, Artificial Sequence
  Description of Artificial Sequence: Synthetic peptide
DEEEIRTTNPVATEQYGSVATNDPQRVEI

SEQ ID NO: 26294 - protein, 30 aa, Artificial Sequence
  Description of Artificial Sequence: Synthetic polypeptide
DEEEIRTTNPVATEQYGSVATNDQPGGTNQ

SEQ ID NO: 26295 - protein, 32 aa, Artificial Sequence
  Description of Artificial Sequence: Synthetic polypeptide
DEEEIRTTNPVATEQYGSVSSTNLQSNGNSTT

SEQ ID NO: 26296 - protein, 28 aa, Artificial Sequence
  Description of Artificial Sequence: Synthetic peptide
SEGEIAPTNPCATEQYGSVSENLQRGNR

SEQ ID NO: 26297 - protein, 31 aa, Artificial Sequence
  Description of Artificial Sequence: Synthetic polypeptide
DEEEICTTNPVATEQYGSVSTNLQGGNGNTE

SEQ ID NO: 26298 - protein, 31 aa, Artificial Sequence
  Description of Artificial Sequence: Synthetic polypeptide
DESEIRTTNPVATEQYGSISTNTSQRTGLNR

SEQ ID NO: 26299 - protein, 29 aa, Artificial Sequence
  Description of Artificial Sequence: Synthetic peptide
DESEIRTTNPVATEQYGSISTNTQDEGLR

SEQ ID NO: 26300 - protein, 31 aa, Artificial Sequence
  Description of Artificial Sequence: Synthetic polypeptide
DEEEIRTTNPVATEQYGSVATNDQNRGNTPM

SEQ ID NO: 26301 - protein, 31 aa, Artificial Sequence
  Description of Artificial Sequence: Synthetic polypeptide
DESEIRTTNPVATEQYGSCSTNLNRDGPNRG

SEQ ID NO: 26302 - protein, 31 aa, Artificial Sequence
  Description of Artificial Sequence: Synthetic polypeptide
DEEEIRTTNPVATEQYGSVSTPNLDFEGEND

SEQ ID NO: 26303 - protein, 29 aa, Artificial Sequence
  Description of Artificial Sequence: Synthetic peptide
DEQEIATTNPVATEQYGSVSNNLQGGNES

SEQ ID NO: 26304 - protein, 32 aa, Artificial Sequence
  Description of Artificial Sequence: Synthetic polypeptide
DESEIRTTNPVATEQYGSTVSCTNMLQRVGNQ

SEQ ID NO: 26305 - protein, 31 aa, Artificial Sequence
  Description of Artificial Sequence: Synthetic polypeptide
DEEEIRTTNPVATEQYGSVSSTWLGVRGNED

SEQ ID NO: 26306 - protein, 31 aa, Artificial Sequence
  Description of Artificial Sequence: Synthetic polypeptide
DEEEIRTTNPVATEQYGSVSLNLQTGQNLNE

SEQ ID NO: 26307 - protein, 31 aa, Artificial Sequence
  Description of Artificial Sequence: Synthetic polypeptide
AEEEIRTTNPVATEQYGSVSTNLNQDTNENR

SEQ ID NO: 26308 - protein, 31 aa, Artificial Sequence
  Description of Artificial Sequence: Synthetic polypeptide
DEEEIRTTNPVATEQYGSVSTQLDQEVGNNG

SEQ ID NO: 26309 - protein, 30 aa, Artificial Sequence
  Description of Artificial Sequence: Synthetic polypeptide
DEDEIRTTNPVATEGYGSVSTNLQGNGNDS

SEQ ID NO: 26310 - protein, 30 aa, Artificial Sequence
  Description of Artificial Sequence: Synthetic polypeptide
DEDEIRTTNPVATEGYGSVSTNLQMGGNDN

SEQ ID NO: 26311 - protein, 31 aa, Artificial Sequence
  Description of Artificial Sequence: Synthetic polypeptide
DEEEIRTTNPVATEQYGSVSTQIQRFNNERN

SEQ ID NO: 26312 - protein, 31 aa, Artificial Sequence
  Description of Artificial Sequence: Synthetic polypeptide
DEEEICTTNPVATEQYGSVSTNDQGNQGNER

SEQ ID NO: 26313 - protein, 30 aa, Artificial Sequence
  Description of Artificial Sequence: Synthetic polypeptide
DEEEIRTTNPVATEQYGSVSSTVLQGSINE

SEQ ID NO: 26314 - protein, 30 aa, Artificial Sequence
  Description of Artificial Sequence: Synthetic polypeptide
DEEEICTTNPVATEQYGSVSTNDGGGDENR

SEQ ID NO: 26315 - protein, 30 aa, Artificial Sequence
  Description of Artificial Sequence: Synthetic polypeptide
DESEIRTTNPVATEPYGSVSTNLQEGGNGE

SEQ ID NO: 26316 - protein, 29 aa, Artificial Sequence
  Description of Artificial Sequence: Synthetic peptide
DEECIMTTNPVATEYYGSVNTNGLQRGNM

SEQ ID NO: 26317 - protein, 29 aa, Artificial Sequence
  Description of Artificial Sequence: Synthetic peptide
DEEEIRTTNPVATEQYGSVSLNLQTNSQF

SEQ ID NO: 26318 - protein, 32 aa, Artificial Sequence
  Description of Artificial Sequence: Synthetic polypeptide
DEEEIRTTNPVATEQYGSVSTPNLDQEVGENL

SEQ ID NO: 26319 - protein, 30 aa, Artificial Sequence
  Description of Artificial Sequence: Synthetic polypeptide
AEEEIRTTNPVATEQYGSVSTNNLQTGQDT

SEQ ID NO: 26320 - protein, 30 aa, Artificial Sequence
  Description of Artificial Sequence: Synthetic polypeptide
AEEEIRTTNPVATEQYGSVSTNNLQTGIQE

SEQ ID NO: 26321 - protein, 29 aa, Artificial Sequence
  Description of Artificial Sequence: Synthetic peptide
DEEEIRTTNPVATEQYGSVATNDERHNPE

SEQ ID NO: 26322 - protein, 29 aa, Artificial Sequence
  Description of Artificial Sequence: Synthetic peptide
DEEEIRTTNPVATEQYGSVATNDERGPDV

SEQ ID NO: 26323 - protein, 31 aa, Artificial Sequence
  Description of Artificial Sequence: Synthetic polypeptide
AEEEIRTTNPVATEQYGSVSTNNLQSGNEQQ

SEQ ID NO: 26324 - protein, 28 aa, Artificial Sequence
  Description of Artificial Sequence: Synthetic peptide
DESEIRTTNPVATEIYGSVSNNLQHGTM

SEQ ID NO: 26325 - protein, 32 aa, Artificial Sequence
  Description of Artificial Sequence: Synthetic polypeptide
DEEEIRTTNPVATEQYGSVSETNLQFNGNGGN

SEQ ID NO: 26326 - protein, 33 aa, Artificial Sequence
  Description of Artificial Sequence: Synthetic polypeptide
DEEEIRTTNPVATEQYGSTVSTNLSQRNGGNEN

SEQ ID NO: 26327 - protein, 30 aa, Artificial Sequence
  Description of Artificial Sequence: Synthetic polypeptide
DESEIRTTNPVATEHWGSVVSTNLQYGGNR

SEQ ID NO: 26328 - protein, 29 aa, Artificial Sequence
  Description of Artificial Sequence: Synthetic peptide
DEEEIRTTNPVATEQYGSVATNDERNNDV

SEQ ID NO: 26329 - protein, 31 aa, Artificial Sequence
  Description of Artificial Sequence: Synthetic polypeptide
AEEEIRTTNPVATEQYGSVSTNNLDQQGNNE

SEQ ID NO: 26330 - protein, 28 aa, Artificial Sequence
  Description of Artificial Sequence: Synthetic peptide
SEEHIRCTNPIATEQYGSVSENLMRGNR

SEQ ID NO: 26331 - protein, 31 aa, Artificial Sequence
  Description of Artificial Sequence: Synthetic polypeptide
DEQEIATTNPVATEQYGSVSTNLQDGGLNDR

SEQ ID NO: 26332 - protein, 29 aa, Artificial Sequence
  Description of Artificial Sequence: Synthetic peptide
DEQEIATTNPVATEQYGSVSTDLQRGEDL

SEQ ID NO: 26333 - protein, 30 aa, Artificial Sequence
  Description of Artificial Sequence: Synthetic polypeptide
DEQEIATTNPVATEQYGSVSTGNLQHGNQH

SEQ ID NO: 26334 - protein, 30 aa, Artificial Sequence
  Description of Artificial Sequence: Synthetic polypeptide
DEEEIRTTNPVATEQYGSVSTQLIGNMGNE

SEQ ID NO: 26335 - protein, 29 aa, Artificial Sequence
  Description of Artificial Sequence: Synthetic peptide
DEQEIATTNPVATEQYGSVSTNDGEGNRN

SEQ ID NO: 26336 - protein, 30 aa, Artificial Sequence
  Description of Artificial Sequence: Synthetic polypeptide
DESEIRTTNPVATEQYGCVSTELQVNDGNR

SEQ ID NO: 26337 - protein, 32 aa, Artificial Sequence
  Description of Artificial Sequence: Synthetic polypeptide
DEEEICTTNPVATEQYGSVSTNLGQDGGNDRG

SEQ ID NO: 26338 - protein, 29 aa, Artificial Sequence
  Description of Artificial Sequence: Synthetic peptide
DEQEIATTNPVATEQYGSVSTNDGMEGNR

SEQ ID NO: 26339 - protein, 32 aa, Artificial Sequence
  Description of Artificial Sequence: Synthetic polypeptide
DEEEICTTNPVATEQYGSVSTNLGQDDGNGRE

SEQ ID NO: 26340 - protein, 32 aa, Artificial Sequence
  Description of Artificial Sequence: Synthetic polypeptide
SEEEVRTTNPVATEQYGSVSTWNLDQRIGSNR

SEQ ID NO: 26341 - protein, 30 aa, Artificial Sequence
  Description of Artificial Sequence: Synthetic polypeptide
DEDEIRTTNPVATEGYGSVSTNLQEGMGNG

SEQ ID NO: 26342 - protein, 30 aa, Artificial Sequence
  Description of Artificial Sequence: Synthetic polypeptide
SEEEVRTVNPVATEQYGSVSTNFLERGNRY

SEQ ID NO: 26343 - protein, 29 aa, Artificial Sequence
  Description of Artificial Sequence: Synthetic peptide
DESEIRTTNPVATEQWGSVSDNEQREGNG

SEQ ID NO: 26344 - protein, 31 aa, Artificial Sequence
  Description of Artificial Sequence: Synthetic polypeptide
DEEEIRTTNPVATEQYGSVSTPNLDMEGTNV

SEQ ID NO: 26345 - protein, 31 aa, Artificial Sequence
  Description of Artificial Sequence: Synthetic polypeptide
DESEIRTTNPVATEQWGSVSCTGNSQRGGNR

SEQ ID NO: 26346 - protein, 30 aa, Artificial Sequence
  Description of Artificial Sequence: Synthetic polypeptide
DESEIRTTNPVATEQWGSVSCNLPQREGNG

SEQ ID NO: 26347 - protein, 31 aa, Artificial Sequence
  Description of Artificial Sequence: Synthetic polypeptide
DEEEICTTNPVATEQYGSVSTNLDQGNMGDR

SEQ ID NO: 26348 - protein, 28 aa, Artificial Sequence
  Description of Artificial Sequence: Synthetic peptide
SEEGICTTNPVATEQYGSVSMNSQRGND

SEQ ID NO: 26349 - protein, 28 aa, Artificial Sequence
  Description of Artificial Sequence: Synthetic peptide
SEEGIRCTNPIATEQYGSVSENLMRGNR

SEQ ID NO: 26350 - protein, 31 aa, Artificial Sequence
  Description of Artificial Sequence: Synthetic polypeptide
DEEEICTTNPVATEQYGSVSTNGLFQVRGEH

SEQ ID NO: 26351 - protein, 31 aa, Artificial Sequence
  Description of Artificial Sequence: Synthetic polypeptide
DEEEICTTNPVATEQYGSVSTNGLFQPRGEF

SEQ ID NO: 26352 - protein, 28 aa, Artificial Sequence
  Description of Artificial Sequence: Synthetic peptide
SEEGIATTNPVATEQYGSVSMNSQRGNS

SEQ ID NO: 26353 - protein, 31 aa, Artificial Sequence
  Description of Artificial Sequence: Synthetic polypeptide
DESEIRTTNPVATEQYGSVCSTGNLQSFGNQ

SEQ ID NO: 26354 - protein, 28 aa, Artificial Sequence
  Description of Artificial Sequence: Synthetic peptide
SEETIRCTNPIATEQYGSVSENLIRGNR

SEQ ID NO: 26355 - protein, 32 aa, Artificial Sequence
  Description of Artificial Sequence: Synthetic polypeptide
DEEEIRTTNPVATEQYGSVSETNLQDGGNNGD

SEQ ID NO: 26356 - protein, 29 aa, Artificial Sequence
  Description of Artificial Sequence: Synthetic peptide
DESEIRSTNPIATEQYGSVSAENIQRGNR

SEQ ID NO: 26357 - protein, 30 aa, Artificial Sequence
  Description of Artificial Sequence: Synthetic polypeptide
AEEEIRTTNPVATEQYGSVSTNMQSGVNTE

SEQ ID NO: 26358 - protein, 30 aa, Artificial Sequence
  Description of Artificial Sequence: Synthetic polypeptide
DEEEICTTNPVATEQYGSVATNLQAPNSRE

SEQ ID NO: 26359 - protein, 29 aa, Artificial Sequence
  Description of Artificial Sequence: Synthetic peptide
AEEEIRTTNPVATEQYGSVSTNMQQENSG

SEQ ID NO: 26360 - protein, 30 aa, Artificial Sequence
  Description of Artificial Sequence: Synthetic polypeptide
DEEEICTTNPVATEQYGSVATNLQAGNAQP

SEQ ID NO: 26361 - protein, 29 aa, Artificial Sequence
  Description of Artificial Sequence: Synthetic peptide
DEQEIRCTNPVATEQYGSVSTNLMRGEDL

SEQ ID NO: 26362 - protein, 32 aa, Artificial Sequence
  Description of Artificial Sequence: Synthetic polypeptide
DEEEIRTTNPVATEQYGSVSTPNLIQSGGNNP

SEQ ID NO: 26363 - protein, 30 aa, Artificial Sequence
  Description of Artificial Sequence: Synthetic polypeptide
AEEEIRTTNPVATEQYGSVSTNLQEEDTNQ

SEQ ID NO: 26364 - protein, 30 aa, Artificial Sequence
  Description of Artificial Sequence: Synthetic polypeptide
AEEEIRTTNPVATEQYGSVSTNMQNSNGNF

SEQ ID NO: 26365 - protein, 29 aa, Artificial Sequence
  Description of Artificial Sequence: Synthetic peptide
DEQEIRTTNPCAYEQYGCVSMNLQREGNR

SEQ ID NO: 26366 - protein, 30 aa, Artificial Sequence
  Description of Artificial Sequence: Synthetic polypeptide
DEEEICTTNPVATEQYGSVATNLEAGMNRM

SEQ ID NO: 26367 - protein, 30 aa, Artificial Sequence
  Description of Artificial Sequence: Synthetic polypeptide
DEEEICTTNPVATEQYGSVATNHQERGNED

SEQ ID NO: 26368 - protein, 32 aa, Artificial Sequence
  Description of Artificial Sequence: Synthetic polypeptide
DEEEIRTTNPVATEQYGSVSETNLDQNGNNSS

SEQ ID NO: 26369 - protein, 32 aa, Artificial Sequence
  Description of Artificial Sequence: Synthetic polypeptide
DEEEIRTTNPVATEQYGSVSTPNLIQTGENSN

SEQ ID NO: 26370 - protein, 29 aa, Artificial Sequence
  Description of Artificial Sequence: Synthetic peptide
DEQEIRTTNPVATDQYGCVSTGNLERGNP

SEQ ID NO: 26371 - protein, 30 aa, Artificial Sequence
  Description of Artificial Sequence: Synthetic polypeptide
AEEEIRTTNPVATEQYGSVSTNLQEFGGVE

SEQ ID NO: 26372 - protein, 31 aa, Artificial Sequence
  Description of Artificial Sequence: Synthetic polypeptide
DEEEICTTNPVATEQYGSVATGNLQRGDNTD

SEQ ID NO: 26373 - protein, 31 aa, Artificial Sequence
  Description of Artificial Sequence: Synthetic polypeptide
DEEEIRTTNPVATEQYGSVSETNLDNGGGNI

SEQ ID NO: 26374 - protein, 29 aa, Artificial Sequence
  Description of Artificial Sequence: Synthetic peptide
DEEEICTTNPVATEQYGSVAPNLDQSENR

SEQ ID NO: 26375 - protein, 29 aa, Artificial Sequence
  Description of Artificial Sequence: Synthetic peptide
DESEIRSTNPIATEQYGSVSAENLMRGNR

SEQ ID NO: 26376 - protein, 30 aa, Artificial Sequence
  Description of Artificial Sequence: Synthetic polypeptide
DEEEIRTTNPVATEQYGSVSETNLDRESDG

SEQ ID NO: 26377 - protein, 30 aa, Artificial Sequence
  Description of Artificial Sequence: Synthetic polypeptide
DEDEIRTTNPVATEIYGSVSTNLQGDTGNQ

SEQ ID NO: 26378 - protein, 31 aa, Artificial Sequence
  Description of Artificial Sequence: Synthetic polypeptide
DEEEICTTNPVATEQYGSVATNLQARNNDRA

SEQ ID NO: 26379 - protein, 30 aa, Artificial Sequence
  Description of Artificial Sequence: Synthetic polypeptide
DEEEICTTNPVATEQYGSVATNLQGENNRD

SEQ ID NO: 26380 - protein, 28 aa, Artificial Sequence
  Description of Artificial Sequence: Synthetic peptide
DESEIRTTNPAATEFYGSCSTNLDRGNG

SEQ ID NO: 26381 - protein, 29 aa, Artificial Sequence
  Description of Artificial Sequence: Synthetic peptide
DESEIRTTNCVAYDQYGSVSTNLSQRGDR

SEQ ID NO: 26382 - protein, 31 aa, Artificial Sequence
  Description of Artificial Sequence: Synthetic polypeptide
AEEEIRTTNPVATEQYGSVSTNLQDGGGNQM

SEQ ID NO: 26383 - protein, 28 aa, Artificial Sequence
  Description of Artificial Sequence: Synthetic peptide
DEQEIRCTNPIATEQYGSVSENLMRGER

SEQ ID NO: 26384 - protein, 31 aa, Artificial Sequence
  Description of Artificial Sequence: Synthetic polypeptide
AEEEIRTTNPVATEQYGSVSTNLQDNQGNEE

SEQ ID NO: 26385 - protein, 31 aa, Artificial Sequence
  Description of Artificial Sequence: Synthetic polypeptide
DEEEICTTNPVATEQYGSVATNLQFDGNPRE

SEQ ID NO: 26386 - protein, 32 aa, Artificial Sequence
  Description of Artificial Sequence: Synthetic polypeptide
DEEEICTTNPVATEQYGSVATNLQERGNNNRA

SEQ ID NO: 26387 - protein, 29 aa, Artificial Sequence
  Description of Artificial Sequence: Synthetic peptide
DEEEICTTNPVATEQYGSVATNLQEDGEQ

SEQ ID NO: 26388 - protein, 31 aa, Artificial Sequence
  Description of Artificial Sequence: Synthetic polypeptide
DEEEIRTTNPVATEQYGSVSTPNNQRNMERI

SEQ ID NO: 26389 - protein, 30 aa, Artificial Sequence
  Description of Artificial Sequence: Synthetic polypeptide
DEEEICTTNPVATEQYGSVATNLQEDGENH

SEQ ID NO: 26390 - protein, 31 aa, Artificial Sequence
  Description of Artificial Sequence: Synthetic polypeptide
DEEEICTTNPVATEQYGSVATNLQDSNGDNR

SEQ ID NO: 26391 - protein, 29 aa, Artificial Sequence
  Description of Artificial Sequence: Synthetic peptide
AEEEIRTTNPVATEQYGSVSTNNDEGNVE

SEQ ID NO: 26392 - protein, 30 aa, Artificial Sequence
  Description of Artificial Sequence: Synthetic polypeptide
AEEEIRTTNPVATEQYGSVSTNLQDQGTAA

SEQ ID NO: 26393 - protein, 31 aa, Artificial Sequence
  Description of Artificial Sequence: Synthetic polypeptide
AEEEIRTTNPVATEQYGSVSTNLQDQQGNQT

SEQ ID NO: 26394 - protein, 30 aa, Artificial Sequence
  Description of Artificial Sequence: Synthetic polypeptide
DEEEICTTNPVATEQYGSVATNLQDPGNDF

SEQ ID NO: 26395 - protein, 29 aa, Artificial Sequence
  Description of Artificial Sequence: Synthetic peptide
CEEAIRTTNPVATEQYGCVSTNLQYGSQR

SEQ ID NO: 26396 - protein, 30 aa, Artificial Sequence
  Description of Artificial Sequence: Synthetic polypeptide
DEDEIRTTNPVATEIYGSVSTNLQDGGNGQ

SEQ ID NO: 26397 - protein, 31 aa, Artificial Sequence
  Description of Artificial Sequence: Synthetic polypeptide
DEEEIRTTNPVATEQYGSVSETNLDRMIPDR

SEQ ID NO: 26398 - protein, 31 aa, Artificial Sequence
  Description of Artificial Sequence: Synthetic polypeptide
DEEEIRTTNPVATEQYGSVSLTNLNQNDLTR

SEQ ID NO: 26399 - protein, 31 aa, Artificial Sequence
  Description of Artificial Sequence: Synthetic polypeptide
AEEEIRTTNPVATEQYGSVSTNLQDNTGNTT

SEQ ID NO: 26400 - protein, 30 aa, Artificial Sequence
  Description of Artificial Sequence: Synthetic polypeptide
AEEEIRTTNPVATEQYGSVSTNNDGQDGIR

SEQ ID NO: 26401 - protein, 29 aa, Artificial Sequence
  Description of Artificial Sequence: Synthetic peptide
DESEIRCTNPISTEQYGSVSAENLQRGNR

SEQ ID NO: 26402 - protein, 28 aa, Artificial Sequence
  Description of Artificial Sequence: Synthetic peptide
DESEIRCTNPIATEQYGSVSENEMRGNR

SEQ ID NO: 26403 - protein, 30 aa, Artificial Sequence
  Description of Artificial Sequence: Synthetic polypeptide
DEEEICTTNPMATEQYGSVGTNLQERGNGQ

SEQ ID NO: 26404 - protein, 29 aa, Artificial Sequence
  Description of Artificial Sequence: Synthetic peptide
DEAEIRTTNPVAYEQYGSVSTPNEQDGNT

SEQ ID NO: 26405 - protein, 30 aa, Artificial Sequence
  Description of Artificial Sequence: Synthetic polypeptide
AEEEIRTTNPVATEQYGSVSTNLVQTTSNV

SEQ ID NO: 26406 - protein, 30 aa, Artificial Sequence
  Description of Artificial Sequence: Synthetic polypeptide
AEEEIRTTNPVATEQYGSVSTNLVQTSSNN

SEQ ID NO: 26407 - protein, 30 aa, Artificial Sequence
  Description of Artificial Sequence: Synthetic polypeptide
DESEICTTNPVATEQYGSVSTNLQDGHNDQ

SEQ ID NO: 26408 - protein, 30 aa, Artificial Sequence
  Description of Artificial Sequence: Synthetic polypeptide
DEAEIRTTNPVAYEQYGSVSTNNDQDGNQR

SEQ ID NO: 26409 - protein, 31 aa, Artificial Sequence
  Description of Artificial Sequence: Synthetic polypeptide
DEAEIRTTNPVAYEQYGSVSTNLQRGDNTDI

SEQ ID NO: 26410 - protein, 31 aa, Artificial Sequence
  Description of Artificial Sequence: Synthetic polypeptide
AEEEIRTTNPVATEQYGSVSTNLQFGGINND

SEQ ID NO: 26411 - protein, 29 aa, Artificial Sequence
  Description of Artificial Sequence: Synthetic peptide
DESEICTTNPVATEQYGSVSTAIQREGNS

SEQ ID NO: 26412 - protein, 31 aa, Artificial Sequence
  Description of Artificial Sequence: Synthetic polypeptide
DEEEICTTNPMATEQYGSVPTNLDQHRGNFR

SEQ ID NO: 26413 - protein, 30 aa, Artificial Sequence
  Description of Artificial Sequence: Synthetic polypeptide
DEAEIRTTNPVAYEQYGSVSTNLQGQGDMR

SEQ ID NO: 26414 - protein, 28 aa, Artificial Sequence
  Description of Artificial Sequence: Synthetic peptide
DESEICTTNPVATEQYGSVSANLGDGND

SEQ ID NO: 26415 - protein, 29 aa, Artificial Sequence
  Description of Artificial Sequence: Synthetic peptide
DESEICTTNPVATEQYGSVSANLDQQGNM

SEQ ID NO: 26416 - protein, 31 aa, Artificial Sequence
  Description of Artificial Sequence: Synthetic polypeptide
AEEEIRTTNPVATEQYGSVSTNLVQQGNGIA

SEQ ID NO: 26417 - protein, 29 aa, Artificial Sequence
  Description of Artificial Sequence: Synthetic peptide
DESEICTTNPVATEQYGSVATNLVRGNDP

SEQ ID NO: 26418 - protein, 30 aa, Artificial Sequence
  Description of Artificial Sequence: Synthetic polypeptide
DEQEIRTTNPVATEQYGCVSTNNQRGVNIL

SEQ ID NO: 26419 - protein, 29 aa, Artificial Sequence
  Description of Artificial Sequence: Synthetic peptide
DESEICTTNPVATEQYGSVATNLTREGND

SEQ ID NO: 26420 - protein, 31 aa, Artificial Sequence
  Description of Artificial Sequence: Synthetic polypeptide
DEEEIRTTNPVATEQYGSVSETNGTQRGGPF

SEQ ID NO: 26421 - protein, 31 aa, Artificial Sequence
  Description of Artificial Sequence: Synthetic polypeptide
AEEEIRTTNPVATEQYGSVSTNLQGGGINTI

SEQ ID NO: 26422 - protein, 30 aa, Artificial Sequence
  Description of Artificial Sequence: Synthetic polypeptide
AEEEIRTTNPVATEQYGSVSTNLVVTGGNV

SEQ ID NO: 26423 - protein, 30 aa, Artificial Sequence
  Description of Artificial Sequence: Synthetic polypeptide
DEEEICTTNPMATEQYGSVFTNLQHRGNQE

SEQ ID NO: 26424 - protein, 29 aa, Artificial Sequence
  Description of Artificial Sequence: Synthetic peptide
DESEICTTNPVATEQYGSVSTPLQGRDNP

SEQ ID NO: 26425 - protein, 28 aa, Artificial Sequence
  Description of Artificial Sequence: Synthetic peptide
DESEICTTNPVATGCYGSVSTNLQRQNM

SEQ ID NO: 26426 - protein, 31 aa, Artificial Sequence
  Description of Artificial Sequence: Synthetic polypeptide
AEEEIRTTNPVATEQYGSVSTNLQEGGTNME

SEQ ID NO: 26427 - protein, 33 aa, Artificial Sequence
  Description of Artificial Sequence: Synthetic polypeptide
DEEEICTTNPVATEQYGSTVSTGNLQRGTNNRM

SEQ ID NO: 26428 - protein, 31 aa, Artificial Sequence
  Description of Artificial Sequence: Synthetic polypeptide
DEEEIRTTNPVATEQYGSVSSTNQVQNLGNT

SEQ ID NO: 26429 - protein, 28 aa, Artificial Sequence
  Description of Artificial Sequence: Synthetic peptide
DESEIRCTNPIATEQYGNVSENLMRGNR

SEQ ID NO: 26430 - protein, 30 aa, Artificial Sequence
  Description of Artificial Sequence: Synthetic polypeptide
DEEEIRTTNPVATEQYGSVSESDDLQRVDR

SEQ ID NO: 26431 - protein, 31 aa, Artificial Sequence
  Description of Artificial Sequence: Synthetic polypeptide
DEEEIRTTNPVATEQYGSVAANDLQRGPNPE

SEQ ID NO: 26432 - protein, 29 aa, Artificial Sequence
  Description of Artificial Sequence: Synthetic peptide
DEAEIRTTNPVAYEQYGSYSTNLERPDNR

SEQ ID NO: 26433 - protein, 28 aa, Artificial Sequence
  Description of Artificial Sequence: Synthetic peptide
DEQEIRTTNPVATEIYGSVSSNDQHGNC

SEQ ID NO: 26434 - protein, 29 aa, Artificial Sequence
  Description of Artificial Sequence: Synthetic peptide
DEEEIRTTNPVAHEQYGSVATNLQHHDSR

SEQ ID NO: 26435 - protein, 31 aa, Artificial Sequence
  Description of Artificial Sequence: Synthetic polypeptide
DEEEIRTTNPVATEQYGSVSETNIQRDGEEH

SEQ ID NO: 26436 - protein, 30 aa, Artificial Sequence
  Description of Artificial Sequence: Synthetic polypeptide
DEEEICTTNPVATEQYGSMSEDLQRSGENR

SEQ ID NO: 26437 - protein, 29 aa, Artificial Sequence
  Description of Artificial Sequence: Synthetic peptide
DEAEIRTTNPVAYEQYGSVVTNLQGGNDE

SEQ ID NO: 26438 - protein, 31 aa, Artificial Sequence
  Description of Artificial Sequence: Synthetic polypeptide
DEAEIRTTNPVAYEQYGSVVSTNLQRGDNDQ

SEQ ID NO: 26439 - protein, 30 aa, Artificial Sequence
  Description of Artificial Sequence: Synthetic polypeptide
DEEEIRTTNPVATEQYGSVAANLQAGETNH

SEQ ID NO: 26440 - protein, 31 aa, Artificial Sequence
  Description of Artificial Sequence: Synthetic polypeptide
AEEEIRTTNPVATEQYGSVSTNLQETGGNVE

SEQ ID NO: 26441 - protein, 30 aa, Artificial Sequence
  Description of Artificial Sequence: Synthetic polypeptide
AEEEIRTTNPVATEQYGSVSTNMGQTGGNN

SEQ ID NO: 26442 - protein, 29 aa, Artificial Sequence
  Description of Artificial Sequence: Synthetic peptide
DEEEIRTTNPVAHEQYGSVATNLQSFDSR

SEQ ID NO: 26443 - protein, 29 aa, Artificial Sequence
  Description of Artificial Sequence: Synthetic peptide
DEEEIRTTNPVAHEQYGSVATNLQVPDSR

SEQ ID NO: 26444 - protein, 30 aa, Artificial Sequence
  Description of Artificial Sequence: Synthetic polypeptide
DEEEIRTTNPVATEQYGSVAANLQERENQG

SEQ ID NO: 26445 - protein, 30 aa, Artificial Sequence
  Description of Artificial Sequence: Synthetic polypeptide
DEEEICTTNPMATEQYGSVATNLQGRGNEA

SEQ ID NO: 26446 - protein, 30 aa, Artificial Sequence
  Description of Artificial Sequence: Synthetic polypeptide
AEEEIRTTNPVATEQYGSVSTNMGQTGNAG

SEQ ID NO: 26447 - protein, 32 aa, Artificial Sequence
  Description of Artificial Sequence: Synthetic polypeptide
DEEEIRTTNPVATEQYGSVSTPNLIQNFGNGN

SEQ ID NO: 26448 - protein, 30 aa, Artificial Sequence
  Description of Artificial Sequence: Synthetic polypeptide
AEEEIRTTNPVATEQYGSVSTNLQANSNFT

SEQ ID NO: 26449 - protein, 30 aa, Artificial Sequence
  Description of Artificial Sequence: Synthetic polypeptide
DESEIRTTNPIATEQYGSVSCNLPQREGNG

SEQ ID NO: 26450 - protein, 30 aa, Artificial Sequence
  Description of Artificial Sequence: Synthetic polypeptide
DEEEICTTNPVATEQYGSVATNLQRVGQDE

SEQ ID NO: 26451 - protein, 32 aa, Artificial Sequence
  Description of Artificial Sequence: Synthetic polypeptide
DEEEIRTTNPVATEQYGSVSETNLIQTNGNGQ

SEQ ID NO: 26452 - protein, 29 aa, Artificial Sequence
  Description of Artificial Sequence: Synthetic peptide
DESEIRTTNPVATDQYGSVNTELQRGNDA

SEQ ID NO: 26453 - protein, 29 aa, Artificial Sequence
  Description of Artificial Sequence: Synthetic peptide
DESEIRTTNPVATDQYGSVNPTQLQRGND

SEQ ID NO: 26454 - protein, 28 aa, Artificial Sequence
  Description of Artificial Sequence: Synthetic peptide
SEEKIRCTNPIATEQYGSVSENLMRGNR

SEQ ID NO: 26455 - protein, 30 aa, Artificial Sequence
  Description of Artificial Sequence: Synthetic polypeptide
DEEEICTTNPCATEQYGSVPTNLQHPGNTR

SEQ ID NO: 26456 - protein, 31 aa, Artificial Sequence
  Description of Artificial Sequence: Synthetic polypeptide
DEEEIRTTNPVATEQYGSVSSTNQNQEIGNE

SEQ ID NO: 26457 - protein, 31 aa, Artificial Sequence
  Description of Artificial Sequence: Synthetic polypeptide
DEEEIRTTNPVATEQYGSVSETNLIGNGNGQ

SEQ ID NO: 26458 - protein, 30 aa, Artificial Sequence
  Description of Artificial Sequence: Synthetic polypeptide
DEEEICTTNPCATEQYGSVTTNLQEVGNGR

SEQ ID NO: 26459 - protein, 28 aa, Artificial Sequence
  Description of Artificial Sequence: Synthetic peptide
DESEIRTTNPVATDQYGAVSTNLEEGNP

SEQ ID NO: 26460 - protein, 29 aa, Artificial Sequence
  Description of Artificial Sequence: Synthetic peptide
DESEIRTTNPVATDHYGSVSTPNLQRTNG

SEQ ID NO: 26461 - protein, 30 aa, Artificial Sequence
  Description of Artificial Sequence: Synthetic polypeptide
AEEEIRTTNPVATEQYGSVSTNLNTSGGNL

SEQ ID NO: 26462 - protein, 29 aa, Artificial Sequence
  Description of Artificial Sequence: Synthetic peptide
DESEIRTTNPVATDHYGSVSTNLQRQNEM

SEQ ID NO: 26463 - protein, 29 aa, Artificial Sequence
  Description of Artificial Sequence: Synthetic peptide
DEEEIRTTNPVATEQYGSVSEQLQSEQRD

SEQ ID NO: 26464 - protein, 30 aa, Artificial Sequence
  Description of Artificial Sequence: Synthetic polypeptide
DEEEICTTNPCATEQYGSVVTNLQLMGNGR

SEQ ID NO: 26465 - protein, 28 aa, Artificial Sequence
  Description of Artificial Sequence: Synthetic peptide
DESEIRTTNPVATDHYGSVSTNLQRDMM

SEQ ID NO: 26466 - protein, 30 aa, Artificial Sequence
  Description of Artificial Sequence: Synthetic polypeptide
DEEEICTTNPCATEQYGSVYTNLQQRGNGG

SEQ ID NO: 26467 - protein, 31 aa, Artificial Sequence
  Description of Artificial Sequence: Synthetic polypeptide
DEEEIRTTNPVATEQYGSVSTPNLFTGVNID

SEQ ID NO: 26468 - protein, 28 aa, Artificial Sequence
  Description of Artificial Sequence: Synthetic peptide
DEQEIATTNPVSSEQYGSVSTNLQSGER

SEQ ID NO: 26469 - protein, 29 aa, Artificial Sequence
  Description of Artificial Sequence: Synthetic peptide
DEEEIRTTNPVATEQYGSVSTPPQQVGDD

SEQ ID NO: 26470 - protein, 31 aa, Artificial Sequence
  Description of Artificial Sequence: Synthetic polypeptide
DEEEICTTNPVATEQYGSVATNLQSDGNNRE

SEQ ID NO: 26471 - protein, 29 aa, Artificial Sequence
  Description of Artificial Sequence: Synthetic peptide
AEEEIRTTNPVATEQYGSVSTNNGDVGNI

SEQ ID NO: 26472 - protein, 30 aa, Artificial Sequence
  Description of Artificial Sequence: Synthetic polypeptide
DEEEICTTNPCATEQYGSVPTNLQERGNTA

SEQ ID NO: 26473 - protein, 29 aa, Artificial Sequence
  Description of Artificial Sequence: Synthetic peptide
DEEEIRTTNPVATEQYGSVSEPLQSENGQ

SEQ ID NO: 26474 - protein, 30 aa, Artificial Sequence
  Description of Artificial Sequence: Synthetic polypeptide
DEEEICTTNPCATEQYGSVATNLQFGGNGR

SEQ ID NO: 26475 - protein, 29 aa, Artificial Sequence
  Description of Artificial Sequence: Synthetic peptide
DESEIRTTNPVATDSYGSVSTNLQRTNLF

SEQ ID NO: 26476 - protein, 28 aa, Artificial Sequence
  Description of Artificial Sequence: Synthetic peptide
DESEIRTTNPVATDSYGSVSTNLQRTGG

SEQ ID NO: 26477 - protein, 31 aa, Artificial Sequence
  Description of Artificial Sequence: Synthetic polypeptide
AEEEIRTTNPVATEQYGSVSTNLNQTQGNIM

SEQ ID NO: 26478 - protein, 32 aa, Artificial Sequence
  Description of Artificial Sequence: Synthetic polypeptide
DEEEIRTTNPVATEQYGSTVVSTGLSQRGGGR

SEQ ID NO: 26479 - protein, 29 aa, Artificial Sequence
  Description of Artificial Sequence: Synthetic peptide
DESEIRTTNPVATDSYGSVSTNLQRAGEM

SEQ ID NO: 26480 - protein, 32 aa, Artificial Sequence
  Description of Artificial Sequence: Synthetic polypeptide
DEEEICTTNPVATEQYGSVCCTNLSQRGTNYR

SEQ ID NO: 26481 - protein, 31 aa, Artificial Sequence
  Description of Artificial Sequence: Synthetic polypeptide
DEEEICTTNPCATEQYGSVPTNELQHRGNNR

SEQ ID NO: 26482 - protein, 31 aa, Artificial Sequence
  Description of Artificial Sequence: Synthetic polypeptide
AEEEIRTTNPVATEQYGSVSTNLQAGENNQD

SEQ ID NO: 26483 - protein, 32 aa, Artificial Sequence
  Description of Artificial Sequence: Synthetic polypeptide
AEEEIRTTNPVATEQYGSVSTTNLQQGNGTNR

SEQ ID NO: 26484 - protein, 29 aa, Artificial Sequence
  Description of Artificial Sequence: Synthetic peptide
DESEIRTTNPVATDSYGSVSTNLQFTGND

SEQ ID NO: 26485 - protein, 29 aa, Artificial Sequence
  Description of Artificial Sequence: Synthetic peptide
AEEEIRTTNPVATEQYGSVSTNNGTEGNE

SEQ ID NO: 26486 - protein, 31 aa, Artificial Sequence
  Description of Artificial Sequence: Synthetic polypeptide
DEEEIRTTNPVATEQYGSVSTPNLFEGGNGM

SEQ ID NO: 26487 - protein, 32 aa, Artificial Sequence
  Description of Artificial Sequence: Synthetic polypeptide
DEEEIRTTNPVATEQYGSVSETNLNQISGNEV

SEQ ID NO: 26488 - protein, 29 aa, Artificial Sequence
  Description of Artificial Sequence: Synthetic peptide
DEQEIATTNPVAYEQYGSVSTNLQHGDAR

SEQ ID NO: 26489 - protein, 31 aa, Artificial Sequence
  Description of Artificial Sequence: Synthetic polypeptide
DEEEIRTTNPVATEQYGSVSLPLQRGQVQRS

SEQ ID NO: 26490 - protein, 32 aa, Artificial Sequence
  Description of Artificial Sequence: Synthetic polypeptide
DEEEIRTTNPVATEQYGSVSTPNLFQGGNGQQ

SEQ ID NO: 26491 - protein, 29 aa, Artificial Sequence
  Description of Artificial Sequence: Synthetic peptide
DESEIRTTNPVATDQYGSVTTQLQRGNTD

SEQ ID NO: 26492 - protein, 29 aa, Artificial Sequence
  Description of Artificial Sequence: Synthetic peptide
DEEEIRTTNPVATEQYGSVSEQLQGEERQ

SEQ ID NO: 26493 - protein, 30 aa, Artificial Sequence
  Description of Artificial Sequence: Synthetic polypeptide
AEEEIRTTNPVATEQYGSVSTNNGTLGENR

SEQ ID NO: 26494 - protein, 29 aa, Artificial Sequence
  Description of Artificial Sequence: Synthetic peptide
DESEIRTTNPVATDHYGSVSTNELQRANM

SEQ ID NO: 26495 - protein, 28 aa, Artificial Sequence
  Description of Artificial Sequence: Synthetic peptide
DESEIRTTNPVATDHYGSVSTGLQRVNM

SEQ ID NO: 26496 - protein, 30 aa, Artificial Sequence
  Description of Artificial Sequence: Synthetic polypeptide
DEEEICTTNPVATEQYGSVATNLQRPGEGN

SEQ ID NO: 26497 - protein, 29 aa, Artificial Sequence
  Description of Artificial Sequence: Synthetic peptide
DEEEICTTNPVATEQYGSVATNLQNGPVS

SEQ ID NO: 26498 - protein, 31 aa, Artificial Sequence
  Description of Artificial Sequence: Synthetic polypeptide
DEEEIRTTNPVATEQYGSVSTPNSNQRMERD

SEQ ID NO: 26499 - protein, 30 aa, Artificial Sequence
  Description of Artificial Sequence: Synthetic polypeptide
DEDEIRTTNPVATEIWGSVSTNLQRGNGDM

SEQ ID NO: 26500 - protein, 31 aa, Artificial Sequence
  Description of Artificial Sequence: Synthetic polypeptide
AEEEIRTTNPVATEQYGSVSTNNEEQGGENR

SEQ ID NO: 26501 - protein, 28 aa, Artificial Sequence
  Description of Artificial Sequence: Synthetic peptide
DESEIRTTNPVATAHYGSVSTGLQRDNM

SEQ ID NO: 26502 - protein, 29 aa, Artificial Sequence
  Description of Artificial Sequence: Synthetic peptide
DEDEIRTTNPVATEIYGCVSTNLGDGNER

SEQ ID NO: 26503 - protein, 30 aa, Artificial Sequence
  Description of Artificial Sequence: Synthetic polypeptide
AEEEIRTTNPVATEQYGSVSTNNDQQQGNV

SEQ ID NO: 26504 - protein, 28 aa, Artificial Sequence
  Description of Artificial Sequence: Synthetic peptide
DEQEICTVNPVATEQYGSVSTNLNEGNH

SEQ ID NO: 26505 - protein, 30 aa, Artificial Sequence
  Description of Artificial Sequence: Synthetic polypeptide
DEEEICTTNPVATEQYGSVATNLQHGNSPE

SEQ ID NO: 26506 - protein, 31 aa, Artificial Sequence
  Description of Artificial Sequence: Synthetic polypeptide
DEEEIRTTNPVATEQYGSVSTPNTQNGENEM

SEQ ID NO: 26507 - protein, 29 aa, Artificial Sequence
  Description of Artificial Sequence: Synthetic peptide
DEQEICTVNPVATEQYGSVSTNLQFEGNS

SEQ ID NO: 26508 - protein, 29 aa, Artificial Sequence
  Description of Artificial Sequence: Synthetic peptide
DEEEICTTNPVATEQYGSVATNLQHDNDN

SEQ ID NO: 26509 - protein, 30 aa, Artificial Sequence
  Description of Artificial Sequence: Synthetic polypeptide
DEEEICTTNPVATEQYGSVATNLQGGNSQD

SEQ ID NO: 26510 - protein, 28 aa, Artificial Sequence
  Description of Artificial Sequence: Synthetic peptide
SEEMIRCTNPIATEQYGSVSENLMRGNR

SEQ ID NO: 26511 - protein, 28 aa, Artificial Sequence
  Description of Artificial Sequence: Synthetic peptide
DEDEIRTTNPVATEIYGSVSNNDQRGTM

SEQ ID NO: 26512 - protein, 29 aa, Artificial Sequence
  Description of Artificial Sequence: Synthetic peptide
DEEEICTTNPVATEQYGSVATNLQGGGDQ

SEQ ID NO: 26513 - protein, 31 aa, Artificial Sequence
  Description of Artificial Sequence: Synthetic polypeptide
DEEEICTTNPEATEQYGSVCPTNLQERGNGR

SEQ ID NO: 26514 - protein, 30 aa, Artificial Sequence
  Description of Artificial Sequence: Synthetic polypeptide
DEEEICTTNPVATEQYGSVATNLQGGDNLD

SEQ ID NO: 26515 - protein, 28 aa, Artificial Sequence
  Description of Artificial Sequence: Synthetic peptide
DEDEIRTTNPVATEIYGSVSNNLQRVTQ

SEQ ID NO: 26516 - protein, 29 aa, Artificial Sequence
  Description of Artificial Sequence: Synthetic peptide
DEEEIRTTNPVATEQYGSVSTPNQREETQ

SEQ ID NO: 26517 - protein, 31 aa, Artificial Sequence
  Description of Artificial Sequence: Synthetic polypeptide
DEEEIRTTNPVATEQYGSVSETNLDYGEDIR

SEQ ID NO: 26518 - protein, 31 aa, Artificial Sequence
  Description of Artificial Sequence: Synthetic polypeptide
DEEEIRTTNPVATEQYGSVSTPTLQRGVPVV

SEQ ID NO: 26519 - protein, 31 aa, Artificial Sequence
  Description of Artificial Sequence: Synthetic polypeptide
DEEEICTTNPVATEQYGSVATNLQNRNNNRQ

SEQ ID NO: 26520 - protein, 31 aa, Artificial Sequence
  Description of Artificial Sequence: Synthetic polypeptide
DEEEIRTTNPVATEQYGSVSTPNLIMGGNQD

SEQ ID NO: 26521 - protein, 30 aa, Artificial Sequence
  Description of Artificial Sequence: Synthetic polypeptide
DEEEICTTNPVATEQYGSVATNLQRNNNDD

SEQ ID NO: 26522 - protein, 28 aa, Artificial Sequence
  Description of Artificial Sequence: Synthetic peptide
DEQEIATTNPVSTEQYGSVSENLQHGGR

SEQ ID NO: 26523 - protein, 30 aa, Artificial Sequence
  Description of Artificial Sequence: Synthetic polypeptide
DEEEICTTNPVATEQYGSVATNLQRNNMFA

SEQ ID NO: 26524 - protein, 28 aa, Artificial Sequence
  Description of Artificial Sequence: Synthetic peptide
DESEIRTTNPVATDHWGSVSTNLQRTNA

SEQ ID NO: 26525 - protein, 30 aa, Artificial Sequence
  Description of Artificial Sequence: Synthetic polypeptide
DEEEICTTNPVATEQYGSVATNLQRNNDQW

SEQ ID NO: 26526 - protein, 28 aa, Artificial Sequence
  Description of Artificial Sequence: Synthetic peptide
DESEIRTTNPVATDAYGSVSTGLQRENG

SEQ ID NO: 26527 - protein, 28 aa, Artificial Sequence
  Description of Artificial Sequence: Synthetic peptide
SEELIRCTNPIATEQYGSVSENLMRGNR

SEQ ID NO: 26528 - protein, 28 aa, Artificial Sequence
  Description of Artificial Sequence: Synthetic peptide
DESEIRTTNPVATCHYGSVSTNLQITNV

SEQ ID NO: 26529 - protein, 30 aa, Artificial Sequence
  Description of Artificial Sequence: Synthetic polypeptide
DEEEICTTNPVATEQYGSVATNLQRNDNSA

SEQ ID NO: 26530 - protein, 29 aa, Artificial Sequence
  Description of Artificial Sequence: Synthetic peptide
DEEEICTTNPVATEQYGSVATNLQPGEMD

SEQ ID NO: 26531 - protein, 29 aa, Artificial Sequence
  Description of Artificial Sequence: Synthetic peptide
DEEEIRTTNPVATEQYGSVATDLIRVEND

SEQ ID NO: 26532 - protein, 31 aa, Artificial Sequence
  Description of Artificial Sequence: Synthetic polypeptide
DEEEICTTNPVATEQYGSVATNLQRENNNRM

SEQ ID NO: 26533 - protein, 28 aa, Artificial Sequence
  Description of Artificial Sequence: Synthetic peptide
CEDEIRTTNPVATEQYGSVDTNLQIGQG

SEQ ID NO: 26534 - protein, 30 aa, Artificial Sequence
  Description of Artificial Sequence: Synthetic polypeptide
DEEEIRTTNPVATEQYGSVSLPLQRGVQSF

SEQ ID NO: 26535 - protein, 29 aa, Artificial Sequence
  Description of Artificial Sequence: Synthetic peptide
DESEIRTTNPVATCHYGSVSTENLQRTNF

SEQ ID NO: 26536 - protein, 31 aa, Artificial Sequence
  Description of Artificial Sequence: Synthetic polypeptide
DEEEIRTTNPVATEQYGSVSTPNLGGGGNTS

SEQ ID NO: 26537 - protein, 32 aa, Artificial Sequence
  Description of Artificial Sequence: Synthetic polypeptide
DEEEIRTTNPVATEQYGSVSTPNLHQRVNNIE

SEQ ID NO: 26538 - protein, 32 aa, Artificial Sequence
  Description of Artificial Sequence: Synthetic polypeptide
DEEEIRTTNPVATEQYGSVSTPNLHTRGSESR

SEQ ID NO: 26539 - protein, 29 aa, Artificial Sequence
  Description of Artificial Sequence: Synthetic peptide
DESEIRTTNPVATCHYGSVQSTNLQRTNQ

SEQ ID NO: 26540 - protein, 31 aa, Artificial Sequence
  Description of Artificial Sequence: Synthetic polypeptide
DEEEIRTTNPVATEQYGSVSTPNLIMGGNID

SEQ ID NO: 26541 - protein, 31 aa, Artificial Sequence
  Description of Artificial Sequence: Synthetic polypeptide
DEEEIRTTNPVATEQYGSVSTPNVQAGGNEE

SEQ ID NO: 26542 - protein, 31 aa, Artificial Sequence
  Description of Artificial Sequence: Synthetic polypeptide
SEEEIRTTNPVATEQYGSVTSTSNLQIGNLL

SEQ ID NO: 26543 - protein, 30 aa, Artificial Sequence
  Description of Artificial Sequence: Synthetic polypeptide
AEEEIRTTNPVATEQYGSVSTNLQQENLGG

SEQ ID NO: 26544 - protein, 31 aa, Artificial Sequence
  Description of Artificial Sequence: Synthetic polypeptide
DEEEIRTTNPVATEQYGSVATNLQPEGEPRT

SEQ ID NO: 26545 - protein, 29 aa, Artificial Sequence
  Description of Artificial Sequence: Synthetic peptide
DEDEIRTTNPVATEQYGCTATNLQRGQNE

SEQ ID NO: 26546 - protein, 32 aa, Artificial Sequence
  Description of Artificial Sequence: Synthetic polypeptide
DEEEIGTTNPVATEQYGSVSTPNQLQPRMGNL

SEQ ID NO: 26547 - protein, 31 aa, Artificial Sequence
  Description of Artificial Sequence: Synthetic polypeptide
DEEEIRTTNPVATEQYGSVSTNNQGSGNEEQ

SEQ ID NO: 26548 - protein, 28 aa, Artificial Sequence
  Description of Artificial Sequence: Synthetic peptide
DEECIRCTNPVATEQYGSVSWGSQRGNQ

SEQ ID NO: 26549 - protein, 28 aa, Artificial Sequence
  Description of Artificial Sequence: Synthetic peptide
DETSIRTTNPTATEQFGSVSFNLQDGNR

SEQ ID NO: 26550 - protein, 29 aa, Artificial Sequence
  Description of Artificial Sequence: Synthetic peptide
DENEIRTTNPVATWPYGSVSTNLQRTVGN

SEQ ID NO: 26551 - protein, 31 aa, Artificial Sequence
  Description of Artificial Sequence: Synthetic polypeptide
DEEEIRTTNPVATEQYGSVSTDLQQGQNIQE

SEQ ID NO: 26552 - protein, 30 aa, Artificial Sequence
  Description of Artificial Sequence: Synthetic polypeptide
AEEEIRTTNPVATEQYGSVSTTLVQSGNND

SEQ ID NO: 26553 - protein, 31 aa, Artificial Sequence
  Description of Artificial Sequence: Synthetic polypeptide
DEEEIRTTNPVATEQYGSVSTNNQITGINEV

SEQ ID NO: 26554 - protein, 28 aa, Artificial Sequence
  Description of Artificial Sequence: Synthetic peptide
DETSIRTTNPLATEQWGSVSVNLQSGNR

SEQ ID NO: 26555 - protein, 30 aa, Artificial Sequence
  Description of Artificial Sequence: Synthetic polypeptide
DEEEIRTTNPVATEQYGSVSTNNQMEGSEE

SEQ ID NO: 26556 - protein, 31 aa, Artificial Sequence
  Description of Artificial Sequence: Synthetic polypeptide
DEEEIGTTNPVATEQYGSVSTNSLFQVRGEI

SEQ ID NO: 26557 - protein, 31 aa, Artificial Sequence
  Description of Artificial Sequence: Synthetic polypeptide
DEEEIGTTNPVATEQYGSVSTNQLTEREGNL

SEQ ID NO: 26558 - protein, 31 aa, Artificial Sequence
  Description of Artificial Sequence: Synthetic polypeptide
DEEEIRTTNPVATEQYGSVSTNNQNFGFNQA

SEQ ID NO: 26559 - protein, 29 aa, Artificial Sequence
  Description of Artificial Sequence: Synthetic peptide
DEECIGTTNPVATEAYGSVNTNALQRGNM

SEQ ID NO: 26560 - protein, 30 aa, Artificial Sequence
  Description of Artificial Sequence: Synthetic polypeptide
SEEEIRTTNPVATEQYGSVNSTNDQMGENQ

SEQ ID NO: 26561 - protein, 31 aa, Artificial Sequence
  Description of Artificial Sequence: Synthetic polypeptide
DEEEIRTTNPVATEQYGSVSTNNQGFEGNEV

SEQ ID NO: 26562 - protein, 31 aa, Artificial Sequence
  Description of Artificial Sequence: Synthetic polypeptide
DEEEIRTTNPVATEQYGSVSTNNQGEGGNEG

SEQ ID NO: 26563 - protein, 32 aa, Artificial Sequence
  Description of Artificial Sequence: Synthetic polypeptide
DEEEIRTTNPVATEQYGSVSTQNLTQEDIGNF

SEQ ID NO: 26564 - protein, 30 aa, Artificial Sequence
  Description of Artificial Sequence: Synthetic polypeptide
SEEEIRTTNPVATEQWGSVSQNLQQGNDRS

SEQ ID NO: 26565 - protein, 31 aa, Artificial Sequence
  Description of Artificial Sequence: Synthetic polypeptide
DEEEIRTTNPVATEQYGSVSTNNPQRLNEDQ

SEQ ID NO: 26566 - protein, 31 aa, Artificial Sequence
  Description of Artificial Sequence: Synthetic polypeptide
DEEEIGTTNPVATEQYGSVSWNDLQERMGNQ

SEQ ID NO: 26567 - protein, 32 aa, Artificial Sequence
  Description of Artificial Sequence: Synthetic polypeptide
DEEEIRTTNPVATEQYGCVCSTNELQFGSNRI

SEQ ID NO: 26568 - protein, 31 aa, Artificial Sequence
  Description of Artificial Sequence: Synthetic polypeptide
DEEEIGTTNPVATEQYGSVSTVQLQEREGNL

SEQ ID NO: 26569 - protein, 29 aa, Artificial Sequence
  Description of Artificial Sequence: Synthetic peptide
DETTIRTTNPVATEQYGCVETNDDQRGNR

SEQ ID NO: 26570 - protein, 30 aa, Artificial Sequence
  Description of Artificial Sequence: Synthetic polypeptide
AEEEIRTTNPVATEQYGSVSTENNQLGNAS

SEQ ID NO: 26571 - protein, 32 aa, Artificial Sequence
  Description of Artificial Sequence: Synthetic polypeptide
DEEEIGTTNPVATEQYGSVSTVNGLQERMGNL

SEQ ID NO: 26572 - protein, 30 aa, Artificial Sequence
  Description of Artificial Sequence: Synthetic polypeptide
DEDEIRTTNPCATEQYGSVSTNLQHDGGMR

SEQ ID NO: 26573 - protein, 31 aa, Artificial Sequence
  Description of Artificial Sequence: Synthetic polypeptide
DEEEIMTTNPVATEQYGSVSTNSLFQDRGEF

SEQ ID NO: 26574 - protein, 31 aa, Artificial Sequence
  Description of Artificial Sequence: Synthetic polypeptide
DEEEIRTTNPVATEQYGSVSLTNLQIDGIID

SEQ ID NO: 26575 - protein, 28 aa, Artificial Sequence
  Description of Artificial Sequence: Synthetic peptide
DENEIRTTNPVATWHYGSVSTNLERTNQ

SEQ ID NO: 26576 - protein, 31 aa, Artificial Sequence
  Description of Artificial Sequence: Synthetic polypeptide
DEEEIRTTNPVATEQYGSVSTNNQGDGFNQQ

SEQ ID NO: 26577 - protein, 30 aa, Artificial Sequence
  Description of Artificial Sequence: Synthetic polypeptide
SEEEIRTTNPVATEQWGSVATNLQRGDNEQ

SEQ ID NO: 26578 - protein, 31 aa, Artificial Sequence
  Description of Artificial Sequence: Synthetic polypeptide
DEEEIGTTNPVATEQYGSVSTNQLQETMGNT

SEQ ID NO: 26579 - protein, 29 aa, Artificial Sequence
  Description of Artificial Sequence: Synthetic peptide
DEEEIRTTNPVASEQYGSVSCPALNSGNR

SEQ ID NO: 26580 - protein, 31 aa, Artificial Sequence
  Description of Artificial Sequence: Synthetic polypeptide
DEEEIGTTNPVATEQYGSVSTNQLQEDMGNS

SEQ ID NO: 26581 - protein, 30 aa, Artificial Sequence
  Description of Artificial Sequence: Synthetic polypeptide
DEEEIRTTNPVATEQYGSVSFTDLEREVRG

SEQ ID NO: 26582 - protein, 29 aa, Artificial Sequence
  Description of Artificial Sequence: Synthetic peptide
DEECIRCTNPVATEQYGSVSVNFQREGNL

SEQ ID NO: 26583 - protein, 30 aa, Artificial Sequence
  Description of Artificial Sequence: Synthetic polypeptide
DEEEIRTTNPVATEQYGSIVSTLDDQRGEQ

SEQ ID NO: 26584 - protein, 31 aa, Artificial Sequence
  Description of Artificial Sequence: Synthetic polypeptide
DEEEIRTTNPVATEQYGCVCSTNGLQFTSNR

SEQ ID NO: 26585 - protein, 30 aa, Artificial Sequence
  Description of Artificial Sequence: Synthetic polypeptide
AEEEIRTTNPVATEQYGSVSTTLQQNQGNG

SEQ ID NO: 26586 - protein, 30 aa, Artificial Sequence
  Description of Artificial Sequence: Synthetic polypeptide
DENEIRTTNPVATEQYGSVSTNGQDNGERA

SEQ ID NO: 26587 - protein, 31 aa, Artificial Sequence
  Description of Artificial Sequence: Synthetic polypeptide
DEEEIRTTNPVATEQYGSVSTNMQSQSVTNR

SEQ ID NO: 26588 - protein, 32 aa, Artificial Sequence
  Description of Artificial Sequence: Synthetic polypeptide
DEEEIRTTNPVATEQYGSVSTNMQSQSGGNTR

SEQ ID NO: 26589 - protein, 29 aa, Artificial Sequence
  Description of Artificial Sequence: Synthetic peptide
DENEIRTTNPVATEQYGSVSTNDTRGEDQ

SEQ ID NO: 26590 - protein, 28 aa, Artificial Sequence
  Description of Artificial Sequence: Synthetic peptide
DEVEIATVNPVATEQYGSVSTNLFEGNE

SEQ ID NO: 26591 - protein, 32 aa, Artificial Sequence
  Description of Artificial Sequence: Synthetic polypeptide
DEEEIRTTNPVATEQYGSVSTQNLQSNGENNP

SEQ ID NO: 26592 - protein, 31 aa, Artificial Sequence
  Description of Artificial Sequence: Synthetic polypeptide
DEEEIGTTNPVATEQYGSVSTNLQRSGSEVP

SEQ ID NO: 26593 - protein, 29 aa, Artificial Sequence
  Description of Artificial Sequence: Synthetic peptide
DEECIRCTNPVATEQYGSVSNNFQREGNL

SEQ ID NO: 26594 - protein, 28 aa, Artificial Sequence
  Description of Artificial Sequence: Synthetic peptide
DENEIRTTNPVAVEQYGSTSTNLEQQNR

SEQ ID NO: 26595 - protein, 30 aa, Artificial Sequence
  Description of Artificial Sequence: Synthetic polypeptide
AEEEIRTTNPVATEQYGSVSTTLQQISGNN

SEQ ID NO: 26596 - protein, 28 aa, Artificial Sequence
  Description of Artificial Sequence: Synthetic peptide
AENEIRCTNPVATEQYGEASENLQRGNR

SEQ ID NO: 26597 - protein, 32 aa, Artificial Sequence
  Description of Artificial Sequence: Synthetic polypeptide
DEEEIGTTNPVATEQYGSVSTNMLQERMGNLG

SEQ ID NO: 26598 - protein, 32 aa, Artificial Sequence
  Description of Artificial Sequence: Synthetic polypeptide
DEEEIGTTNPVATEQYGSVSYTNELQERTGNL

SEQ ID NO: 26599 - protein, 31 aa, Artificial Sequence
  Description of Artificial Sequence: Synthetic polypeptide
DEEEIGTTNPVATEQYGSVSTNNLDERMGNL

SEQ ID NO: 26600 - protein, 28 aa, Artificial Sequence
  Description of Artificial Sequence: Synthetic peptide
AEEEIRTTNPVATEQYGSVSTTLSTTNE

SEQ ID NO: 26601 - protein, 30 aa, Artificial Sequence
  Description of Artificial Sequence: Synthetic polypeptide
SEEEIRTTNPVATEQWGSVATNLDRGNDRD

SEQ ID NO: 26602 - protein, 31 aa, Artificial Sequence
  Description of Artificial Sequence: Synthetic polypeptide
DEEEIRTTNPVATEQYGSVSTNNQQFGNNED

SEQ ID NO: 26603 - protein, 28 aa, Artificial Sequence
  Description of Artificial Sequence: Synthetic peptide
DENEIRTTNPVAVEQYGSISTNLERPNH

SEQ ID NO: 26604 - protein, 32 aa, Artificial Sequence
  Description of Artificial Sequence: Synthetic polypeptide
DEEEIRTTNPVATEQYGSVSTQNLQTEGGNTG

SEQ ID NO: 26605 - protein, 31 aa, Artificial Sequence
  Description of Artificial Sequence: Synthetic polypeptide
DEEEIGTTNPVATEQYGSVSTNQGQEREGNS

SEQ ID NO: 26606 - protein, 29 aa, Artificial Sequence
  Description of Artificial Sequence: Synthetic peptide
DEECIRCTNPVATEQYGSVSVWNQQRGNL

SEQ ID NO: 26607 - protein, 31 aa, Artificial Sequence
  Description of Artificial Sequence: Synthetic polypeptide
DEEEIRTTNPVATEQYGSVSTNNQQVDGFNQ

SEQ ID NO: 26608 - protein, 32 aa, Artificial Sequence
  Description of Artificial Sequence: Synthetic polypeptide
DEEEIRTTNPVATEQYGSIVSTNLQRFGSVQM

SEQ ID NO: 26609 - protein, 28 aa, Artificial Sequence
  Description of Artificial Sequence: Synthetic peptide
DEEEIRTTNPTATELYGSVATNHGRGNA

SEQ ID NO: 26610 - protein, 31 aa, Artificial Sequence
  Description of Artificial Sequence: Synthetic polypeptide
DEEEIRTTNPVATEQYGSIVSTNHQNGSNVD

SEQ ID NO: 26611 - protein, 30 aa, Artificial Sequence
  Description of Artificial Sequence: Synthetic polypeptide
SEEEIRTTNPVATEPYGSVSTNLQIGGNSE

SEQ ID NO: 26612 - protein, 31 aa, Artificial Sequence
  Description of Artificial Sequence: Synthetic polypeptide
DEEEIGTTNPVATEQYGSVSTNPPQERMGNL

SEQ ID NO: 26613 - protein, 32 aa, Artificial Sequence
  Description of Artificial Sequence: Synthetic polypeptide
DEEEIGTTNPVATEQYGSVSTNNPLQNFGSNR

SEQ ID NO: 26614 - protein, 28 aa, Artificial Sequence
  Description of Artificial Sequence: Synthetic peptide
DETSIRTTNPLATEQFGSVSLNLQTGNR

SEQ ID NO: 26615 - protein, 32 aa, Artificial Sequence
  Description of Artificial Sequence: Synthetic polypeptide
DEEEIRTTNPVATEQYGSVSTDGNLQRGSQQA

SEQ ID NO: 26616 - protein, 31 aa, Artificial Sequence
  Description of Artificial Sequence: Synthetic polypeptide
DEEEIGTTNPVATEQYGSVSTNNLQEGMGNL

SEQ ID NO: 26617 - protein, 28 aa, Artificial Sequence
  Description of Artificial Sequence: Synthetic peptide
DEVEIATVNPVATEQYGSVSTNLVDGNH

SEQ ID NO: 26618 - protein, 28 aa, Artificial Sequence
  Description of Artificial Sequence: Synthetic peptide
DENEIRTTNPVATNQYGSVNTQLQSGND

SEQ ID NO: 26619 - protein, 28 aa, Artificial Sequence
  Description of Artificial Sequence: Synthetic peptide
DETVIRTTNPCATEQWGSVSVNLQPGNR

SEQ ID NO: 26620 - protein, 31 aa, Artificial Sequence
  Description of Artificial Sequence: Synthetic polypeptide
DEEEIRTTNPVATEQYGSVCATNLERDINER

SEQ ID NO: 26621 - protein, 32 aa, Artificial Sequence
  Description of Artificial Sequence: Synthetic polypeptide
DEEEIRTTNPVATEQYGSVSTNNLQTVEGGNG

SEQ ID NO: 26622 - protein, 30 aa, Artificial Sequence
  Description of Artificial Sequence: Synthetic polypeptide
DEDEIRTTNPCATEQYGSVSTNLNQDGGNA

SEQ ID NO: 26623 - protein, 30 aa, Artificial Sequence
  Description of Artificial Sequence: Synthetic polypeptide
DEDEIRTTNPCATEQYGSVSTNLNQDGSNE

SEQ ID NO: 26624 - protein, 32 aa, Artificial Sequence
  Description of Artificial Sequence: Synthetic polypeptide
DEEEIRTTNPVATEQYGSVSTNNLQTVEGNTN

SEQ ID NO: 26625 - protein, 28 aa, Artificial Sequence
  Description of Artificial Sequence: Synthetic peptide
DEVEIATTNPVATDQYGTVSTALQGGNR

SEQ ID NO: 26626 - protein, 31 aa, Artificial Sequence
  Description of Artificial Sequence: Synthetic polypeptide
DEEEIRTTNPVATEQYGSVSTDLQNVVGNTP

SEQ ID NO: 26627 - protein, 32 aa, Artificial Sequence
  Description of Artificial Sequence: Synthetic polypeptide
DEEEIRTTNPVATEQYGSVSTNNLQVGNENEG

SEQ ID NO: 26628 - protein, 29 aa, Artificial Sequence
  Description of Artificial Sequence: Synthetic peptide
DEVEIATTNPVATDQYGMVSTALQRGNNR

SEQ ID NO: 26629 - protein, 28 aa, Artificial Sequence
  Description of Artificial Sequence: Synthetic peptide
DEVEIATTNPVATDQYGIVSTDLQRGND

SEQ ID NO: 26630 - protein, 30 aa, Artificial Sequence
  Description of Artificial Sequence: Synthetic polypeptide
DEEEIMTTNPVATEPYGSVCFTNLTRSGNR

SEQ ID NO: 26631 - protein, 28 aa, Artificial Sequence
  Description of Artificial Sequence: Synthetic peptide
AEEEIRTTNPVATEQYGSVSTMQQQGTT

SEQ ID NO: 26632 - protein, 30 aa, Artificial Sequence
  Description of Artificial Sequence: Synthetic polypeptide
DEEEIMTTNPVATEQYGSVSCTNGGQRGDF

SEQ ID NO: 26633 - protein, 31 aa, Artificial Sequence
  Description of Artificial Sequence: Synthetic polypeptide
DEEEIRTTNPVATEQYGSVSTNNLTGGGGNE

SEQ ID NO: 26634 - protein, 28 aa, Artificial Sequence
  Description of Artificial Sequence: Synthetic peptide
DEVEIATTNPVATDQYGNVSTQLQRGNT

SEQ ID NO: 26635 - protein, 28 aa, Artificial Sequence
  Description of Artificial Sequence: Synthetic peptide
DEVEIATTNPVATDQYGVVSTELQRGNQ

SEQ ID NO: 26636 - protein, 30 aa, Artificial Sequence
  Description of Artificial Sequence: Synthetic polypeptide
DEEEIATTNPVAYEQYGSVSTELQGGEGNR

SEQ ID NO: 26637 - protein, 28 aa, Artificial Sequence
  Description of Artificial Sequence: Synthetic peptide
DENEIRTTNPVATEQYGVVSTTLQIPND

SEQ ID NO: 26638 - protein, 33 aa, Artificial Sequence
  Description of Artificial Sequence: Synthetic polypeptide
DEEEIRTTNPVATEQYGSVATNPLDQMRPGPNR

SEQ ID NO: 26639 - protein, 30 aa, Artificial Sequence
  Description of Artificial Sequence: Synthetic polypeptide
SEEEIRTTNPVATEQYGSVCSTVLERNNDR

SEQ ID NO: 26640 - protein, 31 aa, Artificial Sequence
  Description of Artificial Sequence: Synthetic polypeptide
DEDEIRTTNPVATEQYGCVSTNLQREGNDQP

SEQ ID NO: 26641 - protein, 30 aa, Artificial Sequence
  Description of Artificial Sequence: Synthetic polypeptide
DEEEIRTTNPVATEQYGSVATNNQGSGNAE

SEQ ID NO: 26642 - protein, 31 aa, Artificial Sequence
  Description of Artificial Sequence: Synthetic polypeptide
DEEEIRTTNPVATEQYGSVSTQNVGQVGNSN

SEQ ID NO: 26643 - protein, 31 aa, Artificial Sequence
  Description of Artificial Sequence: Synthetic polypeptide
DEEEIRTTNPVATEQYGSVSENGPMMRNGNR

SEQ ID NO: 26644 - protein, 29 aa, Artificial Sequence
  Description of Artificial Sequence: Synthetic peptide
AEEEIRTTNPVATEQYGSVSTMQGQNGNQ

SEQ ID NO: 26645 - protein, 28 aa, Artificial Sequence
  Description of Artificial Sequence: Synthetic peptide
AEEEIRTTNPVATEQYGSVSTMQQIGIG

SEQ ID NO: 26646 - protein, 32 aa, Artificial Sequence
  Description of Artificial Sequence: Synthetic polypeptide
DEEEIRTTNPVATEQYGSVSTNNLQSGNGNVT

SEQ ID NO: 26647 - protein, 30 aa, Artificial Sequence
  Description of Artificial Sequence: Synthetic polypeptide
DEVEIATTNPVATEAYGSVSTNLQRGENDS

SEQ ID NO: 26648 - protein, 32 aa, Artificial Sequence
  Description of Artificial Sequence: Synthetic polypeptide
DEEEIRTTNPVATEQYGSVSTNNLQSIGQGNT

SEQ ID NO: 26649 - protein, 28 aa, Artificial Sequence
  Description of Artificial Sequence: Synthetic peptide
DEEEIRTTNPTATDQYGQVPTDLQRGNP

SEQ ID NO: 26650 - protein, 32 aa, Artificial Sequence
  Description of Artificial Sequence: Synthetic polypeptide
DEEEIRTTNPVATEQYGSVSTNNLQSMGNGNP

SEQ ID NO: 26651 - protein, 29 aa, Artificial Sequence
  Description of Artificial Sequence: Synthetic peptide
DEECIRCTNPVATEQYGSVSWNDQRGNQV

SEQ ID NO: 26652 - protein, 28 aa, Artificial Sequence
  Description of Artificial Sequence: Synthetic peptide
DENEIRTTNPVATEQYGVVSTPLQRPTD

SEQ ID NO: 26653 - protein, 32 aa, Artificial Sequence
  Description of Artificial Sequence: Synthetic polypeptide
DEEEIRTTNPVATEQYGSVSTNNLTQSGGENP

SEQ ID NO: 26654 - protein, 31 aa, Artificial Sequence
  Description of Artificial Sequence: Synthetic polypeptide
DEEEIRTTNPVATEQYGSVSTDLQPQGENIM

SEQ ID NO: 26655 - protein, 31 aa, Artificial Sequence
  Description of Artificial Sequence: Synthetic polypeptide
SEEEIRTTNPVATEQYGSVETTNNLNQSGNR

SEQ ID NO: 26656 - protein, 28 aa, Artificial Sequence
  Description of Artificial Sequence: Synthetic peptide
DEVEIATTNPVATDQYGDVSTALQEGNR

SEQ ID NO: 26657 - protein, 31 aa, Artificial Sequence
  Description of Artificial Sequence: Synthetic polypeptide
AEEEIRTTNPVATEQYGSVSTTNLNQGGNAS

SEQ ID NO: 26658 - protein, 31 aa, Artificial Sequence
  Description of Artificial Sequence: Synthetic polypeptide
DEEEIMTTNPVATEQYGSVSTNLLQQVRGEF

SEQ ID NO: 26659 - protein, 29 aa, Artificial Sequence
  Description of Artificial Sequence: Synthetic peptide
SEEEIRTTNPVATEQYGSVGTGALQNGFR

SEQ ID NO: 26660 - protein, 30 aa, Artificial Sequence
  Description of Artificial Sequence: Synthetic polypeptide
AEEEIRTTNPVATEQYGSVSTENNQNEGNS

SEQ ID NO: 26661 - protein, 29 aa, Artificial Sequence
  Description of Artificial Sequence: Synthetic peptide
DEEEIGTTNPVATEQYGVVSTEPQRGSER

SEQ ID NO: 26662 - protein, 30 aa, Artificial Sequence
  Description of Artificial Sequence: Synthetic polypeptide
DEEEIRTTNPVATEQYGSVSTNNNTTTGNS

SEQ ID NO: 26663 - protein, 28 aa, Artificial Sequence
  Description of Artificial Sequence: Synthetic peptide
DEEEIRTTNPTATECYGSCSTNLDHGNA

SEQ ID NO: 26664 - protein, 29 aa, Artificial Sequence
  Description of Artificial Sequence: Synthetic peptide
DEVAIRTTNPVATEQYGSFSTGNLEIGNR

SEQ ID NO: 26665 - protein, 28 aa, Artificial Sequence
  Description of Artificial Sequence: Synthetic peptide
SENEIRCTNPIATEQYGSVSENLMRGNR

SEQ ID NO: 26666 - protein, 31 aa, Artificial Sequence
  Description of Artificial Sequence: Synthetic polypeptide
DEEEIRTTNPVATEQYGSVSTNNPEQNNGNL

SEQ ID NO: 26667 - protein, 31 aa, Artificial Sequence
  Description of Artificial Sequence: Synthetic polypeptide
DEEEIRTTNPVATEQYGSVSLTNLQLGELLS

SEQ ID NO: 26668 - protein, 29 aa, Artificial Sequence
  Description of Artificial Sequence: Synthetic peptide
DENEIRTTNPVATKHYGSVSTDNLQRTNE

SEQ ID NO: 26669 - protein, 29 aa, Artificial Sequence
  Description of Artificial Sequence: Synthetic peptide
DETVIRTTNPVATEQYGNVEETNGQRGNR

SEQ ID NO: 26670 - protein, 28 aa, Artificial Sequence
  Description of Artificial Sequence: Synthetic peptide
DETVIRTTNPVATEQYGCVETNDQRGNE

SEQ ID NO: 26671 - protein, 30 aa, Artificial Sequence
  Description of Artificial Sequence: Synthetic polypeptide
AEEEIRTTNPVATEQYGSVSTTNAQTGNDN

SEQ ID NO: 26672 - protein, 28 aa, Artificial Sequence
  Description of Artificial Sequence: Synthetic peptide
DEVEIATTNPVATAQYGCVSTALQRGNL

SEQ ID NO: 26673 - protein, 30 aa, Artificial Sequence
  Description of Artificial Sequence: Synthetic polypeptide
DEEEIRTTNPVATEQYGSVCATNLERGPDD

SEQ ID NO: 26674 - protein, 31 aa, Artificial Sequence
  Description of Artificial Sequence: Synthetic polypeptide
DEDEIRTTNPCATEQYGSVSTNLQGDGNPRD

SEQ ID NO: 26675 - protein, 28 aa, Artificial Sequence
  Description of Artificial Sequence: Synthetic peptide
DEECIRCTNPVATEQYGSVSWNDNRGNL

SEQ ID NO: 26676 - protein, 31 aa, Artificial Sequence
  Description of Artificial Sequence: Synthetic polypeptide
DEEEIRTTNPVATEQYGSVSTNNLTVRGVQN

SEQ ID NO: 26677 - protein, 28 aa, Artificial Sequence
  Description of Artificial Sequence: Synthetic peptide
DEVEIATTNPVATDQYGAVSTLLQRGNA

SEQ ID NO: 26678 - protein, 31 aa, Artificial Sequence
  Description of Artificial Sequence: Synthetic polypeptide
DEEEIRTTNPVATEQYGSVATNNLDTRGNED

SEQ ID NO: 26679 - protein, 28 aa, Artificial Sequence
  Description of Artificial Sequence: Synthetic peptide
DEVEIATTNPVATDAYGCVSTALQRGNR

SEQ ID NO: 26680 - protein, 29 aa, Artificial Sequence
  Description of Artificial Sequence: Synthetic peptide
DEVEIATTNPVATCQYGVVSTALQRGNRN

SEQ ID NO: 26681 - protein, 30 aa, Artificial Sequence
  Description of Artificial Sequence: Synthetic polypeptide
DEEEIRTTNPVATEQYGSVSFSDLQRDGDS

SEQ ID NO: 26682 - protein, 28 aa, Artificial Sequence
  Description of Artificial Sequence: Synthetic peptide
DEEEIRTTNPTATECYGSCSTNDMRGNA

SEQ ID NO: 26683 - protein, 31 aa, Artificial Sequence
  Description of Artificial Sequence: Synthetic polypeptide
DEEEIRTTNPVATEQYGSVSTQNPGQINGND

SEQ ID NO: 26684 - protein, 30 aa, Artificial Sequence
  Description of Artificial Sequence: Synthetic polypeptide
AEEEIRTTNPVATEQYGSVSTENNQQAGNL

SEQ ID NO: 26685 - protein, 29 aa, Artificial Sequence
  Description of Artificial Sequence: Synthetic peptide
SEEEIRTTNPVATEQYGSVGTALQENGDR

SEQ ID NO: 26686 - protein, 31 aa, Artificial Sequence
  Description of Artificial Sequence: Synthetic polypeptide
DEEEIRTTNPVATEQYGSVSSTNGVQTGGND

SEQ ID NO: 26687 - protein, 28 aa, Artificial Sequence
  Description of Artificial Sequence: Synthetic peptide
DENEIRTTNPVATESYGSVSNNLQQGTT

SEQ ID NO: 26688 - protein, 31 aa, Artificial Sequence
  Description of Artificial Sequence: Synthetic polypeptide
DEEEIRTTNPVATEQYGSVSFENLQRNEERD

SEQ ID NO: 26689 - protein, 29 aa, Artificial Sequence
  Description of Artificial Sequence: Synthetic peptide
AEEEIRTTNPVATEQYGSVSTMVGQIGNE

SEQ ID NO: 26690 - protein, 31 aa, Artificial Sequence
  Description of Artificial Sequence: Synthetic polypeptide
DEEEIRTTNPVATEQYGSVSTQNMQEDGNFT

SEQ ID NO: 26691 - protein, 31 aa, Artificial Sequence
  Description of Artificial Sequence: Synthetic polypeptide
DEEEIRTTNPVATEQYGSQVCSTNLQNNSER

SEQ ID NO: 26692 - protein, 32 aa, Artificial Sequence
  Description of Artificial Sequence: Synthetic polypeptide
DENEIRTTNPVATEQYGVVDSTPNLQRGSNRI

SEQ ID NO: 26693 - protein, 32 aa, Artificial Sequence
  Description of Artificial Sequence: Synthetic polypeptide
DEEEIRTTNPVATEQYGSVSTQNLQSEMGNQT

SEQ ID NO: 26694 - protein, 31 aa, Artificial Sequence
  Description of Artificial Sequence: Synthetic polypeptide
SEEEIRTTNPVATEQYGSVNTTNDQRGNERN

SEQ ID NO: 26695 - protein, 29 aa, Artificial Sequence
  Description of Artificial Sequence: Synthetic peptide
DEVEIRTTNPVATDQYGSVNTQNDQRGND

SEQ ID NO: 26696 - protein, 28 aa, Artificial Sequence
  Description of Artificial Sequence: Synthetic peptide
DEEEIRTTNPTATEQYGSVPTDLARGAE

SEQ ID NO: 26697 - protein, 30 aa, Artificial Sequence
  Description of Artificial Sequence: Synthetic polypeptide
AEEEIRTTNPVATEQYGSVSTNDDQEGNGG

SEQ ID NO: 26698 - protein, 28 aa, Artificial Sequence
  Description of Artificial Sequence: Synthetic peptide
AENEIRTTNPVATECYGSVSENEQRGGR

SEQ ID NO: 26699 - protein, 30 aa, Artificial Sequence
  Description of Artificial Sequence: Synthetic polypeptide
DEVEIRTTNPVATEAYGSVSTNLQEGDGNG

SEQ ID NO: 26700 - protein, 31 aa, Artificial Sequence
  Description of Artificial Sequence: Synthetic polypeptide
DEEEIRTTNPVATEQYGSVATNLTRPGENPT

SEQ ID NO: 26701 - protein, 28 aa, Artificial Sequence
  Description of Artificial Sequence: Synthetic peptide
DEVEIRTTNPVATDQYGSVNTQLERGND

SEQ ID NO: 26702 - protein, 32 aa, Artificial Sequence
  Description of Artificial Sequence: Synthetic polypeptide
AEEEIRTTNPVATEQYGSVSTTNLQEQGGNNR

SEQ ID NO: 26703 - protein, 31 aa, Artificial Sequence
  Description of Artificial Sequence: Synthetic polypeptide
AEEEIRTTNPVATEQYGSVSTTNLQEQGNSA

SEQ ID NO: 26704 - protein, 31 aa, Artificial Sequence
  Description of Artificial Sequence: Synthetic polypeptide
DEEEIRTTNPVATEQYGSVSTNPEQGITGNL

SEQ ID NO: 26705 - protein, 30 aa, Artificial Sequence
  Description of Artificial Sequence: Synthetic polypeptide
DEEEIATTNPVAYEQYGSVSTNPQQEGNDR

SEQ ID NO: 26706 - protein, 30 aa, Artificial Sequence
  Description of Artificial Sequence: Synthetic polypeptide
AEEEIRTTNPVATEQYGSVSTTNLQEQGTD

SEQ ID NO: 26707 - protein, 30 aa, Artificial Sequence
  Description of Artificial Sequence: Synthetic polypeptide
CEEEIRTTNPVATEQYGSVVTSTNQTGANR

SEQ ID NO: 26708 - protein, 28 aa, Artificial Sequence
  Description of Artificial Sequence: Synthetic peptide
DETEISTTNPVATAQYGCVSTNLERGNP

SEQ ID NO: 26709 - protein, 29 aa, Artificial Sequence
  Description of Artificial Sequence: Synthetic peptide
AEEEIRTTNPVATEQYGSVSTNDELGNQG

SEQ ID NO: 26710 - protein, 31 aa, Artificial Sequence
  Description of Artificial Sequence: Synthetic polypeptide
DEEEIRTTNPVATEQYGSVSTDLQRTDDIRI

SEQ ID NO: 26711 - protein, 29 aa, Artificial Sequence
  Description of Artificial Sequence: Synthetic peptide
SEEEIRTTNPVATEQYGSVSEAGPMRGNR

SEQ ID NO: 26712 - protein, 32 aa, Artificial Sequence
  Description of Artificial Sequence: Synthetic polypeptide
DEEEIRTTNPVATEQYGSVSTQNLQEDGENQI

SEQ ID NO: 26713 - protein, 31 aa, Artificial Sequence
  Description of Artificial Sequence: Synthetic polypeptide
DEEEIGTTNPVATEQYGSVSTNDLQEYMGNA

SEQ ID NO: 26714 - protein, 29 aa, Artificial Sequence
  Description of Artificial Sequence: Synthetic peptide
DEVEIKTVNPVATEQYGSVSTNLQFEGNT

SEQ ID NO: 26715 - protein, 32 aa, Artificial Sequence
  Description of Artificial Sequence: Synthetic polypeptide
DEEEIRTTNPVATEQYGSVSTQNLQEMGNQQD

SEQ ID NO: 26716 - protein, 31 aa, Artificial Sequence
  Description of Artificial Sequence: Synthetic polypeptide
DEEEIRTTNPVATEQYGSVSTDLQRNNNEGG

SEQ ID NO: 26717 - protein, 31 aa, Artificial Sequence
  Description of Artificial Sequence: Synthetic polypeptide
DEEEIRTTNPVATEQYGCVCSTNNLQYGSDR

SEQ ID NO: 26718 - protein, 30 aa, Artificial Sequence
  Description of Artificial Sequence: Synthetic polypeptide
DEEEIATTNPVAYEQYGSVSTNLQRPGETL

SEQ ID NO: 26719 - protein, 30 aa, Artificial Sequence
  Description of Artificial Sequence: Synthetic polypeptide
DEVEIRATNPVATEQYGSVSMNLQERGNDC

SEQ ID NO: 26720 - protein, 29 aa, Artificial Sequence
  Description of Artificial Sequence: Synthetic peptide
SEEEIRTTNPVATEPYGSVATNLQQGDRN

SEQ ID NO: 26721 - protein, 31 aa, Artificial Sequence
  Description of Artificial Sequence: Synthetic polypeptide
DEEEIRTTNPVATEQYGSISTSNLIRDVNRE

SEQ ID NO: 26722 - protein, 32 aa, Artificial Sequence
  Description of Artificial Sequence: Synthetic polypeptide
DEEEIRTTNPVATEQYGCVCSTNNLQSFGSNR

SEQ ID NO: 26723 - protein, 30 aa, Artificial Sequence
  Description of Artificial Sequence: Synthetic polypeptide
DEEEIATTNPVAYEQYGSVSTNNDQMGNQR

SEQ ID NO: 26724 - protein, 32 aa, Artificial Sequence
  Description of Artificial Sequence: Synthetic polypeptide
DEEEIRTTNPVATEQYGSVSTQNLQEGGNEQI

SEQ ID NO: 26725 - protein, 32 aa, Artificial Sequence
  Description of Artificial Sequence: Synthetic polypeptide
DEEEIRTTNPVATEQYGSVSTNNVQQGEGNER

SEQ ID NO: 26726 - protein, 32 aa, Artificial Sequence
  Description of Artificial Sequence: Synthetic polypeptide
DETEISTTNPVATEQYGSVSTENLQRFGSNRG

SEQ ID NO: 26727 - protein, 31 aa, Artificial Sequence
  Description of Artificial Sequence: Synthetic polypeptide
AEEEIRTTNPVATEQYGSVSTTLNQQQGNER

SEQ ID NO: 26728 - protein, 30 aa, Artificial Sequence
  Description of Artificial Sequence: Synthetic polypeptide
DEDEIRTTNPVATEQYGAVSTNLQGDTGNH

SEQ ID NO: 26729 - protein, 32 aa, Artificial Sequence
  Description of Artificial Sequence: Synthetic polypeptide
DEEEIRTTNPVATEQYGSVSTNMQIEEVGNER

SEQ ID NO: 26730 - protein, 30 aa, Artificial Sequence
  Description of Artificial Sequence: Synthetic polypeptide
DEEEIRTTNPVATEQYGSISTPNINRGLTR

SEQ ID NO: 26731 - protein, 30 aa, Artificial Sequence
  Description of Artificial Sequence: Synthetic polypeptide
DEVEIRTTNPVATECYGSVSTNLQDGGNAE

SEQ ID NO: 26732 - protein, 31 aa, Artificial Sequence
  Description of Artificial Sequence: Synthetic polypeptide
DEEEIRTTNPVATEQYGSVSTNMQGTGNGGN

SEQ ID NO: 26733 - protein, 30 aa, Artificial Sequence
  Description of Artificial Sequence: Synthetic polypeptide
DEVEIRTTNPVATECYGSVSTNLQGGMGNS

SEQ ID NO: 26734 - protein, 32 aa, Artificial Sequence
  Description of Artificial Sequence: Synthetic polypeptide
DEEEIRTTNPVATEQYGCVCSTNDLQYGSNRY

SEQ ID NO: 26735 - protein, 30 aa, Artificial Sequence
  Description of Artificial Sequence: Synthetic polypeptide
DEVEIRTTNPVATECYGSVSTNLQGQGNSD

SEQ ID NO: 26736 - protein, 31 aa, Artificial Sequence
  Description of Artificial Sequence: Synthetic polypeptide
DEEEIRTTNPVATEQYGSVATNLTQDGNEDD

SEQ ID NO: 26737 - protein, 32 aa, Artificial Sequence
  Description of Artificial Sequence: Synthetic polypeptide
DEEEIGTTNPVATEQYGSVSTDNNLQERFGNL

SEQ ID NO: 26738 - protein, 30 aa, Artificial Sequence
  Description of Artificial Sequence: Synthetic polypeptide
DEEEIRTTNPVATEQYGSVSTDDQLGEDAR

SEQ ID NO: 26739 - protein, 30 aa, Artificial Sequence
  Description of Artificial Sequence: Synthetic polypeptide
DEVEIRTTNPVATECYGSVSTNLQIGGGNM

SEQ ID NO: 26740 - protein, 31 aa, Artificial Sequence
  Description of Artificial Sequence: Synthetic polypeptide
DEVEIRTTNPVATEEYGSVSTNLQRGGNGDA

SEQ ID NO: 26741 - protein, 31 aa, Artificial Sequence
  Description of Artificial Sequence: Synthetic polypeptide
DEEEIRTTNPVATEQYGSQVSTNLQNFQSNA

SEQ ID NO: 26742 - protein, 30 aa, Artificial Sequence
  Description of Artificial Sequence: Synthetic polypeptide
AEEEIRTTNPVATEQYGSVSTTLNQIQENR

SEQ ID NO: 26743 - protein, 30 aa, Artificial Sequence
  Description of Artificial Sequence: Synthetic polypeptide
DEVEIRTTNPVATEHYGSVSTNLQEGGNHG

SEQ ID NO: 26744 - protein, 30 aa, Artificial Sequence
  Description of Artificial Sequence: Synthetic polypeptide
DEVEIRTTNPVATEHYGSVSTNLQFGNGDM

SEQ ID NO: 26745 - protein, 30 aa, Artificial Sequence
  Description of Artificial Sequence: Synthetic polypeptide
AEEEIRTTNPVATEQYGSVSTTLNNDEGNR

SEQ ID NO: 26746 - protein, 30 aa, Artificial Sequence
  Description of Artificial Sequence: Synthetic polypeptide
CEEEIRTTNPVATEQYGCVSTNLQRNSNII

SEQ ID NO: 26747 - protein, 32 aa, Artificial Sequence
  Description of Artificial Sequence: Synthetic polypeptide
DEEEIRTTNPVATEQYGSVATNLTRDGDNTRD

SEQ ID NO: 26748 - protein, 29 aa, Artificial Sequence
  Description of Artificial Sequence: Synthetic peptide
DEEEIATTNPVAYEQYGSVSTNLQNGGPG

SEQ ID NO: 26749 - protein, 29 aa, Artificial Sequence
  Description of Artificial Sequence: Synthetic peptide
SEEEIRTTNPVATEQYGSVSENGNMRGNV

SEQ ID NO: 26750 - protein, 31 aa, Artificial Sequence
  Description of Artificial Sequence: Synthetic polypeptide
DEEEIRTTNPVATEQYGSVSTNPLQNTGSQN

SEQ ID NO: 26751 - protein, 30 aa, Artificial Sequence
  Description of Artificial Sequence: Synthetic polypeptide
DEVEIRTTNPVATECYGSVSTNLQGDGNGE

SEQ ID NO: 26752 - protein, 29 aa, Artificial Sequence
  Description of Artificial Sequence: Synthetic peptide
SEEEIRTTNPVATEQYGSVSEDLMDHGNR

SEQ ID NO: 26753 - protein, 30 aa, Artificial Sequence
  Description of Artificial Sequence: Synthetic polypeptide
DEEEIATTNPVAYEQYGSVSTNPQQMEGNR

SEQ ID NO: 26754 - protein, 30 aa, Artificial Sequence
  Description of Artificial Sequence: Synthetic polypeptide
DEEEIRTTNPVATEQYGSVSTSMNQRGEDV

SEQ ID NO: 26755 - protein, 30 aa, Artificial Sequence
  Description of Artificial Sequence: Synthetic polypeptide
DEVEIRTTNPVATECYGSVSTNLQGEQNDR

SEQ ID NO: 26756 - protein, 32 aa, Artificial Sequence
  Description of Artificial Sequence: Synthetic polypeptide
DEEEIRTTNPVATEQYGSVSTQNLQAGEGNEE

SEQ ID NO: 26757 - protein, 31 aa, Artificial Sequence
  Description of Artificial Sequence: Synthetic polypeptide
DEEEIRTTNPVATEQYGSVSTNPHQERIMIR

SEQ ID NO: 26758 - protein, 29 aa, Artificial Sequence
  Description of Artificial Sequence: Synthetic peptide
DENEIRTTNPVCTEHYGSVSNPNLQRGNL

SEQ ID NO: 26759 - protein, 28 aa, Artificial Sequence
  Description of Artificial Sequence: Synthetic peptide
SEEEIRTTNPVATEQYGSVSEILMAGDR

SEQ ID NO: 26760 - protein, 30 aa, Artificial Sequence
  Description of Artificial Sequence: Synthetic polypeptide
DEEEIRTTNPVATEQYGSVATNLTRPGEEA

SEQ ID NO: 26761 - protein, 30 aa, Artificial Sequence
  Description of Artificial Sequence: Synthetic polypeptide
SEEEIRTTNPVATEQYGSVSEILMNRAGNR

SEQ ID NO: 26762 - protein, 32 aa, Artificial Sequence
  Description of Artificial Sequence: Synthetic polypeptide
DEEEIRTTNPVATEQYGSVSTNPLPRGENETL

SEQ ID NO: 26763 - protein, 29 aa, Artificial Sequence
  Description of Artificial Sequence: Synthetic peptide
SEEEIRTTNPVATEQYGSVSENGMRGMNV

SEQ ID NO: 26764 - protein, 32 aa, Artificial Sequence
  Description of Artificial Sequence: Synthetic polypeptide
DEEEIRTTNPVATEQYGSVSEVNVLGQRGENE

SEQ ID NO: 26765 - protein, 31 aa, Artificial Sequence
  Description of Artificial Sequence: Synthetic polypeptide
DEEEIGTTNPVATEQYGSVSTDQLQERMGNE

SEQ ID NO: 26766 - protein, 31 aa, Artificial Sequence
  Description of Artificial Sequence: Synthetic polypeptide
CEEEIRTTNPVATEQYGCVTSTNLQRNSNRN

SEQ ID NO: 26767 - protein, 29 aa, Artificial Sequence
  Description of Artificial Sequence: Synthetic peptide
DEECIRCTNPVATEQYGSVSLNFQREGNL

SEQ ID NO: 26768 - protein, 31 aa, Artificial Sequence
  Description of Artificial Sequence: Synthetic polypeptide
DEEEIATTNPVAYEQYGSVSTNLQNGGEDNR

SEQ ID NO: 26769 - protein, 30 aa, Artificial Sequence
  Description of Artificial Sequence: Synthetic polypeptide
AEEEIRTTNPVATEQYGSVSTTLPQVGNLL

SEQ ID NO: 26770 - protein, 31 aa, Artificial Sequence
  Description of Artificial Sequence: Synthetic polypeptide
AEEEIRTTNPVATEQYGSVSTTNLQAGENNP

SEQ ID NO: 26771 - protein, 31 aa, Artificial Sequence
  Description of Artificial Sequence: Synthetic polypeptide
DEEEIRTTNPVATEQYGSIVSNTNVQYGSND

SEQ ID NO: 26772 - protein, 30 aa, Artificial Sequence
  Description of Artificial Sequence: Synthetic polypeptide
AEEEIRTTNPVATEQYGSVSTENNQEQGNS

SEQ ID NO: 26773 - protein, 31 aa, Artificial Sequence
  Description of Artificial Sequence: Synthetic polypeptide
DEEEIRTTNPVATEQYGSVSSTNLDTGVNED

SEQ ID NO: 26774 - protein, 30 aa, Artificial Sequence
  Description of Artificial Sequence: Synthetic polypeptide
DEEEIRTTNPVATEQYGSVSTNNQRSEDQY

SEQ ID NO: 26775 - protein, 31 aa, Artificial Sequence
  Description of Artificial Sequence: Synthetic polypeptide
DENEIRTTNPVAVEQYGSVISTNLQERGNNV

SEQ ID NO: 26776 - protein, 30 aa, Artificial Sequence
  Description of Artificial Sequence: Synthetic polypeptide
DEEEIGTTNPVATEQYGSVSTNLQHNSNVS

SEQ ID NO: 26777 - protein, 30 aa, Artificial Sequence
  Description of Artificial Sequence: Synthetic polypeptide
AEEEIRTTNPVATEQYGSVSTTNLQDENTE

SEQ ID NO: 26778 - protein, 31 aa, Artificial Sequence
  Description of Artificial Sequence: Synthetic polypeptide
DENEIRTTNPVAVEQYGSVISTNLQERNNTR

SEQ ID NO: 26779 - protein, 30 aa, Artificial Sequence
  Description of Artificial Sequence: Synthetic polypeptide
AEEEIRTTNPVATEQYGSVSTTNLQDENVQ

SEQ ID NO: 26780 - protein, 28 aa, Artificial Sequence
  Description of Artificial Sequence: Synthetic peptide
DEEEIATTNPVAYEQYGSVSTNDQAGDV

SEQ ID NO: 26781 - protein, 30 aa, Artificial Sequence
  Description of Artificial Sequence: Synthetic polypeptide
DENEIRTTNPVATEQYGSVSTNDNSSGENR

SEQ ID NO: 26782 - protein, 32 aa, Artificial Sequence
  Description of Artificial Sequence: Synthetic polypeptide
DEEEIRTTNPVATEQYGSVSTNNQTRGVNEDN

SEQ ID NO: 26783 - protein, 32 aa, Artificial Sequence
  Description of Artificial Sequence: Synthetic polypeptide
DEEEIRTTNPVATEQYGSIVFSTGPLFTRGNR

SEQ ID NO: 26784 - protein, 30 aa, Artificial Sequence
  Description of Artificial Sequence: Synthetic polypeptide
SEEEIRTTNPVATEQYGSVSATQLQMIGNQ

SEQ ID NO: 26785 - protein, 31 aa, Artificial Sequence
  Description of Artificial Sequence: Synthetic polypeptide
AEEEIRTTNPVATEQYGSVSTTNLPQTQGNN

SEQ ID NO: 26786 - protein, 28 aa, Artificial Sequence
  Description of Artificial Sequence: Synthetic peptide
AENEIRCTNPVATEQYGEVSENLQRGGR

SEQ ID NO: 26787 - protein, 33 aa, Artificial Sequence
  Description of Artificial Sequence: Synthetic polypeptide
DEEEIRTTNPVATEQYGSVSLTNLQGREGNTLG

SEQ ID NO: 26788 - protein, 30 aa, Artificial Sequence
  Description of Artificial Sequence: Synthetic polypeptide
AEEEIRTTNPVATEQYGSVSTTLQNGGNNN

SEQ ID NO: 26789 - protein, 30 aa, Artificial Sequence
  Description of Artificial Sequence: Synthetic polypeptide
AEEEIRTTNPVATEQYGSVSTENNQFGNSV

SEQ ID NO: 26790 - protein, 28 aa, Artificial Sequence
  Description of Artificial Sequence: Synthetic peptide
DEVEICTTNPVATDQYGNVSTALQRGNN

SEQ ID NO: 26791 - protein, 28 aa, Artificial Sequence
  Description of Artificial Sequence: Synthetic peptide
DETSIRTTNPIATEQFGSVSNNLQAGNR

SEQ ID NO: 26792 - protein, 29 aa, Artificial Sequence
  Description of Artificial Sequence: Synthetic peptide
DEVEICTTNPVATDQYGTVSTALQRGNIR

SEQ ID NO: 26793 - protein, 31 aa, Artificial Sequence
  Description of Artificial Sequence: Synthetic polypeptide
SEEEIRTTNPVATEPYGSVSSTNLQQDNGNR

SEQ ID NO: 26794 - protein, 28 aa, Artificial Sequence
  Description of Artificial Sequence: Synthetic peptide
DEVEICTTNPVATDQYGVVSTALQRTNR

SEQ ID NO: 26795 - protein, 28 aa, Artificial Sequence
  Description of Artificial Sequence: Synthetic peptide
DETSIRTTNPEATEQFGSVSCNLQGGNR

SEQ ID NO: 26796 - protein, 32 aa, Artificial Sequence
  Description of Artificial Sequence: Synthetic polypeptide
DEEEIRTTNPVATEQYGSVSTQNLQSDGNGDP

SEQ ID NO: 26797 - protein, 32 aa, Artificial Sequence
  Description of Artificial Sequence: Synthetic polypeptide
SEEEIRTTNPVATEQYGSVPTSNLEQRGENYR

SEQ ID NO: 26798 - protein, 29 aa, Artificial Sequence
  Description of Artificial Sequence: Synthetic peptide
DEVEICTTNPVATDQYGVVSTANLQRGND

SEQ ID NO: 26799 - protein, 28 aa, Artificial Sequence
  Description of Artificial Sequence: Synthetic peptide
DEEEIRTTNPVATEQYGSVSTDDYGGGD

SEQ ID NO: 26800 - protein, 29 aa, Artificial Sequence
  Description of Artificial Sequence: Synthetic peptide
SEEEIRTTNPVATEQYGSVSANLQNDNHE

SEQ ID NO: 26801 - protein, 28 aa, Artificial Sequence
  Description of Artificial Sequence: Synthetic peptide
DEECIRCTNPVATEQYGSVSINFGRGNL

SEQ ID NO: 26802 - protein, 28 aa, Artificial Sequence
  Description of Artificial Sequence: Synthetic peptide
SENEIRCTNPIATECYGSVSENLQRGNR

SEQ ID NO: 26803 - protein, 32 aa, Artificial Sequence
  Description of Artificial Sequence: Synthetic polypeptide
DEEEIRTTNPVATEQYGSVSTQNLQNEMGNNP

SEQ ID NO: 26804 - protein, 30 aa, Artificial Sequence
  Description of Artificial Sequence: Synthetic polypeptide
SEEEIRTTNPVATEQYGSVSAWNLDENGNR

SEQ ID NO: 26805 - protein, 28 aa, Artificial Sequence
  Description of Artificial Sequence: Synthetic peptide
DETSIRTTNPCATEQWGSVSCNLQTGNR

SEQ ID NO: 26806 - protein, 30 aa, Artificial Sequence
  Description of Artificial Sequence: Synthetic polypeptide
DEEEIRTTNPVATEQYGSVCATNLGMGEDR

SEQ ID NO: 26807 - protein, 31 aa, Artificial Sequence
  Description of Artificial Sequence: Synthetic polypeptide
DEEEIRTTNPVATEQYGSVCATNLQHVENRD

SEQ ID NO: 26808 - protein, 28 aa, Artificial Sequence
  Description of Artificial Sequence: Synthetic peptide
DEVEIGTTNPVATDQYGDVSTGLQRGNI

SEQ ID NO: 26809 - protein, 31 aa, Artificial Sequence
  Description of Artificial Sequence: Synthetic polypeptide
AEEEIRTTNPVATEQYGSVSTTNLQEDGNEE

SEQ ID NO: 26810 - protein, 32 aa, Artificial Sequence
  Description of Artificial Sequence: Synthetic polypeptide
DEEEIGTTNPVATEQYGSVSTNLLAQERMGNL

SEQ ID NO: 26811 - protein, 30 aa, Artificial Sequence
  Description of Artificial Sequence: Synthetic polypeptide
AEEEIRTTNPVATEQYGSVSTTNLQEDTND

SEQ ID NO: 26812 - protein, 29 aa, Artificial Sequence
  Description of Artificial Sequence: Synthetic peptide
DEEEIGTTNPVATEQYGSVSTNLILGSDD

SEQ ID NO: 26813 - protein, 32 aa, Artificial Sequence
  Description of Artificial Sequence: Synthetic polypeptide
DEEEIRTTNPVATEQYGSVSEYNLNQRGEDER

SEQ ID NO: 26814 - protein, 30 aa, Artificial Sequence
  Description of Artificial Sequence: Synthetic polypeptide
DEEEIRTTNPVATEQYGSISTTLGRGNQDD

SEQ ID NO: 26815 - protein, 30 aa, Artificial Sequence
  Description of Artificial Sequence: Synthetic polypeptide
DEEEIATTNPVAYEQYGSVSTNLQGGDNPE

SEQ ID NO: 26816 - protein, 32 aa, Artificial Sequence
  Description of Artificial Sequence: Synthetic polypeptide
DEEEIGTTNPVATEQYGSVSTNELSQERPGNE

SEQ ID NO: 26817 - protein, 30 aa, Artificial Sequence
  Description of Artificial Sequence: Synthetic polypeptide
AEEEIRTTNPVATEQYGSVSTTLQLIGNSE

SEQ ID NO: 26818 - protein, 30 aa, Artificial Sequence
  Description of Artificial Sequence: Synthetic polypeptide
AEEEIRTTNPVATEQYGSVSTNAQGTVGNV

SEQ ID NO: 26819 - protein, 30 aa, Artificial Sequence
  Description of Artificial Sequence: Synthetic polypeptide
AEEEIRTTNPVATEQYGSVSTTLQIGGNPT

SEQ ID NO: 26820 - protein, 30 aa, Artificial Sequence
  Description of Artificial Sequence: Synthetic polypeptide
DEEEIATTNPVAYEQYGSVSTNLQHNGDMR

SEQ ID NO: 26821 - protein, 30 aa, Artificial Sequence
  Description of Artificial Sequence: Synthetic polypeptide
AEEEIRTTNPVATEQYGSVSTTLQGGVNTI

SEQ ID NO: 26822 - protein, 30 aa, Artificial Sequence
  Description of Artificial Sequence: Synthetic polypeptide
SEEEIRTTNPVATEQYGSVSDQNLDEFGNR

SEQ ID NO: 26823 - protein, 32 aa, Artificial Sequence
  Description of Artificial Sequence: Synthetic polypeptide
DEEEIGTTNPVATEQYGSVSTNELQERMGNLD

SEQ ID NO: 26824 - protein, 31 aa, Artificial Sequence
  Description of Artificial Sequence: Synthetic polypeptide
AEEEIRTTNPVATEQYGSVSTTNLQDNGNGD

SEQ ID NO: 26825 - protein, 31 aa, Artificial Sequence
  Description of Artificial Sequence: Synthetic polypeptide
AEEEIRTTNPVATEQYGSVSTTNLQDGTNVG

SEQ ID NO: 26826 - protein, 28 aa, Artificial Sequence
  Description of Artificial Sequence: Synthetic peptide
SENEIACTNPVATEQYGSVSENLQRGGR

SEQ ID NO: 26827 - protein, 31 aa, Artificial Sequence
  Description of Artificial Sequence: Synthetic polypeptide
AEEEIRTTNPVATEQYGSVSTTNLQDGNIEQ

SEQ ID NO: 26828 - protein, 29 aa, Artificial Sequence
  Description of Artificial Sequence: Synthetic peptide
DEECIRCTNPVATEQYGSVSENFQRGNNL

SEQ ID NO: 26829 - protein, 32 aa, Artificial Sequence
  Description of Artificial Sequence: Synthetic polypeptide
DEEEIRTTNPVATEQYGSVSTDLQRMMEFNRL

SEQ ID NO: 26830 - protein, 28 aa, Artificial Sequence
  Description of Artificial Sequence: Synthetic peptide
SENEIACTNPVATEQYGSVSENLMRGNR

SEQ ID NO: 26831 - protein, 32 aa, Artificial Sequence
  Description of Artificial Sequence: Synthetic polypeptide
DEEEIRTTNPVATEQYGSVSTQNLQMEGGNNP

SEQ ID NO: 26832 - protein, 31 aa, Artificial Sequence
  Description of Artificial Sequence: Synthetic polypeptide
DEEEIRTTNPVATCQYGSVCSTNLQNFGNQA

SEQ ID NO: 26833 - protein, 32 aa, Artificial Sequence
  Description of Artificial Sequence: Synthetic polypeptide
DEEEIRTTNPVATEQYGSVSSTNLERGNQIEA

SEQ ID NO: 26834 - protein, 30 aa, Artificial Sequence
  Description of Artificial Sequence: Synthetic polypeptide
DEDEIRTTNPVATEQYGAVSTNLQIDGNAQ

SEQ ID NO: 26835 - protein, 29 aa, Artificial Sequence
  Description of Artificial Sequence: Synthetic peptide
AEEEIRTTNPVATEQYGSVSTILQTGTED

SEQ ID NO: 26836 - protein, 32 aa, Artificial Sequence
  Description of Artificial Sequence: Synthetic polypeptide
SEEEIRTTNPVATEQYGSVSCTNLSQHGGNTR

SEQ ID NO: 26837 - protein, 29 aa, Artificial Sequence
  Description of Artificial Sequence: Synthetic peptide
DENEIRTTNPVAVEQYGSVTSTNLIGTNR

SEQ ID NO: 26838 - protein, 31 aa, Artificial Sequence
  Description of Artificial Sequence: Synthetic polypeptide
SEEEIRTTNPVATEPYGSVPSCTNLHRGDNR

SEQ ID NO: 26839 - protein, 30 aa, Artificial Sequence
  Description of Artificial Sequence: Synthetic polypeptide
DEEEIRTTNPVATEQYGSVSTDDSQYRSER

SEQ ID NO: 26840 - protein, 33 aa, Artificial Sequence
  Description of Artificial Sequence: Synthetic polypeptide
DEEEIRTTNPVATEQYGSISYTENELSQRTGNR

SEQ ID NO: 26841 - protein, 28 aa, Artificial Sequence
  Description of Artificial Sequence: Synthetic peptide
AENEIRCTNPVATEQYGSVSENLMRGGR

SEQ ID NO: 26842 - protein, 28 aa, Artificial Sequence
  Description of Artificial Sequence: Synthetic peptide
DEEEIRTTNPTATEQYGSVPTGLARGAE

SEQ ID NO: 26843 - protein, 30 aa, Artificial Sequence
  Description of Artificial Sequence: Synthetic polypeptide
DEEEIRTTNPVATEQYGSIVSVDNLDRGEI

SEQ ID NO: 26844 - protein, 30 aa, Artificial Sequence
  Description of Artificial Sequence: Synthetic polypeptide
DEEEIRTTNPVATEQYGCVCSTNPQNGSNQ

SEQ ID NO: 26845 - protein, 31 aa, Artificial Sequence
  Description of Artificial Sequence: Synthetic polypeptide
AEEEIRTTNPVATEQYGSVSTTNLLQNGNQQ

SEQ ID NO: 26846 - protein, 30 aa, Artificial Sequence
  Description of Artificial Sequence: Synthetic polypeptide
DEEEIRTTNPVATEQYGSVSTNNLNQMVDE

SEQ ID NO: 26847 - protein, 30 aa, Artificial Sequence
  Description of Artificial Sequence: Synthetic polypeptide
DEEEIRTTNPVATEQYGSVSTNNLNQMVEP

SEQ ID NO: 26848 - protein, 32 aa, Artificial Sequence
  Description of Artificial Sequence: Synthetic polypeptide
DEEEIKTTNPVATEQYGSVSTNELSQERTGNL

SEQ ID NO: 26849 - protein, 31 aa, Artificial Sequence
  Description of Artificial Sequence: Synthetic polypeptide
DEEEIRTTNPVATEQYGSVSTSDLQRNSNEE

SEQ ID NO: 26850 - protein, 30 aa, Artificial Sequence
  Description of Artificial Sequence: Synthetic polypeptide
CEEEIRTTNPVATEQYGSVSTLNLQENVNS

SEQ ID NO: 26851 - protein, 32 aa, Artificial Sequence
  Description of Artificial Sequence: Synthetic polypeptide
CEEEIRTTNPVATEQYGSVNTSNLNQRGENGR

SEQ ID NO: 26852 - protein, 31 aa, Artificial Sequence
  Description of Artificial Sequence: Synthetic polypeptide
AEEEIRTTNPVATEQYGSVSTTNLEENGTNR

SEQ ID NO: 26853 - protein, 32 aa, Artificial Sequence
  Description of Artificial Sequence: Synthetic polypeptide
CEEEIRTTNPVATEQYGSVNTPNLDQRGENYR

SEQ ID NO: 26854 - protein, 30 aa, Artificial Sequence
  Description of Artificial Sequence: Synthetic polypeptide
DEEEIRTTNPVATEQYGSVSTDLQFEDNVY

SEQ ID NO: 26855 - protein, 29 aa, Artificial Sequence
  Description of Artificial Sequence: Synthetic peptide
DEEEIRTTNPVATEQYGSVSFNDQRNEGQ

SEQ ID NO: 26856 - protein, 30 aa, Artificial Sequence
  Description of Artificial Sequence: Synthetic polypeptide
DEVEIATTNPVATEQYGSVSTNLQGGDNPV

SEQ ID NO: 26857 - protein, 30 aa, Artificial Sequence
  Description of Artificial Sequence: Synthetic polypeptide
DEVEIATTNPVATEQYGSVSTNLQGEDNDR

SEQ ID NO: 26858 - protein, 31 aa, Artificial Sequence
  Description of Artificial Sequence: Synthetic polypeptide
DEVEIATTNPVATEQYGSVSTNLQGDGPNDR

SEQ ID NO: 26859 - protein, 31 aa, Artificial Sequence
  Description of Artificial Sequence: Synthetic polypeptide
DEEEIRTTNPVATEQYGSVSTDLGRLGDNSG

SEQ ID NO: 26860 - protein, 30 aa, Artificial Sequence
  Description of Artificial Sequence: Synthetic polypeptide
DEEEIRTTNPVATEQYGSVSTDLQEGGDFQ

SEQ ID NO: 26861 - protein, 30 aa, Artificial Sequence
  Description of Artificial Sequence: Synthetic polypeptide
SEEEIRTTNPVATEQYGCVCSTNLQFGERD

SEQ ID NO: 26862 - protein, 28 aa, Artificial Sequence
  Description of Artificial Sequence: Synthetic peptide
DEEEIRTTNPNATEEYGSVMTNHERGNA

SEQ ID NO: 26863 - protein, 30 aa, Artificial Sequence
  Description of Artificial Sequence: Synthetic polypeptide
AEEEIRTTNPVATEQYGSVSTGNQQDGGNN

SEQ ID NO: 26864 - protein, 31 aa, Artificial Sequence
  Description of Artificial Sequence: Synthetic polypeptide
AEEEIRTTNPVATEQYGSVSTTNLEQNGENI

SEQ ID NO: 26865 - protein, 31 aa, Artificial Sequence
  Description of Artificial Sequence: Synthetic polypeptide
AEEEIRTTNPVATEQYGSVSTTNLEQIVGNQ

SEQ ID NO: 26866 - protein, 28 aa, Artificial Sequence
  Description of Artificial Sequence: Synthetic peptide
DEDEIRTTNPVATEQYGCVATHLQRDND

SEQ ID NO: 26867 - protein, 33 aa, Artificial Sequence
  Description of Artificial Sequence: Synthetic polypeptide
CEEEIRTTNPVATEQYGSVSTGNLNQRFGENNR

SEQ ID NO: 26868 - protein, 31 aa, Artificial Sequence
  Description of Artificial Sequence: Synthetic polypeptide
DEEEIRTTNPVATEQYGSVSTNNLIGFGNGP

SEQ ID NO: 26869 - protein, 30 aa, Artificial Sequence
  Description of Artificial Sequence: Synthetic polypeptide
CEEEIRTTNPVATEQYGSVPTELQHGSNRG

SEQ ID NO: 26870 - protein, 29 aa, Artificial Sequence
  Description of Artificial Sequence: Synthetic peptide
DEVEIATTNPVATGQYGEVSTALQRGNDR

SEQ ID NO: 26871 - protein, 31 aa, Artificial Sequence
  Description of Artificial Sequence: Synthetic polypeptide
AEEEIRTTNPVATEQYGSVSTTNLEQGNTNR

SEQ ID NO: 26872 - protein, 28 aa, Artificial Sequence
  Description of Artificial Sequence: Synthetic peptide
DEVEIATTNPVATHQYGCVSTALQFGNR

SEQ ID NO: 26873 - protein, 30 aa, Artificial Sequence
  Description of Artificial Sequence: Synthetic polypeptide
AEEEIRTTNPVATEQYGSVSTLNDQGVGNE

SEQ ID NO: 26874 - protein, 31 aa, Artificial Sequence
  Description of Artificial Sequence: Synthetic polypeptide
DEEEIRTTNPVATEQYGSVCATNLEDGENRD

SEQ ID NO: 26875 - protein, 31 aa, Artificial Sequence
  Description of Artificial Sequence: Synthetic polypeptide
AEEEIRTTNPVATEQYGSVSTTNLLQDGNGS

SEQ ID NO: 26876 - protein, 29 aa, Artificial Sequence
  Description of Artificial Sequence: Synthetic peptide
DEEEIRTTNPVATEQYGSVAWNLQNLSND

SEQ ID NO: 26877 - protein, 31 aa, Artificial Sequence
  Description of Artificial Sequence: Synthetic polypeptide
DEEEIRTTNPVATEQYGSVAVTNLQREPENI

SEQ ID NO: 26878 - protein, 29 aa, Artificial Sequence
  Description of Artificial Sequence: Synthetic peptide
DEEEIRTTNPVATEQYGSVSTDLERIMFQ

SEQ ID NO: 26879 - protein, 28 aa, Artificial Sequence
  Description of Artificial Sequence: Synthetic peptide
DEEEIRTTNPNATEEYGSVATNIMRGNA

SEQ ID NO: 26880 - protein, 29 aa, Artificial Sequence
  Description of Artificial Sequence: Synthetic peptide
DENEIRTTNPVATEQYGSVSTNLQNFIEQ

SEQ ID NO: 26881 - protein, 31 aa, Artificial Sequence
  Description of Artificial Sequence: Synthetic polypeptide
DEEEIRTTNPVATEQYGSVSTSDLQPEGENV

SEQ ID NO: 26882 - protein, 29 aa, Artificial Sequence
  Description of Artificial Sequence: Synthetic peptide
DEVEIATTNPVATSQYGAVSTMALQRGNR

SEQ ID NO: 26883 - protein, 28 aa, Artificial Sequence
  Description of Artificial Sequence: Synthetic peptide
SEEEIRTTNPVATEQYGSLSTHLQRQEF

SEQ ID NO: 26884 - protein, 28 aa, Artificial Sequence
  Description of Artificial Sequence: Synthetic peptide
DEVEIATTNPVATSQYGCVSTALQDGNR

SEQ ID NO: 26885 - protein, 31 aa, Artificial Sequence
  Description of Artificial Sequence: Synthetic polypeptide
DEEEIATTNPVAYEQYGSVCTNLSQRPGTNR

SEQ ID NO: 26886 - protein, 33 aa, Artificial Sequence
  Description of Artificial Sequence: Synthetic polypeptide
DEEEIRTTNPVATEQYGSVSTNNLQENGSNTRM

SEQ ID NO: 26887 - protein, 33 aa, Artificial Sequence
  Description of Artificial Sequence: Synthetic polypeptide
SEEEIRTTNPVATEQYGSTVPSCTGNLQRGGNR

SEQ ID NO: 26888 - protein, 28 aa, Artificial Sequence
  Description of Artificial Sequence: Synthetic peptide
SENEIRCTNPVATEQYGEVSENLQRGGR

SEQ ID NO: 26889 - protein, 31 aa, Artificial Sequence
  Description of Artificial Sequence: Synthetic polypeptide
DEEEIRTTNPVATEQYGSVATTDQPRGNDRE

SEQ ID NO: 26890 - protein, 31 aa, Artificial Sequence
  Description of Artificial Sequence: Synthetic polypeptide
DEEEIRTTNPVATEQYGSVSTNNLQNEGEET

SEQ ID NO: 26891 - protein, 31 aa, Artificial Sequence
  Description of Artificial Sequence: Synthetic polypeptide
DEEEIRTTNPVATEQYGSVSTNNLQNFGEDE

SEQ ID NO: 26892 - protein, 31 aa, Artificial Sequence
  Description of Artificial Sequence: Synthetic polypeptide
DEEEIRTTNPVATEQYGSVSTSDDQRGNNQG

SEQ ID NO: 26893 - protein, 29 aa, Artificial Sequence
  Description of Artificial Sequence: Synthetic peptide
DEVEIATTNPVATTQYGDVSTGLQRGDNR

SEQ ID NO: 26894 - protein, 31 aa, Artificial Sequence
  Description of Artificial Sequence: Synthetic polypeptide
DEEEIRTTNPVATEQYGSVSTDLENRNPGQR

SEQ ID NO: 26895 - protein, 31 aa, Artificial Sequence
  Description of Artificial Sequence: Synthetic polypeptide
DEEEIRTTNPVATEQYGSVSTNNLQNIQGEE

SEQ ID NO: 26896 - protein, 30 aa, Artificial Sequence
  Description of Artificial Sequence: Synthetic polypeptide
CEEEIRTTNPVATEQYGSVSTNHQGGNNQA

SEQ ID NO: 26897 - protein, 28 aa, Artificial Sequence
  Description of Artificial Sequence: Synthetic peptide
DEVEIATTNPVATNQYGEVSTALQHGNR

SEQ ID NO: 26898 - protein, 31 aa, Artificial Sequence
  Description of Artificial Sequence: Synthetic polypeptide
AEEEIRTTNPVATEQYGSVSTTNLEQVGNNI

SEQ ID NO: 26899 - protein, 28 aa, Artificial Sequence
  Description of Artificial Sequence: Synthetic peptide
SEEEIRTTNPVATEQYGSASTHLQDPGR

SEQ ID NO: 26900 - protein, 32 aa, Artificial Sequence
  Description of Artificial Sequence: Synthetic polypeptide
DEEEIRTTNPVATEQYGSVSTNNLQDPGGNQI

SEQ ID NO: 26901 - protein, 30 aa, Artificial Sequence
  Description of Artificial Sequence: Synthetic polypeptide
AEEEIRTTNPVATEQYGSVSTLNEQEVGNG

SEQ ID NO: 26902 - protein, 31 aa, Artificial Sequence
  Description of Artificial Sequence: Synthetic polypeptide
DEEEIRTTNPVATEQYGSVSSTNEVQGNGND

SEQ ID NO: 26903 - protein, 31 aa, Artificial Sequence
  Description of Artificial Sequence: Synthetic polypeptide
DEEEIRTTNPVATEQYGSNCSTNDLQGMNNR

SEQ ID NO: 26904 - protein, 30 aa, Artificial Sequence
  Description of Artificial Sequence: Synthetic polypeptide
AEEEIRTTNPVATEQYGSVSTLNEQQTGNT

SEQ ID NO: 26905 - protein, 30 aa, Artificial Sequence
  Description of Artificial Sequence: Synthetic polypeptide
AEEEIRTTNPVATEQYGSVSTLNLQENNEL

SEQ ID NO: 26906 - protein, 30 aa, Artificial Sequence
  Description of Artificial Sequence: Synthetic polypeptide
AEEEIRTTNPVATEQYGSVSTTNIQQQGNN

SEQ ID NO: 26907 - protein, 28 aa, Artificial Sequence
  Description of Artificial Sequence: Synthetic peptide
DEEEIRTTNPNATEEYGSVATNIGRGNT

SEQ ID NO: 26908 - protein, 31 aa, Artificial Sequence
  Description of Artificial Sequence: Synthetic polypeptide
DEVEIATTNPVATEQYGSVSTNLQDNGENMR

SEQ ID NO: 26909 - protein, 32 aa, Artificial Sequence
  Description of Artificial Sequence: Synthetic polypeptide
DEEEIRTTNPVATEQYGSVSTNNLQDEGNNEF

SEQ ID NO: 26910 - protein, 28 aa, Artificial Sequence
  Description of Artificial Sequence: Synthetic peptide
DEVEIATTNPVATIQYGMVSTVLQRGNQ

SEQ ID NO: 26911 - protein, 31 aa, Artificial Sequence
  Description of Artificial Sequence: Synthetic polypeptide
DEEEIRTTNPVATEQYGSVSTDLQFGQNTQQ

SEQ ID NO: 26912 - protein, 28 aa, Artificial Sequence
  Description of Artificial Sequence: Synthetic peptide
SEEEIRTTNPVATEQYGSAPENCQRENR

SEQ ID NO: 26913 - protein, 33 aa, Artificial Sequence
  Description of Artificial Sequence: Synthetic polypeptide
DEEEIRTTNPVATEQYGSNSMTENLSQRIGNER

SEQ ID NO: 26914 - protein, 30 aa, Artificial Sequence
  Description of Artificial Sequence: Synthetic polypeptide
AEEEIRTTNPVATEQYGSVSTLNLQEVENS

SEQ ID NO: 26915 - protein, 31 aa, Artificial Sequence
  Description of Artificial Sequence: Synthetic polypeptide
AEEEIRTTNPVATEQYGSVSTLNLQQEGGNN

SEQ ID NO: 26916 - protein, 30 aa, Artificial Sequence
  Description of Artificial Sequence: Synthetic polypeptide
AEEEIRTTNPVATEQYGSVSTLNNQQEGNG

SEQ ID NO: 26917 - protein, 30 aa, Artificial Sequence
  Description of Artificial Sequence: Synthetic polypeptide
DEEEIRTTNPVATEQYGSVSTDLQFNSNDY

SEQ ID NO: 26918 - protein, 31 aa, Artificial Sequence
  Description of Artificial Sequence: Synthetic polypeptide
DEEEIRTTNPVATEQYGSVCAANLQDGENDR

SEQ ID NO: 26919 - protein, 31 aa, Artificial Sequence
  Description of Artificial Sequence: Synthetic polypeptide
DEEEIRTTNPVATEQYGCVCSTNVLQFGSQR

SEQ ID NO: 26920 - protein, 29 aa, Artificial Sequence
  Description of Artificial Sequence: Synthetic peptide
DEVEIATTNPVATERYGSVATNLQSGNER

SEQ ID NO: 26921 - protein, 30 aa, Artificial Sequence
  Description of Artificial Sequence: Synthetic polypeptide
SEEEIRTTNPVATEQYGCVSTNLQEGVEDR

SEQ ID NO: 26922 - protein, 30 aa, Artificial Sequence
  Description of Artificial Sequence: Synthetic polypeptide
AEEEIRTTNPVATEQYGSVSTINQENNGNR

SEQ ID NO: 26923 - protein, 30 aa, Artificial Sequence
  Description of Artificial Sequence: Synthetic polypeptide
DEEEIRTTNPVATEQYGSMSTDLDQQRQER

SEQ ID NO: 26924 - protein, 29 aa, Artificial Sequence
  Description of Artificial Sequence: Synthetic peptide
DEEEIRTTNPVATEQYGSVSTDLNGENEV

SEQ ID NO: 26925 - protein, 30 aa, Artificial Sequence
  Description of Artificial Sequence: Synthetic polypeptide
DEEEIRTTNPVATEQYGSVSTDLNAQGSNQ

SEQ ID NO: 26926 - protein, 32 aa, Artificial Sequence
  Description of Artificial Sequence: Synthetic polypeptide
DEEEIRTTNPVATEQYGSVSTNNLEIRGLNIA

SEQ ID NO: 26927 - protein, 28 aa, Artificial Sequence
  Description of Artificial Sequence: Synthetic peptide
SENEIRPTNPIATEQYGSVSENLMRGNR

SEQ ID NO: 26928 - protein, 30 aa, Artificial Sequence
  Description of Artificial Sequence: Synthetic polypeptide
DENEIRTTNPVATEQYGSVSTPNEQEGNDG

SEQ ID NO: 26929 - protein, 30 aa, Artificial Sequence
  Description of Artificial Sequence: Synthetic polypeptide
AEEEIRTTNPVATEQYGSVSTTNLIEGNNN

SEQ ID NO: 26930 - protein, 29 aa, Artificial Sequence
  Description of Artificial Sequence: Synthetic peptide
DEEEIRTTNPVATEQYGSVSTDLMDHGEL

SEQ ID NO: 26931 - protein, 30 aa, Artificial Sequence
  Description of Artificial Sequence: Synthetic polypeptide
DENEIRTTNPVATEQYGSVSTQNLNNNMNR

SEQ ID NO: 26932 - protein, 30 aa, Artificial Sequence
  Description of Artificial Sequence: Synthetic polypeptide
DEEEIRTTNPVATEQYGSVSTDLLQNRTDD

SEQ ID NO: 26933 - protein, 31 aa, Artificial Sequence
  Description of Artificial Sequence: Synthetic polypeptide
CEEEIRTTNPVATEQYGSVSGTNLQRNANFG

SEQ ID NO: 26934 - protein, 29 aa, Artificial Sequence
  Description of Artificial Sequence: Synthetic peptide
DEVEIATTNPVATEQYGTVSTGLVQTGNR

SEQ ID NO: 26935 - protein, 31 aa, Artificial Sequence
  Description of Artificial Sequence: Synthetic polypeptide
DEEEIKTTNPVATEQYGSVCSTNLQRPSNDG

SEQ ID NO: 26936 - protein, 30 aa, Artificial Sequence
  Description of Artificial Sequence: Synthetic polypeptide
DEVEIATTNPVATERYGSVSTNLQTGGNTR

SEQ ID NO: 26937 - protein, 29 aa, Artificial Sequence
  Description of Artificial Sequence: Synthetic peptide
AEEEIRTTNPVATEQYGSVSTILQGNVNQ

SEQ ID NO: 26938 - protein, 31 aa, Artificial Sequence
  Description of Artificial Sequence: Synthetic polypeptide
DEEEIRTTNPVATEQYGSVSTNNLDIFGNEL

SEQ ID NO: 26939 - protein, 31 aa, Artificial Sequence
  Description of Artificial Sequence: Synthetic polypeptide
DEEEIRTTNPVATEQYGSVCATNEQRGDERD

SEQ ID NO: 26940 - protein, 28 aa, Artificial Sequence
  Description of Artificial Sequence: Synthetic peptide
DEEEIKTTNPVATEQYGSVETYHQGGND

SEQ ID NO: 26941 - protein, 30 aa, Artificial Sequence
  Description of Artificial Sequence: Synthetic polypeptide
AEEEIRTTNPVATEQYGSVSTINEQEGNAN

SEQ ID NO: 26942 - protein, 30 aa, Artificial Sequence
  Description of Artificial Sequence: Synthetic polypeptide
DENEIRTTNPVATEQYGSVSTNNTDQRGEE

SEQ ID NO: 26943 - protein, 31 aa, Artificial Sequence
  Description of Artificial Sequence: Synthetic polypeptide
DEEEIRTTNPVATEQYGSVSTSLQFGQNGGP

SEQ ID NO: 26944 - protein, 32 aa, Artificial Sequence
  Description of Artificial Sequence: Synthetic polypeptide
DEEEIRTTNPVATEQYGSVSTNNLDQEVGNNP

SEQ ID NO: 26945 - protein, 29 aa, Artificial Sequence
  Description of Artificial Sequence: Synthetic peptide
AEEEIRTTNPVATEQYGSVSTILQTGIIG

SEQ ID NO: 26946 - protein, 31 aa, Artificial Sequence
  Description of Artificial Sequence: Synthetic polypeptide
DEEEIRTTNPVATEQYGSVSTSLQGIGGNGN

SEQ ID NO: 26947 - protein, 29 aa, Artificial Sequence
  Description of Artificial Sequence: Synthetic peptide
DEDEIRTTNPVATEQYGCTSTNLQRGDSA

SEQ ID NO: 26948 - protein, 31 aa, Artificial Sequence
  Description of Artificial Sequence: Synthetic polypeptide
DEEEIRTTNPVATEQYGSVSTSLQFGGNNQP

SEQ ID NO: 26949 - protein, 31 aa, Artificial Sequence
  Description of Artificial Sequence: Synthetic polypeptide
CEEEIRTTNPVATEQYGSVSNTNDQSGSNRS

SEQ ID NO: 26950 - protein, 33 aa, Artificial Sequence
  Description of Artificial Sequence: Synthetic polypeptide
CEEEIRTTNPVATEQYGSVSMTNLMQRDGSNRS

SEQ ID NO: 26951 - protein, 29 aa, Artificial Sequence
  Description of Artificial Sequence: Synthetic peptide
DEDEIRTTNPVATEQYGCTSTNLQRTGDS

SEQ ID NO: 26952 - protein, 30 aa, Artificial Sequence
  Description of Artificial Sequence: Synthetic polypeptide
AEEEIRTTNPVATEQYGSVSTINNQQTGNL

SEQ ID NO: 26953 - protein, 32 aa, Artificial Sequence
  Description of Artificial Sequence: Synthetic polypeptide
DEEEIRTTNPVATEQYGSVSTNNLEQEDGGNG

SEQ ID NO: 26954 - protein, 30 aa, Artificial Sequence
  Description of Artificial Sequence: Synthetic polypeptide
AEEEIRTTNPVATEQYGSVSTTNLGQNGTM

SEQ ID NO: 26955 - protein, 30 aa, Artificial Sequence
  Description of Artificial Sequence: Synthetic polypeptide
AEEEIRTTNPVATEQYGSVSTLLQDGGGNN

SEQ ID NO: 26956 - protein, 31 aa, Artificial Sequence
  Description of Artificial Sequence: Synthetic polypeptide
AEEEIRTTNPVATEQYGSVSTTNLGQNGNPI

SEQ ID NO: 26957 - protein, 30 aa, Artificial Sequence
  Description of Artificial Sequence: Synthetic polypeptide
CEEEIRTTNPVATEQYGSVSAWNLDEGGNR

SEQ ID NO: 26958 - protein, 29 aa, Artificial Sequence
  Description of Artificial Sequence: Synthetic peptide
DEVEIATTNPVATEQYGSVSTNQQHGQNG

SEQ ID NO: 26959 - protein, 28 aa, Artificial Sequence
  Description of Artificial Sequence: Synthetic peptide
DEEEIRTTNPNATESYGSVATNGARGNA

SEQ ID NO: 26960 - protein, 30 aa, Artificial Sequence
  Description of Artificial Sequence: Synthetic polypeptide
AEEEIRTTNPVATEQYGSVSTLLQIQGNAN

SEQ ID NO: 26961 - protein, 30 aa, Artificial Sequence
  Description of Artificial Sequence: Synthetic polypeptide
DEEEIRTTNPVATEQYGSVSTNNGQNDVNP

SEQ ID NO: 26962 - protein, 28 aa, Artificial Sequence
  Description of Artificial Sequence: Synthetic peptide
SENEIRCTNPVATEQYGSVATNLQHGNA

SEQ ID NO: 26963 - protein, 30 aa, Artificial Sequence
  Description of Artificial Sequence: Synthetic polypeptide
AEEEIRTTNPVATEQYGSVSTTNLETGNEG

SEQ ID NO: 26964 - protein, 28 aa, Artificial Sequence
  Description of Artificial Sequence: Synthetic peptide
DEEEIRTTNPNATEEYGSVYTNEGRGNA

SEQ ID NO: 26965 - protein, 32 aa, Artificial Sequence
  Description of Artificial Sequence: Synthetic polypeptide
DEEEIRTTNPVATEQYGSLVSTNMHSQSGGNR

SEQ ID NO: 26966 - protein, 31 aa, Artificial Sequence
  Description of Artificial Sequence: Synthetic polypeptide
AEEEIRTTNPVATEQYGSVSTTNLLNTVGNR

SEQ ID NO: 26967 - protein, 31 aa, Artificial Sequence
  Description of Artificial Sequence: Synthetic polypeptide
DEEEIRTTNPVATEQYGSVSTSLQIIGNQNN

SEQ ID NO: 26968 - protein, 30 aa, Artificial Sequence
  Description of Artificial Sequence: Synthetic polypeptide
DEVEIATTNPVATEQYGSVSTNLQSGGNEA

SEQ ID NO: 26969 - protein, 32 aa, Artificial Sequence
  Description of Artificial Sequence: Synthetic polypeptide
CEEEIRTTNPVATEQYGSVSTENLNQRGGNNQ

SEQ ID NO: 26970 - protein, 31 aa, Artificial Sequence
  Description of Artificial Sequence: Synthetic polypeptide
DEEEIRTTNPVATEQYGSVSENDLDQRGQED

SEQ ID NO: 26971 - protein, 29 aa, Artificial Sequence
  Description of Artificial Sequence: Synthetic peptide
DEEEIRTTNPVATEQYGSVSTSGQDGEQE

SEQ ID NO: 26972 - protein, 30 aa, Artificial Sequence
  Description of Artificial Sequence: Synthetic polypeptide
AEEEIRTTNPVATEQYGSVSTLLQGGGNAN

SEQ ID NO: 26973 - protein, 30 aa, Artificial Sequence
  Description of Artificial Sequence: Synthetic polypeptide
DEVEIATTNPVATEQYGSVSTNLQRDGESE

SEQ ID NO: 26974 - protein, 32 aa, Artificial Sequence
  Description of Artificial Sequence: Synthetic polypeptide
DEEEIRTTNPVATEQYGSVSTNNGQRFQNQRA

SEQ ID NO: 26975 - protein, 31 aa, Artificial Sequence
  Description of Artificial Sequence: Synthetic polypeptide
DEEEIKTTNPVATEQYGHVSWTNLENRGMNR

SEQ ID NO: 26976 - protein, 30 aa, Artificial Sequence
  Description of Artificial Sequence: Synthetic polypeptide
DEVEIATTNPVATEVYGSVSTNLQGDHGNR

SEQ ID NO: 26977 - protein, 31 aa, Artificial Sequence
  Description of Artificial Sequence: Synthetic polypeptide
DEEEIRTTNPVATEQYGSVSTDLHQRSTNEF

SEQ ID NO: 26978 - protein, 30 aa, Artificial Sequence
  Description of Artificial Sequence: Synthetic polypeptide
DEEEIRTTNPVATEQYGSVSTNNGSEDENR

SEQ ID NO: 26979 - protein, 30 aa, Artificial Sequence
  Description of Artificial Sequence: Synthetic polypeptide
DEEEIKTTNPVATEQYGSVSMTELQNGNDQ

SEQ ID NO: 26980 - protein, 31 aa, Artificial Sequence
  Description of Artificial Sequence: Synthetic polypeptide
SEEEIRTTNPVATEQYGCVSTNLQRFNSNRD

SEQ ID NO: 26981 - protein, 32 aa, Artificial Sequence
  Description of Artificial Sequence: Synthetic polypeptide
DENEIRTTNPVATEQYGSVSTNLQRSGSNPQS

SEQ ID NO: 26982 - protein, 30 aa, Artificial Sequence
  Description of Artificial Sequence: Synthetic polypeptide
AEEEIRTTNPVATEQYGSVSTLLQEEGNIA

SEQ ID NO: 26983 - protein, 28 aa, Artificial Sequence
  Description of Artificial Sequence: Synthetic peptide
DEEEIRTTNPNATENYGSVATNHGRGNQ

SEQ ID NO: 26984 - protein, 30 aa, Artificial Sequence
  Description of Artificial Sequence: Synthetic polypeptide
SEEEIRTTNPVATEQYGCVSTPLQRGSDRG

SEQ ID NO: 26985 - protein, 34 aa, Artificial Sequence
  Description of Artificial Sequence: Synthetic polypeptide
DEEEIRTTNPVATEQYGSVCASTTNLQRIEGNRF

SEQ ID NO: 26986 - protein, 30 aa, Artificial Sequence
  Description of Artificial Sequence: Synthetic polypeptide
SEEEIRTTNPVATEQYGCVSTTELQHGSNR

SEQ ID NO: 26987 - protein, 29 aa, Artificial Sequence
  Description of Artificial Sequence: Synthetic peptide
DEVEIATTNPVATEQYGSVSTNQQYGQNM

SEQ ID NO: 26988 - protein, 29 aa, Artificial Sequence
  Description of Artificial Sequence: Synthetic peptide
DEVEIATTNPVATEQYGSVSTNQQTGDNM

SEQ ID NO: 26989 - protein, 28 aa, Artificial Sequence
  Description of Artificial Sequence: Synthetic peptide
DEECIHTVNPVATEPYGSVSDNLERGNR

SEQ ID NO: 26990 - protein, 30 aa, Artificial Sequence
  Description of Artificial Sequence: Synthetic polypeptide
AEEEIRTTNPVATEQYGSVSTLLQEEGNNL

SEQ ID NO: 26991 - protein, 30 aa, Artificial Sequence
  Description of Artificial Sequence: Synthetic polypeptide
AEEEIRTTNPVATEQYGSVSTGVLQEGGNT

SEQ ID NO: 26992 - protein, 31 aa, Artificial Sequence
  Description of Artificial Sequence: Synthetic polypeptide
SEEEIRTTNPVATEQYGSVCSTNLQRNFNFV

SEQ ID NO: 26993 - protein, 31 aa, Artificial Sequence
  Description of Artificial Sequence: Synthetic polypeptide
CEEEIRTTNPVATEQYGSVSTNHQRFGNNAS

SEQ ID NO: 26994 - protein, 31 aa, Artificial Sequence
  Description of Artificial Sequence: Synthetic polypeptide
CEEEIRTTNPVATEQYGSVGTNLQRFGSNAV

SEQ ID NO: 26995 - protein, 30 aa, Artificial Sequence
  Description of Artificial Sequence: Synthetic polypeptide
AEEEIRTTNPVATEQYGSVSTMNNTQGGNQ

SEQ ID NO: 26996 - protein, 29 aa, Artificial Sequence
  Description of Artificial Sequence: Synthetic peptide
AEEEIRTTNPVATEQYGSVSTEYDTSGNR

SEQ ID NO: 26997 - protein, 30 aa, Artificial Sequence
  Description of Artificial Sequence: Synthetic polypeptide
DEEEIRTTNPVATEQYGSNVSVTVLDNGER

SEQ ID NO: 26998 - protein, 31 aa, Artificial Sequence
  Description of Artificial Sequence: Synthetic polypeptide
DEEEIRTTNPVATEQYGSVSTDLQMEGGNQG

SEQ ID NO: 26999 - protein, 28 aa, Artificial Sequence
  Description of Artificial Sequence: Synthetic peptide
SENEIRCTNPVATEQYGEASENLQRGNR

SEQ ID NO: 27000 - protein, 31 aa, Artificial Sequence
  Description of Artificial Sequence: Synthetic polypeptide
DEEEIRTTNPVATEQYGSVSTDLQMGGEQRD

SEQ ID NO: 27001 - protein, 28 aa, Artificial Sequence
  Description of Artificial Sequence: Synthetic peptide
DEEEIHTVNPVATEQYGSVWTDLQPGND

SEQ ID NO: 27002 - protein, 31 aa, Artificial Sequence
  Description of Artificial Sequence: Synthetic polypeptide
AEEEIRTTNPVATEQYGSVSTTNLNEQVGNS

SEQ ID NO: 27003 - protein, 30 aa, Artificial Sequence
  Description of Artificial Sequence: Synthetic polypeptide
DEDEIRTTNPVATEQYGCVSTNLQDGDNDD

SEQ ID NO: 27004 - protein, 31 aa, Artificial Sequence
  Description of Artificial Sequence: Synthetic polypeptide
DEEEIRTTNPVATEQYGSVSTDLDERGVERI

SEQ ID NO: 27005 - protein, 31 aa, Artificial Sequence
  Description of Artificial Sequence: Synthetic polypeptide
DEEEIRTTNPVATEQYGSVSSTNGGQRGGTF

SEQ ID NO: 27006 - protein, 31 aa, Artificial Sequence
  Description of Artificial Sequence: Synthetic polypeptide
DEEEIRTTNPVATEQYGSVSTNNDGQNGNNN

SEQ ID NO: 27007 - protein, 30 aa, Artificial Sequence
  Description of Artificial Sequence: Synthetic polypeptide
SEEEIRTTNPVATEQYGSVATNLQRNPNDS

SEQ ID NO: 27008 - protein, 30 aa, Artificial Sequence
  Description of Artificial Sequence: Synthetic polypeptide
DEEEIHTTNPVATEQYGSVSVEFNLQRVNI

SEQ ID NO: 27009 - protein, 30 aa, Artificial Sequence
  Description of Artificial Sequence: Synthetic polypeptide
AEEEIRTTNPVATEQYGSVSTEQLQISGNT

SEQ ID NO: 27010 - protein, 31 aa, Artificial Sequence
  Description of Artificial Sequence: Synthetic polypeptide
DEEEIRTTNPVATEQYGSVSTDLQLVVGNIE

SEQ ID NO: 27011 - protein, 29 aa, Artificial Sequence
  Description of Artificial Sequence: Synthetic peptide
DEDEIRTTNPVATEQYGCTSNTNLQRGDA

SEQ ID NO: 27012 - protein, 29 aa, Artificial Sequence
  Description of Artificial Sequence: Synthetic peptide
AEEEIRTTNPVATEQYGSVSTTNLMTGQN

SEQ ID NO: 27013 - protein, 30 aa, Artificial Sequence
  Description of Artificial Sequence: Synthetic polypeptide
AEEEIRTTNPVATEQYGSVSTMLQEVGNNV

SEQ ID NO: 27014 - protein, 31 aa, Artificial Sequence
  Description of Artificial Sequence: Synthetic polypeptide
DEEEIRTTNPVATEQYGSVSTQNLDGTGNED

SEQ ID NO: 27015 - protein, 30 aa, Artificial Sequence
  Description of Artificial Sequence: Synthetic polypeptide
AEEEIRTTNPVATEQYGSVSTMLQGVGGNV

SEQ ID NO: 27016 - protein, 31 aa, Artificial Sequence
  Description of Artificial Sequence: Synthetic polypeptide
DEEEIRTTNPVATEQYGSVSSTNGGQESGNE

SEQ ID NO: 27017 - protein, 30 aa, Artificial Sequence
  Description of Artificial Sequence: Synthetic polypeptide
SEEEIRTTNPVATEQYGSVATNLQEAGNDD

SEQ ID NO: 27018 - protein, 30 aa, Artificial Sequence
  Description of Artificial Sequence: Synthetic polypeptide
SEEEIRTTNPVATEQYGSVATNLQGGGERN

SEQ ID NO: 27019 - protein, 30 aa, Artificial Sequence
  Description of Artificial Sequence: Synthetic polypeptide
SEEEIRTTNPVATEQYGSVATNLQMGENHA

SEQ ID NO: 27020 - protein, 31 aa, Artificial Sequence
  Description of Artificial Sequence: Synthetic polypeptide
DEEEIRTTNPVATEQYGSVSTQNVQVNGNGQ

SEQ ID NO: 27021 - protein, 30 aa, Artificial Sequence
  Description of Artificial Sequence: Synthetic polypeptide
SEEEIRTTNPVATEQYGSVATNLQNPGGNH

SEQ ID NO: 27022 - protein, 29 aa, Artificial Sequence
  Description of Artificial Sequence: Synthetic peptide
DEDEIRTTNPVATEQYGCVSTGLQRPNDH

SEQ ID NO: 27023 - protein, 31 aa, Artificial Sequence
  Description of Artificial Sequence: Synthetic polypeptide
DEEEIRTTNPVATEQYGSVSTQNVQNGNSQE

SEQ ID NO: 27024 - protein, 30 aa, Artificial Sequence
  Description of Artificial Sequence: Synthetic polypeptide
SEEEIRTTNPVATEQYGSVATNLQQGNEDS

SEQ ID NO: 27025 - protein, 29 aa, Artificial Sequence
  Description of Artificial Sequence: Synthetic peptide
DEEEIRTTNPVATEQYGSLSTDNLRDNNE

SEQ ID NO: 27026 - protein, 32 aa, Artificial Sequence
  Description of Artificial Sequence: Synthetic polypeptide
CEEEIRTTNPVATEQYGSQVCSTNLQRFGNDN

SEQ ID NO: 27027 - protein, 29 aa, Artificial Sequence
  Description of Artificial Sequence: Synthetic peptide
AEEEIRTTNPVATEQYGSVSTGIQNGGND

SEQ ID NO: 27028 - protein, 30 aa, Artificial Sequence
  Description of Artificial Sequence: Synthetic polypeptide
SEEEIRTTNPVATEQYGSVATNLQRPDDRN

SEQ ID NO: 27029 - protein, 30 aa, Artificial Sequence
  Description of Artificial Sequence: Synthetic polypeptide
DEEEIKTTNPVAYEQYGSVSCTNLQMGGNE

SEQ ID NO: 27030 - protein, 30 aa, Artificial Sequence
  Description of Artificial Sequence: Synthetic polypeptide
AEEEIRTTNPVATEQYGSVSTMNQQQIGND

SEQ ID NO: 27031 - protein, 31 aa, Artificial Sequence
  Description of Artificial Sequence: Synthetic polypeptide
DEEEIKTTNPVAYEQYGSVSTNLSQNTGGNR

SEQ ID NO: 27032 - protein, 29 aa, Artificial Sequence
  Description of Artificial Sequence: Synthetic peptide
CEEEIRTTNPVATEQYGSVSTTDAQTGND

SEQ ID NO: 27033 - protein, 31 aa, Artificial Sequence
  Description of Artificial Sequence: Synthetic polypeptide
DEEEIRTTNPVATCQYGCVSTNLERFGSNRV

SEQ ID NO: 27034 - protein, 31 aa, Artificial Sequence
  Description of Artificial Sequence: Synthetic polypeptide
DEDEIRTTNPVATEQYGCVSTNLQGDVGNER

SEQ ID NO: 27035 - protein, 29 aa, Artificial Sequence
  Description of Artificial Sequence: Synthetic peptide
DEAEISTTNPVATEQYGSVCSTNLIYGNT

SEQ ID NO: 27036 - protein, 30 aa, Artificial Sequence
  Description of Artificial Sequence: Synthetic polypeptide
DEEEIRTTNPVATEQYGSIYTNLQPRIGVF

SEQ ID NO: 27037 - protein, 29 aa, Artificial Sequence
  Description of Artificial Sequence: Synthetic peptide
DEEEIRTTNPVATEQYGSIYTNLISGIRF

SEQ ID NO: 27038 - protein, 31 aa, Artificial Sequence
  Description of Artificial Sequence: Synthetic polypeptide
DEEEIRTTNPVATEQYGSVATNPQNNGNERP

SEQ ID NO: 27039 - protein, 30 aa, Artificial Sequence
  Description of Artificial Sequence: Synthetic polypeptide
DEEEIRTTNPVATEQYGSQCSTNDQDGDER

SEQ ID NO: 27040 - protein, 30 aa, Artificial Sequence
  Description of Artificial Sequence: Synthetic polypeptide
AEEEIRTTNPVATEQYGSVSTTNEQEGNIA

SEQ ID NO: 27041 - protein, 29 aa, Artificial Sequence
  Description of Artificial Sequence: Synthetic peptide
AEEEIRTTNPVATEQYGSVSTENNQSGVS

SEQ ID NO: 27042 - protein, 31 aa, Artificial Sequence
  Description of Artificial Sequence: Synthetic polypeptide
DEEEIRTTNPVATEQYGSVATNPQNGAGNRD

SEQ ID NO: 27043 - protein, 30 aa, Artificial Sequence
  Description of Artificial Sequence: Synthetic polypeptide
SEEEIRTTNPVATEQWGSVSTNLQQGEENA

SEQ ID NO: 27044 - protein, 29 aa, Artificial Sequence
  Description of Artificial Sequence: Synthetic peptide
DEEEIRTTNPVATEQYGSVSTNNDFQGDQ

SEQ ID NO: 27045 - protein, 30 aa, Artificial Sequence
  Description of Artificial Sequence: Synthetic polypeptide
AEEEIRTTNPVATEQYGSVSTTNENQDGNA

SEQ ID NO: 27046 - protein, 30 aa, Artificial Sequence
  Description of Artificial Sequence: Synthetic polypeptide
DEDEIRTTNPVATEQYGCVSTNLQKGEGNH

SEQ ID NO: 27047 - protein, 30 aa, Artificial Sequence
  Description of Artificial Sequence: Synthetic polypeptide
AEEEIRTTNPVATEQYGSVSTTNEQILGNE

SEQ ID NO: 27048 - protein, 30 aa, Artificial Sequence
  Description of Artificial Sequence: Synthetic polypeptide
AEEEIRTTNPVATEQYGSVSTTNLLQVQNT

SEQ ID NO: 27049 - protein, 31 aa, Artificial Sequence
  Description of Artificial Sequence: Synthetic polypeptide
DEEEIRTTNPVATEQYGSVSTDLQNMGENIA

SEQ ID NO: 27050 - protein, 30 aa, Artificial Sequence
  Description of Artificial Sequence: Synthetic polypeptide
DENEIRTTNPVATEQYGTVSTNLERFGSNQ

SEQ ID NO: 27051 - protein, 28 aa, Artificial Sequence
  Description of Artificial Sequence: Synthetic peptide
DEEEIRTTNPSATEQYGSVPTILARGTE

SEQ ID NO: 27052 - protein, 30 aa, Artificial Sequence
  Description of Artificial Sequence: Synthetic polypeptide
SEEEIRTTNPVATEQYGSVATNLTRPGENP

SEQ ID NO: 27053 - protein, 30 aa, Artificial Sequence
  Description of Artificial Sequence: Synthetic polypeptide
DEEEIRTTNPVATEQYGSVSTDLARTINSD

SEQ ID NO: 27054 - protein, 29 aa, Artificial Sequence
  Description of Artificial Sequence: Synthetic peptide
DEEEIRTTNPSATEQYGSVSLNITRGGND

SEQ ID NO: 27055 - protein, 32 aa, Artificial Sequence
  Description of Artificial Sequence: Synthetic polypeptide
CEEEIRTTNPVATEQYGSVSTSNEQQRGENTR

SEQ ID NO: 27056 - protein, 32 aa, Artificial Sequence
  Description of Artificial Sequence: Synthetic polypeptide
SEEEIRTTNPVATEQYGSVATSNLVQRGPNPR

SEQ ID NO: 27057 - protein, 31 aa, Artificial Sequence
  Description of Artificial Sequence: Synthetic polypeptide
DEEEIKTTNPVAYEQYGSVVSTNLQGTGGNR

SEQ ID NO: 27058 - protein, 31 aa, Artificial Sequence
  Description of Artificial Sequence: Synthetic polypeptide
DEEEIRTTNPVATEQYGSVSTNNDGQNGGNG

SEQ ID NO: 27059 - protein, 31 aa, Artificial Sequence
  Description of Artificial Sequence: Synthetic polypeptide
DEEEIRTTNPVATEQYGSVSTQNVQAGGNGQ

SEQ ID NO: 27060 - protein, 30 aa, Artificial Sequence
  Description of Artificial Sequence: Synthetic polypeptide
DEEEIRTTNPVATEQYGSVSTDIQSLGNVQ

SEQ ID NO: 27061 - protein, 31 aa, Artificial Sequence
  Description of Artificial Sequence: Synthetic polypeptide
DEEEIRTTNPVATEQYGSVSTNNDGQNGGND

SEQ ID NO: 27062 - protein, 30 aa, Artificial Sequence
  Description of Artificial Sequence: Synthetic polypeptide
DEEEIRTTNPVATCQYGCVSTEDHQRGSNR

SEQ ID NO: 27063 - protein, 29 aa, Artificial Sequence
  Description of Artificial Sequence: Synthetic peptide
DEVEIATTNPVAYEQYGSVSTNLQGGEND

SEQ ID NO: 27064 - protein, 32 aa, Artificial Sequence
  Description of Artificial Sequence: Synthetic polypeptide
CEEEIRTTNPVATEQYGSVSTSNLSARGMNYR

SEQ ID NO: 27065 - protein, 28 aa, Artificial Sequence
  Description of Artificial Sequence: Synthetic peptide
DEEEIRTTNPVATEQYGSVSLLLDRQEQ

SEQ ID NO: 27066 - protein, 30 aa, Artificial Sequence
  Description of Artificial Sequence: Synthetic polypeptide
SEEEIRTTNPVATEQWGSVTSTELQRDNRD

SEQ ID NO: 27067 - protein, 32 aa, Artificial Sequence
  Description of Artificial Sequence: Synthetic polypeptide
DEEEIRTTNPVATEQYGSVSTNNLQPNGNPTI

SEQ ID NO: 27068 - protein, 31 aa, Artificial Sequence
  Description of Artificial Sequence: Synthetic polypeptide
AEEEIRTTNPVATEQYGSVSTGNLQQGEQNN

SEQ ID NO: 27069 - protein, 31 aa, Artificial Sequence
  Description of Artificial Sequence: Synthetic polypeptide
DEEEIRTTNPVATEQYGSVSTDLQIGGGNND

SEQ ID NO: 27070 - protein, 28 aa, Artificial Sequence
  Description of Artificial Sequence: Synthetic peptide
SENEIRTTNPVATECYGSVSENLMRENR

SEQ ID NO: 27071 - protein, 31 aa, Artificial Sequence
  Description of Artificial Sequence: Synthetic polypeptide
DEEEIRTTNPVATEQYGSVSLTNLQQGSMID

SEQ ID NO: 27072 - protein, 32 aa, Artificial Sequence
  Description of Artificial Sequence: Synthetic polypeptide
DEEEIRTTNPVATEQYGSVSTNNLQQEGGNEQ

SEQ ID NO: 27073 - protein, 30 aa, Artificial Sequence
  Description of Artificial Sequence: Synthetic polypeptide
AEEEIRTTNPVATEQYGSVSTLNVQDEGNE

SEQ ID NO: 27074 - protein, 31 aa, Artificial Sequence
  Description of Artificial Sequence: Synthetic polypeptide
DEEEIRTTNPVATEQYGSVSLTNLQQGVEDM

SEQ ID NO: 27075 - protein, 31 aa, Artificial Sequence
  Description of Artificial Sequence: Synthetic polypeptide
CEEEIRTTNPVATEQYGSVSTNLFQFFGNDA

SEQ ID NO: 27076 - protein, 30 aa, Artificial Sequence
  Description of Artificial Sequence: Synthetic polypeptide
DEEEIRTTNPVATEQYGSVSTDLQGESNND

SEQ ID NO: 27077 - protein, 30 aa, Artificial Sequence
  Description of Artificial Sequence: Synthetic polypeptide
DEEEIRTTNPVATEQYGSVSLLIERGENER

SEQ ID NO: 27078 - protein, 30 aa, Artificial Sequence
  Description of Artificial Sequence: Synthetic polypeptide
AEEEIRTTNPVATEQYGSVSTGNNQGTGNL

SEQ ID NO: 27079 - protein, 32 aa, Artificial Sequence
  Description of Artificial Sequence: Synthetic polypeptide
DEEEIRTTNPVATEQYGSVSTNNLQRENENIT

SEQ ID NO: 27080 - protein, 31 aa, Artificial Sequence
  Description of Artificial Sequence: Synthetic polypeptide
DEEEIKTTNPVATEQYGSVSTNQLQESNGNL

SEQ ID NO: 27081 - protein, 29 aa, Artificial Sequence
  Description of Artificial Sequence: Synthetic peptide
SEEEIRTTNPVATEQYGSVATALQNGGVR

SEQ ID NO: 27082 - protein, 31 aa, Artificial Sequence
  Description of Artificial Sequence: Synthetic polypeptide
DEEEIRTTNPVATEQYGSVATQLQRGSNQEQ

SEQ ID NO: 27083 - protein, 29 aa, Artificial Sequence
  Description of Artificial Sequence: Synthetic peptide
SEEEIRTTNPVATEQYGSVATALQNGPER

SEQ ID NO: 27084 - protein, 28 aa, Artificial Sequence
  Description of Artificial Sequence: Synthetic peptide
SEEEIRTTNPVATEQYGSVATALQNGFS

SEQ ID NO: 27085 - protein, 32 aa, Artificial Sequence
  Description of Artificial Sequence: Synthetic polypeptide
CEEEIRTTNPVATEQYGSVFTPNLSQRGENYR

SEQ ID NO: 27086 - protein, 31 aa, Artificial Sequence
  Description of Artificial Sequence: Synthetic polypeptide
DEVEIATTNPVATEQYGSTVSTNLDQNGNRD

SEQ ID NO: 27087 - protein, 30 aa, Artificial Sequence
  Description of Artificial Sequence: Synthetic polypeptide
DENEIRTTNPVATEQYGSVSWNLQSGSNQP

SEQ ID NO: 27088 - protein, 28 aa, Artificial Sequence
  Description of Artificial Sequence: Synthetic peptide
CEEEIRTTNPVATEQYGSVGTALQNGFA

SEQ ID NO: 27089 - protein, 28 aa, Artificial Sequence
  Description of Artificial Sequence: Synthetic peptide
DEVEIATTNPVATEQYGSVATNLEDGND

SEQ ID NO: 27090 - protein, 31 aa, Artificial Sequence
  Description of Artificial Sequence: Synthetic polypeptide
DEEEIRTTNPVATEQYGSVSLINLQRSEIER

SEQ ID NO: 27091 - protein, 32 aa, Artificial Sequence
  Description of Artificial Sequence: Synthetic polypeptide
DEEEIRTTNPVATEQYGSVSTNNLQQEFGGNG

SEQ ID NO: 27092 - protein, 31 aa, Artificial Sequence
  Description of Artificial Sequence: Synthetic polypeptide
DEEEIRTTNPVATEQYGSVSTDLQGDGENNG

SEQ ID NO: 27093 - protein, 28 aa, Artificial Sequence
  Description of Artificial Sequence: Synthetic peptide
AENEIATTNPVATEQYGEVSENLQRGER

SEQ ID NO: 27094 - protein, 28 aa, Artificial Sequence
  Description of Artificial Sequence: Synthetic peptide
AENEIATTNPVATEQYGEVSENLQRGGR

SEQ ID NO: 27095 - protein, 30 aa, Artificial Sequence
  Description of Artificial Sequence: Synthetic polypeptide
DEEEIRTTNPVATEQYGSVSTSADQLGEMR

SEQ ID NO: 27096 - protein, 29 aa, Artificial Sequence
  Description of Artificial Sequence: Synthetic peptide
DEVEIATTNPVATEQYGSVATNGQRGDND

SEQ ID NO: 27097 - protein, 28 aa, Artificial Sequence
  Description of Artificial Sequence: Synthetic peptide
DEVEIATTNPVATTQYGMVSTALQRGNE

SEQ ID NO: 27098 - protein, 30 aa, Artificial Sequence
  Description of Artificial Sequence: Synthetic polypeptide
AEEEIRTTNPVATEQYGSVSTLNVQAGGNI

SEQ ID NO: 27099 - protein, 31 aa, Artificial Sequence
  Description of Artificial Sequence: Synthetic polypeptide
DEEEIRTTNPVATEQYGSNVDSTNLQGFGQD

SEQ ID NO: 27100 - protein, 29 aa, Artificial Sequence
  Description of Artificial Sequence: Synthetic peptide
DEVEIATTNPVATEQYGSVAMNLQRGNQV

SEQ ID NO: 27101 - protein, 28 aa, Artificial Sequence
  Description of Artificial Sequence: Synthetic peptide
DEEEIRTTNPNATEEYGSVATNGNRGND

SEQ ID NO: 27102 - protein, 28 aa, Artificial Sequence
  Description of Artificial Sequence: Synthetic peptide
DEVEIATTNPVATEQYGSVAANDQRGND

SEQ ID NO: 27103 - protein, 29 aa, Artificial Sequence
  Description of Artificial Sequence: Synthetic peptide
AEEEIRTTNPVATEQYGSVSTLQQLQGNP

SEQ ID NO: 27104 - protein, 30 aa, Artificial Sequence
  Description of Artificial Sequence: Synthetic polypeptide
DEEEIRTTNPVATEQYGSVSENDQNGNEES

SEQ ID NO: 27105 - protein, 32 aa, Artificial Sequence
  Description of Artificial Sequence: Synthetic polypeptide
DEEEIKTTNPVATEQYGSVSTNQLQTRMGNPL

SEQ ID NO: 27106 - protein, 30 aa, Artificial Sequence
  Description of Artificial Sequence: Synthetic polypeptide
DEEEIRTTNPVATEQYGSVSTNNDNRIGEQ

SEQ ID NO: 27107 - protein, 29 aa, Artificial Sequence
  Description of Artificial Sequence: Synthetic peptide
SENEIRTTNPVATEQYGSISENLQQQGNR

SEQ ID NO: 27108 - protein, 28 aa, Artificial Sequence
  Description of Artificial Sequence: Synthetic peptide
AEEEIRTTNPVATEQYGSVSTMEQGGQT

SEQ ID NO: 27109 - protein, 33 aa, Artificial Sequence
  Description of Artificial Sequence: Synthetic polypeptide
DEEEIKTTNPVATEQYGSVVSVTNLSQRGGNNR

SEQ ID NO: 27110 - protein, 30 aa, Artificial Sequence
  Description of Artificial Sequence: Synthetic polypeptide
SEEEIRTTNPVATEQYGSVATNLQANGDNN

SEQ ID NO: 27111 - protein, 30 aa, Artificial Sequence
  Description of Artificial Sequence: Synthetic polypeptide
DEEEIRTTNPMAYEQYGSVVATNLQRGNDA

SEQ ID NO: 27112 - protein, 31 aa, Artificial Sequence
  Description of Artificial Sequence: Synthetic polypeptide
DENEIRTTNPVATEQYGSVTSTNLQHGSNQP

SEQ ID NO: 27113 - protein, 31 aa, Artificial Sequence
  Description of Artificial Sequence: Synthetic polypeptide
DEEEIRTTNPVATEQYGSVATPDQPRNGNPR

SEQ ID NO: 27114 - protein, 31 aa, Artificial Sequence
  Description of Artificial Sequence: Synthetic polypeptide
DEEEIRTTNPVATEQYGSVSTDLQGYEENRL

SEQ ID NO: 27115 - protein, 30 aa, Artificial Sequence
  Description of Artificial Sequence: Synthetic polypeptide
DEEEIRTTNPVATEQYGSVSTDLDQQELER

SEQ ID NO: 27116 - protein, 28 aa, Artificial Sequence
  Description of Artificial Sequence: Synthetic peptide
DEEEIRTTNPSATEQYGSVCTWLARGKE

SEQ ID NO: 27117 - protein, 30 aa, Artificial Sequence
  Description of Artificial Sequence: Synthetic polypeptide
DEAEISTTNPVATEQYGSVSTNLGGDGNER

SEQ ID NO: 27118 - protein, 30 aa, Artificial Sequence
  Description of Artificial Sequence: Synthetic polypeptide
SENEIRTTNPVATEQYGSVIWTNQQSRGNR

SEQ ID NO: 27119 - protein, 30 aa, Artificial Sequence
  Description of Artificial Sequence: Synthetic polypeptide
DEEEIRTTNPVATEQYGSVSTDLQIDGDAQ

SEQ ID NO: 27120 - protein, 30 aa, Artificial Sequence
  Description of Artificial Sequence: Synthetic polypeptide
SEEEIRTTNPVATEQYGSVATNLQDGNVDL

SEQ ID NO: 27121 - protein, 31 aa, Artificial Sequence
  Description of Artificial Sequence: Synthetic polypeptide
AEEEIRTTNPVATEQYGSVSTTNLLQSIGNN

SEQ ID NO: 27122 - protein, 31 aa, Artificial Sequence
  Description of Artificial Sequence: Synthetic polypeptide
DEEEIRTTNPVATEQYGSVSTDLQGIGTNED

SEQ ID NO: 27123 - protein, 31 aa, Artificial Sequence
  Description of Artificial Sequence: Synthetic polypeptide
DEEEIRTTNPVATEQYGSVSTDLQISGENNM

SEQ ID NO: 27124 - protein, 31 aa, Artificial Sequence
  Description of Artificial Sequence: Synthetic polypeptide
CEEEIRTTNPVATEQYGSVSTNLNQHGSNQQ

SEQ ID NO: 27125 - protein, 31 aa, Artificial Sequence
  Description of Artificial Sequence: Synthetic polypeptide
DEEEIRTTNPVATEQYGSVSTDLDQQRDSIR

SEQ ID NO: 27126 - protein, 28 aa, Artificial Sequence
  Description of Artificial Sequence: Synthetic peptide
DEDEIRTTNPVATEQYGCTSTELQRGDL

SEQ ID NO: 27127 - protein, 29 aa, Artificial Sequence
  Description of Artificial Sequence: Synthetic peptide
DEEEIRTTNPVATEQYGSVSENDQREEDD

SEQ ID NO: 27128 - protein, 30 aa, Artificial Sequence
  Description of Artificial Sequence: Synthetic polypeptide
DEEEIRTTNPVATEQYGSVSTNNDNRGQDN

SEQ ID NO: 27129 - protein, 30 aa, Artificial Sequence
  Description of Artificial Sequence: Synthetic polypeptide
DEVEIATTNPVATEQYGEVSTNLQGDGTNR

SEQ ID NO: 27130 - protein, 30 aa, Artificial Sequence
  Description of Artificial Sequence: Synthetic polypeptide
DEEEIRTTNPVATEQYGSNVSTDLERNEQR

SEQ ID NO: 27131 - protein, 29 aa, Artificial Sequence
  Description of Artificial Sequence: Synthetic peptide
DEEEIRTTNPVATEQYGSNVSTLIDNGER

SEQ ID NO: 27132 - protein, 28 aa, Artificial Sequence
  Description of Artificial Sequence: Synthetic peptide
AEEEIRTTNPVATEQYGSVSTLQQQTNN

SEQ ID NO: 27133 - protein, 31 aa, Artificial Sequence
  Description of Artificial Sequence: Synthetic polypeptide
DEEEIRTTNPVATEQYGSNVSTNDQRGIEDG

SEQ ID NO: 27134 - protein, 29 aa, Artificial Sequence
  Description of Artificial Sequence: Synthetic peptide
DEDEIRTTNGVAYCQYGSVCSTNLQRGDR

SEQ ID NO: 27135 - protein, 29 aa, Artificial Sequence
  Description of Artificial Sequence: Synthetic peptide
DEAEISTTNPVATEQYGSVSTNLQGNNQL

SEQ ID NO: 27136 - protein, 29 aa, Artificial Sequence
  Description of Artificial Sequence: Synthetic peptide
DEDEIRTTNCVAYCQYGSVSTNLQRGDRP

SEQ ID NO: 27137 - protein, 32 aa, Artificial Sequence
  Description of Artificial Sequence: Synthetic polypeptide
DEEEIRTTNPVATEQYGSVSTQTTLQRGTNGG

SEQ ID NO: 27138 - protein, 30 aa, Artificial Sequence
  Description of Artificial Sequence: Synthetic polypeptide
DEAEISTTNPVATEQYGSVSTNLQGDGNDT

SEQ ID NO: 27139 - protein, 29 aa, Artificial Sequence
  Description of Artificial Sequence: Synthetic peptide
AEEEIRTTNPVATEQYGSVSTLVQAGINN

SEQ ID NO: 27140 - protein, 32 aa, Artificial Sequence
  Description of Artificial Sequence: Synthetic polypeptide
DEEEIRTTNPVATEQYGSVSTDLDQQRGDMER

SEQ ID NO: 27141 - protein, 29 aa, Artificial Sequence
  Description of Artificial Sequence: Synthetic peptide
SEEEIRTTNPVATEQYGSVATNLERGPDA

SEQ ID NO: 27142 - protein, 29 aa, Artificial Sequence
  Description of Artificial Sequence: Synthetic peptide
AEEEIRTTNPVATEQYGSVSTTLGTGINN

SEQ ID NO: 27143 - protein, 30 aa, Artificial Sequence
  Description of Artificial Sequence: Synthetic polypeptide
SEEEIRTTNPVATEQYGSVSCTNGGQRGDF

SEQ ID NO: 27144 - protein, 31 aa, Artificial Sequence
  Description of Artificial Sequence: Synthetic polypeptide
DEEEIRTTNPVATEQYGSVSTNNLDNFGEDR

SEQ ID NO: 27145 - protein, 30 aa, Artificial Sequence
  Description of Artificial Sequence: Synthetic polypeptide
DETEIRTTNPVATEQYGTVSTNLQHNGNDD

SEQ ID NO: 27146 - protein, 30 aa, Artificial Sequence
  Description of Artificial Sequence: Synthetic polypeptide
DETEIRTTNPVATEQYGTVSTNLQLDGNEQ

SEQ ID NO: 27147 - protein, 29 aa, Artificial Sequence
  Description of Artificial Sequence: Synthetic peptide
AEEEIRTTNPVATEQYGSVSTELQEDENG

SEQ ID NO: 27148 - protein, 30 aa, Artificial Sequence
  Description of Artificial Sequence: Synthetic polypeptide
DEVEIRTTNPVATEQYGSVISTNDQREGLG

SEQ ID NO: 27149 - protein, 31 aa, Artificial Sequence
  Description of Artificial Sequence: Synthetic polypeptide
AEEEIRTTNPVATEQYGSVSTTNLQPGTNMG

SEQ ID NO: 27150 - protein, 29 aa, Artificial Sequence
  Description of Artificial Sequence: Synthetic peptide
DETEIRTTNPVATEQYGSISTNQQTEGLR

SEQ ID NO: 27151 - protein, 30 aa, Artificial Sequence
  Description of Artificial Sequence: Synthetic polypeptide
DETEIRTTNPVATEQYGTVSTNLQPDGNMN

SEQ ID NO: 27152 - protein, 32 aa, Artificial Sequence
  Description of Artificial Sequence: Synthetic polypeptide
DEEEIRTTNPVATEQYGSVSTQNLGQNMGFNV

SEQ ID NO: 27153 - protein, 29 aa, Artificial Sequence
  Description of Artificial Sequence: Synthetic peptide
DEEEIATTNPVAYEQYGSVATNLQQGNLT

SEQ ID NO: 27154 - protein, 28 aa, Artificial Sequence
  Description of Artificial Sequence: Synthetic peptide
DENVIRTTNPVATEQYGCVETNPQRGNT

SEQ ID NO: 27155 - protein, 28 aa, Artificial Sequence
  Description of Artificial Sequence: Synthetic peptide
DENTIRTTNPVATEQYGCVETNGQRGNA

SEQ ID NO: 27156 - protein, 28 aa, Artificial Sequence
  Description of Artificial Sequence: Synthetic peptide
AEQEIATTNPVATEQYGDASENLQRGNR

SEQ ID NO: 27157 - protein, 31 aa, Artificial Sequence
  Description of Artificial Sequence: Synthetic polypeptide
DEEEIRTTNPVATEQYGSVSTNSSQLRDMIR

SEQ ID NO: 27158 - protein, 30 aa, Artificial Sequence
  Description of Artificial Sequence: Synthetic polypeptide
AEEEIRTTNPVATEQYGSVSTNFGQGGNTQ

SEQ ID NO: 27159 - protein, 31 aa, Artificial Sequence
  Description of Artificial Sequence: Synthetic polypeptide
AEEEIRTTNPVATEQYGSVSTTNLQQAGNVA

SEQ ID NO: 27160 - protein, 32 aa, Artificial Sequence
  Description of Artificial Sequence: Synthetic polypeptide
DEEEIQTTNPVATEPYGSVVSTNLSQRGGNNR

SEQ ID NO: 27161 - protein, 29 aa, Artificial Sequence
  Description of Artificial Sequence: Synthetic peptide
DENVIRTTNPVATEQYGCVETNQQRGNRI

SEQ ID NO: 27162 - protein, 30 aa, Artificial Sequence
  Description of Artificial Sequence: Synthetic polypeptide
DETEIRTTNPVATEQYGSIISTNQQREGLR

SEQ ID NO: 27163 - protein, 31 aa, Artificial Sequence
  Description of Artificial Sequence: Synthetic polypeptide
DEEEIRTTNPVATEQYGSVSTSNLIIDGDND

SEQ ID NO: 27164 - protein, 33 aa, Artificial Sequence
  Description of Artificial Sequence: Synthetic polypeptide
SEEEIRTTNPVATEQYGSVSTSNLMQREGENER

SEQ ID NO: 27165 - protein, 31 aa, Artificial Sequence
  Description of Artificial Sequence: Synthetic polypeptide
DETEIRTTNPVATEQYGTVSTNLQPGGDNDR

SEQ ID NO: 27166 - protein, 32 aa, Artificial Sequence
  Description of Artificial Sequence: Synthetic polypeptide
DEEEIRTTNPVATEQYGSTAYTENLSQRTGNR

SEQ ID NO: 27167 - protein, 30 aa, Artificial Sequence
  Description of Artificial Sequence: Synthetic polypeptide
AEEEIRTTNPVATEQYGSVSTNGNQQTGNN

SEQ ID NO: 27168 - protein, 31 aa, Artificial Sequence
  Description of Artificial Sequence: Synthetic polypeptide
DEEEIRTTNPVATEQYGSVSTNMHQEREMIR

SEQ ID NO: 27169 - protein, 31 aa, Artificial Sequence
  Description of Artificial Sequence: Synthetic polypeptide
DEEEIRTTNPVATEQYGSVSTQNLIGFGGNQ

SEQ ID NO: 27170 - protein, 30 aa, Artificial Sequence
  Description of Artificial Sequence: Synthetic polypeptide
DEEEIATTNPVAYEQYGSVATNLQRGDNEE

SEQ ID NO: 27171 - protein, 29 aa, Artificial Sequence
  Description of Artificial Sequence: Synthetic peptide
DETEIRTTNPVATEQYGSISTNIQTEGLR

SEQ ID NO: 27172 - protein, 30 aa, Artificial Sequence
  Description of Artificial Sequence: Synthetic polypeptide
DETEIRTTNPVATEQYGTVSTNLQPGGNSQ

SEQ ID NO: 27173 - protein, 32 aa, Artificial Sequence
  Description of Artificial Sequence: Synthetic polypeptide
DEVEIRTTNPVATEQYGSVSTDNDGNQRGDNR

SEQ ID NO: 27174 - protein, 29 aa, Artificial Sequence
  Description of Artificial Sequence: Synthetic peptide
DEDEIRTTNPVATDQYGVVSTNLERGVND

SEQ ID NO: 27175 - protein, 32 aa, Artificial Sequence
  Description of Artificial Sequence: Synthetic polypeptide
DEEEIRTTNPVATEQYGSVSTSNLQIGIGTNI

SEQ ID NO: 27176 - protein, 31 aa, Artificial Sequence
  Description of Artificial Sequence: Synthetic polypeptide
DEEEIRTTNPVATEQYGSVATNLQRGDEGDH

SEQ ID NO: 27177 - protein, 30 aa, Artificial Sequence
  Description of Artificial Sequence: Synthetic polypeptide
AEEEIRTTNPVATEQYGSVSTTNLQMGDGE

SEQ ID NO: 27178 - protein, 29 aa, Artificial Sequence
  Description of Artificial Sequence: Synthetic peptide
DETEIRTTNPVATEQYGSTSTNTQFGGLR

SEQ ID NO: 27179 - protein, 32 aa, Artificial Sequence
  Description of Artificial Sequence: Synthetic polypeptide
DEEEIRTTNPVATEQYGSVSTSNLQIIGGNGN

SEQ ID NO: 27180 - protein, 32 aa, Artificial Sequence
  Description of Artificial Sequence: Synthetic polypeptide
DETEIRTTNPVATEQYGSVYSSTNTDLQLGNR

SEQ ID NO: 27181 - protein, 29 aa, Artificial Sequence
  Description of Artificial Sequence: Synthetic peptide
DENTIRTTNPVATEQYGCVETNQGQRGNR

SEQ ID NO: 27182 - protein, 30 aa, Artificial Sequence
  Description of Artificial Sequence: Synthetic polypeptide
DETEIRTTNPVATEQYGTVSTNLGQDGDDR

SEQ ID NO: 27183 - protein, 28 aa, Artificial Sequence
  Description of Artificial Sequence: Synthetic peptide
SEPEIRGTNPIATEQYGSVSENLMRGNR

SEQ ID NO: 27184 - protein, 31 aa, Artificial Sequence
  Description of Artificial Sequence: Synthetic polypeptide
DEVEIRTTNPVATEQYGSVNSTNDQNRGDRG

SEQ ID NO: 27185 - protein, 31 aa, Artificial Sequence
  Description of Artificial Sequence: Synthetic polypeptide
DEVEIRTTNPVATEQYGSVSTDGDQREGNQR

SEQ ID NO: 27186 - protein, 29 aa, Artificial Sequence
  Description of Artificial Sequence: Synthetic peptide
AEEEIRTTNPVATEQYGSVSTSTQNGNVS

SEQ ID NO: 27187 - protein, 30 aa, Artificial Sequence
  Description of Artificial Sequence: Synthetic polypeptide
DETEIRTTNPVATEQYGTVSTNLQHGGNDI

SEQ ID NO: 27188 - protein, 30 aa, Artificial Sequence
  Description of Artificial Sequence: Synthetic polypeptide
DETEIRTTNPVATEQYGTVSTNLQGDMGNQ

SEQ ID NO: 27189 - protein, 29 aa, Artificial Sequence
  Description of Artificial Sequence: Synthetic peptide
AEEEIRTTNPVATEQYGSVSTSTQVQGNM

SEQ ID NO: 27190 - protein, 28 aa, Artificial Sequence
  Description of Artificial Sequence: Synthetic peptide
DENVIRTTNPVATEQYGCVATNPQTGNR

SEQ ID NO: 27191 - protein, 31 aa, Artificial Sequence
  Description of Artificial Sequence: Synthetic polypeptide
DEEEINTTNPVATEQYGSVSTNSLQQVRGEV

SEQ ID NO: 27192 - protein, 31 aa, Artificial Sequence
  Description of Artificial Sequence: Synthetic polypeptide
DEEEINTTNPVATEQYGSVSTNSLGQVRGEM

SEQ ID NO: 27193 - protein, 31 aa, Artificial Sequence
  Description of Artificial Sequence: Synthetic polypeptide
DEEEIRTTNPVATEQYGSVATNLQREEMGEE

SEQ ID NO: 27194 - protein, 32 aa, Artificial Sequence
  Description of Artificial Sequence: Synthetic polypeptide
DEEEIRTTNPVATEQYGSVSTSNLLQIGGNVT

SEQ ID NO: 27195 - protein, 30 aa, Artificial Sequence
  Description of Artificial Sequence: Synthetic polypeptide
AEEEIRTTNPVATEQYGSVSTNGNQQGNIG

SEQ ID NO: 27196 - protein, 31 aa, Artificial Sequence
  Description of Artificial Sequence: Synthetic polypeptide
DEEEIRTTNPVATEQYGSVSELYQLRGENER

SEQ ID NO: 27197 - protein, 28 aa, Artificial Sequence
  Description of Artificial Sequence: Synthetic peptide
DENTIRTTNPVATEQYGCVETNPTRGNR

SEQ ID NO: 27198 - protein, 32 aa, Artificial Sequence
  Description of Artificial Sequence: Synthetic polypeptide
SEEEIRTTNPVATEQYGSVSTSNLDQRGENEN

SEQ ID NO: 27199 - protein, 33 aa, Artificial Sequence
  Description of Artificial Sequence: Synthetic polypeptide
DEEEIRTTNPVATEQYGSSVTSTGNLQRGSNNQ

SEQ ID NO: 27200 - protein, 33 aa, Artificial Sequence
  Description of Artificial Sequence: Synthetic polypeptide
SEEEIRTTNPVATEQYGSVSTSNLGQERGENDR

SEQ ID NO: 27201 - protein, 32 aa, Artificial Sequence
  Description of Artificial Sequence: Synthetic polypeptide
DEEEIRTTNPVATEQYGSVSSTNLHESGDNRS

SEQ ID NO: 27202 - protein, 31 aa, Artificial Sequence
  Description of Artificial Sequence: Synthetic polypeptide
DEEEIRTTNPVATEQYGSVATNLQRNQENIV

SEQ ID NO: 27203 - protein, 30 aa, Artificial Sequence
  Description of Artificial Sequence: Synthetic polypeptide
DEVEIRTTNPVATEQYGSVCSTELQHFGER

SEQ ID NO: 27204 - protein, 32 aa, Artificial Sequence
  Description of Artificial Sequence: Synthetic polypeptide
DEEEIRTTNPVATEQYGSVSTSNLQMSGINVQ

SEQ ID NO: 27205 - protein, 30 aa, Artificial Sequence
  Description of Artificial Sequence: Synthetic polypeptide
CEEEIRTTNPVAYEPYGSVSCTNLSQSGNR

SEQ ID NO: 27206 - protein, 30 aa, Artificial Sequence
  Description of Artificial Sequence: Synthetic polypeptide
AEEEIRTTNPVATEQYGSVSTTNLQLETND

SEQ ID NO: 27207 - protein, 29 aa, Artificial Sequence
  Description of Artificial Sequence: Synthetic peptide
DENGIRTTNPVATEQYGSISLTNLINGNR

SEQ ID NO: 27208 - protein, 28 aa, Artificial Sequence
  Description of Artificial Sequence: Synthetic peptide
DETEIRTTNPVATQQYGTVSTTLERGNP

SEQ ID NO: 27209 - protein, 31 aa, Artificial Sequence
  Description of Artificial Sequence: Synthetic polypeptide
AEEEIRTTNPVATEQYGSVSTENNLQLNGNQ

SEQ ID NO: 27210 - protein, 30 aa, Artificial Sequence
  Description of Artificial Sequence: Synthetic polypeptide
DEVEIRTTNPVATEQYGSVATNLQDGMNDE

SEQ ID NO: 27211 - protein, 28 aa, Artificial Sequence
  Description of Artificial Sequence: Synthetic peptide
DETEIRTTNPVATTAYGSVSTNLQDTNM

SEQ ID NO: 27212 - protein, 29 aa, Artificial Sequence
  Description of Artificial Sequence: Synthetic peptide
DENGIRTTNPVATEQYGSFSTNLINTGNR

SEQ ID NO: 27213 - protein, 29 aa, Artificial Sequence
  Description of Artificial Sequence: Synthetic peptide
DETEIRTTNPVATTAYGSVSTNLQRTNNQ

SEQ ID NO: 27214 - protein, 30 aa, Artificial Sequence
  Description of Artificial Sequence: Synthetic polypeptide
DEEEIRTTNPVATEQYGSVATNLQRPEPGQ

SEQ ID NO: 27215 - protein, 29 aa, Artificial Sequence
  Description of Artificial Sequence: Synthetic peptide
DENEIVTTNPVATEQYGSVSTNLESVGNL

SEQ ID NO: 27216 - protein, 31 aa, Artificial Sequence
  Description of Artificial Sequence: Synthetic polypeptide
AEEEIRTTNPVATEQYGSVSTTNLQIIGNAG

SEQ ID NO: 27217 - protein, 31 aa, Artificial Sequence
  Description of Artificial Sequence: Synthetic polypeptide
DEEEIRTTNPVATEQYGSVATNLQRPDNPVM

SEQ ID NO: 27218 - protein, 28 aa, Artificial Sequence
  Description of Artificial Sequence: Synthetic peptide
DETEIRTTNPVATTQYGCVSTNLERGDP

SEQ ID NO: 27219 - protein, 29 aa, Artificial Sequence
  Description of Artificial Sequence: Synthetic peptide
DEDEIRTTNPVATEQYGECSTNDLQRGDS

SEQ ID NO: 27220 - protein, 30 aa, Artificial Sequence
  Description of Artificial Sequence: Synthetic polypeptide
DEEEIRTTNPVATEQYGSVSTDLQTPTERD

SEQ ID NO: 27221 - protein, 28 aa, Artificial Sequence
  Description of Artificial Sequence: Synthetic peptide
DETEIRTTNPVATWPYGSVSTNLQRTGI

SEQ ID NO: 27222 - protein, 31 aa, Artificial Sequence
  Description of Artificial Sequence: Synthetic polypeptide
DETEIRTTNPVATEQYGEVSTNLEQEGGNDR

SEQ ID NO: 27223 - protein, 32 aa, Artificial Sequence
  Description of Artificial Sequence: Synthetic polypeptide
DEEEIRTTNPVATEQYGSVSTNQNQDRGNNMN

SEQ ID NO: 27224 - protein, 29 aa, Artificial Sequence
  Description of Artificial Sequence: Synthetic peptide
DETEIRTTNPVAVEQYGSISTNLERTNRQ

SEQ ID NO: 27225 - protein, 30 aa, Artificial Sequence
  Description of Artificial Sequence: Synthetic polypeptide
DEVEIRTTNPVATEQYGNVSTNLQGGGNNQ

SEQ ID NO: 27226 - protein, 30 aa, Artificial Sequence
  Description of Artificial Sequence: Synthetic polypeptide
DEEEIRTTNPVATEQYGSSSTDLNQRGDDQ

SEQ ID NO: 27227 - protein, 30 aa, Artificial Sequence
  Description of Artificial Sequence: Synthetic polypeptide
DEEEIRTTNPVATEQYGSVSTNTDGEGNNA

SEQ ID NO: 27228 - protein, 31 aa, Artificial Sequence
  Description of Artificial Sequence: Synthetic polypeptide
DEEEINTTNPVATEQYGSVSTNSLFQTRGEG

SEQ ID NO: 27229 - protein, 32 aa, Artificial Sequence
  Description of Artificial Sequence: Synthetic polypeptide
AEEEIRTTNPVATEQYGSVSTTNLQQDEGNER

SEQ ID NO: 27230 - protein, 31 aa, Artificial Sequence
  Description of Artificial Sequence: Synthetic polypeptide
DEEEINTTNPVATEQYGSVSTNSLFQNRGES

SEQ ID NO: 27231 - protein, 30 aa, Artificial Sequence
  Description of Artificial Sequence: Synthetic polypeptide
DEEEIRTTNPVATEQYGSVSTDLQVFENVQ

SEQ ID NO: 27232 - protein, 31 aa, Artificial Sequence
  Description of Artificial Sequence: Synthetic polypeptide
DETEIRTTNPVATEQYGEVSTNLQGDLGNER

SEQ ID NO: 27233 - protein, 30 aa, Artificial Sequence
  Description of Artificial Sequence: Synthetic polypeptide
DEEEIRTTNPMATEQYGSVIETNLQRGEQA

SEQ ID NO: 27234 - protein, 31 aa, Artificial Sequence
  Description of Artificial Sequence: Synthetic polypeptide
SEEEIRTTNPVATEQYGSVSTGQLQTGNIRG

SEQ ID NO: 27235 - protein, 31 aa, Artificial Sequence
  Description of Artificial Sequence: Synthetic polypeptide
DETEIRTTNPVATEQYGNVSTNLQMGGDNTR

SEQ ID NO: 27236 - protein, 30 aa, Artificial Sequence
  Description of Artificial Sequence: Synthetic polypeptide
DETEIRTTNPVATEQYGNVSTNLQGMGDDR

SEQ ID NO: 27237 - protein, 30 aa, Artificial Sequence
  Description of Artificial Sequence: Synthetic polypeptide
DEEEIATTNPVAYEQYGSVATNLQRNDNRM

SEQ ID NO: 27238 - protein, 31 aa, Artificial Sequence
  Description of Artificial Sequence: Synthetic polypeptide
AEEEIRTTNPVATEQYGSVSTTNLQLQGTIR

SEQ ID NO: 27239 - protein, 31 aa, Artificial Sequence
  Description of Artificial Sequence: Synthetic polypeptide
DETEIRTTNPVATEQYGTVSTNLQRGGNGDT

SEQ ID NO: 27240 - protein, 31 aa, Artificial Sequence
  Description of Artificial Sequence: Synthetic polypeptide
DEEEIGTTNPVATEQYGEVSTNELQERMGNL

SEQ ID NO: 27241 - protein, 31 aa, Artificial Sequence
  Description of Artificial Sequence: Synthetic polypeptide
DETEIRTTNPVATEQYGNVSTNLQGEGDNER

SEQ ID NO: 27242 - protein, 28 aa, Artificial Sequence
  Description of Artificial Sequence: Synthetic peptide
DENQIRTTNPVATEQYGSVSTVELRGNT

SEQ ID NO: 27243 - protein, 31 aa, Artificial Sequence
  Description of Artificial Sequence: Synthetic polypeptide
DETEIRTTNPVATEQYGNVSTNLNQGEGNER

SEQ ID NO: 27244 - protein, 31 aa, Artificial Sequence
  Description of Artificial Sequence: Synthetic polypeptide
DEEEIRTTNPVATEQYGSVSETWNGGQRGGF

SEQ ID NO: 27245 - protein, 29 aa, Artificial Sequence
  Description of Artificial Sequence: Synthetic peptide
DETEIRTTNPVATEQYGVVSTILQRLEND

SEQ ID NO: 27246 - protein, 31 aa, Artificial Sequence
  Description of Artificial Sequence: Synthetic polypeptide
DEEEIRTTNPVATEQYGSVSTDLQVVGNDIN

SEQ ID NO: 27247 - protein, 32 aa, Artificial Sequence
  Description of Artificial Sequence: Synthetic polypeptide
DEEEIRTTNPVATEQYGSVSTSNLQQNGIENE

SEQ ID NO: 27248 - protein, 30 aa, Artificial Sequence
  Description of Artificial Sequence: Synthetic polypeptide
DETEIRTTNPVATEQYGVVSTNLQPDGNDS

SEQ ID NO: 27249 - protein, 31 aa, Artificial Sequence
  Description of Artificial Sequence: Synthetic polypeptide
DETEIRTTNPVATEQYGVVSTNLQRGGDNGG

SEQ ID NO: 27250 - protein, 30 aa, Artificial Sequence
  Description of Artificial Sequence: Synthetic polypeptide
AEEEIRTTNPVATEQYGSVSTNGQEGNIND

SEQ ID NO: 27251 - protein, 30 aa, Artificial Sequence
  Description of Artificial Sequence: Synthetic polypeptide
DETEIRTTNPVATEQYGEVSTNLQRGGDMG

SEQ ID NO: 27252 - protein, 31 aa, Artificial Sequence
  Description of Artificial Sequence: Synthetic polypeptide
DEEEIRTTNPVATEQYGSVSTNQNQGEGGNG

SEQ ID NO: 27253 - protein, 31 aa, Artificial Sequence
  Description of Artificial Sequence: Synthetic polypeptide
DEEEIRTTNPVATEQYGSVSTSNLIDRDNEE

SEQ ID NO: 27254 - protein, 31 aa, Artificial Sequence
  Description of Artificial Sequence: Synthetic polypeptide
DEEEIRTTNPTATEQYGSVSTNLQLIEGDNE

SEQ ID NO: 27255 - protein, 31 aa, Artificial Sequence
  Description of Artificial Sequence: Synthetic polypeptide
DEVEIRTTNPVATEQYGSVCSENLQREGDRE

SEQ ID NO: 27256 - protein, 28 aa, Artificial Sequence
  Description of Artificial Sequence: Synthetic peptide
DEDEIRTTNPVATEQYGATSTNLQSGTD

SEQ ID NO: 27257 - protein, 30 aa, Artificial Sequence
  Description of Artificial Sequence: Synthetic polypeptide
DETEIRTTNPVATEWYGSVSTNLQGENGND

SEQ ID NO: 27258 - protein, 30 aa, Artificial Sequence
  Description of Artificial Sequence: Synthetic polypeptide
DEEEIRTTNPVATEQYGSVATNLQRNVEDN

SEQ ID NO: 27259 - protein, 31 aa, Artificial Sequence
  Description of Artificial Sequence: Synthetic polypeptide
DEEEIRTTNPVATEQYGSVSLTNLQRFPEEH

SEQ ID NO: 27260 - protein, 31 aa, Artificial Sequence
  Description of Artificial Sequence: Synthetic polypeptide
DETEIRTTNPVATEQYGSVSGNLPQDDGNPR

SEQ ID NO: 27261 - protein, 29 aa, Artificial Sequence
  Description of Artificial Sequence: Synthetic peptide
DENMIRTTNPVATEQYGSASTNLINGNER

SEQ ID NO: 27262 - protein, 31 aa, Artificial Sequence
  Description of Artificial Sequence: Synthetic polypeptide
DETEIRTTNPVATEQYGSVVTDNDQERNGNR

SEQ ID NO: 27263 - protein, 31 aa, Artificial Sequence
  Description of Artificial Sequence: Synthetic polypeptide
SEEEIRTTNPVATEQYGSVSTNLGRNGNEPT

SEQ ID NO: 27264 - protein, 30 aa, Artificial Sequence
  Description of Artificial Sequence: Synthetic polypeptide
DEEEIRTTNPMATEQYGSVCGTNLQRGDTA

SEQ ID NO: 27265 - protein, 30 aa, Artificial Sequence
  Description of Artificial Sequence: Synthetic polypeptide
DEVEIRTTNPVATEQYGSVQSTHLQHGSNQ

SEQ ID NO: 27266 - protein, 31 aa, Artificial Sequence
  Description of Artificial Sequence: Synthetic polypeptide
SEEEIRTTNPVATEQYGSVSTNLQVENGNNI

SEQ ID NO: 27267 - protein, 32 aa, Artificial Sequence
  Description of Artificial Sequence: Synthetic polypeptide
DEEEIRTTNPVATEQYGSVSTQNLEQNMGNLQ

SEQ ID NO: 27268 - protein, 31 aa, Artificial Sequence
  Description of Artificial Sequence: Synthetic polypeptide
AEEEIRTTNPVATEQYGSVSTTNLQNGGNAF

SEQ ID NO: 27269 - protein, 30 aa, Artificial Sequence
  Description of Artificial Sequence: Synthetic polypeptide
AEEEIRTTNPVATEQYGSVSTSTLQSGNQI

SEQ ID NO: 27270 - protein, 31 aa, Artificial Sequence
  Description of Artificial Sequence: Synthetic polypeptide
DEEEIRTTNPVATEQYGSVSTSNLQFNEFNG

SEQ ID NO: 27271 - protein, 31 aa, Artificial Sequence
  Description of Artificial Sequence: Synthetic polypeptide
DEEEIRTTNPVATEQYGSVSTDLVNGQNERE

SEQ ID NO: 27272 - protein, 30 aa, Artificial Sequence
  Description of Artificial Sequence: Synthetic polypeptide
CEEEIRTTNPVATEQYGCVCSTNLQHGSND

SEQ ID NO: 27273 - protein, 30 aa, Artificial Sequence
  Description of Artificial Sequence: Synthetic polypeptide
SEEEIRTTNPVATEQYGSVSTNTLQMGIQD

SEQ ID NO: 27274 - protein, 31 aa, Artificial Sequence
  Description of Artificial Sequence: Synthetic polypeptide
DETEIRTTNPVATEQYGSVSTNLQGGGNTDL

SEQ ID NO: 27275 - protein, 29 aa, Artificial Sequence
  Description of Artificial Sequence: Synthetic peptide
DEEEIATTNPVAYEQYGVVATNLSQRVNR

SEQ ID NO: 27276 - protein, 30 aa, Artificial Sequence
  Description of Artificial Sequence: Synthetic polypeptide
AEEEIRTTNPVATEQYGSVSTNGGQDGGND

SEQ ID NO: 27277 - protein, 30 aa, Artificial Sequence
  Description of Artificial Sequence: Synthetic polypeptide
AEEEIRTTNPVATEQYGSVSTSNVNQLGNG

SEQ ID NO: 27278 - protein, 30 aa, Artificial Sequence
  Description of Artificial Sequence: Synthetic polypeptide
DETEIRTTNPVATEQYGSVSTNLDNNGNQD

SEQ ID NO: 27279 - protein, 31 aa, Artificial Sequence
  Description of Artificial Sequence: Synthetic polypeptide
DETEIRTTNPVATEQYGSVSTNLQGGMGNQL

SEQ ID NO: 27280 - protein, 32 aa, Artificial Sequence
  Description of Artificial Sequence: Synthetic polypeptide
DEEEIRTTNPVATEQYGSVSTSNLQAGTGNIE

SEQ ID NO: 27281 - protein, 31 aa, Artificial Sequence
  Description of Artificial Sequence: Synthetic polypeptide
DETEIRTTNPVATEQYGSVSTNLQGMQGNDG

SEQ ID NO: 27282 - protein, 32 aa, Artificial Sequence
  Description of Artificial Sequence: Synthetic polypeptide
DEEEIRTTNPVATEQYGSISTNLQRFGSNTDP

SEQ ID NO: 27283 - protein, 29 aa, Artificial Sequence
  Description of Artificial Sequence: Synthetic peptide
DENEIRTTNPVATEQYGSVSSNDERNNRD

SEQ ID NO: 27284 - protein, 31 aa, Artificial Sequence
  Description of Artificial Sequence: Synthetic polypeptide
AEEEIRTTNPVATEQYGSVSTTNLQNFNGNN

SEQ ID NO: 27285 - protein, 31 aa, Artificial Sequence
  Description of Artificial Sequence: Synthetic polypeptide
DEEEIRTTNPVATEQYGSVSTDLTQEPGDRS

SEQ ID NO: 27286 - protein, 30 aa, Artificial Sequence
  Description of Artificial Sequence: Synthetic polypeptide
DEDEIRTTNPVATEQYGDVSTNLQGEGDND

SEQ ID NO: 27287 - protein, 30 aa, Artificial Sequence
  Description of Artificial Sequence: Synthetic polypeptide
AEEEIRTTNPVATEQYGSVSTSNTQDNGNG

SEQ ID NO: 27288 - protein, 32 aa, Artificial Sequence
  Description of Artificial Sequence: Synthetic polypeptide
AEEEIRTTNPVATEQYGSVSTTNLQNEGGNER

SEQ ID NO: 27289 - protein, 30 aa, Artificial Sequence
  Description of Artificial Sequence: Synthetic polypeptide
AEEEIRTTNPVATEQYGSVSTNGEQEGGNT

SEQ ID NO: 27290 - protein, 31 aa, Artificial Sequence
  Description of Artificial Sequence: Synthetic polypeptide
DETEIRTTNPVATEQYGSVSTNLQGNDQNER

SEQ ID NO: 27291 - protein, 30 aa, Artificial Sequence
  Description of Artificial Sequence: Synthetic polypeptide
DEEEIRTTNPVATEQYGSISTNLQGVENDS

SEQ ID NO: 27292 - protein, 32 aa, Artificial Sequence
  Description of Artificial Sequence: Synthetic polypeptide
DEEEIRTTNPVATEQYGSVSTSNLQEIGNQGF

SEQ ID NO: 27293 - protein, 31 aa, Artificial Sequence
  Description of Artificial Sequence: Synthetic polypeptide
DEEEIRTTNPVATEQYGSVATNLQRNGEEGD

SEQ ID NO: 27294 - protein, 30 aa, Artificial Sequence
  Description of Artificial Sequence: Synthetic polypeptide
DETEIRTTNPVATEQYGSVSTNLDGNGNVN

SEQ ID NO: 27295 - protein, 31 aa, Artificial Sequence
  Description of Artificial Sequence: Synthetic polypeptide
DEEEIRTTNPVATEQYGSVSSTNLGNDEGNI

SEQ ID NO: 27296 - protein, 32 aa, Artificial Sequence
  Description of Artificial Sequence: Synthetic polypeptide
DETEIRTTNPVATEQYGSVSNTNLQLGGENAR

SEQ ID NO: 27297 - protein, 30 aa, Artificial Sequence
  Description of Artificial Sequence: Synthetic polypeptide
DEEEIRTTNPMATEQYGSVCQTNLQNGNNA

SEQ ID NO: 27298 - protein, 30 aa, Artificial Sequence
  Description of Artificial Sequence: Synthetic polypeptide
DETEIRTTNPVATEQYGSVSENTQRGENNL

SEQ ID NO: 27299 - protein, 32 aa, Artificial Sequence
  Description of Artificial Sequence: Synthetic polypeptide
SEEEIRTTNPVATEQYGSVSTNNLNQNGSNNR

SEQ ID NO: 27300 - protein, 29 aa, Artificial Sequence
  Description of Artificial Sequence: Synthetic peptide
SEMEIRTTNPVATEQYGTVSTNLVERGND

SEQ ID NO: 27301 - protein, 30 aa, Artificial Sequence
  Description of Artificial Sequence: Synthetic polypeptide
DETEIRTTNPVATEQYGSVSTANPEQGMNR

SEQ ID NO: 27302 - protein, 30 aa, Artificial Sequence
  Description of Artificial Sequence: Synthetic polypeptide
AEEEIRTTNPVATEQYGSVSTENLQQQNQM

SEQ ID NO: 27303 - protein, 31 aa, Artificial Sequence
  Description of Artificial Sequence: Synthetic polypeptide
DETEIRTTNPVATEQYGSVSTDNHLDQRGEG

SEQ ID NO: 27304 - protein, 30 aa, Artificial Sequence
  Description of Artificial Sequence: Synthetic polypeptide
SEEEIRTTNPVATEQYGSVSTNLTRNENFY

SEQ ID NO: 27305 - protein, 28 aa, Artificial Sequence
  Description of Artificial Sequence: Synthetic peptide
SEEEIRTTNPVATELFGSVNTNLQQGPR

SEQ ID NO: 27306 - protein, 31 aa, Artificial Sequence
  Description of Artificial Sequence: Synthetic polypeptide
DETEIRTTNPVATEQYGSVSTGPLQMDGNVR

SEQ ID NO: 27307 - protein, 31 aa, Artificial Sequence
  Description of Artificial Sequence: Synthetic polypeptide
DETEIRTTNPVATEQYGSVSTHNDPQMDGNR

SEQ ID NO: 27308 - protein, 31 aa, Artificial Sequence
  Description of Artificial Sequence: Synthetic polypeptide
SEEEIRTTNPVATEQYGSVSTNQLQQMGNQF

SEQ ID NO: 27309 - protein, 28 aa, Artificial Sequence
  Description of Artificial Sequence: Synthetic peptide
SEPEIRCTNPIATEQYGSVSENLMRGNR

SEQ ID NO: 27310 - protein, 31 aa, Artificial Sequence
  Description of Artificial Sequence: Synthetic polypeptide
DEEEIRTTNPVATEQYGSVCCTNMLSTSGNR

SEQ ID NO: 27311 - protein, 31 aa, Artificial Sequence
  Description of Artificial Sequence: Synthetic polypeptide
AEEEIRTTNPVATEQYGSVSTTNLQNGNQVS

SEQ ID NO: 27312 - protein, 28 aa, Artificial Sequence
  Description of Artificial Sequence: Synthetic peptide
SEMEIRCTNPVATEQYGSVSEGLMRGNR

SEQ ID NO: 27313 - protein, 32 aa, Artificial Sequence
  Description of Artificial Sequence: Synthetic polypeptide
DEEEIRTTNPVATEQYGSVSTSNLQFEMGNQI

SEQ ID NO: 27314 - protein, 30 aa, Artificial Sequence
  Description of Artificial Sequence: Synthetic polypeptide
DETEIRTTNPVATEQYGSVSTNDNGSGNSR

SEQ ID NO: 27315 - protein, 30 aa, Artificial Sequence
  Description of Artificial Sequence: Synthetic polypeptide
DEEEIRTTNPVATEQYGSVSLEPHQRPSNR

SEQ ID NO: 27316 - protein, 30 aa, Artificial Sequence
  Description of Artificial Sequence: Synthetic polypeptide
DETEIRTTNPVATEQYGSVSTNDNRDGQNQ

SEQ ID NO: 27317 - protein, 31 aa, Artificial Sequence
  Description of Artificial Sequence: Synthetic polypeptide
AEEEIRTTNPVATEQYGSVSTTNLQNGGNDF

SEQ ID NO: 27318 - protein, 30 aa, Artificial Sequence
  Description of Artificial Sequence: Synthetic polypeptide
DETEIRTTNPVATEQYGSVSTNGQGDGQND

SEQ ID NO: 27319 - protein, 32 aa, Artificial Sequence
  Description of Artificial Sequence: Synthetic polypeptide
DEVEIRTTNPVATEQYGSVSNTNGDQERGENR

SEQ ID NO: 27320 - protein, 30 aa, Artificial Sequence
  Description of Artificial Sequence: Synthetic polypeptide
DETEIRTTNPVATEQYGSVSTNLDGHNGNG

SEQ ID NO: 27321 - protein, 30 aa, Artificial Sequence
  Description of Artificial Sequence: Synthetic polypeptide
DETEIRTTNPVATEQYGSVSTNLDGNGNTD

SEQ ID NO: 27322 - protein, 31 aa, Artificial Sequence
  Description of Artificial Sequence: Synthetic polypeptide
DEEEIRTTNPVATEQYGSVSSTNLGNGFGNT

SEQ ID NO: 27323 - protein, 28 aa, Artificial Sequence
  Description of Artificial Sequence: Synthetic peptide
DETEIRTTNPVATEQYGSVQTALIEMNR

SEQ ID NO: 27324 - protein, 31 aa, Artificial Sequence
  Description of Artificial Sequence: Synthetic polypeptide
DEEEIRTTNPMATEQYGSVCATNLQRGTNQA

SEQ ID NO: 27325 - protein, 31 aa, Artificial Sequence
  Description of Artificial Sequence: Synthetic polypeptide
DEEEIRTTNPVATEQYGSVSTNMASQSGGND

SEQ ID NO: 27326 - protein, 30 aa, Artificial Sequence
  Description of Artificial Sequence: Synthetic polypeptide
DETEIRTTNPVATEQYGSVSTNLQHDNGGA

SEQ ID NO: 27327 - protein, 30 aa, Artificial Sequence
  Description of Artificial Sequence: Synthetic polypeptide
DETEIRTTNPVATEQYGSVSTNPQQGNGEA

SEQ ID NO: 27328 - protein, 31 aa, Artificial Sequence
  Description of Artificial Sequence: Synthetic polypeptide
DETEIRTTNPVATEQYGSVSTNQQRGENGED

SEQ ID NO: 27329 - protein, 31 aa, Artificial Sequence
  Description of Artificial Sequence: Synthetic polypeptide
DEEEIRTTNPVATEQYGSVCCTENLTYRGTR

SEQ ID NO: 27330 - protein, 28 aa, Artificial Sequence
  Description of Artificial Sequence: Synthetic peptide
SEPEIRCTNPVATEQYGSVGTNLQHGNQ

SEQ ID NO: 27331 - protein, 31 aa, Artificial Sequence
  Description of Artificial Sequence: Synthetic polypeptide
DEEEIRTTNPVATEQYGSVSTNSHQERNMDR

SEQ ID NO: 27332 - protein, 29 aa, Artificial Sequence
  Description of Artificial Sequence: Synthetic peptide
DEEEIRTTNPVATEQYGSVSTDMDQEGEE

SEQ ID NO: 27333 - protein, 31 aa, Artificial Sequence
  Description of Artificial Sequence: Synthetic polypeptide
DEEEIRTTNPVATEQYGSVSTNSHQERFVIR

SEQ ID NO: 27334 - protein, 28 aa, Artificial Sequence
  Description of Artificial Sequence: Synthetic peptide
SEMEIRCTNPIATEQYGSVSENLMRGNR

SEQ ID NO: 27335 - protein, 31 aa, Artificial Sequence
  Description of Artificial Sequence: Synthetic polypeptide
DEEEIRTTNPVATEQYGSVSTNSHQERDMER

SEQ ID NO: 27336 - protein, 29 aa, Artificial Sequence
  Description of Artificial Sequence: Synthetic peptide
DENVIGTTNPVATEQWGSVSTDLDQRGNR

SEQ ID NO: 27337 - protein, 31 aa, Artificial Sequence
  Description of Artificial Sequence: Synthetic polypeptide
DETEIRTTNPVATEQYGSVSTTNLQSPNERE

SEQ ID NO: 27338 - protein, 32 aa, Artificial Sequence
  Description of Artificial Sequence: Synthetic polypeptide
SEEEIRTTNPVATEQYGSVSTPNLPNRNGMNR

SEQ ID NO: 27339 - protein, 30 aa, Artificial Sequence
  Description of Artificial Sequence: Synthetic polypeptide
DEEEIRTTNPVATEQYGSVSTDDQANENGR

SEQ ID NO: 27340 - protein, 31 aa, Artificial Sequence
  Description of Artificial Sequence: Synthetic polypeptide
DEEEIRTTNPVATEQYGSVSTNSHQERDHIR

SEQ ID NO: 27341 - protein, 30 aa, Artificial Sequence
  Description of Artificial Sequence: Synthetic polypeptide
SEEEIRTTNPVATEHYGSVSTPNDQHGNHR

SEQ ID NO: 27342 - protein, 31 aa, Artificial Sequence
  Description of Artificial Sequence: Synthetic polypeptide
SEEEIRTTNPVATEQYGSVSTPNLQQGNEPA

SEQ ID NO: 27343 - protein, 32 aa, Artificial Sequence
  Description of Artificial Sequence: Synthetic polypeptide
SEEEIRTTNPVATEQYGSVSTSDLSQRGENDR

SEQ ID NO: 27344 - protein, 29 aa, Artificial Sequence
  Description of Artificial Sequence: Synthetic peptide
DENVIGTTNPVATEQWGSVSTDNLQLGNR

SEQ ID NO: 27345 - protein, 29 aa, Artificial Sequence
  Description of Artificial Sequence: Synthetic peptide
DEDEIRTTNPVATDQYGVVSTNLERGNQV

SEQ ID NO: 27346 - protein, 32 aa, Artificial Sequence
  Description of Artificial Sequence: Synthetic polypeptide
DEEEIRTTNPVATEQYGSVSTQNLGQNFGPNI

SEQ ID NO: 27347 - protein, 32 aa, Artificial Sequence
  Description of Artificial Sequence: Synthetic polypeptide
DEVEIRTTNPVATEQYGSVSTANGDQNRGGNR

SEQ ID NO: 27348 - protein, 29 aa, Artificial Sequence
  Description of Artificial Sequence: Synthetic peptide
DEEEIGTTNPVATEQYGCVGTYHQERGNR

SEQ ID NO: 27349 - protein, 29 aa, Artificial Sequence
  Description of Artificial Sequence: Synthetic peptide
DETEIRTTNPVATEQYGSVTEGLQRGNID

SEQ ID NO: 27350 - protein, 29 aa, Artificial Sequence
  Description of Artificial Sequence: Synthetic peptide
DETEIRTTNPVATEQYGSTSTNTQREGVG

SEQ ID NO: 27351 - protein, 32 aa, Artificial Sequence
  Description of Artificial Sequence: Synthetic polypeptide
SEEEIRTTNPVATEQYGSVSTSNLADRGENGR

SEQ ID NO: 27352 - protein, 31 aa, Artificial Sequence
  Description of Artificial Sequence: Synthetic polypeptide
DEEEIRTTNPVATEQYGSVSTNSDQERDEIR

SEQ ID NO: 27353 - protein, 31 aa, Artificial Sequence
  Description of Artificial Sequence: Synthetic polypeptide
DEEEIRTTNPVATEQYGSVSTNSHEERDNPR

SEQ ID NO: 27354 - protein, 29 aa, Artificial Sequence
  Description of Artificial Sequence: Synthetic peptide
DEECIRCTNPVATEQYGSVCSQNFQRGNL

SEQ ID NO: 27355 - protein, 29 aa, Artificial Sequence
  Description of Artificial Sequence: Synthetic peptide
DETEIRTTNPVATEQYGSVSTNPQDGDHG

SEQ ID NO: 27356 - protein, 31 aa, Artificial Sequence
  Description of Artificial Sequence: Synthetic polypeptide
DEEEIRTTNPVATEQYGSVATNLQRNPENPE

SEQ ID NO: 27357 - protein, 31 aa, Artificial Sequence
  Description of Artificial Sequence: Synthetic polypeptide
CEEEIRTTNPVATEQYGCVCSTNLQRFGSNE

SEQ ID NO: 27358 - protein, 33 aa, Artificial Sequence
  Description of Artificial Sequence: Synthetic polypeptide
DEEEIRTTNPVATEQYGSVSFTNDLQRGANDGI

SEQ ID NO: 27359 - protein, 30 aa, Artificial Sequence
  Description of Artificial Sequence: Synthetic polypeptide
AEEEIRTTNPVATEQYGSVSTNFLGEGGGR

SEQ ID NO: 27360 - protein, 32 aa, Artificial Sequence
  Description of Artificial Sequence: Synthetic polypeptide
DEEEIRTTNPVATEQYGSVSLTNLQRFPEMRE

SEQ ID NO: 27361 - protein, 29 aa, Artificial Sequence
  Description of Artificial Sequence: Synthetic peptide
DETEIRTTNPVATEQYGSVQTADLIRMNR

SEQ ID NO: 27362 - protein, 30 aa, Artificial Sequence
  Description of Artificial Sequence: Synthetic polypeptide
AEEEIRTTNPVATEQYGSVSTSNSNTGTNR

SEQ ID NO: 27363 - protein, 31 aa, Artificial Sequence
  Description of Artificial Sequence: Synthetic polypeptide
DETEIRTTNPVATEQYGSVSTNLQHEGNNDE

SEQ ID NO: 27364 - protein, 32 aa, Artificial Sequence
  Description of Artificial Sequence: Synthetic polypeptide
DEEEIRTTNPVATEQYGSVSTSNLQIGIGNME

SEQ ID NO: 27365 - protein, 31 aa, Artificial Sequence
  Description of Artificial Sequence: Synthetic polypeptide
DEVEIRTTNPVATEQYGSVSSTNLQQGGNET

SEQ ID NO: 27366 - protein, 31 aa, Artificial Sequence
  Description of Artificial Sequence: Synthetic polypeptide
DETEIRTTNPVATEQYGSVSTNLQHGDNPDE

SEQ ID NO: 27367 - protein, 31 aa, Artificial Sequence
  Description of Artificial Sequence: Synthetic polypeptide
SEEEIRTTNPVATEQYGSVSTNLQRENANEY

SEQ ID NO: 27368 - protein, 30 aa, Artificial Sequence
  Description of Artificial Sequence: Synthetic polypeptide
DETEIRTTNPVATEQYGSVNSTNTQNEGER

SEQ ID NO: 27369 - protein, 31 aa, Artificial Sequence
  Description of Artificial Sequence: Synthetic polypeptide
DEEEIGTTNPVATEQYGCVCSTNPLQFGSNR

SEQ ID NO: 27370 - protein, 31 aa, Artificial Sequence
  Description of Artificial Sequence: Synthetic polypeptide
DEEEIRTTNPVATEQYGSVSTNSHQERTPSR

SEQ ID NO: 27371 - protein, 30 aa, Artificial Sequence
  Description of Artificial Sequence: Synthetic polypeptide
AEEEIRTTNPVATEQYGSVSTSNQQTGNEL

SEQ ID NO: 27372 - protein, 28 aa, Artificial Sequence
  Description of Artificial Sequence: Synthetic peptide
AEQEIACTNPVATEQYGEVSTNLQRGGR

SEQ ID NO: 27373 - protein, 31 aa, Artificial Sequence
  Description of Artificial Sequence: Synthetic polypeptide
DETEIRTTNPVATEQYGSVSTNLQQGDGNDA

SEQ ID NO: 27374 - protein, 30 aa, Artificial Sequence
  Description of Artificial Sequence: Synthetic polypeptide
SEEEIRTTNPVATEQYGSVSTNLQFPSNDY

SEQ ID NO: 27375 - protein, 29 aa, Artificial Sequence
  Description of Artificial Sequence: Synthetic peptide
DENEIRTTNPVATEQYGSVSQNLNDNENR

SEQ ID NO: 27376 - protein, 31 aa, Artificial Sequence
  Description of Artificial Sequence: Synthetic polypeptide
SEEEIRTTNPVATEQYGSVSTPNLMMRGNPV

SEQ ID NO: 27377 - protein, 31 aa, Artificial Sequence
  Description of Artificial Sequence: Synthetic polypeptide
CEEEIRTTNPVATEQYGCVCSTNLQRGFNQP

SEQ ID NO: 27378 - protein, 31 aa, Artificial Sequence
  Description of Artificial Sequence: Synthetic polypeptide
DETEIRTTNPVATEQYGSVSTNLQSNDENTR

SEQ ID NO: 27379 - protein, 31 aa, Artificial Sequence
  Description of Artificial Sequence: Synthetic polypeptide
DEEEINTTNPVATEQYGSVSTNSLTQQRGEF

SEQ ID NO: 27380 - protein, 30 aa, Artificial Sequence
  Description of Artificial Sequence: Synthetic polypeptide
DETEIRTTNPVATEQYGSVSTNPERGNGEH

SEQ ID NO: 27381 - protein, 31 aa, Artificial Sequence
  Description of Artificial Sequence: Synthetic polypeptide
DEEEIRTTNPMATEQYGSVIATMNLQRGNEA

SEQ ID NO: 27382 - protein, 28 aa, Artificial Sequence
  Description of Artificial Sequence: Synthetic peptide
DETEIRTTNPVATEQYGSVDTNDCIGNV

SEQ ID NO: 27383 - protein, 30 aa, Artificial Sequence
  Description of Artificial Sequence: Synthetic polypeptide
AEEEIRTTNPVATEQYGSVSTNGNQEIGNQ

SEQ ID NO: 27384 - protein, 30 aa, Artificial Sequence
  Description of Artificial Sequence: Synthetic polypeptide
DETEIRTTNPVATEQYGSVSTNLQHDGGMD

SEQ ID NO: 27385 - protein, 30 aa, Artificial Sequence
  Description of Artificial Sequence: Synthetic polypeptide
AEEEIRTTNPVATEQYGSVSTNEQQMGNIN

SEQ ID NO: 27386 - protein, 30 aa, Artificial Sequence
  Description of Artificial Sequence: Synthetic polypeptide
SEEEIRTTNPVATEQYGSVSTNNTNQVGDR

SEQ ID NO: 27387 - protein, 31 aa, Artificial Sequence
  Description of Artificial Sequence: Synthetic polypeptide
CEEEIRTTNPVATEQYGVTVSCHNLQRGGNR

SEQ ID NO: 27388 - protein, 30 aa, Artificial Sequence
  Description of Artificial Sequence: Synthetic polypeptide
DEEEIRTTNPVATEQYGSVSTNMQEHRLDI

SEQ ID NO: 27389 - protein, 30 aa, Artificial Sequence
  Description of Artificial Sequence: Synthetic polypeptide
DEEEIRTTNPVATEQYGSTNSTVEQRGLRI

SEQ ID NO: 27390 - protein, 29 aa, Artificial Sequence
  Description of Artificial Sequence: Synthetic peptide
AEEEIRTTNPVATEQYGSVSTDVQQGINE

SEQ ID NO: 27391 - protein, 31 aa, Artificial Sequence
  Description of Artificial Sequence: Synthetic polypeptide
AEEEIRTTNPVATEQYGSVSTTNLQQGGNQL

SEQ ID NO: 27392 - protein, 31 aa, Artificial Sequence
  Description of Artificial Sequence: Synthetic polypeptide
DEEEINTTNPVATEQYGSVSTNDLFQVRGEE

SEQ ID NO: 27393 - protein, 31 aa, Artificial Sequence
  Description of Artificial Sequence: Synthetic polypeptide
DEEEIRTTNPVATEQYGSVCATTNLYGRGTR

SEQ ID NO: 27394 - protein, 30 aa, Artificial Sequence
  Description of Artificial Sequence: Synthetic polypeptide
DEVEIRTTNPVATEQWGSVSTNLQSGGNDN

SEQ ID NO: 27395 - protein, 30 aa, Artificial Sequence
  Description of Artificial Sequence: Synthetic polypeptide
DEEEIRTTNPVATEQYGSVSTDDLQRPEMD

SEQ ID NO: 27396 - protein, 30 aa, Artificial Sequence
  Description of Artificial Sequence: Synthetic polypeptide
CEEEIRTTNPVATEQYGCVSTNLQGSSNRD

SEQ ID NO: 27397 - protein, 31 aa, Artificial Sequence
  Description of Artificial Sequence: Synthetic polypeptide
DEEEIRTTNPVATEQYGSVSTDLQTDVGNIP

SEQ ID NO: 27398 - protein, 30 aa, Artificial Sequence
  Description of Artificial Sequence: Synthetic polypeptide
DEEEIRTTNPVATEQYGSVSTNDQFISNAY

SEQ ID NO: 27399 - protein, 31 aa, Artificial Sequence
  Description of Artificial Sequence: Synthetic polypeptide
SEEEIRTTNPVATEQYGSVSNTNLQQTGGTR

SEQ ID NO: 27400 - protein, 28 aa, Artificial Sequence
  Description of Artificial Sequence: Synthetic peptide
DEDEIRTTNPVATEQYGEIATNLQRGDS

SEQ ID NO: 27401 - protein, 28 aa, Artificial Sequence
  Description of Artificial Sequence: Synthetic peptide
SEQEIRCTNPIATEQYGSVSENLMRGNR

SEQ ID NO: 27402 - protein, 30 aa, Artificial Sequence
  Description of Artificial Sequence: Synthetic polypeptide
DEEEIRTTNPVATEQYGSVATNLQQANNTE

SEQ ID NO: 27403 - protein, 31 aa, Artificial Sequence
  Description of Artificial Sequence: Synthetic polypeptide
DEEEIRTTNPVATEQYGSVSTDLQSMGNPQY

SEQ ID NO: 27404 - protein, 30 aa, Artificial Sequence
  Description of Artificial Sequence: Synthetic polypeptide
DENEIRTTNPVATEQYGSVSGNLFRSNMNR

SEQ ID NO: 27405 - protein, 31 aa, Artificial Sequence
  Description of Artificial Sequence: Synthetic polypeptide
DEEEINTTNPVATEQYGSVSTNFLFQVRGEP

SEQ ID NO: 27406 - protein, 30 aa, Artificial Sequence
  Description of Artificial Sequence: Synthetic polypeptide
DEEEIRTTNPMATEQYGSVAATNLQHGNEA

SEQ ID NO: 27407 - protein, 30 aa, Artificial Sequence
  Description of Artificial Sequence: Synthetic polypeptide
SEEEIRTTNPVATEQYGSVSNNLTDTFGNR

SEQ ID NO: 27408 - protein, 31 aa, Artificial Sequence
  Description of Artificial Sequence: Synthetic polypeptide
DEEEIRTTNPVATEQYGSTNSTNLQERGQDS

SEQ ID NO: 27409 - protein, 31 aa, Artificial Sequence
  Description of Artificial Sequence: Synthetic polypeptide
SEEEIRTTNPVATEQYGSVSEPNLNRNGMNR

SEQ ID NO: 27410 - protein, 30 aa, Artificial Sequence
  Description of Artificial Sequence: Synthetic polypeptide
DEVEIRTTNPVATEQYGAVSTNLQTGTNDQ

SEQ ID NO: 27411 - protein, 30 aa, Artificial Sequence
  Description of Artificial Sequence: Synthetic polypeptide
DEEEIRTTNPVATEQYGSVSTNLVQVNEVV

SEQ ID NO: 27412 - protein, 30 aa, Artificial Sequence
  Description of Artificial Sequence: Synthetic polypeptide
DEEEIRTTNPVATEQYGSVATNLQPSNPSD

SEQ ID NO: 27413 - protein, 30 aa, Artificial Sequence
  Description of Artificial Sequence: Synthetic polypeptide
DEEEIRTTNPVATEQYGSVATNLQVDGEQP

SEQ ID NO: 27414 - protein, 31 aa, Artificial Sequence
  Description of Artificial Sequence: Synthetic polypeptide
AEEEIRTTNPVATEQYGSVSTTNLQQGNEIM

SEQ ID NO: 27415 - protein, 31 aa, Artificial Sequence
  Description of Artificial Sequence: Synthetic polypeptide
DEEEIRTTNPMATEQYGSVAATNLQRGPNMA

SEQ ID NO: 27416 - protein, 31 aa, Artificial Sequence
  Description of Artificial Sequence: Synthetic polypeptide
DEEEIRTTNPVATEQYGSVSTDDLQHVNSNR

SEQ ID NO: 27417 - protein, 31 aa, Artificial Sequence
  Description of Artificial Sequence: Synthetic polypeptide
DEAEISTTNPVATEQYGCVSTNLQERGNERE

SEQ ID NO: 27418 - protein, 30 aa, Artificial Sequence
  Description of Artificial Sequence: Synthetic polypeptide
AEEEIRTTNPVATEQYGSVSTSNNQQGNQQ

SEQ ID NO: 27419 - protein, 31 aa, Artificial Sequence
  Description of Artificial Sequence: Synthetic polypeptide
DEEEINTTNPVATEQYGSVSTNNLFQVRGQF

SEQ ID NO: 27420 - protein, 28 aa, Artificial Sequence
  Description of Artificial Sequence: Synthetic peptide
SEQEIRCTNPIATEQYGSVSTNLERGNL

SEQ ID NO: 27421 - protein, 28 aa, Artificial Sequence
  Description of Artificial Sequence: Synthetic peptide
DEEEIRTTNPTATEQYGSVPTTLARGSE

SEQ ID NO: 27422 - protein, 32 aa, Artificial Sequence
  Description of Artificial Sequence: Synthetic polypeptide
DEEEIGTTNPVATEQYGSVSDTNQLQERMGNQ

SEQ ID NO: 27423 - protein, 32 aa, Artificial Sequence
  Description of Artificial Sequence: Synthetic polypeptide
DEEEIRTTNPVATEQYGSVSTNTLIQEPGANN

SEQ ID NO: 27424 - protein, 31 aa, Artificial Sequence
  Description of Artificial Sequence: Synthetic polypeptide
DEEEIRTTNPVATEQYGSVSTSNLDDGEGNN

SEQ ID NO: 27425 - protein, 29 aa, Artificial Sequence
  Description of Artificial Sequence: Synthetic peptide
DEEEIRTTNPVATEQYGSVSTNPTAGPDE

SEQ ID NO: 27426 - protein, 32 aa, Artificial Sequence
  Description of Artificial Sequence: Synthetic polypeptide
DEEEIRTTNPVATEQYGSVSTNTLGQGNGNET

SEQ ID NO: 27427 - protein, 32 aa, Artificial Sequence
  Description of Artificial Sequence: Synthetic polypeptide
AEEEIRTTNPVATEQYGSVSTTNLQGQGTNRG

SEQ ID NO: 27428 - protein, 28 aa, Artificial Sequence
  Description of Artificial Sequence: Synthetic peptide
DETEIRTTNPVAYEQYGSVSTNPQHGMQ

SEQ ID NO: 27429 - protein, 30 aa, Artificial Sequence
  Description of Artificial Sequence: Synthetic polypeptide
DEEEIRTTNPVATEQYGSVCETNLQPNNYE

SEQ ID NO: 27430 - protein, 31 aa, Artificial Sequence
  Description of Artificial Sequence: Synthetic polypeptide
AEEEIRTTNPVATEQYGSVSTTGNTLQGGNT

SEQ ID NO: 27431 - protein, 29 aa, Artificial Sequence
  Description of Artificial Sequence: Synthetic peptide
AENEIRTTNPVATEQYGEVSENLQNRGGR

SEQ ID NO: 27432 - protein, 30 aa, Artificial Sequence
  Description of Artificial Sequence: Synthetic polypeptide
CEEEIRTTNPVATEQYGCVSTNLQHGSNAF

SEQ ID NO: 27433 - protein, 30 aa, Artificial Sequence
  Description of Artificial Sequence: Synthetic polypeptide
AEEEIRTTNPVATEQYGSVSTTNLQGQGQN

SEQ ID NO: 27434 - protein, 30 aa, Artificial Sequence
  Description of Artificial Sequence: Synthetic polypeptide
AEEEIRTTNPVATEQYGSVSTNDQSGNQLG

SEQ ID NO: 27435 - protein, 30 aa, Artificial Sequence
  Description of Artificial Sequence: Synthetic polypeptide
AEEEIRTTNPVATEQYGSVSTNDQRNANEY

SEQ ID NO: 27436 - protein, 28 aa, Artificial Sequence
  Description of Artificial Sequence: Synthetic peptide
DETEIRTTNPVATEIYGSVSVNLQSGTE

SEQ ID NO: 27437 - protein, 31 aa, Artificial Sequence
  Description of Artificial Sequence: Synthetic polypeptide
DEEEIGTTNPVATEQYGSVDTNLQRGSENHD

SEQ ID NO: 27438 - protein, 29 aa, Artificial Sequence
  Description of Artificial Sequence: Synthetic peptide
AENEIRTTNPVATEQYGSVATNLQIGSDR

SEQ ID NO: 27439 - protein, 29 aa, Artificial Sequence
  Description of Artificial Sequence: Synthetic peptide
DETEIRTTNPVATEEYGTVSTNLQGDGNQ

SEQ ID NO: 27440 - protein, 33 aa, Artificial Sequence
  Description of Artificial Sequence: Synthetic polypeptide
DEEEIRTTNPVATEQYGSTNSGTENLSQRIGNR

SEQ ID NO: 27441 - protein, 30 aa, Artificial Sequence
  Description of Artificial Sequence: Synthetic polypeptide
DEEEIRTTNPVATEQYGSVATNLQRDDDTM

SEQ ID NO: 27442 - protein, 32 aa, Artificial Sequence
  Description of Artificial Sequence: Synthetic polypeptide
DEEEIRTTNPVATEQYGSVSTNTHQERDNEIR

SEQ ID NO: 27443 - protein, 31 aa, Artificial Sequence
  Description of Artificial Sequence: Synthetic polypeptide
DETEIRTTNPVATECYGSVSTTNLDQRGNQD

SEQ ID NO: 27444 - protein, 31 aa, Artificial Sequence
  Description of Artificial Sequence: Synthetic polypeptide
DEEEIRTTNPVATEQYGSVSTQNLNTGGGNE

SEQ ID NO: 27445 - protein, 31 aa, Artificial Sequence
  Description of Artificial Sequence: Synthetic polypeptide
DEEEIRTTNPVATEQYGSVSTDLQSMEENRD

SEQ ID NO: 27446 - protein, 30 aa, Artificial Sequence
  Description of Artificial Sequence: Synthetic polypeptide
DEEEIRTTNPVATEQYGSVATNLQQGEDLV

SEQ ID NO: 27447 - protein, 31 aa, Artificial Sequence
  Description of Artificial Sequence: Synthetic polypeptide
DEEEIRTTNPVATEQYGSVATNLQQGNEGDD

SEQ ID NO: 27448 - protein, 32 aa, Artificial Sequence
  Description of Artificial Sequence: Synthetic polypeptide
DEEEIRTTNPVATEQYGSVSTDDNLQHFGEDR

SEQ ID NO: 27449 - protein, 28 aa, Artificial Sequence
  Description of Artificial Sequence: Synthetic peptide
AENEIACTNPVATEQYGSASTNLQRGGR

SEQ ID NO: 27450 - protein, 31 aa, Artificial Sequence
  Description of Artificial Sequence: Synthetic polypeptide
DEEEIRTTNPVATEQYGSVSTNTHQERQMIR

SEQ ID NO: 27451 - protein, 32 aa, Artificial Sequence
  Description of Artificial Sequence: Synthetic polypeptide
DEEEIRTTNPVATEQYGSVSTNPQREGDEQRQ

SEQ ID NO: 27452 - protein, 28 aa, Artificial Sequence
  Description of Artificial Sequence: Synthetic peptide
DEEEIRTTNPVATEQYGSVSTDDNSGED

SEQ ID NO: 27453 - protein, 29 aa, Artificial Sequence
  Description of Artificial Sequence: Synthetic peptide
DETEIRTTNPVAYEQYGNVSTNLQNGNQS

SEQ ID NO: 27454 - protein, 30 aa, Artificial Sequence
  Description of Artificial Sequence: Synthetic polypeptide
AEEEIRTTNPVATEQYGSVSTNGQTGNEQE

SEQ ID NO: 27455 - protein, 31 aa, Artificial Sequence
  Description of Artificial Sequence: Synthetic polypeptide
DEEEIRTTNPVATEQYGSVSTDLQSLGQNPM

SEQ ID NO: 27456 - protein, 29 aa, Artificial Sequence
  Description of Artificial Sequence: Synthetic peptide
DETEIRTTNPVAYEQYGNVSTNLQNGNTA

SEQ ID NO: 27457 - protein, 31 aa, Artificial Sequence
  Description of Artificial Sequence: Synthetic polypeptide
DEEEIRTTNPVATEQYGSVSSTNLIDTGNED

SEQ ID NO: 27458 - protein, 30 aa, Artificial Sequence
  Description of Artificial Sequence: Synthetic polypeptide
AEEEIRTTNPVATEQYGSVSTTNLQGNGTI

SEQ ID NO: 27459 - protein, 31 aa, Artificial Sequence
  Description of Artificial Sequence: Synthetic polypeptide
DEEEINTTNPVATEQYGSVSTNILPQVRGEF

SEQ ID NO: 27460 - protein, 31 aa, Artificial Sequence
  Description of Artificial Sequence: Synthetic polypeptide
DEEEIRTTNPVATEQYGSVSTNTHQERDELR

SEQ ID NO: 27461 - protein, 31 aa, Artificial Sequence
  Description of Artificial Sequence: Synthetic polypeptide
CEEEIRTTNPVATEQYGCVSTNHQRGGSNDR

SEQ ID NO: 27462 - protein, 30 aa, Artificial Sequence
  Description of Artificial Sequence: Synthetic polypeptide
SEEEIRTTNPVATEQYGSVSETTLQLGNPE

SEQ ID NO: 27463 - protein, 29 aa, Artificial Sequence
  Description of Artificial Sequence: Synthetic peptide
SEEEIRTTNPVATEMYGSVSTNLQGGPDS

SEQ ID NO: 27464 - protein, 31 aa, Artificial Sequence
  Description of Artificial Sequence: Synthetic polypeptide
DEEEIRTTNPVATEQYGSQVSTNPQRFQSNQ

SEQ ID NO: 27465 - protein, 31 aa, Artificial Sequence
  Description of Artificial Sequence: Synthetic polypeptide
DEEEIGTTNPVATEQYGSVITNQLQERMGNS

SEQ ID NO: 27466 - protein, 32 aa, Artificial Sequence
  Description of Artificial Sequence: Synthetic polypeptide
DEEEIRTTNPVATEQYGSVSTNPQPREGPNQD

SEQ ID NO: 27467 - protein, 30 aa, Artificial Sequence
  Description of Artificial Sequence: Synthetic polypeptide
AEEEIRTTNPVATEQYGSVSTSNNQAGNED

SEQ ID NO: 27468 - protein, 30 aa, Artificial Sequence
  Description of Artificial Sequence: Synthetic polypeptide
DETEIRTTNPVATEHYGSVSTNLQDNGDND

SEQ ID NO: 27469 - protein, 29 aa, Artificial Sequence
  Description of Artificial Sequence: Synthetic peptide
SEEEIRTTNPVATEMYGSVSTNLQNDDTR

SEQ ID NO: 27470 - protein, 29 aa, Artificial Sequence
  Description of Artificial Sequence: Synthetic peptide
DEPAIRTTNPVATEQYGSFCSTNLINGNR

SEQ ID NO: 27471 - protein, 31 aa, Artificial Sequence
  Description of Artificial Sequence: Synthetic polypeptide
DEEEINTTNPVATEQYGSVSTNHLDQVRGEF

SEQ ID NO: 27472 - protein, 30 aa, Artificial Sequence
  Description of Artificial Sequence: Synthetic polypeptide
SEEEIRTTNPVATEQYGSVSMDNLDEFGNR

SEQ ID NO: 27473 - protein, 30 aa, Artificial Sequence
  Description of Artificial Sequence: Synthetic polypeptide
CEEEIRTTNPVATEQYGCVSTELQRNSNRQ

SEQ ID NO: 27474 - protein, 30 aa, Artificial Sequence
  Description of Artificial Sequence: Synthetic polypeptide
SEEEIRTTNPVATEQYGSVSITNLDMQENR

SEQ ID NO: 27475 - protein, 31 aa, Artificial Sequence
  Description of Artificial Sequence: Synthetic polypeptide
DEEEIRTTNPMATEQYGSVPATGNLQRGNNA

SEQ ID NO: 27476 - protein, 28 aa, Artificial Sequence
  Description of Artificial Sequence: Synthetic peptide
DEECIRCTNPVATEQYGSVSANTQSGNL

SEQ ID NO: 27477 - protein, 31 aa, Artificial Sequence
  Description of Artificial Sequence: Synthetic polypeptide
DEEEIRTTNPVATEQYGSVSTDNDGQEEGND

SEQ ID NO: 27478 - protein, 33 aa, Artificial Sequence
  Description of Artificial Sequence: Synthetic polypeptide
DEEEIRTTNPVATEQYGSTCSMTENLSQRMGNR

SEQ ID NO: 27479 - protein, 30 aa, Artificial Sequence
  Description of Artificial Sequence: Synthetic polypeptide
DETEIRTTNPVAYEQYGSVSTNLQPNGNEQ

SEQ ID NO: 27480 - protein, 30 aa, Artificial Sequence
  Description of Artificial Sequence: Synthetic polypeptide
AEEEIRTTNPVATEQYGSVSTNDQQTGNLE

SEQ ID NO: 27481 - protein, 32 aa, Artificial Sequence
  Description of Artificial Sequence: Synthetic polypeptide
DEEEIRTTNPVATEQYGSTIMTENLEQRNGNR

SEQ ID NO: 27482 - protein, 31 aa, Artificial Sequence
  Description of Artificial Sequence: Synthetic polypeptide
DEEEIRTTNPVATEQYGSVSTQNLDNIGGNI

SEQ ID NO: 27483 - protein, 31 aa, Artificial Sequence
  Description of Artificial Sequence: Synthetic polypeptide
DEEEIRTTNPVATEQYGSVSEMLNLQRNIND

SEQ ID NO: 27484 - protein, 32 aa, Artificial Sequence
  Description of Artificial Sequence: Synthetic polypeptide
DETEIRTTNPVAYEQYGSVSTNALSQRTGNNR

SEQ ID NO: 27485 - protein, 31 aa, Artificial Sequence
  Description of Artificial Sequence: Synthetic polypeptide
DEEEIRTTNPMATEQYGSVAATNALQRGNQA

SEQ ID NO: 27486 - protein, 29 aa, Artificial Sequence
  Description of Artificial Sequence: Synthetic peptide
DEECIRTTNPVAYEQYGCVSTINNQRGNL

SEQ ID NO: 27487 - protein, 31 aa, Artificial Sequence
  Description of Artificial Sequence: Synthetic polypeptide
DEEEIGTTNPVATEQYGSVQTNDLQERMGNL

SEQ ID NO: 27488 - protein, 30 aa, Artificial Sequence
  Description of Artificial Sequence: Synthetic polypeptide
DEEEIRTTNPVATEQYGSVSTNQEEVENER

SEQ ID NO: 27489 - protein, 31 aa, Artificial Sequence
  Description of Artificial Sequence: Synthetic polypeptide
DEEEINTTNPVATEQYGSVSTNSLFQERGEQ

SEQ ID NO: 27490 - protein, 31 aa, Artificial Sequence
  Description of Artificial Sequence: Synthetic polypeptide
DEEEIRTTNPVATEQYGSVSTNPNQGSGSNI

SEQ ID NO: 27491 - protein, 32 aa, Artificial Sequence
  Description of Artificial Sequence: Synthetic polypeptide
DEEEIRTTNPVATEQYGSVSTQNLQAEMGNII

SEQ ID NO: 27492 - protein, 30 aa, Artificial Sequence
  Description of Artificial Sequence: Synthetic polypeptide
DEEEIATTNPVAYEQYGTVSTNLSQTTGNR

SEQ ID NO: 27493 - protein, 30 aa, Artificial Sequence
  Description of Artificial Sequence: Synthetic polypeptide
DEEEIRTTNPVATEQYGSVATNLQRQEQFI

SEQ ID NO: 27494 - protein, 30 aa, Artificial Sequence
  Description of Artificial Sequence: Synthetic polypeptide
DEEEIRTTNPVATEQYGSVSTNQNMGMNGE

SEQ ID NO: 27495 - protein, 32 aa, Artificial Sequence
  Description of Artificial Sequence: Synthetic polypeptide
DENEIRTTNPVATEQYGSVSTGNLQRFISNRQ

SEQ ID NO: 27496 - protein, 30 aa, Artificial Sequence
  Description of Artificial Sequence: Synthetic polypeptide
AEEEIRTTNPVATEQYGSVSTNEQGGNINE

SEQ ID NO: 27497 - protein, 31 aa, Artificial Sequence
  Description of Artificial Sequence: Synthetic polypeptide
DEEEIRTTNPVATEQYGSVSTNPPQFRDMIR

SEQ ID NO: 27498 - protein, 28 aa, Artificial Sequence
  Description of Artificial Sequence: Synthetic peptide
AENEIACTNPVATEQYGSVSENLQRGGR

SEQ ID NO: 27499 - protein, 31 aa, Artificial Sequence
  Description of Artificial Sequence: Synthetic polypeptide
DEEEINTTNPVATEQYGSVSTNSLEQTRGEF

SEQ ID NO: 27500 - protein, 31 aa, Artificial Sequence
  Description of Artificial Sequence: Synthetic polypeptide
SEEEIRTTNPVATEQYGSVSTDIQRGNNERN

SEQ ID NO: 27501 - protein, 29 aa, Artificial Sequence
  Description of Artificial Sequence: Synthetic peptide
AEEEIRTTNPVATEQYGSVSTNEELGNGE

SEQ ID NO: 27502 - protein, 30 aa, Artificial Sequence
  Description of Artificial Sequence: Synthetic polypeptide
SEEEIRTTNPVATEQYGSVSTANLQVTGAE

SEQ ID NO: 27503 - protein, 30 aa, Artificial Sequence
  Description of Artificial Sequence: Synthetic polypeptide
AEEEIRTTNPVATEQYGSVSTNEQEGNIFG

SEQ ID NO: 27504 - protein, 29 aa, Artificial Sequence
  Description of Artificial Sequence: Synthetic peptide
AEEEIRTTNPVATEQYGSVSTNEQEENIG

SEQ ID NO: 27505 - protein, 31 aa, Artificial Sequence
  Description of Artificial Sequence: Synthetic polypeptide
SEEEIRTTNPVATEQYGSVSTANLLQEVGNT

SEQ ID NO: 27506 - protein, 31 aa, Artificial Sequence
  Description of Artificial Sequence: Synthetic polypeptide
AEEEIRTTNPVATEQYGSVSTTDNLNQGGNN

SEQ ID NO: 27507 - protein, 30 aa, Artificial Sequence
  Description of Artificial Sequence: Synthetic polypeptide
DEEEIRTTNPVATEQYGSVATNLQRVEDEM

SEQ ID NO: 27508 - protein, 31 aa, Artificial Sequence
  Description of Artificial Sequence: Synthetic polypeptide
DEEEIRTTNPVATEQYGSVSTNMQGGGGNEG

SEQ ID NO: 27509 - protein, 28 aa, Artificial Sequence
  Description of Artificial Sequence: Synthetic peptide
DEECIRTTNPVAYEQYGCVSTNIQFGNE

SEQ ID NO: 27510 - protein, 30 aa, Artificial Sequence
  Description of Artificial Sequence: Synthetic polypeptide
SEEEIRTTNPVATEQYGSVSTDLEDREGNL

SEQ ID NO: 27511 - protein, 30 aa, Artificial Sequence
  Description of Artificial Sequence: Synthetic polypeptide
DEEEIRTTNPVATEQYGSVSTNPNQGGISQ

SEQ ID NO: 27512 - protein, 31 aa, Artificial Sequence
  Description of Artificial Sequence: Synthetic polypeptide
DEEEIRTTNPVATEQYGSVSSTNDQDGNGNG

SEQ ID NO: 27513 - protein, 31 aa, Artificial Sequence
  Description of Artificial Sequence: Synthetic polypeptide
DEEEIRTTNPVATEQYGSVSTNTDQMRDMIR

SEQ ID NO: 27514 - protein, 31 aa, Artificial Sequence
  Description of Artificial Sequence: Synthetic polypeptide
CEEEIRTTNPVATEQYGCVSTNLQRFGGNQS

SEQ ID NO: 27515 - protein, 31 aa, Artificial Sequence
  Description of Artificial Sequence: Synthetic polypeptide
DEVEIRTTNPVATEQYGEVSTNPLQGDGDNR

SEQ ID NO: 27516 - protein, 32 aa, Artificial Sequence
  Description of Artificial Sequence: Synthetic polypeptide
DEEEIRTTNPVATEQYGSVATNLQPNDGNPRA

SEQ ID NO: 27517 - protein, 29 aa, Artificial Sequence
  Description of Artificial Sequence: Synthetic peptide
DEEEIRTTNPVAAEQYGSVATNLQVFDSR

SEQ ID NO: 27518 - protein, 31 aa, Artificial Sequence
  Description of Artificial Sequence: Synthetic polypeptide
DEEEIRTTNPMATEQYGSVIETNLQRGNHVF

SEQ ID NO: 27519 - protein, 30 aa, Artificial Sequence
  Description of Artificial Sequence: Synthetic polypeptide
DEEEIRTTNPMATEQYGSVINTDLQRGNEQ

SEQ ID NO: 27520 - protein, 31 aa, Artificial Sequence
  Description of Artificial Sequence: Synthetic polypeptide
SEEEIRTTNPVATEQYGSVSENLPMMRNGNR

SEQ ID NO: 27521 - protein, 31 aa, Artificial Sequence
  Description of Artificial Sequence: Synthetic polypeptide
DEEEIRTTNPVATEQYGSSSSPNMLQRDNRM

SEQ ID NO: 27522 - protein, 30 aa, Artificial Sequence
  Description of Artificial Sequence: Synthetic polypeptide
DETEIRTTNPVAVEQYGSVISTNDQERNNR

SEQ ID NO: 27523 - protein, 29 aa, Artificial Sequence
  Description of Artificial Sequence: Synthetic peptide
AEQEIATTNPVATEQYGSVSTNLQRGGDL

SEQ ID NO: 27524 - protein, 31 aa, Artificial Sequence
  Description of Artificial Sequence: Synthetic polypeptide
DEEEIRTTNPVATEQYGSVSTNTFQEREMER

SEQ ID NO: 27525 - protein, 31 aa, Artificial Sequence
  Description of Artificial Sequence: Synthetic polypeptide
AEEEIRTTNPVATEQYGSVSTTNLQQEQGNP

SEQ ID NO: 27526 - protein, 29 aa, Artificial Sequence
  Description of Artificial Sequence: Synthetic peptide
AEEEIRTTNPVATEQYGSVSTTDEQEGNA

SEQ ID NO: 27527 - protein, 32 aa, Artificial Sequence
  Description of Artificial Sequence: Synthetic polypeptide
DEEEIRTTNPVATEQYGSSSMTENLSQNIGNR

SEQ ID NO: 27528 - protein, 30 aa, Artificial Sequence
  Description of Artificial Sequence: Synthetic polypeptide
CEEEIRTTNPVATEQYGCVSTNLQNNSNRA

SEQ ID NO: 27529 - protein, 28 aa, Artificial Sequence
  Description of Artificial Sequence: Synthetic peptide
AENEIRTTNPVATEQYGEASENLQRGGR

SEQ ID NO: 27530 - protein, 31 aa, Artificial Sequence
  Description of Artificial Sequence: Synthetic polypeptide
AEEEIRTTNPVATEQYGSVSTTNLQQGANDD

SEQ ID NO: 27531 - protein, 32 aa, Artificial Sequence
  Description of Artificial Sequence: Synthetic polypeptide
DEEEIRTTNPVATEQYGSSSMLTNLQENGENR

SEQ ID NO: 27532 - protein, 31 aa, Artificial Sequence
  Description of Artificial Sequence: Synthetic polypeptide
AEEEIRTTNPVATEQYGSVSTTDNLQNDGNE

SEQ ID NO: 27533 - protein, 30 aa, Artificial Sequence
  Description of Artificial Sequence: Synthetic polypeptide
DEEEIRTTNPVATEQYGSVATNLQRSEEGM

SEQ ID NO: 27534 - protein, 31 aa, Artificial Sequence
  Description of Artificial Sequence: Synthetic polypeptide
DEEEINTTNPVATEQYGSVSTNPLFQGRGEF

SEQ ID NO: 27535 - protein, 32 aa, Artificial Sequence
  Description of Artificial Sequence: Synthetic polypeptide
SEEEIRTTNPVATEQYGSVSSTENLMRNGMNR

SEQ ID NO: 27536 - protein, 31 aa, Artificial Sequence
  Description of Artificial Sequence: Synthetic polypeptide
DEEEIRTTNPVATEQYGSVSTQNLIGGGNNP

SEQ ID NO: 27537 - protein, 31 aa, Artificial Sequence
  Description of Artificial Sequence: Synthetic polypeptide
DEEEINTTNPVATEQYGSVSTNSLEQDRGEG

SEQ ID NO: 27538 - protein, 30 aa, Artificial Sequence
  Description of Artificial Sequence: Synthetic polypeptide
DEVEIRTTNPVATENYGSVSTNLQGGGGNI

SEQ ID NO: 27539 - protein, 29 aa, Artificial Sequence
  Description of Artificial Sequence: Synthetic peptide
DEDEIRTTNPTATEQYGQVSTNLQGGNQQ

SEQ ID NO: 27540 - protein, 31 aa, Artificial Sequence
  Description of Artificial Sequence: Synthetic polypeptide
DEEEINTTNPVATEQYGSVSTNPLFQERGEK

SEQ ID NO: 27541 - protein, 32 aa, Artificial Sequence
  Description of Artificial Sequence: Synthetic polypeptide
DEVEIRTTNPVATEQYGSVSTGDNLGQGGDNR

SEQ ID NO: 27542 - protein, 28 aa, Artificial Sequence
  Description of Artificial Sequence: Synthetic peptide
CEEEIRTTNPVATEQYGCVGTALQNGDR

SEQ ID NO: 27543 - protein, 28 aa, Artificial Sequence
  Description of Artificial Sequence: Synthetic peptide
DEEEIRTTNPTATEQYGSVPTQLARGDS

SEQ ID NO: 27544 - protein, 29 aa, Artificial Sequence
  Description of Artificial Sequence: Synthetic peptide
DEVEIRTTNPVATEQYGDISTNDQREGLR

SEQ ID NO: 27545 - protein, 30 aa, Artificial Sequence
  Description of Artificial Sequence: Synthetic polypeptide
AEEEIRTTNPVATEQYGSVSTNEGQQTGND

SEQ ID NO: 27546 - protein, 31 aa, Artificial Sequence
  Description of Artificial Sequence: Synthetic polypeptide
DEEEIRTTNPVATEQYGSVSTNTGQEADNIR

SEQ ID NO: 27547 - protein, 30 aa, Artificial Sequence
  Description of Artificial Sequence: Synthetic polypeptide
AEEEIRTTNPVATEQYGSVSTNEGQEGNIL

SEQ ID NO: 27548 - protein, 28 aa, Artificial Sequence
  Description of Artificial Sequence: Synthetic peptide
DEECIRCTNPVATEQYGSVQWNPQRGNL

SEQ ID NO: 27549 - protein, 31 aa, Artificial Sequence
  Description of Artificial Sequence: Synthetic polypeptide
AEEEIRTTNPVATEQYGSVSTTNLQQGNGLG

SEQ ID NO: 27550 - protein, 30 aa, Artificial Sequence
  Description of Artificial Sequence: Synthetic polypeptide
AEEEIRTTNPVATEQYGSVSTNEGQEDGNM

SEQ ID NO: 27551 - protein, 31 aa, Artificial Sequence
  Description of Artificial Sequence: Synthetic polypeptide
DEEEIGTTNPVATEQYGSVSGNALQERNGNL

SEQ ID NO: 27552 - protein, 30 aa, Artificial Sequence
  Description of Artificial Sequence: Synthetic polypeptide
DEEEIGTTNPVATEQYGSSSLPNDLQRDNR

SEQ ID NO: 27553 - protein, 31 aa, Artificial Sequence
  Description of Artificial Sequence: Synthetic polypeptide
SEEEIRTTNPVATEQYGSVSTYNLQNTINNR

SEQ ID NO: 27554 - protein, 29 aa, Artificial Sequence
  Description of Artificial Sequence: Synthetic peptide
AEEEIRTTNPVATEQYGSVSTNEGTVGNQ

SEQ ID NO: 27555 - protein, 30 aa, Artificial Sequence
  Description of Artificial Sequence: Synthetic polypeptide
DEEEIRTTNPVATEQYGSVATNLQRVPEMD

SEQ ID NO: 27556 - protein, 31 aa, Artificial Sequence
  Description of Artificial Sequence: Synthetic polypeptide
DEEEIRTTNPVATEQYGSVSEMNLQRGVAQN

SEQ ID NO: 27557 - protein, 30 aa, Artificial Sequence
  Description of Artificial Sequence: Synthetic polypeptide
DETEIRTTNPVATEQYGAVATNLQRGGNDQ

SEQ ID NO: 27558 - protein, 29 aa, Artificial Sequence
  Description of Artificial Sequence: Synthetic peptide
SEEEIRTTNPVATEQYGSVSTAGNRGMNV

SEQ ID NO: 27559 - protein, 30 aa, Artificial Sequence
  Description of Artificial Sequence: Synthetic polypeptide
SEEEIRTTNPVATEQYGSVSEPALPMRGNR

SEQ ID NO: 27560 - protein, 29 aa, Artificial Sequence
  Description of Artificial Sequence: Synthetic peptide
SEEEIRTTNPVATEQYGSVSTAGMRGMNV

SEQ ID NO: 27561 - protein, 30 aa, Artificial Sequence
  Description of Artificial Sequence: Synthetic polypeptide
AEEEIRTTNPVATEQYGSVSTNENQEGNMN

SEQ ID NO: 27562 - protein, 32 aa, Artificial Sequence
  Description of Artificial Sequence: Synthetic polypeptide
DEEEIRTTNPVATEQYGSVSGTNNLQSNGQGN

SEQ ID NO: 27563 - protein, 33 aa, Artificial Sequence
  Description of Artificial Sequence: Synthetic polypeptide
DEEEIRTTNPVATEQYGSVSGTNNLQSTGGQNQ

SEQ ID NO: 27564 - protein, 30 aa, Artificial Sequence
  Description of Artificial Sequence: Synthetic polypeptide
DEDEIRTTNPVAYEQWGSVSTNLQMGGDHR

SEQ ID NO: 27565 - protein, 31 aa, Artificial Sequence
  Description of Artificial Sequence: Synthetic polypeptide
DEEEIRTTNPVATEQYGSVSTMLQQGVVQVM

SEQ ID NO: 27566 - protein, 30 aa, Artificial Sequence
  Description of Artificial Sequence: Synthetic polypeptide
DEDEIRTTNPVATEQWGTSVSTALDRGNES

SEQ ID NO: 27567 - protein, 32 aa, Artificial Sequence
  Description of Artificial Sequence: Synthetic polypeptide
DEEEIRTTNPVATEQYGSVSGTNNMQGGGNNG

SEQ ID NO: 27568 - protein, 32 aa, Artificial Sequence
  Description of Artificial Sequence: Synthetic polypeptide
DEEEIRTTNPVATEQYGSVSNTMNLIRGVFVD

SEQ ID NO: 27569 - protein, 31 aa, Artificial Sequence
  Description of Artificial Sequence: Synthetic polypeptide
DEEEIRTTNPVATEQYGSVSTTNMLDRPEDI

SEQ ID NO: 27570 - protein, 33 aa, Artificial Sequence
  Description of Artificial Sequence: Synthetic polypeptide
DEEEIRTTNPVATEQYGSVSTNDLMQRGEEDGD

SEQ ID NO: 27571 - protein, 32 aa, Artificial Sequence
  Description of Artificial Sequence: Synthetic polypeptide
DEEEIRTTNPVATEQYGSVSTPNVIQGEGNED

SEQ ID NO: 27572 - protein, 33 aa, Artificial Sequence
  Description of Artificial Sequence: Synthetic polypeptide
DEEEIRTTNPVATEQYGSVSSTMNLIQNDEGNG

SEQ ID NO: 27573 - protein, 29 aa, Artificial Sequence
  Description of Artificial Sequence: Synthetic peptide
DEDEIRTTNPVATEQWGEVSTNDGQHGNK

SEQ ID NO: 27574 - protein, 31 aa, Artificial Sequence
  Description of Artificial Sequence: Synthetic polypeptide
DEEEIRTTNPVATEQYGSVSTNLETTSENQF

SEQ ID NO: 27575 - protein, 31 aa, Artificial Sequence
  Description of Artificial Sequence: Synthetic polypeptide
DEEEIRTTNPVATEQYGSVSELIEQRTENER

SEQ ID NO: 27576 - protein, 30 aa, Artificial Sequence
  Description of Artificial Sequence: Synthetic polypeptide
DEECIRTTNPVATEQYGCVSTNAHSQFGNS

SEQ ID NO: 27577 - protein, 31 aa, Artificial Sequence
  Description of Artificial Sequence: Synthetic polypeptide
DEEEIRTTNPVATEQYGSVPPVFNEQRGNEF

SEQ ID NO: 27578 - protein, 31 aa, Artificial Sequence
  Description of Artificial Sequence: Synthetic polypeptide
DEEEIRTTNPVATEQYGSVSTMLQQGEPGED

SEQ ID NO: 27579 - protein, 32 aa, Artificial Sequence
  Description of Artificial Sequence: Synthetic polypeptide
DEEEIRTTNPVATEQYGSVSPDTNLERDENME

SEQ ID NO: 27580 - protein, 32 aa, Artificial Sequence
  Description of Artificial Sequence: Synthetic polypeptide
DEEEIRTTNPVATEQYGSVSPETMLQRTNQVV

SEQ ID NO: 27581 - protein, 31 aa, Artificial Sequence
  Description of Artificial Sequence: Synthetic polypeptide
DEECISTTNPVATEQYGSVSTNLDQSNNERY

SEQ ID NO: 27582 - protein, 32 aa, Artificial Sequence
  Description of Artificial Sequence: Synthetic polypeptide
DEEEIRTTNPVATEQYGSVSTTVLQGMGINSE

SEQ ID NO: 27583 - protein, 29 aa, Artificial Sequence
  Description of Artificial Sequence: Synthetic peptide
DEDEIRTTNPVATEQYGETSTNLQHGDAD

SEQ ID NO: 27584 - protein, 31 aa, Artificial Sequence
  Description of Artificial Sequence: Synthetic polypeptide
DEEEIRTTNPVATEQYGSVSELIQERGENEG

SEQ ID NO: 27585 - protein, 32 aa, Artificial Sequence
  Description of Artificial Sequence: Synthetic polypeptide
DEEEIRTTNPVATEQYGSVSSTNQVQNNGNTV

SEQ ID NO: 27586 - protein, 33 aa, Artificial Sequence
  Description of Artificial Sequence: Synthetic polypeptide
DEEEIRTTNPVATEQYGSVSTTVNLQSGGTNGN

SEQ ID NO: 27587 - protein, 28 aa, Artificial Sequence
  Description of Artificial Sequence: Synthetic peptide
DEDEIRTTNPVATEQYGSVQTALIGNNN

SEQ ID NO: 27588 - protein, 30 aa, Artificial Sequence
  Description of Artificial Sequence: Synthetic polypeptide
DEEEIRTTNPVATEQYGSVSPNGLERIVEP

SEQ ID NO: 27589 - protein, 32 aa, Artificial Sequence
  Description of Artificial Sequence: Synthetic polypeptide
DEEEIRTTNPVATEQYGSVSTMNLDQQEGGGQ

SEQ ID NO: 27590 - protein, 34 aa, Artificial Sequence
  Description of Artificial Sequence: Synthetic polypeptide
DEEEIRTTNPVATEQYGSVSTTENLEQTSGNFRQ

SEQ ID NO: 27591 - protein, 32 aa, Artificial Sequence
  Description of Artificial Sequence: Synthetic polypeptide
DEEEIRTTNPVATEQYGSVSTSNLQFNNGQGG

SEQ ID NO: 27592 - protein, 31 aa, Artificial Sequence
  Description of Artificial Sequence: Synthetic polypeptide
DEEEIRTTNPVATEQYGSVNWTENDDRGNNI

SEQ ID NO: 27593 - protein, 31 aa, Artificial Sequence
  Description of Artificial Sequence: Synthetic polypeptide
DEEEIRTTNPVATEQYGSVSEQLQSMENNRQ

SEQ ID NO: 27594 - protein, 31 aa, Artificial Sequence
  Description of Artificial Sequence: Synthetic polypeptide
DEEEIRTTNPVATEQYGSVSTNDQFFNSDQE

SEQ ID NO: 27595 - protein, 33 aa, Artificial Sequence
  Description of Artificial Sequence: Synthetic polypeptide
DEEEIRTTNPVATEQYGSVSTTDNLQQEEGGNI

SEQ ID NO: 27596 - protein, 30 aa, Artificial Sequence
  Description of Artificial Sequence: Synthetic polypeptide
DEECIRTTNPVATEQYGCVSHTNDQGQGNA

SEQ ID NO: 27597 - protein, 29 aa, Artificial Sequence
  Description of Artificial Sequence: Synthetic peptide
DEEEIRTTNPVATEQYGSVSPNDQMNVQQ

SEQ ID NO: 27598 - protein, 32 aa, Artificial Sequence
  Description of Artificial Sequence: Synthetic polypeptide
DEEEIRTTNPVATEQYGSVSTMNGQIGFGNTV

SEQ ID NO: 27599 - protein, 31 aa, Artificial Sequence
  Description of Artificial Sequence: Synthetic polypeptide
DEEEIRTTNPVATEQYGSVSTPNNQRMEEDA

SEQ ID NO: 27600 - protein, 32 aa, Artificial Sequence
  Description of Artificial Sequence: Synthetic polypeptide
DEEEIRTTNPVATEQYGSVSPETNVQAMNMVR

SEQ ID NO: 27601 - protein, 32 aa, Artificial Sequence
  Description of Artificial Sequence: Synthetic polypeptide
DEEEIRTTNPVATEQYGSVSTMLQQEGGNGEN

SEQ ID NO: 27602 - protein, 30 aa, Artificial Sequence
  Description of Artificial Sequence: Synthetic polypeptide
DEDEIRTTNPVATEQYGCVSGTGLQRPNQD

SEQ ID NO: 27603 - protein, 32 aa, Artificial Sequence
  Description of Artificial Sequence: Synthetic polypeptide
DEEEIRTTNPVATEQYGSVSTMLQPNGNNGEE

SEQ ID NO: 27604 - protein, 33 aa, Artificial Sequence
  Description of Artificial Sequence: Synthetic polypeptide
DEEEIRTTNPVATEQYGSVSTSNLQIEGGNNEE

SEQ ID NO: 27605 - protein, 33 aa, Artificial Sequence
  Description of Artificial Sequence: Synthetic polypeptide
DEEEIRTTNPVATEQYGSVSTMNLDQSEGENGQ

SEQ ID NO: 27606 - protein, 32 aa, Artificial Sequence
  Description of Artificial Sequence: Synthetic polypeptide
DEEEIRTTNPVATEQYGSVSTTENLIRDNVTD

SEQ ID NO: 27607 - protein, 31 aa, Artificial Sequence
  Description of Artificial Sequence: Synthetic polypeptide
DEEEIRTTNPVATEQYGSVSSTNAIGTGGNQ

SEQ ID NO: 27608 - protein, 32 aa, Artificial Sequence
  Description of Artificial Sequence: Synthetic polypeptide
DEEEIRTTNPVATEQYGSVSSTMNLMGMGNFS

SEQ ID NO: 27609 - protein, 32 aa, Artificial Sequence
  Description of Artificial Sequence: Synthetic polypeptide
DEEEIRTTNPVATEQYGSVSTMNGQNNGNEGE

SEQ ID NO: 27610 - protein, 32 aa, Artificial Sequence
  Description of Artificial Sequence: Synthetic polypeptide
DEEEIRTTNPVATEQYGSVSSTNQNQNSGNGT

SEQ ID NO: 27611 - protein, 32 aa, Artificial Sequence
  Description of Artificial Sequence: Synthetic polypeptide
DEEEIRTTNPVATEQYGSVSPETGLQRSNQEL

SEQ ID NO: 27612 - protein, 33 aa, Artificial Sequence
  Description of Artificial Sequence: Synthetic polypeptide
DEEEIRTTNPVATEQYGSVSGTNLQGDEGNDTE

SEQ ID NO: 27613 - protein, 32 aa, Artificial Sequence
  Description of Artificial Sequence: Synthetic polypeptide
DEEEIRTTNPVATEQYGSVSTMNLDQNGGGQE

SEQ ID NO: 27614 - protein, 30 aa, Artificial Sequence
  Description of Artificial Sequence: Synthetic polypeptide
DEDEIACTNPVATEQYGSVATNLQRDGNDN

SEQ ID NO: 27615 - protein, 31 aa, Artificial Sequence
  Description of Artificial Sequence: Synthetic polypeptide
DEEEIRTTNPVATEQYGSVSTNDLHDGQEEK

SEQ ID NO: 27616 - protein, 30 aa, Artificial Sequence
  Description of Artificial Sequence: Synthetic polypeptide
DEDEIRTTNPVAYEQWGSVSTNLQPPGDAR

SEQ ID NO: 27617 - protein, 32 aa, Artificial Sequence
  Description of Artificial Sequence: Synthetic polypeptide
DEEEIRTTNPVATEQYGSVSNTNLQIGEIQGQ

SEQ ID NO: 27618 - protein, 32 aa, Artificial Sequence
  Description of Artificial Sequence: Synthetic polypeptide
DEEEIRTTNPVATEQYGSVSTNLISGFGENGQ

SEQ ID NO: 27619 - protein, 32 aa, Artificial Sequence
  Description of Artificial Sequence: Synthetic polypeptide
DEEEIRTTNPVATEQYGSVQCLNLQQGENGRQ

SEQ ID NO: 27620 - protein, 33 aa, Artificial Sequence
  Description of Artificial Sequence: Synthetic polypeptide
DEEEIRTTNPVATEQYGSVSGTNLQGEMGNGNS

SEQ ID NO: 27621 - protein, 32 aa, Artificial Sequence
  Description of Artificial Sequence: Synthetic polypeptide
DEEEIRTTNPVATEQYGSVYYTNDIDQKGGNR

SEQ ID NO: 27622 - protein, 31 aa, Artificial Sequence
  Description of Artificial Sequence: Synthetic polypeptide
DEEEIRTTNPVATEQYGSVSSTNADRDSERM

SEQ ID NO: 27623 - protein, 31 aa, Artificial Sequence
  Description of Artificial Sequence: Synthetic polypeptide
DEEEIRTTNPVATEQYGSVSPNGSQTGELRQ

SEQ ID NO: 27624 - protein, 30 aa, Artificial Sequence
  Description of Artificial Sequence: Synthetic polypeptide
DEEEIRTTNPVATEQYGSVSPNLGRVPIAE

SEQ ID NO: 27625 - protein, 33 aa, Artificial Sequence
  Description of Artificial Sequence: Synthetic polypeptide
DEEEIRTTNPVATEQYGSVSGTNNLQESGANEG

SEQ ID NO: 27626 - protein, 30 aa, Artificial Sequence
  Description of Artificial Sequence: Synthetic polypeptide
DEAEICTTNPVATENYGSVSTNLQANGNDD

SEQ ID NO: 27627 - protein, 32 aa, Artificial Sequence
  Description of Artificial Sequence: Synthetic polypeptide
DEEEIRTTNPVATEQYGSVSTTVLQSVGTNFN

SEQ ID NO: 27628 - protein, 32 aa, Artificial Sequence
  Description of Artificial Sequence: Synthetic polypeptide
DEEEIRTTNPVATEQYGSVSNTPLARGNDSIE

SEQ ID NO: 27629 - protein, 30 aa, Artificial Sequence
  Description of Artificial Sequence: Synthetic polypeptide
DEEEIRTTNPVATEQYGSVSTNDQATEDGD

SEQ ID NO: 27630 - protein, 31 aa, Artificial Sequence
  Description of Artificial Sequence: Synthetic polypeptide
DEEEIRTTNPVATEQYGSYSAPNIEQRGNEL

SEQ ID NO: 27631 - protein, 33 aa, Artificial Sequence
  Description of Artificial Sequence: Synthetic polypeptide
DEEEIRTTNPVATEQYGSVSGTNLQAQEGGNDT

SEQ ID NO: 27632 - protein, 31 aa, Artificial Sequence
  Description of Artificial Sequence: Synthetic polypeptide
DEEEIRTTNPVATEQYGSVVTNTLLQTGTVS

SEQ ID NO: 27633 - protein, 33 aa, Artificial Sequence
  Description of Artificial Sequence: Synthetic polypeptide
DEEEIRTTNPVATEQYGSVSSTMNLDQNGNVTT

SEQ ID NO: 27634 - protein, 33 aa, Artificial Sequence
  Description of Artificial Sequence: Synthetic polypeptide
DEEEIRTTNPVATEQYGSVSTMNLDQEGGENGI

SEQ ID NO: 27635 - protein, 32 aa, Artificial Sequence
  Description of Artificial Sequence: Synthetic polypeptide
DEEEIRTTNPVATEQYGSVSTSNNLNRGEELD

SEQ ID NO: 27636 - protein, 32 aa, Artificial Sequence
  Description of Artificial Sequence: Synthetic polypeptide
DEEEIRTTNPVATEQYGSVSSTNEVQSGGNTD

SEQ ID NO: 27637 - protein, 29 aa, Artificial Sequence
  Description of Artificial Sequence: Synthetic peptide
DEECIGTVNPVATEWYGSVSSNLERGSNR

SEQ ID NO: 27638 - protein, 32 aa, Artificial Sequence
  Description of Artificial Sequence: Synthetic polypeptide
DEEEIRTTNPVATEQYGSVSTTVLQNNGTNEN

SEQ ID NO: 27639 - protein, 28 aa, Artificial Sequence
  Description of Artificial Sequence: Synthetic peptide
DEECIGTVNPVATEWYGSVSYNLEHGNR

SEQ ID NO: 27640 - protein, 29 aa, Artificial Sequence
  Description of Artificial Sequence: Synthetic peptide
DEECIRTTNPVATEQYGCVSTELQGGSED

SEQ ID NO: 27641 - protein, 32 aa, Artificial Sequence
  Description of Artificial Sequence: Synthetic polypeptide
DEEEIRTTNPVATEQYGSVSDTWLYQESQNDR

SEQ ID NO: 27642 - protein, 29 aa, Artificial Sequence
  Description of Artificial Sequence: Synthetic peptide
DEEEIACTNPVATEQYGSVATNLTSGNVD

SEQ ID NO: 27643 - protein, 33 aa, Artificial Sequence
  Description of Artificial Sequence: Synthetic polypeptide
DEEEIRTTNPVATEQYGSVSTMNLDQDGNNNEG

SEQ ID NO: 27644 - protein, 29 aa, Artificial Sequence
  Description of Artificial Sequence: Synthetic peptide
DEEEIRTTNPVATEQYGSVYVTSLQTEEQ

SEQ ID NO: 27645 - protein, 32 aa, Artificial Sequence
  Description of Artificial Sequence: Synthetic polypeptide
DEEEIRTTNPVATEQYGSVSTTNMVQRAENDI

SEQ ID NO: 27646 - protein, 32 aa, Artificial Sequence
  Description of Artificial Sequence: Synthetic polypeptide
DEEEIRTTNPVATEQYGSVSTMNLDGNGGQNV

SEQ ID NO: 27647 - protein, 31 aa, Artificial Sequence
  Description of Artificial Sequence: Synthetic polypeptide
DEEEIRTTNPVATEQYGSVSTPNQNNGDNGE

SEQ ID NO: 27648 - protein, 30 aa, Artificial Sequence
  Description of Artificial Sequence: Synthetic polypeptide
DEEEIRTTNPVATEQYGSYSFNDQQRPEER

SEQ ID NO: 27649 - protein, 29 aa, Artificial Sequence
  Description of Artificial Sequence: Synthetic peptide
DEECIGTVNPVATEWYGSVSDNGLERGNR

SEQ ID NO: 27650 - protein, 29 aa, Artificial Sequence
  Description of Artificial Sequence: Synthetic peptide
DEDEIACTNPVATEQYGSVATNLQRADND

SEQ ID NO: 27651 - protein, 32 aa, Artificial Sequence
  Description of Artificial Sequence: Synthetic polypeptide
DEEEIRTTNPVATEQYGSVSTTVLQSFGENQN

SEQ ID NO: 27652 - protein, 32 aa, Artificial Sequence
  Description of Artificial Sequence: Synthetic polypeptide
DEEEIRTTNPVATEQYGSVSTMNLDFGGNNEQ

SEQ ID NO: 27653 - protein, 33 aa, Artificial Sequence
  Description of Artificial Sequence: Synthetic polypeptide
DEEEIRTTNPVATEQYGSVSGTNLQGEGGNGEQ

SEQ ID NO: 27654 - protein, 33 aa, Artificial Sequence
  Description of Artificial Sequence: Synthetic polypeptide
DEEEIRTTNPVATEQYGSVSSTMNELQNDGNGD

SEQ ID NO: 27655 - protein, 33 aa, Artificial Sequence
  Description of Artificial Sequence: Synthetic polypeptide
DEEEIRTTNPVATEQYGSVSGTNLQGDGGNGGN

SEQ ID NO: 27656 - protein, 33 aa, Artificial Sequence
  Description of Artificial Sequence: Synthetic polypeptide
DEEEIRTTNPVATEQYGSVSTTNNDNQERGNVE

SEQ ID NO: 27657 - protein, 33 aa, Artificial Sequence
  Description of Artificial Sequence: Synthetic polypeptide
DEEEIRTTNPVATEQYGSVSNTPGLQRLLENRS

SEQ ID NO: 27658 - protein, 32 aa, Artificial Sequence
  Description of Artificial Sequence: Synthetic polypeptide
DEEEIRTTNPVATEQYGSVSTTVLQSNGTNED

SEQ ID NO: 27659 - protein, 31 aa, Artificial Sequence
  Description of Artificial Sequence: Synthetic polypeptide
DEEEIRTTNPVATEQYGSVSDTWLYQDSQNP

SEQ ID NO: 27660 - protein, 32 aa, Artificial Sequence
  Description of Artificial Sequence: Synthetic polypeptide
DEEEIRTTNPVATEQYGSVSTTVLQQSGGGNN

SEQ ID NO: 27661 - protein, 29 aa, Artificial Sequence
  Description of Artificial Sequence: Synthetic peptide
DEEEIRTTNPVATEQYGSVSPEGQLGEQA

SEQ ID NO: 27662 - protein, 32 aa, Artificial Sequence
  Description of Artificial Sequence: Synthetic polypeptide
DEEEIRTTNPVATEQYGSVSNTELQTGGGNEG

SEQ ID NO: 27663 - protein, 32 aa, Artificial Sequence
  Description of Artificial Sequence: Synthetic polypeptide
DEEEIRTTNPVATEQYGSVSSTNEVQNSGNDD

SEQ ID NO: 27664 - protein, 32 aa, Artificial Sequence
  Description of Artificial Sequence: Synthetic polypeptide
DEEEIRTTNPVATEQYGSVSTTVLQSNGTNNV

SEQ ID NO: 27665 - protein, 32 aa, Artificial Sequence
  Description of Artificial Sequence: Synthetic polypeptide
DEEEIRTTNPVATEQYGSVSNTNDLQGEGVIM

SEQ ID NO: 27666 - protein, 29 aa, Artificial Sequence
  Description of Artificial Sequence: Synthetic peptide
DEDEIRTTNPVATEQYGETSTNLQNGDSE

SEQ ID NO: 27667 - protein, 33 aa, Artificial Sequence
  Description of Artificial Sequence: Synthetic polypeptide
DEEEIRTTNPVATEQYGSVYVTNPLQIRGENLQ

SEQ ID NO: 27668 - protein, 32 aa, Artificial Sequence
  Description of Artificial Sequence: Synthetic polypeptide
DEEEIRTTNPVATEQYGSVSSTNQQQGNIGNT

SEQ ID NO: 27669 - protein, 32 aa, Artificial Sequence
  Description of Artificial Sequence: Synthetic polypeptide
DEEEIRTTNPVATEQYGSVSPEGNLQRGFTGN

SEQ ID NO: 27670 - protein, 33 aa, Artificial Sequence
  Description of Artificial Sequence: Synthetic polypeptide
DEEEIRTTNPVATEQYGSVSGTNNLQSEMGNGF

SEQ ID NO: 27671 - protein, 31 aa, Artificial Sequence
  Description of Artificial Sequence: Synthetic polypeptide
DEEEIRTTNPVATEQYGSVSTTNNDQEEGQD

SEQ ID NO: 27672 - protein, 31 aa, Artificial Sequence
  Description of Artificial Sequence: Synthetic polypeptide
DEEEIRTTNPVATEQYGSVSPNGQREIENIP

SEQ ID NO: 27673 - protein, 30 aa, Artificial Sequence
  Description of Artificial Sequence: Synthetic polypeptide
DEECISTTNPVATEGYGSVNTNALQRFGNQ

SEQ ID NO: 27674 - protein, 31 aa, Artificial Sequence
  Description of Artificial Sequence: Synthetic polypeptide
DEEEIRTTNPVATEQYGSVSELMIQRGENEN

SEQ ID NO: 27675 - protein, 29 aa, Artificial Sequence
  Description of Artificial Sequence: Synthetic peptide
DEDEIRTTNPVATEQYGELSTELQRGDDQ

SEQ ID NO: 27676 - protein, 33 aa, Artificial Sequence
  Description of Artificial Sequence: Synthetic polypeptide
DEEEIRTTNPVATEQYGSVSPENLQNTGLENRL

SEQ ID NO: 27677 - protein, 32 aa, Artificial Sequence
  Description of Artificial Sequence: Synthetic polypeptide
DEEEIRTTNPVATEQYGSVSNTNLQVGEELDS

SEQ ID NO: 27678 - protein, 31 aa, Artificial Sequence
  Description of Artificial Sequence: Synthetic polypeptide
DEDEIRTTNPVAYEQWGSVSTNLQRDGDMND

SEQ ID NO: 27679 - protein, 32 aa, Artificial Sequence
  Description of Artificial Sequence: Synthetic polypeptide
DEEEIRTTNPVATEQYGSVSPNGLQQRQGLQP

SEQ ID NO: 27680 - protein, 31 aa, Artificial Sequence
  Description of Artificial Sequence: Synthetic polypeptide
DEEEIRTTNPVATEQYGSWCSSPNMHQRDNR

SEQ ID NO: 27681 - protein, 32 aa, Artificial Sequence
  Description of Artificial Sequence: Synthetic polypeptide
DEEEIRTTNPVATEQYGSVPPTTNLQRGQVEF

SEQ ID NO: 27682 - protein, 33 aa, Artificial Sequence
  Description of Artificial Sequence: Synthetic polypeptide
DEEEIRTTNPVATEQYGSVSNTNDAQHRGSENM

SEQ ID NO: 27683 - protein, 31 aa, Artificial Sequence
  Description of Artificial Sequence: Synthetic polypeptide
DEECIRTTNPVATEQYYASVCSWNLQNGDNR

SEQ ID NO: 27684 - protein, 33 aa, Artificial Sequence
  Description of Artificial Sequence: Synthetic polypeptide
DEEEIRTTNPVATEQYGSVSTMNLDQGTGENED

SEQ ID NO: 27685 - protein, 33 aa, Artificial Sequence
  Description of Artificial Sequence: Synthetic polypeptide
DEEEIRTTNPVATEQYGSVSTMNLDQLNGENNM

SEQ ID NO: 27686 - protein, 33 aa, Artificial Sequence
  Description of Artificial Sequence: Synthetic polypeptide
DEEEIRTTNPVATEQYGSVSTPNPLQNLSNIRE

SEQ ID NO: 27687 - protein, 29 aa, Artificial Sequence
  Description of Artificial Sequence: Synthetic peptide
DEEEIRTTNPVATEQYGSVQINDQREDYI

SEQ ID NO: 27688 - protein, 31 aa, Artificial Sequence
  Description of Artificial Sequence: Synthetic polypeptide
DEEEIRTTNPVATEQYGSVVSTNVDLFTNNT

SEQ ID NO: 27689 - protein, 31 aa, Artificial Sequence
  Description of Artificial Sequence: Synthetic polypeptide
DEEEIRTTNPVATEQYGSWCSWPNPLQRDNQ

SEQ ID NO: 27690 - protein, 33 aa, Artificial Sequence
  Description of Artificial Sequence: Synthetic polypeptide
DEEEIRTTNPVATEQYGSVSGTNNLQSEGGNNP

SEQ ID NO: 27691 - protein, 32 aa, Artificial Sequence
  Description of Artificial Sequence: Synthetic polypeptide
DEEEIRTTNPVATEQYGSVSETENLQIGIQGL

SEQ ID NO: 27692 - protein, 32 aa, Artificial Sequence
  Description of Artificial Sequence: Synthetic polypeptide
DEEEIRTTNPVATEQYGSVSTPNNQRTMEERQ

SEQ ID NO: 27693 - protein, 32 aa, Artificial Sequence
  Description of Artificial Sequence: Synthetic polypeptide
DEEEIRTTNPVATEQYGSVSLTNLQNSGELLN

SEQ ID NO: 27694 - protein, 32 aa, Artificial Sequence
  Description of Artificial Sequence: Synthetic polypeptide
DEEEIRTTNPVATEQYGSVSDTWLYQMEQNRI

SEQ ID NO: 27695 - protein, 32 aa, Artificial Sequence
  Description of Artificial Sequence: Synthetic polypeptide
DEEEIRTTNPVATEQYGSVSNTMNNQIGGNEV

SEQ ID NO: 27696 - protein, 31 aa, Artificial Sequence
  Description of Artificial Sequence: Synthetic polypeptide
DEEEIRTTNPVATEQYGSVSTTNNLEREDID

SEQ ID NO: 27697 - protein, 31 aa, Artificial Sequence
  Description of Artificial Sequence: Synthetic polypeptide
DEDEIRTTNPVATEQYGSVSDTWLYQRSQND

SEQ ID NO: 27698 - protein, 33 aa, Artificial Sequence
  Description of Artificial Sequence: Synthetic polypeptide
DEEEIRTTNPVATEQYGSVSTMNLDQEIGENDD

SEQ ID NO: 27699 - protein, 28 aa, Artificial Sequence
  Description of Artificial Sequence: Synthetic peptide
DEDEIRTTNPVATEQYGECATNLQQGDS

SEQ ID NO: 27700 - protein, 32 aa, Artificial Sequence
  Description of Artificial Sequence: Synthetic polypeptide
DEEEIRTTNPVATEQYGSVSTTNNGGQTGNQF

SEQ ID NO: 27701 - protein, 31 aa, Artificial Sequence
  Description of Artificial Sequence: Synthetic polypeptide
DEEEIRTTNPVATEQYGSVSPNLQEGLEVDD

SEQ ID NO: 27702 - protein, 32 aa, Artificial Sequence
  Description of Artificial Sequence: Synthetic polypeptide
DEEEIRTTNPVATEQYGSVSTMNLDDPEGNNQ

SEQ ID NO: 27703 - protein, 32 aa, Artificial Sequence
  Description of Artificial Sequence: Synthetic polypeptide
DEEEIRTTNPVATEQYGSVSTMNLANFGSNQS

SEQ ID NO: 27704 - protein, 31 aa, Artificial Sequence
  Description of Artificial Sequence: Synthetic polypeptide
DEEEIRTTNPVATEQYGSVYTVNENRGEDFR

SEQ ID NO: 27705 - protein, 32 aa, Artificial Sequence
  Description of Artificial Sequence: Synthetic polypeptide
DEEEIRTTNPVATEQYGSVSSTNQVQNLGINE

SEQ ID NO: 27706 - protein, 32 aa, Artificial Sequence
  Description of Artificial Sequence: Synthetic polypeptide
DEEEIRTTNPVATEQYGSVPWTDNLQRGVTEF

SEQ ID NO: 27707 - protein, 32 aa, Artificial Sequence
  Description of Artificial Sequence: Synthetic polypeptide
DEEEIRTTNPVATEQYGSVSTTNNGGQEGNQF

SEQ ID NO: 27708 - protein, 31 aa, Artificial Sequence
  Description of Artificial Sequence: Synthetic polypeptide
DEEEIRTTNPVATEQYGSVVTPNGQAEGEER

SEQ ID NO: 27709 - protein, 31 aa, Artificial Sequence
  Description of Artificial Sequence: Synthetic polypeptide
DEEEIRTTNPVATEQYGSVSTTGLGQGSQND

SEQ ID NO: 27710 - protein, 32 aa, Artificial Sequence
  Description of Artificial Sequence: Synthetic polypeptide
DEEEIRTTNPVATEQYGSVSTMNLDQGDNGEL

SEQ ID NO: 27711 - protein, 29 aa, Artificial Sequence
  Description of Artificial Sequence: Synthetic peptide
DEDEIATTNPVATEQWGSVATNDQRGNDN

SEQ ID NO: 27712 - protein, 30 aa, Artificial Sequence
  Description of Artificial Sequence: Synthetic polypeptide
DEEEIRTTNPVATEQYGSVNVTNVDRNNNE

SEQ ID NO: 27713 - protein, 29 aa, Artificial Sequence
  Description of Artificial Sequence: Synthetic peptide
DEDEIRTTNPVATEQYGECSTNSLQQGGS

SEQ ID NO: 27714 - protein, 31 aa, Artificial Sequence
  Description of Artificial Sequence: Synthetic polypeptide
DEEEIRTTNPVATEQYGSVSTTNNGGQQGQV

SEQ ID NO: 27715 - protein, 32 aa, Artificial Sequence
  Description of Artificial Sequence: Synthetic polypeptide
DEEEIRTTNPVATEQYGSVSSTNEVQSGNIDG

SEQ ID NO: 27716 - protein, 33 aa, Artificial Sequence
  Description of Artificial Sequence: Synthetic polypeptide
DEEEIRTTNPVATEQYGSVSTMNLDQGNGNDNQ

SEQ ID NO: 27717 - protein, 30 aa, Artificial Sequence
  Description of Artificial Sequence: Synthetic polypeptide
DEAEICTTNPVATEQWGSVSTLNLQADGNF

SEQ ID NO: 27718 - protein, 32 aa, Artificial Sequence
  Description of Artificial Sequence: Synthetic polypeptide
DEEEIRTTNPVATEQYGSVSNTENLETGSQRS

SEQ ID NO: 27719 - protein, 29 aa, Artificial Sequence
  Description of Artificial Sequence: Synthetic peptide
DEEEIRTTNPVATEQYGSVPMPLQTNENT

SEQ ID NO: 27720 - protein, 30 aa, Artificial Sequence
  Description of Artificial Sequence: Synthetic polypeptide
DEDEIATTNPVATEQWGSVATNLQQGNDRD

SEQ ID NO: 27721 - protein, 30 aa, Artificial Sequence
  Description of Artificial Sequence: Synthetic polypeptide
DEDEIRTTNPVAYEQWGSVSTNLQTGGDER

SEQ ID NO: 27722 - protein, 33 aa, Artificial Sequence
  Description of Artificial Sequence: Synthetic polypeptide
DEEEIRTTNPVATEQYGSVSPENDLQRGVNDVD

SEQ ID NO: 27723 - protein, 30 aa, Artificial Sequence
  Description of Artificial Sequence: Synthetic polypeptide
DEEEIRTTNPVATEQYGSVPLPLQRGVQVL

SEQ ID NO: 27724 - protein, 32 aa, Artificial Sequence
  Description of Artificial Sequence: Synthetic polypeptide
DEEEIRTTNPVATEQYGSVSSTNQVQNLGNGQ

SEQ ID NO: 27725 - protein, 33 aa, Artificial Sequence
  Description of Artificial Sequence: Synthetic polypeptide
DEEEIRTTNPVATEQYGSVSGTNNLQGGSGNGT

SEQ ID NO: 27726 - protein, 32 aa, Artificial Sequence
  Description of Artificial Sequence: Synthetic polypeptide
DEEEIRTTNPVATEQYGSVQIPTNLQPQGEIR

SEQ ID NO: 27727 - protein, 32 aa, Artificial Sequence
  Description of Artificial Sequence: Synthetic polypeptide
DEEEIRTTNPVATEQYGSVSNTGLNQRLQENG

SEQ ID NO: 27728 - protein, 32 aa, Artificial Sequence
  Description of Artificial Sequence: Synthetic polypeptide
DEEEIRTTNPVATEQYGSVSTMLQQIGINGEA

SEQ ID NO: 27729 - protein, 33 aa, Artificial Sequence
  Description of Artificial Sequence: Synthetic polypeptide
DEEEIRTTNPVATEQYGSVSGTTNLQESGNGQQ

SEQ ID NO: 27730 - protein, 32 aa, Artificial Sequence
  Description of Artificial Sequence: Synthetic polypeptide
DEEEIRTTNPVATEQYGSVSTMNGGDQNGGNV

SEQ ID NO: 27731 - protein, 32 aa, Artificial Sequence
  Description of Artificial Sequence: Synthetic polypeptide
DEEEIRTTNPVATEQYGSVSNTNNDGQNEGNG

SEQ ID NO: 27732 - protein, 32 aa, Artificial Sequence
  Description of Artificial Sequence: Synthetic polypeptide
DEEEIRTTNPVATEQYGSVSTTTLLQQNSQNR

SEQ ID NO: 27733 - protein, 32 aa, Artificial Sequence
  Description of Artificial Sequence: Synthetic polypeptide
DEEEIRTTNPVATEQYGSVSTSNLDDIEGNTD

SEQ ID NO: 27734 - protein, 33 aa, Artificial Sequence
  Description of Artificial Sequence: Synthetic polypeptide
DEEEIRTTNPVATEQYGSVSTTADAQRNGNVRL

SEQ ID NO: 27735 - protein, 28 aa, Artificial Sequence
  Description of Artificial Sequence: Synthetic peptide
DEAEIRTTNPVATDHYGSVSTELQRTDM

SEQ ID NO: 27736 - protein, 31 aa, Artificial Sequence
  Description of Artificial Sequence: Synthetic polypeptide
DEEEIRTTNPVATEQYGSVSPINEQLLVNQR

SEQ ID NO: 27737 - protein, 31 aa, Artificial Sequence
  Description of Artificial Sequence: Synthetic polypeptide
DEEEIRTTNPVATEQYGSVSTMLSQPNEDRI

SEQ ID NO: 27738 - protein, 32 aa, Artificial Sequence
  Description of Artificial Sequence: Synthetic polypeptide
DEEEIRTTNPVATEQYGSVSGTNLNIIGNGNQ

SEQ ID NO: 27739 - protein, 32 aa, Artificial Sequence
  Description of Artificial Sequence: Synthetic polypeptide
DEEEIRTTNPVATEQYGSVSSTPALQMSGMNV

SEQ ID NO: 27740 - protein, 32 aa, Artificial Sequence
  Description of Artificial Sequence: Synthetic polypeptide
DEAEIRTTNPVATEQYGSVYSTSNLQVEGNIV

SEQ ID NO: 27741 - protein, 31 aa, Artificial Sequence
  Description of Artificial Sequence: Synthetic polypeptide
DEEEIRTTNPVATEQYGSWSLPVGLQRDNRN

SEQ ID NO: 27742 - protein, 32 aa, Artificial Sequence
  Description of Artificial Sequence: Synthetic polypeptide
DEEEIRTTNPVATEQYGSVSTNEHSQERDPDR

SEQ ID NO: 27743 - protein, 33 aa, Artificial Sequence
  Description of Artificial Sequence: Synthetic polypeptide
DEEEIRTTNPVATEQYGSVSTNEHSQERPPINR

SEQ ID NO: 27744 - protein, 33 aa, Artificial Sequence
  Description of Artificial Sequence: Synthetic polypeptide
DEEEIRTTNPVATEQYGSVSGTTNLQNIGVNDP

SEQ ID NO: 27745 - protein, 33 aa, Artificial Sequence
  Description of Artificial Sequence: Synthetic polypeptide
DEEEIRTTNPVATEQYGSVSNTNLQQIGQNEGG

SEQ ID NO: 27746 - protein, 32 aa, Artificial Sequence
  Description of Artificial Sequence: Synthetic polypeptide
DEEEIRTTNPVATEQYGSVSTMNGEQGEGGNQ

SEQ ID NO: 27747 - protein, 32 aa, Artificial Sequence
  Description of Artificial Sequence: Synthetic polypeptide
DEEEIRTTNPVATEQYGSVVTGNLQREGIDMD

SEQ ID NO: 27748 - protein, 30 aa, Artificial Sequence
  Description of Artificial Sequence: Synthetic polypeptide
DEDEIRTTNPVATEQYGETCSTNLSQRGDS

SEQ ID NO: 27749 - protein, 32 aa, Artificial Sequence
  Description of Artificial Sequence: Synthetic polypeptide
DEECIRTTNPVATEQYGESVSINLQDKGGDNR

SEQ ID NO: 27750 - protein, 32 aa, Artificial Sequence
  Description of Artificial Sequence: Synthetic polypeptide
DEEEIRTTNPVATEQYGSVSTMNDDQEEGGNS

SEQ ID NO: 27751 - protein, 32 aa, Artificial Sequence
  Description of Artificial Sequence: Synthetic polypeptide
DEEEIRTTNPVATEQYGSVSTMMDQQGVNQRQ

SEQ ID NO: 27752 - protein, 33 aa, Artificial Sequence
  Description of Artificial Sequence: Synthetic polypeptide
DEEEIRTTNPVATEQYGSVSTNLIGRNGDIIRQ

SEQ ID NO: 27753 - protein, 31 aa, Artificial Sequence
  Description of Artificial Sequence: Synthetic polypeptide
DEECIRTTNPVATEQYGESYSGDNHQRGDNR

SEQ ID NO: 27754 - protein, 32 aa, Artificial Sequence
  Description of Artificial Sequence: Synthetic polypeptide
DEEEIRTTNPVATEQYGSVSTMNELQGEMNEP

SEQ ID NO: 27755 - protein, 32 aa, Artificial Sequence
  Description of Artificial Sequence: Synthetic polypeptide
DEEEIRTTNPVATEQYGSVSEMLDQRNGDNDM

SEQ ID NO: 27756 - protein, 33 aa, Artificial Sequence
  Description of Artificial Sequence: Synthetic polypeptide
DEEEIRTTNPVATEQYGSVSTMNELQGSGNNTE

SEQ ID NO: 27757 - protein, 32 aa, Artificial Sequence
  Description of Artificial Sequence: Synthetic polypeptide
DEEEIRTTNPVATEQYGSVSSTLLQGGGNNQQ

SEQ ID NO: 27758 - protein, 32 aa, Artificial Sequence
  Description of Artificial Sequence: Synthetic polypeptide
DEEEIRTTNPVATEQYGSVSTTPLDQATGPRQ

SEQ ID NO: 27759 - protein, 32 aa, Artificial Sequence
  Description of Artificial Sequence: Synthetic polypeptide
DEEEIRTTNPVATEQYGSVSTMNGDGQEGNED

SEQ ID NO: 27760 - protein, 32 aa, Artificial Sequence
  Description of Artificial Sequence: Synthetic polypeptide
DEEEIRTTNPVATEQYGSVSEMLNDLQRNENT

SEQ ID NO: 27761 - protein, 32 aa, Artificial Sequence
  Description of Artificial Sequence: Synthetic polypeptide
DEEEIRTTNPVATEQYGSVSSTPALNMRGMNV

SEQ ID NO: 27762 - protein, 32 aa, Artificial Sequence
  Description of Artificial Sequence: Synthetic polypeptide
DEEEIRTTNPVATEQYGSVSTMNGDQEEGNNL

SEQ ID NO: 27763 - protein, 30 aa, Artificial Sequence
  Description of Artificial Sequence: Synthetic polypeptide
DEEEIRTTNPVATEQYGSVSTTPDDQFSER

SEQ ID NO: 27764 - protein, 32 aa, Artificial Sequence
  Description of Artificial Sequence: Synthetic polypeptide
DEEEIRTTNPVATEQYGSVSTSLQTRGSDQFE

SEQ ID NO: 27765 - protein, 32 aa, Artificial Sequence
  Description of Artificial Sequence: Synthetic polypeptide
DEECIRTTNPVATEQYGESVSIENLQKGDNDR

SEQ ID NO: 27766 - protein, 32 aa, Artificial Sequence
  Description of Artificial Sequence: Synthetic polypeptide
DEEEIRTTNPVATEQYGSVSCTPNGGQDRGSF

SEQ ID NO: 27767 - protein, 31 aa, Artificial Sequence
  Description of Artificial Sequence: Synthetic polypeptide
DEEEIRTTNPVATEQYGSVSSTPLDRVENSS

SEQ ID NO: 27768 - protein, 31 aa, Artificial Sequence
  Description of Artificial Sequence: Synthetic polypeptide
DEEEIRTTNPVATEQYGSVSPMPLMRGEERQ

SEQ ID NO: 27769 - protein, 32 aa, Artificial Sequence
  Description of Artificial Sequence: Synthetic polypeptide
DEEEIRTTNPVATEQYGSVSTSNVNQGGNNQE

SEQ ID NO: 27770 - protein, 33 aa, Artificial Sequence
  Description of Artificial Sequence: Synthetic polypeptide
DEEEIRTTNPVATEQYGSVSNTGNLQNEGGNGG

SEQ ID NO: 27771 - protein, 32 aa, Artificial Sequence
  Description of Artificial Sequence: Synthetic polypeptide
DEAEIRTTNPVATEAWGSTVPSCTNLSQRGNR

SEQ ID NO: 27772 - protein, 30 aa, Artificial Sequence
  Description of Artificial Sequence: Synthetic polypeptide
DEEEIRTTNPVATEQYGSWSLPNMNQRDER

SEQ ID NO: 27773 - protein, 33 aa, Artificial Sequence
  Description of Artificial Sequence: Synthetic polypeptide
DEEEIRTTNPVATEQYGSVSTSNLDQEVGNNLN

SEQ ID NO: 27774 - protein, 31 aa, Artificial Sequence
  Description of Artificial Sequence: Synthetic polypeptide
DEEEIRTTNPVATEQYGSVSDEDNDQRNEGR

SEQ ID NO: 27775 - protein, 30 aa, Artificial Sequence
  Description of Artificial Sequence: Synthetic polypeptide
DEAEICTTNPVATECYGSVSTNLQDGGNEQ

SEQ ID NO: 27776 - protein, 31 aa, Artificial Sequence
  Description of Artificial Sequence: Synthetic polypeptide
DEEEIRTTNPVATEQYGSVSSNLQFFGSVQY

SEQ ID NO: 27777 - protein, 31 aa, Artificial Sequence
  Description of Artificial Sequence: Synthetic polypeptide
DEEEIRTTNPVATEQYGSVSPILDLQRLQLR

SEQ ID NO: 27778 - protein, 33 aa, Artificial Sequence
  Description of Artificial Sequence: Synthetic polypeptide
DEEEIRTTNPVATEQYGSVSTPNLSAQRHENEL

SEQ ID NO: 27779 - protein, 32 aa, Artificial Sequence
  Description of Artificial Sequence: Synthetic polypeptide
DEDEIRTTNPVATEQYGCVSTNLQRGGDNGDQ

SEQ ID NO: 27780 - protein, 32 aa, Artificial Sequence
  Description of Artificial Sequence: Synthetic polypeptide
DEEEIRTTNPVATEQYGSVSCTPGEQRSGEIR

SEQ ID NO: 27781 - protein, 32 aa, Artificial Sequence
  Description of Artificial Sequence: Synthetic polypeptide
DEEEIRTTNPVATEQYGSVSGTNLQAMGEDGI

SEQ ID NO: 27782 - protein, 31 aa, Artificial Sequence
  Description of Artificial Sequence: Synthetic polypeptide
DEEEIRTTNPVATEQYGSVPDTDLEQREDRD

SEQ ID NO: 27783 - protein, 32 aa, Artificial Sequence
  Description of Artificial Sequence: Synthetic polypeptide
DEEEIRTTNPVATEQYGSVSTMNGIQEQGNED

SEQ ID NO: 27784 - protein, 33 aa, Artificial Sequence
  Description of Artificial Sequence: Synthetic polypeptide
DEEEIRTTNPVATEQYGSVSTPNLQVTGNEVQD

SEQ ID NO: 27785 - protein, 31 aa, Artificial Sequence
  Description of Artificial Sequence: Synthetic polypeptide
DEEEIRTTNPVATEQYGSVSSNLQENASNDI

SEQ ID NO: 27786 - protein, 30 aa, Artificial Sequence
  Description of Artificial Sequence: Synthetic polypeptide
DEDEIRTTNPVATEQWGEVSTNLGQHDGNA

SEQ ID NO: 27787 - protein, 32 aa, Artificial Sequence
  Description of Artificial Sequence: Synthetic polypeptide
DEEEIRTTNPVATEQYGSVSTMLQTNDGENDD

SEQ ID NO: 27788 - protein, 33 aa, Artificial Sequence
  Description of Artificial Sequence: Synthetic polypeptide
DEEEIRTTNPVATEQYGSVSTNEHSQERTMGIR

SEQ ID NO: 27789 - protein, 33 aa, Artificial Sequence
  Description of Artificial Sequence: Synthetic polypeptide
DEEEIRTTNPVATEQYGSVPCTPNLQRQGVNDE

SEQ ID NO: 27790 - protein, 33 aa, Artificial Sequence
  Description of Artificial Sequence: Synthetic polypeptide
DEEEIRTTNPVATEQYGSVSGTSNLQDGTGNES

SEQ ID NO: 27791 - protein, 31 aa, Artificial Sequence
  Description of Artificial Sequence: Synthetic polypeptide
DEDEIATTNPVATEQYGAVSTNLQGDGMNQR

SEQ ID NO: 27792 - protein, 29 aa, Artificial Sequence
  Description of Artificial Sequence: Synthetic peptide
DEEAIRATNPVATEQYGSVSENDQQGNLQ

SEQ ID NO: 27793 - protein, 31 aa, Artificial Sequence
  Description of Artificial Sequence: Synthetic polypeptide
DEEEIRTTNPVATEQYGSVSTTAGPMRGMNV

SEQ ID NO: 27794 - protein, 31 aa, Artificial Sequence
  Description of Artificial Sequence: Synthetic polypeptide
DEEEIRTTNPVATEQYGSVSEDPQRGEEERN

SEQ ID NO: 27795 - protein, 32 aa, Artificial Sequence
  Description of Artificial Sequence: Synthetic polypeptide
DEEEIRTTNPVATEQYGSVSNTENTIVRGNNQ

SEQ ID NO: 27796 - protein, 33 aa, Artificial Sequence
  Description of Artificial Sequence: Synthetic polypeptide
DEEEIRTTNPVATEQYGSVSNTNNLQGGSGNNV

SEQ ID NO: 27797 - protein, 32 aa, Artificial Sequence
  Description of Artificial Sequence: Synthetic polypeptide
DEEEIRTTNPVATEQYGSVSTMNGIQDGGNED

SEQ ID NO: 27798 - protein, 30 aa, Artificial Sequence
  Description of Artificial Sequence: Synthetic polypeptide
DEEEIRTTNPVATEQYGSVVTDLQSNGEDM

SEQ ID NO: 27799 - protein, 32 aa, Artificial Sequence
  Description of Artificial Sequence: Synthetic polypeptide
DEEEIRTTNPVATEQYGSVSDYNLQRFSENMQ

SEQ ID NO: 27800 - protein, 31 aa, Artificial Sequence
  Description of Artificial Sequence: Synthetic polypeptide
DEDEIRTTNPVATEQWGEVSTNLGQHEGNDR

SEQ ID NO: 27801 - protein, 32 aa, Artificial Sequence
  Description of Artificial Sequence: Synthetic polypeptide
DEEEIRTTNPVATEQYGSVSTSNLDDPGGNNQ

SEQ ID NO: 27802 - protein, 30 aa, Artificial Sequence
  Description of Artificial Sequence: Synthetic polypeptide
DEEEIRTTNPVATEQYGSVVTDLDFRGEDM

SEQ ID NO: 27803 - protein, 31 aa, Artificial Sequence
  Description of Artificial Sequence: Synthetic polypeptide
DEEEIRTTNPVATEQYGSVSEENLQIGIQGN

SEQ ID NO: 27804 - protein, 32 aa, Artificial Sequence
  Description of Artificial Sequence: Synthetic polypeptide
DEEEIRTTNPVATEQYGSVSPIGNLQRQNTGI

SEQ ID NO: 27805 - protein, 33 aa, Artificial Sequence
  Description of Artificial Sequence: Synthetic polypeptide
DEEEIRTTNPVATEQYGSVSTTTAMLQRGDNLI

SEQ ID NO: 27806 - protein, 33 aa, Artificial Sequence
  Description of Artificial Sequence: Synthetic polypeptide
DEEEIRTTNPVATEQYGSVSPMLLQRVGENERL

SEQ ID NO: 27807 - protein, 31 aa, Artificial Sequence
  Description of Artificial Sequence: Synthetic polypeptide
DEEEIRTTNPVATEQYGSVSEDLDQQGMEER

SEQ ID NO: 27808 - protein, 30 aa, Artificial Sequence
  Description of Artificial Sequence: Synthetic polypeptide
DEEEIRTTNPVATEQYGSVSTNDTGGSEQT

SEQ ID NO: 27809 - protein, 31 aa, Artificial Sequence
  Description of Artificial Sequence: Synthetic polypeptide
DEEEIRTTNPVATEQYGSVSGNLVNVGNFGE

SEQ ID NO: 27810 - protein, 33 aa, Artificial Sequence
  Description of Artificial Sequence: Synthetic polypeptide
DEEEIRTTNPVATEQYGSVSTSNELEQGEGNET

SEQ ID NO: 27811 - protein, 32 aa, Artificial Sequence
  Description of Artificial Sequence: Synthetic polypeptide
DEEEIRTTNPVATEQYGSVSTMNDIQEGENID

SEQ ID NO: 27812 - protein, 31 aa, Artificial Sequence
  Description of Artificial Sequence: Synthetic polypeptide
DEEEIRTTNPVATEQYGSVSTTQHGDGENSR

SEQ ID NO: 27813 - protein, 32 aa, Artificial Sequence
  Description of Artificial Sequence: Synthetic polypeptide
DEEEIRTTNPVATEQYGSVSEMNGDQRGGEER

SEQ ID NO: 27814 - protein, 29 aa, Artificial Sequence
  Description of Artificial Sequence: Synthetic peptide
DEEEIRTTNPVATEQYGSVSTNDTEPEGG

SEQ ID NO: 27815 - protein, 32 aa, Artificial Sequence
  Description of Artificial Sequence: Synthetic polypeptide
DEEEIRTTNPVATEQYGSVSTTSLQAETVGND

SEQ ID NO: 27816 - protein, 31 aa, Artificial Sequence
  Description of Artificial Sequence: Synthetic polypeptide
DEECIRTTNPVATEQYGCVSTNLQNSGSNQA

SEQ ID NO: 27817 - protein, 31 aa, Artificial Sequence
  Description of Artificial Sequence: Synthetic polypeptide
DEEEIRTTNPVATEQYGSVSCVVNLNQNSER

SEQ ID NO: 27818 - protein, 33 aa, Artificial Sequence
  Description of Artificial Sequence: Synthetic polypeptide
DEEEIRTTNPVATEQYGSVSTTSNLIQSGGENP

SEQ ID NO: 27819 - protein, 31 aa, Artificial Sequence
  Description of Artificial Sequence: Synthetic polypeptide
DEEEIRTTNPVATEQYGSVSPITNLQDMVVI

SEQ ID NO: 27820 - protein, 33 aa, Artificial Sequence
  Description of Artificial Sequence: Synthetic polypeptide
DEEEIRTTNPVATEQYGSVSTTSNLQGFGVNTG

SEQ ID NO: 27821 - protein, 32 aa, Artificial Sequence
  Description of Artificial Sequence: Synthetic polypeptide
DEEEIRTTNPVATEQYGSVSGTVNMQNGNGGN

SEQ ID NO: 27822 - protein, 33 aa, Artificial Sequence
  Description of Artificial Sequence: Synthetic polypeptide
DEEEIRTTNPVATEQYGSVSNTNNELQTGGGNP

SEQ ID NO: 27823 - protein, 33 aa, Artificial Sequence
  Description of Artificial Sequence: Synthetic polypeptide
DEEEIRTTNPVATEQYGSVSGTNLQFEGENGEG

SEQ ID NO: 27824 - protein, 32 aa, Artificial Sequence
  Description of Artificial Sequence: Synthetic polypeptide
DEEEIRTTNPVATEQYGSVSCVNHSQHGGNNR

SEQ ID NO: 27825 - protein, 33 aa, Artificial Sequence
  Description of Artificial Sequence: Synthetic polypeptide
DEEEIRTTNPVATEQYGSVSCTVLSQRGGNNED

SEQ ID NO: 27826 - protein, 30 aa, Artificial Sequence
  Description of Artificial Sequence: Synthetic polypeptide
DEECIRTTNPVATEQYGCVSTNMQFNGDNM

SEQ ID NO: 27827 - protein, 32 aa, Artificial Sequence
  Description of Artificial Sequence: Synthetic polypeptide
DEEEIRTTNPVATEQYGSVSTSNDNEQGPGNT

SEQ ID NO: 27828 - protein, 33 aa, Artificial Sequence
  Description of Artificial Sequence: Synthetic polypeptide
DEEEIRTTNPVATEQYGSVSGTNLNQGGGNGNE

SEQ ID NO: 27829 - protein, 29 aa, Artificial Sequence
  Description of Artificial Sequence: Synthetic peptide
DEEEIRTTNPVATEQYGSVSEDLNSEQRQ

SEQ ID NO: 27830 - protein, 32 aa, Artificial Sequence
  Description of Artificial Sequence: Synthetic polypeptide
DEEEIRTTNPVATEQYGSVSEMNLQRVGEEQN

SEQ ID NO: 27831 - protein, 29 aa, Artificial Sequence
  Description of Artificial Sequence: Synthetic peptide
DEECIRTTNPVATEQYGCVSTNPQFGEQS

SEQ ID NO: 27832 - protein, 33 aa, Artificial Sequence
  Description of Artificial Sequence: Synthetic polypeptide
DEEEIRTTNPVATEQYGSVSTPNLQSVEGGNIG

SEQ ID NO: 27833 - protein, 30 aa, Artificial Sequence
  Description of Artificial Sequence: Synthetic polypeptide
DEECIRTTNPVAWEQYGQVSTINGMQRGNN

SEQ ID NO: 27834 - protein, 31 aa, Artificial Sequence
  Description of Artificial Sequence: Synthetic polypeptide
DEEEIRTTNPVATEQYGSVSCTYGGQRDGKF

SEQ ID NO: 27835 - protein, 33 aa, Artificial Sequence
  Description of Artificial Sequence: Synthetic polypeptide
DEEEIRTTNPVATEQYGSVVTISTNLLQEGNED

SEQ ID NO: 27836 - protein, 32 aa, Artificial Sequence
  Description of Artificial Sequence: Synthetic polypeptide
DEEEIRTTNPVATEQYGSVSSNLPNNLQEDNR

SEQ ID NO: 27837 - protein, 32 aa, Artificial Sequence
  Description of Artificial Sequence: Synthetic polypeptide
DEEEIRTTNPVATEQYGSVSTMNDLQQSTDVR

SEQ ID NO: 27838 - protein, 32 aa, Artificial Sequence
  Description of Artificial Sequence: Synthetic polypeptide
DEEEIRTTNPVATEQYGSVSTNDTQNFGSNQN

SEQ ID NO: 27839 - protein, 31 aa, Artificial Sequence
  Description of Artificial Sequence: Synthetic polypeptide
DEEEIRTTNPVATEQYGSVSLTNLERNELQN

SEQ ID NO: 27840 - protein, 32 aa, Artificial Sequence
  Description of Artificial Sequence: Synthetic polypeptide
DEEEIRTTNPVATEQYGSVSTTQLLQNSTNIR

SEQ ID NO: 27841 - protein, 31 aa, Artificial Sequence
  Description of Artificial Sequence: Synthetic polypeptide
DEEEIRTTNPVATEQYGSVSTNLGVAFGEPV

SEQ ID NO: 27842 - protein, 32 aa, Artificial Sequence
  Description of Artificial Sequence: Synthetic polypeptide
DEEEIRTTNPVATEQYGSVSCTVNGGQRGPEF

SEQ ID NO: 27843 - protein, 31 aa, Artificial Sequence
  Description of Artificial Sequence: Synthetic polypeptide
DEEEIRTTNPVATEQYGSVSPMLNQRGEEVQ

SEQ ID NO: 27844 - protein, 33 aa, Artificial Sequence
  Description of Artificial Sequence: Synthetic polypeptide
DEEEIRTTNPVATEQYGSVSTTSNLQVGIGTNG

SEQ ID NO: 27845 - protein, 32 aa, Artificial Sequence
  Description of Artificial Sequence: Synthetic polypeptide
DEEEIRTTNPVATEQYGSVSTSTLQQEGNGGT

SEQ ID NO: 27846 - protein, 30 aa, Artificial Sequence
  Description of Artificial Sequence: Synthetic polypeptide
DEEEIRTTNPVATEQYGSVSPMDLNRGDDT

SEQ ID NO: 27847 - protein, 29 aa, Artificial Sequence
  Description of Artificial Sequence: Synthetic peptide
DEDEIRTTNPVATEQYGETATNLQRGGDS

SEQ ID NO: 27848 - protein, 29 aa, Artificial Sequence
  Description of Artificial Sequence: Synthetic peptide
DEAEIRTTNPVAYEQWGSTSTNLERPGNE

SEQ ID NO: 27849 - protein, 32 aa, Artificial Sequence
  Description of Artificial Sequence: Synthetic polypeptide
DEEEIRTTNPVATEQYGSVSTSTLNQEGNGGT

SEQ ID NO: 27850 - protein, 31 aa, Artificial Sequence
  Description of Artificial Sequence: Synthetic polypeptide
DEEEIRTTNPVATEQYGSVSSNLQADSMGIM

SEQ ID NO: 27851 - protein, 30 aa, Artificial Sequence
  Description of Artificial Sequence: Synthetic polypeptide
DEEEIRTTNPVATEQYGSVSPIPLQNMENE

SEQ ID NO: 27852 - protein, 32 aa, Artificial Sequence
  Description of Artificial Sequence: Synthetic polypeptide
DEEEIRTTNPVATEQYGSVSTNDLQMFGSFEE

SEQ ID NO: 27853 - protein, 32 aa, Artificial Sequence
  Description of Artificial Sequence: Synthetic polypeptide
DEEEIRTTNPVATEQYGSVSTMNDQNGGNDEA

SEQ ID NO: 27854 - protein, 31 aa, Artificial Sequence
  Description of Artificial Sequence: Synthetic polypeptide
DEEEIRTTNPVATEQYGSVSPMLEQVGDNIE

SEQ ID NO: 27855 - protein, 30 aa, Artificial Sequence
  Description of Artificial Sequence: Synthetic polypeptide
DEDEIRTTNPVAYEQWGTVSTNLQGEGNDR

SEQ ID NO: 27856 - protein, 32 aa, Artificial Sequence
  Description of Artificial Sequence: Synthetic polypeptide
DEEEIRTTNPVATEQYGSVSNTGLQRLQENTT

SEQ ID NO: 27857 - protein, 32 aa, Artificial Sequence
  Description of Artificial Sequence: Synthetic polypeptide
DEEEIRTTNPVATEQYGSVSTPNLQTVTNNQN

SEQ ID NO: 27858 - protein, 32 aa, Artificial Sequence
  Description of Artificial Sequence: Synthetic polypeptide
DEEEIRTTNPVATEQYGSWSTLNLNARSGDER

SEQ ID NO: 27859 - protein, 29 aa, Artificial Sequence
  Description of Artificial Sequence: Synthetic peptide
DEDEIRTTNPVATEQYGETCCTNLQRGDS

SEQ ID NO: 27860 - protein, 32 aa, Artificial Sequence
  Description of Artificial Sequence: Synthetic polypeptide
DEEEIRTTNPVATEQYGSVSTMNDGQNGGNVQ

SEQ ID NO: 27861 - protein, 32 aa, Artificial Sequence
  Description of Artificial Sequence: Synthetic polypeptide
DEEEIRTTNPVATEQYGSVSTMNDQGTGGENA

SEQ ID NO: 27862 - protein, 32 aa, Artificial Sequence
  Description of Artificial Sequence: Synthetic polypeptide
DEEEIRTTNPVATEQYGSVSTTPNGMMRGNPV

SEQ ID NO: 27863 - protein, 31 aa, Artificial Sequence
  Description of Artificial Sequence: Synthetic polypeptide
DEEEIRTTNPVATEQYGSVSNTGHLQLGSQE

SEQ ID NO: 27864 - protein, 31 aa, Artificial Sequence
  Description of Artificial Sequence: Synthetic polypeptide
DEEEIRTTNPVATEQYGSVSNTGLQRLLEIG

SEQ ID NO: 27865 - protein, 31 aa, Artificial Sequence
  Description of Artificial Sequence: Synthetic polypeptide
DEEEIRTTNPVATEQYGSVSTNEAQVRSEDQ

SEQ ID NO: 27866 - protein, 32 aa, Artificial Sequence
  Description of Artificial Sequence: Synthetic polypeptide
DEEEIRTTNPVATEQYGSVSSTPAGPNRGMNR

SEQ ID NO: 27867 - protein, 32 aa, Artificial Sequence
  Description of Artificial Sequence: Synthetic polypeptide
DEEEIRTTNPVATEQYGSVSEDENLQRFENVT

SEQ ID NO: 27868 - protein, 31 aa, Artificial Sequence
  Description of Artificial Sequence: Synthetic polypeptide
DEEEIRTTNPVATEQYGSVSCYNEAEEGNRN

SEQ ID NO: 27869 - protein, 29 aa, Artificial Sequence
  Description of Artificial Sequence: Synthetic peptide
DEEEIRTTNPVATEQYGSVVTLLDNIGEI

SEQ ID NO: 27870 - protein, 31 aa, Artificial Sequence
  Description of Artificial Sequence: Synthetic polypeptide
DEEEIRTTNPVATEQYGSVSTSLYRGEDTSN

SEQ ID NO: 27871 - protein, 30 aa, Artificial Sequence
  Description of Artificial Sequence: Synthetic polypeptide
DEECIRTTNPVATEQYGCVSTNIQFGGNNQ

SEQ ID NO: 27872 - protein, 33 aa, Artificial Sequence
  Description of Artificial Sequence: Synthetic polypeptide
DEEEIRTTNPVATEQYGSVSTTSTQLQQGSTNR

SEQ ID NO: 27873 - protein, 29 aa, Artificial Sequence
  Description of Artificial Sequence: Synthetic peptide
DEDEIRTTNPVATEQYGCVSTVLQRPDDL

SEQ ID NO: 27874 - protein, 33 aa, Artificial Sequence
  Description of Artificial Sequence: Synthetic polypeptide
DEEEIRTTNPVATEQYGSVSGTVNLEQGIGNFV

SEQ ID NO: 27875 - protein, 32 aa, Artificial Sequence
  Description of Artificial Sequence: Synthetic polypeptide
DEEEIRTTNPVATEQYGSVSGNNLQEGGGNGN

SEQ ID NO: 27876 - protein, 30 aa, Artificial Sequence
  Description of Artificial Sequence: Synthetic polypeptide
DEECIRTTNPVAWEQYGQVSTINQVQRGNN

SEQ ID NO: 27877 - protein, 29 aa, Artificial Sequence
  Description of Artificial Sequence: Synthetic peptide
DEDEIRTTNPVATEQYGCVSTTLQDPNAD

SEQ ID NO: 27878 - protein, 32 aa, Artificial Sequence
  Description of Artificial Sequence: Synthetic polypeptide
DEEEIRTTNPVATEQYGSVSTMNDQEGGGGNS

SEQ ID NO: 27879 - protein, 31 aa, Artificial Sequence
  Description of Artificial Sequence: Synthetic polypeptide
DEEEIRTTNPVATEQYGSVSPLMNSIRQGVR

SEQ ID NO: 27880 - protein, 33 aa, Artificial Sequence
  Description of Artificial Sequence: Synthetic polypeptide
DEEEIRTTNPVATEQYGSVSPLNLQIIGEENRI

SEQ ID NO: 27881 - protein, 32 aa, Artificial Sequence
  Description of Artificial Sequence: Synthetic polypeptide
DEEEIRTTNPVATEQYGSVSTSNGQGGGGNEE

SEQ ID NO: 27882 - protein, 31 aa, Artificial Sequence
  Description of Artificial Sequence: Synthetic polypeptide
DEEEIRTTNPVATEQYGSVSPEVQDRQGNEN

SEQ ID NO: 27883 - protein, 30 aa, Artificial Sequence
  Description of Artificial Sequence: Synthetic polypeptide
DEAEICTTNPVATECYGSVSTNLQGDGNED

SEQ ID NO: 27884 - protein, 30 aa, Artificial Sequence
  Description of Artificial Sequence: Synthetic polypeptide
DEEEIRTTNPVATEQYGSWSLPNMLQVDNI

SEQ ID NO: 27885 - protein, 31 aa, Artificial Sequence
  Description of Artificial Sequence: Synthetic polypeptide
DEDEIATTNPVATEQWGSVSTANLQRDGNEE

SEQ ID NO: 27886 - protein, 32 aa, Artificial Sequence
  Description of Artificial Sequence: Synthetic polypeptide
DEEEIRTTNPVATEQYGSVSTNLFGEFGGNNG

SEQ ID NO: 27887 - protein, 31 aa, Artificial Sequence
  Description of Artificial Sequence: Synthetic polypeptide
DEEEIRTTNPVATEQYGSVSNTLLQVRIDGQ

SEQ ID NO: 27888 - protein, 32 aa, Artificial Sequence
  Description of Artificial Sequence: Synthetic polypeptide
DEEEIRTTNPVATEQYGSVSNTNQQGGGNQET

SEQ ID NO: 27889 - protein, 31 aa, Artificial Sequence
  Description of Artificial Sequence: Synthetic polypeptide
DEEEIRTTNPVATEQYGSVSTTDIQRQVNEH

SEQ ID NO: 27890 - protein, 31 aa, Artificial Sequence
  Description of Artificial Sequence: Synthetic polypeptide
DEEEIRTTNPVATEQYGSVSGNNNQISGNEV

SEQ ID NO: 27891 - protein, 30 aa, Artificial Sequence
  Description of Artificial Sequence: Synthetic polypeptide
DEDEIRTTNPVATEQYGSVSDQNLFGNMNR

SEQ ID NO: 27892 - protein, 32 aa, Artificial Sequence
  Description of Artificial Sequence: Synthetic polypeptide
DEEEIRTTNPVATEQYGSVSTMLQSELGMNNF

SEQ ID NO: 27893 - protein, 32 aa, Artificial Sequence
  Description of Artificial Sequence: Synthetic polypeptide
DEEEIRTTNPVATEQYGSVSTNDQQGEGGNQS

SEQ ID NO: 27894 - protein, 32 aa, Artificial Sequence
  Description of Artificial Sequence: Synthetic polypeptide
DEEEIRTTNPVATEQYGSVSNTNLQNEGSLEF

SEQ ID NO: 27895 - protein, 32 aa, Artificial Sequence
  Description of Artificial Sequence: Synthetic polypeptide
DEEEIRTTNPVATEQYGSVSTTDLPQENGTNP

SEQ ID NO: 27896 - protein, 32 aa, Artificial Sequence
  Description of Artificial Sequence: Synthetic polypeptide
DEEEIRTTNPVATEQYGSVSCTNNLQFGGSDI

SEQ ID NO: 27897 - protein, 32 aa, Artificial Sequence
  Description of Artificial Sequence: Synthetic polypeptide
DEEEIRTTNPVATEQYGSVSNTNQQTGGGNIE

SEQ ID NO: 27898 - protein, 28 aa, Artificial Sequence
  Description of Artificial Sequence: Synthetic peptide
DEAEIRTTNPVAHEQYGSCSTNLERPES

SEQ ID NO: 27899 - protein, 29 aa, Artificial Sequence
  Description of Artificial Sequence: Synthetic peptide
DEEEIRTTNPVATEQYGSVSPGLQNADQI

SEQ ID NO: 27900 - protein, 32 aa, Artificial Sequence
  Description of Artificial Sequence: Synthetic polypeptide
DEEEIRTTNPVATEQYGSVSTTNQGQGFGNTG

SEQ ID NO: 27901 - protein, 32 aa, Artificial Sequence
  Description of Artificial Sequence: Synthetic polypeptide
DEEEIRTTNPVATEQYGSWSFLPNDLQRDNAR

SEQ ID NO: 27902 - protein, 31 aa, Artificial Sequence
  Description of Artificial Sequence: Synthetic polypeptide
DEEEIRTTNPVATEQYGSVSTNLFGNGGGQQ

SEQ ID NO: 27903 - protein, 32 aa, Artificial Sequence
  Description of Artificial Sequence: Synthetic polypeptide
DEEEIRTTNPVATEQYGSVSGTNLISGGENEQ

SEQ ID NO: 27904 - protein, 32 aa, Artificial Sequence
  Description of Artificial Sequence: Synthetic polypeptide
DEEEIRTTNPVATEQYGSVSTTVELQSGTNNG

SEQ ID NO: 27905 - protein, 33 aa, Artificial Sequence
  Description of Artificial Sequence: Synthetic polypeptide
DEEEIRTTNPVATEQYGSVSDTYNLGQHFGEDR

SEQ ID NO: 27906 - protein, 32 aa, Artificial Sequence
  Description of Artificial Sequence: Synthetic polypeptide
DEAEIRTTNPVATEAYGSVSYTNLSQEVGNRM

SEQ ID NO: 27907 - protein, 32 aa, Artificial Sequence
  Description of Artificial Sequence: Synthetic polypeptide
DEEEIRTTNPVATEQYGSVSDTYLQDTGSQRD

SEQ ID NO: 27908 - protein, 32 aa, Artificial Sequence
  Description of Artificial Sequence: Synthetic polypeptide
DEEEIRTTNPVATEQYGSVSDTYHNQRFSQNR

SEQ ID NO: 27909 - protein, 31 aa, Artificial Sequence
  Description of Artificial Sequence: Synthetic polypeptide
DEEEIRTTNPVATEQYGSWSLPNMLERDNRP

SEQ ID NO: 27910 - protein, 32 aa, Artificial Sequence
  Description of Artificial Sequence: Synthetic polypeptide
DEEEIRTTNPVATEQYGSVSDTWSLYQRSQER

SEQ ID NO: 27911 - protein, 32 aa, Artificial Sequence
  Description of Artificial Sequence: Synthetic polypeptide
DEEEIRTTNPVATEQYGSVSTMLQRMGGGGGE

SEQ ID NO: 27912 - protein, 32 aa, Artificial Sequence
  Description of Artificial Sequence: Synthetic polypeptide
DEEEIRTTNPVATEQYGSVSPGTILQRTNQLI

SEQ ID NO: 27913 - protein, 31 aa, Artificial Sequence
  Description of Artificial Sequence: Synthetic polypeptide
DEEEIRTTNPVATEQYGSVSNTNPQNGSDQE

SEQ ID NO: 27914 - protein, 33 aa, Artificial Sequence
  Description of Artificial Sequence: Synthetic polypeptide
DEDEIRTTNPVATEQYGSVSCTNLSQYGGSNRK

SEQ ID NO: 27915 - protein, 33 aa, Artificial Sequence
  Description of Artificial Sequence: Synthetic polypeptide
DEEEIRTTNPVATEQYGSVSPGSMLQRGPNDRE

SEQ ID NO: 27916 - protein, 33 aa, Artificial Sequence
  Description of Artificial Sequence: Synthetic polypeptide
DEEEIRTTNPVATEQYGSVSPGNLQQRQGDNHE

SEQ ID NO: 27917 - protein, 32 aa, Artificial Sequence
  Description of Artificial Sequence: Synthetic polypeptide
DEEEIRTTNPVATEQYGSVSNTNPQQVQGNHE

SEQ ID NO: 27918 - protein, 32 aa, Artificial Sequence
  Description of Artificial Sequence: Synthetic polypeptide
DEEEIRTTNPVATEQYGSVSNTLDLTEGNNDR

SEQ ID NO: 27919 - protein, 29 aa, Artificial Sequence
  Description of Artificial Sequence: Synthetic peptide
DEEEIRTTNPVATEQYGSVQETPLQTVVV

SEQ ID NO: 27920 - protein, 32 aa, Artificial Sequence
  Description of Artificial Sequence: Synthetic polypeptide
DEEEIRTTNPVATEQYGSVSTNEQPQGVEERY

SEQ ID NO: 27921 - protein, 28 aa, Artificial Sequence
  Description of Artificial Sequence: Synthetic peptide
DEECIQCTNPVATEQYGSVSWNQQYGNL

SEQ ID NO: 27922 - protein, 31 aa, Artificial Sequence
  Description of Artificial Sequence: Synthetic polypeptide
DEEEIRTTNPVATEQYGSVSNTNSERGSILL

SEQ ID NO: 27923 - protein, 32 aa, Artificial Sequence
  Description of Artificial Sequence: Synthetic polypeptide
DEEEIRTTNPVATEQYGSVQCTNLEQRGELIL

SEQ ID NO: 27924 - protein, 32 aa, Artificial Sequence
  Description of Artificial Sequence: Synthetic polypeptide
DEEEIRTTNPVATEQYGSVSTPNNLDVEGNEG

SEQ ID NO: 27925 - protein, 32 aa, Artificial Sequence
  Description of Artificial Sequence: Synthetic polypeptide
DEEEIRTTNPVATEQYGSVSNTENLQGNSEQF

SEQ ID NO: 27926 - protein, 32 aa, Artificial Sequence
  Description of Artificial Sequence: Synthetic polypeptide
DEEEIRTTNPVATEQYGSVSSNLQNRGLEIIL

SEQ ID NO: 27927 - protein, 32 aa, Artificial Sequence
  Description of Artificial Sequence: Synthetic polypeptide
DEEEIRTTNPVATEQYGSVSSTNDQTGNGGNI

SEQ ID NO: 27928 - protein, 31 aa, Artificial Sequence
  Description of Artificial Sequence: Synthetic polypeptide
DEEEIRTTNPVATEQYGSVSTMLQQNINGEL

SEQ ID NO: 27929 - protein, 31 aa, Artificial Sequence
  Description of Artificial Sequence: Synthetic polypeptide
DEEEIRTTNPVATEQYGSVSPFLQPVGVEVR

SEQ ID NO: 27930 - protein, 34 aa, Artificial Sequence
  Description of Artificial Sequence: Synthetic polypeptide
DEEEIRTTNPVATEQYGSVSTNDNLEEQRGEDRN

SEQ ID NO: 27931 - protein, 33 aa, Artificial Sequence
  Description of Artificial Sequence: Synthetic polypeptide
DEEEIRTTNPVATEQYGSVSTTNNQERTGSELR

SEQ ID NO: 27932 - protein, 32 aa, Artificial Sequence
  Description of Artificial Sequence: Synthetic polypeptide
DEEEIRTTNPVATEQYGSYQATNLQRGVLTNQ

SEQ ID NO: 27933 - protein, 32 aa, Artificial Sequence
  Description of Artificial Sequence: Synthetic polypeptide
DEEEIRTTNPVATEQYGSVSTTVLQGIGTNIN

SEQ ID NO: 27934 - protein, 32 aa, Artificial Sequence
  Description of Artificial Sequence: Synthetic polypeptide
DEEEIRTTNPVATEQYGSVSTMLQQNGINGGD

SEQ ID NO: 27935 - protein, 28 aa, Artificial Sequence
  Description of Artificial Sequence: Synthetic peptide
DEEEIRTTNPVATEQYGSVSSNENGDML

SEQ ID NO: 27936 - protein, 32 aa, Artificial Sequence
  Description of Artificial Sequence: Synthetic polypeptide
DEEEIRTTNPVATEQYGSVSGTNNNEQSTGND

SEQ ID NO: 27937 - protein, 32 aa, Artificial Sequence
  Description of Artificial Sequence: Synthetic polypeptide
DEEEIRTTNPVATEQYGSVSTPNNLQFTGGDM

SEQ ID NO: 27938 - protein, 31 aa, Artificial Sequence
  Description of Artificial Sequence: Synthetic polypeptide
DEEEIRTTNPVATEQYGSVSTNESDQSQDNI

SEQ ID NO: 27939 - protein, 29 aa, Artificial Sequence
  Description of Artificial Sequence: Synthetic peptide
DEDEIRTTNPVATEQYGSVQTANLINENM

SEQ ID NO: 27940 - protein, 32 aa, Artificial Sequence
  Description of Artificial Sequence: Synthetic polypeptide
DEEEIRTTNPVATEQYGSVSNTMGLQDGPNEG

SEQ ID NO: 27941 - protein, 32 aa, Artificial Sequence
  Description of Artificial Sequence: Synthetic polypeptide
DEEEIRTTNPVATEQYGSVSGNTNQQGVGNET

SEQ ID NO: 27942 - protein, 30 aa, Artificial Sequence
  Description of Artificial Sequence: Synthetic polypeptide
DEDEIRTTNPVATEQYGCVSTGELQRPNDD

SEQ ID NO: 27943 - protein, 29 aa, Artificial Sequence
  Description of Artificial Sequence: Synthetic peptide
DEAEIRTTNPVAFEQYGSIISTNLERPNS

SEQ ID NO: 27944 - protein, 32 aa, Artificial Sequence
  Description of Artificial Sequence: Synthetic polypeptide
DEEEIRTTNPVATEQYGSVQGPTTNLQPGNEL

SEQ ID NO: 27945 - protein, 31 aa, Artificial Sequence
  Description of Artificial Sequence: Synthetic polypeptide
DEDEIRTTNPVATEQYGCVSTNLQANGEDMR

SEQ ID NO: 27946 - protein, 32 aa, Artificial Sequence
  Description of Artificial Sequence: Synthetic polypeptide
DEEEIRTTNPVATEQYGSVSEINLQQEGNPLD

SEQ ID NO: 27947 - protein, 31 aa, Artificial Sequence
  Description of Artificial Sequence: Synthetic polypeptide
DEEEIRTTNPVATEQYGSVSSNGGQRILNVE

SEQ ID NO: 27948 - protein, 32 aa, Artificial Sequence
  Description of Artificial Sequence: Synthetic polypeptide
DEEEIRTTNPVATEQYGSVSGTNLQFNENNED

SEQ ID NO: 27949 - protein, 30 aa, Artificial Sequence
  Description of Artificial Sequence: Synthetic polypeptide
DEEEIRTTNPVATEQYGSYNSSNDQQGNEQ

SEQ ID NO: 27950 - protein, 33 aa, Artificial Sequence
  Description of Artificial Sequence: Synthetic polypeptide
DEEEIRTTNPVATEQYGSVVSTTSFNMQDQGNR

SEQ ID NO: 27951 - protein, 32 aa, Artificial Sequence
  Description of Artificial Sequence: Synthetic polypeptide
DEEEIRTTNPVATEQYGSVSTTVLQGFGGGNN

SEQ ID NO: 27952 - protein, 33 aa, Artificial Sequence
  Description of Artificial Sequence: Synthetic polypeptide
DEEEIRTTNPVATEQYGSVVSTTLEQRGENDAD

SEQ ID NO: 27953 - protein, 28 aa, Artificial Sequence
  Description of Artificial Sequence: Synthetic peptide
DEECISCTNPVATEQYGSVSWNFQGGNQ

SEQ ID NO: 27954 - protein, 28 aa, Artificial Sequence
  Description of Artificial Sequence: Synthetic peptide
DEEEIRTTNPVATEQYGSVQINDEREDG

SEQ ID NO: 27955 - protein, 33 aa, Artificial Sequence
  Description of Artificial Sequence: Synthetic polypeptide
DEEEIRTTNPVATEQYGSVSLTQNGLQRGFLAD

SEQ ID NO: 27956 - protein, 32 aa, Artificial Sequence
  Description of Artificial Sequence: Synthetic polypeptide
DEEEIRTTNPVATEQYGSVSTTDNGQTGENIE

SEQ ID NO: 27957 - protein, 31 aa, Artificial Sequence
  Description of Artificial Sequence: Synthetic polypeptide
DEEEIRTTNPVATEQYGSVSTNDQPGGLEDS

SEQ ID NO: 27958 - protein, 33 aa, Artificial Sequence
  Description of Artificial Sequence: Synthetic polypeptide
DEEEIRTTNPVATEQYGSVSLTNLQRDGVTVEQ

SEQ ID NO: 27959 - protein, 31 aa, Artificial Sequence
  Description of Artificial Sequence: Synthetic polypeptide
DEEEIRTTNPVATEQYGSVSNTNLTFNSNQS

SEQ ID NO: 27960 - protein, 28 aa, Artificial Sequence
  Description of Artificial Sequence: Synthetic peptide
DEDEIRTTNPVATEQYGEMSTNGQDGDD

SEQ ID NO: 27961 - protein, 32 aa, Artificial Sequence
  Description of Artificial Sequence: Synthetic polypeptide
DEEEIRTTNPVATEQYGSVSGTNTQQNGGTNI

SEQ ID NO: 27962 - protein, 33 aa, Artificial Sequence
  Description of Artificial Sequence: Synthetic polypeptide
DEEEIRTTNPVATEQYGSVSPGTNLQRINNEDE

SEQ ID NO: 27963 - protein, 33 aa, Artificial Sequence
  Description of Artificial Sequence: Synthetic polypeptide
DEEEIRTTNPVATEQYGSVSTSNLLDQGGNNTE

SEQ ID NO: 27964 - protein, 30 aa, Artificial Sequence
  Description of Artificial Sequence: Synthetic polypeptide
DEAEIRTTNPVATEAYGEVSTNLQDDGNQE

SEQ ID NO: 27965 - protein, 32 aa, Artificial Sequence
  Description of Artificial Sequence: Synthetic polypeptide
DEEEIRTTNPVATEQYGSVSTMNGLEGEGNQI

SEQ ID NO: 27966 - protein, 33 aa, Artificial Sequence
  Description of Artificial Sequence: Synthetic polypeptide
DEEEIRTTNPVATEQYGSVSNTGNLQYFGSNQF

SEQ ID NO: 27967 - protein, 33 aa, Artificial Sequence
  Description of Artificial Sequence: Synthetic polypeptide
DEEEIRTTNPVATEQYGSVSTSNVLQGIGNNTN

SEQ ID NO: 27968 - protein, 32 aa, Artificial Sequence
  Description of Artificial Sequence: Synthetic polypeptide
DEEEIRTTNPVATEQYGSVSTTNVQRGPQFLT

SEQ ID NO: 27969 - protein, 31 aa, Artificial Sequence
  Description of Artificial Sequence: Synthetic polypeptide
DEEEIRTTNPVATEQYGSVSTTNVQPEVNDD

SEQ ID NO: 27970 - protein, 32 aa, Artificial Sequence
  Description of Artificial Sequence: Synthetic polypeptide
DEEEIRTTNPVATEQYGSVSTMLQSVGVNGGE

SEQ ID NO: 27971 - protein, 32 aa, Artificial Sequence
  Description of Artificial Sequence: Synthetic polypeptide
DEEEIRTTNPVATEQYGSVSNTNLQNGGEVTT

SEQ ID NO: 27972 - protein, 32 aa, Artificial Sequence
  Description of Artificial Sequence: Synthetic polypeptide
DEEEIRTTNPVATEQYGSVSETANLQRMEFST

SEQ ID NO: 27973 - protein, 31 aa, Artificial Sequence
  Description of Artificial Sequence: Synthetic polypeptide
DEAEICTTNPVATECYGSVSTNLQGNGMDNR

SEQ ID NO: 27974 - protein, 31 aa, Artificial Sequence
  Description of Artificial Sequence: Synthetic polypeptide
DEEEIRTTNPVATEQYGSVVTNDQRGGEEFN

SEQ ID NO: 27975 - protein, 33 aa, Artificial Sequence
  Description of Artificial Sequence: Synthetic polypeptide
DEEEIRTTNPVATEQYGSVSTMNGLEQMGNTGD

SEQ ID NO: 27976 - protein, 32 aa, Artificial Sequence
  Description of Artificial Sequence: Synthetic polypeptide
DEEEIRTTNPVATEQYGSVSTNDLQGNGQSHV

SEQ ID NO: 27977 - protein, 30 aa, Artificial Sequence
  Description of Artificial Sequence: Synthetic polypeptide
DEEEIRTTNPVATEQYGSVSPIDLQRDAEI

SEQ ID NO: 27978 - protein, 32 aa, Artificial Sequence
  Description of Artificial Sequence: Synthetic polypeptide
DEEEIRTTNPVATEQYGSVVSTYALAQQGGLR

SEQ ID NO: 27979 - protein, 29 aa, Artificial Sequence
  Description of Artificial Sequence: Synthetic peptide
DEDEIRTTNPVATEQWGSVATNLQTPNAE

SEQ ID NO: 27980 - protein, 29 aa, Artificial Sequence
  Description of Artificial Sequence: Synthetic peptide
DEAEIRTTNPVATEAYGCVSTNNPAGENR

SEQ ID NO: 27981 - protein, 31 aa, Artificial Sequence
  Description of Artificial Sequence: Synthetic polypeptide
DEEEIRTTNPVATEQYGSVVTNDQQRIQDRQ

SEQ ID NO: 27982 - protein, 32 aa, Artificial Sequence
  Description of Artificial Sequence: Synthetic polypeptide
DEEEIRTTNPVATEQYGSVSPIGNLQRLNTEN

SEQ ID NO: 27983 - protein, 31 aa, Artificial Sequence
  Description of Artificial Sequence: Synthetic polypeptide
DEEEIRTTNPVATEQYGSWSLPNMLQNDNRM

SEQ ID NO: 27984 - protein, 33 aa, Artificial Sequence
  Description of Artificial Sequence: Synthetic polypeptide
DEEEIRTTNPVATEQYGSVSGTSNGLQDGGGNQ

SEQ ID NO: 27985 - protein, 30 aa, Artificial Sequence
  Description of Artificial Sequence: Synthetic polypeptide
DEEEIRTTNPVATEQYGSWSLPNMLQMDDR

SEQ ID NO: 27986 - protein, 29 aa, Artificial Sequence
  Description of Artificial Sequence: Synthetic peptide
DEDEIRTTNPVATEQYGETSTELQRGDSS

SEQ ID NO: 27987 - protein, 30 aa, Artificial Sequence
  Description of Artificial Sequence: Synthetic polypeptide
DEEEIRTTNPVATEQYGSVVTNDQQNVEDR

SEQ ID NO: 27988 - protein, 33 aa, Artificial Sequence
  Description of Artificial Sequence: Synthetic polypeptide
DEEEIRTTNPVATEQYGSVVTNDQQRGGNEDRN

SEQ ID NO: 27989 - protein, 33 aa, Artificial Sequence
  Description of Artificial Sequence: Synthetic polypeptide
DEEEIRTTNPVATEQYGSVSTSNVLQGGNNITT

SEQ ID NO: 27990 - protein, 33 aa, Artificial Sequence
  Description of Artificial Sequence: Synthetic polypeptide
DEEEIRTTNPVATEQYGSVSNTNNLQIGVNDMV

SEQ ID NO: 27991 - protein, 28 aa, Artificial Sequence
  Description of Artificial Sequence: Synthetic peptide
DEAEIRTTNPVAYEQWGSASTNLERPNP

SEQ ID NO: 27992 - protein, 30 aa, Artificial Sequence
  Description of Artificial Sequence: Synthetic polypeptide
DEDEIRTTNPVATEQYGETSTGNFLQRGDS

SEQ ID NO: 27993 - protein, 32 aa, Artificial Sequence
  Description of Artificial Sequence: Synthetic polypeptide
DEEEIRTTNPVATEQYGSVVSWTLLNRGQNDG

SEQ ID NO: 27994 - protein, 32 aa, Artificial Sequence
  Description of Artificial Sequence: Synthetic polypeptide
DEEEIRTTNPVATEQYGSVSTNDMQSRGDQID

SEQ ID NO: 27995 - protein, 32 aa, Artificial Sequence
  Description of Artificial Sequence: Synthetic polypeptide
DEEEIRTTNPVATEQYGSVQCTTNLQRGLQDQ

SEQ ID NO: 27996 - protein, 32 aa, Artificial Sequence
  Description of Artificial Sequence: Synthetic polypeptide
DEEEIRTTNPVATEQYGSVSGNLVEQTGGNFA

SEQ ID NO: 27997 - protein, 31 aa, Artificial Sequence
  Description of Artificial Sequence: Synthetic polypeptide
DEEEIRTTNPVATEQYGSVQCTYLQREVVND

SEQ ID NO: 27998 - protein, 32 aa, Artificial Sequence
  Description of Artificial Sequence: Synthetic polypeptide
DEEEIRTTNPVATEQYGSVSTSNLIQTGPIAN

SEQ ID NO: 27999 - protein, 29 aa, Artificial Sequence
  Description of Artificial Sequence: Synthetic peptide
DEEEIRTTNPVATEQYGSVSEILMNAENA

SEQ ID NO: 28000 - protein, 32 aa, Artificial Sequence
  Description of Artificial Sequence: Synthetic polypeptide
DEEEIRTTNPVATEQYGSVQETNLQGNGFMVR

SEQ ID NO: 28001 - protein, 33 aa, Artificial Sequence
  Description of Artificial Sequence: Synthetic polypeptide
DEEEIRTTNPVATEQYGSVSTSNVLQGEGNNEE

SEQ ID NO: 28002 - protein, 33 aa, Artificial Sequence
  Description of Artificial Sequence: Synthetic polypeptide
DEEEIRTTNPVATEQYGSVSTPNLQSEGENISN

SEQ ID NO: 28003 - protein, 32 aa, Artificial Sequence
  Description of Artificial Sequence: Synthetic polypeptide
DEEEIRTTNPVATEQYGSVSTTNTDRQGPARN

SEQ ID NO: 28004 - protein, 33 aa, Artificial Sequence
  Description of Artificial Sequence: Synthetic polypeptide
DEEEIRTTNPVATEQYGSVSPIANLQRGDENEG

SEQ ID NO: 28005 - protein, 34 aa, Artificial Sequence
  Description of Artificial Sequence: Synthetic polypeptide
DEEEIRTTNPVATEQYGSVSNTGNMDMQRGNNRD

SEQ ID NO: 28006 - protein, 32 aa, Artificial Sequence
  Description of Artificial Sequence: Synthetic polypeptide
DEEEIRTTNPVATEQYGSVSTNDLQEGEDTSN

SEQ ID NO: 28007 - protein, 31 aa, Artificial Sequence
  Description of Artificial Sequence: Synthetic polypeptide
DEDEIRTTNPVATEQWGEVSTNLGQGDNGNR

SEQ ID NO: 28008 - protein, 31 aa, Artificial Sequence
  Description of Artificial Sequence: Synthetic polypeptide
DEEEIRTTNPVATEQYGSVSTMNGLGNGIGQ

SEQ ID NO: 28009 - protein, 33 aa, Artificial Sequence
  Description of Artificial Sequence: Synthetic polypeptide
DEEEIRTTNPVATEQYGSVSTNDLQEFFNSNRE

SEQ ID NO: 28010 - protein, 30 aa, Artificial Sequence
  Description of Artificial Sequence: Synthetic polypeptide
DEECIGTTNPVATECYGSVNTNALQRGSNQ

SEQ ID NO: 28011 - protein, 32 aa, Artificial Sequence
  Description of Artificial Sequence: Synthetic polypeptide
DEEEIRTTNPVATEQYGSVSNTNPNQRDSERF

SEQ ID NO: 28012 - protein, 33 aa, Artificial Sequence
  Description of Artificial Sequence: Synthetic polypeptide
DEEEIRTTNPVATEQYGSVSTTNSLQRENEITQ

SEQ ID NO: 28013 - protein, 33 aa, Artificial Sequence
  Description of Artificial Sequence: Synthetic polypeptide
DEEEIRTTNPVATEQYGSVSTMNGLGQGEGENV

SEQ ID NO: 28014 - protein, 31 aa, Artificial Sequence
  Description of Artificial Sequence: Synthetic polypeptide
DEEEIRTTNPVATEQYGSVSPGVLQRQDVRD

SEQ ID NO: 28015 - protein, 32 aa, Artificial Sequence
  Description of Artificial Sequence: Synthetic polypeptide
DEEEIRTTNPVATEQYGSVSGNNLQGSGNNGD

SEQ ID NO: 28016 - protein, 31 aa, Artificial Sequence
  Description of Artificial Sequence: Synthetic polypeptide
DEDEIRTTNPVATEQWGEVSTNLGQDHGNAR

SEQ ID NO: 28017 - protein, 31 aa, Artificial Sequence
  Description of Artificial Sequence: Synthetic polypeptide
DEEEIRTTNPVATEQYGSVSTNDNFGGDNEP

SEQ ID NO: 28018 - protein, 32 aa, Artificial Sequence
  Description of Artificial Sequence: Synthetic polypeptide
DEEEIRTTNPVATEQYGSVSTMNGLGGGNQGT

SEQ ID NO: 28019 - protein, 31 aa, Artificial Sequence
  Description of Artificial Sequence: Synthetic polypeptide
DEAEIRTTNPVATEAYGSVSTNLQANGMNDD

SEQ ID NO: 28020 - protein, 31 aa, Artificial Sequence
  Description of Artificial Sequence: Synthetic polypeptide
DEAEIRTTNPVATEAYGSVSTNLNQGDGNEN

SEQ ID NO: 28021 - protein, 30 aa, Artificial Sequence
  Description of Artificial Sequence: Synthetic polypeptide
DEEEIRTTNPVATEQYGSVSTNDMVSGEDQ

SEQ ID NO: 28022 - protein, 32 aa, Artificial Sequence
  Description of Artificial Sequence: Synthetic polypeptide
DEAEIRTTNPVATEAYGSVSCTNLSQPVGNRE

SEQ ID NO: 28023 - protein, 33 aa, Artificial Sequence
  Description of Artificial Sequence: Synthetic polypeptide
DEEEIRTTNPVATEQYGSVSTMNGLEQMGTNGI

SEQ ID NO: 28024 - protein, 31 aa, Artificial Sequence
  Description of Artificial Sequence: Synthetic polypeptide
DEEEIRTTNPVATEQYGSVVTNLDLDRENQE

SEQ ID NO: 28025 - protein, 31 aa, Artificial Sequence
  Description of Artificial Sequence: Synthetic polypeptide
DEEEIRTTNPVATEQYGSVSTTTLSDNYGNS

SEQ ID NO: 28026 - protein, 30 aa, Artificial Sequence
  Description of Artificial Sequence: Synthetic polypeptide
DEAEICTTNPVATECYGSVSTNLQHNGNDS

SEQ ID NO: 28027 - protein, 31 aa, Artificial Sequence
  Description of Artificial Sequence: Synthetic polypeptide
DEEEIRTTNPVATEQYGSVVTNLDNPELFNR

SEQ ID NO: 28028 - protein, 30 aa, Artificial Sequence
  Description of Artificial Sequence: Synthetic polypeptide
DEEEIRTTNPVATEQYGSVSDVDLQNAQND

SEQ ID NO: 28029 - protein, 33 aa, Artificial Sequence
  Description of Artificial Sequence: Synthetic polypeptide
DEEEIRTTNPVATEQYGSVSTMNGLEQNVGNTI

SEQ ID NO: 28030 - protein, 32 aa, Artificial Sequence
  Description of Artificial Sequence: Synthetic polypeptide
DEEEIRTTNPVATEQYGSVSTTNTNTRGNLEL

SEQ ID NO: 28031 - protein, 32 aa, Artificial Sequence
  Description of Artificial Sequence: Synthetic polypeptide
DEEEIRTTNPVATEQYGSYASTPNLQRANEVS

SEQ ID NO: 28032 - protein, 31 aa, Artificial Sequence
  Description of Artificial Sequence: Synthetic polypeptide
DEEEIRTTNPVATEQYGSVSSNLQGRELEEE

SEQ ID NO: 28033 - protein, 33 aa, Artificial Sequence
  Description of Artificial Sequence: Synthetic polypeptide
DEEEIRTTNPVATEQYGSVSCTNSHQERDVGDR

SEQ ID NO: 28034 - protein, 32 aa, Artificial Sequence
  Description of Artificial Sequence: Synthetic polypeptide
DEEEIRTTNPVATEQYGSVSGTNVDQSGEGNV

SEQ ID NO: 28035 - protein, 32 aa, Artificial Sequence
  Description of Artificial Sequence: Synthetic polypeptide
DEEEIRTTNPVATEQYGSVPFNELQNMGSNRT

SEQ ID NO: 28036 - protein, 32 aa, Artificial Sequence
  Description of Artificial Sequence: Synthetic polypeptide
DEEEIRTTNPVATEQYGSVQETNLQRGLDPDI

SEQ ID NO: 28037 - protein, 32 aa, Artificial Sequence
  Description of Artificial Sequence: Synthetic polypeptide
DEEEIRTTNPVATEQYGSVSTNDLQESTDDRF

SEQ ID NO: 28038 - protein, 31 aa, Artificial Sequence
  Description of Artificial Sequence: Synthetic polypeptide
DEEEIRTTNPVATEQYGSVSTTNSEGGGERS

SEQ ID NO: 28039 - protein, 30 aa, Artificial Sequence
  Description of Artificial Sequence: Synthetic polypeptide
DEEEIRTTNPVATEQYGSVSTQSLPQQVLE

SEQ ID NO: 28040 - protein, 31 aa, Artificial Sequence
  Description of Artificial Sequence: Synthetic polypeptide
DEEEIRTTNPVATEQYGSVPVTNLQDGMDQD

SEQ ID NO: 28041 - protein, 34 aa, Artificial Sequence
  Description of Artificial Sequence: Synthetic polypeptide
DEEEIRTTNPVATEQYGSVPSVTNLSQTPGGNNR

SEQ ID NO: 28042 - protein, 33 aa, Artificial Sequence
  Description of Artificial Sequence: Synthetic polypeptide
DEEEIRTTNPVATEQYGSVSTQNLNQNIGNGAT

SEQ ID NO: 28043 - protein, 31 aa, Artificial Sequence
  Description of Artificial Sequence: Synthetic polypeptide
DEDEIRTTNPVATEQYGSVATNLERTGPNEM

SEQ ID NO: 28044 - protein, 30 aa, Artificial Sequence
  Description of Artificial Sequence: Synthetic polypeptide
DEDEIRTTNPVATEQYGSVATNLERNNMEM

SEQ ID NO: 28045 - protein, 31 aa, Artificial Sequence
  Description of Artificial Sequence: Synthetic polypeptide
DEEEIRTTNPVATEQYGSVSTNHMQDRSEDG

SEQ ID NO: 28046 - protein, 31 aa, Artificial Sequence
  Description of Artificial Sequence: Synthetic polypeptide
DEEEIRTTNPVATEQYGSVSTNHNMNMENER

SEQ ID NO: 28047 - protein, 29 aa, Artificial Sequence
  Description of Artificial Sequence: Synthetic peptide
DEAEIRTTNCVAYCQYGSVSTNLQRGDVI

SEQ ID NO: 28048 - protein, 30 aa, Artificial Sequence
  Description of Artificial Sequence: Synthetic polypeptide
DEEEIRTTNPVATEQYGSVYTNGERSDEND

SEQ ID NO: 28049 - protein, 35 aa, Artificial Sequence
  Description of Artificial Sequence: Synthetic polypeptide
DEEEIRTTNPVATEQYGSVPSVTNALSQRPGGNNR

SEQ ID NO: 28050 - protein, 31 aa, Artificial Sequence
  Description of Artificial Sequence: Synthetic polypeptide
DEEEIRTTNPVATEQYGSVYLALLEQDRGND

SEQ ID NO: 28051 - protein, 33 aa, Artificial Sequence
  Description of Artificial Sequence: Synthetic polypeptide
DEEEIRTTNPVATEQYGSVSSTNLQFNEGINED

SEQ ID NO: 28052 - protein, 32 aa, Artificial Sequence
  Description of Artificial Sequence: Synthetic polypeptide
DEEEIRTTNPVATEQYGSVSTNHNQENFGSNI

SEQ ID NO: 28053 - protein, 33 aa, Artificial Sequence
  Description of Artificial Sequence: Synthetic polypeptide
DEEEIRTTNPVATEQYGSVSTTMNLNQPEGENI

SEQ ID NO: 28054 - protein, 32 aa, Artificial Sequence
  Description of Artificial Sequence: Synthetic polypeptide
DEEEIRTTNPVATEQYGSVSTQNLNNEMGNQI

SEQ ID NO: 28055 - protein, 32 aa, Artificial Sequence
  Description of Artificial Sequence: Synthetic polypeptide
DEEEIRTTNPVATEQYGSVSTQNLNEVGNVID

SEQ ID NO: 28056 - protein, 32 aa, Artificial Sequence
  Description of Artificial Sequence: Synthetic polypeptide
DEEEIRTTNPVATEQYGSVSENLQQRGFQIIE

SEQ ID NO: 28057 - protein, 31 aa, Artificial Sequence
  Description of Artificial Sequence: Synthetic polypeptide
DEEEIRTTNPVATEQYGSVSENLQQQTGEIE

SEQ ID NO: 28058 - protein, 32 aa, Artificial Sequence
  Description of Artificial Sequence: Synthetic polypeptide
DEEEIRTTNPVATEQYGSVSTTMNLQELMERV

SEQ ID NO: 28059 - protein, 32 aa, Artificial Sequence
  Description of Artificial Sequence: Synthetic polypeptide
DEEEIRTTNPVATEQYGSVSTTNLQGGLAEMY

SEQ ID NO: 28060 - protein, 32 aa, Artificial Sequence
  Description of Artificial Sequence: Synthetic polypeptide
DEEEIRTTNPVATEQYGSVSTQNLNEMGNENI

SEQ ID NO: 28061 - protein, 32 aa, Artificial Sequence
  Description of Artificial Sequence: Synthetic polypeptide
DEEEIRTTNPVATEQYGSVSTTMNLQQQNNIL

SEQ ID NO: 28062 - protein, 30 aa, Artificial Sequence
  Description of Artificial Sequence: Synthetic polypeptide
DEAEIRTTNCVAYDQYGSVPSTNLQRGGDR

SEQ ID NO: 28063 - protein, 33 aa, Artificial Sequence
  Description of Artificial Sequence: Synthetic polypeptide
DEEEIRTTNPVATEQYGSVSTTMNLQVEGENIN

SEQ ID NO: 28064 - protein, 30 aa, Artificial Sequence
  Description of Artificial Sequence: Synthetic polypeptide
DECEIRTTNPVATEQYGVVSTENLQEPNND

SEQ ID NO: 28065 - protein, 31 aa, Artificial Sequence
  Description of Artificial Sequence: Synthetic polypeptide
DEEEIRTTNPVATEQYGSVPTDLDQQRNEER

SEQ ID NO: 28066 - protein, 32 aa, Artificial Sequence
  Description of Artificial Sequence: Synthetic polypeptide
DEEEIRTTNPVATEQYGSVSTMNNHQERDMIR

SEQ ID NO: 28067 - protein, 32 aa, Artificial Sequence
  Description of Artificial Sequence: Synthetic polypeptide
DEEEIRTTNPVATEQYGSVSTTMNLEQPDENI

SEQ ID NO: 28068 - protein, 31 aa, Artificial Sequence
  Description of Artificial Sequence: Synthetic polypeptide
DEEEIRTTNPVATEQYGSVSNVDLMHGGNRS

SEQ ID NO: 28069 - protein, 33 aa, Artificial Sequence
  Description of Artificial Sequence: Synthetic polypeptide
DEEEIRTTNPVATEQYGSVPTDSLVQERGENRI

SEQ ID NO: 28070 - protein, 28 aa, Artificial Sequence
  Description of Artificial Sequence: Synthetic peptide
DEAEIRTTNGCAYCQYGSVSTNLQRGDM

SEQ ID NO: 28071 - protein, 29 aa, Artificial Sequence
  Description of Artificial Sequence: Synthetic peptide
DEAEIRTTNCVSYTQYGSVSTNLQRGTDR

SEQ ID NO: 28072 - protein, 29 aa, Artificial Sequence
  Description of Artificial Sequence: Synthetic peptide
DEDEIRTTNPVATEQYGKTSTNHSQRGDS

SEQ ID NO: 28073 - protein, 29 aa, Artificial Sequence
  Description of Artificial Sequence: Synthetic peptide
DECEIRTTNPVATEQYGVVSTALQNPNDA

SEQ ID NO: 28074 - protein, 30 aa, Artificial Sequence
  Description of Artificial Sequence: Synthetic polypeptide
DEAEIRTTNCVAYMQYGSVSTNMLSQRGDR

SEQ ID NO: 28075 - protein, 32 aa, Artificial Sequence
  Description of Artificial Sequence: Synthetic polypeptide
DEEEIRTTNPVATEQYGSVSTQNDNLNGGNED

SEQ ID NO: 28076 - protein, 30 aa, Artificial Sequence
  Description of Artificial Sequence: Synthetic polypeptide
DEAEIRTTNCVAYMQYGSVSCTNLQRGGDR

SEQ ID NO: 28077 - protein, 29 aa, Artificial Sequence
  Description of Artificial Sequence: Synthetic peptide
DEAEIRTTNCVAYHPYGSVSTNLQRGGDR

SEQ ID NO: 28078 - protein, 31 aa, Artificial Sequence
  Description of Artificial Sequence: Synthetic polypeptide
DEEEIRTTNPVATEQYGSVSNTNLQAFSSQY

SEQ ID NO: 28079 - protein, 33 aa, Artificial Sequence
  Description of Artificial Sequence: Synthetic polypeptide
DEEEIRTTNPVATEQYGSVPSCTNVSTRNGGNR

SEQ ID NO: 28080 - protein, 30 aa, Artificial Sequence
  Description of Artificial Sequence: Synthetic polypeptide
DEDEIRTTNPVATEQYGSVATNLQDGQGDH

SEQ ID NO: 28081 - protein, 28 aa, Artificial Sequence
  Description of Artificial Sequence: Synthetic peptide
DEECIATVNPVAYEAYGSVSCNLERGNR

SEQ ID NO: 28082 - protein, 29 aa, Artificial Sequence
  Description of Artificial Sequence: Synthetic peptide
DECEIRTTNPVATEQYGVVSTELQEPNDD

SEQ ID NO: 28083 - protein, 31 aa, Artificial Sequence
  Description of Artificial Sequence: Synthetic polypeptide
DEEEIRTTNPVATEQYGSVYKMNDIQDIGNR

SEQ ID NO: 28084 - protein, 32 aa, Artificial Sequence
  Description of Artificial Sequence: Synthetic polypeptide
DEEEIRTTNPVATEQYGSVSTTNLQGSGSDQS

SEQ ID NO: 28085 - protein, 31 aa, Artificial Sequence
  Description of Artificial Sequence: Synthetic polypeptide
DEAEIRTTNCVAYDQYGSVSTNLSQRTGDNR

SEQ ID NO: 28086 - protein, 32 aa, Artificial Sequence
  Description of Artificial Sequence: Synthetic polypeptide
DEEEIRTTNPVATEQYGSVYTNIDVQRINQER

SEQ ID NO: 28087 - protein, 32 aa, Artificial Sequence
  Description of Artificial Sequence: Synthetic polypeptide
DEEEIRTTNPVATEQYGSVSTQNDNPLSGGND

SEQ ID NO: 28088 - protein, 31 aa, Artificial Sequence
  Description of Artificial Sequence: Synthetic polypeptide
DECEIRTTNPVATEQYGVVSTKLQERFPGND

SEQ ID NO: 28089 - protein, 30 aa, Artificial Sequence
  Description of Artificial Sequence: Synthetic polypeptide
DEEEIRTTNPVATEQYGSVYLNLQDRNEME

SEQ ID NO: 28090 - protein, 28 aa, Artificial Sequence
  Description of Artificial Sequence: Synthetic peptide
DECEIRTTNPVATEQYGVVSTKLQGPED

SEQ ID NO: 28091 - protein, 32 aa, Artificial Sequence
  Description of Artificial Sequence: Synthetic polypeptide
DEEEIRTTNPVATEQYGSVSLTNLQTANENQE

SEQ ID NO: 28092 - protein, 29 aa, Artificial Sequence
  Description of Artificial Sequence: Synthetic peptide
DEAEIRTCNPVATEQYGSVSTPLWEGNQE

SEQ ID NO: 28093 - protein, 28 aa, Artificial Sequence
  Description of Artificial Sequence: Synthetic peptide
DEECIATVNPVATEWYGSVSWNLEGGNR

SEQ ID NO: 28094 - protein, 32 aa, Artificial Sequence
  Description of Artificial Sequence: Synthetic polypeptide
DEEEIRTTNPVATEQYGSVSGTGNGQEMGNGE

SEQ ID NO: 28095 - protein, 32 aa, Artificial Sequence
  Description of Artificial Sequence: Synthetic polypeptide
DEEEIRTTNPVATEQYGSVSNTWNLERIGEDM

SEQ ID NO: 28096 - protein, 31 aa, Artificial Sequence
  Description of Artificial Sequence: Synthetic polypeptide
DEEEIRTTNPVATEQYGSVYMTNNIQGCVNR

SEQ ID NO: 28097 - protein, 29 aa, Artificial Sequence
  Description of Artificial Sequence: Synthetic peptide
DEECIATVNPVATEWYGSVSGNLERGDNR

SEQ ID NO: 28098 - protein, 30 aa, Artificial Sequence
  Description of Artificial Sequence: Synthetic polypeptide
DECEIRTTNPVATEQYGVVSTVLQRPNNDV

SEQ ID NO: 28099 - protein, 31 aa, Artificial Sequence
  Description of Artificial Sequence: Synthetic polypeptide
DEEEIRTTNPVATEQYGSVSTTNDDRGEQHE

SEQ ID NO: 28100 - protein, 31 aa, Artificial Sequence
  Description of Artificial Sequence: Synthetic polypeptide
DEEEIRTTNPVATEQYGSVYTGNGIQEDGNE

SEQ ID NO: 28101 - protein, 29 aa, Artificial Sequence
  Description of Artificial Sequence: Synthetic peptide
DEEEIRTTNPVATEQYGSVSTTNDEGVGE

SEQ ID NO: 28102 - protein, 33 aa, Artificial Sequence
  Description of Artificial Sequence: Synthetic polypeptide
DEEEIRTTNPVATEQYGSVSTPNLQQIGVNELD

SEQ ID NO: 28103 - protein, 33 aa, Artificial Sequence
  Description of Artificial Sequence: Synthetic polypeptide
DEEEIRTTNPVATEQYGSVSGTINLDQEGNNLE

SEQ ID NO: 28104 - protein, 30 aa, Artificial Sequence
  Description of Artificial Sequence: Synthetic polypeptide
DEDEIRTTNPVATEQYGSVATNGGDAGDNR

SEQ ID NO: 28105 - protein, 30 aa, Artificial Sequence
  Description of Artificial Sequence: Synthetic polypeptide
DECEIRTTNPVATEQYGYVVSTGELQRPND

SEQ ID NO: 28106 - protein, 31 aa, Artificial Sequence
  Description of Artificial Sequence: Synthetic polypeptide
DEEEIRTTNPVATEQYGSVSTNHQNEGSELD

SEQ ID NO: 28107 - protein, 32 aa, Artificial Sequence
  Description of Artificial Sequence: Synthetic polypeptide
DEEEIRTTNPVATEQYGSVSGTLNDQGEIGNQ

SEQ ID NO: 28108 - protein, 33 aa, Artificial Sequence
  Description of Artificial Sequence: Synthetic polypeptide
DEEEIRTTNPVATEQYGSVSTMNNLQGSGEFNI

SEQ ID NO: 28109 - protein, 30 aa, Artificial Sequence
  Description of Artificial Sequence: Synthetic polypeptide
DECEIRTTNPVAYEHYGSVSTNLQQGGNNQ

SEQ ID NO: 28110 - protein, 31 aa, Artificial Sequence
  Description of Artificial Sequence: Synthetic polypeptide
DEAEIRSTNPVATEQYGSVSTNLQRFINGDP

SEQ ID NO: 28111 - protein, 32 aa, Artificial Sequence
  Description of Artificial Sequence: Synthetic polypeptide
DEEEIRTTNPVATEQYGSVSTTNDGQENDNIR

SEQ ID NO: 28112 - protein, 30 aa, Artificial Sequence
  Description of Artificial Sequence: Synthetic polypeptide
DECEIRTTNPVATEQYGVVSTVLQQGPQND

SEQ ID NO: 28113 - protein, 31 aa, Artificial Sequence
  Description of Artificial Sequence: Synthetic polypeptide
DEEEIRTTNPVATEQYGSVSTNHQFFPSNDY

SEQ ID NO: 28114 - protein, 31 aa, Artificial Sequence
  Description of Artificial Sequence: Synthetic polypeptide
DEEEIRTTNPVATEQYGSVSTNALQQNEETV

SEQ ID NO: 28115 - protein, 30 aa, Artificial Sequence
  Description of Artificial Sequence: Synthetic polypeptide
DEAEICTTNPVAYEQYGSVSTNPQGEGDNR

SEQ ID NO: 28116 - protein, 32 aa, Artificial Sequence
  Description of Artificial Sequence: Synthetic polypeptide
DEEEIRTTNPVATEQYGSVSTQNLIGGDGNTN

SEQ ID NO: 28117 - protein, 33 aa, Artificial Sequence
  Description of Artificial Sequence: Synthetic polypeptide
DEEEIRTTNPVATEQYGSVSDTNLQDEMGTNEF

SEQ ID NO: 28118 - protein, 29 aa, Artificial Sequence
  Description of Artificial Sequence: Synthetic peptide
DECEIRTTNPVATEQYGVVSTLLQEQPND

SEQ ID NO: 28119 - protein, 28 aa, Artificial Sequence
  Description of Artificial Sequence: Synthetic peptide
DEECIKTVNPVATEAWGSVSDNLERGNR

SEQ ID NO: 28120 - protein, 29 aa, Artificial Sequence
  Description of Artificial Sequence: Synthetic peptide
DEAEIRTTNPVATQQYGCVSTNLEDNGNP

SEQ ID NO: 28121 - protein, 32 aa, Artificial Sequence
  Description of Artificial Sequence: Synthetic polypeptide
DEEEIRTTNPVATEQYGSVYTNDIQRDGDNID

SEQ ID NO: 28122 - protein, 30 aa, Artificial Sequence
  Description of Artificial Sequence: Synthetic polypeptide
DECEIRTTNPVATEQYGVVSTQLNLQEPND

SEQ ID NO: 28123 - protein, 31 aa, Artificial Sequence
  Description of Artificial Sequence: Synthetic polypeptide
DEEEIRTTNPVATEQYGSVYLTNLQTPENQE

SEQ ID NO: 28124 - protein, 30 aa, Artificial Sequence
  Description of Artificial Sequence: Synthetic polypeptide
DECEIRTTNPVATEQYGVVSTQLQRPNDDH

SEQ ID NO: 28125 - protein, 32 aa, Artificial Sequence
  Description of Artificial Sequence: Synthetic polypeptide
DEEEIRTTNPVATEQYGSVSTQNLIGFGGNTT

SEQ ID NO: 28126 - protein, 30 aa, Artificial Sequence
  Description of Artificial Sequence: Synthetic polypeptide
DEEEIRTTNPVATEQYGSVYIPNSLDRGEQ

SEQ ID NO: 28127 - protein, 32 aa, Artificial Sequence
  Description of Artificial Sequence: Synthetic polypeptide
DEEEIRTTNPVATEQYGSVSTNHQERFQSNTQ

SEQ ID NO: 28128 - protein, 32 aa, Artificial Sequence
  Description of Artificial Sequence: Synthetic polypeptide
DEEEIRTTNPVATEQYGSVPSTNMQRGMVILD

SEQ ID NO: 28129 - protein, 31 aa, Artificial Sequence
  Description of Artificial Sequence: Synthetic polypeptide
DEEEIRTTNPVATEQYGSVSTNHQESFGEQD

SEQ ID NO: 28130 - protein, 31 aa, Artificial Sequence
  Description of Artificial Sequence: Synthetic polypeptide
DEEEIRTTNPVATEQYGSVYTMGEQVRGDRQ

SEQ ID NO: 28131 - protein, 30 aa, Artificial Sequence
  Description of Artificial Sequence: Synthetic polypeptide
DEEEIRTTNPVATEQYGSVYTILQTVENQG

SEQ ID NO: 28132 - protein, 32 aa, Artificial Sequence
  Description of Artificial Sequence: Synthetic polypeptide
DEEEIRTTNPVATEQYGSVSDTDLQRQVTERN

SEQ ID NO: 28133 - protein, 30 aa, Artificial Sequence
  Description of Artificial Sequence: Synthetic polypeptide
DEAEIRTTNPVATQQYGKVSTNLSERGNNP

SEQ ID NO: 28134 - protein, 32 aa, Artificial Sequence
  Description of Artificial Sequence: Synthetic polypeptide
DEEEIRTTNPVATEQYGSVPSELPNLQRTGDD

SEQ ID NO: 28135 - protein, 29 aa, Artificial Sequence
  Description of Artificial Sequence: Synthetic peptide
DECEIRTTNPVATEQYGVVSTTLQQPDND

SEQ ID NO: 28136 - protein, 32 aa, Artificial Sequence
  Description of Artificial Sequence: Synthetic polypeptide
DEEEIRTTNPVATEQYGSVSNTNLISGGENIP

SEQ ID NO: 28137 - protein, 30 aa, Artificial Sequence
  Description of Artificial Sequence: Synthetic polypeptide
DECEIRTTNPVATEQYGVVSTTLQRPENDV

SEQ ID NO: 28138 - protein, 29 aa, Artificial Sequence
  Description of Artificial Sequence: Synthetic peptide
DEECIMTTNPVATECYGSVNTNTLQQGNM

SEQ ID NO: 28139 - protein, 31 aa, Artificial Sequence
  Description of Artificial Sequence: Synthetic polypeptide
DEEEIRTTNPVATEQYGSVSTTNDIQGGDAD

SEQ ID NO: 28140 - protein, 32 aa, Artificial Sequence
  Description of Artificial Sequence: Synthetic polypeptide
DEEEIRTTNPVATEQYGSVSGTDQNGQESGNG

SEQ ID NO: 28141 - protein, 31 aa, Artificial Sequence
  Description of Artificial Sequence: Synthetic polypeptide
DEEEIRTTNPVATEQYGSVYTNLDRNLENDA

SEQ ID NO: 28142 - protein, 30 aa, Artificial Sequence
  Description of Artificial Sequence: Synthetic polypeptide
DEEEIRTTNPVATEQYGSVWTNMLPNGMEF

SEQ ID NO: 28143 - protein, 32 aa, Artificial Sequence
  Description of Artificial Sequence: Synthetic polypeptide
DEEEIRTTNPVATEQYGSVSNTNLENDGGNTN

SEQ ID NO: 28144 - protein, 31 aa, Artificial Sequence
  Description of Artificial Sequence: Synthetic polypeptide
DEEEIRTTNPVATEQYGSVSNYNLDDDGNSE

SEQ ID NO: 28145 - protein, 29 aa, Artificial Sequence
  Description of Artificial Sequence: Synthetic peptide
DEAEIRTTNGVAYCQYGQSVSTNLQGGDR

SEQ ID NO: 28146 - protein, 32 aa, Artificial Sequence
  Description of Artificial Sequence: Synthetic polypeptide
DEEEIRTTNPVATEQYGSVSGTNGGQGEGNEF

SEQ ID NO: 28147 - protein, 31 aa, Artificial Sequence
  Description of Artificial Sequence: Synthetic polypeptide
DEAEIRTTNPVATEWYGSVSTNLQEGNGNFE

SEQ ID NO: 28148 - protein, 31 aa, Artificial Sequence
  Description of Artificial Sequence: Synthetic polypeptide
DEAEIRTTNPVATEWYGSVSTNLQGDGGNAE

SEQ ID NO: 28149 - protein, 31 aa, Artificial Sequence
  Description of Artificial Sequence: Synthetic polypeptide
DEAEIRTTNPVATEWYGSVSTNLQHGGDGNA

SEQ ID NO: 28150 - protein, 32 aa, Artificial Sequence
  Description of Artificial Sequence: Synthetic polypeptide
DEEEIRTTNPVATEQYGSVSTNAQGVNGTNGF

SEQ ID NO: 28151 - protein, 31 aa, Artificial Sequence
  Description of Artificial Sequence: Synthetic polypeptide
DEDEIRTTNPVATEQYGSVATNLQRGGDDHG

SEQ ID NO: 28152 - protein, 31 aa, Artificial Sequence
  Description of Artificial Sequence: Synthetic polypeptide
DEDEIRTTNPVATEQYGEVTSTNLSQRGGDE

SEQ ID NO: 28153 - protein, 32 aa, Artificial Sequence
  Description of Artificial Sequence: Synthetic polypeptide
DEDEIRTTNPVATEQYGSVATNLQREGPNNQP

SEQ ID NO: 28154 - protein, 32 aa, Artificial Sequence
  Description of Artificial Sequence: Synthetic polypeptide
DECEIRTTNPVATEQYGSVSTNLQGDGGNTQQ

SEQ ID NO: 28155 - protein, 31 aa, Artificial Sequence
  Description of Artificial Sequence: Synthetic polypeptide
DEEEIRTTNPVATEQYGSVWTTDNNDRSGNQ

SEQ ID NO: 28156 - protein, 32 aa, Artificial Sequence
  Description of Artificial Sequence: Synthetic polypeptide
DEEEIRTTNPVATEQYGSVSTNAQEGGGTNAS

SEQ ID NO: 28157 - protein, 30 aa, Artificial Sequence
  Description of Artificial Sequence: Synthetic polypeptide
DEEEIRTTNPVATEQYGSVPTNLDNTEQRE

SEQ ID NO: 28158 - protein, 32 aa, Artificial Sequence
  Description of Artificial Sequence: Synthetic polypeptide
DEEEIRTTNPVATEQYGSVSTMNLVNGQNEGN

SEQ ID NO: 28159 - protein, 31 aa, Artificial Sequence
  Description of Artificial Sequence: Synthetic polypeptide
DEEEIRTTNPVATEQYGSVWTVPLDYDGENR

SEQ ID NO: 28160 - protein, 33 aa, Artificial Sequence
  Description of Artificial Sequence: Synthetic polypeptide
DEEEIRTTNPVATEQYGSVSTMNLVQGEGGNGQ

SEQ ID NO: 28161 - protein, 33 aa, Artificial Sequence
  Description of Artificial Sequence: Synthetic polypeptide
DEEEIRTTNPVATEQYGSVSTNGVIQSRGENES

SEQ ID NO: 28162 - protein, 31 aa, Artificial Sequence
  Description of Artificial Sequence: Synthetic polypeptide
DEEEIRTTNPVATEQYGSVYATNGIQRVQVR

SEQ ID NO: 28163 - protein, 31 aa, Artificial Sequence
  Description of Artificial Sequence: Synthetic polypeptide
DEECIRTTNPVATEQYGSVSTNLNDNGQNQQ

SEQ ID NO: 28164 - protein, 32 aa, Artificial Sequence
  Description of Artificial Sequence: Synthetic polypeptide
DEEEIRTTNPVATEQYGSVSTTMLQPRGEEQD

SEQ ID NO: 28165 - protein, 32 aa, Artificial Sequence
  Description of Artificial Sequence: Synthetic polypeptide
DEEEIRTTNPVATEQYGSVSDTDDGQRNSQNR

SEQ ID NO: 28166 - protein, 30 aa, Artificial Sequence
  Description of Artificial Sequence: Synthetic polypeptide
DEDEIRTTNPVAYERYGSVSTNLQGEGDAR

SEQ ID NO: 28167 - protein, 32 aa, Artificial Sequence
  Description of Artificial Sequence: Synthetic polypeptide
DEEEIRTTNPVATEQYGSVSTQNDNLGGGEND

SEQ ID NO: 28168 - protein, 31 aa, Artificial Sequence
  Description of Artificial Sequence: Synthetic polypeptide
DEEEIRTTNPVATEQYGSVSTTLTTRNNQDN

SEQ ID NO: 28169 - protein, 33 aa, Artificial Sequence
  Description of Artificial Sequence: Synthetic polypeptide
DEEEIRTTNPVATEQYGSVPSCTNLSHRGGNSH

SEQ ID NO: 28170 - protein, 32 aa, Artificial Sequence
  Description of Artificial Sequence: Synthetic polypeptide
DEEEIRTTNPVATEQYGSVSTMNLQRSSVFVD

SEQ ID NO: 28171 - protein, 33 aa, Artificial Sequence
  Description of Artificial Sequence: Synthetic polypeptide
DEEEIRTTNPVATEQYGSVPSCTNLSQAVGNWA

SEQ ID NO: 28172 - protein, 32 aa, Artificial Sequence
  Description of Artificial Sequence: Synthetic polypeptide
DEEEIRTTNPVATEQYGSVSDTNLVRNPDTRE

SEQ ID NO: 28173 - protein, 31 aa, Artificial Sequence
  Description of Artificial Sequence: Synthetic polypeptide
DEEEIRTTNPVATEQYGSVYTNLQQEDNNIA

SEQ ID NO: 28174 - protein, 28 aa, Artificial Sequence
  Description of Artificial Sequence: Synthetic peptide
DEAEIRTTNGVAYCQYGSVSAELQRGDR

SEQ ID NO: 28175 - protein, 31 aa, Artificial Sequence
  Description of Artificial Sequence: Synthetic polypeptide
DEEEIRTTNPVATEQYGSVYTNLQQDGELVI

SEQ ID NO: 28176 - protein, 31 aa, Artificial Sequence
  Description of Artificial Sequence: Synthetic polypeptide
DEDEIRTTNPVATEQYGAVSTNLQHDQGGNV

SEQ ID NO: 28177 - protein, 30 aa, Artificial Sequence
  Description of Artificial Sequence: Synthetic polypeptide
DEEEIRTTNPVATEQYGSVSTTMDQPSGEQ

SEQ ID NO: 28178 - protein, 32 aa, Artificial Sequence
  Description of Artificial Sequence: Synthetic polypeptide
DEEEIRTTNPVATEQYGSVYTNLQMRTLNQDG

SEQ ID NO: 28179 - protein, 30 aa, Artificial Sequence
  Description of Artificial Sequence: Synthetic polypeptide
DEAEIRTTNPVATEVYGSVVSTVNNMGGNR

SEQ ID NO: 28180 - protein, 32 aa, Artificial Sequence
  Description of Artificial Sequence: Synthetic polypeptide
DEEEIRTTNPVATEQYGSVSTQNDNLIDGNED

SEQ ID NO: 28181 - protein, 30 aa, Artificial Sequence
  Description of Artificial Sequence: Synthetic polypeptide
DEEEIRTTNPVATEQYGSVSTNGTDGQDQD

SEQ ID NO: 28182 - protein, 33 aa, Artificial Sequence
  Description of Artificial Sequence: Synthetic polypeptide
DEEEIRTTNPVATEQYGSVSTMNLQSVDGNGED

SEQ ID NO: 28183 - protein, 32 aa, Artificial Sequence
  Description of Artificial Sequence: Synthetic polypeptide
DEEEIRTTNPVATEQYGSVSTTNLQNVHNVQQ

SEQ ID NO: 28184 - protein, 33 aa, Artificial Sequence
  Description of Artificial Sequence: Synthetic polypeptide
DEEEIRTTNPVATEQYGSVPSCTNLSQRGGDPE

SEQ ID NO: 28185 - protein, 32 aa, Artificial Sequence
  Description of Artificial Sequence: Synthetic polypeptide
DEEEIRTTNPVATEQYGSVSTTMILQPEGINQ

SEQ ID NO: 28186 - protein, 32 aa, Artificial Sequence
  Description of Artificial Sequence: Synthetic polypeptide
DEEEIRTTNPVATEQYGSVSTNAQNGNGTNGS

SEQ ID NO: 28187 - protein, 32 aa, Artificial Sequence
  Description of Artificial Sequence: Synthetic polypeptide
DEEEIRTTNPVATEQYGSVSTTMIQRNGNNEE

SEQ ID NO: 28188 - protein, 33 aa, Artificial Sequence
  Description of Artificial Sequence: Synthetic polypeptide
DEEEIRTTNPVATEQYGSVSTMNLQTEMGNNED

SEQ ID NO: 28189 - protein, 33 aa, Artificial Sequence
  Description of Artificial Sequence: Synthetic polypeptide
DEEEIRTTNPVATEQYGSVSTMNLVQIGTGGNG

SEQ ID NO: 28190 - protein, 31 aa, Artificial Sequence
  Description of Artificial Sequence: Synthetic polypeptide
DEAEIRTTNPVATEYYGSVSTNLQADGNNDD

SEQ ID NO: 28191 - protein, 32 aa, Artificial Sequence
  Description of Artificial Sequence: Synthetic polypeptide
DEEEIRTTNPVATEQYGSVSTNANQGDEGGNG

SEQ ID NO: 28192 - protein, 30 aa, Artificial Sequence
  Description of Artificial Sequence: Synthetic polypeptide
DEECIRTTNPVATEQYSAEVSTNLNQNGNQ

SEQ ID NO: 28193 - protein, 30 aa, Artificial Sequence
  Description of Artificial Sequence: Synthetic polypeptide
DEAEIRTTNPVAYEQWGSVSTNLQNGDGNT

SEQ ID NO: 28194 - protein, 29 aa, Artificial Sequence
  Description of Artificial Sequence: Synthetic peptide
DEECIRTTNPVATEQYGSVSWEELRGSNQ

SEQ ID NO: 28195 - protein, 30 aa, Artificial Sequence
  Description of Artificial Sequence: Synthetic polypeptide
DEEEIRTTNPVATEQYGSVYETNLIQTMEL

SEQ ID NO: 28196 - protein, 31 aa, Artificial Sequence
  Description of Artificial Sequence: Synthetic polypeptide
DEEEIRTTNPVATEQYGSVYETNLNRENDGD

SEQ ID NO: 28197 - protein, 31 aa, Artificial Sequence
  Description of Artificial Sequence: Synthetic polypeptide
DEEEIRTTNPVATEQYGSVPTINPQDGQNPH

SEQ ID NO: 28198 - protein, 32 aa, Artificial Sequence
  Description of Artificial Sequence: Synthetic polypeptide
DEEEIRTTNPVATEQYGSVYTNLGREGQLGRE

SEQ ID NO: 28199 - protein, 31 aa, Artificial Sequence
  Description of Artificial Sequence: Synthetic polypeptide
DEEEIRTTNPVATEQYGSVSNVTLQRGEDQQ

SEQ ID NO: 28200 - protein, 32 aa, Artificial Sequence
  Description of Artificial Sequence: Synthetic polypeptide
DEEEIRTTNPVATEQYGSVSNVNLLQSNGNGS

SEQ ID NO: 28201 - protein, 30 aa, Artificial Sequence
  Description of Artificial Sequence: Synthetic polypeptide
DEEEIRTTNPVATEQYGSVSTNHINGSEIG

SEQ ID NO: 28202 - protein, 29 aa, Artificial Sequence
  Description of Artificial Sequence: Synthetic peptide
DEEEIRTTNPVATEQYGSVYEVLDDRGDV

SEQ ID NO: 28203 - protein, 30 aa, Artificial Sequence
  Description of Artificial Sequence: Synthetic polypeptide
DECEIRTTNPVATEQYGVVPSTPPLQRPND

SEQ ID NO: 28204 - protein, 31 aa, Artificial Sequence
  Description of Artificial Sequence: Synthetic polypeptide
DEDEIRTTNPVATEQYGSVATNLQEAGNDEF

SEQ ID NO: 28205 - protein, 30 aa, Artificial Sequence
  Description of Artificial Sequence: Synthetic polypeptide
DECEIRTTNPVATEQYGVVSCTGELQRVND

SEQ ID NO: 28206 - protein, 32 aa, Artificial Sequence
  Description of Artificial Sequence: Synthetic polypeptide
DEEEIRTTNPVATEQYGSVSGTDNVQEGGGND

SEQ ID NO: 28207 - protein, 31 aa, Artificial Sequence
  Description of Artificial Sequence: Synthetic polypeptide
DEEEIRTTNPVATEQYGSVYGTNGGQQRGGF

SEQ ID NO: 28208 - protein, 30 aa, Artificial Sequence
  Description of Artificial Sequence: Synthetic polypeptide
DEEEIRTTNPVATEQYGSVYTNLEGMEDER

SEQ ID NO: 28209 - protein, 29 aa, Artificial Sequence
  Description of Artificial Sequence: Synthetic peptide
DEEEIRTTNPVATEQYGSVSTNHISNSDQ

SEQ ID NO: 28210 - protein, 29 aa, Artificial Sequence
  Description of Artificial Sequence: Synthetic peptide
DEEEIRTTNPVATEQYGSVYTNLEGDTET

SEQ ID NO: 28211 - protein, 30 aa, Artificial Sequence
  Description of Artificial Sequence: Synthetic polypeptide
DEEEIRTTNPVATEQYGSVYIMNDQRGDSQ

SEQ ID NO: 28212 - protein, 28 aa, Artificial Sequence
  Description of Artificial Sequence: Synthetic peptide
DEDEIRTTNPVSTEQFGDVSTNLQFGDF

SEQ ID NO: 28213 - protein, 32 aa, Artificial Sequence
  Description of Artificial Sequence: Synthetic polypeptide
DEEEIRTTNPVATEQYGSVYEPTNLPQRLGQQ

SEQ ID NO: 28214 - protein, 31 aa, Artificial Sequence
  Description of Artificial Sequence: Synthetic polypeptide
DEEEIRTTNPVATEQYGSVSDTDLIQRIQEG

SEQ ID NO: 28215 - protein, 32 aa, Artificial Sequence
  Description of Artificial Sequence: Synthetic polypeptide
DEEEIRTTNPVATEQYGSVSTTNLQLGITEQN

SEQ ID NO: 28216 - protein, 32 aa, Artificial Sequence
  Description of Artificial Sequence: Synthetic polypeptide
DEEEIRTTNPVATEQYGSVSNWLNDLQRGSSQ

SEQ ID NO: 28217 - protein, 33 aa, Artificial Sequence
  Description of Artificial Sequence: Synthetic polypeptide
DEEEIRTTNPVATEQYGSVSTMNLVQNVGNMEM

SEQ ID NO: 28218 - protein, 33 aa, Artificial Sequence
  Description of Artificial Sequence: Synthetic polypeptide
DEEEIRTTNPVATEQYGSVPSCTNSSQRGNNQD

SEQ ID NO: 28219 - protein, 33 aa, Artificial Sequence
  Description of Artificial Sequence: Synthetic polypeptide
DEEEIRTTNPVATEQYGSVSTTMNDEQERGERE

SEQ ID NO: 28220 - protein, 33 aa, Artificial Sequence
  Description of Artificial Sequence: Synthetic polypeptide
DEEEIRTTNPVATEQYGSVSTTMNDLQRNEENT

SEQ ID NO: 28221 - protein, 31 aa, Artificial Sequence
  Description of Artificial Sequence: Synthetic polypeptide
DEDEIRTTNPVATEQYGSVATNLQERGADQA

SEQ ID NO: 28222 - protein, 33 aa, Artificial Sequence
  Description of Artificial Sequence: Synthetic polypeptide
DEEEIRTTNPVATEQYGSVSSTNLQGTGGNTME

SEQ ID NO: 28223 - protein, 30 aa, Artificial Sequence
  Description of Artificial Sequence: Synthetic polypeptide
DEEEIRTTNPVATEQYGSVSTNHENFGDQL

SEQ ID NO: 28224 - protein, 31 aa, Artificial Sequence
  Description of Artificial Sequence: Synthetic polypeptide
DEAEIRTTNPVATEYYGSVSTNLQDNGDERD

SEQ ID NO: 28225 - protein, 31 aa, Artificial Sequence
  Description of Artificial Sequence: Synthetic polypeptide
DEEEIRTTNPVATEQYGSVYDDNLQRGEGFD

SEQ ID NO: 28226 - protein, 31 aa, Artificial Sequence
  Description of Artificial Sequence: Synthetic polypeptide
DEECIRTTNPVATEQYSAEVSTNLQIFGNTR

SEQ ID NO: 28227 - protein, 31 aa, Artificial Sequence
  Description of Artificial Sequence: Synthetic polypeptide
DEEEIRTTNPVATEQYGSVYINLQEREGDED

SEQ ID NO: 28228 - protein, 30 aa, Artificial Sequence
  Description of Artificial Sequence: Synthetic polypeptide
DEEEIRTTNPVATEQYGSVSNWVDRGEQRE

SEQ ID NO: 28229 - protein, 31 aa, Artificial Sequence
  Description of Artificial Sequence: Synthetic polypeptide
DEAEIRTTNPVATEYYGSVSTNLQDNGNNED

SEQ ID NO: 28230 - protein, 32 aa, Artificial Sequence
  Description of Artificial Sequence: Synthetic polypeptide
DEEEIRTTNPVATEQYGSVSTTMNHQPSGENI

SEQ ID NO: 28231 - protein, 30 aa, Artificial Sequence
  Description of Artificial Sequence: Synthetic polypeptide
DEEEIRTTNPVATEQYGSVYTNLNQGELVA

SEQ ID NO: 28232 - protein, 32 aa, Artificial Sequence
  Description of Artificial Sequence: Synthetic polypeptide
DEEEIRTTNPVATEQYGSVSTMNNDGQGEGNS

SEQ ID NO: 28233 - protein, 30 aa, Artificial Sequence
  Description of Artificial Sequence: Synthetic polypeptide
DEAEIRTTNPVATEYYGSVSTTNGDQDGNS

SEQ ID NO: 28234 - protein, 33 aa, Artificial Sequence
  Description of Artificial Sequence: Synthetic polypeptide
DEEEIRTTNPVATEQYGSVSSTNLQGTGGGNTG

SEQ ID NO: 28235 - protein, 32 aa, Artificial Sequence
  Description of Artificial Sequence: Synthetic polypeptide
DEEEIRTTNPVATEQYGSVSTMNNGQNGGGNV

SEQ ID NO: 28236 - protein, 31 aa, Artificial Sequence
  Description of Artificial Sequence: Synthetic polypeptide
DEEEIRTTNPVATEQYGSVSNWLQRFTVERQ

SEQ ID NO: 28237 - protein, 31 aa, Artificial Sequence
  Description of Artificial Sequence: Synthetic polypeptide
DEEEIRTTNPVATEQYGSVSTNHGERGEFFE

SEQ ID NO: 28238 - protein, 32 aa, Artificial Sequence
  Description of Artificial Sequence: Synthetic polypeptide
DEEEIRTTNPVATEQYGSVSTTMNLDGEGENI

SEQ ID NO: 28239 - protein, 31 aa, Artificial Sequence
  Description of Artificial Sequence: Synthetic polypeptide
DEEEIRTTNPVATEQYGSVYDTNGIQEDGVR

SEQ ID NO: 28240 - protein, 30 aa, Artificial Sequence
  Description of Artificial Sequence: Synthetic polypeptide
DEDEISTTNPVATEQYGSVATNLQHGNSAD

SEQ ID NO: 28241 - protein, 32 aa, Artificial Sequence
  Description of Artificial Sequence: Synthetic polypeptide
DEEEIRTTNPVATEQYGSVSTMNNQISGNDEV

SEQ ID NO: 28242 - protein, 29 aa, Artificial Sequence
  Description of Artificial Sequence: Synthetic peptide
DEECIRTTNPVATEQYGSVYTHELRDGNT

SEQ ID NO: 28243 - protein, 32 aa, Artificial Sequence
  Description of Artificial Sequence: Synthetic polypeptide
DEEEIRTTNPVATEQYGSVSTMNVEQGGNNTE

SEQ ID NO: 28244 - protein, 33 aa, Artificial Sequence
  Description of Artificial Sequence: Synthetic polypeptide
DEEEIRTTNPVATEQYGSVSGTNLQQNNEGNTM

SEQ ID NO: 28245 - protein, 33 aa, Artificial Sequence
  Description of Artificial Sequence: Synthetic polypeptide
DEEEIRTTNPVATEQYGSVSTTNGGLQGRGEVD

SEQ ID NO: 28246 - protein, 32 aa, Artificial Sequence
  Description of Artificial Sequence: Synthetic polypeptide
DEEEIRTTNPVATEQYGSVSTMNVIQEGGNDF

SEQ ID NO: 28247 - protein, 29 aa, Artificial Sequence
  Description of Artificial Sequence: Synthetic peptide
DEAEIRTTNPVAYEQWGSVSTNDQHGNPD

SEQ ID NO: 28248 - protein, 28 aa, Artificial Sequence
  Description of Artificial Sequence: Synthetic peptide
DEAEIHTTNSVAYCQWGSVSTNLQRGDR

SEQ ID NO: 28249 - protein, 32 aa, Artificial Sequence
  Description of Artificial Sequence: Synthetic polypeptide
DEEEIRTTNPVATEQYGSVSSTNLNMTGGNED

SEQ ID NO: 28250 - protein, 33 aa, Artificial Sequence
  Description of Artificial Sequence: Synthetic polypeptide
DEEEIRTTNPVATEQYGSVSGTNLQQNEMGNGQ

SEQ ID NO: 28251 - protein, 32 aa, Artificial Sequence
  Description of Artificial Sequence: Synthetic polypeptide
DEEEIRTTNPVATEQYGSVSTNADQAVENERN

SEQ ID NO: 28252 - protein, 31 aa, Artificial Sequence
  Description of Artificial Sequence: Synthetic polypeptide
DEEEIRTTNPVATEQYGSVSTTNGGQEGQEF

SEQ ID NO: 28253 - protein, 32 aa, Artificial Sequence
  Description of Artificial Sequence: Synthetic polypeptide
DEEEIRTTNPVATEQYGSVYSSNNIDQGSGNR

SEQ ID NO: 28254 - protein, 32 aa, Artificial Sequence
  Description of Artificial Sequence: Synthetic polypeptide
DEEEIRTTNPVATEQYGSVSTMNVIQGFGGND

SEQ ID NO: 28255 - protein, 32 aa, Artificial Sequence
  Description of Artificial Sequence: Synthetic polypeptide
DEEEIRTTNPVATEQYGSVSTTNLERINQQED

SEQ ID NO: 28256 - protein, 32 aa, Artificial Sequence
  Description of Artificial Sequence: Synthetic polypeptide
DEEEIRTTNPVATEQYGSVSTTNGGQQLGNQV

SEQ ID NO: 28257 - protein, 28 aa, Artificial Sequence
  Description of Artificial Sequence: Synthetic peptide
DEAEIRATNGTAYQQYGSVSTNLQRGDR

SEQ ID NO: 28258 - protein, 31 aa, Artificial Sequence
  Description of Artificial Sequence: Synthetic polypeptide
DEEEIRTTNPVATEQYGSVSTTNGGQTGQAN

SEQ ID NO: 28259 - protein, 33 aa, Artificial Sequence
  Description of Artificial Sequence: Synthetic polypeptide
DEEEIRTTNPVATEQYGSVSSTENLQTEMGTNE

SEQ ID NO: 28260 - protein, 33 aa, Artificial Sequence
  Description of Artificial Sequence: Synthetic polypeptide
DEEEIRTTNPVATEQYGSVSNTTNLIQGIGNGD

SEQ ID NO: 28261 - protein, 31 aa, Artificial Sequence
  Description of Artificial Sequence: Synthetic polypeptide
DEAEIRTTNPVAYEAYGSVATNLSQDRGGNR

SEQ ID NO: 28262 - protein, 32 aa, Artificial Sequence
  Description of Artificial Sequence: Synthetic polypeptide
DEEEIRTTNPVATEQYGSVSTQNGVEQVGNSQ

SEQ ID NO: 28263 - protein, 31 aa, Artificial Sequence
  Description of Artificial Sequence: Synthetic polypeptide
DEAEIRTTNPVAYEAYGSVATNLSQRGGNRF

SEQ ID NO: 28264 - protein, 32 aa, Artificial Sequence
  Description of Artificial Sequence: Synthetic polypeptide
DEEEIRTTNPVATEQYGSVSDTELQGGSNFQP

SEQ ID NO: 28265 - protein, 33 aa, Artificial Sequence
  Description of Artificial Sequence: Synthetic polypeptide
DEEEIRTTNPVATEQYGSVSGTNLQQGEAGGNP

SEQ ID NO: 28266 - protein, 32 aa, Artificial Sequence
  Description of Artificial Sequence: Synthetic polypeptide
DEEEIRTTNPVATEQYGSVSTQNGNQNNNGNE

SEQ ID NO: 28267 - protein, 31 aa, Artificial Sequence
  Description of Artificial Sequence: Synthetic polypeptide
DEEEIRTTNPVATEQYGSVSDTELNQYSSDR

SEQ ID NO: 28268 - protein, 33 aa, Artificial Sequence
  Description of Artificial Sequence: Synthetic polypeptide
DEEEIRTTNPVATEQYGSVSGTNLQSGGGGNED

SEQ ID NO: 28269 - protein, 32 aa, Artificial Sequence
  Description of Artificial Sequence: Synthetic polypeptide
DEEEIRTTNPVATEQYGSVSDTELDQRFSSNQ

SEQ ID NO: 28270 - protein, 32 aa, Artificial Sequence
  Description of Artificial Sequence: Synthetic polypeptide
DEEEIRTTNPVATEQYGSVSTMNTQAFGSNQT

SEQ ID NO: 28271 - protein, 31 aa, Artificial Sequence
  Description of Artificial Sequence: Synthetic polypeptide
DEEEIRTTNPVATEQYGSVSTNAHQENFMQR

SEQ ID NO: 28272 - protein, 33 aa, Artificial Sequence
  Description of Artificial Sequence: Synthetic polypeptide
DEEEIRTTNPVATEQYGSVSTQNLEQNMGFNNQ

SEQ ID NO: 28273 - protein, 31 aa, Artificial Sequence
  Description of Artificial Sequence: Synthetic polypeptide
DEEEIRTTNPVATEQYGSVSTNAHQEGFMDQ

SEQ ID NO: 28274 - protein, 33 aa, Artificial Sequence
  Description of Artificial Sequence: Synthetic polypeptide
DEEEIRTTNPVATEQYGSVYSENLNQRSGEERM

SEQ ID NO: 28275 - protein, 32 aa, Artificial Sequence
  Description of Artificial Sequence: Synthetic polypeptide
DEEEIRTTNPVATEQYGSVSTQNGNQNGGNDQ

SEQ ID NO: 28276 - protein, 32 aa, Artificial Sequence
  Description of Artificial Sequence: Synthetic polypeptide
DEEEIRTTNPVATEQYGSVSTTNLIREIPARD

SEQ ID NO: 28277 - protein, 32 aa, Artificial Sequence
  Description of Artificial Sequence: Synthetic polypeptide
DEEEIRTTNPVATEQYGSVSTMNTQQNIGTNP

SEQ ID NO: 28278 - protein, 30 aa, Artificial Sequence
  Description of Artificial Sequence: Synthetic polypeptide
DEDEIRTTNPVATEQYGSCSTNDQREGQDD

SEQ ID NO: 28279 - protein, 31 aa, Artificial Sequence
  Description of Artificial Sequence: Synthetic polypeptide
DEEEIRTTNPVATEQYGSVSTTNLINDNAID

SEQ ID NO: 28280 - protein, 33 aa, Artificial Sequence
  Description of Artificial Sequence: Synthetic polypeptide
DEEEIRTTNPVATEQYGSVSSTNLHERSGQEDR

SEQ ID NO: 28281 - protein, 33 aa, Artificial Sequence
  Description of Artificial Sequence: Synthetic polypeptide
DEEEIRTTNPVATEQYGSVSTNAGSQRVGNNPT

SEQ ID NO: 28282 - protein, 30 aa, Artificial Sequence
  Description of Artificial Sequence: Synthetic polypeptide
DEAEIRATNPVATEQYGFVSMTNLFQGGNN

SEQ ID NO: 28283 - protein, 32 aa, Artificial Sequence
  Description of Artificial Sequence: Synthetic polypeptide
DEEEIRTTNPVATEQYGSVSTMNTVIQEGNDD

SEQ ID NO: 28284 - protein, 32 aa, Artificial Sequence
  Description of Artificial Sequence: Synthetic polypeptide
DEEEIRTTNPVATEQYGSVSTMNVEQGEGGND

SEQ ID NO: 28285 - protein, 33 aa, Artificial Sequence
  Description of Artificial Sequence: Synthetic polypeptide
DEEEIRTTNPVATEQYGSVYSNTNCIQKCGNRI

SEQ ID NO: 28286 - protein, 32 aa, Artificial Sequence
  Description of Artificial Sequence: Synthetic polypeptide
DEEEIRTTNPVATEQYGSVSTQNGNQNNGFNN

SEQ ID NO: 28287 - protein, 33 aa, Artificial Sequence
  Description of Artificial Sequence: Synthetic polypeptide
DEEEIRTTNPVATEQYGSVYSNTNDIQENGSNR

SEQ ID NO: 28288 - protein, 30 aa, Artificial Sequence
  Description of Artificial Sequence: Synthetic polypeptide
DEEEIACTNPVATEQYGSVATNLQAEDNER

SEQ ID NO: 28289 - protein, 31 aa, Artificial Sequence
  Description of Artificial Sequence: Synthetic polypeptide
DEAEIGTTNPVATEQYGSVSTNDLQERMGVL

SEQ ID NO: 28290 - protein, 33 aa, Artificial Sequence
  Description of Artificial Sequence: Synthetic polypeptide
DEEEIRTTNPVATEQYGSVYSTNCIGQKCGNRF

SEQ ID NO: 28291 - protein, 32 aa, Artificial Sequence
  Description of Artificial Sequence: Synthetic polypeptide
DEEEIRTTNPVATEQYGSVSTQNLELEAGGNQ

SEQ ID NO: 28292 - protein, 32 aa, Artificial Sequence
  Description of Artificial Sequence: Synthetic polypeptide
DEEEIRTTNPVATEQYGSVYSTNCIQGCGLER

SEQ ID NO: 28293 - protein, 30 aa, Artificial Sequence
  Description of Artificial Sequence: Synthetic polypeptide
DEECIRTTNPVAYEPYGCVSTNLSQEGGNR

SEQ ID NO: 28294 - protein, 31 aa, Artificial Sequence
  Description of Artificial Sequence: Synthetic polypeptide
DEEEIRTTNPVATEQYGSVSTTNLDRMIPED

SEQ ID NO: 28295 - protein, 32 aa, Artificial Sequence
  Description of Artificial Sequence: Synthetic polypeptide
DEEEIRTTNPVATEQYGSVSDTEWLEQRSQSR

SEQ ID NO: 28296 - protein, 28 aa, Artificial Sequence
  Description of Artificial Sequence: Synthetic peptide
DECEIYTTNPVATEQYGSVSTNDMYGDT

SEQ ID NO: 28297 - protein, 33 aa, Artificial Sequence
  Description of Artificial Sequence: Synthetic polypeptide
DEEEIRTTNPVATEQYGSVSGTNLQMEMGNGQE

SEQ ID NO: 28298 - protein, 30 aa, Artificial Sequence
  Description of Artificial Sequence: Synthetic polypeptide
DEAEIRTTNPVAYEQWGSVSTNLGQGGDMR

SEQ ID NO: 28299 - protein, 32 aa, Artificial Sequence
  Description of Artificial Sequence: Synthetic polypeptide
DEEEIRTTNPVATEQYGSVSSTNLITGGGNGD

SEQ ID NO: 28300 - protein, 33 aa, Artificial Sequence
  Description of Artificial Sequence: Synthetic polypeptide
DEEEIRTTNPVATEQYGSVSTTNLDQEVTNIRD

SEQ ID NO: 28301 - protein, 31 aa, Artificial Sequence
  Description of Artificial Sequence: Synthetic polypeptide
DEEEIRTTNPVATEQYGSVYSTNDPGRGSQS

SEQ ID NO: 28302 - protein, 32 aa, Artificial Sequence
  Description of Artificial Sequence: Synthetic polypeptide
DEEEIRTTNPVATEQYGSVSGTNLQNEDNGGE

SEQ ID NO: 28303 - protein, 29 aa, Artificial Sequence
  Description of Artificial Sequence: Synthetic peptide
DECEIYTTNPVATEQYGSVSTNLMYGETF

SEQ ID NO: 28304 - protein, 32 aa, Artificial Sequence
  Description of Artificial Sequence: Synthetic polypeptide
DEEEIRTTNPVATEQYGSVSDTGNTQNSGSNQ

SEQ ID NO: 28305 - protein, 29 aa, Artificial Sequence
  Description of Artificial Sequence: Synthetic peptide
DEEEIRTTNPVATEQYGSVYSTNIVLNEE

SEQ ID NO: 28306 - protein, 33 aa, Artificial Sequence
  Description of Artificial Sequence: Synthetic polypeptide
DEEEIRTTNPVATEQYGSVSTTNGQLQQGSTNP

SEQ ID NO: 28307 - protein, 28 aa, Artificial Sequence
  Description of Artificial Sequence: Synthetic peptide
DEDEIATTNPVATAQYGCVSTALQRSNQ

SEQ ID NO: 28308 - protein, 33 aa, Artificial Sequence
  Description of Artificial Sequence: Synthetic polypeptide
DEEEIRTTNPVATEQYGSVSGTNLQNGGGNEGT

SEQ ID NO: 28309 - protein, 31 aa, Artificial Sequence
  Description of Artificial Sequence: Synthetic polypeptide
DEEEIRTTNPVATEQYGSVPSNTNEQRMEEQ

SEQ ID NO: 28310 - protein, 31 aa, Artificial Sequence
  Description of Artificial Sequence: Synthetic polypeptide
DEEEIRTTNPVATEQYGSVSENLQDFNNESN

SEQ ID NO: 28311 - protein, 29 aa, Artificial Sequence
  Description of Artificial Sequence: Synthetic peptide
DEECIATVNPVATEWYGSVSDNLERGNFR

SEQ ID NO: 28312 - protein, 30 aa, Artificial Sequence
  Description of Artificial Sequence: Synthetic polypeptide
DECEIYTTNPVATEQYGSVSTNLMYGENTN

SEQ ID NO: 28313 - protein, 30 aa, Artificial Sequence
  Description of Artificial Sequence: Synthetic polypeptide
DEEEIRTTNPVATEQYGSVSTTNLAVNEIV

SEQ ID NO: 28314 - protein, 28 aa, Artificial Sequence
  Description of Artificial Sequence: Synthetic peptide
DEECIATVNPVATEPYGSVSDNLERMNR

SEQ ID NO: 28315 - protein, 33 aa, Artificial Sequence
  Description of Artificial Sequence: Synthetic polypeptide
DEEEIRTTNPVATEQYGSVSTTNGLERGEENNV

SEQ ID NO: 28316 - protein, 31 aa, Artificial Sequence
  Description of Artificial Sequence: Synthetic polypeptide
DEEEIRTTNPVATEQYGSVSENLQDGEGESP

SEQ ID NO: 28317 - protein, 29 aa, Artificial Sequence
  Description of Artificial Sequence: Synthetic peptide
DECEIYTTNPVATEQYGSVSTNSMYYGNT

SEQ ID NO: 28318 - protein, 28 aa, Artificial Sequence
  Description of Artificial Sequence: Synthetic peptide
DEECIKTVNPVATEWYGSVSDNLEDGNR

SEQ ID NO: 28319 - protein, 31 aa, Artificial Sequence
  Description of Artificial Sequence: Synthetic polypeptide
DEEEIRTTNPVATEQYGSVYSTNCIQKCGQI

SEQ ID NO: 28320 - protein, 31 aa, Artificial Sequence
  Description of Artificial Sequence: Synthetic polypeptide
DEEEIRTTNPVATEQYGSVSTQNIGDDEGNV

SEQ ID NO: 28321 - protein, 33 aa, Artificial Sequence
  Description of Artificial Sequence: Synthetic polypeptide
DEEEIRTTNPVATEQYGSVSTQNIGLQNNGNGE

SEQ ID NO: 28322 - protein, 32 aa, Artificial Sequence
  Description of Artificial Sequence: Synthetic polypeptide
DEEEIRTTNPVATEQYGSVSTTNGIQESGNTE

SEQ ID NO: 28323 - protein, 33 aa, Artificial Sequence
  Description of Artificial Sequence: Synthetic polypeptide
DEEEIRTTNPVATEQYGSVSGTNLQGSGGNNGD

SEQ ID NO: 28324 - protein, 31 aa, Artificial Sequence
  Description of Artificial Sequence: Synthetic polypeptide
DEEEIRTTNPVATEQYGSVSDTMSLPMGERF

SEQ ID NO: 28325 - protein, 33 aa, Artificial Sequence
  Description of Artificial Sequence: Synthetic polypeptide
DEEEIRTTNPVATEQYGSVSGTNLQQEAGGNGQ

SEQ ID NO: 28326 - protein, 33 aa, Artificial Sequence
  Description of Artificial Sequence: Synthetic polypeptide
DEEEIRTTNPVATEQYGSVSGTNLQQEAGGNDT

SEQ ID NO: 28327 - protein, 31 aa, Artificial Sequence
  Description of Artificial Sequence: Synthetic polypeptide
DEEEIRTTNPVATEQYGSVYSTNNINTGGNQ

SEQ ID NO: 28328 - protein, 32 aa, Artificial Sequence
  Description of Artificial Sequence: Synthetic polypeptide
DEEEIRTTNPVATEQYGSVSGTNDQGEGGNED

SEQ ID NO: 28329 - protein, 32 aa, Artificial Sequence
  Description of Artificial Sequence: Synthetic polypeptide
DEEEIRTTNPVATEQYGSVYSTNCIQKCLNRE

SEQ ID NO: 28330 - protein, 33 aa, Artificial Sequence
  Description of Artificial Sequence: Synthetic polypeptide
DEEEIRTTNPVATEQYGSVSGTNLQGSGGNNST

SEQ ID NO: 28331 - protein, 33 aa, Artificial Sequence
  Description of Artificial Sequence: Synthetic polypeptide
DEEEIRTTNPVATEQYGSVSTTNLENRENVERT

SEQ ID NO: 28332 - protein, 32 aa, Artificial Sequence
  Description of Artificial Sequence: Synthetic polypeptide
DEEEIRTTNPVATEQYGSVSTTNLEHGQNQLM

SEQ ID NO: 28333 - protein, 33 aa, Artificial Sequence
  Description of Artificial Sequence: Synthetic polypeptide
DEEEIRTTNPVATEQYGSVSGTNLQMEGGNITT

SEQ ID NO: 28334 - protein, 28 aa, Artificial Sequence
  Description of Artificial Sequence: Synthetic peptide
DEDEIATTNPVATAQYGCVSTGLERGNQ

SEQ ID NO: 28335 - protein, 33 aa, Artificial Sequence
  Description of Artificial Sequence: Synthetic polypeptide
DEEEIRTTNPVATEQYGSVSTTNLEGGENNIRS

SEQ ID NO: 28336 - protein, 31 aa, Artificial Sequence
  Description of Artificial Sequence: Synthetic polypeptide
DEEEIRTTNPVATEQYGSVSLTNNGQNDEIR

SEQ ID NO: 28337 - protein, 33 aa, Artificial Sequence
  Description of Artificial Sequence: Synthetic polypeptide
DEEEIRTTNPVATEQYGSVSGTNLQMEMGNGDG

SEQ ID NO: 28338 - protein, 30 aa, Artificial Sequence
  Description of Artificial Sequence: Synthetic polypeptide
DECEIYTTNPVATEQYGSVSYTNLNMGGNT

SEQ ID NO: 28339 - protein, 32 aa, Artificial Sequence
  Description of Artificial Sequence: Synthetic polypeptide
DEEEIRTTNPVATEQYGSVSTQNIGNQGNGNM

SEQ ID NO: 28340 - protein, 32 aa, Artificial Sequence
  Description of Artificial Sequence: Synthetic polypeptide
DEEEIRTTNPVATEQYGSVYSTNNEQGGGNFN

SEQ ID NO: 28341 - protein, 29 aa, Artificial Sequence
  Description of Artificial Sequence: Synthetic peptide
DEEEIRTTNPVATEQYGSVYPNLDNIGEI

SEQ ID NO: 28342 - protein, 32 aa, Artificial Sequence
  Description of Artificial Sequence: Synthetic polypeptide
DEEEIRTTNPVATEQYGSVSGTNLQSNGTGEN

SEQ ID NO: 28343 - protein, 33 aa, Artificial Sequence
  Description of Artificial Sequence: Synthetic polypeptide
DEEEIRTTNPVATEQYGSVYSDTNDIQKGGNNR

SEQ ID NO: 28344 - protein, 28 aa, Artificial Sequence
  Description of Artificial Sequence: Synthetic peptide
DEAEIRATNPVAYEQYGSVATNLVRGDL

SEQ ID NO: 28345 - protein, 33 aa, Artificial Sequence
  Description of Artificial Sequence: Synthetic polypeptide
DEEEIRTTNPVATEQYGSVSTMNQLGQNGGNTV

SEQ ID NO: 28346 - protein, 30 aa, Artificial Sequence
  Description of Artificial Sequence: Synthetic polypeptide
DEAEIRTTNPVAVEQYGSISTNLERLPSNR

SEQ ID NO: 28347 - protein, 32 aa, Artificial Sequence
  Description of Artificial Sequence: Synthetic polypeptide
DEEEIRTTNPVATEQYGSVSTQNGGQNNGGNE

SEQ ID NO: 28348 - protein, 31 aa, Artificial Sequence
  Description of Artificial Sequence: Synthetic polypeptide
DEEEIRTTNPVATEQYGSVSTNHQSSGSDLP

SEQ ID NO: 28349 - protein, 30 aa, Artificial Sequence
  Description of Artificial Sequence: Synthetic polypeptide
DEEEIRTTNPVATEQYGSVYPTNPGQTGEN

SEQ ID NO: 28350 - protein, 30 aa, Artificial Sequence
  Description of Artificial Sequence: Synthetic polypeptide
DECEIRTTNPVAYEQWGSVSTNLQGGNTDM

SEQ ID NO: 28351 - protein, 32 aa, Artificial Sequence
  Description of Artificial Sequence: Synthetic polypeptide
DEEEIRTTNPVATEQYGSVYTDNDLQIGENSD

SEQ ID NO: 28352 - protein, 33 aa, Artificial Sequence
  Description of Artificial Sequence: Synthetic polypeptide
DEEEIRTTNPVATEQYGSVYTDNDLQERGNQSD

SEQ ID NO: 28353 - protein, 32 aa, Artificial Sequence
  Description of Artificial Sequence: Synthetic polypeptide
DEEEIRTTNPVATEQYGSVYTDNDLQADGDNQ

SEQ ID NO: 28354 - protein, 33 aa, Artificial Sequence
  Description of Artificial Sequence: Synthetic polypeptide
DEEEIRTTNPVATEQYGSVSTTNDLQRDNIENT

SEQ ID NO: 28355 - protein, 30 aa, Artificial Sequence
  Description of Artificial Sequence: Synthetic polypeptide
DEEEIACTNPVATEQYGSVATNLQDGPGNL

SEQ ID NO: 28356 - protein, 31 aa, Artificial Sequence
  Description of Artificial Sequence: Synthetic polypeptide
DEEEIRTTNPVATEQYGSVYTDNDLDRGGSD

SEQ ID NO: 28357 - protein, 32 aa, Artificial Sequence
  Description of Artificial Sequence: Synthetic polypeptide
DEEEIRTTNPVATEQYGSVSGTMNEIQGEGND

SEQ ID NO: 28358 - protein, 30 aa, Artificial Sequence
  Description of Artificial Sequence: Synthetic polypeptide
DEEEIRTTNPVATEQYGSVYTDMIQRGEEQ

SEQ ID NO: 28359 - protein, 31 aa, Artificial Sequence
  Description of Artificial Sequence: Synthetic polypeptide
DEEEIACTNPVATEQYGSVATNLQAAGENVR

SEQ ID NO: 28360 - protein, 31 aa, Artificial Sequence
  Description of Artificial Sequence: Synthetic polypeptide
DEEEIRTTNPVATEQYGSVSTQNLGNGIGGE

SEQ ID NO: 28361 - protein, 33 aa, Artificial Sequence
  Description of Artificial Sequence: Synthetic polypeptide
DEEEIRTTNPVATEQYGSVSTTNLQEVGENIFD

SEQ ID NO: 28362 - protein, 29 aa, Artificial Sequence
  Description of Artificial Sequence: Synthetic peptide
DECEIRTTNPVAYEQYGVVSTGLQRPNDK

SEQ ID NO: 28363 - protein, 30 aa, Artificial Sequence
  Description of Artificial Sequence: Synthetic polypeptide
DECEIRTTNPVAYEQYGVVSTNLQGDAGNE

SEQ ID NO: 28364 - protein, 33 aa, Artificial Sequence
  Description of Artificial Sequence: Synthetic polypeptide
DEEEIRTTNPVATEQYGSVSTNKHQERDMNIRN

SEQ ID NO: 28365 - protein, 32 aa, Artificial Sequence
  Description of Artificial Sequence: Synthetic polypeptide
DEEEIRTTNPVATEQYGSVYPTNLQRTLNNVG

SEQ ID NO: 28366 - protein, 31 aa, Artificial Sequence
  Description of Artificial Sequence: Synthetic polypeptide
DEEEIRTTNPVATEQYGSVSTTNLQEVEEEG

SEQ ID NO: 28367 - protein, 30 aa, Artificial Sequence
  Description of Artificial Sequence: Synthetic polypeptide
DEEEIACTNPVATEQYGSVATNLQDPNDRN

SEQ ID NO: 28368 - protein, 33 aa, Artificial Sequence
  Description of Artificial Sequence: Synthetic polypeptide
DEEEIRTTNPVATEQYGSVSTMNQLDQNGEGNI

SEQ ID NO: 28369 - protein, 31 aa, Artificial Sequence
  Description of Artificial Sequence: Synthetic polypeptide
DEEEIACTNPVATEQYGSVATNLQDRTGNEE

SEQ ID NO: 28370 - protein, 32 aa, Artificial Sequence
  Description of Artificial Sequence: Synthetic polypeptide
DEEEIRTTNPVATEQYGSVSTQNDQGIGGNNV

SEQ ID NO: 28371 - protein, 29 aa, Artificial Sequence
  Description of Artificial Sequence: Synthetic peptide
DEAEIRTTNPVAVEQYGSCSTNLERENQY

SEQ ID NO: 28372 - protein, 32 aa, Artificial Sequence
  Description of Artificial Sequence: Synthetic polypeptide
DEEEIRTTNPVATEQYGSVSTMNNVIQGEGNE

SEQ ID NO: 28373 - protein, 31 aa, Artificial Sequence
  Description of Artificial Sequence: Synthetic polypeptide
DEEEIRTTNPVATEQYGSVSTNALNQMVEPQ

SEQ ID NO: 28374 - protein, 32 aa, Artificial Sequence
  Description of Artificial Sequence: Synthetic polypeptide
DEECIRTTNPVATEQYGVVVSTNLQYGMTQNR

SEQ ID NO: 28375 - protein, 29 aa, Artificial Sequence
  Description of Artificial Sequence: Synthetic peptide
DEAEIRTTNPVAVEQYGSCSTNLERPERA

SEQ ID NO: 28376 - protein, 31 aa, Artificial Sequence
  Description of Artificial Sequence: Synthetic polypeptide
DEAEIRCTNPVATEQYGSVSTGNLQDVGNAV

SEQ ID NO: 28377 - protein, 32 aa, Artificial Sequence
  Description of Artificial Sequence: Synthetic polypeptide
DEEEIRTTNPVATEQYGSVYPTDNDLQRDNSD

SEQ ID NO: 28378 - protein, 33 aa, Artificial Sequence
  Description of Artificial Sequence: Synthetic polypeptide
DEEEIRTTNPVATEQYGSVSTNALLQQRAENEL

SEQ ID NO: 28379 - protein, 32 aa, Artificial Sequence
  Description of Artificial Sequence: Synthetic polypeptide
DEEEIRTTNPVATEQYGSVSGTNDQQGEGGNG

SEQ ID NO: 28380 - protein, 32 aa, Artificial Sequence
  Description of Artificial Sequence: Synthetic polypeptide
DEEEIRTTNPVATEQYGSVPSTNEHQERPVSR

SEQ ID NO: 28381 - protein, 32 aa, Artificial Sequence
  Description of Artificial Sequence: Synthetic polypeptide
DEEEIRTTNPVATEQYGSVSTMNQDQGGGGNV

SEQ ID NO: 28382 - protein, 33 aa, Artificial Sequence
  Description of Artificial Sequence: Synthetic polypeptide
DEEEIRTTNPVATEQYGSVPSTNDIQQIQGNRH

SEQ ID NO: 28383 - protein, 31 aa, Artificial Sequence
  Description of Artificial Sequence: Synthetic polypeptide
DEEEIRTTNPVATEQYGSVYTENEGRGENEQ

SEQ ID NO: 28384 - protein, 28 aa, Artificial Sequence
  Description of Artificial Sequence: Synthetic peptide
DEAEIRTTNPVAVEQYGSISTLLERPNC

SEQ ID NO: 28385 - protein, 32 aa, Artificial Sequence
  Description of Artificial Sequence: Synthetic polypeptide
DEEEIRTTNPVATEQYGSVSTNHQRSGSDTDP

SEQ ID NO: 28386 - protein, 31 aa, Artificial Sequence
  Description of Artificial Sequence: Synthetic polypeptide
DEECIRTTNPVATEQYRWEVSTNALSQIGNR

SEQ ID NO: 28387 - protein, 31 aa, Artificial Sequence
  Description of Artificial Sequence: Synthetic polypeptide
DEEEIACTNPVATEQYGSVATNLQDRGNNEH

SEQ ID NO: 28388 - protein, 32 aa, Artificial Sequence
  Description of Artificial Sequence: Synthetic polypeptide
DEEEIRTTNPVATEQYGSVYPTNLPQRGVEDQ

SEQ ID NO: 28389 - protein, 33 aa, Artificial Sequence
  Description of Artificial Sequence: Synthetic polypeptide
DEEEIRTTNPVATEQYGSVSTMNQLDQNEGGNE

SEQ ID NO: 28390 - protein, 31 aa, Artificial Sequence
  Description of Artificial Sequence: Synthetic polypeptide
DEEEIACTNPVATEQYGSVATNLERNGDNER

SEQ ID NO: 28391 - protein, 31 aa, Artificial Sequence
  Description of Artificial Sequence: Synthetic polypeptide
DEEEIRTTNPVATEQYGSVYPTWDLPQDENR

SEQ ID NO: 28392 - protein, 33 aa, Artificial Sequence
  Description of Artificial Sequence: Synthetic polypeptide
DEEEIRTTNPVATEQYGSVSGTMNLEQGGGNED

SEQ ID NO: 28393 - protein, 32 aa, Artificial Sequence
  Description of Artificial Sequence: Synthetic polypeptide
DEEEIRTTNPVATEQYGSVSGTNDQMEGGNIN

SEQ ID NO: 28394 - protein, 29 aa, Artificial Sequence
  Description of Artificial Sequence: Synthetic peptide
DECEISTTNPVATEQYGSVSHNLDMDGNT

SEQ ID NO: 28395 - protein, 34 aa, Artificial Sequence
  Description of Artificial Sequence: Synthetic polypeptide
DEEEIRTTNPVATEQYGSVSTTNLPQMRNGMNPV

SEQ ID NO: 28396 - protein, 33 aa, Artificial Sequence
  Description of Artificial Sequence: Synthetic polypeptide
DEEEIRTTNPVATEQYGSVPSTDSWDQRGNERP

SEQ ID NO: 28397 - protein, 31 aa, Artificial Sequence
  Description of Artificial Sequence: Synthetic polypeptide
DEEEIRTTNPVATEQYGSVSTQNGIEDGGNE

SEQ ID NO: 28398 - protein, 32 aa, Artificial Sequence
  Description of Artificial Sequence: Synthetic polypeptide
DEEEIRTTNPVATEQYGSVSSTNLGNFGGNIQ

SEQ ID NO: 28399 - protein, 30 aa, Artificial Sequence
  Description of Artificial Sequence: Synthetic polypeptide
DECEISTTNPVATEQYGSVSTNLMGDGNTH

SEQ ID NO: 28400 - protein, 32 aa, Artificial Sequence
  Description of Artificial Sequence: Synthetic polypeptide
DEEEIRTTNPVATEQYGSVSSTDNVLFEFGIR

SEQ ID NO: 28401 - protein, 32 aa, Artificial Sequence
  Description of Artificial Sequence: Synthetic polypeptide
DEEEIRTTNPVATEQYGSVSTTNLNRQGVTPE

SEQ ID NO: 28402 - protein, 30 aa, Artificial Sequence
  Description of Artificial Sequence: Synthetic polypeptide
DEEEIACTNPVATEQYGSVATNLQDGNNDD

SEQ ID NO: 28403 - protein, 29 aa, Artificial Sequence
  Description of Artificial Sequence: Synthetic peptide
DEEEIACTNPVATEQYGSVATNLQDGHEM

SEQ ID NO: 28404 - protein, 33 aa, Artificial Sequence
  Description of Artificial Sequence: Synthetic polypeptide
DEEEIRTTNPVATEQYGSVSGTNLQTEMGNGED

SEQ ID NO: 28405 - protein, 33 aa, Artificial Sequence
  Description of Artificial Sequence: Synthetic polypeptide
DEEEIRTTNPVATEQYGSVSTQNGLQAGGHNDN

SEQ ID NO: 28406 - protein, 31 aa, Artificial Sequence
  Description of Artificial Sequence: Synthetic polypeptide
DEEEIRTTNPVATEQYGSVSTMNTDGTGNES

SEQ ID NO: 28407 - protein, 33 aa, Artificial Sequence
  Description of Artificial Sequence: Synthetic polypeptide
DEEEIRTTNPVATEQYGSVSGTNLQGQGGNGNV

SEQ ID NO: 28408 - protein, 32 aa, Artificial Sequence
  Description of Artificial Sequence: Synthetic polypeptide
DEEEIRTTNPVATEQYGSVSTMNTDQEGGNVA

SEQ ID NO: 28409 - protein, 29 aa, Artificial Sequence
  Description of Artificial Sequence: Synthetic peptide
DEEEIACTNPVATEQYGSVATNLQADNDS

SEQ ID NO: 28410 - protein, 32 aa, Artificial Sequence
  Description of Artificial Sequence: Synthetic polypeptide
DEEEIRTTNPVATEQYGSVSSTNLGNFNGNNI

SEQ ID NO: 28411 - protein, 31 aa, Artificial Sequence
  Description of Artificial Sequence: Synthetic polypeptide
DEEEIRTTNPVATEQYGSVSTTNLNFQGVFN

SEQ ID NO: 28412 - protein, 33 aa, Artificial Sequence
  Description of Artificial Sequence: Synthetic polypeptide
DEEEIRTTNPVATEQYGSVSGTNLQTDEGEGNA

SEQ ID NO: 28413 - protein, 33 aa, Artificial Sequence
  Description of Artificial Sequence: Synthetic polypeptide
DEEEIRTTNPVATEQYGSVYSDTHDGQRGSQNR

SEQ ID NO: 28414 - protein, 34 aa, Artificial Sequence
  Description of Artificial Sequence: Synthetic polypeptide
DEEEIRTTNPVATEQYGSVSTTNLNEREGPNIRD

SEQ ID NO: 28415 - protein, 32 aa, Artificial Sequence
  Description of Artificial Sequence: Synthetic polypeptide
DEEEIRTTNPVATEQYGSVSTMNSSQERDDIR

SEQ ID NO: 28416 - protein, 31 aa, Artificial Sequence
  Description of Artificial Sequence: Synthetic polypeptide
DEEEIRTTNPVATEQYGSVSNTVLDTGNTQS

SEQ ID NO: 28417 - protein, 33 aa, Artificial Sequence
  Description of Artificial Sequence: Synthetic polypeptide
DEEEIRTTNPVATEQYGSVSNTVNTLDERGERN

SEQ ID NO: 28418 - protein, 31 aa, Artificial Sequence
  Description of Artificial Sequence: Synthetic polypeptide
DEEEIRTTNPVATEQYGSVYSTTLQTEVNPP

SEQ ID NO: 28419 - protein, 31 aa, Artificial Sequence
  Description of Artificial Sequence: Synthetic polypeptide
DEEEIRTTNPVATEQYGSVSTNHQYFGSVAY

SEQ ID NO: 28420 - protein, 30 aa, Artificial Sequence
  Description of Artificial Sequence: Synthetic polypeptide
DEAEIRATNPVATEQYGTVSHTNDFQGGNR

SEQ ID NO: 28421 - protein, 32 aa, Artificial Sequence
  Description of Artificial Sequence: Synthetic polypeptide
DEEEIRTTNPVATEQYGSVSGTMNPEQNNGNL

SEQ ID NO: 28422 - protein, 33 aa, Artificial Sequence
  Description of Artificial Sequence: Synthetic polypeptide
DEEEIRTTNPVATEQYGSVSTMNQLQNEIGGNE

SEQ ID NO: 28423 - protein, 33 aa, Artificial Sequence
  Description of Artificial Sequence: Synthetic polypeptide
DEEEIRTTNPVATEQYGSVYSVENLNQRSGERI

SEQ ID NO: 28424 - protein, 30 aa, Artificial Sequence
  Description of Artificial Sequence: Synthetic polypeptide
DEEEIRTTNPVATEQYGSVPSNIQRDDNLV

SEQ ID NO: 28425 - protein, 30 aa, Artificial Sequence
  Description of Artificial Sequence: Synthetic polypeptide
DEEEIACTNPVATEQYGSVATNLQDGNSDE

SEQ ID NO: 28426 - protein, 33 aa, Artificial Sequence
  Description of Artificial Sequence: Synthetic polypeptide
DEEEIRTTNPVATEQYGSVSTTNDNQEAGNIRE

SEQ ID NO: 28427 - protein, 32 aa, Artificial Sequence
  Description of Artificial Sequence: Synthetic polypeptide
DEEEIRTTNPVATEQYGSVYSTTNGNQEIGNQ

SEQ ID NO: 28428 - protein, 32 aa, Artificial Sequence
  Description of Artificial Sequence: Synthetic polypeptide
DEEEIRTTNPVATEQYGSVSTTNDNQELGERE

SEQ ID NO: 28429 - protein, 32 aa, Artificial Sequence
  Description of Artificial Sequence: Synthetic polypeptide
DEEEIRTTNPVATEQYGSVSTMNTGQGNGTNP

SEQ ID NO: 28430 - protein, 33 aa, Artificial Sequence
  Description of Artificial Sequence: Synthetic polypeptide
DEEEIRTTNPVATEQYGSVSTMNQLQNEMGNEG

SEQ ID NO: 28431 - protein, 32 aa, Artificial Sequence
  Description of Artificial Sequence: Synthetic polypeptide
DEEEIRTTNPVATEQYGSVSTQNLGEEVGNTP

SEQ ID NO: 28432 - protein, 33 aa, Artificial Sequence
  Description of Artificial Sequence: Synthetic polypeptide
DEEEIRTTNPVATEQYGSVSTMNQLQNSGGNVQ

SEQ ID NO: 28433 - protein, 33 aa, Artificial Sequence
  Description of Artificial Sequence: Synthetic polypeptide
DEEEIRTTNPVATEQYGSVSTTNDNQERGVNIE

SEQ ID NO: 28434 - protein, 33 aa, Artificial Sequence
  Description of Artificial Sequence: Synthetic polypeptide
DEEEIRTTNPVATEQYGSVSTNAHSQPGGNNRC

SEQ ID NO: 28435 - protein, 31 aa, Artificial Sequence
  Description of Artificial Sequence: Synthetic polypeptide
DEEEIRTTNPVATEQYGSVSDTDNLEIDGST

SEQ ID NO: 28436 - protein, 29 aa, Artificial Sequence
  Description of Artificial Sequence: Synthetic peptide
DEECIATVNPVATEWYGSVSDNLQERGNS

SEQ ID NO: 28437 - protein, 32 aa, Artificial Sequence
  Description of Artificial Sequence: Synthetic polypeptide
DEEEIRTTNPVATEQYGSVYSTTNDDRNGDDR

SEQ ID NO: 28438 - protein, 33 aa, Artificial Sequence
  Description of Artificial Sequence: Synthetic polypeptide
DEEEIRTTNPVATEQYGSVSSTNLQAEGGNVTT

SEQ ID NO: 28439 - protein, 28 aa, Artificial Sequence
  Description of Artificial Sequence: Synthetic peptide
DEAEIRTTNPVAWEQYGSISTNLEHPNA

SEQ ID NO: 28440 - protein, 29 aa, Artificial Sequence
  Description of Artificial Sequence: Synthetic peptide
DEAEIRTTNPVAWEQYGSISTNLEYPNRA

SEQ ID NO: 28441 - protein, 28 aa, Artificial Sequence
  Description of Artificial Sequence: Synthetic peptide
DEAEIRTTNPVAVEQYGSTSTNLEQTNG

SEQ ID NO: 28442 - protein, 33 aa, Artificial Sequence
  Description of Artificial Sequence: Synthetic polypeptide
DEEEIRTTNPVATEQYGSVSTMNLDQSEGNDID

SEQ ID NO: 28443 - protein, 30 aa, Artificial Sequence
  Description of Artificial Sequence: Synthetic polypeptide
DEDEIRTTNPVATEQYGSVATNNQGDGNAE

SEQ ID NO: 28444 - protein, 33 aa, Artificial Sequence
  Description of Artificial Sequence: Synthetic polypeptide
DEEEIRTTNPVATEQYGSVSTQNLQMEMGNEQG

SEQ ID NO: 28445 - protein, 30 aa, Artificial Sequence
  Description of Artificial Sequence: Synthetic polypeptide
DEEEIRTTNPVATEQYGSVSDPLFQGENGF

SEQ ID NO: 28446 - protein, 31 aa, Artificial Sequence
  Description of Artificial Sequence: Synthetic polypeptide
DEEEIRTTNPVATEQYGSVYTPNLLQQRNEQ

SEQ ID NO: 28447 - protein, 32 aa, Artificial Sequence
  Description of Artificial Sequence: Synthetic polypeptide
DEEEIRTTNPVATEQYGSVSSTNNAQGGNLED

SEQ ID NO: 28448 - protein, 31 aa, Artificial Sequence
  Description of Artificial Sequence: Synthetic polypeptide
DEEEIRTTNPVATEQYGSVSSNVLMTIGNPI

SEQ ID NO: 28449 - protein, 32 aa, Artificial Sequence
  Description of Artificial Sequence: Synthetic polypeptide
DEAEIRTTNPCATEQYGSVSTNLQNDEGNNNR

SEQ ID NO: 28450 - protein, 30 aa, Artificial Sequence
  Description of Artificial Sequence: Synthetic polypeptide
DEDAIRTTNPVATEQYGSFSNTNLIIGSNR

SEQ ID NO: 28451 - protein, 32 aa, Artificial Sequence
  Description of Artificial Sequence: Synthetic polypeptide
DEEEIRTTNPVATEQYGSVSSTNMTQGGGNGT

SEQ ID NO: 28452 - protein, 31 aa, Artificial Sequence
  Description of Artificial Sequence: Synthetic polypeptide
DEEEIRTTNPVATEQYGSVSTNLDVNSEDRF

SEQ ID NO: 28453 - protein, 31 aa, Artificial Sequence
  Description of Artificial Sequence: Synthetic polypeptide
DEEEIRTTNPVATEQYGSVPTNSLERNGEFA

SEQ ID NO: 28454 - protein, 32 aa, Artificial Sequence
  Description of Artificial Sequence: Synthetic polypeptide
DEEEIRTTNPVATEQYGSVSTQLFQEGNGNNE

SEQ ID NO: 28455 - protein, 32 aa, Artificial Sequence
  Description of Artificial Sequence: Synthetic polypeptide
DEEEIRTTNPVATEQYGSVSSTNLVGNDGNDN

SEQ ID NO: 28456 - protein, 31 aa, Artificial Sequence
  Description of Artificial Sequence: Synthetic polypeptide
DEEEIRTTNPVATEQYGSVSTQLIFGGNNEE

SEQ ID NO: 28457 - protein, 31 aa, Artificial Sequence
  Description of Artificial Sequence: Synthetic polypeptide
DEEEIRTTNPVATEQYGSVSGNVNEQTFGNI

SEQ ID NO: 28458 - protein, 31 aa, Artificial Sequence
  Description of Artificial Sequence: Synthetic polypeptide
DEEEIRTTNPVATEQYGSVSENLVLRGDQVN

SEQ ID NO: 28459 - protein, 31 aa, Artificial Sequence
  Description of Artificial Sequence: Synthetic polypeptide
DEAEIRTTNPCATEQYGSVSTNLQGDGDNSD

SEQ ID NO: 28460 - protein, 33 aa, Artificial Sequence
  Description of Artificial Sequence: Synthetic polypeptide
DEEEIRTTNPVATEQYGSVSTTLNLQELMNIRD

SEQ ID NO: 28461 - protein, 33 aa, Artificial Sequence
  Description of Artificial Sequence: Synthetic polypeptide
DEEEIRTTNPVATEQYGSVSTMNLEQGGGTNPA

SEQ ID NO: 28462 - protein, 31 aa, Artificial Sequence
  Description of Artificial Sequence: Synthetic polypeptide
DEEEIRTTNPVATEQYGSVSTQLIGGGNNEF

SEQ ID NO: 28463 - protein, 30 aa, Artificial Sequence
  Description of Artificial Sequence: Synthetic polypeptide
DEAEIRTTNPVATEQYGVVSTALQRPSNDN

SEQ ID NO: 28464 - protein, 31 aa, Artificial Sequence
  Description of Artificial Sequence: Synthetic polypeptide
DEEEIRTTNPVATEQYGSVSTQLIGGGNNQE

SEQ ID NO: 28465 - protein, 31 aa, Artificial Sequence
  Description of Artificial Sequence: Synthetic polypeptide
DEEEIRTTNPVATEQYGSVYTPNIQRENEEG

SEQ ID NO: 28466 - protein, 31 aa, Artificial Sequence
  Description of Artificial Sequence: Synthetic polypeptide
DEEEIRTTNPVATEQYGSVSTQLDIGMGGNG

SEQ ID NO: 28467 - protein, 32 aa, Artificial Sequence
  Description of Artificial Sequence: Synthetic polypeptide
DEEEIRTTNPVATEQYGSVSDQDLIQRGIQNG

SEQ ID NO: 28468 - protein, 31 aa, Artificial Sequence
  Description of Artificial Sequence: Synthetic polypeptide
DEEEIRTTNPVATEQYGSVSTQLDEIGNNDD

SEQ ID NO: 28469 - protein, 31 aa, Artificial Sequence
  Description of Artificial Sequence: Synthetic polypeptide
DEEEIRTTNPVATEQYGSVSTNLDVTGSDES

SEQ ID NO: 28470 - protein, 32 aa, Artificial Sequence
  Description of Artificial Sequence: Synthetic polypeptide
DEEEIRTTNPVATEQYGSVSNTNLQIEAIQRQ

SEQ ID NO: 28471 - protein, 32 aa, Artificial Sequence
  Description of Artificial Sequence: Synthetic polypeptide
DEEEIRTTNPVATEQYGSVSTTNLQTLIGLDE

SEQ ID NO: 28472 - protein, 34 aa, Artificial Sequence
  Description of Artificial Sequence: Synthetic polypeptide
DEEEIRTTNPVATEQYGSVSTNDLDQLRGENEGG

SEQ ID NO: 28473 - protein, 33 aa, Artificial Sequence
  Description of Artificial Sequence: Synthetic polypeptide
DEEEIRTTNPVATEQYGSVWPTNDVQRNGNERI

SEQ ID NO: 28474 - protein, 33 aa, Artificial Sequence
  Description of Artificial Sequence: Synthetic polypeptide
DEEEIRTTNPVATEQYGSVSTTNLQTIGNNEFI

SEQ ID NO: 28475 - protein, 33 aa, Artificial Sequence
  Description of Artificial Sequence: Synthetic polypeptide
DEEEIRTTNPVATEQYGSVSDTPNVVIRIGNER

SEQ ID NO: 28476 - protein, 33 aa, Artificial Sequence
  Description of Artificial Sequence: Synthetic polypeptide
DEEEIRTTNPVATEQYGSVSTMNLEQGGGGNEA

SEQ ID NO: 28477 - protein, 31 aa, Artificial Sequence
  Description of Artificial Sequence: Synthetic polypeptide
DEAEIRTTNPVATEQYGVVPSTSLSQRPGND

SEQ ID NO: 28478 - protein, 32 aa, Artificial Sequence
  Description of Artificial Sequence: Synthetic polypeptide
DEEEIRTTNPVATEQYGSVSTTLLIRSGEHRM

SEQ ID NO: 28479 - protein, 31 aa, Artificial Sequence
  Description of Artificial Sequence: Synthetic polypeptide
DEEEIRTTNPVATEQYGSVSTTLLLQNSQNL

SEQ ID NO: 28480 - protein, 31 aa, Artificial Sequence
  Description of Artificial Sequence: Synthetic polypeptide
DEEEIRTTNPVATEQYGSVSTNGHQEEDMIR

SEQ ID NO: 28481 - protein, 31 aa, Artificial Sequence
  Description of Artificial Sequence: Synthetic polypeptide
DEEEIRTTNPVATEQYGSVWPTNESQRGDQI

SEQ ID NO: 28482 - protein, 31 aa, Artificial Sequence
  Description of Artificial Sequence: Synthetic polypeptide
DEEEIRTTNPVATEQYGSVSSTLENRGDNVG

SEQ ID NO: 28483 - protein, 32 aa, Artificial Sequence
  Description of Artificial Sequence: Synthetic polypeptide
DEEEIRTTNPVATEQYGSVSLTNLQLIAENDT

SEQ ID NO: 28484 - protein, 32 aa, Artificial Sequence
  Description of Artificial Sequence: Synthetic polypeptide
DEEEIRTTNPVATEQYGSVSTSAIREGENQRT

SEQ ID NO: 28485 - protein, 29 aa, Artificial Sequence
  Description of Artificial Sequence: Synthetic peptide
DEDEIRTTNPVATEQYGETSTTNLQTGDS

SEQ ID NO: 28486 - protein, 32 aa, Artificial Sequence
  Description of Artificial Sequence: Synthetic polypeptide
DEEEIRTTNPVATEQYGSVWPTNSLEGNGENR

SEQ ID NO: 28487 - protein, 31 aa, Artificial Sequence
  Description of Artificial Sequence: Synthetic polypeptide
DEAEIRTTNPCATEQYGSVWETQNLQRGNID

SEQ ID NO: 28488 - protein, 30 aa, Artificial Sequence
  Description of Artificial Sequence: Synthetic polypeptide
DEAEIRTTNPCATEQYGSVSTNPQHDNGNA

SEQ ID NO: 28489 - protein, 29 aa, Artificial Sequence
  Description of Artificial Sequence: Synthetic peptide
DEEEIACTNPVATEQYGSVATNLQQGDDQ

SEQ ID NO: 28490 - protein, 31 aa, Artificial Sequence
  Description of Artificial Sequence: Synthetic polypeptide
DEEEIRTTNPVATEQYGSVSTNLDVTSLNEG

SEQ ID NO: 28491 - protein, 28 aa, Artificial Sequence
  Description of Artificial Sequence: Synthetic peptide
DEECIETVNPVATEIYGSVSDNQERGNR

SEQ ID NO: 28492 - protein, 31 aa, Artificial Sequence
  Description of Artificial Sequence: Synthetic polypeptide
DEEEIACTNPVATEQYGSVATNLQQDGNERD

SEQ ID NO: 28493 - protein, 32 aa, Artificial Sequence
  Description of Artificial Sequence: Synthetic polypeptide
DEEEIRTTNPVATEQYGSVSNTNDQGQIGGNT

SEQ ID NO: 28494 - protein, 29 aa, Artificial Sequence
  Description of Artificial Sequence: Synthetic peptide
DEECIRTTNPVATEQYGSVCSTEELYGNQ

SEQ ID NO: 28495 - protein, 32 aa, Artificial Sequence
  Description of Artificial Sequence: Synthetic polypeptide
DEEEIRTTNPVATEQYGSVSGTNIGQRGPPDQ

SEQ ID NO: 28496 - protein, 31 aa, Artificial Sequence
  Description of Artificial Sequence: Synthetic polypeptide
DEDEIRTTNPVAYEQYGSVSTNTQQDNGNVR

SEQ ID NO: 28497 - protein, 31 aa, Artificial Sequence
  Description of Artificial Sequence: Synthetic polypeptide
DEAEIRTTNPVATEQYGVVSTNLQGDAGNEK

SEQ ID NO: 28498 - protein, 30 aa, Artificial Sequence
  Description of Artificial Sequence: Synthetic polypeptide
DEDEIRTTNPVAYEQYGSVSTTNDGNHGNR

SEQ ID NO: 28499 - protein, 29 aa, Artificial Sequence
  Description of Artificial Sequence: Synthetic peptide
DEECICTVNPVATEAYGSVVSDNLERGNR

SEQ ID NO: 28500 - protein, 33 aa, Artificial Sequence
  Description of Artificial Sequence: Synthetic polypeptide
DEEEIRTTNPVATEQYGSVSTNGLETRSGINNL

SEQ ID NO: 28501 - protein, 32 aa, Artificial Sequence
  Description of Artificial Sequence: Synthetic polypeptide
DEEEIRTTNPVATEQYGSVSTNDHQRFGSQPQ

SEQ ID NO: 28502 - protein, 29 aa, Artificial Sequence
  Description of Artificial Sequence: Synthetic peptide
DEDEIRTTNPVATEQYGETTSTNLQFGDS

SEQ ID NO: 28503 - protein, 33 aa, Artificial Sequence
  Description of Artificial Sequence: Synthetic polypeptide
DEEEIRTTNPVATEQYGSVSTMNLFQNGGENND

SEQ ID NO: 28504 - protein, 32 aa, Artificial Sequence
  Description of Artificial Sequence: Synthetic polypeptide
DEEEIRTTNPVATEQYGSVSTQLLQEIGNNTD

SEQ ID NO: 28505 - protein, 33 aa, Artificial Sequence
  Description of Artificial Sequence: Synthetic polypeptide
DEEEIRTTNPVATEQYGSVSTMNLFQTGEGNQI

SEQ ID NO: 28506 - protein, 30 aa, Artificial Sequence
  Description of Artificial Sequence: Synthetic polypeptide
DEAEIRTTNPVATEQYGVVSTNLQHDGGSQ

SEQ ID NO: 28507 - protein, 29 aa, Artificial Sequence
  Description of Artificial Sequence: Synthetic peptide
DEEEIRTTNPVATEQYGSVSPDNDRGDGL

SEQ ID NO: 28508 - protein, 30 aa, Artificial Sequence
  Description of Artificial Sequence: Synthetic polypeptide
DEEEIRTTNPVATEQYGSVSPDMQRSNSQF

SEQ ID NO: 28509 - protein, 33 aa, Artificial Sequence
  Description of Artificial Sequence: Synthetic polypeptide
DEEEIRTTNPVATEQYGSVWSLPNELQRDINRI

SEQ ID NO: 28510 - protein, 32 aa, Artificial Sequence
  Description of Artificial Sequence: Synthetic polypeptide
DEEEIRTTNPVATEQYGSVSGTNNIQGIGNEG

SEQ ID NO: 28511 - protein, 30 aa, Artificial Sequence
  Description of Artificial Sequence: Synthetic polypeptide
DEAEICTTNPVATEQYGSVSTNLGNGMDNS

SEQ ID NO: 28512 - protein, 32 aa, Artificial Sequence
  Description of Artificial Sequence: Synthetic polypeptide
DEEEIRTTNPVATEQYGSVSTNDHQHSGSDRP

SEQ ID NO: 28513 - protein, 31 aa, Artificial Sequence
  Description of Artificial Sequence: Synthetic polypeptide
DEEEIRTTNPVATEQYGSVSPDMQRGNSQQD

SEQ ID NO: 28514 - protein, 30 aa, Artificial Sequence
  Description of Artificial Sequence: Synthetic polypeptide
DEAEIRTTNPVATEQYGVVSTNLQHGGDGQ

SEQ ID NO: 28515 - protein, 32 aa, Artificial Sequence
  Description of Artificial Sequence: Synthetic polypeptide
DEEEIRTTNPVATEQYGSVSTQNVQTVGNSQD

SEQ ID NO: 28516 - protein, 32 aa, Artificial Sequence
  Description of Artificial Sequence: Synthetic polypeptide
DEEEIRTTNPVATEQYGSVSTTLPQNGGNNQS

SEQ ID NO: 28517 - protein, 33 aa, Artificial Sequence
  Description of Artificial Sequence: Synthetic polypeptide
DEEEIRTTNPVATEQYGSVSTMNLFQEGGNGDQ

SEQ ID NO: 28518 - protein, 33 aa, Artificial Sequence
  Description of Artificial Sequence: Synthetic polypeptide
DEEEIRTTNPVATEQYGSVSTTLPNNLQGNDNR

SEQ ID NO: 28519 - protein, 31 aa, Artificial Sequence
  Description of Artificial Sequence: Synthetic polypeptide
DEDEIRTTNPVAYEQYGSVSTNPQQDNGNER

SEQ ID NO: 28520 - protein, 34 aa, Artificial Sequence
  Description of Artificial Sequence: Synthetic polypeptide
DEEEIRTTNPVATEQYGSVPSCTGNLQGPVGNRK

SEQ ID NO: 28521 - protein, 33 aa, Artificial Sequence
  Description of Artificial Sequence: Synthetic polypeptide
DEEEIRTTNPVATEQYGSVSTMNLEQITGNGGE

SEQ ID NO: 28522 - protein, 33 aa, Artificial Sequence
  Description of Artificial Sequence: Synthetic polypeptide
DEEEIRTTNPVATEQYGSVSTMNLEQLDGENTQ

SEQ ID NO: 28523 - protein, 30 aa, Artificial Sequence
  Description of Artificial Sequence: Synthetic polypeptide
DEDEIRTTNPVAYEQYGSVSTNPDQSGDAR

SEQ ID NO: 28524 - protein, 32 aa, Artificial Sequence
  Description of Artificial Sequence: Synthetic polypeptide
DEECIRTTNPVATEQYGSVCSTGNLQEGGSND

SEQ ID NO: 28525 - protein, 30 aa, Artificial Sequence
  Description of Artificial Sequence: Synthetic polypeptide
DEAEIRTTNPCATEQYGSVSTNLNGDGNEN

SEQ ID NO: 28526 - protein, 33 aa, Artificial Sequence
  Description of Artificial Sequence: Synthetic polypeptide
DEEEIRTTNPVATEQYGSVSTTLNLQESGTNVS

SEQ ID NO: 28527 - protein, 31 aa, Artificial Sequence
  Description of Artificial Sequence: Synthetic polypeptide
DEEEIRTTNPVATEQYGSVPTNNLQNDGEEM

SEQ ID NO: 28528 - protein, 31 aa, Artificial Sequence
  Description of Artificial Sequence: Synthetic polypeptide
DEEEIRTTNPVATEQYGSVSTQLINGGGNNT

SEQ ID NO: 28529 - protein, 33 aa, Artificial Sequence
  Description of Artificial Sequence: Synthetic polypeptide
DEEEIRTTNPVATEQYGSVSTMNLEQVEGGNEQ

SEQ ID NO: 28530 - protein, 32 aa, Artificial Sequence
  Description of Artificial Sequence: Synthetic polypeptide
DEEEIRTTNPVATEQYGSVSTTLIQEGGNNEQ

SEQ ID NO: 28531 - protein, 33 aa, Artificial Sequence
  Description of Artificial Sequence: Synthetic polypeptide
DEEEIRTTNPVATEQYGSVSTTLNLQQGENEEV

SEQ ID NO: 28532 - protein, 30 aa, Artificial Sequence
  Description of Artificial Sequence: Synthetic polypeptide
DEAEICTTNPVATEQYGSVSTMNGDEHGNR

SEQ ID NO: 28533 - protein, 29 aa, Artificial Sequence
  Description of Artificial Sequence: Synthetic peptide
DECEIGTTNPVATEQYGSVSTNLMYENTN

SEQ ID NO: 28534 - protein, 30 aa, Artificial Sequence
  Description of Artificial Sequence: Synthetic polypeptide
DEDEIRTTNPVAYEQYGSVSTNPQGGNMDA

SEQ ID NO: 28535 - protein, 31 aa, Artificial Sequence
  Description of Artificial Sequence: Synthetic polypeptide
DEEEIRTTNPVATEQYGSVPTNLYQMREVEE

SEQ ID NO: 28536 - protein, 28 aa, Artificial Sequence
  Description of Artificial Sequence: Synthetic peptide
DEECIETVNPVATEEYGSVSDNLERGNS

SEQ ID NO: 28537 - protein, 31 aa, Artificial Sequence
  Description of Artificial Sequence: Synthetic polypeptide
DEEEIRTTNPVATEQYGSVSDQDLIQRIQAR

SEQ ID NO: 28538 - protein, 32 aa, Artificial Sequence
  Description of Artificial Sequence: Synthetic polypeptide
DEEEIRTTNPVATEQYGSVSGPTLTQRGGNEM

SEQ ID NO: 28539 - protein, 32 aa, Artificial Sequence
  Description of Artificial Sequence: Synthetic polypeptide
DEEEIRTTNPVATEQYGSVSTMNLEVGGNGDQ

SEQ ID NO: 28540 - protein, 33 aa, Artificial Sequence
  Description of Artificial Sequence: Synthetic polypeptide
DEEEIRTTNPVATEQYGSVPSCTNAIQNSGGNR

SEQ ID NO: 28541 - protein, 28 aa, Artificial Sequence
  Description of Artificial Sequence: Synthetic peptide
DEECIETVNPVATEAYGSVSDNQERGNR

SEQ ID NO: 28542 - protein, 29 aa, Artificial Sequence
  Description of Artificial Sequence: Synthetic peptide
DECEIGTTNPVATEQYGSVSTINLMYVNT

SEQ ID NO: 28543 - protein, 32 aa, Artificial Sequence
  Description of Artificial Sequence: Synthetic polypeptide
DEEEIRTTNPVATEQYGSVSTQLNQEIGNVGD

SEQ ID NO: 28544 - protein, 29 aa, Artificial Sequence
  Description of Artificial Sequence: Synthetic peptide
DEECIETVNPVATEPYGSVSTDNLERGNM

SEQ ID NO: 28545 - protein, 31 aa, Artificial Sequence
  Description of Artificial Sequence: Synthetic polypeptide
DEDEIRTTNPVAYEQYGSVSTNLQGNAGNAQ

SEQ ID NO: 28546 - protein, 32 aa, Artificial Sequence
  Description of Artificial Sequence: Synthetic polypeptide
DEEEIRTTNPVATEQYGSVSTPTLQTGENSSA

SEQ ID NO: 28547 - protein, 32 aa, Artificial Sequence
  Description of Artificial Sequence: Synthetic polypeptide
DEEEIRTTNPVATEQYGSVSSTNQDQNQGNIF

SEQ ID NO: 28548 - protein, 29 aa, Artificial Sequence
  Description of Artificial Sequence: Synthetic peptide
DEEEIRTTNPVATEQYGSVPTVVDLGERD

SEQ ID NO: 28549 - protein, 29 aa, Artificial Sequence
  Description of Artificial Sequence: Synthetic peptide
DEEEIRTTNPVATEQYGSVYTTHEMRGEG

SEQ ID NO: 28550 - protein, 33 aa, Artificial Sequence
  Description of Artificial Sequence: Synthetic polypeptide
DEEEIRTTNPVATEQYGSVSTMNLDQSNGNDED

SEQ ID NO: 28551 - protein, 33 aa, Artificial Sequence
  Description of Artificial Sequence: Synthetic polypeptide
DEEEIRTTNPVATEQYGSVSTNLEQEGMGENTS

SEQ ID NO: 28552 - protein, 30 aa, Artificial Sequence
  Description of Artificial Sequence: Synthetic polypeptide
DEEEIRTTNPVATEQYGSVSTTNLVVNEIV

SEQ ID NO: 28553 - protein, 31 aa, Artificial Sequence
  Description of Artificial Sequence: Synthetic polypeptide
DEEEIRTTNPVATEQYGSVVWTNDDRNGDER

SEQ ID NO: 28554 - protein, 32 aa, Artificial Sequence
  Description of Artificial Sequence: Synthetic polypeptide
DEEEIRTTNPVATEQYGSVSTTGVLQQGSTNE

SEQ ID NO: 28555 - protein, 33 aa, Artificial Sequence
  Description of Artificial Sequence: Synthetic polypeptide
DEEEIRTTNPVATEQYGSVSTTNLVTTRVGARQ

SEQ ID NO: 28556 - protein, 29 aa, Artificial Sequence
  Description of Artificial Sequence: Synthetic peptide
DEEEIRTTNPVATEQYGSVSTTHGDTNSE

SEQ ID NO: 28557 - protein, 32 aa, Artificial Sequence
  Description of Artificial Sequence: Synthetic polypeptide
DEDEIRTTNPVAYEQYGQSVSTNDLVQRGMGR

SEQ ID NO: 28558 - protein, 34 aa, Artificial Sequence
  Description of Artificial Sequence: Synthetic polypeptide
DEEEIRTTNPVATEQYGSVSTTNLVPREGINPRN

SEQ ID NO: 28559 - protein, 31 aa, Artificial Sequence
  Description of Artificial Sequence: Synthetic polypeptide
DEEEIRTTNPVATEQYGSVSEPALQRFENVT

SEQ ID NO: 28560 - protein, 31 aa, Artificial Sequence
  Description of Artificial Sequence: Synthetic polypeptide
DEAEICTTNPVATEQYGSVSNNLQGDGNNGR

SEQ ID NO: 28561 - protein, 30 aa, Artificial Sequence
  Description of Artificial Sequence: Synthetic polypeptide
DEAEICTTNPVATEQYGSVSNNLQGGNEGM

SEQ ID NO: 28562 - protein, 31 aa, Artificial Sequence
  Description of Artificial Sequence: Synthetic polypeptide
DEEEIRTTNPVATEQYGSVPTVLERNGEERI

SEQ ID NO: 28563 - protein, 30 aa, Artificial Sequence
  Description of Artificial Sequence: Synthetic polypeptide
DEEEIACTNPVATEQYGSVATNLQRENNTQ

SEQ ID NO: 28564 - protein, 32 aa, Artificial Sequence
  Description of Artificial Sequence: Synthetic polypeptide
DEEEIRTTNPVATEQYGSVSTSLEQEGDDDRF

SEQ ID NO: 28565 - protein, 32 aa, Artificial Sequence
  Description of Artificial Sequence: Synthetic polypeptide
DEDEIRTTNPVATEQYGSVCSTNDIQDNGNRQ

SEQ ID NO: 28566 - protein, 32 aa, Artificial Sequence
  Description of Artificial Sequence: Synthetic polypeptide
DEEEIRTTNPVATEQYGSVSTSLDQQVEGEER

SEQ ID NO: 28567 - protein, 30 aa, Artificial Sequence
  Description of Artificial Sequence: Synthetic polypeptide
DEEEIRTTNPVATEQYGSVSTTGQDQGEQS

SEQ ID NO: 28568 - protein, 32 aa, Artificial Sequence
  Description of Artificial Sequence: Synthetic polypeptide
DEEEIRTTNPVATEQYGSVVYTELDVRGDNRI

SEQ ID NO: 28569 - protein, 31 aa, Artificial Sequence
  Description of Artificial Sequence: Synthetic polypeptide
DEEEIRTTNPVATEQYGSVVVSQNLQEGSIV

SEQ ID NO: 28570 - protein, 30 aa, Artificial Sequence
  Description of Artificial Sequence: Synthetic polypeptide
DEEEIACTNPVATEQYGSVATNLQRTENAQ

SEQ ID NO: 28571 - protein, 32 aa, Artificial Sequence
  Description of Artificial Sequence: Synthetic polypeptide
DEEEIRTTNPVATEQYGSVSTTGLQSEGGNED

SEQ ID NO: 28572 - protein, 31 aa, Artificial Sequence
  Description of Artificial Sequence: Synthetic polypeptide
DEEEIRTTNPVATEQYGSVPQDTNDQRLNQI

SEQ ID NO: 28573 - protein, 33 aa, Artificial Sequence
  Description of Artificial Sequence: Synthetic polypeptide
DEEEIRTTNPVATEQYGSVSTMNLDQSGENQIT

SEQ ID NO: 28574 - protein, 32 aa, Artificial Sequence
  Description of Artificial Sequence: Synthetic polypeptide
DEEEIRTTNPVATEQYGSVSTMNLDQSGEQEA

SEQ ID NO: 28575 - protein, 30 aa, Artificial Sequence
  Description of Artificial Sequence: Synthetic polypeptide
DEDEIRTTNPVATEQYGCTSTNLQRGSDVS

SEQ ID NO: 28576 - protein, 32 aa, Artificial Sequence
  Description of Artificial Sequence: Synthetic polypeptide
DEEEIRTTNPVATEQYGSVSTPNVQIGVGNET

SEQ ID NO: 28577 - protein, 32 aa, Artificial Sequence
  Description of Artificial Sequence: Synthetic polypeptide
DEEEIRTTNPVATEQYGSVSDTWLEQLRSQNV

SEQ ID NO: 28578 - protein, 31 aa, Artificial Sequence
  Description of Artificial Sequence: Synthetic polypeptide
DEEEIRTTNPVATEQYGSVPVTGLEQRGGIL

SEQ ID NO: 28579 - protein, 31 aa, Artificial Sequence
  Description of Artificial Sequence: Synthetic polypeptide
DEEEIRTTNPVATEQYGSVYTTNGIQPDGNA

SEQ ID NO: 28580 - protein, 32 aa, Artificial Sequence
  Description of Artificial Sequence: Synthetic polypeptide
DEEEIRTTNPVATEQYGSVSTTGNLDGGGNEG

SEQ ID NO: 28581 - protein, 33 aa, Artificial Sequence
  Description of Artificial Sequence: Synthetic polypeptide
DEEEIRTTNPVATEQYGSVSTNLEQLDVGNVQD

SEQ ID NO: 28582 - protein, 31 aa, Artificial Sequence
  Description of Artificial Sequence: Synthetic polypeptide
DEEEIRTTNPVATEQYGSVPVSLNVQRMVNI

SEQ ID NO: 28583 - protein, 32 aa, Artificial Sequence
  Description of Artificial Sequence: Synthetic polypeptide
DEEEIRTTNPVATEQYGSVSTSLQEFGGNEQG

SEQ ID NO: 28584 - protein, 33 aa, Artificial Sequence
  Description of Artificial Sequence: Synthetic polypeptide
DEEEIRTTNPVATEQYGSVSTNLEQLDGENVQE

SEQ ID NO: 28585 - protein, 31 aa, Artificial Sequence
  Description of Artificial Sequence: Synthetic polypeptide
DEEEIRTTNPVATEQYGSVPVSENVQRDVNP

SEQ ID NO: 28586 - protein, 31 aa, Artificial Sequence
  Description of Artificial Sequence: Synthetic polypeptide
DEEEIRTTNPVATEQYGSVSEPVGLQSGERD

SEQ ID NO: 28587 - protein, 31 aa, Artificial Sequence
  Description of Artificial Sequence: Synthetic polypeptide
DEEEIRTTNPVATEQYGSVSTSLQDMGGSEM

SEQ ID NO: 28588 - protein, 33 aa, Artificial Sequence
  Description of Artificial Sequence: Synthetic polypeptide
DEEEIRTTNPVATEQYGSVSTTGNLQQENVGNG

SEQ ID NO: 28589 - protein, 32 aa, Artificial Sequence
  Description of Artificial Sequence: Synthetic polypeptide
DEECIRTTNPVATEQYGSTVSTNELSDNGGNR

SEQ ID NO: 28590 - protein, 31 aa, Artificial Sequence
  Description of Artificial Sequence: Synthetic polypeptide
DEEEIRTTNPVATEQYGSVSSNLQYDSGIIM

SEQ ID NO: 28591 - protein, 32 aa, Artificial Sequence
  Description of Artificial Sequence: Synthetic polypeptide
DEAEIRTTNPVATEQYGTVVSCTTLSQRGGNR

SEQ ID NO: 28592 - protein, 32 aa, Artificial Sequence
  Description of Artificial Sequence: Synthetic polypeptide
DEEEIRTTNPVATEQYGSVSTNDLDQNGEMED

SEQ ID NO: 28593 - protein, 32 aa, Artificial Sequence
  Description of Artificial Sequence: Synthetic polypeptide
DEEEIRTTNPVATEQYGSVSTNGDQDTEGNNE

SEQ ID NO: 28594 - protein, 33 aa, Artificial Sequence
  Description of Artificial Sequence: Synthetic polypeptide
DEEEIRTTNPVATEQYGSVSLTNLQANGEELRL

SEQ ID NO: 28595 - protein, 29 aa, Artificial Sequence
  Description of Artificial Sequence: Synthetic peptide
DEDEIRTTNPVAYEQYGSCSTNLEAPNRQ

SEQ ID NO: 28596 - protein, 32 aa, Artificial Sequence
  Description of Artificial Sequence: Synthetic polypeptide
DEEEIRTTNPVATEQYGSVSTMNLEMEGGNGD

SEQ ID NO: 28597 - protein, 32 aa, Artificial Sequence
  Description of Artificial Sequence: Synthetic polypeptide
DEEEIRTTNPVATEQYGSVSTNGGQQQRPAER

SEQ ID NO: 28598 - protein, 31 aa, Artificial Sequence
  Description of Artificial Sequence: Synthetic polypeptide
DEEEIRTTNPVATEQYGSVSDNTLQRESLLG

SEQ ID NO: 28599 - protein, 32 aa, Artificial Sequence
  Description of Artificial Sequence: Synthetic polypeptide
DEEEIRTTNPVATEQYGSVSTTNLQTVNENQP

SEQ ID NO: 28600 - protein, 33 aa, Artificial Sequence
  Description of Artificial Sequence: Synthetic polypeptide
DEEEIRTTNPVATEQYGSVSGTNLQGIGGGNTM

SEQ ID NO: 28601 - protein, 29 aa, Artificial Sequence
  Description of Artificial Sequence: Synthetic peptide
DEDEIRTTNPVATEQYGETSTNLQSGDSD

SEQ ID NO: 28602 - protein, 32 aa, Artificial Sequence
  Description of Artificial Sequence: Synthetic polypeptide
DEEEIRTTNPVATEQYGSVSTMNLEMGGNIDD

SEQ ID NO: 28603 - protein, 32 aa, Artificial Sequence
  Description of Artificial Sequence: Synthetic polypeptide
DEEEIRTTNPVATEQYGSVSNTPNDLQNQDNM

SEQ ID NO: 28604 - protein, 32 aa, Artificial Sequence
  Description of Artificial Sequence: Synthetic polypeptide
DEEEIRTTNPVATEQYGSVSSNPNTLLQGDNR

SEQ ID NO: 28605 - protein, 30 aa, Artificial Sequence
  Description of Artificial Sequence: Synthetic polypeptide
DEECISTTNPVATEEYGSVNTNGLQRGSNM

SEQ ID NO: 28606 - protein, 32 aa, Artificial Sequence
  Description of Artificial Sequence: Synthetic polypeptide
DEEEIRTTNPVATEQYGSVWNSLPNMLQRDER

SEQ ID NO: 28607 - protein, 33 aa, Artificial Sequence
  Description of Artificial Sequence: Synthetic polypeptide
DEEEIRTTNPVATEQYGSVSNTPNGLQRAENGF

SEQ ID NO: 28608 - protein, 31 aa, Artificial Sequence
  Description of Artificial Sequence: Synthetic polypeptide
DEEEIRTTNPVATEQYGSVSTTLDNGGGENI

SEQ ID NO: 28609 - protein, 32 aa, Artificial Sequence
  Description of Artificial Sequence: Synthetic polypeptide
DEEEIRTTNPVATEQYGSVSTTLEQGDGENTS

SEQ ID NO: 28610 - protein, 31 aa, Artificial Sequence
  Description of Artificial Sequence: Synthetic polypeptide
DEEEIRTTNPVATEQYGSVSSTNNGGQNGTF

SEQ ID NO: 28611 - protein, 33 aa, Artificial Sequence
  Description of Artificial Sequence: Synthetic polypeptide
DEEEIRTTNPVATEQYGSVSTMNLEQGEGENLA

SEQ ID NO: 28612 - protein, 33 aa, Artificial Sequence
  Description of Artificial Sequence: Synthetic polypeptide
DEEEIRTTNPVATEQYGSVSTMNLEQGGGENTS

SEQ ID NO: 28613 - protein, 32 aa, Artificial Sequence
  Description of Artificial Sequence: Synthetic polypeptide
DEEEIRTTNPVATEQYGSVSGTNINNQGEGNA

SEQ ID NO: 28614 - protein, 28 aa, Artificial Sequence
  Description of Artificial Sequence: Synthetic peptide
DEECIETVNPVATESYGSVSVNLERGNT

SEQ ID NO: 28615 - protein, 33 aa, Artificial Sequence
  Description of Artificial Sequence: Synthetic polypeptide
DEEEIRTTNPVATEQYGSVSTMNLEQGGGENTT

SEQ ID NO: 28616 - protein, 29 aa, Artificial Sequence
  Description of Artificial Sequence: Synthetic peptide
DEECIATVNPVATEAYGSVSDNLERGSNR

SEQ ID NO: 28617 - protein, 29 aa, Artificial Sequence
  Description of Artificial Sequence: Synthetic peptide
DEECISTTNPVATEEYGSVNTNDLQRGDQ

SEQ ID NO: 28618 - protein, 30 aa, Artificial Sequence
  Description of Artificial Sequence: Synthetic polypeptide
DEEEIRTTNPVATEQYGSVSENVPQGGPSE

SEQ ID NO: 28619 - protein, 32 aa, Artificial Sequence
  Description of Artificial Sequence: Synthetic polypeptide
DEEEIRTTNPVATEQYGSVSTPVSLQRGEEVL

SEQ ID NO: 28620 - protein, 30 aa, Artificial Sequence
  Description of Artificial Sequence: Synthetic polypeptide
DEDEIRTTNPVATEQYGETSTNLQRQGDSF

SEQ ID NO: 28621 - protein, 30 aa, Artificial Sequence
  Description of Artificial Sequence: Synthetic polypeptide
DEECISTTNPVATECYGSTVNTNELQRGNM

SEQ ID NO: 28622 - protein, 30 aa, Artificial Sequence
  Description of Artificial Sequence: Synthetic polypeptide
DEEEIRTTNPVATEQYGSVSSNLVMNHENA

SEQ ID NO: 28623 - protein, 30 aa, Artificial Sequence
  Description of Artificial Sequence: Synthetic polypeptide
DEEEIACTNPVATEQYGSVATNLQREGGED

SEQ ID NO: 28624 - protein, 32 aa, Artificial Sequence
  Description of Artificial Sequence: Synthetic polypeptide
DEEEIRTTNPVATEQYGSVSGTNLEQRIVVED

SEQ ID NO: 28625 - protein, 32 aa, Artificial Sequence
  Description of Artificial Sequence: Synthetic polypeptide
DEEEIRTTNPVATEQYGSVSTPVGLQQRGEQV

SEQ ID NO: 28626 - protein, 32 aa, Artificial Sequence
  Description of Artificial Sequence: Synthetic polypeptide
DEEEIRTTNPVATEQYGSVSNTNDQEFGSNQE

SEQ ID NO: 28627 - protein, 32 aa, Artificial Sequence
  Description of Artificial Sequence: Synthetic polypeptide
DEEEIRTTNPVATEQYGSVSTMNLEIGGENTS

SEQ ID NO: 28628 - protein, 32 aa, Artificial Sequence
  Description of Artificial Sequence: Synthetic polypeptide
DEEEIRTTNPVATEQYGSVSLTNLQNNVVNNI

SEQ ID NO: 28629 - protein, 31 aa, Artificial Sequence
  Description of Artificial Sequence: Synthetic polypeptide
DEAEICTTNPVATEQYGSVSTDNGNQRDGNH

SEQ ID NO: 28630 - protein, 33 aa, Artificial Sequence
  Description of Artificial Sequence: Synthetic polypeptide
DEEEIRTTNPVATEQYGSVSGNTVNNLQGGNGQ

SEQ ID NO: 28631 - protein, 29 aa, Artificial Sequence
  Description of Artificial Sequence: Synthetic peptide
DEECIATVNPVATEAYGSVSDNSLTRGNR

SEQ ID NO: 28632 - protein, 30 aa, Artificial Sequence
  Description of Artificial Sequence: Synthetic polypeptide
DEEEIRTTNPVATEQYGSVSTSEGQDGEQD

SEQ ID NO: 28633 - protein, 31 aa, Artificial Sequence
  Description of Artificial Sequence: Synthetic polypeptide
DEDEIRTTNPVAYEQYGSVSTELQEGSGNNR

SEQ ID NO: 28634 - protein, 30 aa, Artificial Sequence
  Description of Artificial Sequence: Synthetic polypeptide
DEDEIRTTNPVAYEQYGSVSTGNGQSGDAR

SEQ ID NO: 28635 - protein, 33 aa, Artificial Sequence
  Description of Artificial Sequence: Synthetic polypeptide
DEEEIRTTNPVATEQYGSVSTNDLDQLRTENEE

SEQ ID NO: 28636 - protein, 31 aa, Artificial Sequence
  Description of Artificial Sequence: Synthetic polypeptide
DEEEIRTTNPVATEQYGSVSENDLTRGVEDV

SEQ ID NO: 28637 - protein, 32 aa, Artificial Sequence
  Description of Artificial Sequence: Synthetic polypeptide
DEEEIRTTNPVATEQYGSVSGTNINNQTGNEF

SEQ ID NO: 28638 - protein, 30 aa, Artificial Sequence
  Description of Artificial Sequence: Synthetic polypeptide
DEEEIRTTNPVATEQYGSVSENDQLGGEEQ

SEQ ID NO: 28639 - protein, 31 aa, Artificial Sequence
  Description of Artificial Sequence: Synthetic polypeptide
DEEEIACTNPVATEQYGSVATNLQRDNNTRA

SEQ ID NO: 28640 - protein, 32 aa, Artificial Sequence
  Description of Artificial Sequence: Synthetic polypeptide
DEEEIRTTNPVATEQYGSVSNTNDQEGGGNDN

SEQ ID NO: 28641 - protein, 33 aa, Artificial Sequence
  Description of Artificial Sequence: Synthetic polypeptide
DEEEIRTTNPVATEQYGSVSSTNNNLQPGENGG

SEQ ID NO: 28642 - protein, 31 aa, Artificial Sequence
  Description of Artificial Sequence: Synthetic polypeptide
DEEEIRTTNPVATEQYGSVSTNLENFGSDVA

SEQ ID NO: 28643 - protein, 30 aa, Artificial Sequence
  Description of Artificial Sequence: Synthetic polypeptide
DEDEIRTTNPVAYEQYGSVSTDDLQSGDAR

SEQ ID NO: 28644 - protein, 31 aa, Artificial Sequence
  Description of Artificial Sequence: Synthetic polypeptide
DEAEIRTTNPVATEVYGSVSTNLQNDGDNNM

SEQ ID NO: 28645 - protein, 31 aa, Artificial Sequence
  Description of Artificial Sequence: Synthetic polypeptide
DEAEIRTTNPVATEQYGVVSTNLQHNGDGNM

SEQ ID NO: 28646 - protein, 31 aa, Artificial Sequence
  Description of Artificial Sequence: Synthetic polypeptide
DEEEIRTTNPVATEQYGSVSDQNATQSAGNN

SEQ ID NO: 28647 - protein, 32 aa, Artificial Sequence
  Description of Artificial Sequence: Synthetic polypeptide
DEEEIRTTNPVATEQYGSVSTQLQSGMGGNED

SEQ ID NO: 28648 - protein, 29 aa, Artificial Sequence
  Description of Artificial Sequence: Synthetic peptide
DEAEIRTTNGVAYCQYGSVTTNLTQRGDR

SEQ ID NO: 28649 - protein, 32 aa, Artificial Sequence
  Description of Artificial Sequence: Synthetic polypeptide
DEEEIRTTNPVATEQYGSVSTQNLSNGFGGNI

SEQ ID NO: 28650 - protein, 34 aa, Artificial Sequence
  Description of Artificial Sequence: Synthetic polypeptide
DEEEIRTTNPVATEQYGSVSSTNLAERNGNQEDR

SEQ ID NO: 28651 - protein, 32 aa, Artificial Sequence
  Description of Artificial Sequence: Synthetic polypeptide
DEEEIRTTNPVATEQYGSVSTQNLSGFGGNTT

SEQ ID NO: 28652 - protein, 32 aa, Artificial Sequence
  Description of Artificial Sequence: Synthetic polypeptide
DEEEIRTTNPVATEQYGSVSTNGQPQEGELRY

SEQ ID NO: 28653 - protein, 31 aa, Artificial Sequence
  Description of Artificial Sequence: Synthetic polypeptide
DEEEIRTTNPVATEQYGSVSDTADQRGEEID

SEQ ID NO: 28654 - protein, 31 aa, Artificial Sequence
  Description of Artificial Sequence: Synthetic polypeptide
DEEEIRTTNPVATEQYGSVSTNDDQETDEQR

SEQ ID NO: 28655 - protein, 32 aa, Artificial Sequence
  Description of Artificial Sequence: Synthetic polypeptide
DEEEIRTTNPVATEQYGSVSTTLQVNISNERE

SEQ ID NO: 28656 - protein, 33 aa, Artificial Sequence
  Description of Artificial Sequence: Synthetic polypeptide
DEEEIRTTNPVATEQYGSVSTTNLQQETVGNTM

SEQ ID NO: 28657 - protein, 32 aa, Artificial Sequence
  Description of Artificial Sequence: Synthetic polypeptide
DEEEIRTTNPVATEQYGSVSTMNLQGEQGIGD

SEQ ID NO: 28658 - protein, 31 aa, Artificial Sequence
  Description of Artificial Sequence: Synthetic polypeptide
DECEIRTTNPVATEQYGEVSTNLQGNNGDDR

SEQ ID NO: 28659 - protein, 33 aa, Artificial Sequence
  Description of Artificial Sequence: Synthetic polypeptide
DEEEIRTTNPVATEQYGSVSNTNLQFREGEEEE

SEQ ID NO: 28660 - protein, 32 aa, Artificial Sequence
  Description of Artificial Sequence: Synthetic polypeptide
DEEEIRTTNPVATEQYGSVPTNLLQRANVPVD

SEQ ID NO: 28661 - protein, 32 aa, Artificial Sequence
  Description of Artificial Sequence: Synthetic polypeptide
DEEEIRTTNPVATEQYGSVSTTLQWRMVDNDI

SEQ ID NO: 28662 - protein, 29 aa, Artificial Sequence
  Description of Artificial Sequence: Synthetic peptide
DEDEIATTNPVATEPYGSVATNLQVGNPM

SEQ ID NO: 28663 - protein, 31 aa, Artificial Sequence
  Description of Artificial Sequence: Synthetic polypeptide
DEEEIRTTNPVATEQYGSVPTNLLGRTEEDR

SEQ ID NO: 28664 - protein, 31 aa, Artificial Sequence
  Description of Artificial Sequence: Synthetic polypeptide
DEEEIRTTNPVATEQYGSVSTNDDLGENNHT

SEQ ID NO: 28665 - protein, 31 aa, Artificial Sequence
  Description of Artificial Sequence: Synthetic polypeptide
DEEEIRTTNPVATEQYGSVSTNLDGNGEEHV

SEQ ID NO: 28666 - protein, 33 aa, Artificial Sequence
  Description of Artificial Sequence: Synthetic polypeptide
DEEEIRTTNPVATEQYGSVSGTNLQGIGGNGNE

SEQ ID NO: 28667 - protein, 30 aa, Artificial Sequence
  Description of Artificial Sequence: Synthetic polypeptide
DEECIKTTNPVATECYGSVNCTNELQRGNM

SEQ ID NO: 28668 - protein, 31 aa, Artificial Sequence
  Description of Artificial Sequence: Synthetic polypeptide
DEEEIRTTNPVATEQYGSVSTTLQTQGLELG

SEQ ID NO: 28669 - protein, 29 aa, Artificial Sequence
  Description of Artificial Sequence: Synthetic peptide
DEDEIRTTNPVATEQYGCTATNLQRGDPW

SEQ ID NO: 28670 - protein, 33 aa, Artificial Sequence
  Description of Artificial Sequence: Synthetic polypeptide
DEEEIRTTNPVATEQYGSVSLTNLQIIIGENQT

SEQ ID NO: 28671 - protein, 33 aa, Artificial Sequence
  Description of Artificial Sequence: Synthetic polypeptide
DEEEIRTTNPVATEQYGSVSTTNLQQGQGQNGG

SEQ ID NO: 28672 - protein, 31 aa, Artificial Sequence
  Description of Artificial Sequence: Synthetic polypeptide
DEAEIRTTNPVAYEPYGSVISTNLSGRPGNR

SEQ ID NO: 28673 - protein, 33 aa, Artificial Sequence
  Description of Artificial Sequence: Synthetic polypeptide
DEEEIRTTNPVATEQYGSVSTTNLQQNGENENE

SEQ ID NO: 28674 - protein, 32 aa, Artificial Sequence
  Description of Artificial Sequence: Synthetic polypeptide
DEDEIRTTNPVATEQYGEVSTNLQQPGQDNDR

SEQ ID NO: 28675 - protein, 30 aa, Artificial Sequence
  Description of Artificial Sequence: Synthetic polypeptide
DEEEIRTTNPVATEQYGSVWTELDVRGEIA

SEQ ID NO: 28676 - protein, 32 aa, Artificial Sequence
  Description of Artificial Sequence: Synthetic polypeptide
DEEEIRTTNPVATEQYGSVSTMNLQEGGGEGI

SEQ ID NO: 28677 - protein, 32 aa, Artificial Sequence
  Description of Artificial Sequence: Synthetic polypeptide
DEEEIRTTNPVATEQYGSVSTQLQPNGNNNEI

SEQ ID NO: 28678 - protein, 30 aa, Artificial Sequence
  Description of Artificial Sequence: Synthetic polypeptide
DEAEIRTTNPVAYEPYGNVSTNLSQRVGMR

SEQ ID NO: 28679 - protein, 32 aa, Artificial Sequence
  Description of Artificial Sequence: Synthetic polypeptide
DEEEIRTTNPVATEQYGSVSTNGLSQNLLMNN

SEQ ID NO: 28680 - protein, 31 aa, Artificial Sequence
  Description of Artificial Sequence: Synthetic polypeptide
DEEEIRTTNPVATEQYGSVPTNLNRNESNSE

SEQ ID NO: 28681 - protein, 31 aa, Artificial Sequence
  Description of Artificial Sequence: Synthetic polypeptide
DEEEIRTTNPVATEQYGSVSTNGMDGSQQRY

SEQ ID NO: 28682 - protein, 33 aa, Artificial Sequence
  Description of Artificial Sequence: Synthetic polypeptide
DEEEIRTTNPVATEQYGSVSTNLDQEGFGENGF

SEQ ID NO: 28683 - protein, 32 aa, Artificial Sequence
  Description of Artificial Sequence: Synthetic polypeptide
DEEEIRTTNPVATEQYGSVSTQNMQDGGNGEE

SEQ ID NO: 28684 - protein, 30 aa, Artificial Sequence
  Description of Artificial Sequence: Synthetic polypeptide
DEDEIATTNPVATEPYGSVSATNLQQGNDT

SEQ ID NO: 28685 - protein, 32 aa, Artificial Sequence
  Description of Artificial Sequence: Synthetic polypeptide
DEEEIRTTNPVATEQYGSVSDTNNQGSGENEV

SEQ ID NO: 28686 - protein, 31 aa, Artificial Sequence
  Description of Artificial Sequence: Synthetic polypeptide
DEEEIRTTNPVATEQYGSVSGSLVRNGNEDQ

SEQ ID NO: 28687 - protein, 32 aa, Artificial Sequence
  Description of Artificial Sequence: Synthetic polypeptide
DEEEIRTTNPVATEQYGSVSGTNGQGNNGNED

SEQ ID NO: 28688 - protein, 31 aa, Artificial Sequence
  Description of Artificial Sequence: Synthetic polypeptide
DEEEIRTTNPVATEQYGSVSTNDDQLFGEII

SEQ ID NO: 28689 - protein, 30 aa, Artificial Sequence
  Description of Artificial Sequence: Synthetic polypeptide
DEECIRTTNPVAYEAYGSVSTNLSDNGGNR

SEQ ID NO: 28690 - protein, 31 aa, Artificial Sequence
  Description of Artificial Sequence: Synthetic polypeptide
DEEEIRTTNPVATEQYGSVSTNLDNMGGEQI

SEQ ID NO: 28691 - protein, 32 aa, Artificial Sequence
  Description of Artificial Sequence: Synthetic polypeptide
DEEEIRTTNPVATEQYGSVSTNLDNEGFGENI

SEQ ID NO: 28692 - protein, 29 aa, Artificial Sequence
  Description of Artificial Sequence: Synthetic peptide
DEAEIRTTNGVAYCQYGSVYTNLERGNDR

SEQ ID NO: 28693 - protein, 32 aa, Artificial Sequence
  Description of Artificial Sequence: Synthetic polypeptide
DEEEIRTTNPVATEQYGSVSNTSALEERGFNV

SEQ ID NO: 28694 - protein, 32 aa, Artificial Sequence
  Description of Artificial Sequence: Synthetic polypeptide
DEEEIRTTNPVATEQYGSVSTNLDGENIGNGQ

SEQ ID NO: 28695 - protein, 29 aa, Artificial Sequence
  Description of Artificial Sequence: Synthetic peptide
DEAEIRTTNGVAYCQYGSVSTNLQRGSDQ

SEQ ID NO: 28696 - protein, 30 aa, Artificial Sequence
  Description of Artificial Sequence: Synthetic polypeptide
DEDEIATTNPVATEPYGSVAATNLARDGNR

SEQ ID NO: 28697 - protein, 30 aa, Artificial Sequence
  Description of Artificial Sequence: Synthetic polypeptide
DEAEIRTTNPVAYEHYGSVVSTNLQGGNGE

SEQ ID NO: 28698 - protein, 31 aa, Artificial Sequence
  Description of Artificial Sequence: Synthetic polypeptide
DEECIRTTNPVATEQYGSVSTNLENFGSNQM

SEQ ID NO: 28699 - protein, 33 aa, Artificial Sequence
  Description of Artificial Sequence: Synthetic polypeptide
DEEEIRTTNPVATEQYGSVSTMNLQPEMGENQQ

SEQ ID NO: 28700 - protein, 31 aa, Artificial Sequence
  Description of Artificial Sequence: Synthetic polypeptide
DEAEIRTTNPVAYEHYGSVSTNLQRGGDNNQ

SEQ ID NO: 28701 - protein, 29 aa, Artificial Sequence
  Description of Artificial Sequence: Synthetic peptide
DEAEIRTTNGVAYCQYGSVSNTNLQRGDD

SEQ ID NO: 28702 - protein, 32 aa, Artificial Sequence
  Description of Artificial Sequence: Synthetic polypeptide
DEEEIRTTNPVATEQYGSVSTTNLQQETVGFL

SEQ ID NO: 28703 - protein, 34 aa, Artificial Sequence
  Description of Artificial Sequence: Synthetic polypeptide
DEEEIRTTNPVATEQYGSVSLTPNLQEREGNQIG

SEQ ID NO: 28704 - protein, 32 aa, Artificial Sequence
  Description of Artificial Sequence: Synthetic polypeptide
DEEEIRTTNPVATEQYGSVSLTPNLIRTNFDT

SEQ ID NO: 28705 - protein, 31 aa, Artificial Sequence
  Description of Artificial Sequence: Synthetic polypeptide
DECEIRTTNPVATEQYGSVLSTGLTRQDGDR

SEQ ID NO: 28706 - protein, 33 aa, Artificial Sequence
  Description of Artificial Sequence: Synthetic polypeptide
DEEEIRTTNPVATEQYGSVSTMNLQQGQGNNED

SEQ ID NO: 28707 - protein, 30 aa, Artificial Sequence
  Description of Artificial Sequence: Synthetic polypeptide
DEEEIRTTNPVATEQYGSVSENLQSEEMPY

SEQ ID NO: 28708 - protein, 32 aa, Artificial Sequence
  Description of Artificial Sequence: Synthetic polypeptide
DEEEIRTTNPVATEQYGSVSTNGSQTGGENPQ

SEQ ID NO: 28709 - protein, 29 aa, Artificial Sequence
  Description of Artificial Sequence: Synthetic peptide
DEDEISTTNPVAYEPYGSVATNLQRDGND

SEQ ID NO: 28710 - protein, 31 aa, Artificial Sequence
  Description of Artificial Sequence: Synthetic polypeptide
DECEIRTTNPVATEQYGSVSTDDAGQNGNAR

SEQ ID NO: 28711 - protein, 32 aa, Artificial Sequence
  Description of Artificial Sequence: Synthetic polypeptide
DEEEIRTTNPVATEQYGSVSGTDNDDQEGGNS

SEQ ID NO: 28712 - protein, 30 aa, Artificial Sequence
  Description of Artificial Sequence: Synthetic polypeptide
DECEIRTTNPVATEQYGSVSTGLDLGDNAE

SEQ ID NO: 28713 - protein, 33 aa, Artificial Sequence
  Description of Artificial Sequence: Synthetic polypeptide
DEEEIRTTNPVATEQYGSVSTQNLQQEMGNTQI

SEQ ID NO: 28714 - protein, 31 aa, Artificial Sequence
  Description of Artificial Sequence: Synthetic polypeptide
DEEEIRTTNPVATEQYGSVSTQNDNGTGGND

SEQ ID NO: 28715 - protein, 32 aa, Artificial Sequence
  Description of Artificial Sequence: Synthetic polypeptide
DEEEIRTTNPVATEQYGSVSTQNDNLDIGQND

SEQ ID NO: 28716 - protein, 32 aa, Artificial Sequence
  Description of Artificial Sequence: Synthetic polypeptide
DEEEIRTTNPVATEQYGSVSSTDLQNGGNVGT

SEQ ID NO: 28717 - protein, 31 aa, Artificial Sequence
  Description of Artificial Sequence: Synthetic polypeptide
DEEEIRTTNPVATEQYGSVSTTLTTRNNEED

SEQ ID NO: 28718 - protein, 30 aa, Artificial Sequence
  Description of Artificial Sequence: Synthetic polypeptide
DEDEIATTNPVATEHYGSVSTNLQQGNDEN

SEQ ID NO: 28719 - protein, 32 aa, Artificial Sequence
  Description of Artificial Sequence: Synthetic polypeptide
DEEEIRTTNPVATEQYGSVSNTNHQGSGSDRP

SEQ ID NO: 28720 - protein, 32 aa, Artificial Sequence
  Description of Artificial Sequence: Synthetic polypeptide
DEEEIRTTNPVATEQYGSVSTMNLQNRSMVIV

SEQ ID NO: 28721 - protein, 32 aa, Artificial Sequence
  Description of Artificial Sequence: Synthetic polypeptide
DEEEIRTTNPVATEQYGSVSTQNAGNQNNGNF

SEQ ID NO: 28722 - protein, 31 aa, Artificial Sequence
  Description of Artificial Sequence: Synthetic polypeptide
DEEEIRTTNPVATEQYGSVSTNDDARGIQHT

SEQ ID NO: 28723 - protein, 31 aa, Artificial Sequence
  Description of Artificial Sequence: Synthetic polypeptide
DEEEIRTTNPVATEQYGSVSTMNLQIHEFQD

SEQ ID NO: 28724 - protein, 29 aa, Artificial Sequence
  Description of Artificial Sequence: Synthetic peptide
DEAEIRTTNGVAYCQYGSVSTNLQRGDQY

SEQ ID NO: 28725 - protein, 32 aa, Artificial Sequence
  Description of Artificial Sequence: Synthetic polypeptide
DEEEIRTTNPVATEQYGSVSTTLSQRVGEEDL

SEQ ID NO: 28726 - protein, 29 aa, Artificial Sequence
  Description of Artificial Sequence: Synthetic peptide
DEAEIRTTNGVAYCQYGSVSTNLQRGDDE

SEQ ID NO: 28727 - protein, 33 aa, Artificial Sequence
  Description of Artificial Sequence: Synthetic polypeptide
DEEEIRTTNPVATEQYGSVSTTNLQQETVGNIQ

SEQ ID NO: 28728 - protein, 29 aa, Artificial Sequence
  Description of Artificial Sequence: Synthetic peptide
DEAEIRTTNGVAYCQYGSVSTNLQFGDRP

SEQ ID NO: 28729 - protein, 29 aa, Artificial Sequence
  Description of Artificial Sequence: Synthetic peptide
DEAEIRTTNGVAYCQYGSVSTNLERGTDR

SEQ ID NO: 28730 - protein, 32 aa, Artificial Sequence
  Description of Artificial Sequence: Synthetic polypeptide
DEEEIRTTNPVATEQYGSVSNTNLQFNEFNGQ

SEQ ID NO: 28731 - protein, 32 aa, Artificial Sequence
  Description of Artificial Sequence: Synthetic polypeptide
DEEEIRTTNPVATEQYGSVPSCTNLSDRGGDS

SEQ ID NO: 28732 - protein, 28 aa, Artificial Sequence
  Description of Artificial Sequence: Synthetic peptide
DEECIATVNPVAYEPYGSVSDNLTRGNR

SEQ ID NO: 28733 - protein, 31 aa, Artificial Sequence
  Description of Artificial Sequence: Synthetic polypeptide
DEAEIRTTNPVATETYGSVSTNLQHNGGNNS

SEQ ID NO: 28734 - protein, 33 aa, Artificial Sequence
  Description of Artificial Sequence: Synthetic polypeptide
DEEEIRTTNPVATEQYGSVSTMNLQLEFGNFIP

SEQ ID NO: 28735 - protein, 32 aa, Artificial Sequence
  Description of Artificial Sequence: Synthetic polypeptide
DEEEIRTTNPVATEQYGSVSTQNLQSNGTTEN

SEQ ID NO: 28736 - protein, 29 aa, Artificial Sequence
  Description of Artificial Sequence: Synthetic peptide
DEAEIRTTNGVAYCQYGSVSTMNLERGIR

SEQ ID NO: 28737 - protein, 32 aa, Artificial Sequence
  Description of Artificial Sequence: Synthetic polypeptide
DEEEIRTTNPVATEQYGSVSSTNLDARDNNMG

SEQ ID NO: 28738 - protein, 30 aa, Artificial Sequence
  Description of Artificial Sequence: Synthetic polypeptide
DEEEIRTTNPVATEQYGSVSTNLDESVDEI

SEQ ID NO: 28739 - protein, 30 aa, Artificial Sequence
  Description of Artificial Sequence: Synthetic polypeptide
DEEEIRTTNPVATEQYGSVWTNDMNGENNE

SEQ ID NO: 28740 - protein, 33 aa, Artificial Sequence
  Description of Artificial Sequence: Synthetic polypeptide
DEEEIRTTNPVATEQYGSVSTNLDDYRGGNEEG

SEQ ID NO: 28741 - protein, 31 aa, Artificial Sequence
  Description of Artificial Sequence: Synthetic polypeptide
DEEEIRTTNPVATEQYGSVWTNHDRGTNNDE

SEQ ID NO: 28742 - protein, 32 aa, Artificial Sequence
  Description of Artificial Sequence: Synthetic polypeptide
DEEEIRTTNPVATEQYGSVSTMNLQNIQGGDD

SEQ ID NO: 28743 - protein, 31 aa, Artificial Sequence
  Description of Artificial Sequence: Synthetic polypeptide
DEEEIRTTNPVATEQYGSVSTNDARVGEETS

SEQ ID NO: 28744 - protein, 30 aa, Artificial Sequence
  Description of Artificial Sequence: Synthetic polypeptide
DEAEIRTTNGVAYCQYGSVSTNLDQRGSDR

SEQ ID NO: 28745 - protein, 31 aa, Artificial Sequence
  Description of Artificial Sequence: Synthetic polypeptide
DEECIRTTNPVATEQYSEEVSTNLQNFGNRA

SEQ ID NO: 28746 - protein, 33 aa, Artificial Sequence
  Description of Artificial Sequence: Synthetic polypeptide
DEEEIRTTNPVATEQYGSVSSTNLQNNGGNTTT

SEQ ID NO: 28747 - protein, 33 aa, Artificial Sequence
  Description of Artificial Sequence: Synthetic polypeptide
DEEEIRTTNPVATEQYGSVSNTQNLQTNGENNI

SEQ ID NO: 28748 - protein, 31 aa, Artificial Sequence
  Description of Artificial Sequence: Synthetic polypeptide
DEEEIRTTNPVATEQYGSVSTNDHQERDMDD

SEQ ID NO: 28749 - protein, 32 aa, Artificial Sequence
  Description of Artificial Sequence: Synthetic polypeptide
DEEEIRTTNPVATEQYGSVSDSNLNERGEDDR

SEQ ID NO: 28750 - protein, 31 aa, Artificial Sequence
  Description of Artificial Sequence: Synthetic polypeptide
DEDEIRTTNPVATEQYGEVSTNLNQGDGNNQ

SEQ ID NO: 28751 - protein, 31 aa, Artificial Sequence
  Description of Artificial Sequence: Synthetic polypeptide
DEEEIRTTNPVATEQYGSVSPANMVRGMDRD

SEQ ID NO: 28752 - protein, 30 aa, Artificial Sequence
  Description of Artificial Sequence: Synthetic polypeptide
DEEEIRTTNPVATEQYGSVSPANMIRNEER

SEQ ID NO: 28753 - protein, 30 aa, Artificial Sequence
  Description of Artificial Sequence: Synthetic polypeptide
DEDEIRTTNPVATEQYGCTPSTNLQRGGDS

SEQ ID NO: 28754 - protein, 31 aa, Artificial Sequence
  Description of Artificial Sequence: Synthetic polypeptide
DEAEIRTTNPVATEQYGVVVSTNLQHGNEGE

SEQ ID NO: 28755 - protein, 32 aa, Artificial Sequence
  Description of Artificial Sequence: Synthetic polypeptide
DEEEIRTTNPVATEQYGSVSTNLDQVQENIFL

SEQ ID NO: 28756 - protein, 33 aa, Artificial Sequence
  Description of Artificial Sequence: Synthetic polypeptide
DEEEIRTTNPVATEQYGSVWSNTNDLDWRGTQR

SEQ ID NO: 28757 - protein, 33 aa, Artificial Sequence
  Description of Artificial Sequence: Synthetic polypeptide
DEEEIRTTNPVATEQYGSVSTMNLIQQNNGNEQ

SEQ ID NO: 28758 - protein, 32 aa, Artificial Sequence
  Description of Artificial Sequence: Synthetic polypeptide
DEEEIRTTNPVATEQYGSVSTQNVNQVGNSQG

SEQ ID NO: 28759 - protein, 33 aa, Artificial Sequence
  Description of Artificial Sequence: Synthetic polypeptide
DEEEIRTTNPVATEQYGSVSSTNLQPQGGNTMT

SEQ ID NO: 28760 - protein, 32 aa, Artificial Sequence
  Description of Artificial Sequence: Synthetic polypeptide
DEECIRTTNPVATEQYGSVSCTNLSDNGGNNR

SEQ ID NO: 28761 - protein, 32 aa, Artificial Sequence
  Description of Artificial Sequence: Synthetic polypeptide
DEEEIRTTNPVATEQYGSVYTNLVPRFGQANV

SEQ ID NO: 28762 - protein, 32 aa, Artificial Sequence
  Description of Artificial Sequence: Synthetic polypeptide
DEEEIRTTNPVATEQYGSVSNTNGQTGGNQEG

SEQ ID NO: 28763 - protein, 32 aa, Artificial Sequence
  Description of Artificial Sequence: Synthetic polypeptide
DEEEIRTTNPVATEQYGSVSPANLQTGQSLNE

SEQ ID NO: 28764 - protein, 29 aa, Artificial Sequence
  Description of Artificial Sequence: Synthetic peptide
DEECIATVNPVATEAYGSVSWNLERGNRS

SEQ ID NO: 28765 - protein, 33 aa, Artificial Sequence
  Description of Artificial Sequence: Synthetic polypeptide
DEEEIRTTNPVATEQYGSVSNTQNLDQEMGNQI

SEQ ID NO: 28766 - protein, 32 aa, Artificial Sequence
  Description of Artificial Sequence: Synthetic polypeptide
DEEEIRTTNPVATEQYGSVSTMNLLIEMVNRN

SEQ ID NO: 28767 - protein, 32 aa, Artificial Sequence
  Description of Artificial Sequence: Synthetic polypeptide
DEEEIRTTNPVATEQYGSVSPANLQTGEEIRQ

SEQ ID NO: 28768 - protein, 31 aa, Artificial Sequence
  Description of Artificial Sequence: Synthetic polypeptide
DEAEICTTNPVATEQYGSVSTNLQGDMGNDH

SEQ ID NO: 28769 - protein, 33 aa, Artificial Sequence
  Description of Artificial Sequence: Synthetic polypeptide
DEEEIRTTNPVATEQYGSVSTTNLQSVGENESS

SEQ ID NO: 28770 - protein, 32 aa, Artificial Sequence
  Description of Artificial Sequence: Synthetic polypeptide
DEEEIRTTNPVATEQYGSVSGTNNDGQNNGNE

SEQ ID NO: 28771 - protein, 31 aa, Artificial Sequence
  Description of Artificial Sequence: Synthetic polypeptide
DEDEIRTTNPVATEQYGEVSTNLNQGDGDMR

SEQ ID NO: 28772 - protein, 30 aa, Artificial Sequence
  Description of Artificial Sequence: Synthetic polypeptide
DEDEIRTTNPVATEQYGCTSCTNLSQRGDS

SEQ ID NO: 28773 - protein, 32 aa, Artificial Sequence
  Description of Artificial Sequence: Synthetic polypeptide
DEEEIRTTNPVATEQYGSVSTQLQDTNGNNED

SEQ ID NO: 28774 - protein, 32 aa, Artificial Sequence
  Description of Artificial Sequence: Synthetic polypeptide
DEEEIRTTNPVATEQYGSVSTTLQQNGINENE

SEQ ID NO: 28775 - protein, 32 aa, Artificial Sequence
  Description of Artificial Sequence: Synthetic polypeptide
DEEEIRTTNPVATEQYGSVSNTNEQQGIGGNE

SEQ ID NO: 28776 - protein, 30 aa, Artificial Sequence
  Description of Artificial Sequence: Synthetic polypeptide
DEAEIRTTNPVATEQYGVVSTPLQRPSNQS

SEQ ID NO: 28777 - protein, 32 aa, Artificial Sequence
  Description of Artificial Sequence: Synthetic polypeptide
DEEEIRTTNPVATEQYGSVSTQNVQGVGNGQE

SEQ ID NO: 28778 - protein, 29 aa, Artificial Sequence
  Description of Artificial Sequence: Synthetic peptide
DEAEIRTTNPVATEQYGVVSTPLQSPSND

SEQ ID NO: 28779 - protein, 30 aa, Artificial Sequence
  Description of Artificial Sequence: Synthetic polypeptide
DEAEIRTTNPVATEQYGVVSTSALSQRPND

SEQ ID NO: 28780 - protein, 32 aa, Artificial Sequence
  Description of Artificial Sequence: Synthetic polypeptide
DEEEIRTTNPVATEQYGSVWSLPNMLQRDLTR

SEQ ID NO: 28781 - protein, 33 aa, Artificial Sequence
  Description of Artificial Sequence: Synthetic polypeptide
DEEEIRTTNPVATEQYGSVSGTNNELQEGGNGG

SEQ ID NO: 28782 - protein, 33 aa, Artificial Sequence
  Description of Artificial Sequence: Synthetic polypeptide
DEEEIRTTNPVATEQYGSVSTMNLGVGGQEGNV

SEQ ID NO: 28783 - protein, 30 aa, Artificial Sequence
  Description of Artificial Sequence: Synthetic polypeptide
DEDEIRTTNPVAYEQYGTVSTNLQDHGDER

SEQ ID NO: 28784 - protein, 30 aa, Artificial Sequence
  Description of Artificial Sequence: Synthetic polypeptide
DEDEIRTTNPVAYEQYGTVSTNLQGNGNDD

SEQ ID NO: 28785 - protein, 30 aa, Artificial Sequence
  Description of Artificial Sequence: Synthetic polypeptide
DEAEICTTNPVATEQYGSVSTNLNGNGNDK

SEQ ID NO: 28786 - protein, 32 aa, Artificial Sequence
  Description of Artificial Sequence: Synthetic polypeptide
DEEEIRTTNPVATEQYGSVSTNDHQERDMISR

SEQ ID NO: 28787 - protein, 31 aa, Artificial Sequence
  Description of Artificial Sequence: Synthetic polypeptide
DEEEIRTTNPVATEQYGSVSNTNGGQEAGGF

SEQ ID NO: 28788 - protein, 33 aa, Artificial Sequence
  Description of Artificial Sequence: Synthetic polypeptide
DEEEIRTTNPVATEQYGSVSPCNEQERGEENRM

SEQ ID NO: 28789 - protein, 30 aa, Artificial Sequence
  Description of Artificial Sequence: Synthetic polypeptide
DEDEIRTTNPVAYEQYGTVSTNLQNGGNEH

SEQ ID NO: 28790 - protein, 29 aa, Artificial Sequence
  Description of Artificial Sequence: Synthetic peptide
DEDEIRTTNPVAYEQYGTVSTNNQGDGER

SEQ ID NO: 28791 - protein, 32 aa, Artificial Sequence
  Description of Artificial Sequence: Synthetic polypeptide
DEEEIRTTNPVATEQYGSVSTNDHQERDMERM

SEQ ID NO: 28792 - protein, 29 aa, Artificial Sequence
  Description of Artificial Sequence: Synthetic peptide
DECVIGTTNPVATEQDGSVSTDFLQRGER

SEQ ID NO: 28793 - protein, 30 aa, Artificial Sequence
  Description of Artificial Sequence: Synthetic polypeptide
DEEEIRTTNPVATEQYGSVSSPNLNRSEGH

SEQ ID NO: 28794 - protein, 32 aa, Artificial Sequence
  Description of Artificial Sequence: Synthetic polypeptide
DEEEIRTTNPVATEQYGSVSNTQNEQVGNGFE

SEQ ID NO: 28795 - protein, 32 aa, Artificial Sequence
  Description of Artificial Sequence: Synthetic polypeptide
DEEEIRTTNPVATEQYGSVSTMNLNEFGGNDE

SEQ ID NO: 28796 - protein, 30 aa, Artificial Sequence
  Description of Artificial Sequence: Synthetic polypeptide
DEDEIRTTNPVAYEQYGVVSTNLQHDGGNS

SEQ ID NO: 28797 - protein, 32 aa, Artificial Sequence
  Description of Artificial Sequence: Synthetic polypeptide
DEEEIRTTNPVATEQYGSVSGTNMEQNIGNSM

SEQ ID NO: 28798 - protein, 33 aa, Artificial Sequence
  Description of Artificial Sequence: Synthetic polypeptide
DEEEIRTTNPVATEQYGSVSGTNLVQEMGNGEG

SEQ ID NO: 28799 - protein, 32 aa, Artificial Sequence
  Description of Artificial Sequence: Synthetic polypeptide
DEEEIRTTNPVATEQYGSVSTMNLPNIGNGQE

SEQ ID NO: 28800 - protein, 32 aa, Artificial Sequence
  Description of Artificial Sequence: Synthetic polypeptide
DEEEIRTTNPVATEQYGSVSTTNLQQVMENVL

SEQ ID NO: 28801 - protein, 30 aa, Artificial Sequence
  Description of Artificial Sequence: Synthetic polypeptide
DEAEIRTTNPCATECYGSVSTNLQMGGDER

SEQ ID NO: 28802 - protein, 31 aa, Artificial Sequence
  Description of Artificial Sequence: Synthetic polypeptide
DEEEIRTTNPVATEQYGSVYTNLQVILNEGV

SEQ ID NO: 28803 - protein, 32 aa, Artificial Sequence
  Description of Artificial Sequence: Synthetic polypeptide
DEEEIRTTNPVATEQYGSVSTNGLQQTPAERM

SEQ ID NO: 28804 - protein, 33 aa, Artificial Sequence
  Description of Artificial Sequence: Synthetic polypeptide
DEEEIRTTNPVATEQYGSVSTMNLQDEFGNPGE

SEQ ID NO: 28805 - protein, 31 aa, Artificial Sequence
  Description of Artificial Sequence: Synthetic polypeptide
DEAEICTTNPVATEQYGSVSTQNDQGGGDNR

SEQ ID NO: 28806 - protein, 30 aa, Artificial Sequence
  Description of Artificial Sequence: Synthetic polypeptide
DEECIRTTNPVATEQYSECVSTPLQIGSNR

SEQ ID NO: 28807 - protein, 32 aa, Artificial Sequence
  Description of Artificial Sequence: Synthetic polypeptide
DEEEIRTTNPVATEQYGSVSTTNLQQVFGIGD

SEQ ID NO: 28808 - protein, 31 aa, Artificial Sequence
  Description of Artificial Sequence: Synthetic polypeptide
DEEEIRTTNPVATEQYGSVSTNDGNDEGDNF

SEQ ID NO: 28809 - protein, 31 aa, Artificial Sequence
  Description of Artificial Sequence: Synthetic polypeptide
DEAEIRTTNPCATECYGSVSTNLQGEDGNER

SEQ ID NO: 28810 - protein, 31 aa, Artificial Sequence
  Description of Artificial Sequence: Synthetic polypeptide
DEEEIRTTNPVATEQYGSVSDSNLQGQMNGI

SEQ ID NO: 28811 - protein, 33 aa, Artificial Sequence
  Description of Artificial Sequence: Synthetic polypeptide
DEEEIRTTNPVATEQYGSVSTMNLQDEMGNGQD

SEQ ID NO: 28812 - protein, 32 aa, Artificial Sequence
  Description of Artificial Sequence: Synthetic polypeptide
DEEEIRTTNPVATEQYGSVSTQNQHQERDMIR

SEQ ID NO: 28813 - protein, 32 aa, Artificial Sequence
  Description of Artificial Sequence: Synthetic polypeptide
DEAEIRTTNPVAYEPYGSVSTTGNLSQRGNNR

SEQ ID NO: 28814 - protein, 31 aa, Artificial Sequence
  Description of Artificial Sequence: Synthetic polypeptide
DEEEIRTTNPVATEQYGSVYTNLQSTGELVA

SEQ ID NO: 28815 - protein, 32 aa, Artificial Sequence
  Description of Artificial Sequence: Synthetic polypeptide
DEEEIRTTNPVATEQYGSVSTMNLQDETGQGE

SEQ ID NO: 28816 - protein, 32 aa, Artificial Sequence
  Description of Artificial Sequence: Synthetic polypeptide
DEAEIRTTNPVAYEPYGSVSCTNLSQRGNNRC

SEQ ID NO: 28817 - protein, 30 aa, Artificial Sequence
  Description of Artificial Sequence: Synthetic polypeptide
DEECIRTTNPVATEQYSECVSTNLQNGNNA

SEQ ID NO: 28818 - protein, 31 aa, Artificial Sequence
  Description of Artificial Sequence: Synthetic polypeptide
DEAEIRTTNPVATERYGSVSTNNDQEGGNDR

SEQ ID NO: 28819 - protein, 33 aa, Artificial Sequence
  Description of Artificial Sequence: Synthetic polypeptide
DEEEIRTTNPVATEQYGSVSSTNLQPGGGNTDE

SEQ ID NO: 28820 - protein, 33 aa, Artificial Sequence
  Description of Artificial Sequence: Synthetic polypeptide
DEEEIRTTNPVATEQYGSVSNTQNLQTNFGNEF

SEQ ID NO: 28821 - protein, 33 aa, Artificial Sequence
  Description of Artificial Sequence: Synthetic polypeptide
DEEEIRTTNPVATEQYGSVSLTPNLQTGENPVA

SEQ ID NO: 28822 - protein, 33 aa, Artificial Sequence
  Description of Artificial Sequence: Synthetic polypeptide
DEEEIRTTNPVATEQYGSVSTMNLNQNGGNENE

SEQ ID NO: 28823 - protein, 30 aa, Artificial Sequence
  Description of Artificial Sequence: Synthetic polypeptide
DEECIRTTNPVATEQYGSVSKTLELEGGNT

SEQ ID NO: 28824 - protein, 30 aa, Artificial Sequence
  Description of Artificial Sequence: Synthetic polypeptide
DEEEIRTTNPVATEQYGSVYTNLQVSELVA

SEQ ID NO: 28825 - protein, 32 aa, Artificial Sequence
  Description of Artificial Sequence: Synthetic polypeptide
DEEEIRTTNPVATEQYGSVSPANLQQVVGSLR

SEQ ID NO: 28826 - protein, 32 aa, Artificial Sequence
  Description of Artificial Sequence: Synthetic polypeptide
DEAEICTTNPVATEQYGSVSTNLQGNDDGNTR

SEQ ID NO: 28827 - protein, 33 aa, Artificial Sequence
  Description of Artificial Sequence: Synthetic polypeptide
DEEEIRTTNPVATEQYGSVSPANLMRQGNEQRY

SEQ ID NO: 28828 - protein, 32 aa, Artificial Sequence
  Description of Artificial Sequence: Synthetic polypeptide
DEEEIRTTNPVATEQYGSVSTNGLQNAGSQGI

SEQ ID NO: 28829 - protein, 32 aa, Artificial Sequence
  Description of Artificial Sequence: Synthetic polypeptide
DEEEIRTTNPVATEQYGSVSTMNLNLDGGQNF

SEQ ID NO: 28830 - protein, 29 aa, Artificial Sequence
  Description of Artificial Sequence: Synthetic peptide
DEEEIRTTNPVATEQYGSVSSQSTRGEEL

SEQ ID NO: 28831 - protein, 32 aa, Artificial Sequence
  Description of Artificial Sequence: Synthetic polypeptide
DEEEIRTTNPVATEQYGSVSTMNLNNIGGNGD

SEQ ID NO: 28832 - protein, 31 aa, Artificial Sequence
  Description of Artificial Sequence: Synthetic polypeptide
DEAEICTTNPVATEQYGSVSTNLQGNDGNDS

SEQ ID NO: 28833 - protein, 31 aa, Artificial Sequence
  Description of Artificial Sequence: Synthetic polypeptide
DEEEIRTTNPVATEQYGSVSTQNPIQGEDER

SEQ ID NO: 28834 - protein, 31 aa, Artificial Sequence
  Description of Artificial Sequence: Synthetic polypeptide
DEEEIRTTNPVATEQYGSVSSSGPLQRDEVR

SEQ ID NO: 28835 - protein, 31 aa, Artificial Sequence
  Description of Artificial Sequence: Synthetic polypeptide
DEAEICTTNPVATEQYGSVSTNLQGTGDNNM

SEQ ID NO: 28836 - protein, 32 aa, Artificial Sequence
  Description of Artificial Sequence: Synthetic polypeptide
DEEEIRTTNPVATEQYGSVSTQLQNIGGENQA

SEQ ID NO: 28837 - protein, 33 aa, Artificial Sequence
  Description of Artificial Sequence: Synthetic polypeptide
DEEEIRTTNPVATEQYGSVSPANLIERGENSRS

SEQ ID NO: 28838 - protein, 31 aa, Artificial Sequence
  Description of Artificial Sequence: Synthetic polypeptide
DEEEIRTTNPVATEQYGSVSPANLGRGPIEE

SEQ ID NO: 28839 - protein, 32 aa, Artificial Sequence
  Description of Artificial Sequence: Synthetic polypeptide
DEEEIRTTNPVATEQYGSVWSVPNMIQRDNRI

SEQ ID NO: 28840 - protein, 32 aa, Artificial Sequence
  Description of Artificial Sequence: Synthetic polypeptide
DEDEIRTTNPVATEQYGEVSTNLQGNAGNEDR

SEQ ID NO: 28841 - protein, 33 aa, Artificial Sequence
  Description of Artificial Sequence: Synthetic polypeptide
DEEEIRTTNPVATEQYGSVSTMNLNQNFGSNQA

SEQ ID NO: 28842 - protein, 31 aa, Artificial Sequence
  Description of Artificial Sequence: Synthetic polypeptide
DEAEICTTNPVATEQYGSVSTNLQNDDNGRE

SEQ ID NO: 28843 - protein, 32 aa, Artificial Sequence
  Description of Artificial Sequence: Synthetic polypeptide
DEEEIRTTNPVATEQYGSVSGTNGQQGGGNEL

SEQ ID NO: 28844 - protein, 32 aa, Artificial Sequence
  Description of Artificial Sequence: Synthetic polypeptide
DEEEIRTTNPVATEQYGSVSNTQNLIGGGNGT

SEQ ID NO: 28845 - protein, 31 aa, Artificial Sequence
  Description of Artificial Sequence: Synthetic polypeptide
DEAEICTTNPVATEQYGSVSTNLQGQGGNDT

SEQ ID NO: 28846 - protein, 32 aa, Artificial Sequence
  Description of Artificial Sequence: Synthetic polypeptide
DEEEIRTTNPVATEQYGSVYNTFNLEYGRGTR

SEQ ID NO: 28847 - protein, 33 aa, Artificial Sequence
  Description of Artificial Sequence: Synthetic polypeptide
DEEEIRTTNPVATEQYGSVSMTENLQNFGSIRP

SEQ ID NO: 28848 - protein, 32 aa, Artificial Sequence
  Description of Artificial Sequence: Synthetic polypeptide
DEEEIRTTNPVATEQYGSVSLTNIEQERDMIR

SEQ ID NO: 28849 - protein, 30 aa, Artificial Sequence
  Description of Artificial Sequence: Synthetic polypeptide
DEAEIRTTNPVATEQYGSSSTNTQQREGLD

SEQ ID NO: 28850 - protein, 31 aa, Artificial Sequence
  Description of Artificial Sequence: Synthetic polypeptide
DEEEIRTTNPVATEQYGSVSTNQNNNGGNGE

SEQ ID NO: 28851 - protein, 31 aa, Artificial Sequence
  Description of Artificial Sequence: Synthetic polypeptide
DEEEIRTTNPVATEQYGSVSTWNDDERSEER

SEQ ID NO: 28852 - protein, 32 aa, Artificial Sequence
  Description of Artificial Sequence: Synthetic polypeptide
DEDEIRTTNPVATEQYGSVSTTNGDQGQGNTR

SEQ ID NO: 28853 - protein, 31 aa, Artificial Sequence
  Description of Artificial Sequence: Synthetic polypeptide
DEDEIRTTNPVATEQYGSVSTTNGDGNGNNR

SEQ ID NO: 28854 - protein, 33 aa, Artificial Sequence
  Description of Artificial Sequence: Synthetic polypeptide
DEDEIRTTNPVATEQYGSVSTTNDLQGQDGNTR

SEQ ID NO: 28855 - protein, 31 aa, Artificial Sequence
  Description of Artificial Sequence: Synthetic polypeptide
DEEEIRTTNPVATEQYGSVSANLEVGENSVL

SEQ ID NO: 28856 - protein, 32 aa, Artificial Sequence
  Description of Artificial Sequence: Synthetic polypeptide
DEEEIRTTNPVATEQYGSVSPTNLTQPIVNII

SEQ ID NO: 28857 - protein, 31 aa, Artificial Sequence
  Description of Artificial Sequence: Synthetic polypeptide
DEEEIRTTNPVATEQYGSVSPTNLTERNQED

SEQ ID NO: 28858 - protein, 32 aa, Artificial Sequence
  Description of Artificial Sequence: Synthetic polypeptide
DEEEIRTTNPVATEQYGSVSTNQNQGDNGNGN

SEQ ID NO: 28859 - protein, 30 aa, Artificial Sequence
  Description of Artificial Sequence: Synthetic polypeptide
DEEEIRTTNPVATEQYGSVSNNLDQSVEGI

SEQ ID NO: 28860 - protein, 28 aa, Artificial Sequence
  Description of Artificial Sequence: Synthetic peptide
DEDEIATTNPVAYEQYGSVATNDQRGSD

SEQ ID NO: 28861 - protein, 30 aa, Artificial Sequence
  Description of Artificial Sequence: Synthetic polypeptide
DEEEIRTTNPVATEQYGSVSVTTLQGDIDQ

SEQ ID NO: 28862 - protein, 33 aa, Artificial Sequence
  Description of Artificial Sequence: Synthetic polypeptide
DEEEIRTTNPVATEQYGSVSPTNLVQRDDNETE

SEQ ID NO: 28863 - protein, 33 aa, Artificial Sequence
  Description of Artificial Sequence: Synthetic polypeptide
DEECIRTTNPVATEAYGSVPSDTNLSQRTGGNR

SEQ ID NO: 28864 - protein, 32 aa, Artificial Sequence
  Description of Artificial Sequence: Synthetic polypeptide
DEEEIRTTNPVATEQYGSVSPTNLQVGMDQDP

SEQ ID NO: 28865 - protein, 32 aa, Artificial Sequence
  Description of Artificial Sequence: Synthetic polypeptide
DEEEIRTTNPVATEQYGSVSITNLQTLTNVGI

SEQ ID NO: 28866 - protein, 32 aa, Artificial Sequence
  Description of Artificial Sequence: Synthetic polypeptide
DEAEIRTTNPVATEQYGSVSTDNHQGNGNERK

SEQ ID NO: 28867 - protein, 30 aa, Artificial Sequence
  Description of Artificial Sequence: Synthetic polypeptide
DEEEIRTTNPVATEQYGSVSTDDDQLGEML

SEQ ID NO: 28868 - protein, 31 aa, Artificial Sequence
  Description of Artificial Sequence: Synthetic polypeptide
DEEEIRTTNPVATEQYGSVSPTNLQTQDVIL

SEQ ID NO: 28869 - protein, 29 aa, Artificial Sequence
  Description of Artificial Sequence: Synthetic peptide
DEEEIRTTNPVATEQYGSVSANIQTTISE

SEQ ID NO: 28870 - protein, 32 aa, Artificial Sequence
  Description of Artificial Sequence: Synthetic polypeptide
DEEEIRTTNPVATEQYGSVSTENLQGGGDEQE

SEQ ID NO: 28871 - protein, 32 aa, Artificial Sequence
  Description of Artificial Sequence: Synthetic polypeptide
DEEEIRTTNPVATEQYGSVSPTNLQTIEENAM

SEQ ID NO: 28872 - protein, 32 aa, Artificial Sequence
  Description of Artificial Sequence: Synthetic polypeptide
DEDEIRTTNPVATEQYGSVSTTNAGQGQDGNR

SEQ ID NO: 28873 - protein, 32 aa, Artificial Sequence
  Description of Artificial Sequence: Synthetic polypeptide
DEEEIRTTNPVATEQYGSVSSDTSNGQGGNNS

SEQ ID NO: 28874 - protein, 32 aa, Artificial Sequence
  Description of Artificial Sequence: Synthetic polypeptide
DEEEIRTTNPVATEQYGSVSTENLQNGGEEGE

SEQ ID NO: 28875 - protein, 33 aa, Artificial Sequence
  Description of Artificial Sequence: Synthetic polypeptide
DEEEIRTTNPVATEQYGSVSTDALQNQGGENIR

SEQ ID NO: 28876 - protein, 33 aa, Artificial Sequence
  Description of Artificial Sequence: Synthetic polypeptide
DEEEIRTTNPVATEQYGSVSTENLQNQIGGNEL

SEQ ID NO: 28877 - protein, 31 aa, Artificial Sequence
  Description of Artificial Sequence: Synthetic polypeptide
DEEEIRTTNPVATEQYGSVSVTTLQQVNNDQ

SEQ ID NO: 28878 - protein, 31 aa, Artificial Sequence
  Description of Artificial Sequence: Synthetic polypeptide
DEDEIRTTNPVATEQYGSVSTTNGGDGNNRQ

SEQ ID NO: 28879 - protein, 32 aa, Artificial Sequence
  Description of Artificial Sequence: Synthetic polypeptide
DEEEIRTTNPVATEQYGSVSPTNLVRDLNVGE

SEQ ID NO: 28880 - protein, 30 aa, Artificial Sequence
  Description of Artificial Sequence: Synthetic polypeptide
DEEEIRTTNPVATEQYGSVSTDDDQYNGEQ

SEQ ID NO: 28881 - protein, 32 aa, Artificial Sequence
  Description of Artificial Sequence: Synthetic polypeptide
DEEEIRTTNPVATEQYGSVSPTNNGQNNENER

SEQ ID NO: 28882 - protein, 32 aa, Artificial Sequence
  Description of Artificial Sequence: Synthetic polypeptide
DEAEISTTNPVATEQYGCVSTENLQRFGSNRQ

SEQ ID NO: 28883 - protein, 30 aa, Artificial Sequence
  Description of Artificial Sequence: Synthetic polypeptide
DECEIATTNPVATECYGEVSTNLQHEGNER

SEQ ID NO: 28884 - protein, 32 aa, Artificial Sequence
  Description of Artificial Sequence: Synthetic polypeptide
DEEEIRTTNPVATEQYGSVSMNLDQNSGQDRM

SEQ ID NO: 28885 - protein, 31 aa, Artificial Sequence
  Description of Artificial Sequence: Synthetic polypeptide
DEDEIRTTNPVATTQYGSVSTTQNLQTGNND

SEQ ID NO: 28886 - protein, 33 aa, Artificial Sequence
  Description of Artificial Sequence: Synthetic polypeptide
DEEEIRTTNPVATEQYGSVSCTDNWSQRGGSNQ

SEQ ID NO: 28887 - protein, 32 aa, Artificial Sequence
  Description of Artificial Sequence: Synthetic polypeptide
DEEEIRTTNPVATEQYGSVSFVSTLQTGNNRQ

SEQ ID NO: 28888 - protein, 31 aa, Artificial Sequence
  Description of Artificial Sequence: Synthetic polypeptide
DEEAIRTTNPVATEQYRWSVSINLQRGGNNE

SEQ ID NO: 28889 - protein, 32 aa, Artificial Sequence
  Description of Artificial Sequence: Synthetic polypeptide
DEEEIRTTNPVATEQYGSVSVTPNLGQVRSEQ

SEQ ID NO: 28890 - protein, 31 aa, Artificial Sequence
  Description of Artificial Sequence: Synthetic polypeptide
DEEEIRTTNPVATEQYGSVSTWNHDEGELRD

SEQ ID NO: 28891 - protein, 31 aa, Artificial Sequence
  Description of Artificial Sequence: Synthetic polypeptide
DEEEIRTTNPVATEQYGSVSVTPNPGDRSLR

SEQ ID NO: 28892 - protein, 31 aa, Artificial Sequence
  Description of Artificial Sequence: Synthetic polypeptide
DEEEIRTTNPVATEQYGSVSNNGLGEEGGRE

SEQ ID NO: 28893 - protein, 32 aa, Artificial Sequence
  Description of Artificial Sequence: Synthetic polypeptide
DEEEIRTTNPVATEQYGSVSTDDILQRDTEDR

SEQ ID NO: 28894 - protein, 30 aa, Artificial Sequence
  Description of Artificial Sequence: Synthetic polypeptide
DEEEIRTTNPVATEQYGSVSTDDHDGDNDE

SEQ ID NO: 28895 - protein, 32 aa, Artificial Sequence
  Description of Artificial Sequence: Synthetic polypeptide
DEEAIRTTNPVATEQYGVVVSTNALQRTGGNM

SEQ ID NO: 28896 - protein, 32 aa, Artificial Sequence
  Description of Artificial Sequence: Synthetic polypeptide
DEEEIRTTNPVATEQYGSVSTWNDQRQGAVLM

SEQ ID NO: 28897 - protein, 32 aa, Artificial Sequence
  Description of Artificial Sequence: Synthetic polypeptide
DEEEIRTTNPVATEQYGSVSNNGLIGRGLNLI

SEQ ID NO: 28898 - protein, 31 aa, Artificial Sequence
  Description of Artificial Sequence: Synthetic polypeptide
DEEEIRTTNPVATEQYGSVSNNGLQDGEDQD

SEQ ID NO: 28899 - protein, 32 aa, Artificial Sequence
  Description of Artificial Sequence: Synthetic polypeptide
DEDEIRTTNPVATEQYGSVSTTNGNQEQGNRG

SEQ ID NO: 28900 - protein, 32 aa, Artificial Sequence
  Description of Artificial Sequence: Synthetic polypeptide
DEDEIRTTNPVATEQYGSVSTTNGNQEMGNER

SEQ ID NO: 28901 - protein, 32 aa, Artificial Sequence
  Description of Artificial Sequence: Synthetic polypeptide
DEAEIRTTNPVATEQYGSVSTDDNLSRGEDRN

SEQ ID NO: 28902 - protein, 32 aa, Artificial Sequence
  Description of Artificial Sequence: Synthetic polypeptide
DEEEIRTTNPVATEQYGSVSVTSLAQDRSNMM

SEQ ID NO: 28903 - protein, 32 aa, Artificial Sequence
  Description of Artificial Sequence: Synthetic polypeptide
DEEEIRTTNPVATEQYGSVSPTNMLQRPLEGE

SEQ ID NO: 28904 - protein, 31 aa, Artificial Sequence
  Description of Artificial Sequence: Synthetic polypeptide
DEAEIRTTNPVATEQYGSVSTDLHQRSTENQ

SEQ ID NO: 28905 - protein, 30 aa, Artificial Sequence
  Description of Artificial Sequence: Synthetic polypeptide
DEEEIRTTNPVATEQYGSVSEVGQASVGER

SEQ ID NO: 28906 - protein, 32 aa, Artificial Sequence
  Description of Artificial Sequence: Synthetic polypeptide
DEEEIRTTNPVATEQYGSVSTENLQASGSEQS

SEQ ID NO: 28907 - protein, 30 aa, Artificial Sequence
  Description of Artificial Sequence: Synthetic polypeptide
DEEEIRTTNPVATEQYGSVSMNLDENGDDM

SEQ ID NO: 28908 - protein, 31 aa, Artificial Sequence
  Description of Artificial Sequence: Synthetic polypeptide
DEAEIRTTNPVATEQYGSVSTDLNNGNEIRV

SEQ ID NO: 28909 - protein, 30 aa, Artificial Sequence
  Description of Artificial Sequence: Synthetic polypeptide
DEAEIRTTNPVATEQYGSVSTDLQRTEEGS

SEQ ID NO: 28910 - protein, 32 aa, Artificial Sequence
  Description of Artificial Sequence: Synthetic polypeptide
DEDEIRTTNPVATEQYGSVSTTLQGDSGNNRQ

SEQ ID NO: 28911 - protein, 32 aa, Artificial Sequence
  Description of Artificial Sequence: Synthetic polypeptide
DEEEIRTTNPVATEQYGSVSPTNNHQERDMSR

SEQ ID NO: 28912 - protein, 30 aa, Artificial Sequence
  Description of Artificial Sequence: Synthetic polypeptide
DEECIRCTNPVATEQYGSVCSWNPQRGGNL

SEQ ID NO: 28913 - protein, 31 aa, Artificial Sequence
  Description of Artificial Sequence: Synthetic polypeptide
DEAEIRTTNPVATEQYGSVSTELQNFGSNAS

SEQ ID NO: 28914 - protein, 33 aa, Artificial Sequence
  Description of Artificial Sequence: Synthetic polypeptide
DEEEIRTTNPVATEQYGSVSTENPYQRSGNEEG

SEQ ID NO: 28915 - protein, 30 aa, Artificial Sequence
  Description of Artificial Sequence: Synthetic polypeptide
DEEEIRTTNPVATEQYGSVSWASEQRGMDE

SEQ ID NO: 28916 - protein, 32 aa, Artificial Sequence
  Description of Artificial Sequence: Synthetic polypeptide
DEEEIRTTNPVATEQYGSVSPTNLQQTGEEIE

SEQ ID NO: 28917 - protein, 31 aa, Artificial Sequence
  Description of Artificial Sequence: Synthetic polypeptide
DEDEIRTTNPVATEQYGSVSTTGDDDQRGNA

SEQ ID NO: 28918 - protein, 32 aa, Artificial Sequence
  Description of Artificial Sequence: Synthetic polypeptide
DEEEIRTTNPVATEQYGSVSCTFLSGSGGNNR

SEQ ID NO: 28919 - protein, 32 aa, Artificial Sequence
  Description of Artificial Sequence: Synthetic polypeptide
DEEEIRTTNPVATEQYGSVSTENVQGTGGGNE

SEQ ID NO: 28920 - protein, 32 aa, Artificial Sequence
  Description of Artificial Sequence: Synthetic polypeptide
DEEEIRTTNPVATEQYGSVSSENLQLAGENES

SEQ ID NO: 28921 - protein, 31 aa, Artificial Sequence
  Description of Artificial Sequence: Synthetic polypeptide
DEEEIRTTNPVATEQYGSVSETVGGQRVGVQ

SEQ ID NO: 28922 - protein, 32 aa, Artificial Sequence
  Description of Artificial Sequence: Synthetic polypeptide
DEEEIRTTNPVATEQYGSVSTEPAGPNRGNPR

SEQ ID NO: 28923 - protein, 32 aa, Artificial Sequence
  Description of Artificial Sequence: Synthetic polypeptide
DEEEIRTTNPVATEQYGSVSPTNLQQDMETRD

SEQ ID NO: 28924 - protein, 33 aa, Artificial Sequence
  Description of Artificial Sequence: Synthetic polypeptide
DEEEIRTTNPVATEQYGSVSPTNLQQDINLEVR

SEQ ID NO: 28925 - protein, 30 aa, Artificial Sequence
  Description of Artificial Sequence: Synthetic polypeptide
DEDEIRTTNPVATDQYGSVSNNTQLQTGND

SEQ ID NO: 28926 - protein, 32 aa, Artificial Sequence
  Description of Artificial Sequence: Synthetic polypeptide
DEEEIRTTNPVATEQYGSVSTEPHQERGSNQA

SEQ ID NO: 28927 - protein, 32 aa, Artificial Sequence
  Description of Artificial Sequence: Synthetic polypeptide
DEAEIRTTNPVATEQYGSVSTGPLQHAGGNDR

SEQ ID NO: 28928 - protein, 31 aa, Artificial Sequence
  Description of Artificial Sequence: Synthetic polypeptide
DEEEIRTTNPVATEQYGSVSETVFLQTNENN

SEQ ID NO: 28929 - protein, 32 aa, Artificial Sequence
  Description of Artificial Sequence: Synthetic polypeptide
DEEEIRTTNPVATEQYGSVSPTNLQNSGVFVT

SEQ ID NO: 28930 - protein, 31 aa, Artificial Sequence
  Description of Artificial Sequence: Synthetic polypeptide
DEEEIRTTNPVATEQYGSVSTNSNQTMGEDE

SEQ ID NO: 28931 - protein, 31 aa, Artificial Sequence
  Description of Artificial Sequence: Synthetic polypeptide
DEEEIRTTNPVATEQYGSVSWEDLQYFGSER

SEQ ID NO: 28932 - protein, 31 aa, Artificial Sequence
  Description of Artificial Sequence: Synthetic polypeptide
DEEEIRTTNPVATEQYGSVSWEEHQRGSNQI

SEQ ID NO: 28933 - protein, 29 aa, Artificial Sequence
  Description of Artificial Sequence: Synthetic peptide
DEDEIRTTNPVATDQYGVVSTNLEAGNNP

SEQ ID NO: 28934 - protein, 30 aa, Artificial Sequence
  Description of Artificial Sequence: Synthetic polypeptide
DEEEIRTTNPVATEQYGSVSWELQFFGEDG

SEQ ID NO: 28935 - protein, 31 aa, Artificial Sequence
  Description of Artificial Sequence: Synthetic polypeptide
DECEIATTNPVATEQYGEVSTNLQRDGNNGS

SEQ ID NO: 28936 - protein, 29 aa, Artificial Sequence
  Description of Artificial Sequence: Synthetic peptide
DEDEIRTTNPVATDQYGVVSTNLEDNGNP

SEQ ID NO: 28937 - protein, 31 aa, Artificial Sequence
  Description of Artificial Sequence: Synthetic polypeptide
DEEEIRTTNPVATEQYGSVSTEPLNDHTGNA

SEQ ID NO: 28938 - protein, 31 aa, Artificial Sequence
  Description of Artificial Sequence: Synthetic polypeptide
DEEEIRTTNPVATEQYGSVSPTNLQMTISEL

SEQ ID NO: 28939 - protein, 29 aa, Artificial Sequence
  Description of Artificial Sequence: Synthetic peptide
DEEEIRTTNPVATEQYGSVSANDDRDEES

SEQ ID NO: 28940 - protein, 33 aa, Artificial Sequence
  Description of Artificial Sequence: Synthetic polypeptide
DEEEIRTTNPVATEQYGSVSPTNLQMRIGVLQE

SEQ ID NO: 28941 - protein, 31 aa, Artificial Sequence
  Description of Artificial Sequence: Synthetic polypeptide
DEAEIRTTNPVATEQYGSVSTLLGMRGSNEN

SEQ ID NO: 28942 - protein, 28 aa, Artificial Sequence
  Description of Artificial Sequence: Synthetic peptide
DEEEIRTTNPVATEQYGSVSANDNGEEE

SEQ ID NO: 28943 - protein, 32 aa, Artificial Sequence
  Description of Artificial Sequence: Synthetic polypeptide
DEEEIRTTNPVATEQYGSVSVYNLNYNGSNVR

SEQ ID NO: 28944 - protein, 32 aa, Artificial Sequence
  Description of Artificial Sequence: Synthetic polypeptide
DEEEIRTTNPVATEQYGSVSTENPLQGNSNQL

SEQ ID NO: 28945 - protein, 32 aa, Artificial Sequence
  Description of Artificial Sequence: Synthetic polypeptide
DEEEIRTTNPVATEQYGSVSPTNLQQVSQVRD

SEQ ID NO: 28946 - protein, 30 aa, Artificial Sequence
  Description of Artificial Sequence: Synthetic polypeptide
DEEEIRTTNPVATEQYGSVSLNDDEGNEIE

SEQ ID NO: 28947 - protein, 33 aa, Artificial Sequence
  Description of Artificial Sequence: Synthetic polypeptide
DEEEIRTTNPVATEQYGSVSTENLQQTGIVDRD

SEQ ID NO: 28948 - protein, 31 aa, Artificial Sequence
  Description of Artificial Sequence: Synthetic polypeptide
DEAEIRTTNPVATEQYGSVSTENAQQGNNGA

SEQ ID NO: 28949 - protein, 32 aa, Artificial Sequence
  Description of Artificial Sequence: Synthetic polypeptide
DEEEIRTTNPVATEQYGSVSTNQSQETGGNNS

SEQ ID NO: 28950 - protein, 31 aa, Artificial Sequence
  Description of Artificial Sequence: Synthetic polypeptide
DEEEIRTTNPVATEQYGSVSVTVNDDRLGDS

SEQ ID NO: 28951 - protein, 32 aa, Artificial Sequence
  Description of Artificial Sequence: Synthetic polypeptide
DEEEIRTTNPVATEQYGSVSVTVNGTQTGVNP

SEQ ID NO: 28952 - protein, 31 aa, Artificial Sequence
  Description of Artificial Sequence: Synthetic polypeptide
DEEEIRTTNPVATEQYGSVSANGERGEQSRQ

SEQ ID NO: 28953 - protein, 33 aa, Artificial Sequence
  Description of Artificial Sequence: Synthetic polypeptide
DEEEIRTTNPVATEQYGSVSSDTSNTLQPGNGG

SEQ ID NO: 28954 - protein, 31 aa, Artificial Sequence
  Description of Artificial Sequence: Synthetic polypeptide
DEEEIRTTNPVATEQYGSVSMNDLQGGEEDD

SEQ ID NO: 28955 - protein, 30 aa, Artificial Sequence
  Description of Artificial Sequence: Synthetic polypeptide
DEEEIRTTNPVATEQYGSVSMNDDQNGDKM

SEQ ID NO: 28956 - protein, 32 aa, Artificial Sequence
  Description of Artificial Sequence: Synthetic polypeptide
DEEEIRTTNPVATEQYGSVSVTWLNDRGEQRE

SEQ ID NO: 28957 - protein, 31 aa, Artificial Sequence
  Description of Artificial Sequence: Synthetic polypeptide
DEEEIRTTNPVATEQYGSVSETVGGQTGGNF

SEQ ID NO: 28958 - protein, 31 aa, Artificial Sequence
  Description of Artificial Sequence: Synthetic polypeptide
DEAEIRTTNPVATEQYGSVSTENLGQGDNGA

SEQ ID NO: 28959 - protein, 31 aa, Artificial Sequence
  Description of Artificial Sequence: Synthetic polypeptide
DEEEIRTTNPVATEQYGSVSITNLQSLTEGQ

SEQ ID NO: 28960 - protein, 33 aa, Artificial Sequence
  Description of Artificial Sequence: Synthetic polypeptide
DEEEIRTTNPVATEQYGSVSVTYSLQIRGNDSQ

SEQ ID NO: 28961 - protein, 32 aa, Artificial Sequence
  Description of Artificial Sequence: Synthetic polypeptide
DEEEIRTTNPVATEQYGSVSVTYVLQRGIEDG

SEQ ID NO: 28962 - protein, 31 aa, Artificial Sequence
  Description of Artificial Sequence: Synthetic polypeptide
DEEEIRTTNPVATEQYGSVSVVDNDHQRVND

SEQ ID NO: 28963 - protein, 30 aa, Artificial Sequence
  Description of Artificial Sequence: Synthetic polypeptide
DEAEIRTTNPVATEQYGSVSTGGDPRDNER

SEQ ID NO: 28964 - protein, 30 aa, Artificial Sequence
  Description of Artificial Sequence: Synthetic polypeptide
DEDEIRTTNPVATDQYGSVNTQNLQTGNDG

SEQ ID NO: 28965 - protein, 29 aa, Artificial Sequence
  Description of Artificial Sequence: Synthetic peptide
DEEEIRTTNPVATEQYGSVSANDQMDEIE

SEQ ID NO: 28966 - protein, 29 aa, Artificial Sequence
  Description of Artificial Sequence: Synthetic peptide
DEECTRTTNPIAYEQYGEVSTNLQGFGNR

SEQ ID NO: 28967 - protein, 34 aa, Artificial Sequence
  Description of Artificial Sequence: Synthetic polypeptide
DEEEIRTTNPVATEQYGSVSTNSHSQERTVGINR

SEQ ID NO: 28968 - protein, 29 aa, Artificial Sequence
  Description of Artificial Sequence: Synthetic peptide
DEDEIRTTNPVAYEAWGSVSTNLQGGNEN

SEQ ID NO: 28969 - protein, 29 aa, Artificial Sequence
  Description of Artificial Sequence: Synthetic peptide
DEECTSTTNPCAVEQYGVVSTNLQRGDNR

SEQ ID NO: 28970 - protein, 30 aa, Artificial Sequence
  Description of Artificial Sequence: Synthetic polypeptide
DEEEIRTTNPVATEQYGSVSANDQARDEQE

SEQ ID NO: 28971 - protein, 32 aa, Artificial Sequence
  Description of Artificial Sequence: Synthetic polypeptide
DEEEIRTTNPVATEQYGSVSTNSLFRGEEDVD

SEQ ID NO: 28972 - protein, 30 aa, Artificial Sequence
  Description of Artificial Sequence: Synthetic polypeptide
DEEEIRTTNPVATEQYGSVSVWPNQSSDNR

SEQ ID NO: 28973 - protein, 32 aa, Artificial Sequence
  Description of Artificial Sequence: Synthetic polypeptide
DEAEIRTTNPVATEQYGSVSTGNLGNDGENRS

SEQ ID NO: 28974 - protein, 31 aa, Artificial Sequence
  Description of Artificial Sequence: Synthetic polypeptide
DEEEIRTTNPVATEQYGSVSCTELQRQEDFI

SEQ ID NO: 28975 - protein, 28 aa, Artificial Sequence
  Description of Artificial Sequence: Synthetic peptide
DEDEIRTTNPVAVEQYGEISTNLEQNNR

SEQ ID NO: 28976 - protein, 28 aa, Artificial Sequence
  Description of Artificial Sequence: Synthetic peptide
DEAEISTTNPVATEQYGCVSWNLMYGNQ

SEQ ID NO: 28977 - protein, 30 aa, Artificial Sequence
  Description of Artificial Sequence: Synthetic polypeptide
DEEEIRTTNPVATEQYGSVSNNEQPGEQDD

SEQ ID NO: 28978 - protein, 30 aa, Artificial Sequence
  Description of Artificial Sequence: Synthetic polypeptide
DEEEIRTTNPVATEQYGSVSEVLQDQVNES

SEQ ID NO: 28979 - protein, 29 aa, Artificial Sequence
  Description of Artificial Sequence: Synthetic peptide
DEEAIRTTNPVAYEQYSEEVTTNLQDGNR

SEQ ID NO: 28980 - protein, 33 aa, Artificial Sequence
  Description of Artificial Sequence: Synthetic polypeptide
DEEEIRTTNPVATEQYGSVSNMNLQQRGDDNEL

SEQ ID NO: 28981 - protein, 32 aa, Artificial Sequence
  Description of Artificial Sequence: Synthetic polypeptide
DEEEIRTTNPVATEQYGSVSVTNLQMVNENDQ

SEQ ID NO: 28982 - protein, 32 aa, Artificial Sequence
  Description of Artificial Sequence: Synthetic polypeptide
DEEEIRTTNPVATEQYGSVSPTNSQVGEENTM

SEQ ID NO: 28983 - protein, 28 aa, Artificial Sequence
  Description of Artificial Sequence: Synthetic peptide
DEECISTVNPVATEAYGSVSDNLENGNR

SEQ ID NO: 28984 - protein, 31 aa, Artificial Sequence
  Description of Artificial Sequence: Synthetic polypeptide
DEEEIRTTNPVATEQYGSVSCTANGGERGKF

SEQ ID NO: 28985 - protein, 33 aa, Artificial Sequence
  Description of Artificial Sequence: Synthetic polypeptide
DEEEIRTTNPVATEQYGSVSCTANLQANGENLP

SEQ ID NO: 28986 - protein, 28 aa, Artificial Sequence
  Description of Artificial Sequence: Synthetic peptide
DEECSRTTNPTAYEQYGTVSTNLQSGNN

SEQ ID NO: 28987 - protein, 30 aa, Artificial Sequence
  Description of Artificial Sequence: Synthetic polypeptide
DEECIRTTNPVAEEQYGEVSTWNDVQRGNN

SEQ ID NO: 28988 - protein, 31 aa, Artificial Sequence
  Description of Artificial Sequence: Synthetic polypeptide
DEEEIRTTNPVATEQYGSVSVTNLQPAVEDD

SEQ ID NO: 28989 - protein, 31 aa, Artificial Sequence
  Description of Artificial Sequence: Synthetic polypeptide
DEDEIATTNPVAYEQYGSVATNLQRGDNMRH

SEQ ID NO: 28990 - protein, 29 aa, Artificial Sequence
  Description of Artificial Sequence: Synthetic peptide
DEDEIATTNPVAYEQYGSVATNLQRDDNV

SEQ ID NO: 28991 - protein, 30 aa, Artificial Sequence
  Description of Artificial Sequence: Synthetic polypeptide
DEEEIRTTNPVATEQYGSVSITNMQMQDEE

SEQ ID NO: 28992 - protein, 31 aa, Artificial Sequence
  Description of Artificial Sequence: Synthetic polypeptide
DEEEIRTTNPVATEQYGSVSTNNQSVVENDS

SEQ ID NO: 28993 - protein, 31 aa, Artificial Sequence
  Description of Artificial Sequence: Synthetic polypeptide
DEEEIRTTNPVATEQYGSVSTNNQYFGSQQS

SEQ ID NO: 28994 - protein, 31 aa, Artificial Sequence
  Description of Artificial Sequence: Synthetic polypeptide
DEEEIRTTNPVATEQYGSVSCTDDEQREDRD

SEQ ID NO: 28995 - protein, 28 aa, Artificial Sequence
  Description of Artificial Sequence: Synthetic peptide
DEECIRCTNPVATEQYGSVSDNHEGGNL

SEQ ID NO: 28996 - protein, 32 aa, Artificial Sequence
  Description of Artificial Sequence: Synthetic polypeptide
DEEEIRTTNPVATEQYGSVSTENDGQGEGGNE

SEQ ID NO: 28997 - protein, 32 aa, Artificial Sequence
  Description of Artificial Sequence: Synthetic polypeptide
DEEEIRTTNPVATEQYGSVSPTNQTQERDMIR

SEQ ID NO: 28998 - protein, 32 aa, Artificial Sequence
  Description of Artificial Sequence: Synthetic polypeptide
DEEEIRTTNPVATEQYGSVSTYELQRFSENNQ

SEQ ID NO: 28999 - protein, 30 aa, Artificial Sequence
  Description of Artificial Sequence: Synthetic polypeptide
DEECIRTTNPVAEEQYGQVSTINVQRGNEG

SEQ ID NO: 29000 - protein, 30 aa, Artificial Sequence
  Description of Artificial Sequence: Synthetic polypeptide
DEDEIRTTNPVATEQYGEISTNLSQRGDTS

SEQ ID NO: 29001 - protein, 29 aa, Artificial Sequence
  Description of Artificial Sequence: Synthetic peptide
DEECIRTTNPVAEEQYGQVSTMDVQRGNN

SEQ ID NO: 29002 - protein, 32 aa, Artificial Sequence
  Description of Artificial Sequence: Synthetic polypeptide
DEEEIRTTNPVATEQYGSVSPTNQPRPIVNRI

SEQ ID NO: 29003 - protein, 31 aa, Artificial Sequence
  Description of Artificial Sequence: Synthetic polypeptide
DEEEIRTTNPVATEQYGSVSFDNSLDREERD

SEQ ID NO: 29004 - protein, 31 aa, Artificial Sequence
  Description of Artificial Sequence: Synthetic polypeptide
DEEEIRTTNPVATEQYGSVSPTNQLQLALLQ

SEQ ID NO: 29005 - protein, 32 aa, Artificial Sequence
  Description of Artificial Sequence: Synthetic polypeptide
DEEEIRTTNPVATEQYGSVSPTNPLTQEQVND

SEQ ID NO: 29006 - protein, 32 aa, Artificial Sequence
  Description of Artificial Sequence: Synthetic polypeptide
DEEEIRTTNPVATEQYGSVSPTNPLQTGEGFM

SEQ ID NO: 29007 - protein, 30 aa, Artificial Sequence
  Description of Artificial Sequence: Synthetic polypeptide
DEDEIATTNPVAYEQYGSVATNLQQRGNEH

SEQ ID NO: 29008 - protein, 31 aa, Artificial Sequence
  Description of Artificial Sequence: Synthetic polypeptide
DEEEIRTTNPVATEQYGSVSTELQYSGSELS

SEQ ID NO: 29009 - protein, 29 aa, Artificial Sequence
  Description of Artificial Sequence: Synthetic peptide
DEEEIRTTNPVATEQYGSVSTYGQDTEQS

SEQ ID NO: 29010 - protein, 31 aa, Artificial Sequence
  Description of Artificial Sequence: Synthetic polypeptide
DEEEIRTTNPVATEQYGSVSVTNLQHQVEMI

SEQ ID NO: 29011 - protein, 32 aa, Artificial Sequence
  Description of Artificial Sequence: Synthetic polypeptide
DEEEIRTTNPVATEQYGSVSTYLQNFGSNPAL

SEQ ID NO: 29012 - protein, 31 aa, Artificial Sequence
  Description of Artificial Sequence: Synthetic polypeptide
DEEEIRTTNPVATEQYGSVSTYLQMPGEQQD

SEQ ID NO: 29013 - protein, 33 aa, Artificial Sequence
  Description of Artificial Sequence: Synthetic polypeptide
DEEEIRTTNPVATEQYGSVSQTNSLIGRGLNLD

SEQ ID NO: 29014 - protein, 32 aa, Artificial Sequence
  Description of Artificial Sequence: Synthetic polypeptide
DEEEIRTTNPVATEQYGSVSTNNQGSGDNIEV

SEQ ID NO: 29015 - protein, 31 aa, Artificial Sequence
  Description of Artificial Sequence: Synthetic polypeptide
DEEEIRTTNPVATEQYGSVSTYLQFFGSDQP

SEQ ID NO: 29016 - protein, 31 aa, Artificial Sequence
  Description of Artificial Sequence: Synthetic polypeptide
DEEEIRTTNPVATEQYGSVSPTNVQPFVNND

SEQ ID NO: 29017 - protein, 31 aa, Artificial Sequence
  Description of Artificial Sequence: Synthetic polypeptide
DEEEIRTTNPVATEQYGSVSTELQFSQSNDY

SEQ ID NO: 29018 - protein, 30 aa, Artificial Sequence
  Description of Artificial Sequence: Synthetic polypeptide
DEECIRCTNPVATEQYGSVSWGNHQRGNQS

SEQ ID NO: 29019 - protein, 29 aa, Artificial Sequence
  Description of Artificial Sequence: Synthetic peptide
DEECIRCTNPVATEQYGSVSWEHQRGGNL

SEQ ID NO: 29020 - protein, 33 aa, Artificial Sequence
  Description of Artificial Sequence: Synthetic polypeptide
DEEEIRTTNPVATEQYGSVSNMNLGQDRGDNNE

SEQ ID NO: 29021 - protein, 29 aa, Artificial Sequence
  Description of Artificial Sequence: Synthetic peptide
DEDEIRTTNPVATQQYGCVSTNLEHGGNP

SEQ ID NO: 29022 - protein, 32 aa, Artificial Sequence
  Description of Artificial Sequence: Synthetic polypeptide
DEDEIRTTNPCATEQYGSVSTVNLQNAGENRE

SEQ ID NO: 29023 - protein, 31 aa, Artificial Sequence
  Description of Artificial Sequence: Synthetic polypeptide
DEEEIRTTNPVATEQYGSVSTYLNQNGSEQP

SEQ ID NO: 29024 - protein, 31 aa, Artificial Sequence
  Description of Artificial Sequence: Synthetic polypeptide
DEEEIRTTNPVATEQYGSVSPTNVQDGLEIV

SEQ ID NO: 29025 - protein, 30 aa, Artificial Sequence
  Description of Artificial Sequence: Synthetic polypeptide
DEEEIRTTNPVATEQYGSVSTDGQDFGSQG

SEQ ID NO: 29026 - protein, 33 aa, Artificial Sequence
  Description of Artificial Sequence: Synthetic polypeptide
DEEEIRTTNPVATEQYGSVSVTNLNDGRDGEGR

SEQ ID NO: 29027 - protein, 32 aa, Artificial Sequence
  Description of Artificial Sequence: Synthetic polypeptide
DEEEIRTTNPVATEQYGSVSCQGNLSTRGGDR

SEQ ID NO: 29028 - protein, 33 aa, Artificial Sequence
  Description of Artificial Sequence: Synthetic polypeptide
DEEEIRTTNPVATEQYGSVSVTNLNDRMGNGIE

SEQ ID NO: 29029 - protein, 32 aa, Artificial Sequence
  Description of Artificial Sequence: Synthetic polypeptide
DEEEIRTTNPVATEQYGSVSCSANLSQRTVNI

SEQ ID NO: 29030 - protein, 31 aa, Artificial Sequence
  Description of Artificial Sequence: Synthetic polypeptide
DEEEIRTTNPVATEQYGSVSPTNVDYENTSR

SEQ ID NO: 29031 - protein, 30 aa, Artificial Sequence
  Description of Artificial Sequence: Synthetic polypeptide
DEEEIRTTNPVATEQYGSVSTDEVQEQNDQ

SEQ ID NO: 29032 - protein, 32 aa, Artificial Sequence
  Description of Artificial Sequence: Synthetic polypeptide
DEEEIRTTNPVATEQYGSVSNMNLGQSNGNGQ

SEQ ID NO: 29033 - protein, 32 aa, Artificial Sequence
  Description of Artificial Sequence: Synthetic polypeptide
DEEEIRTTNPVATEQYGSVSCSFNLSQRVTNI

SEQ ID NO: 29034 - protein, 32 aa, Artificial Sequence
  Description of Artificial Sequence: Synthetic polypeptide
DEEEIRTTNPVATEQYGSVSANLQNRQGQAIL

SEQ ID NO: 29035 - protein, 29 aa, Artificial Sequence
  Description of Artificial Sequence: Synthetic peptide
DEEAIRTTNPVCTEGYGSVSMPDLQRGNE

SEQ ID NO: 29036 - protein, 30 aa, Artificial Sequence
  Description of Artificial Sequence: Synthetic polypeptide
DEDEIRTTNPVATEQYGSVSTVNLFGNNNS

SEQ ID NO: 29037 - protein, 31 aa, Artificial Sequence
  Description of Artificial Sequence: Synthetic polypeptide
DEAEIRTTNPVATEQYGSVSPTQLQRGEDMG

SEQ ID NO: 29038 - protein, 32 aa, Artificial Sequence
  Description of Artificial Sequence: Synthetic polypeptide
DEEEIRTTNPVATEQYGSVSNMNLQQEGNNED

SEQ ID NO: 29039 - protein, 31 aa, Artificial Sequence
  Description of Artificial Sequence: Synthetic polypeptide
DEAEIRTTNPVATEQYGSTISTNHSQREGSR

SEQ ID NO: 29040 - protein, 32 aa, Artificial Sequence
  Description of Artificial Sequence: Synthetic polypeptide
DEEEIRTTNPVATEQYGSVSQTPWGQRIGVER

SEQ ID NO: 29041 - protein, 31 aa, Artificial Sequence
  Description of Artificial Sequence: Synthetic polypeptide
DEAEIRTTNPVATEQYGSVSQTQLQRGEDIQ

SEQ ID NO: 29042 - protein, 31 aa, Artificial Sequence
  Description of Artificial Sequence: Synthetic polypeptide
DEEEIRTTNPVATEQYGSVSTNNTTREFNFD

SEQ ID NO: 29043 - protein, 32 aa, Artificial Sequence
  Description of Artificial Sequence: Synthetic polypeptide
DEEEIRTTNPVATEQYGSVSTENDMQNREQDR

SEQ ID NO: 29044 - protein, 30 aa, Artificial Sequence
  Description of Artificial Sequence: Synthetic polypeptide
DEDEIATTNPVAYEQYGSVATNLQDNGNVR

SEQ ID NO: 29045 - protein, 31 aa, Artificial Sequence
  Description of Artificial Sequence: Synthetic polypeptide
DEEEIRTTNPVATEQYGSVSQYNLQRELSPQ

SEQ ID NO: 29046 - protein, 31 aa, Artificial Sequence
  Description of Artificial Sequence: Synthetic polypeptide
DEEEIRTTNPVATEQYGSVSTDDPQRVNEQE

SEQ ID NO: 29047 - protein, 32 aa, Artificial Sequence
  Description of Artificial Sequence: Synthetic polypeptide
DEDEIRTTNPVATEQYGSVSTTNPGQMDGTNR

SEQ ID NO: 29048 - protein, 31 aa, Artificial Sequence
  Description of Artificial Sequence: Synthetic polypeptide
DEEEIRTTNPVATEQYGSVSTNPMTDGSNQI

SEQ ID NO: 29049 - protein, 32 aa, Artificial Sequence
  Description of Artificial Sequence: Synthetic polypeptide
DEEEIRTTNPVATEQYGSVSTWNLQHRTVLEL

SEQ ID NO: 29050 - protein, 31 aa, Artificial Sequence
  Description of Artificial Sequence: Synthetic polypeptide
DEEEIRTTNPVATEQYGSVSMNLQARSDDGE

SEQ ID NO: 29051 - protein, 30 aa, Artificial Sequence
  Description of Artificial Sequence: Synthetic polypeptide
DEEAIRTTNPVATEQYYASVSINLQRGDDQ

SEQ ID NO: 29052 - protein, 29 aa, Artificial Sequence
  Description of Artificial Sequence: Synthetic peptide
DEECIRTTNPVAYEQYGCVSTGNDQRINQ

SEQ ID NO: 29053 - protein, 30 aa, Artificial Sequence
  Description of Artificial Sequence: Synthetic polypeptide
DEEEIRTTNPVATEQYGSVSMNLEEGETDT

SEQ ID NO: 29054 - protein, 32 aa, Artificial Sequence
  Description of Artificial Sequence: Synthetic polypeptide
DEEEIRTTNPVATEQYGSVSITNLQTQMVNID

SEQ ID NO: 29055 - protein, 32 aa, Artificial Sequence
  Description of Artificial Sequence: Synthetic polypeptide
DEEEIRTTNPVATEQYGSVSPTNNPQIGENLE

SEQ ID NO: 29056 - protein, 31 aa, Artificial Sequence
  Description of Artificial Sequence: Synthetic polypeptide
DEDEIRTTNPVATTQYGSVSTTNQLQTGNND

SEQ ID NO: 29057 - protein, 32 aa, Artificial Sequence
  Description of Artificial Sequence: Synthetic polypeptide
DEEEIRTTNPVATEQYGSVSPTNNLQRVMVGI

SEQ ID NO: 29058 - protein, 32 aa, Artificial Sequence
  Description of Artificial Sequence: Synthetic polypeptide
DEEEIRTTNPVATEQYGSVSSDNLDQNTGENI

SEQ ID NO: 29059 - protein, 32 aa, Artificial Sequence
  Description of Artificial Sequence: Synthetic polypeptide
DEEEIRTTNPVATEQYGSVSTDDPQGTGNQRP

SEQ ID NO: 29060 - protein, 32 aa, Artificial Sequence
  Description of Artificial Sequence: Synthetic polypeptide
DEDEIRTTNPVATEQYGSVSTTNNLQGDGNDK

SEQ ID NO: 29061 - protein, 32 aa, Artificial Sequence
  Description of Artificial Sequence: Synthetic polypeptide
DEEEIRTTNPVATEQYGSVSVTNTLQVNQNEQ

SEQ ID NO: 29062 - protein, 34 aa, Artificial Sequence
  Description of Artificial Sequence: Synthetic polypeptide
DEEEIRTTNPVATEQYGSVSPTNNLQRDGDNSEE

SEQ ID NO: 29063 - protein, 33 aa, Artificial Sequence
  Description of Artificial Sequence: Synthetic polypeptide
DEEEIRTTNPVATEQYGSVSSDTDNELQYGGNP

SEQ ID NO: 29064 - protein, 32 aa, Artificial Sequence
  Description of Artificial Sequence: Synthetic polypeptide
DEEEIRTTNPVATEQYGSVSPTNNLQARPPEQ

SEQ ID NO: 29065 - protein, 29 aa, Artificial Sequence
  Description of Artificial Sequence: Synthetic peptide
DEEEIRTTNPVATEQYGSVSTDDNGGEVD

SEQ ID NO: 29066 - protein, 30 aa, Artificial Sequence
  Description of Artificial Sequence: Synthetic polypeptide
DEEEIRTTNPVATEQYGSVSTENHTSGSDQ

SEQ ID NO: 29067 - protein, 32 aa, Artificial Sequence
  Description of Artificial Sequence: Synthetic polypeptide
DEDEIRTTNPVATEQYGSVSTTNLQGGGNANK

SEQ ID NO: 29068 - protein, 32 aa, Artificial Sequence
  Description of Artificial Sequence: Synthetic polypeptide
DEDEIRTTNPVATEQYGSVSTTNLQGGENGDK

SEQ ID NO: 29069 - protein, 33 aa, Artificial Sequence
  Description of Artificial Sequence: Synthetic polypeptide
DEEEIRTTNPVATEQYGSVSPTNNLERGSELRD

SEQ ID NO: 29070 - protein, 31 aa, Artificial Sequence
  Description of Artificial Sequence: Synthetic polypeptide
DEEEIRTTNPVATEQYGSVSNNEQDEGNVEE

SEQ ID NO: 29071 - protein, 30 aa, Artificial Sequence
  Description of Artificial Sequence: Synthetic polypeptide
DEAEIRTTNPVATEQYGSVSSTNTQGQVNM

SEQ ID NO: 29072 - protein, 33 aa, Artificial Sequence
  Description of Artificial Sequence: Synthetic polypeptide
DEEEIRTTNPVATEQYGSVSPTNNHQTGEENRM

SEQ ID NO: 29073 - protein, 31 aa, Artificial Sequence
  Description of Artificial Sequence: Synthetic polypeptide
DEEEIRTTNPVATEQYGSVSQTVLQDNENEQ

SEQ ID NO: 29074 - protein, 32 aa, Artificial Sequence
  Description of Artificial Sequence: Synthetic polypeptide
DEEEIRTTNPVATEQYGSVSPTNLQLVMENVF

SEQ ID NO: 29075 - protein, 32 aa, Artificial Sequence
  Description of Artificial Sequence: Synthetic polypeptide
DEEEIRTTNPVATEQYGSVSPTNNQQGEIPRA

SEQ ID NO: 29076 - protein, 30 aa, Artificial Sequence
  Description of Artificial Sequence: Synthetic polypeptide
DEEEIRTTNPVATEQYGSVSMNLQINELEV

SEQ ID NO: 29077 - protein, 33 aa, Artificial Sequence
  Description of Artificial Sequence: Synthetic polypeptide
DEEEIRTTNPVATEQYGSVSTNNVLQESGNNPE

SEQ ID NO: 29078 - protein, 30 aa, Artificial Sequence
  Description of Artificial Sequence: Synthetic polypeptide
DEEEIRTTNPVATEQYGSVSCTDGTRADRD

SEQ ID NO: 29079 - protein, 29 aa, Artificial Sequence
  Description of Artificial Sequence: Synthetic peptide
DEECIRTTNPVAFEQYGQVSTHNVQGGNN

SEQ ID NO: 29080 - protein, 28 aa, Artificial Sequence
  Description of Artificial Sequence: Synthetic peptide
DECCIMTVNPVATEWYGSVSDNLERGNR

SEQ ID NO: 29081 - protein, 33 aa, Artificial Sequence
  Description of Artificial Sequence: Synthetic polypeptide
DEEEIRTTNPVATEQYGSVSNMNSLGQRGDNNE

SEQ ID NO: 29082 - protein, 32 aa, Artificial Sequence
  Description of Artificial Sequence: Synthetic polypeptide
DEEEIRTTNPVATEQYGSVSVTNLVIRGMSDQ

SEQ ID NO: 29083 - protein, 31 aa, Artificial Sequence
  Description of Artificial Sequence: Synthetic polypeptide
DEEEIRTTNPVATEQYGSVSVTNMERVVNDA

SEQ ID NO: 29084 - protein, 31 aa, Artificial Sequence
  Description of Artificial Sequence: Synthetic polypeptide
DEEEIRTTNPVATEQYGSVSTDDQMGGNELQ

SEQ ID NO: 29085 - protein, 31 aa, Artificial Sequence
  Description of Artificial Sequence: Synthetic polypeptide
DEEEIRTTNPVATEQYGSVSCTDLGQENDRD

SEQ ID NO: 29086 - protein, 30 aa, Artificial Sequence
  Description of Artificial Sequence: Synthetic polypeptide
DEEEIRTTNPVATEQYGSVSTWVDNQRTEV

SEQ ID NO: 29087 - protein, 30 aa, Artificial Sequence
  Description of Artificial Sequence: Synthetic polypeptide
DEECIRTTNPVAGEQYGQVSTMNVQRGNFN

SEQ ID NO: 29088 - protein, 32 aa, Artificial Sequence
  Description of Artificial Sequence: Synthetic polypeptide
DEEEIRTTNPVATEQYGSVSVTNMLEREDNID

SEQ ID NO: 29089 - protein, 31 aa, Artificial Sequence
  Description of Artificial Sequence: Synthetic polypeptide
DEEEIRTTNPVATEQYGSVSTENDPQRQIQG

SEQ ID NO: 29090 - protein, 31 aa, Artificial Sequence
  Description of Artificial Sequence: Synthetic polypeptide
DEEEIRTTNPVATEQYGSVSTDDQLSNEMHR

SEQ ID NO: 29091 - protein, 30 aa, Artificial Sequence
  Description of Artificial Sequence: Synthetic polypeptide
DEEEIRTTNPVATEQYGSVSCTDLQEADHD

SEQ ID NO: 29092 - protein, 32 aa, Artificial Sequence
  Description of Artificial Sequence: Synthetic polypeptide
DEEEIRTTNPVATEQYGSVSTNPDQQSSGEER

SEQ ID NO: 29093 - protein, 33 aa, Artificial Sequence
  Description of Artificial Sequence: Synthetic polypeptide
DEEEIRTTNPVATEQYGSVSNMTNLQGGSGNVD

SEQ ID NO: 29094 - protein, 32 aa, Artificial Sequence
  Description of Artificial Sequence: Synthetic polypeptide
DEEEIRTTNPVATEQYGSVSTNPETWRGNQDS

SEQ ID NO: 29095 - protein, 33 aa, Artificial Sequence
  Description of Artificial Sequence: Synthetic polypeptide
DEEEIRTTNPVATEQYGSVSNMTNLQGSGGNQG

SEQ ID NO: 29096 - protein, 32 aa, Artificial Sequence
  Description of Artificial Sequence: Synthetic polypeptide
DEEEIRTTNPVATEQYGSVSPTNPGQPRGEPN

SEQ ID NO: 29097 - protein, 33 aa, Artificial Sequence
  Description of Artificial Sequence: Synthetic polypeptide
DEEEIRTTNPVATEQYGSVSNMTNLQNEGGNGN

SEQ ID NO: 29098 - protein, 34 aa, Artificial Sequence
  Description of Artificial Sequence: Synthetic polypeptide
DEEEIRTTNPVATEQYGSVSNMTNLQQREGDNNE

SEQ ID NO: 29099 - protein, 32 aa, Artificial Sequence
  Description of Artificial Sequence: Synthetic polypeptide
DEEEIRTTNPVATEQYGSVSTNPHDQERSMIR

SEQ ID NO: 29100 - protein, 32 aa, Artificial Sequence
  Description of Artificial Sequence: Synthetic polypeptide
DEEEIRTTNPVATEQYGSVSQTTNLQENENFE

SEQ ID NO: 29101 - protein, 33 aa, Artificial Sequence
  Description of Artificial Sequence: Synthetic polypeptide
DEEEIRTTNPVATEQYGSVSITNLVGQGGGNGN

SEQ ID NO: 29102 - protein, 31 aa, Artificial Sequence
  Description of Artificial Sequence: Synthetic polypeptide
DEEEIRTTNPVATEQYGSVSMNLQNENIGQN

SEQ ID NO: 29103 - protein, 31 aa, Artificial Sequence
  Description of Artificial Sequence: Synthetic polypeptide
DEEEIRTTNPVATEQYGSVSTNPHVERDMIR

SEQ ID NO: 29104 - protein, 30 aa, Artificial Sequence
  Description of Artificial Sequence: Synthetic polypeptide
DEECIRCTNPVATEQYGSVSCNHSQRTGNL

SEQ ID NO: 29105 - protein, 30 aa, Artificial Sequence
  Description of Artificial Sequence: Synthetic polypeptide
DEDEIRTTNPVATEQYGSVSTTNTQQENEQ

SEQ ID NO: 29106 - protein, 32 aa, Artificial Sequence
  Description of Artificial Sequence: Synthetic polypeptide
DEEAIRTTNPVATEYYGSVCSTGNLQVEGNRE

SEQ ID NO: 29107 - protein, 28 aa, Artificial Sequence
  Description of Artificial Sequence: Synthetic peptide
DEAVIRTTNPVATEQYGCVETNPQEGNY

SEQ ID NO: 29108 - protein, 32 aa, Artificial Sequence
  Description of Artificial Sequence: Synthetic polypeptide
DEEEIRTTNPVATEQYGSVSPTNLQLRVLSGE

SEQ ID NO: 29109 - protein, 30 aa, Artificial Sequence
  Description of Artificial Sequence: Synthetic polypeptide
DEEEIRTTNPVATEQYGSVSWGNSLDNSER

SEQ ID NO: 29110 - protein, 31 aa, Artificial Sequence
  Description of Artificial Sequence: Synthetic polypeptide
DEEEIRTTNPVATEQYGSVSPTNLHNFEDRD

SEQ ID NO: 29111 - protein, 31 aa, Artificial Sequence
  Description of Artificial Sequence: Synthetic polypeptide
DEEEIRTTNPVATEQYGSVSADLQSNISNDR

SEQ ID NO: 29112 - protein, 30 aa, Artificial Sequence
  Description of Artificial Sequence: Synthetic polypeptide
DEEEIRTTNPVATEQYGSVSADLQSDGEAQ

SEQ ID NO: 29113 - protein, 32 aa, Artificial Sequence
  Description of Artificial Sequence: Synthetic polypeptide
DEAEIRTTNPVATEQYGSVSTNLNQSDGNGEN

SEQ ID NO: 29114 - protein, 33 aa, Artificial Sequence
  Description of Artificial Sequence: Synthetic polypeptide
DEEEIRTTNPVATEQYGSVSTFNLNQTEGNNGT

SEQ ID NO: 29115 - protein, 32 aa, Artificial Sequence
  Description of Artificial Sequence: Synthetic polypeptide
DEEEIRTTNPVATEQYGSVSITNLQMNQEQRD

SEQ ID NO: 29116 - protein, 31 aa, Artificial Sequence
  Description of Artificial Sequence: Synthetic polypeptide
DEEEIRTTNPVATEQYGSVSYNDLQENMNQN

SEQ ID NO: 29117 - protein, 31 aa, Artificial Sequence
  Description of Artificial Sequence: Synthetic polypeptide
DEAEIRTTNPVATEQYGSVSTNLNQSGDGEA

SEQ ID NO: 29118 - protein, 31 aa, Artificial Sequence
  Description of Artificial Sequence: Synthetic polypeptide
DEEEIRTTNPVATEQYGSVSNNLEGGGNGEQ

SEQ ID NO: 29119 - protein, 32 aa, Artificial Sequence
  Description of Artificial Sequence: Synthetic polypeptide
DEEEIRTTNPVATEQYGSVSTANLQNIGGVED

SEQ ID NO: 29120 - protein, 30 aa, Artificial Sequence
  Description of Artificial Sequence: Synthetic polypeptide
DEEEIRTTNPVATEQYGSVSNNLETGEPDA

SEQ ID NO: 29121 - protein, 32 aa, Artificial Sequence
  Description of Artificial Sequence: Synthetic polypeptide
DEEEIRTTNPVATEQYGSVSYNLQHRMGMDDF

SEQ ID NO: 29122 - protein, 31 aa, Artificial Sequence
  Description of Artificial Sequence: Synthetic polypeptide
DEEEIRTTNPVATEQYGSVSNNLEVGGNNEQ

SEQ ID NO: 29123 - protein, 33 aa, Artificial Sequence
  Description of Artificial Sequence: Synthetic polypeptide
DEEEIRTTNPVATEQYGSVSTANLQPTGGGNGQ

SEQ ID NO: 29124 - protein, 33 aa, Artificial Sequence
  Description of Artificial Sequence: Synthetic polypeptide
DEEEIRTTNPVATEQYGSVSTANLQNGEGNEFN

SEQ ID NO: 29125 - protein, 33 aa, Artificial Sequence
  Description of Artificial Sequence: Synthetic polypeptide
DEEEIRTTNPVATEQYGSVSTANLQGSGGNGQQ

SEQ ID NO: 29126 - protein, 33 aa, Artificial Sequence
  Description of Artificial Sequence: Synthetic polypeptide
DEEEIRTTNPVATEQYGSVSTANLQGFGNNAND

SEQ ID NO: 29127 - protein, 32 aa, Artificial Sequence
  Description of Artificial Sequence: Synthetic polypeptide
DEEEIRTTNPVATEQYGSVSTNWTQRFGSEQN

SEQ ID NO: 29128 - protein, 33 aa, Artificial Sequence
  Description of Artificial Sequence: Synthetic polypeptide
DEEEIRTTNPVATEQYGSVSTANLQGEIGNNDQ

SEQ ID NO: 29129 - protein, 31 aa, Artificial Sequence
  Description of Artificial Sequence: Synthetic polypeptide
DEAEIRTTNPVATEQYGSVSTNLQGDGQGEA

SEQ ID NO: 29130 - protein, 31 aa, Artificial Sequence
  Description of Artificial Sequence: Synthetic polypeptide
DEAEIRTTNPVATEQYGSVSTNLQGDVGGSG

SEQ ID NO: 29131 - protein, 31 aa, Artificial Sequence
  Description of Artificial Sequence: Synthetic polypeptide
DEEEIRTTNPVATEQYGSVSNNLGELGGNEQ

SEQ ID NO: 29132 - protein, 29 aa, Artificial Sequence
  Description of Artificial Sequence: Synthetic peptide
DEDEIRTTNPVAYEGWGSVSTNLQGGNNE

SEQ ID NO: 29133 - protein, 31 aa, Artificial Sequence
  Description of Artificial Sequence: Synthetic polypeptide
DEEEIRTTNPVATEQYGSVSNNLGQSLETER

SEQ ID NO: 29134 - protein, 33 aa, Artificial Sequence
  Description of Artificial Sequence: Synthetic polypeptide
DEEEIRTTNPVATEQYGSVSTFNLQNGMENEEG

SEQ ID NO: 29135 - protein, 32 aa, Artificial Sequence
  Description of Artificial Sequence: Synthetic polypeptide
DEEEIRTTNPVATEQYGSVSTNYQRDINQEEG

SEQ ID NO: 29136 - protein, 32 aa, Artificial Sequence
  Description of Artificial Sequence: Synthetic polypeptide
DEAEIRTTNPVATEQYGSVSTNLQGEQGNNEH

SEQ ID NO: 29137 - protein, 30 aa, Artificial Sequence
  Description of Artificial Sequence: Synthetic polypeptide
DEAEIRTTNPVATEQYGSCSTNTQREGDGN

SEQ ID NO: 29138 - protein, 33 aa, Artificial Sequence
  Description of Artificial Sequence: Synthetic polypeptide
DEEEIRTTNPVATEQYGSVSTANLQIEFGINTD

SEQ ID NO: 29139 - protein, 33 aa, Artificial Sequence
  Description of Artificial Sequence: Synthetic polypeptide
DEEEIRTTNPVATEQYGSVSTANLQPTGGNGGT

SEQ ID NO: 29140 - protein, 31 aa, Artificial Sequence
  Description of Artificial Sequence: Synthetic polypeptide
DEEEIAATNPVATEQYGSVATNLQVGDNDRE

SEQ ID NO: 29141 - protein, 30 aa, Artificial Sequence
  Description of Artificial Sequence: Synthetic polypeptide
DEEEIAATNPVATEQYGSVATNLDRGNDQL

SEQ ID NO: 29142 - protein, 31 aa, Artificial Sequence
  Description of Artificial Sequence: Synthetic polypeptide
DEAEIRTTNPVATEQYGSVSTNLNGETGNEN

SEQ ID NO: 29143 - protein, 32 aa, Artificial Sequence
  Description of Artificial Sequence: Synthetic polypeptide
DEEEIRTTNPVATEQYGSVSWTPTLQNNGLNF

SEQ ID NO: 29144 - protein, 31 aa, Artificial Sequence
  Description of Artificial Sequence: Synthetic polypeptide
DEEEIRTTNPVATEQYGSVSWTSLEQRDDDS

SEQ ID NO: 29145 - protein, 32 aa, Artificial Sequence
  Description of Artificial Sequence: Synthetic polypeptide
DEDEIRTTNPVATEQYGSVSTNNNLPQVGTNL

SEQ ID NO: 29146 - protein, 33 aa, Artificial Sequence
  Description of Artificial Sequence: Synthetic polypeptide
DEAEIRTTNPVATEQYGSVSTNLNGNQEGENDR

SEQ ID NO: 29147 - protein, 31 aa, Artificial Sequence
  Description of Artificial Sequence: Synthetic polypeptide
DEAEIRTTNPVATEQYGSVSTNLNHENGNEN

SEQ ID NO: 29148 - protein, 33 aa, Artificial Sequence
  Description of Artificial Sequence: Synthetic polypeptide
DEEEIRTTNPVATEQYGSVSWTTNVLVQQMGER

SEQ ID NO: 29149 - protein, 33 aa, Artificial Sequence
  Description of Artificial Sequence: Synthetic polypeptide
DEEEIRTTNPVATEQYGSVSTANLQTTEMGNLG

SEQ ID NO: 29150 - protein, 31 aa, Artificial Sequence
  Description of Artificial Sequence: Synthetic polypeptide
DEEEIRTTNPVATEQYGSVSWTVNVESGGND

SEQ ID NO: 29151 - protein, 32 aa, Artificial Sequence
  Description of Artificial Sequence: Synthetic polypeptide
DEEEIRTTNPVATEQYGSVSITNLQQGEFEAP

SEQ ID NO: 29152 - protein, 31 aa, Artificial Sequence
  Description of Artificial Sequence: Synthetic polypeptide
DEAEIRTTNPVATEQYGSVSTNLNMGGENND

SEQ ID NO: 29153 - protein, 32 aa, Artificial Sequence
  Description of Artificial Sequence: Synthetic polypeptide
DEEEIRTTNPVATEQYGSVSTFNLGQGEDNED

SEQ ID NO: 29154 - protein, 32 aa, Artificial Sequence
  Description of Artificial Sequence: Synthetic polypeptide
DEEEIRTTNPVATEQYGSVSTFNLGQGIGQIQ

SEQ ID NO: 29155 - protein, 32 aa, Artificial Sequence
  Description of Artificial Sequence: Synthetic polypeptide
DEEEIRTTNPVATEQYGSVSTNWHQRFISNQN

SEQ ID NO: 29156 - protein, 31 aa, Artificial Sequence
  Description of Artificial Sequence: Synthetic polypeptide
DEDEIRTTNPVATEQYGSVSTNNGQDAGNHT

SEQ ID NO: 29157 - protein, 33 aa, Artificial Sequence
  Description of Artificial Sequence: Synthetic polypeptide
DEEEIRTTNPVATEQYGSVSPTNLLQLRGELDS

SEQ ID NO: 29158 - protein, 32 aa, Artificial Sequence
  Description of Artificial Sequence: Synthetic polypeptide
DEAEIRTTNPVATEQYGSVSTNLNQGDGDNEM

SEQ ID NO: 29159 - protein, 30 aa, Artificial Sequence
  Description of Artificial Sequence: Synthetic polypeptide
DEEEIAATNPVATEQYGCVATNLQREGNDE

SEQ ID NO: 29160 - protein, 32 aa, Artificial Sequence
  Description of Artificial Sequence: Synthetic polypeptide
DEAEIRTTNPVATEQYGSVSTNLNQGDTGNAN

SEQ ID NO: 29161 - protein, 32 aa, Artificial Sequence
  Description of Artificial Sequence: Synthetic polypeptide
DEAEIRTTNPVATEQYGSVSTNLNQGEHGNSG

SEQ ID NO: 29162 - protein, 32 aa, Artificial Sequence
  Description of Artificial Sequence: Synthetic polypeptide
DEAEIRTTNPVATEQYGSVSTNLNQGGGDNNM

SEQ ID NO: 29163 - protein, 31 aa, Artificial Sequence
  Description of Artificial Sequence: Synthetic polypeptide
DEEEIRTTNPVATEQYGSVSTANLQQHLEID

SEQ ID NO: 29164 - protein, 32 aa, Artificial Sequence
  Description of Artificial Sequence: Synthetic polypeptide
DEEEIRTTNPVATEQYGSVSPTNLHTLGSELR

SEQ ID NO: 29165 - protein, 29 aa, Artificial Sequence
  Description of Artificial Sequence: Synthetic peptide
DEEEIAATNPVATEQYGCVATNLQRNNME

SEQ ID NO: 29166 - protein, 34 aa, Artificial Sequence
  Description of Artificial Sequence: Synthetic polypeptide
DEEEIRTTNPVATEQYGSVSCTNALSTRTGGNRW

SEQ ID NO: 29167 - protein, 31 aa, Artificial Sequence
  Description of Artificial Sequence: Synthetic polypeptide
DEEEIAATNPVATEQYGEVSCTNLSQGGGNR

SEQ ID NO: 29168 - protein, 33 aa, Artificial Sequence
  Description of Artificial Sequence: Synthetic polypeptide
DEEEIRTTNPVATEQYGSVSTFNLGQNGFNGEG

SEQ ID NO: 29169 - protein, 32 aa, Artificial Sequence
  Description of Artificial Sequence: Synthetic polypeptide
DEEEIRTTNPVATEQYGSVSITNLQNGQEFDN

SEQ ID NO: 29170 - protein, 30 aa, Artificial Sequence
  Description of Artificial Sequence: Synthetic polypeptide
DEEEIRTTNPVATEQYGSVSYGLGRMGEID

SEQ ID NO: 29171 - protein, 31 aa, Artificial Sequence
  Description of Artificial Sequence: Synthetic polypeptide
DEEEIRTTNPVATEQYGSVSPTNLENGEVDD

SEQ ID NO: 29172 - protein, 32 aa, Artificial Sequence
  Description of Artificial Sequence: Synthetic polypeptide
DEEEIRTTNPVATEQYGSVSCTNAGSQRGGSF

SEQ ID NO: 29173 - protein, 31 aa, Artificial Sequence
  Description of Artificial Sequence: Synthetic polypeptide
DEEEIRTTNPVATEQYGSVSTFNLQQDEEEG

SEQ ID NO: 29174 - protein, 31 aa, Artificial Sequence
  Description of Artificial Sequence: Synthetic polypeptide
DEAEIRTTNPVATEQYGSCSTNPQREGDGRV

SEQ ID NO: 29175 - protein, 31 aa, Artificial Sequence
  Description of Artificial Sequence: Synthetic polypeptide
DEEEIRTTNPVATEQYGSVSYPNLEQMIGDN

SEQ ID NO: 29176 - protein, 31 aa, Artificial Sequence
  Description of Artificial Sequence: Synthetic polypeptide
DEEEIRTTNPVATEQYGSVSETNLQVMEEEL

SEQ ID NO: 29177 - protein, 32 aa, Artificial Sequence
  Description of Artificial Sequence: Synthetic polypeptide
DEEEIRTTNPVATEQYGSVSTPDLQPRTSERI

SEQ ID NO: 29178 - protein, 34 aa, Artificial Sequence
  Description of Artificial Sequence: Synthetic polypeptide
DEEEIRTTNPVATEQYGSVSPTNLDQRQGDNFEP

SEQ ID NO: 29179 - protein, 32 aa, Artificial Sequence
  Description of Artificial Sequence: Synthetic polypeptide
DEAEIRTTNPVATEQYGSVSTNLQGNMGDGNM

SEQ ID NO: 29180 - protein, 32 aa, Artificial Sequence
  Description of Artificial Sequence: Synthetic polypeptide
DEAEIRTTNPVATEQYGSVSTNLQGNMGNGEA

SEQ ID NO: 29181 - protein, 32 aa, Artificial Sequence
  Description of Artificial Sequence: Synthetic polypeptide
DEAEIRTTNPVATEQYGSVSTNLQGNNGDNTM

SEQ ID NO: 29182 - protein, 32 aa, Artificial Sequence
  Description of Artificial Sequence: Synthetic polypeptide
DEEEIRTTNPVATEQYGSVSPTNLDQFGGEII

SEQ ID NO: 29183 - protein, 31 aa, Artificial Sequence
  Description of Artificial Sequence: Synthetic polypeptide
DEEEIRTTNPVATEQYGSVSITNLQEFQAFD

SEQ ID NO: 29184 - protein, 32 aa, Artificial Sequence
  Description of Artificial Sequence: Synthetic polypeptide
DEAEIRTTNPVATEQYGSVSTNLQGNQGDNNP

SEQ ID NO: 29185 - protein, 32 aa, Artificial Sequence
  Description of Artificial Sequence: Synthetic polypeptide
DEEEIRTTNPVATEQYGSVSPTNLDFRGSEEI

SEQ ID NO: 29186 - protein, 29 aa, Artificial Sequence
  Description of Artificial Sequence: Synthetic peptide
DEEEIACTNPIATEQYGNVSETLQRVGNR

SEQ ID NO: 29187 - protein, 33 aa, Artificial Sequence
  Description of Artificial Sequence: Synthetic polypeptide
DEEEIRTTNPVATEQYGSVSTPDLQRGGNSDGF

SEQ ID NO: 29188 - protein, 32 aa, Artificial Sequence
  Description of Artificial Sequence: Synthetic polypeptide
DEEEIRTTNPVATEQYGSVSYPMNENTRGNRM

SEQ ID NO: 29189 - protein, 31 aa, Artificial Sequence
  Description of Artificial Sequence: Synthetic polypeptide
DEEEIRTTNPVATEQYGSVSTPDLSRTEDRN

SEQ ID NO: 29190 - protein, 32 aa, Artificial Sequence
  Description of Artificial Sequence: Synthetic polypeptide
DEEEIRTTNPVATEQYGSVSITNLPTTGENLV

SEQ ID NO: 29191 - protein, 32 aa, Artificial Sequence
  Description of Artificial Sequence: Synthetic polypeptide
DEAEIRTTNPVATEQYGSVSTNLQGPGQDDDR

SEQ ID NO: 29192 - protein, 33 aa, Artificial Sequence
  Description of Artificial Sequence: Synthetic polypeptide
DEEEIRTTNPVATEQYGSVSITNLNQENIGNQP

SEQ ID NO: 29193 - protein, 31 aa, Artificial Sequence
  Description of Artificial Sequence: Synthetic polypeptide
DEEEIRTTNPVATEQYGSVSTFTQQEAGNDM

SEQ ID NO: 29194 - protein, 32 aa, Artificial Sequence
  Description of Artificial Sequence: Synthetic polypeptide
DEEEIRTTNPVATEQYGSVSTPELQRFGSEDI

SEQ ID NO: 29195 - protein, 32 aa, Artificial Sequence
  Description of Artificial Sequence: Synthetic polypeptide
DEEEIRTTNPVATEQYGSVSTPEMQRGNMVND

SEQ ID NO: 29196 - protein, 31 aa, Artificial Sequence
  Description of Artificial Sequence: Synthetic polypeptide
DEAEIRTTNPVATEQYGSVSTNLQGQGDGTG

SEQ ID NO: 29197 - protein, 31 aa, Artificial Sequence
  Description of Artificial Sequence: Synthetic polypeptide
DEEEIRTTNPVATEQYGSVSTPEQTGGNQEM

SEQ ID NO: 29198 - protein, 33 aa, Artificial Sequence
  Description of Artificial Sequence: Synthetic polypeptide
DEEEIRTTNPVATEQYGSVSYTENDQRMGGNMP

SEQ ID NO: 29199 - protein, 32 aa, Artificial Sequence
  Description of Artificial Sequence: Synthetic polypeptide
DEEEIRTTNPVATEQYGSVSTNLQQVVNVNIE

SEQ ID NO: 29200 - protein, 32 aa, Artificial Sequence
  Description of Artificial Sequence: Synthetic polypeptide
DEEEIRTTNPVATEQYGSVSTNLQQTLGIEIE

SEQ ID NO: 29201 - protein, 31 aa, Artificial Sequence
  Description of Artificial Sequence: Synthetic polypeptide
DEAEIRTTNPVATEQYGSVSTNLQGQGDMSG

SEQ ID NO: 29202 - protein, 32 aa, Artificial Sequence
  Description of Artificial Sequence: Synthetic polypeptide
DEEEIRTTNPVATEQYGSVSYTGNWLEQRIAN

SEQ ID NO: 29203 - protein, 31 aa, Artificial Sequence
  Description of Artificial Sequence: Synthetic polypeptide
DEAEIRTTNPVATEQYGSVSTNLQGPGMGEA

SEQ ID NO: 29204 - protein, 32 aa, Artificial Sequence
  Description of Artificial Sequence: Synthetic polypeptide
DEAEIRTTNPVATEQYGSVSTNLQGNEGNDEQ

SEQ ID NO: 29205 - protein, 29 aa, Artificial Sequence
  Description of Artificial Sequence: Synthetic peptide
DEEEIACTNPIATEQYGNVSENLMRVGNR

SEQ ID NO: 29206 - protein, 31 aa, Artificial Sequence
  Description of Artificial Sequence: Synthetic polypeptide
DEAEIRTTNPVATEQYGSVSTNLQGNEDNND

SEQ ID NO: 29207 - protein, 30 aa, Artificial Sequence
  Description of Artificial Sequence: Synthetic polypeptide
DEAEIRTTNPVATEQYGSCSTNNLQGNQEM

SEQ ID NO: 29208 - protein, 30 aa, Artificial Sequence
  Description of Artificial Sequence: Synthetic polypeptide
DEAEIRTTNPVATEQYGSCSTNDTQREEGR

SEQ ID NO: 29209 - protein, 30 aa, Artificial Sequence
  Description of Artificial Sequence: Synthetic polypeptide
DEAEIRTTNPVATEQYGSCSTNDQREGGQL

SEQ ID NO: 29210 - protein, 33 aa, Artificial Sequence
  Description of Artificial Sequence: Synthetic polypeptide
DEEEIRTTNPVATEQYGSVSTFNLQTEGGNNGG

SEQ ID NO: 29211 - protein, 32 aa, Artificial Sequence
  Description of Artificial Sequence: Synthetic polypeptide
DEEEIRTTNPVATEQYGSVSYNMQDRGANNGI

SEQ ID NO: 29212 - protein, 32 aa, Artificial Sequence
  Description of Artificial Sequence: Synthetic polypeptide
DEAEIRTTNPVATEQYGSVSTNLQGGMGGNEK

SEQ ID NO: 29213 - protein, 31 aa, Artificial Sequence
  Description of Artificial Sequence: Synthetic polypeptide
DEEEIRTTNPVATEQYGSVSNNLHDGSDQRY

SEQ ID NO: 29214 - protein, 29 aa, Artificial Sequence
  Description of Artificial Sequence: Synthetic peptide
DEECIRTTNPVAYEQYGNVSTVNVQMGNN

SEQ ID NO: 29215 - protein, 32 aa, Artificial Sequence
  Description of Artificial Sequence: Synthetic polypeptide
DEAEIRTTNPVATEQYGSVSTNLQGGNGDGEA

SEQ ID NO: 29216 - protein, 33 aa, Artificial Sequence
  Description of Artificial Sequence: Synthetic polypeptide
DEEEIRTTNPVATEQYGSVSTANLQEVGETNEG

SEQ ID NO: 29217 - protein, 30 aa, Artificial Sequence
  Description of Artificial Sequence: Synthetic polypeptide
DEEEIRTTNPVATEQYGSVSPTNLEDNILS

SEQ ID NO: 29218 - protein, 32 aa, Artificial Sequence
  Description of Artificial Sequence: Synthetic polypeptide
DEEEIRTTNPVATEQYGSVSYNNLIQPEGQRI

SEQ ID NO: 29219 - protein, 31 aa, Artificial Sequence
  Description of Artificial Sequence: Synthetic polypeptide
DEEEIRTTNPVATEQYGSVSNNLIDRDVNED

SEQ ID NO: 29220 - protein, 29 aa, Artificial Sequence
  Description of Artificial Sequence: Synthetic peptide
DEEAIRTTNPVATEQYGSVSAHELRGNDT

SEQ ID NO: 29221 - protein, 33 aa, Artificial Sequence
  Description of Artificial Sequence: Synthetic polypeptide
DEEEIRTTNPVATEQYGSVSTPAWLQRGDNNEE

SEQ ID NO: 29222 - protein, 31 aa, Artificial Sequence
  Description of Artificial Sequence: Synthetic polypeptide
DEEEIRTTNPVATEQYGSVSTPDDQLGEMRI

SEQ ID NO: 29223 - protein, 31 aa, Artificial Sequence
  Description of Artificial Sequence: Synthetic polypeptide
DEEEIRTTNPVATEQYGSVSTPDDQVVQNER

SEQ ID NO: 29224 - protein, 32 aa, Artificial Sequence
  Description of Artificial Sequence: Synthetic polypeptide
DEEEIRTTNPVATEQYGSVSTFNLVEGGGNGI

SEQ ID NO: 29225 - protein, 30 aa, Artificial Sequence
  Description of Artificial Sequence: Synthetic polypeptide
DEEEIRTTNPVATEQYGSVSETNNELGELT

SEQ ID NO: 29226 - protein, 32 aa, Artificial Sequence
  Description of Artificial Sequence: Synthetic polypeptide
DEAEIRTTNPVATEQYGSVSTNLQGNDAGNEA

SEQ ID NO: 29227 - protein, 32 aa, Artificial Sequence
  Description of Artificial Sequence: Synthetic polypeptide
DEEEIRTTNPVATEQYGSVSPTNLDQTMEVRE

SEQ ID NO: 29228 - protein, 32 aa, Artificial Sequence
  Description of Artificial Sequence: Synthetic polypeptide
DEEEIRTTNPVATEQYGSVSETNMLQRQMDET

SEQ ID NO: 29229 - protein, 31 aa, Artificial Sequence
  Description of Artificial Sequence: Synthetic polypeptide
DEEEIRTTNPVATEQYGSVSTFNNDRGEDFV

SEQ ID NO: 29230 - protein, 32 aa, Artificial Sequence
  Description of Artificial Sequence: Synthetic polypeptide
DEEEIRTTNPVATEQYGSVSITNLQGGLFEMD

SEQ ID NO: 29231 - protein, 33 aa, Artificial Sequence
  Description of Artificial Sequence: Synthetic polypeptide
DEEEIRTTNPVATEQYGSVSETNMLQRGLTEIW

SEQ ID NO: 29232 - protein, 31 aa, Artificial Sequence
  Description of Artificial Sequence: Synthetic polypeptide
DEAEIRTTNPVATEQYGSVSTNLQGNDENEQ

SEQ ID NO: 29233 - protein, 31 aa, Artificial Sequence
  Description of Artificial Sequence: Synthetic polypeptide
DEEEIRTTNPVATEQYGSVQYTNLQPTANIL

SEQ ID NO: 29234 - protein, 31 aa, Artificial Sequence
  Description of Artificial Sequence: Synthetic polypeptide
DEEEIRTTNPVATEQYGSVSTPDLQASGQGN

SEQ ID NO: 29235 - protein, 32 aa, Artificial Sequence
  Description of Artificial Sequence: Synthetic polypeptide
DEEEIRTTNPVATEQYGSVSCTNASTRVGNEA

SEQ ID NO: 29236 - protein, 31 aa, Artificial Sequence
  Description of Artificial Sequence: Synthetic polypeptide
DEEEIRTTNPVATEQYGSVSADELQEGENFQ

SEQ ID NO: 29237 - protein, 33 aa, Artificial Sequence
  Description of Artificial Sequence: Synthetic polypeptide
DEEEIRTTNPVATEQYGSVSPTNLLQNVGNELP

SEQ ID NO: 29238 - protein, 31 aa, Artificial Sequence
  Description of Artificial Sequence: Synthetic polypeptide
DEEEIRTTNPVATEQYGSVSWTNVQQEGIQD

SEQ ID NO: 29239 - protein, 32 aa, Artificial Sequence
  Description of Artificial Sequence: Synthetic polypeptide
DEAEIRTTNPVATEQYGSVSTNLNDGNTGDDR

SEQ ID NO: 29240 - protein, 31 aa, Artificial Sequence
  Description of Artificial Sequence: Synthetic polypeptide
DECEIATTNPVATEQYGSVSTNNQHDEGNER

SEQ ID NO: 29241 - protein, 32 aa, Artificial Sequence
  Description of Artificial Sequence: Synthetic polypeptide
DEEEIRTTNPVATEQYGSVSWNLDEDAGNARS

SEQ ID NO: 29242 - protein, 31 aa, Artificial Sequence
  Description of Artificial Sequence: Synthetic polypeptide
DEEEIRTTNPVATEQYGSVSTVPLDRGEQIE

SEQ ID NO: 29243 - protein, 31 aa, Artificial Sequence
  Description of Artificial Sequence: Synthetic polypeptide
DEEEIRTTNPVATEQYGSVSTEVDPQRSGEF

SEQ ID NO: 29244 - protein, 32 aa, Artificial Sequence
  Description of Artificial Sequence: Synthetic polypeptide
DEEEIRTTNPVATEQYGSVSTNTLGVGGGNEQ

SEQ ID NO: 29245 - protein, 31 aa, Artificial Sequence
  Description of Artificial Sequence: Synthetic polypeptide
DEEEIRTTNPVATEQYGSVSTEYDLNRVNES

SEQ ID NO: 29246 - protein, 31 aa, Artificial Sequence
  Description of Artificial Sequence: Synthetic polypeptide
DEDEIRTTNPVATEQYGSVSTQNLLSGNNND

SEQ ID NO: 29247 - protein, 32 aa, Artificial Sequence
  Description of Artificial Sequence: Synthetic polypeptide
DEEEIRTTNPVATEQYGSVSTVNVQQGVGNEM

SEQ ID NO: 29248 - protein, 32 aa, Artificial Sequence
  Description of Artificial Sequence: Synthetic polypeptide
DEEEIRTTNPVATEQYGSVSPTNLQDGLEITQ

SEQ ID NO: 29249 - protein, 33 aa, Artificial Sequence
  Description of Artificial Sequence: Synthetic polypeptide
DEEEIRTTNPVATEQYGSVSCTGNLSTRVGNPK

SEQ ID NO: 29250 - protein, 33 aa, Artificial Sequence
  Description of Artificial Sequence: Synthetic polypeptide
DEEEIRTTNPVATEQYGSVSTNTLQDEMGNNED

SEQ ID NO: 29251 - protein, 32 aa, Artificial Sequence
  Description of Artificial Sequence: Synthetic polypeptide
DEEEIRTTNPVATEQYGSVSPTNLPQVMPNDE

SEQ ID NO: 29252 - protein, 33 aa, Artificial Sequence
  Description of Artificial Sequence: Synthetic polypeptide
DEEEIRTTNPVATEQYGSVSCTGNMLSQRAGSQ

SEQ ID NO: 29253 - protein, 31 aa, Artificial Sequence
  Description of Artificial Sequence: Synthetic polypeptide
DEEEIRTTNPVATEQYGSVSWNHQRFGSDIY

SEQ ID NO: 29254 - protein, 31 aa, Artificial Sequence
  Description of Artificial Sequence: Synthetic polypeptide
DEEEIRTTNPVATEQYGSVSETPTGQRGDDQ

SEQ ID NO: 29255 - protein, 33 aa, Artificial Sequence
  Description of Artificial Sequence: Synthetic polypeptide
DEEEIRTTNPVATEQYGSVSTNTLQEEVGGNNP

SEQ ID NO: 29256 - protein, 32 aa, Artificial Sequence
  Description of Artificial Sequence: Synthetic polypeptide
DEAEIRTTNPVATEQYGSVSTNAGQEGDGNNR

SEQ ID NO: 29257 - protein, 32 aa, Artificial Sequence
  Description of Artificial Sequence: Synthetic polypeptide
DEEEIRTTNPVATEQYGSVSMEPLQRGSEIRF

SEQ ID NO: 29258 - protein, 29 aa, Artificial Sequence
  Description of Artificial Sequence: Synthetic peptide
DECEIATTNPVATEQYGVVSTSLQRPNDH

SEQ ID NO: 29259 - protein, 33 aa, Artificial Sequence
  Description of Artificial Sequence: Synthetic polypeptide
DEEEIRTTNPVATEQYGSVSTCGNLQRISEERD

SEQ ID NO: 29260 - protein, 33 aa, Artificial Sequence
  Description of Artificial Sequence: Synthetic polypeptide
DEEEIRTTNPVATEQYGSVSTNTLQTEMGNGNT

SEQ ID NO: 29261 - protein, 31 aa, Artificial Sequence
  Description of Artificial Sequence: Synthetic polypeptide
DEAEIRTTNPVATEQYGSVSTNDLEQNFGEQ

SEQ ID NO: 29262 - protein, 31 aa, Artificial Sequence
  Description of Artificial Sequence: Synthetic polypeptide
DEEEIRTTNPVATEQYGSVSWNLIEVGNSLL

SEQ ID NO: 29263 - protein, 29 aa, Artificial Sequence
  Description of Artificial Sequence: Synthetic peptide
DEEEIRTTNPVATEQYGSVSAIDEQDGTE

SEQ ID NO: 29264 - protein, 30 aa, Artificial Sequence
  Description of Artificial Sequence: Synthetic polypeptide
DEAEIRTTNPVATEQYGSVSTNGDGNGERA

SEQ ID NO: 29265 - protein, 32 aa, Artificial Sequence
  Description of Artificial Sequence: Synthetic polypeptide
DEEEIRTTNPVATEQYGSVSPTNLPLTGENLQ

SEQ ID NO: 29266 - protein, 31 aa, Artificial Sequence
  Description of Artificial Sequence: Synthetic polypeptide
DEEEIRTTNPVATEQYGSVSTNTNFGGDNDP

SEQ ID NO: 29267 - protein, 31 aa, Artificial Sequence
  Description of Artificial Sequence: Synthetic polypeptide
DEEEIRTTNPVATEQYGSVSWNLQFFISNDG

SEQ ID NO: 29268 - protein, 31 aa, Artificial Sequence
  Description of Artificial Sequence: Synthetic polypeptide
DEAEIRTTNPVATEQYGSVSTNAGGEDGNER

SEQ ID NO: 29269 - protein, 33 aa, Artificial Sequence
  Description of Artificial Sequence: Synthetic polypeptide
DEEEIRTTNPVATEQYGSVSTNTLDQEGNGNFE

SEQ ID NO: 29270 - protein, 31 aa, Artificial Sequence
  Description of Artificial Sequence: Synthetic polypeptide
DECEIATTNPVATEQYGSVSTNLQHNGGNTE

SEQ ID NO: 29271 - protein, 32 aa, Artificial Sequence
  Description of Artificial Sequence: Synthetic polypeptide
DECEIATTNPVATEQYGSVSTNLQGQQGENDR

SEQ ID NO: 29272 - protein, 29 aa, Artificial Sequence
  Description of Artificial Sequence: Synthetic peptide
DEEEIRTTNPVATEQYGSVSWLMDRGSEG

SEQ ID NO: 29273 - protein, 30 aa, Artificial Sequence
  Description of Artificial Sequence: Synthetic polypeptide
DEEEIRTTNPVATEQYGSVSWLNQSGDNSF

SEQ ID NO: 29274 - protein, 31 aa, Artificial Sequence
  Description of Artificial Sequence: Synthetic polypeptide
DEEEIRTTNPVATEQYGSVSTVVQLVGEERD

SEQ ID NO: 29275 - protein, 29 aa, Artificial Sequence
  Description of Artificial Sequence: Synthetic peptide
DEDEIRTTNPVATDQYGVVSTNLEVGNPG

SEQ ID NO: 29276 - protein, 29 aa, Artificial Sequence
  Description of Artificial Sequence: Synthetic peptide
DEDEIRTTNPVATDQYGVVSTTNLELGNP

SEQ ID NO: 29277 - protein, 31 aa, Artificial Sequence
  Description of Artificial Sequence: Synthetic polypeptide
DEEEIRTTNPVATEQYGSVSWMLQWNGDNDM

SEQ ID NO: 29278 - protein, 29 aa, Artificial Sequence
  Description of Artificial Sequence: Synthetic peptide
DEDEIRTTNPVATDQYGVVSTVNLEGGNP

SEQ ID NO: 29279 - protein, 31 aa, Artificial Sequence
  Description of Artificial Sequence: Synthetic polypeptide
DEEEIRTTNPVATEQYGSVSGDLQMGGEERT

SEQ ID NO: 29280 - protein, 30 aa, Artificial Sequence
  Description of Artificial Sequence: Synthetic polypeptide
DEEEIRTTNPVATEQYGSVSGDLQRDPLAN

SEQ ID NO: 29281 - protein, 30 aa, Artificial Sequence
  Description of Artificial Sequence: Synthetic polypeptide
DEEEIRTTNPVATEQYGSVSETQLQGQLED

SEQ ID NO: 29282 - protein, 30 aa, Artificial Sequence
  Description of Artificial Sequence: Synthetic polypeptide
DECEIATTNPVATEQYGSVSTNLMGEGDNT

SEQ ID NO: 29283 - protein, 29 aa, Artificial Sequence
  Description of Artificial Sequence: Synthetic peptide
DEECIRTTNPVAYEQYGCVSTNHQPGGND

SEQ ID NO: 29284 - protein, 30 aa, Artificial Sequence
  Description of Artificial Sequence: Synthetic polypeptide
DECEIATTNPVATEQYGSVSTNLMHEGNTM

SEQ ID NO: 29285 - protein, 33 aa, Artificial Sequence
  Description of Artificial Sequence: Synthetic polypeptide
DEEEIRTTNPVATEQYGSVSCTGNLSQRVGDSM

SEQ ID NO: 29286 - protein, 31 aa, Artificial Sequence
  Description of Artificial Sequence: Synthetic polypeptide
DEEEIRTTNPVATEQYGSVSTNTGEDSGNEI

SEQ ID NO: 29287 - protein, 32 aa, Artificial Sequence
  Description of Artificial Sequence: Synthetic polypeptide
DEEEIRTTNPVATEQYGSVSSGLEQRQMGNTY

SEQ ID NO: 29288 - protein, 30 aa, Artificial Sequence
  Description of Artificial Sequence: Synthetic polypeptide
DECEIATTNPVATEQYGSVSTNLNMGGNTH

SEQ ID NO: 29289 - protein, 31 aa, Artificial Sequence
  Description of Artificial Sequence: Synthetic polypeptide
DEDEIRTTNPVATEQYGSVSTQNLTLGNNNS

SEQ ID NO: 29290 - protein, 31 aa, Artificial Sequence
  Description of Artificial Sequence: Synthetic polypeptide
DEEAIRTTNPVATEQYGSVSTNDDRGLNEHT

SEQ ID NO: 29291 - protein, 32 aa, Artificial Sequence
  Description of Artificial Sequence: Synthetic polypeptide
DEDEIRTTNPVATEQYGSVSTQNLQFGNNNTS

SEQ ID NO: 29292 - protein, 30 aa, Artificial Sequence
  Description of Artificial Sequence: Synthetic polypeptide
DEEEIRTTNPVATEQYGSVSWNDDDQQGQE

SEQ ID NO: 29293 - protein, 30 aa, Artificial Sequence
  Description of Artificial Sequence: Synthetic polypeptide
DEEEIRTTNPVATEQYGSVSTNTGSTNPNA

SEQ ID NO: 29294 - protein, 31 aa, Artificial Sequence
  Description of Artificial Sequence: Synthetic polypeptide
DEEEIRTTNPVATEQYGSVSGLLGQNNGGNT

SEQ ID NO: 29295 - protein, 31 aa, Artificial Sequence
  Description of Artificial Sequence: Synthetic polypeptide
DEEEIRTTNPVATEQYGSVSTETQEHFGSNI

SEQ ID NO: 29296 - protein, 32 aa, Artificial Sequence
  Description of Artificial Sequence: Synthetic polypeptide
DEEEIRTTNPVATEQYGSVSTNTLAERFTQRQ

SEQ ID NO: 29297 - protein, 30 aa, Artificial Sequence
  Description of Artificial Sequence: Synthetic polypeptide
DEEEIRTTNPVATEQYGSVSTETQGFGEQM

SEQ ID NO: 29298 - protein, 32 aa, Artificial Sequence
  Description of Artificial Sequence: Synthetic polypeptide
DEEEIRTTNPVATEQYGSVSWNDLQRFGSEQN

SEQ ID NO: 29299 - protein, 29 aa, Artificial Sequence
  Description of Artificial Sequence: Synthetic peptide
DEEEIRTTNPVATEQYGSVSALLNRDIDI

SEQ ID NO: 29300 - protein, 31 aa, Artificial Sequence
  Description of Artificial Sequence: Synthetic polypeptide
DEEEIRTTNPVATEQYGSVSWNEFQNQGNSD

SEQ ID NO: 29301 - protein, 31 aa, Artificial Sequence
  Description of Artificial Sequence: Synthetic polypeptide
DEEEIRTTNPVATEQYGSVSTNTNQEQDEIR

SEQ ID NO: 29302 - protein, 29 aa, Artificial Sequence
  Description of Artificial Sequence: Synthetic peptide
DEECVRTTNPIAYEQYGCVSTNLQNGSNR

SEQ ID NO: 29303 - protein, 32 aa, Artificial Sequence
  Description of Artificial Sequence: Synthetic polypeptide
DEEEIRTTNPVATEQYGSVSITNLQQQVNLLD

SEQ ID NO: 29304 - protein, 31 aa, Artificial Sequence
  Description of Artificial Sequence: Synthetic polypeptide
DEEEIRTTNPVATEQYGSVSPTNLNRTQQDN

SEQ ID NO: 29305 - protein, 32 aa, Artificial Sequence
  Description of Artificial Sequence: Synthetic polypeptide
DEEEIRTTNPVATEQYGSVSTANNQNIGGNEG

SEQ ID NO: 29306 - protein, 32 aa, Artificial Sequence
  Description of Artificial Sequence: Synthetic polypeptide
DEAEIRTTNPVATEQYGSVSTNLEQPGNGDNE

SEQ ID NO: 29307 - protein, 32 aa, Artificial Sequence
  Description of Artificial Sequence: Synthetic polypeptide
DEEEIRTTNPVATEQYGSVSPTNLMSVDVNVR

SEQ ID NO: 29308 - protein, 33 aa, Artificial Sequence
  Description of Artificial Sequence: Synthetic polypeptide
DEEEIRTTNPVATEQYGSVSTANNLQHFGEDVR

SEQ ID NO: 29309 - protein, 31 aa, Artificial Sequence
  Description of Artificial Sequence: Synthetic polypeptide
DEDEIRTTNPVATEQYGSVSTNSNGDGNNDR

SEQ ID NO: 29310 - protein, 31 aa, Artificial Sequence
  Description of Artificial Sequence: Synthetic polypeptide
DEDEIRTTNPVATEQYGSVSTNQGQENGNHN

SEQ ID NO: 29311 - protein, 29 aa, Artificial Sequence
  Description of Artificial Sequence: Synthetic peptide
DEEEIRTTNPVATEQYGSVSWPNQSGDSE

SEQ ID NO: 29312 - protein, 31 aa, Artificial Sequence
  Description of Artificial Sequence: Synthetic polypeptide
DEEEIRTTNPVATEQYGSVSWTALDRIMNTQ

SEQ ID NO: 29313 - protein, 31 aa, Artificial Sequence
  Description of Artificial Sequence: Synthetic polypeptide
DEEEIRTTNPVATEQYGSVSWTDDGQQQQNR

SEQ ID NO: 29314 - protein, 32 aa, Artificial Sequence
  Description of Artificial Sequence: Synthetic polypeptide
DEEEIRTTNPVATEQYGSVSTANMNNQNGNIT

SEQ ID NO: 29315 - protein, 32 aa, Artificial Sequence
  Description of Artificial Sequence: Synthetic polypeptide
DEEAIRTTNPVATEQYGSVSTGNHQRFGSNAF

SEQ ID NO: 29316 - protein, 30 aa, Artificial Sequence
  Description of Artificial Sequence: Synthetic polypeptide
DEAEISTTNPVATEQYGCVATNLQERGNGQ

SEQ ID NO: 29317 - protein, 30 aa, Artificial Sequence
  Description of Artificial Sequence: Synthetic polypeptide
DEAEISTTNPVATEQYGCVATNLQERGDRN

SEQ ID NO: 29318 - protein, 31 aa, Artificial Sequence
  Description of Artificial Sequence: Synthetic polypeptide
DEAEIRTTNPVATEQYGSVSTNLGHGGNNPM

SEQ ID NO: 29319 - protein, 32 aa, Artificial Sequence
  Description of Artificial Sequence: Synthetic polypeptide
DEEEIRTTNPVATEQYGSVSTNVQRIGPQLQT

SEQ ID NO: 29320 - protein, 32 aa, Artificial Sequence
  Description of Artificial Sequence: Synthetic polypeptide
DEEEIRTTNPVATEQYGSVSWTGELQRETNVN

SEQ ID NO: 29321 - protein, 32 aa, Artificial Sequence
  Description of Artificial Sequence: Synthetic polypeptide
DEEEIRTTNPVATEQYGSVSLNGGLQQRGEED

SEQ ID NO: 29322 - protein, 31 aa, Artificial Sequence
  Description of Artificial Sequence: Synthetic polypeptide
DEEEIRTTNPVATEQYGSVSAEDLEDRGEDR

SEQ ID NO: 29323 - protein, 32 aa, Artificial Sequence
  Description of Artificial Sequence: Synthetic polypeptide
DEDEIRTTNPVATEQYGSVSTNPNQNAGDNDR

SEQ ID NO: 29324 - protein, 29 aa, Artificial Sequence
  Description of Artificial Sequence: Synthetic peptide
DEEDIRTTNPVAWEQYGQVSTENVQGGNN

SEQ ID NO: 29325 - protein, 32 aa, Artificial Sequence
  Description of Artificial Sequence: Synthetic polypeptide
DEEEIRTTNPVATEQYGSVSTANMNNQEQGNI

SEQ ID NO: 29326 - protein, 31 aa, Artificial Sequence
  Description of Artificial Sequence: Synthetic polypeptide
DEEEIRTTNPVATEQYGSVSTNVQTRNDDEY

SEQ ID NO: 29327 - protein, 31 aa, Artificial Sequence
  Description of Artificial Sequence: Synthetic polypeptide
DEEEIRTTNPVATEQYGSVSPTNLLQTEDQI

SEQ ID NO: 29328 - protein, 29 aa, Artificial Sequence
  Description of Artificial Sequence: Synthetic peptide
DEAEIRTTNPVATEQYGSHSTDLLQGGDM

SEQ ID NO: 29329 - protein, 31 aa, Artificial Sequence
  Description of Artificial Sequence: Synthetic polypeptide
DEEAIRTTNPVATEQYGSVSTGNDQNFGSNA

SEQ ID NO: 29330 - protein, 32 aa, Artificial Sequence
  Description of Artificial Sequence: Synthetic polypeptide
DEEEIRTTNPVATEQYGSVSITNLQQGLEEMD

SEQ ID NO: 29331 - protein, 33 aa, Artificial Sequence
  Description of Artificial Sequence: Synthetic polypeptide
DEEEIRTTNPVATEQYGSVSWTNNGQRVFNTRQ

SEQ ID NO: 29332 - protein, 32 aa, Artificial Sequence
  Description of Artificial Sequence: Synthetic polypeptide
DEEEIRTTNPVATEQYGSVSWTNNLEQRDTQI

SEQ ID NO: 29333 - protein, 32 aa, Artificial Sequence
  Description of Artificial Sequence: Synthetic polypeptide
DEEEIRTTNPVATEQYGSVSWTNTDTQEGQRD

SEQ ID NO: 29334 - protein, 31 aa, Artificial Sequence
  Description of Artificial Sequence: Synthetic polypeptide
DEEAIRTTNPVATEQYGSVSTGNHQRGSDDP

SEQ ID NO: 29335 - protein, 30 aa, Artificial Sequence
  Description of Artificial Sequence: Synthetic polypeptide
DEEEIRTTNPVATEQYGSVSTEPNARDNSD

SEQ ID NO: 29336 - protein, 29 aa, Artificial Sequence
  Description of Artificial Sequence: Synthetic peptide
DEECVRTTNPVAAEQYGQVSTINFQRGNN

SEQ ID NO: 29337 - protein, 31 aa, Artificial Sequence
  Description of Artificial Sequence: Synthetic polypeptide
DEEEIRTTNPVATEQYGSVSTANQNNDGNGE

SEQ ID NO: 29338 - protein, 30 aa, Artificial Sequence
  Description of Artificial Sequence: Synthetic polypeptide
DEECIRCTNPVATEQYGSTVSCNFQRTGNL

SEQ ID NO: 29339 - protein, 32 aa, Artificial Sequence
  Description of Artificial Sequence: Synthetic polypeptide
DEEEIRTTNPVATEQYGSVSTFNLDEGEGGNI

SEQ ID NO: 29340 - protein, 32 aa, Artificial Sequence
  Description of Artificial Sequence: Synthetic polypeptide
DEEEIRTTNPVATEQYGSVSTNTQNQNDDEIR

SEQ ID NO: 29341 - protein, 32 aa, Artificial Sequence
  Description of Artificial Sequence: Synthetic polypeptide
DEEEIRTTNPVATEQYGSVSWNLQRFGSETQS

SEQ ID NO: 29342 - protein, 32 aa, Artificial Sequence
  Description of Artificial Sequence: Synthetic polypeptide
DEEEIRTTNPVATEQYGSVSPTNLNRQTNLID

SEQ ID NO: 29343 - protein, 31 aa, Artificial Sequence
  Description of Artificial Sequence: Synthetic polypeptide
DEEEIRTTNPVATEQYGSVSTNTQQEDTMIR

SEQ ID NO: 29344 - protein, 30 aa, Artificial Sequence
  Description of Artificial Sequence: Synthetic polypeptide
DEECIRTTNPVATEIYGAVTTNLQDGGSNR

SEQ ID NO: 29345 - protein, 29 aa, Artificial Sequence
  Description of Artificial Sequence: Synthetic peptide
DEECIRTTNPVAYEQYGCVSTVNHQYGNQ

SEQ ID NO: 29346 - protein, 32 aa, Artificial Sequence
  Description of Artificial Sequence: Synthetic polypeptide
DEEEIRTTNPVATEQYGSVSTNTQQNGGTNGD

SEQ ID NO: 29347 - protein, 30 aa, Artificial Sequence
  Description of Artificial Sequence: Synthetic polypeptide
DEECIRTTNPVATEIYGAVTTNLQGDGDNR

SEQ ID NO: 29348 - protein, 32 aa, Artificial Sequence
  Description of Artificial Sequence: Synthetic polypeptide
DEEEIRTTNPVATEQYGSVSWNLQRVGEHQGT

SEQ ID NO: 29349 - protein, 30 aa, Artificial Sequence
  Description of Artificial Sequence: Synthetic polypeptide
DEECIRTTNPVAYEQYGCVTSTGNHQRGNA

SEQ ID NO: 29350 - protein, 33 aa, Artificial Sequence
  Description of Artificial Sequence: Synthetic polypeptide
DEEEIRTTNPVATEQYGSVSWNLQVRVGEAQRA

SEQ ID NO: 29351 - protein, 31 aa, Artificial Sequence
  Description of Artificial Sequence: Synthetic polypeptide
DEAEIRTTNPVATEQYGSVSTNIQGNGDNNS

SEQ ID NO: 29352 - protein, 31 aa, Artificial Sequence
  Description of Artificial Sequence: Synthetic polypeptide
DEDEIRTTNPVATEQYGSVSTQNLAGQNNND

SEQ ID NO: 29353 - protein, 32 aa, Artificial Sequence
  Description of Artificial Sequence: Synthetic polypeptide
DEEEIRTTNPVATEQYGSVSPTNLNRNGQDEI

SEQ ID NO: 29354 - protein, 31 aa, Artificial Sequence
  Description of Artificial Sequence: Synthetic polypeptide
DEEEIRTTNPVATEQYGSVSTNTVQEDDTIR

SEQ ID NO: 29355 - protein, 30 aa, Artificial Sequence
  Description of Artificial Sequence: Synthetic polypeptide
DEAEIRTTNPVATEQYGSISTNLLVDNNQR

SEQ ID NO: 29356 - protein, 31 aa, Artificial Sequence
  Description of Artificial Sequence: Synthetic polypeptide
DEEEIRTTNPVATEQYGSVSTNVAQEDAMIR

SEQ ID NO: 29357 - protein, 31 aa, Artificial Sequence
  Description of Artificial Sequence: Synthetic polypeptide
DEEEIRTTNPVATEQYGSVSTNVEVVGFNEE

SEQ ID NO: 29358 - protein, 32 aa, Artificial Sequence
  Description of Artificial Sequence: Synthetic polypeptide
DEEEIRTTNPVATEQYGSVSTNVHEERDMNIR

SEQ ID NO: 29359 - protein, 31 aa, Artificial Sequence
  Description of Artificial Sequence: Synthetic polypeptide
DEEEIRTTNPVATEQYGSVSWNLTDRDNNMG

SEQ ID NO: 29360 - protein, 32 aa, Artificial Sequence
  Description of Artificial Sequence: Synthetic polypeptide
DEEEIRTTNPVATEQYGSVSPTNLNRNENSQS

SEQ ID NO: 29361 - protein, 31 aa, Artificial Sequence
  Description of Artificial Sequence: Synthetic polypeptide
DEEEIRTTNPVATEQYGSVSETNTQRPVTGL

SEQ ID NO: 29362 - protein, 33 aa, Artificial Sequence
  Description of Artificial Sequence: Synthetic polypeptide
DEEEIRTTNPVATEQYGSVSTANSELQRGAQED

SEQ ID NO: 29363 - protein, 32 aa, Artificial Sequence
  Description of Artificial Sequence: Synthetic polypeptide
DEDEIRTTNPVATEQYGSVSTNTQFSGSNPRD

SEQ ID NO: 29364 - protein, 33 aa, Artificial Sequence
  Description of Artificial Sequence: Synthetic polypeptide
DEEEIRTTNPVATEQYGSVSTNVLQNMGENTEN

SEQ ID NO: 29365 - protein, 30 aa, Artificial Sequence
  Description of Artificial Sequence: Synthetic polypeptide
DEAEIRTTNPVATEQYGSVSTNLENFGSDQ

SEQ ID NO: 29366 - protein, 30 aa, Artificial Sequence
  Description of Artificial Sequence: Synthetic polypeptide
DEEEIRTTNPVATEQYGSVSWNLVTGESQD

SEQ ID NO: 29367 - protein, 31 aa, Artificial Sequence
  Description of Artificial Sequence: Synthetic polypeptide
DEEEIRTTNPVATEQYGSVSAFNLQQQNLLD

SEQ ID NO: 29368 - protein, 34 aa, Artificial Sequence
  Description of Artificial Sequence: Synthetic polypeptide
DEEEIRTTNPVATEQYGSVSYTNALSPRAGGNNR

SEQ ID NO: 29369 - protein, 31 aa, Artificial Sequence
  Description of Artificial Sequence: Synthetic polypeptide
DEEEIRTTNPVATEQYGSVSTELQFGGSDIA

SEQ ID NO: 29370 - protein, 31 aa, Artificial Sequence
  Description of Artificial Sequence: Synthetic polypeptide
DEDEIRTTNPCATEQYGSVSTNLQGGGGNEK

SEQ ID NO: 29371 - protein, 33 aa, Artificial Sequence
  Description of Artificial Sequence: Synthetic polypeptide
DEEEIRTTNPVATEQYGSVSTNNADQRGNNFDD

SEQ ID NO: 29372 - protein, 31 aa, Artificial Sequence
  Description of Artificial Sequence: Synthetic polypeptide
DEDEIRTTNPVATEQYGVVSTNLQSNGDNGA

SEQ ID NO: 29373 - protein, 31 aa, Artificial Sequence
  Description of Artificial Sequence: Synthetic polypeptide
DEDEIRTTNPVATEQYGVVSTNLQPQGDNDK

SEQ ID NO: 29374 - protein, 31 aa, Artificial Sequence
  Description of Artificial Sequence: Synthetic polypeptide
DEEEIRTTNPVATEQYGSVSVDNLQNVENQE

SEQ ID NO: 29375 - protein, 32 aa, Artificial Sequence
  Description of Artificial Sequence: Synthetic polypeptide
DEEEIRTTNPVATEQYGSVSTDNLTFNDGNEE

SEQ ID NO: 29376 - protein, 32 aa, Artificial Sequence
  Description of Artificial Sequence: Synthetic polypeptide
DEEEIRTTNPVATEQYGSVSVSMNLQRFNNIS

SEQ ID NO: 29377 - protein, 30 aa, Artificial Sequence
  Description of Artificial Sequence: Synthetic polypeptide
DEEEIRTTNPVATEQYGSVSTDLQPDQDAQ

SEQ ID NO: 29378 - protein, 31 aa, Artificial Sequence
  Description of Artificial Sequence: Synthetic polypeptide
DEDEIRTTNPVATEQYGVVSTNLQHQGDNSS

SEQ ID NO: 29379 - protein, 30 aa, Artificial Sequence
  Description of Artificial Sequence: Synthetic polypeptide
DEDEIRTTNPVATEQYGVVSTNLQHDGDDS

SEQ ID NO: 29380 - protein, 32 aa, Artificial Sequence
  Description of Artificial Sequence: Synthetic polypeptide
DEEEIRTTNPVATEQYGSVSTNNAQERDMIRV

SEQ ID NO: 29381 - protein, 31 aa, Artificial Sequence
  Description of Artificial Sequence: Synthetic polypeptide
DEDEIRTTNPVATEQYGVVSTNLQHAGDNSE

SEQ ID NO: 29382 - protein, 29 aa, Artificial Sequence
  Description of Artificial Sequence: Synthetic peptide
DEECIRCTNPVAYEQYGSVSGNNDQRGNL

SEQ ID NO: 29383 - protein, 32 aa, Artificial Sequence
  Description of Artificial Sequence: Synthetic polypeptide
DEEEIRTTNPVATEQYGSVSTDLQNSGENLNM

SEQ ID NO: 29384 - protein, 33 aa, Artificial Sequence
  Description of Artificial Sequence: Synthetic polypeptide
DEEEIRTTNPVATEQYGSVSTDNLQQVEGNQGE

SEQ ID NO: 29385 - protein, 31 aa, Artificial Sequence
  Description of Artificial Sequence: Synthetic polypeptide
DEDEIRTTNPVATEQYGVVSTNLQGDPGTNS

SEQ ID NO: 29386 - protein, 30 aa, Artificial Sequence
  Description of Artificial Sequence: Synthetic polypeptide
DEEEIRTTNPVATEQYGSVSVSNNEQGVNI

SEQ ID NO: 29387 - protein, 31 aa, Artificial Sequence
  Description of Artificial Sequence: Synthetic polypeptide
DEEEIRTTNPVATEQYGSVSVDNLNTRGDDM

SEQ ID NO: 29388 - protein, 32 aa, Artificial Sequence
  Description of Artificial Sequence: Synthetic polypeptide
DEEEIRTTNPVATEQYGSVSMPNLQRQNILIE

SEQ ID NO: 29389 - protein, 31 aa, Artificial Sequence
  Description of Artificial Sequence: Synthetic polypeptide
DEEEIRTTNPVATEQYGSVSVDNLDRFNNED

SEQ ID NO: 29390 - protein, 30 aa, Artificial Sequence
  Description of Artificial Sequence: Synthetic polypeptide
DEEEIRTTNPVATEQYGSVSIYLAEVVNRE

SEQ ID NO: 29391 - protein, 32 aa, Artificial Sequence
  Description of Artificial Sequence: Synthetic polypeptide
DEEEIRTTNPVATEQYGSVSVDNIQRFGNVDI

SEQ ID NO: 29392 - protein, 31 aa, Artificial Sequence
  Description of Artificial Sequence: Synthetic polypeptide
DEEEIRTTNPVATEQYGSVSMVNLEVRGEDI

SEQ ID NO: 29393 - protein, 30 aa, Artificial Sequence
  Description of Artificial Sequence: Synthetic polypeptide
DEEEIRTTNPVATEQYGSVSMVSLQNDNED

SEQ ID NO: 29394 - protein, 30 aa, Artificial Sequence
  Description of Artificial Sequence: Synthetic polypeptide
DEEEIRTTNPVATEQYGSVSCDNGQQRVVF

SEQ ID NO: 29395 - protein, 33 aa, Artificial Sequence
  Description of Artificial Sequence: Synthetic polypeptide
DEEEIRTTNPVATEQYGSVSTNLSQPTGGNNEN

SEQ ID NO: 29396 - protein, 33 aa, Artificial Sequence
  Description of Artificial Sequence: Synthetic polypeptide
DEEEIRTTNPVATEQYGSVSNALNLQEGGNEDR

SEQ ID NO: 29397 - protein, 31 aa, Artificial Sequence
  Description of Artificial Sequence: Synthetic polypeptide
DEEEIRTTNPVATEQYGSVSPTTTQRVELRV

SEQ ID NO: 29398 - protein, 29 aa, Artificial Sequence
  Description of Artificial Sequence: Synthetic peptide
DEDEIRTTNPVATEQYGVVSTLLQEPNDD

SEQ ID NO: 29399 - protein, 32 aa, Artificial Sequence
  Description of Artificial Sequence: Synthetic polypeptide
DEEEIRTTNPVATEQYGSVSTDLQNRMMENIL

SEQ ID NO: 29400 - protein, 32 aa, Artificial Sequence
  Description of Artificial Sequence: Synthetic polypeptide
DEEEIRTTNPVATEQYGSVSTDLQPRSMEERL

SEQ ID NO: 29401 - protein, 31 aa, Artificial Sequence
  Description of Artificial Sequence: Synthetic polypeptide
DEEEIRTTNPVATEQYGSVSVSLMLQRVNIE

SEQ ID NO: 29402 - protein, 33 aa, Artificial Sequence
  Description of Artificial Sequence: Synthetic polypeptide
DEEEIRTTNPVATEQYGSVSTDNLQQNFGNENE

SEQ ID NO: 29403 - protein, 31 aa, Artificial Sequence
  Description of Artificial Sequence: Synthetic polypeptide
DEEEIRTTNPVATEQYGSVSVSFNLQRVEIQ

SEQ ID NO: 29404 - protein, 32 aa, Artificial Sequence
  Description of Artificial Sequence: Synthetic polypeptide
DEEEIRTTNPVATEQYGSVSVSFNLQRVENLI

SEQ ID NO: 29405 - protein, 32 aa, Artificial Sequence
  Description of Artificial Sequence: Synthetic polypeptide
DEEEIRTTNPVATEQYGSVSTDNLQMEFGGET

SEQ ID NO: 29406 - protein, 33 aa, Artificial Sequence
  Description of Artificial Sequence: Synthetic polypeptide
DEEEIRTTNPVATEQYGSVSMTPSLQRSNLNRP

SEQ ID NO: 29407 - protein, 33 aa, Artificial Sequence
  Description of Artificial Sequence: Synthetic polypeptide
DEEEIRTTNPVATEQYGSVSTDNLQMEFGNITT

SEQ ID NO: 29408 - protein, 31 aa, Artificial Sequence
  Description of Artificial Sequence: Synthetic polypeptide
DEEEIRTTNPVATEQYGSVSVSFPLQRVENI

SEQ ID NO: 29409 - protein, 28 aa, Artificial Sequence
  Description of Artificial Sequence: Synthetic peptide
DEDEICTTNPVATEGYGSVATNLTNGNE

SEQ ID NO: 29410 - protein, 31 aa, Artificial Sequence
  Description of Artificial Sequence: Synthetic polypeptide
DEEEIRTTNPVATEQYGSVSMTTPLQDGFEQ

SEQ ID NO: 29411 - protein, 29 aa, Artificial Sequence
  Description of Artificial Sequence: Synthetic peptide
DEECLRTTNPIAYEQYGEVSTNHQRFGNR

SEQ ID NO: 29412 - protein, 28 aa, Artificial Sequence
  Description of Artificial Sequence: Synthetic peptide
DEECLRTTNPIAYEQYGEVSTNLQDGDR

SEQ ID NO: 29413 - protein, 32 aa, Artificial Sequence
  Description of Artificial Sequence: Synthetic polypeptide
DEEEIRTTNPVATEQYGSVSVSGNLQERVSNQ

SEQ ID NO: 29414 - protein, 30 aa, Artificial Sequence
  Description of Artificial Sequence: Synthetic polypeptide
DEEEIRTTNPVATEQYGSVSMSDQRDGQDE

SEQ ID NO: 29415 - protein, 32 aa, Artificial Sequence
  Description of Artificial Sequence: Synthetic polypeptide
DEEEIRTTNPVATEQYGSVSVSGNLQREVNDI

SEQ ID NO: 29416 - protein, 28 aa, Artificial Sequence
  Description of Artificial Sequence: Synthetic peptide
DEECIVTVNPVATECYGSVSDNEERGNR

SEQ ID NO: 29417 - protein, 32 aa, Artificial Sequence
  Description of Artificial Sequence: Synthetic polypeptide
DEEEIRTTNPVATEQYGSVSVSGNLQRMSNIM

SEQ ID NO: 29418 - protein, 30 aa, Artificial Sequence
  Description of Artificial Sequence: Synthetic polypeptide
DEEEIRTTNPVATEQYGSVSFTDQQYGIEF

SEQ ID NO: 29419 - protein, 33 aa, Artificial Sequence
  Description of Artificial Sequence: Synthetic polypeptide
DEEEIRTTNPVATEQYGSVSQTLNLVIDGENRI

SEQ ID NO: 29420 - protein, 32 aa, Artificial Sequence
  Description of Artificial Sequence: Synthetic polypeptide
DEEEIRTTNPVATEQYGSVSTDLQQVVGNIIP

SEQ ID NO: 29421 - protein, 31 aa, Artificial Sequence
  Description of Artificial Sequence: Synthetic polypeptide
DEEEIRTTNPVATEQYGSVSVSGNLQYSSNI

SEQ ID NO: 29422 - protein, 29 aa, Artificial Sequence
  Description of Artificial Sequence: Synthetic peptide
DEECLRTTNPIAYEQYGEVSTNLQPGGNR

SEQ ID NO: 29423 - protein, 33 aa, Artificial Sequence
  Description of Artificial Sequence: Synthetic polypeptide
DEEEIRTTNPVATEQYGSVSPTVLWQRGAEENP

SEQ ID NO: 29424 - protein, 29 aa, Artificial Sequence
  Description of Artificial Sequence: Synthetic peptide
DEECLRTTNPIAYEQYGEVSTNLQRGGND

SEQ ID NO: 29425 - protein, 29 aa, Artificial Sequence
  Description of Artificial Sequence: Synthetic peptide
DEECLRTTNPIAYEQYGEVSTNLQRGGNM

SEQ ID NO: 29426 - protein, 33 aa, Artificial Sequence
  Description of Artificial Sequence: Synthetic polypeptide
DEEEIRTTNPVATEQYGSVSVSGNSLSQRVGNQ

SEQ ID NO: 29427 - protein, 28 aa, Artificial Sequence
  Description of Artificial Sequence: Synthetic peptide
DEDEIATVNPVATEQYGSVATNLEEGNP

SEQ ID NO: 29428 - protein, 33 aa, Artificial Sequence
  Description of Artificial Sequence: Synthetic polypeptide
DEEEIRTTNPVATEQYGSVSTDNLQQFEGGNEI

SEQ ID NO: 29429 - protein, 31 aa, Artificial Sequence
  Description of Artificial Sequence: Synthetic polypeptide
DEEEIRTTNPVATEQYGSVSVSINGLQGVNI

SEQ ID NO: 29430 - protein, 32 aa, Artificial Sequence
  Description of Artificial Sequence: Synthetic polypeptide
DEEEIRTTNPVATEQYGSVSTDNLQQGFGEID

SEQ ID NO: 29431 - protein, 30 aa, Artificial Sequence
  Description of Artificial Sequence: Synthetic polypeptide
DEEEIRTTNPVATEQYGSVSVSINGQLVNI

SEQ ID NO: 29432 - protein, 28 aa, Artificial Sequence
  Description of Artificial Sequence: Synthetic peptide
DEDEIRTTNPVATEQYGVVSTKLGRPTD

SEQ ID NO: 29433 - protein, 32 aa, Artificial Sequence
  Description of Artificial Sequence: Synthetic polypeptide
DEEEIRTTNPVATEQYGSVSVSFNLQRNVDNI

SEQ ID NO: 29434 - protein, 33 aa, Artificial Sequence
  Description of Artificial Sequence: Synthetic polypeptide
DEEEIRTTNPVATEQYGSVSCDNLSQGPGGNNR

SEQ ID NO: 29435 - protein, 32 aa, Artificial Sequence
  Description of Artificial Sequence: Synthetic polypeptide
DEEEIRTTNPVATEQYGSVSTDNMQNSEGNEF

SEQ ID NO: 29436 - protein, 33 aa, Artificial Sequence
  Description of Artificial Sequence: Synthetic polypeptide
DEEEIRTTNPVATEQYGSVSVSTNLQQGVNGEE

SEQ ID NO: 29437 - protein, 32 aa, Artificial Sequence
  Description of Artificial Sequence: Synthetic polypeptide
DEEEIRTTNPVATEQYGSVSTNNDQESGQNVE

SEQ ID NO: 29438 - protein, 33 aa, Artificial Sequence
  Description of Artificial Sequence: Synthetic polypeptide
DEEEIRTTNPVATEQYGSVSPTTNLQPVGNNEL

SEQ ID NO: 29439 - protein, 31 aa, Artificial Sequence
  Description of Artificial Sequence: Synthetic polypeptide
DEEEIRTTNPVATEQYGSVSTDNQNEGEEIR

SEQ ID NO: 29440 - protein, 30 aa, Artificial Sequence
  Description of Artificial Sequence: Synthetic polypeptide
DEEEIRTTNPVATEQYGSVSTDNQTEGLHM

SEQ ID NO: 29441 - protein, 31 aa, Artificial Sequence
  Description of Artificial Sequence: Synthetic polypeptide
DEEEIRTTNPVATEQYGSVSTDLQGEMEIRL

SEQ ID NO: 29442 - protein, 31 aa, Artificial Sequence
  Description of Artificial Sequence: Synthetic polypeptide
DEEEIRTTNPVATEQYGSVSTNNDQGQNHAS

SEQ ID NO: 29443 - protein, 32 aa, Artificial Sequence
  Description of Artificial Sequence: Synthetic polypeptide
DEEEIRTTNPVATEQYGSVSTNNDQISEGNEV

SEQ ID NO: 29444 - protein, 32 aa, Artificial Sequence
  Description of Artificial Sequence: Synthetic polypeptide
DEAEIRTTNPVATEQYGSVCSTVLQRSGQEER

SEQ ID NO: 29445 - protein, 29 aa, Artificial Sequence
  Description of Artificial Sequence: Synthetic peptide
DEDEIRTTNPVATEQYGTVTVTNLQPGDQ

SEQ ID NO: 29446 - protein, 30 aa, Artificial Sequence
  Description of Artificial Sequence: Synthetic polypeptide
DEECMRTTNPIAYEQYGEVSCTNMLQRGNR

SEQ ID NO: 29447 - protein, 28 aa, Artificial Sequence
  Description of Artificial Sequence: Synthetic peptide
DEASIATTNPLATEQWGSVSCNLQSGNR

SEQ ID NO: 29448 - protein, 33 aa, Artificial Sequence
  Description of Artificial Sequence: Synthetic polypeptide
DEEEIRTTNPVATEQYGSVSTDNTLGQEEGNNS

SEQ ID NO: 29449 - protein, 28 aa, Artificial Sequence
  Description of Artificial Sequence: Synthetic peptide
DEDEIRTTNPAATEQYGETSTNLQGGDS

SEQ ID NO: 29450 - protein, 31 aa, Artificial Sequence
  Description of Artificial Sequence: Synthetic polypeptide
DEEEIRTTNPVATEQYGSVSNDNGQGEGNNV

SEQ ID NO: 29451 - protein, 32 aa, Artificial Sequence
  Description of Artificial Sequence: Synthetic polypeptide
DEEEIRTTNPVATEQYGSVSQTNGQNRDVNEA

SEQ ID NO: 29452 - protein, 33 aa, Artificial Sequence
  Description of Artificial Sequence: Synthetic polypeptide
DEEEIRTTNPVATEQYGSVSPTTNLIQRNVNFE

SEQ ID NO: 29453 - protein, 32 aa, Artificial Sequence
  Description of Artificial Sequence: Synthetic polypeptide
DEEEIRTTNPVATEQYGSVSTYNLTEVGGNIQ

SEQ ID NO: 29454 - protein, 34 aa, Artificial Sequence
  Description of Artificial Sequence: Synthetic polypeptide
DEEEIRTTNPVATEQYGSVSTNNGLDQRMESNRD

SEQ ID NO: 29455 - protein, 32 aa, Artificial Sequence
  Description of Artificial Sequence: Synthetic polypeptide
DEEEIRTTNPVATEQYGSVSPTTNLIERGEDS

SEQ ID NO: 29456 - protein, 34 aa, Artificial Sequence
  Description of Artificial Sequence: Synthetic polypeptide
DEEEIRTTNPVATEQYGSVSTDNVELQRGGGNED

SEQ ID NO: 29457 - protein, 30 aa, Artificial Sequence
  Description of Artificial Sequence: Synthetic polypeptide
DEEEIRTTNPVATEQYGSVSTDLQEESSQI

SEQ ID NO: 29458 - protein, 31 aa, Artificial Sequence
  Description of Artificial Sequence: Synthetic polypeptide
DEEEIRTTNPVATEQYGSVSTNNGNGNGNGE

SEQ ID NO: 29459 - protein, 33 aa, Artificial Sequence
  Description of Artificial Sequence: Synthetic polypeptide
DEEEIRTTNPVATEQYGSVSTYNLSNQNGENIA

SEQ ID NO: 29460 - protein, 31 aa, Artificial Sequence
  Description of Artificial Sequence: Synthetic polypeptide
DEEEIRTTNPVATEQYGSVSVSVNLQGENIS

SEQ ID NO: 29461 - protein, 31 aa, Artificial Sequence
  Description of Artificial Sequence: Synthetic polypeptide
DEEEIRTTNPVATEQYGSVSVSVNLQGVNII

SEQ ID NO: 29462 - protein, 32 aa, Artificial Sequence
  Description of Artificial Sequence: Synthetic polypeptide
DEEEIRTTNPVATEQYGSVSTNNGQNDENNRQ

SEQ ID NO: 29463 - protein, 32 aa, Artificial Sequence
  Description of Artificial Sequence: Synthetic polypeptide
DEEEIRTTNPVATEQYGSVSVSVNLSQRVNIE

SEQ ID NO: 29464 - protein, 32 aa, Artificial Sequence
  Description of Artificial Sequence: Synthetic polypeptide
DEEEIRTTNPVATEQYGSVSPTTNLLQIGETV

SEQ ID NO: 29465 - protein, 31 aa, Artificial Sequence
  Description of Artificial Sequence: Synthetic polypeptide
DEEEIRTTNPVATEQYGSVSTNNDNRNGDEQ

SEQ ID NO: 29466 - protein, 33 aa, Artificial Sequence
  Description of Artificial Sequence: Synthetic polypeptide
DEEEIRTTNPVATEQYGSVSVSTNLQQGNNNQI

SEQ ID NO: 29467 - protein, 31 aa, Artificial Sequence
  Description of Artificial Sequence: Synthetic polypeptide
DEEEIRTTNPVATEQYGSVSPTTNLQPVTEL

SEQ ID NO: 29468 - protein, 32 aa, Artificial Sequence
  Description of Artificial Sequence: Synthetic polypeptide
DEEEIRTTNPVATEQYGSVSTNNDGQNDGNEN

SEQ ID NO: 29469 - protein, 32 aa, Artificial Sequence
  Description of Artificial Sequence: Synthetic polypeptide
DEEEIRTTNPVATEQYGSVSTNNDGQNEGGNE

SEQ ID NO: 29470 - protein, 30 aa, Artificial Sequence
  Description of Artificial Sequence: Synthetic polypeptide
DEEEIRTTNPVATEQYGSVSIVLQTFNSMQ

SEQ ID NO: 29471 - protein, 31 aa, Artificial Sequence
  Description of Artificial Sequence: Synthetic polypeptide
DEEEIRTTNPVATEQYGSVSNDDDLEQMGNS

SEQ ID NO: 29472 - protein, 28 aa, Artificial Sequence
  Description of Artificial Sequence: Synthetic peptide
DEECISTVNPVATEWYGSVSDNIERGNR

SEQ ID NO: 29473 - protein, 32 aa, Artificial Sequence
  Description of Artificial Sequence: Synthetic polypeptide
DEEEIRTTNPVATEQYGSVSTNLSQGNEVVEE

SEQ ID NO: 29474 - protein, 32 aa, Artificial Sequence
  Description of Artificial Sequence: Synthetic polypeptide
DEEEIRTTNPVATEQYGSVSITVNVEDQRGEN

SEQ ID NO: 29475 - protein, 32 aa, Artificial Sequence
  Description of Artificial Sequence: Synthetic polypeptide
DEEEIRTTNPVATEQYGSVSTDLQNIEGGNEF

SEQ ID NO: 29476 - protein, 30 aa, Artificial Sequence
  Description of Artificial Sequence: Synthetic polypeptide
DEEEIRTTNPVATEQYGSVSVDLQSLLNPQ

SEQ ID NO: 29477 - protein, 28 aa, Artificial Sequence
  Description of Artificial Sequence: Synthetic peptide
DEAPIATTNPVAYEPYGSVATNLQRGND

SEQ ID NO: 29478 - protein, 33 aa, Artificial Sequence
  Description of Artificial Sequence: Synthetic polypeptide
DEEEIRTTNPVATEQYGSVSPTTNLQRMGDLLV

SEQ ID NO: 29479 - protein, 32 aa, Artificial Sequence
  Description of Artificial Sequence: Synthetic polypeptide
DEEEIRTTNPVATEQYGSVSTNNDGQQGEGND

SEQ ID NO: 29480 - protein, 32 aa, Artificial Sequence
  Description of Artificial Sequence: Synthetic polypeptide
DEEEIRTTNPVATEQYGSVSTDLQLEIGNNNL

SEQ ID NO: 29481 - protein, 30 aa, Artificial Sequence
  Description of Artificial Sequence: Synthetic polypeptide
DEEEIRTTNPVATEQYGSVSTNNDNEDGDQ

SEQ ID NO: 29482 - protein, 32 aa, Artificial Sequence
  Description of Artificial Sequence: Synthetic polypeptide
DEEEIRTTNPVATEQYGSVSTDNNDGHRGNIG

SEQ ID NO: 29483 - protein, 32 aa, Artificial Sequence
  Description of Artificial Sequence: Synthetic polypeptide
DEEEIRTTNPVATEQYGSVSVSTNLEQGNNII

SEQ ID NO: 29484 - protein, 28 aa, Artificial Sequence
  Description of Artificial Sequence: Synthetic peptide
DEECLRTTNPTAYEQYGEVSTNLQHDNR

SEQ ID NO: 29485 - protein, 34 aa, Artificial Sequence
  Description of Artificial Sequence: Synthetic polypeptide
DEEEIRTTNPVATEQYGSVSFNNDLDQLRGENER

SEQ ID NO: 29486 - protein, 34 aa, Artificial Sequence
  Description of Artificial Sequence: Synthetic polypeptide
DEEEIRTTNPVATEQYGSVSITVNLEQRGQEVNS

SEQ ID NO: 29487 - protein, 32 aa, Artificial Sequence
  Description of Artificial Sequence: Synthetic polypeptide
DEEEIRTTNPVATEQYGSVSVSTNLQGNNNNI

SEQ ID NO: 29488 - protein, 31 aa, Artificial Sequence
  Description of Artificial Sequence: Synthetic polypeptide
DEEEIRTTNPVATEQYGSVSTDLQGTSIDRI

SEQ ID NO: 29489 - protein, 28 aa, Artificial Sequence
  Description of Artificial Sequence: Synthetic peptide
DEECISTVNPVATEPYGSVSDNLERVNR

SEQ ID NO: 29490 - protein, 32 aa, Artificial Sequence
  Description of Artificial Sequence: Synthetic polypeptide
DEEEIRTTNPVATEQYGSVSNDDNELTQGGND

SEQ ID NO: 29491 - protein, 32 aa, Artificial Sequence
  Description of Artificial Sequence: Synthetic polypeptide
DEEEIRTTNPVATEQYGSVSPTTNLQQMRDVI

SEQ ID NO: 29492 - protein, 33 aa, Artificial Sequence
  Description of Artificial Sequence: Synthetic polypeptide
DEEEIRTTNPVATEQYGSVSTDNNLQAGEGNNE

SEQ ID NO: 29493 - protein, 29 aa, Artificial Sequence
  Description of Artificial Sequence: Synthetic peptide
DEAEISTTNPVAYEPYGSVATNLQRGNDS

SEQ ID NO: 29494 - protein, 28 aa, Artificial Sequence
  Description of Artificial Sequence: Synthetic peptide
DEASIACTNPVATEQYGSVATNLERGND

SEQ ID NO: 29495 - protein, 31 aa, Artificial Sequence
  Description of Artificial Sequence: Synthetic polypeptide
DEEEIRTTNPVATEQYGSVSTDNNPQRVEQQ

SEQ ID NO: 29496 - protein, 33 aa, Artificial Sequence
  Description of Artificial Sequence: Synthetic polypeptide
DEEEIRTTNPVATEQYGSVSVSTNLQQGNNNNM

SEQ ID NO: 29497 - protein, 32 aa, Artificial Sequence
  Description of Artificial Sequence: Synthetic polypeptide
DEEEIRTTNPVATEQYGSVSNANLEEMRGENY

SEQ ID NO: 29498 - protein, 32 aa, Artificial Sequence
  Description of Artificial Sequence: Synthetic polypeptide
DEEEIRTTNPVATEQYGSVSTDLQRMMENIID

SEQ ID NO: 29499 - protein, 33 aa, Artificial Sequence
  Description of Artificial Sequence: Synthetic polypeptide
DEEEIRTTNPVATEQYGSVSPTVNLQRENENEE

SEQ ID NO: 29500 - protein, 32 aa, Artificial Sequence
  Description of Artificial Sequence: Synthetic polypeptide
DEEEIRTTNPVATEQYGSVSTNMQQGVGNEDG

SEQ ID NO: 29501 - protein, 32 aa, Artificial Sequence
  Description of Artificial Sequence: Synthetic polypeptide
DEEEIRTTNPVATEQYGSVSTDLVQGGQNIGN

SEQ ID NO: 29502 - protein, 33 aa, Artificial Sequence
  Description of Artificial Sequence: Synthetic polypeptide
DEEEIRTTNPVATEQYGSVSQGTNLQVMVGNDN

SEQ ID NO: 29503 - protein, 33 aa, Artificial Sequence
  Description of Artificial Sequence: Synthetic polypeptide
DEEEIRTTNPVATEQYGSVSTDNGLGQGGENTE

SEQ ID NO: 29504 - protein, 32 aa, Artificial Sequence
  Description of Artificial Sequence: Synthetic polypeptide
DEEEIRTTNPVATEQYGSVSTDNGMEQGEGNT

SEQ ID NO: 29505 - protein, 30 aa, Artificial Sequence
  Description of Artificial Sequence: Synthetic polypeptide
DEEEIRTTNPVATEQYGSVSTDLVNGSLQE

SEQ ID NO: 29506 - protein, 32 aa, Artificial Sequence
  Description of Artificial Sequence: Synthetic polypeptide
DEEEIRTTNPVATEQYGSVSTNLVAEGENLEL

SEQ ID NO: 29507 - protein, 31 aa, Artificial Sequence
  Description of Artificial Sequence: Synthetic polypeptide
DEEEIRTTNPVATEQYGSVSATVNGEETGNV

SEQ ID NO: 29508 - protein, 28 aa, Artificial Sequence
  Description of Artificial Sequence: Synthetic peptide
DEECIRCTNPVATEQYGSVSWNPQGGEL

SEQ ID NO: 29509 - protein, 32 aa, Artificial Sequence
  Description of Artificial Sequence: Synthetic polypeptide
DEEEIRTTNPVATEQYGSVSPVFNLQRQNNLL

SEQ ID NO: 29510 - protein, 33 aa, Artificial Sequence
  Description of Artificial Sequence: Synthetic polypeptide
DEEEIRTTNPVATEQYGSVSPVFNGEQRGNERN

SEQ ID NO: 29511 - protein, 32 aa, Artificial Sequence
  Description of Artificial Sequence: Synthetic polypeptide
DEEEIRTTNPVATEQYGSVSTDNGNQNEGGNE

SEQ ID NO: 29512 - protein, 30 aa, Artificial Sequence
  Description of Artificial Sequence: Synthetic polypeptide
DEECIRCTNPVATEQYGSVSWNPQRGSNLV

SEQ ID NO: 29513 - protein, 33 aa, Artificial Sequence
  Description of Artificial Sequence: Synthetic polypeptide
DEEEIRTTNPVATEQYGSVSPVENSLQRPENRQ

SEQ ID NO: 29514 - protein, 31 aa, Artificial Sequence
  Description of Artificial Sequence: Synthetic polypeptide
DEEEIRTTNPVATEQYGSVSTDMEQRSTQNV

SEQ ID NO: 29515 - protein, 32 aa, Artificial Sequence
  Description of Artificial Sequence: Synthetic polypeptide
DEEEIRTTNPVATEQYGSVSTDNGQGNGENED

SEQ ID NO: 29516 - protein, 31 aa, Artificial Sequence
  Description of Artificial Sequence: Synthetic polypeptide
DEEEIRTTNPVATEQYGSVSTDLTQNGSDDM

SEQ ID NO: 29517 - protein, 32 aa, Artificial Sequence
  Description of Artificial Sequence: Synthetic polypeptide
DEEEIRTTNPVATEQYGSVSVNLQRPILNVEL

SEQ ID NO: 29518 - protein, 29 aa, Artificial Sequence
  Description of Artificial Sequence: Synthetic peptide
DEEEIRTTNPVATEQYGSVSPVDLENGGQ

SEQ ID NO: 29519 - protein, 32 aa, Artificial Sequence
  Description of Artificial Sequence: Synthetic polypeptide
DEEEIRTTNPVATEQYGSVSTDNGQIGEQGND

SEQ ID NO: 29520 - protein, 31 aa, Artificial Sequence
  Description of Artificial Sequence: Synthetic polypeptide
DEEEIRTTNPVATEQYGSVSTNLTVVGVAQE

SEQ ID NO: 29521 - protein, 31 aa, Artificial Sequence
  Description of Artificial Sequence: Synthetic polypeptide
DEEEIRTTNPVATEQYGSVSFTNDNQGEGSD

SEQ ID NO: 29522 - protein, 31 aa, Artificial Sequence
  Description of Artificial Sequence: Synthetic polypeptide
DEEEIRTTNPVATEQYGSVSATYTSERGNIE

SEQ ID NO: 29523 - protein, 31 aa, Artificial Sequence
  Description of Artificial Sequence: Synthetic polypeptide
DEEEIRTTNPVATEQYGSVSMTNDQRNDQFM

SEQ ID NO: 29524 - protein, 32 aa, Artificial Sequence
  Description of Artificial Sequence: Synthetic polypeptide
DEEEIRTTNPVATEQYGSVSPTYTLDRGEDIR

SEQ ID NO: 29525 - protein, 32 aa, Artificial Sequence
  Description of Artificial Sequence: Synthetic polypeptide
DEEEIRTTNPVATEQYGSVSTNLTSGMGGNIN

SEQ ID NO: 29526 - protein, 31 aa, Artificial Sequence
  Description of Artificial Sequence: Synthetic polypeptide
DEEEIRTTNPVATEQYGSVSPTYQQRELQLR

SEQ ID NO: 29527 - protein, 33 aa, Artificial Sequence
  Description of Artificial Sequence: Synthetic polypeptide
DEEEIRTTNPVATEQYGSVSPTYNLQQRTNVLQ

SEQ ID NO: 29528 - protein, 30 aa, Artificial Sequence
  Description of Artificial Sequence: Synthetic polypeptide
DEEEIRTTNPVATEQYGSVSMTNGGEPGPF

SEQ ID NO: 29529 - protein, 32 aa, Artificial Sequence
  Description of Artificial Sequence: Synthetic polypeptide
DEEEIRTTNPVATEQYGSVSVMNDLQRNEENT

SEQ ID NO: 29530 - protein, 33 aa, Artificial Sequence
  Description of Artificial Sequence: Synthetic polypeptide
DEEEIRTTNPVATEQYGSVSTDNGLGQEEGNNQ

SEQ ID NO: 29531 - protein, 31 aa, Artificial Sequence
  Description of Artificial Sequence: Synthetic polypeptide
DEEEIRTTNPVATEQYGSVSVMNQRNGDNDM

SEQ ID NO: 29532 - protein, 29 aa, Artificial Sequence
  Description of Artificial Sequence: Synthetic peptide
DEECIRCTNPVATEQYGSVSWNIERGNNQ

SEQ ID NO: 29533 - protein, 32 aa, Artificial Sequence
  Description of Artificial Sequence: Synthetic polypeptide
DEEEIRTTNPVATEQYGSVSTDNDLTRDLEMR

SEQ ID NO: 29534 - protein, 30 aa, Artificial Sequence
  Description of Artificial Sequence: Synthetic polypeptide
DEEEIRTTNPVATEQYGSVSPWDLERNEQR

SEQ ID NO: 29535 - protein, 31 aa, Artificial Sequence
  Description of Artificial Sequence: Synthetic polypeptide
DEEEIRTTNPVATEQYGSVSMTHHQRGQEQE

SEQ ID NO: 29536 - protein, 32 aa, Artificial Sequence
  Description of Artificial Sequence: Synthetic polypeptide
DEEEIRTTNPVATEQYGSVSTDNEQTGGNGNE

SEQ ID NO: 29537 - protein, 31 aa, Artificial Sequence
  Description of Artificial Sequence: Synthetic polypeptide
DEEEIRTTNPVATEQYGSVSPVTNLERMEES

SEQ ID NO: 29538 - protein, 32 aa, Artificial Sequence
  Description of Artificial Sequence: Synthetic polypeptide
DEEEIRTTNPVATEQYGSVSTDNDLQMTGSEE

SEQ ID NO: 29539 - protein, 28 aa, Artificial Sequence
  Description of Artificial Sequence: Synthetic peptide
DEECIACTNPVAYEQYGSVSVNGQRGNL

SEQ ID NO: 29540 - protein, 31 aa, Artificial Sequence
  Description of Artificial Sequence: Synthetic polypeptide
DEEEIRTTNPVATEQYGSVSPWNLQDGLEIA

SEQ ID NO: 29541 - protein, 30 aa, Artificial Sequence
  Description of Artificial Sequence: Synthetic polypeptide
DEECIRCTNPVATEQYGSVSWNESDQRGNA

SEQ ID NO: 29542 - protein, 29 aa, Artificial Sequence
  Description of Artificial Sequence: Synthetic peptide
DEECIRCTNPVATEQYGSVSWNFERGNEN

SEQ ID NO: 29543 - protein, 29 aa, Artificial Sequence
  Description of Artificial Sequence: Synthetic peptide
DEECIRCTNPVATEQYGSVSWNFERGNFQ

SEQ ID NO: 29544 - protein, 30 aa, Artificial Sequence
  Description of Artificial Sequence: Synthetic polypeptide
DEECIRCTNPVATEQYGSVSWNEGQERGNQ

SEQ ID NO: 29545 - protein, 29 aa, Artificial Sequence
  Description of Artificial Sequence: Synthetic peptide
DEECIRCTNPVATEQYGSVSWNFQEFGNQ

SEQ ID NO: 29546 - protein, 30 aa, Artificial Sequence
  Description of Artificial Sequence: Synthetic polypeptide
DEECIRCTNPVATEQYGSVSWNFQRGNQQE

SEQ ID NO: 29547 - protein, 30 aa, Artificial Sequence
  Description of Artificial Sequence: Synthetic polypeptide
DEEEIRTTNPVATEQYGSVSMTNDERNEDM

SEQ ID NO: 29548 - protein, 29 aa, Artificial Sequence
  Description of Artificial Sequence: Synthetic peptide
DEECIACTNPVATEQYGSVSNNDQRDGNL

SEQ ID NO: 29549 - protein, 31 aa, Artificial Sequence
  Description of Artificial Sequence: Synthetic polypeptide
DEEEIRTTNPVATEQYGSVSVNLNTRGDDID

SEQ ID NO: 29550 - protein, 33 aa, Artificial Sequence
  Description of Artificial Sequence: Synthetic polypeptide
DEEEIRTTNPVATEQYGSVSTDMNLQERTDNID

SEQ ID NO: 29551 - protein, 29 aa, Artificial Sequence
  Description of Artificial Sequence: Synthetic peptide
DEECIRCTNPVATEQYGSVSWNHQGGNNL

SEQ ID NO: 29552 - protein, 32 aa, Artificial Sequence
  Description of Artificial Sequence: Synthetic polypeptide
DEEEIRTTNPVATEQYGSVSTDNGLEEMGNGG

SEQ ID NO: 29553 - protein, 31 aa, Artificial Sequence
  Description of Artificial Sequence: Synthetic polypeptide
DEEEIRTTNPVATEQYGSVSVNLNTRGDDSQ

SEQ ID NO: 29554 - protein, 32 aa, Artificial Sequence
  Description of Artificial Sequence: Synthetic polypeptide
DEEEIRTTNPVATEQYGSVSTNLVQDGMDQDS

SEQ ID NO: 29555 - protein, 33 aa, Artificial Sequence
  Description of Artificial Sequence: Synthetic polypeptide
DEEEIRTTNPVATEQYGSVSTNLVQDEGENMEM

SEQ ID NO: 29556 - protein, 32 aa, Artificial Sequence
  Description of Artificial Sequence: Synthetic polypeptide
DEEEIRTTNPVATEQYGSVSTDMNLEQTLVNV

SEQ ID NO: 29557 - protein, 32 aa, Artificial Sequence
  Description of Artificial Sequence: Synthetic polypeptide
DEEEIRTTNPVATEQYGSVSPYNLNQRGEDQD

SEQ ID NO: 29558 - protein, 31 aa, Artificial Sequence
  Description of Artificial Sequence: Synthetic polypeptide
DEEEIRTTNPVATEQYGSVSVNLQHTVTENQ

SEQ ID NO: 29559 - protein, 33 aa, Artificial Sequence
  Description of Artificial Sequence: Synthetic polypeptide
DEEEIRTTNPVATEQYGSVSATPNLQPRGVFVF

SEQ ID NO: 29560 - protein, 28 aa, Artificial Sequence
  Description of Artificial Sequence: Synthetic peptide
DEECIACTNPVATEQYGEVSANQQRGNL

SEQ ID NO: 29561 - protein, 31 aa, Artificial Sequence
  Description of Artificial Sequence: Synthetic polypeptide
DEEEIRTTNPVATEQYGSVSQGNLQFFNVEN

SEQ ID NO: 29562 - protein, 33 aa, Artificial Sequence
  Description of Artificial Sequence: Synthetic polypeptide
DEEEIRTTNPVATEQYGSVSQGTNLQVQVDNDR

SEQ ID NO: 29563 - protein, 31 aa, Artificial Sequence
  Description of Artificial Sequence: Synthetic polypeptide
DEEEIRTTNPVATEQYGSVSVNLVSVGENSD

SEQ ID NO: 29564 - protein, 32 aa, Artificial Sequence
  Description of Artificial Sequence: Synthetic polypeptide
DEEEIRTTNPVATEQYGSVSTDNGTTRDNTQR

SEQ ID NO: 29565 - protein, 33 aa, Artificial Sequence
  Description of Artificial Sequence: Synthetic polypeptide
DEEEIRTTNPVATEQYGSVSVNNLDQRMDENRS

SEQ ID NO: 29566 - protein, 31 aa, Artificial Sequence
  Description of Artificial Sequence: Synthetic polypeptide
DEEEIRTTNPVATEQYGSVSVSANLQREVEI

SEQ ID NO: 29567 - protein, 32 aa, Artificial Sequence
  Description of Artificial Sequence: Synthetic polypeptide
DEEEIRTTNPVATEQYGSVSTNLTQNEGSQDM

SEQ ID NO: 29568 - protein, 31 aa, Artificial Sequence
  Description of Artificial Sequence: Synthetic polypeptide
DEEEIRTTNPVATEQYGSVSMTNLPHGMEVV

SEQ ID NO: 29569 - protein, 30 aa, Artificial Sequence
  Description of Artificial Sequence: Synthetic polypeptide
DEAEIRTTNPVATEQYGSVNSVNDQNQGNQ

SEQ ID NO: 29570 - protein, 31 aa, Artificial Sequence
  Description of Artificial Sequence: Synthetic polypeptide
DEEEIRTTNPVATEQYGSVSQNLQNNPDSRS

SEQ ID NO: 29571 - protein, 32 aa, Artificial Sequence
  Description of Artificial Sequence: Synthetic polypeptide
DEEEIRTTNPVATEQYGSVSTNLTNGMGGNTN

SEQ ID NO: 29572 - protein, 29 aa, Artificial Sequence
  Description of Artificial Sequence: Synthetic peptide
DEECIRTTNPVAYEQYDQVSTINVQRGNQ

SEQ ID NO: 29573 - protein, 31 aa, Artificial Sequence
  Description of Artificial Sequence: Synthetic polypeptide
DEEEIRTTNPVATEQYGSVSTNLTGSGSDQV

SEQ ID NO: 29574 - protein, 31 aa, Artificial Sequence
  Description of Artificial Sequence: Synthetic polypeptide
DEEEIRTTNPVATEQYGSVSVSFNEQDGVNI

SEQ ID NO: 29575 - protein, 31 aa, Artificial Sequence
  Description of Artificial Sequence: Synthetic polypeptide
DEEEIRTTNPVATEQYGSVSTDLQSLEDNPQ

SEQ ID NO: 29576 - protein, 31 aa, Artificial Sequence
  Description of Artificial Sequence: Synthetic polypeptide
DEEEIRTTNPVATEQYGSVSVSFNLDQEHNI

SEQ ID NO: 29577 - protein, 32 aa, Artificial Sequence
  Description of Artificial Sequence: Synthetic polypeptide
DEEEIRTTNPVATEQYGSVSTNLTFNDGGNEN

SEQ ID NO: 29578 - protein, 30 aa, Artificial Sequence
  Description of Artificial Sequence: Synthetic polypeptide
DEEEIRTTNPVATEQYGSVSVGLSANGNTN

SEQ ID NO: 29579 - protein, 33 aa, Artificial Sequence
  Description of Artificial Sequence: Synthetic polypeptide
DEEEIRTTNPVATEQYGSVSPTVSELQPRGNLL

SEQ ID NO: 29580 - protein, 28 aa, Artificial Sequence
  Description of Artificial Sequence: Synthetic peptide
DEAEIYTTNPVATEQYGCVSTNHTYGNQ

SEQ ID NO: 29581 - protein, 29 aa, Artificial Sequence
  Description of Artificial Sequence: Synthetic peptide
DEAEIYTTNPVATEQYGSVCSTELIYGNQ

SEQ ID NO: 29582 - protein, 32 aa, Artificial Sequence
  Description of Artificial Sequence: Synthetic polypeptide
DEEEIRTTNPVATEQYGSVSVSFNLPQRVNIA

SEQ ID NO: 29583 - protein, 31 aa, Artificial Sequence
  Description of Artificial Sequence: Synthetic polypeptide
DEEEIRTTNPVATEQYGSVSVSFNLQDDPNI

SEQ ID NO: 29584 - protein, 31 aa, Artificial Sequence
  Description of Artificial Sequence: Synthetic polypeptide
DEEEIRTTNPVATEQYGSVSMTDDQLSGEDR

SEQ ID NO: 29585 - protein, 32 aa, Artificial Sequence
  Description of Artificial Sequence: Synthetic polypeptide
DEEEIRTTNPVATEQYGSVSVSFNLQERDNDI

SEQ ID NO: 29586 - protein, 29 aa, Artificial Sequence
  Description of Artificial Sequence: Synthetic peptide
DEECIATTNPVATEQYGCVSTNHSQFGND

SEQ ID NO: 29587 - protein, 31 aa, Artificial Sequence
  Description of Artificial Sequence: Synthetic polypeptide
DEEEIRTTNPVATEQYGSVSTDLQRSMEDEL

SEQ ID NO: 29588 - protein, 32 aa, Artificial Sequence
  Description of Artificial Sequence: Synthetic polypeptide
DEDEICTTNPVATEQYGSVATNLQRPGENDRP

SEQ ID NO: 29589 - protein, 28 aa, Artificial Sequence
  Description of Artificial Sequence: Synthetic peptide
DEECLRTTNPIAYEQYGEVATNLQHGNR

SEQ ID NO: 29590 - protein, 32 aa, Artificial Sequence
  Description of Artificial Sequence: Synthetic polypeptide
DEEEIRTTNPVATEQYGSVSATGLQRMLIERP

SEQ ID NO: 29591 - protein, 30 aa, Artificial Sequence
  Description of Artificial Sequence: Synthetic polypeptide
DEDEICTTNPVATEQYGSVATNLQERGDQD

SEQ ID NO: 29592 - protein, 30 aa, Artificial Sequence
  Description of Artificial Sequence: Synthetic polypeptide
DEDEICTTNPVATEQYGSVATNLERGDNEM

SEQ ID NO: 29593 - protein, 32 aa, Artificial Sequence
  Description of Artificial Sequence: Synthetic polypeptide
DEEEIRTTNPVATEQYGSVSMSNLQNFGSDRT

SEQ ID NO: 29594 - protein, 28 aa, Artificial Sequence
  Description of Artificial Sequence: Synthetic peptide
DEECIYTVNPVATEGYGSVSWNLERGNQ

SEQ ID NO: 29595 - protein, 31 aa, Artificial Sequence
  Description of Artificial Sequence: Synthetic polypeptide
DEEEIRTTNPVATEQYGSVSPTWLEIRSQNQ

SEQ ID NO: 29596 - protein, 32 aa, Artificial Sequence
  Description of Artificial Sequence: Synthetic polypeptide
DEAEIRTTNPVATEQYGSVCSTGNLQHFGSDR

SEQ ID NO: 29597 - protein, 33 aa, Artificial Sequence
  Description of Artificial Sequence: Synthetic polypeptide
DEEEIRTTNPVATEQYGSVSPTWLMQRESQNRS

SEQ ID NO: 29598 - protein, 33 aa, Artificial Sequence
  Description of Artificial Sequence: Synthetic polypeptide
DEEEIRTTNPVATEQYGSVSTDNLNQVEGQNQI

SEQ ID NO: 29599 - protein, 30 aa, Artificial Sequence
  Description of Artificial Sequence: Synthetic polypeptide
DEECIRCTNPVATEQYGSVVSANFSQRGNL

SEQ ID NO: 29600 - protein, 32 aa, Artificial Sequence
  Description of Artificial Sequence: Synthetic polypeptide
DEEEIRTTNPVATEQYGSVSFTMGLNQAQNIR

SEQ ID NO: 29601 - protein, 29 aa, Artificial Sequence
  Description of Artificial Sequence: Synthetic peptide
DEDEICTVNPVATEQYGSVSTNELDEGNH

SEQ ID NO: 29602 - protein, 33 aa, Artificial Sequence
  Description of Artificial Sequence: Synthetic polypeptide
DEEEIRTTNPVATEQYGSVSPTYNLEQGFGDRT

SEQ ID NO: 29603 - protein, 32 aa, Artificial Sequence
  Description of Artificial Sequence: Synthetic polypeptide
DEEEIRTTNPVATEQYGSVSPTYNLEGLNDRE

SEQ ID NO: 29604 - protein, 34 aa, Artificial Sequence
  Description of Artificial Sequence: Synthetic polypeptide
DEEEIRTTNPVATEQYGSVSPTYMLQRIGEENRM

SEQ ID NO: 29605 - protein, 32 aa, Artificial Sequence
  Description of Artificial Sequence: Synthetic polypeptide
DEEEIRTTNPVATEQYGSVSTDNGVQEGGNDD

SEQ ID NO: 29606 - protein, 32 aa, Artificial Sequence
  Description of Artificial Sequence: Synthetic polypeptide
DEEEIRTTNPVATEQYGSVSTNMHPQERDMIR

SEQ ID NO: 29607 - protein, 33 aa, Artificial Sequence
  Description of Artificial Sequence: Synthetic polypeptide
DEEEIRTTNPVATEQYGSVSPTYLQQARGIVRD

SEQ ID NO: 29608 - protein, 30 aa, Artificial Sequence
  Description of Artificial Sequence: Synthetic polypeptide
DEEEIRTTNPVATEQYGSVSVNNLQNVDEE

SEQ ID NO: 29609 - protein, 33 aa, Artificial Sequence
  Description of Artificial Sequence: Synthetic polypeptide
DEEEIRTTNPVATEQYGSVSTDNLDQEEGNGNS

SEQ ID NO: 29610 - protein, 33 aa, Artificial Sequence
  Description of Artificial Sequence: Synthetic polypeptide
DEEEIRTTNPVATEQYGSVSTDNLDQEVGNNQL

SEQ ID NO: 29611 - protein, 31 aa, Artificial Sequence
  Description of Artificial Sequence: Synthetic polypeptide
DEEEIRTTNPVATEQYGSVSVNNTSQDGGQR

SEQ ID NO: 29612 - protein, 32 aa, Artificial Sequence
  Description of Artificial Sequence: Synthetic polypeptide
DEEEIRTTNPVATEQYGSVSTDNLDQGEPNNP

SEQ ID NO: 29613 - protein, 31 aa, Artificial Sequence
  Description of Artificial Sequence: Synthetic polypeptide
DEEEIRTTNPVATEQYGSVSAVVHIQRGIER

SEQ ID NO: 29614 - protein, 30 aa, Artificial Sequence
  Description of Artificial Sequence: Synthetic polypeptide
DEEEIRTTNPVATEQYGSVSMTDLERIDFD

SEQ ID NO: 29615 - protein, 32 aa, Artificial Sequence
  Description of Artificial Sequence: Synthetic polypeptide
DEEEIRTTNPVATEQYGSVSQLNLQEVVDNDR

SEQ ID NO: 29616 - protein, 32 aa, Artificial Sequence
  Description of Artificial Sequence: Synthetic polypeptide
DEEEIRTTNPVATEQYGSVSTDLQVRTSSIRI

SEQ ID NO: 29617 - protein, 31 aa, Artificial Sequence
  Description of Artificial Sequence: Synthetic polypeptide
DEEEIRTTNPVATEQYGSVSCAGNGGQRGDF

SEQ ID NO: 29618 - protein, 32 aa, Artificial Sequence
  Description of Artificial Sequence: Synthetic polypeptide
DEEEIRTTNPVATEQYGSVSMTNLENMMMNRY

SEQ ID NO: 29619 - protein, 30 aa, Artificial Sequence
  Description of Artificial Sequence: Synthetic polypeptide
DEEEIRTTNPVATEQYGSVSVPNAERSGED

SEQ ID NO: 29620 - protein, 33 aa, Artificial Sequence
  Description of Artificial Sequence: Synthetic polypeptide
DEEEIRTTNPVATEQYGSVSMTNLEQQTGNATV

SEQ ID NO: 29621 - protein, 31 aa, Artificial Sequence
  Description of Artificial Sequence: Synthetic polypeptide
DEEEIRTTNPVATEQYGSVSMTDDQTNNDRM

SEQ ID NO: 29622 - protein, 32 aa, Artificial Sequence
  Description of Artificial Sequence: Synthetic polypeptide
DEEEIRTTNPVATEQYGSVSVPNLNTRNGDDR

SEQ ID NO: 29623 - protein, 32 aa, Artificial Sequence
  Description of Artificial Sequence: Synthetic polypeptide
DEEEIRTTNPVATEQYGSVSVPNLQRTGEQDF

SEQ ID NO: 29624 - protein, 31 aa, Artificial Sequence
  Description of Artificial Sequence: Synthetic polypeptide
DEEEIRTTNPVATEQYGSVSMTNLETNGPEE

SEQ ID NO: 29625 - protein, 30 aa, Artificial Sequence
  Description of Artificial Sequence: Synthetic polypeptide
DEEEIRTTNPVATEQYGSVSVIELQQGSVE

SEQ ID NO: 29626 - protein, 32 aa, Artificial Sequence
  Description of Artificial Sequence: Synthetic polypeptide
DEEEIRTTNPVATEQYGSVSATNLPVVVLNRT

SEQ ID NO: 29627 - protein, 32 aa, Artificial Sequence
  Description of Artificial Sequence: Synthetic polypeptide
DEEEIRTTNPVATEQYGSVSVQNLQANGIVMR

SEQ ID NO: 29628 - protein, 33 aa, Artificial Sequence
  Description of Artificial Sequence: Synthetic polypeptide
DEEEIRTTNPVATEQYGSVSPTWLWQPRSQNRE

SEQ ID NO: 29629 - protein, 30 aa, Artificial Sequence
  Description of Artificial Sequence: Synthetic polypeptide
DEAEIRTTNPVATEQYGSVSPLVQDGNERD

SEQ ID NO: 29630 - protein, 32 aa, Artificial Sequence
  Description of Artificial Sequence: Synthetic polypeptide
DEEEIRTTNPVATEQYGSVSPTTNLERNQNED

SEQ ID NO: 29631 - protein, 31 aa, Artificial Sequence
  Description of Artificial Sequence: Synthetic polypeptide
DEDEIRTTNPVATEQYGTVTSTNLQQGNDEN

SEQ ID NO: 29632 - protein, 31 aa, Artificial Sequence
  Description of Artificial Sequence: Synthetic polypeptide
DEAEIRTTNPVATEQYGSVATNLTREGPNDQ

SEQ ID NO: 29633 - protein, 31 aa, Artificial Sequence
  Description of Artificial Sequence: Synthetic polypeptide
DEDEIRTTNPVATERYGSVSTNLNQGEGNSD

SEQ ID NO: 29634 - protein, 31 aa, Artificial Sequence
  Description of Artificial Sequence: Synthetic polypeptide
DEEEIRTTNPVATEQYGSVSTDLDQGNNFEG

SEQ ID NO: 29635 - protein, 31 aa, Artificial Sequence
  Description of Artificial Sequence: Synthetic polypeptide
DEDEIRTTNPVATESWGSVSTNLQGEGDNTR

SEQ ID NO: 29636 - protein, 31 aa, Artificial Sequence
  Description of Artificial Sequence: Synthetic polypeptide
DEDEIRTTNPVATESWGSVSTNLQGNMGDNR

SEQ ID NO: 29637 - protein, 32 aa, Artificial Sequence
  Description of Artificial Sequence: Synthetic polypeptide
DEEEIRTTNPVATEQYGSVSQTNLQPQGQMQL

SEQ ID NO: 29638 - protein, 32 aa, Artificial Sequence
  Description of Artificial Sequence: Synthetic polypeptide
DEEEIRTTNPVATEQYGSVSTDLDIRNGENSG

SEQ ID NO: 29639 - protein, 31 aa, Artificial Sequence
  Description of Artificial Sequence: Synthetic polypeptide
DEEEIRTTNPVATEQYGSVSTEDLESGNNDH

SEQ ID NO: 29640 - protein, 32 aa, Artificial Sequence
  Description of Artificial Sequence: Synthetic polypeptide
DEEEIRTTNPVATEQYGSVSTEDLQEHFNSNR

SEQ ID NO: 29641 - protein, 33 aa, Artificial Sequence
  Description of Artificial Sequence: Synthetic polypeptide
DEEEIRTTNPVATEQYGSVSQTNLQPTGEMNLA

SEQ ID NO: 29642 - protein, 31 aa, Artificial Sequence
  Description of Artificial Sequence: Synthetic polypeptide
DEDEIRTTNPVATESWGSVSTNLQLGGDNNR

SEQ ID NO: 29643 - protein, 32 aa, Artificial Sequence
  Description of Artificial Sequence: Synthetic polypeptide
DEEEIRTTNPVATEQYGSVSQTNLQQGLFLMD

SEQ ID NO: 29644 - protein, 32 aa, Artificial Sequence
  Description of Artificial Sequence: Synthetic polypeptide
DEEEIRTTNPVATEQYGSVSTYNLFNEMGGNV

SEQ ID NO: 29645 - protein, 32 aa, Artificial Sequence
  Description of Artificial Sequence: Synthetic polypeptide
DEEEIRTTNPVATEQYGSVSQTNLQPNDENVL

SEQ ID NO: 29646 - protein, 32 aa, Artificial Sequence
  Description of Artificial Sequence: Synthetic polypeptide
DEEEIRTTNPVATEQYGSVSQTNLQQHEVSMR

SEQ ID NO: 29647 - protein, 30 aa, Artificial Sequence
  Description of Artificial Sequence: Synthetic polypeptide
DEAEIRTTNPVATEQYGSVSHDNLQGTGDE

SEQ ID NO: 29648 - protein, 32 aa, Artificial Sequence
  Description of Artificial Sequence: Synthetic polypeptide
DEEEIRTTNPVATEQYGSVSTDKHQERSMNIR

SEQ ID NO: 29649 - protein, 31 aa, Artificial Sequence
  Description of Artificial Sequence: Synthetic polypeptide
DEEEIRTTNPVATEQYGSVSNMNEQVGNIFE

SEQ ID NO: 29650 - protein, 31 aa, Artificial Sequence
  Description of Artificial Sequence: Synthetic polypeptide
DEEEIRTTNPVATEQYGSVSTEDQFFNSNRE

SEQ ID NO: 29651 - protein, 31 aa, Artificial Sequence
  Description of Artificial Sequence: Synthetic polypeptide
DEDEIRTTNPCATEQYGEVSTNLQGDGGMNR

SEQ ID NO: 29652 - protein, 31 aa, Artificial Sequence
  Description of Artificial Sequence: Synthetic polypeptide
DEEEIRTTNPVATEQYGSVSTEEHQFGSNQA

SEQ ID NO: 29653 - protein, 30 aa, Artificial Sequence
  Description of Artificial Sequence: Synthetic polypeptide
DEDEIRTTNPCATEQYGSVCGTNLQDAGNA

SEQ ID NO: 29654 - protein, 31 aa, Artificial Sequence
  Description of Artificial Sequence: Synthetic polypeptide
DEEEIRTTNPVATEQYGSVSTDILQRSTDDD

SEQ ID NO: 29655 - protein, 32 aa, Artificial Sequence
  Description of Artificial Sequence: Synthetic polypeptide
DEAEIRTTNPVATEQYGSVATNLQRGNPEGDD

SEQ ID NO: 29656 - protein, 32 aa, Artificial Sequence
  Description of Artificial Sequence: Synthetic polypeptide
DEEEIRTTNPVATEQYGSVSTDILQFSTNDIR

SEQ ID NO: 29657 - protein, 31 aa, Artificial Sequence
  Description of Artificial Sequence: Synthetic polypeptide
DEEEIRTTNPVATEQYGSVSTEEHQRGSVQS

SEQ ID NO: 29658 - protein, 29 aa, Artificial Sequence
  Description of Artificial Sequence: Synthetic peptide
DEEEIRTTNPVATEQYGSVSLLLNAEQER

SEQ ID NO: 29659 - protein, 32 aa, Artificial Sequence
  Description of Artificial Sequence: Synthetic polypeptide
DEDEIRTTNPCATEQYGSVSTGNLQGDMGNRD

SEQ ID NO: 29660 - protein, 31 aa, Artificial Sequence
  Description of Artificial Sequence: Synthetic polypeptide
DEEEIRTTNPVATEQYGSVSTNLQSVPEISS

SEQ ID NO: 29661 - protein, 30 aa, Artificial Sequence
  Description of Artificial Sequence: Synthetic polypeptide
DEEEIRTTNPVATEQYGSVSLLLDRQEERD

SEQ ID NO: 29662 - protein, 32 aa, Artificial Sequence
  Description of Artificial Sequence: Synthetic polypeptide
DEEEIRTTNPVATEQYGSVSTYNLGNIENGNG

SEQ ID NO: 29663 - protein, 30 aa, Artificial Sequence
  Description of Artificial Sequence: Synthetic polypeptide
DEEEIRTTNPVATEQYGSVSTDLDQQDDEH

SEQ ID NO: 29664 - protein, 30 aa, Artificial Sequence
  Description of Artificial Sequence: Synthetic polypeptide
DEECIRTTNPVAYEQYGCVCSTINDQRGNV

SEQ ID NO: 29665 - protein, 31 aa, Artificial Sequence
  Description of Artificial Sequence: Synthetic polypeptide
DEEEIRTTNPVATEQYGSVSFLDLQRDGSDG

SEQ ID NO: 29666 - protein, 32 aa, Artificial Sequence
  Description of Artificial Sequence: Synthetic polypeptide
DEEEIRTTNPVATEQYGSVSTYNLNGFNGGNV

SEQ ID NO: 29667 - protein, 30 aa, Artificial Sequence
  Description of Artificial Sequence: Synthetic polypeptide
DEAVICTTNPVATEQDGSVSTDELQRGTNR

SEQ ID NO: 29668 - protein, 29 aa, Artificial Sequence
  Description of Artificial Sequence: Synthetic peptide
DEECSRTTNPIAYEQYGCVSTELQRFGNR

SEQ ID NO: 29669 - protein, 28 aa, Artificial Sequence
  Description of Artificial Sequence: Synthetic peptide
DEECSRTTNPIAYEQYGEVATNLQRGNF

SEQ ID NO: 29670 - protein, 30 aa, Artificial Sequence
  Description of Artificial Sequence: Synthetic polypeptide
DEEEIRTTNPVATEQYGSVSPTPLQQDEVE

SEQ ID NO: 29671 - protein, 33 aa, Artificial Sequence
  Description of Artificial Sequence: Synthetic polypeptide
DEEEIRTTNPVATEQYGSVSTYNLNDRGEDDNQ

SEQ ID NO: 29672 - protein, 30 aa, Artificial Sequence
  Description of Artificial Sequence: Synthetic polypeptide
DEEEIRTTNPVATEQYGSVSLLLDRQEDRI

SEQ ID NO: 29673 - protein, 32 aa, Artificial Sequence
  Description of Artificial Sequence: Synthetic polypeptide
DEEEIRTTNPVATEQYGSVSVTNIHQERDMDR

SEQ ID NO: 29674 - protein, 34 aa, Artificial Sequence
  Description of Artificial Sequence: Synthetic polypeptide
DEEEIRTTNPVATEQYGSVSVTNILTQREGNDKV

SEQ ID NO: 29675 - protein, 33 aa, Artificial Sequence
  Description of Artificial Sequence: Synthetic polypeptide
DEEEIRTTNPVATEQYGSVSVTNLDEGRGNEPF

SEQ ID NO: 29676 - protein, 32 aa, Artificial Sequence
  Description of Artificial Sequence: Synthetic polypeptide
DEEEIRTTNPVATEQYGSVSPTPLQITGENLG

SEQ ID NO: 29677 - protein, 30 aa, Artificial Sequence
  Description of Artificial Sequence: Synthetic polypeptide
DEEEIRTTNPVATEQYGSVSNMDLQGEENE

SEQ ID NO: 29678 - protein, 32 aa, Artificial Sequence
  Description of Artificial Sequence: Synthetic polypeptide
DEEEIRTTNPVATEQYGSVSVTNLDENLNGND

SEQ ID NO: 29679 - protein, 31 aa, Artificial Sequence
  Description of Artificial Sequence: Synthetic polypeptide
DEEEIRTTNPVATEQYGSVSTDLDQQRDIEV

SEQ ID NO: 29680 - protein, 32 aa, Artificial Sequence
  Description of Artificial Sequence: Synthetic polypeptide
DEEEIRTTNPVATEQYGSVSTDLDQQRDEMRM

SEQ ID NO: 29681 - protein, 31 aa, Artificial Sequence
  Description of Artificial Sequence: Synthetic polypeptide
DEEEIRTTNPVATEQYGSVSTDLDQQHDERQ

SEQ ID NO: 29682 - protein, 32 aa, Artificial Sequence
  Description of Artificial Sequence: Synthetic polypeptide
DEEEIRTTNPVATEQYGSVSVTNLDQLNGMDQ

SEQ ID NO: 29683 - protein, 30 aa, Artificial Sequence
  Description of Artificial Sequence: Synthetic polypeptide
DEAEISTTNPVATEQYGSVSTNLGGEDGNM

SEQ ID NO: 29684 - protein, 31 aa, Artificial Sequence
  Description of Artificial Sequence: Synthetic polypeptide
DEEEIRTTNPVATEQYGSVSTDLDQQGDEDI

SEQ ID NO: 29685 - protein, 31 aa, Artificial Sequence
  Description of Artificial Sequence: Synthetic polypeptide
DEEEIRTTNPVATEQYGSVSVTNLDQSIEEI

SEQ ID NO: 29686 - protein, 32 aa, Artificial Sequence
  Description of Artificial Sequence: Synthetic polypeptide
DEEEIRTTNPVATEQYGSVSTYNLIGFGGNIV

SEQ ID NO: 29687 - protein, 28 aa, Artificial Sequence
  Description of Artificial Sequence: Synthetic peptide
DEECSRTTNPIAYEQYGEVSTNLQHGND

SEQ ID NO: 29688 - protein, 33 aa, Artificial Sequence
  Description of Artificial Sequence: Synthetic polypeptide
DEEEIRTTNPVATEQYGSVSTYNLGQSRINQED

SEQ ID NO: 29689 - protein, 31 aa, Artificial Sequence
  Description of Artificial Sequence: Synthetic polypeptide
DEEEIRTTNPVATEQYGSVSVTNLEPNNEDQ

SEQ ID NO: 29690 - protein, 29 aa, Artificial Sequence
  Description of Artificial Sequence: Synthetic peptide
DEECSRTTNPIAYEQYGEVSTNLQIGNNR

SEQ ID NO: 29691 - protein, 32 aa, Artificial Sequence
  Description of Artificial Sequence: Synthetic polypeptide
DEEEIRTTNPVATEQYGSVSTEALNMRNGNPV

SEQ ID NO: 29692 - protein, 32 aa, Artificial Sequence
  Description of Artificial Sequence: Synthetic polypeptide
DEAEIRTTNPVATEQYGSVATTNLNQDGGNER

SEQ ID NO: 29693 - protein, 31 aa, Artificial Sequence
  Description of Artificial Sequence: Synthetic polypeptide
DEAEIRTTNPVATEQYGSVATNLQERGDSDS

SEQ ID NO: 29694 - protein, 33 aa, Artificial Sequence
  Description of Artificial Sequence: Synthetic polypeptide
DEEEIRTTNPVATEQYGSVSTNNLQQEMGNING

SEQ ID NO: 29695 - protein, 31 aa, Artificial Sequence
  Description of Artificial Sequence: Synthetic polypeptide
DEAEIRTTNPVATEQYGSVATNLQERGDDQW

SEQ ID NO: 29696 - protein, 29 aa, Artificial Sequence
  Description of Artificial Sequence: Synthetic peptide
DEAEISTTNPVATEQYGSVATNLQGINDL

SEQ ID NO: 29697 - protein, 29 aa, Artificial Sequence
  Description of Artificial Sequence: Synthetic peptide
DEECSRTTNPIAYEQYGEVSTNLQRGNDI

SEQ ID NO: 29698 - protein, 31 aa, Artificial Sequence
  Description of Artificial Sequence: Synthetic polypeptide
DEAEIRTTNPVATEQYGSVSNNLQHNGDNNM

SEQ ID NO: 29699 - protein, 31 aa, Artificial Sequence
  Description of Artificial Sequence: Synthetic polypeptide
DEEEIRTTNPVATEQYGSVSTNNLVPMVERV

SEQ ID NO: 29700 - protein, 31 aa, Artificial Sequence
  Description of Artificial Sequence: Synthetic polypeptide
DEEEIRTTNPVATEQYGSVSCPNIQRGEEHN

SEQ ID NO: 29701 - protein, 32 aa, Artificial Sequence
  Description of Artificial Sequence: Synthetic polypeptide
DEEEIRTTNPVATEQYGSVSTYNDDRGENMHT

SEQ ID NO: 29702 - protein, 32 aa, Artificial Sequence
  Description of Artificial Sequence: Synthetic polypeptide
DEEEIRTTNPVATEQYGSVSTNNLVQVDNVEL

SEQ ID NO: 29703 - protein, 33 aa, Artificial Sequence
  Description of Artificial Sequence: Synthetic polypeptide
DEAEIRTTNPVATEQYGSVSNVLNLQRGNDDRN

SEQ ID NO: 29704 - protein, 28 aa, Artificial Sequence
  Description of Artificial Sequence: Synthetic peptide
DEECSRTTNPIAYEQYGEVSTVLQRGNE

SEQ ID NO: 29705 - protein, 31 aa, Artificial Sequence
  Description of Artificial Sequence: Synthetic polypeptide
DEEEIRTTNPVATEQYGSVSTELEHGSNNDS

SEQ ID NO: 29706 - protein, 31 aa, Artificial Sequence
  Description of Artificial Sequence: Synthetic polypeptide
DEEEIRTTNPVATEQYGSVSTNNNDNRGEDQ

SEQ ID NO: 29707 - protein, 30 aa, Artificial Sequence
  Description of Artificial Sequence: Synthetic polypeptide
DEAEIRTTNPVATEQYGSVAATNNLNRGPE

SEQ ID NO: 29708 - protein, 32 aa, Artificial Sequence
  Description of Artificial Sequence: Synthetic polypeptide
DEEEIRTTNPVATEQYGSVSPTNVVRVGFNEE

SEQ ID NO: 29709 - protein, 29 aa, Artificial Sequence
  Description of Artificial Sequence: Synthetic peptide
DEECIRCTNPVATEQYGSVSWNDFQQGNA

SEQ ID NO: 29710 - protein, 28 aa, Artificial Sequence
  Description of Artificial Sequence: Synthetic peptide
DEECSRTTNPIAYEQYGEVSTNLQRGDG

SEQ ID NO: 29711 - protein, 33 aa, Artificial Sequence
  Description of Artificial Sequence: Synthetic polypeptide
DEEEIRTTNPVATEQYGSVSTNNNLWNRGEDRN

SEQ ID NO: 29712 - protein, 31 aa, Artificial Sequence
  Description of Artificial Sequence: Synthetic polypeptide
DEEEIRTTNPVATEQYGSVSTELERFNSEQS

SEQ ID NO: 29713 - protein, 30 aa, Artificial Sequence
  Description of Artificial Sequence: Synthetic polypeptide
DEEEIRTTNPVATEQYGSVSTNNNQADILN

SEQ ID NO: 29714 - protein, 30 aa, Artificial Sequence
  Description of Artificial Sequence: Synthetic polypeptide
DEAEIRTTNPVATEQYGSVAATNDTTRGNE

SEQ ID NO: 29715 - protein, 29 aa, Artificial Sequence
  Description of Artificial Sequence: Synthetic peptide
DEECIRTTNPVAEEQWGQVSTINDQRGNN

SEQ ID NO: 29716 - protein, 31 aa, Artificial Sequence
  Description of Artificial Sequence: Synthetic polypeptide
DEDEIRTTNPVATEYYGSVSTNDQREGQNDM

SEQ ID NO: 29717 - protein, 32 aa, Artificial Sequence
  Description of Artificial Sequence: Synthetic polypeptide
DEEEIRTTNPVATEQYGSVSTNNPHQERPMIR

SEQ ID NO: 29718 - protein, 32 aa, Artificial Sequence
  Description of Artificial Sequence: Synthetic polypeptide
DEEEIRTTNPVATEQYGSVSTELPNNLQGDNQ

SEQ ID NO: 29719 - protein, 32 aa, Artificial Sequence
  Description of Artificial Sequence: Synthetic polypeptide
DEEEIRTTNPVATEQYGSVSTELPQGFGSNQS

SEQ ID NO: 29720 - protein, 30 aa, Artificial Sequence
  Description of Artificial Sequence: Synthetic polypeptide
DEECIRCTNPVATEQYGSVSWNDDQRGNLG

SEQ ID NO: 29721 - protein, 31 aa, Artificial Sequence
  Description of Artificial Sequence: Synthetic polypeptide
DEEEIRTTNPVATEQYGSVSTELQASGSDQI

SEQ ID NO: 29722 - protein, 32 aa, Artificial Sequence
  Description of Artificial Sequence: Synthetic polypeptide
DEEEIRTTNPVATEQYGSVSTNNQEEVLQNRG

SEQ ID NO: 29723 - protein, 33 aa, Artificial Sequence
  Description of Artificial Sequence: Synthetic polypeptide
DEEEIRTTNPVATEQYGSVSTELQEFSGSNNRT

SEQ ID NO: 29724 - protein, 29 aa, Artificial Sequence
  Description of Artificial Sequence: Synthetic peptide
DEECIRTTNPVAEEQYGCVSTINVQRGDN

SEQ ID NO: 29725 - protein, 31 aa, Artificial Sequence
  Description of Artificial Sequence: Synthetic polypeptide
DEEEIRTTNPVATEQYGSVSTNNNNAGIENS

SEQ ID NO: 29726 - protein, 33 aa, Artificial Sequence
  Description of Artificial Sequence: Synthetic polypeptide
DEEEIRTTNPVATEQYGSVSTNNLTQMEGGNNN

SEQ ID NO: 29727 - protein, 32 aa, Artificial Sequence
  Description of Artificial Sequence: Synthetic polypeptide
DEEEIRTTNPVATEQYGSVSPTNWQRGEEVTM

SEQ ID NO: 29728 - protein, 32 aa, Artificial Sequence
  Description of Artificial Sequence: Synthetic polypeptide
DEEEIRTTNPVATEQYGSVSNMNLDQFEGENQ

SEQ ID NO: 29729 - protein, 32 aa, Artificial Sequence
  Description of Artificial Sequence: Synthetic polypeptide
DEEEIRTTNPVATEQYGSVSPTPGLEMRGNET

SEQ ID NO: 29730 - protein, 32 aa, Artificial Sequence
  Description of Artificial Sequence: Synthetic polypeptide
DEEEIRTTNPVATEQYGSVSTYNLDNEGGNIG

SEQ ID NO: 29731 - protein, 30 aa, Artificial Sequence
  Description of Artificial Sequence: Synthetic polypeptide
DEAEIRTTNPVATEQYGSVATNLERGMPDN

SEQ ID NO: 29732 - protein, 32 aa, Artificial Sequence
  Description of Artificial Sequence: Synthetic polypeptide
DEEEIRTTNPVATEQYGSVSTYNLDNANGNEG

SEQ ID NO: 29733 - protein, 29 aa, Artificial Sequence
  Description of Artificial Sequence: Synthetic peptide
DEDEIRTTNPVATESYGSVSNNLQEHGTS

SEQ ID NO: 29734 - protein, 33 aa, Artificial Sequence
  Description of Artificial Sequence: Synthetic polypeptide
DEEEIRTTNPVATEQYGSVSTYNLDLQNGGNTP

SEQ ID NO: 29735 - protein, 30 aa, Artificial Sequence
  Description of Artificial Sequence: Synthetic polypeptide
DEDEIRTTNPCATEQYGSVSTNGGDMGNGR

SEQ ID NO: 29736 - protein, 29 aa, Artificial Sequence
  Description of Artificial Sequence: Synthetic peptide
DEAEIRTTNPVATEQYGSVATNDQAPNES

SEQ ID NO: 29737 - protein, 31 aa, Artificial Sequence
  Description of Artificial Sequence: Synthetic polypeptide
DEEEIRTTNPVATEQYGSVSTDILDQQRDEQ

SEQ ID NO: 29738 - protein, 33 aa, Artificial Sequence
  Description of Artificial Sequence: Synthetic polypeptide
DEEEIRTTNPVATEQYGSVSTEEPLQFFGSNRL

SEQ ID NO: 29739 - protein, 29 aa, Artificial Sequence
  Description of Artificial Sequence: Synthetic peptide
DEECIRTTNPVACEQYGQVSTVNVQNGNN

SEQ ID NO: 29740 - protein, 32 aa, Artificial Sequence
  Description of Artificial Sequence: Synthetic polypeptide
DEEEIRTTNPVATEQYGSVSTNNLQRVIVPLI

SEQ ID NO: 29741 - protein, 29 aa, Artificial Sequence
  Description of Artificial Sequence: Synthetic peptide
DEEEIRTTNPVATEQYGSVSLLMDRGEEQ

SEQ ID NO: 29742 - protein, 32 aa, Artificial Sequence
  Description of Artificial Sequence: Synthetic polypeptide
DEEEIRTTNPVATEQYGSVSTYNLDDPEGGNI

SEQ ID NO: 29743 - protein, 31 aa, Artificial Sequence
  Description of Artificial Sequence: Synthetic polypeptide
DEDEIRTTNPCATEQYGSVSTNLGGEQGENR

SEQ ID NO: 29744 - protein, 32 aa, Artificial Sequence
  Description of Artificial Sequence: Synthetic polypeptide
DEEEIRTTNPVATEQYGSVSTNNLQRVSQEVT

SEQ ID NO: 29745 - protein, 31 aa, Artificial Sequence
  Description of Artificial Sequence: Synthetic polypeptide
DEDEIRTTNPCATEQYGSVSTNLGSNDGDNR

SEQ ID NO: 29746 - protein, 32 aa, Artificial Sequence
  Description of Artificial Sequence: Synthetic polypeptide
DEEEIRTTNPVATEQYGSVSTYNDLSNGNGNI

SEQ ID NO: 29747 - protein, 31 aa, Artificial Sequence
  Description of Artificial Sequence: Synthetic polypeptide
DEAEIRTTNPVATEQYGSVASTSAGQRGENM

SEQ ID NO: 29748 - protein, 32 aa, Artificial Sequence
  Description of Artificial Sequence: Synthetic polypeptide
DEEEIRTTNPVATEQYGSVSQTNLQVQMVNLA

SEQ ID NO: 29749 - protein, 29 aa, Artificial Sequence
  Description of Artificial Sequence: Synthetic peptide
DEECIRCTNPVATEQYGSVSWNDQEGQNL

SEQ ID NO: 29750 - protein, 32 aa, Artificial Sequence
  Description of Artificial Sequence: Synthetic polypeptide
DEEEIRTTNPVATEQYGSVSTYNDLQGQNGGI

SEQ ID NO: 29751 - protein, 33 aa, Artificial Sequence
  Description of Artificial Sequence: Synthetic polypeptide
DEEEIRTTNPVATEQYGSVSTNNLQTEMGNNEE

SEQ ID NO: 29752 - protein, 30 aa, Artificial Sequence
  Description of Artificial Sequence: Synthetic polypeptide
DEEEIRTTNPVATEQYGSVSTEGNQEGEQS

SEQ ID NO: 29753 - protein, 31 aa, Artificial Sequence
  Description of Artificial Sequence: Synthetic polypeptide
DEAEIRTTNPVATEQYGSVSNNLGQGDGNNG

SEQ ID NO: 29754 - protein, 30 aa, Artificial Sequence
  Description of Artificial Sequence: Synthetic polypeptide
DEEEIRTTNPVATEQYGSVSTEHQFSSNQY

SEQ ID NO: 29755 - protein, 31 aa, Artificial Sequence
  Description of Artificial Sequence: Synthetic polypeptide
DEEEIRTTNPVATEQYGSVSTEHQRSGSDQA

SEQ ID NO: 29756 - protein, 31 aa, Artificial Sequence
  Description of Artificial Sequence: Synthetic polypeptide
DEDEIRTTNPVATETWGSVSTNLQLGGDNER

SEQ ID NO: 29757 - protein, 30 aa, Artificial Sequence
  Description of Artificial Sequence: Synthetic polypeptide
DEEEIRTTNPVATEQYGSVSTEHQYSGEQD

SEQ ID NO: 29758 - protein, 33 aa, Artificial Sequence
  Description of Artificial Sequence: Synthetic polypeptide
DEEEIRTTNPVATEQYGSVSQTNLQRVFQNIEI

SEQ ID NO: 29759 - protein, 31 aa, Artificial Sequence
  Description of Artificial Sequence: Synthetic polypeptide
DEEEIRTTNPVATEQYGSVSPTPLQRQSLLD

SEQ ID NO: 29760 - protein, 31 aa, Artificial Sequence
  Description of Artificial Sequence: Synthetic polypeptide
DEEEIRTTNPVATEQYGSVSPTPLWNGEQRD

SEQ ID NO: 29761 - protein, 32 aa, Artificial Sequence
  Description of Artificial Sequence: Synthetic polypeptide
DEEEIRTTNPVATEQYGSVSVTNGGQNNGNQF

SEQ ID NO: 29762 - protein, 30 aa, Artificial Sequence
  Description of Artificial Sequence: Synthetic polypeptide
DEEEIRTTNPVATEQYGSVSTDQDQQGIDN

SEQ ID NO: 29763 - protein, 29 aa, Artificial Sequence
  Description of Artificial Sequence: Synthetic peptide
DEASIRTTNPCATEQFGSVSSNLQSGNER

SEQ ID NO: 29764 - protein, 29 aa, Artificial Sequence
  Description of Artificial Sequence: Synthetic peptide
DEDEIRTTNPVATEQYGTCSTNDQQGGNT

SEQ ID NO: 29765 - protein, 32 aa, Artificial Sequence
  Description of Artificial Sequence: Synthetic polypeptide
DEEEIRTTNPVATEQYGSVSTDLNNGNENQRD

SEQ ID NO: 29766 - protein, 30 aa, Artificial Sequence
  Description of Artificial Sequence: Synthetic polypeptide
DEEEIRTTNPVATEQYGSVSMNLQTSDDVE

SEQ ID NO: 29767 - protein, 33 aa, Artificial Sequence
  Description of Artificial Sequence: Synthetic polypeptide
DEEEIRTTNPVATEQYGSVSPTTLFQRVIENER

SEQ ID NO: 29768 - protein, 32 aa, Artificial Sequence
  Description of Artificial Sequence: Synthetic polypeptide
DEEEIRTTNPVATEQYGSVSPTTILERTNQRI

SEQ ID NO: 29769 - protein, 32 aa, Artificial Sequence
  Description of Artificial Sequence: Synthetic polypeptide
DEEEIRTTNPVATEQYGSVSMNLQTRVENDIG

SEQ ID NO: 29770 - protein, 33 aa, Artificial Sequence
  Description of Artificial Sequence: Synthetic polypeptide
DEEEIRTTNPVATEQYGSVSNDNSLEQRGNVEQ

SEQ ID NO: 29771 - protein, 31 aa, Artificial Sequence
  Description of Artificial Sequence: Synthetic polypeptide
DEEEIRTTNPVATEQYGSVSTDLNAGTGDFR

SEQ ID NO: 29772 - protein, 31 aa, Artificial Sequence
  Description of Artificial Sequence: Synthetic polypeptide
DEEEIRTTNPVATEQYGSVSVTGLQRQLVDD

SEQ ID NO: 29773 - protein, 32 aa, Artificial Sequence
  Description of Artificial Sequence: Synthetic polypeptide
DEEEIRTTNPVATEQYGSVSVTGNLQRVEEII

SEQ ID NO: 29774 - protein, 31 aa, Artificial Sequence
  Description of Artificial Sequence: Synthetic polypeptide
DEEEIRTTNPVATEQYGSVSTDQQQERDMIR

SEQ ID NO: 29775 - protein, 34 aa, Artificial Sequence
  Description of Artificial Sequence: Synthetic polypeptide
DEEEIRTTNPVATEQYGSVSVTENLQRQGVNDEN

SEQ ID NO: 29776 - protein, 30 aa, Artificial Sequence
  Description of Artificial Sequence: Synthetic polypeptide
DEDEIRTTNPVATEQYGSVVTNGGGNGNER

SEQ ID NO: 29777 - protein, 33 aa, Artificial Sequence
  Description of Artificial Sequence: Synthetic polypeptide
DEEEIRTTNPVATEQYGSVSTNNLEQITGNGFE

SEQ ID NO: 29778 - protein, 30 aa, Artificial Sequence
  Description of Artificial Sequence: Synthetic polypeptide
DEDEIRTTNPVATEQYGSVVQNLFERNINR

SEQ ID NO: 29779 - protein, 32 aa, Artificial Sequence
  Description of Artificial Sequence: Synthetic polypeptide
DEEEIRTTNPVATEQYGSVSTNNLGFEGGNEA

SEQ ID NO: 29780 - protein, 32 aa, Artificial Sequence
  Description of Artificial Sequence: Synthetic polypeptide
DEAEIRTTNPVATEQYGSVSCQNLSFRVGNNR

SEQ ID NO: 29781 - protein, 31 aa, Artificial Sequence
  Description of Artificial Sequence: Synthetic polypeptide
DEEEIRTTNPVATEQYGSVSPTSSQRGEAEN

SEQ ID NO: 29782 - protein, 32 aa, Artificial Sequence
  Description of Artificial Sequence: Synthetic polypeptide
DEEEIRTTNPVATEQYGSVSITQNELQDQERE

SEQ ID NO: 29783 - protein, 31 aa, Artificial Sequence
  Description of Artificial Sequence: Synthetic polypeptide
DEEEIRTTNPVATEQYGSVSTDQVDQEGGNG

SEQ ID NO: 29784 - protein, 32 aa, Artificial Sequence
  Description of Artificial Sequence: Synthetic polypeptide
DEEEIRTTNPVATEQYGSVSTNNLGFGGNNED

SEQ ID NO: 29785 - protein, 31 aa, Artificial Sequence
  Description of Artificial Sequence: Synthetic polypeptide
DEEEIRTTNPVATEQYGSVSTNLQVTPEIVD

SEQ ID NO: 29786 - protein, 33 aa, Artificial Sequence
  Description of Artificial Sequence: Synthetic polypeptide
DEEEIRTTNPVATEQYGSVSTYNLSNGQNGNEQ

SEQ ID NO: 29787 - protein, 32 aa, Artificial Sequence
  Description of Artificial Sequence: Synthetic polypeptide
DEEEIRTTNPVATEQYGSVSTYNLSNGEGNEQ

SEQ ID NO: 29788 - protein, 32 aa, Artificial Sequence
  Description of Artificial Sequence: Synthetic polypeptide
DEEEIRTTNPVATEQYGSVSANLQRDGVEEFV

SEQ ID NO: 29789 - protein, 32 aa, Artificial Sequence
  Description of Artificial Sequence: Synthetic polypeptide
DEEEIRTTNPVATEQYGSVSTDTDLQRIDEGR

SEQ ID NO: 29790 - protein, 30 aa, Artificial Sequence
  Description of Artificial Sequence: Synthetic polypeptide
DEDEIRTTNPVATEQYGSVVTNGGGMDGNR

SEQ ID NO: 29791 - protein, 33 aa, Artificial Sequence
  Description of Artificial Sequence: Synthetic polypeptide
DEEEIRTTNPVATEQYGSVSITSLEQPVGLNLR

SEQ ID NO: 29792 - protein, 31 aa, Artificial Sequence
  Description of Artificial Sequence: Synthetic polypeptide
DEDEIRTTNPVATEQYGTVSTMNLADEGNRN

SEQ ID NO: 29793 - protein, 31 aa, Artificial Sequence
  Description of Artificial Sequence: Synthetic polypeptide
DEEEIRTTNPVATEQYGSVSTDPVQNNNGNG

SEQ ID NO: 29794 - protein, 32 aa, Artificial Sequence
  Description of Artificial Sequence: Synthetic polypeptide
DEAEIRTTNPVATEQYGSVCSTGELQNFGSNR

SEQ ID NO: 29795 - protein, 30 aa, Artificial Sequence
  Description of Artificial Sequence: Synthetic polypeptide
DEDEIRTTNPVATEQYGTVTSTNLQQGDEE

SEQ ID NO: 29796 - protein, 31 aa, Artificial Sequence
  Description of Artificial Sequence: Synthetic polypeptide
DEEEIRTTNPVATEQYGSVSTDLPQRVTEEE

SEQ ID NO: 29797 - protein, 30 aa, Artificial Sequence
  Description of Artificial Sequence: Synthetic polypeptide
DEAEIRTTNPVATEQYGSVCSTELQHGSEQ

SEQ ID NO: 29798 - protein, 33 aa, Artificial Sequence
  Description of Artificial Sequence: Synthetic polypeptide
DEEEIRTTNPVATEQYGSVSTYNLSNNQNGNQG

SEQ ID NO: 29799 - protein, 31 aa, Artificial Sequence
  Description of Artificial Sequence: Synthetic polypeptide
DEEEIRTTNPVATEQYGSVSVSYNLQSVENE

SEQ ID NO: 29800 - protein, 33 aa, Artificial Sequence
  Description of Artificial Sequence: Synthetic polypeptide
DEEEIRTTNPVATEQYGSVSPTTNLEQLVGNFD

SEQ ID NO: 29801 - protein, 32 aa, Artificial Sequence
  Description of Artificial Sequence: Synthetic polypeptide
DEEEIRTTNPVATEQYGSVSTYNLSNNGGNNV

SEQ ID NO: 29802 - protein, 30 aa, Artificial Sequence
  Description of Artificial Sequence: Synthetic polypeptide
DEEEIRTTNPVATEQYGSVSANYQETFNDQ

SEQ ID NO: 29803 - protein, 32 aa, Artificial Sequence
  Description of Artificial Sequence: Synthetic polypeptide
DEEEIRTTNPVATEQYGSVSPTTNLELGSNVF

SEQ ID NO: 29804 - protein, 32 aa, Artificial Sequence
  Description of Artificial Sequence: Synthetic polypeptide
DEEEIRTTNPVATEQYGSVSCINEPQDREGNG

SEQ ID NO: 29805 - protein, 33 aa, Artificial Sequence
  Description of Artificial Sequence: Synthetic polypeptide
DEEEIRTTNPVATEQYGSVSVTDGLQRGNVFTN

SEQ ID NO: 29806 - protein, 30 aa, Artificial Sequence
  Description of Artificial Sequence: Synthetic polypeptide
DEEEIRTTNPVATEQYGSVSTDPMVSGEDR

SEQ ID NO: 29807 - protein, 31 aa, Artificial Sequence
  Description of Artificial Sequence: Synthetic polypeptide
DEEEIRTTNPVATEQYGSVSTDPNQRDGSQF

SEQ ID NO: 29808 - protein, 31 aa, Artificial Sequence
  Description of Artificial Sequence: Synthetic polypeptide
DEEEIRTTNPVATEQYGSVSVTDLQGGILQD

SEQ ID NO: 29809 - protein, 30 aa, Artificial Sequence
  Description of Artificial Sequence: Synthetic polypeptide
DEEEIRTTNPVATEQYGSVSTDPNQRDSSD

SEQ ID NO: 29810 - protein, 32 aa, Artificial Sequence
  Description of Artificial Sequence: Synthetic polypeptide
DEEEIRTTNPVATEQYGSVSPTTLQLPIVNRI

SEQ ID NO: 29811 - protein, 33 aa, Artificial Sequence
  Description of Artificial Sequence: Synthetic polypeptide
DEEEIRTTNPVATEQYGSVSTYNLSNGQTGENI

SEQ ID NO: 29812 - protein, 31 aa, Artificial Sequence
  Description of Artificial Sequence: Synthetic polypeptide
DEDEIRTTNPVATEQYGTVSTNLQPGGDNDG

SEQ ID NO: 29813 - protein, 31 aa, Artificial Sequence
  Description of Artificial Sequence: Synthetic polypeptide
DEDEIRTTNPVATEQYGTVSTNLQNGSGNNH

SEQ ID NO: 29814 - protein, 32 aa, Artificial Sequence
  Description of Artificial Sequence: Synthetic polypeptide
DEEEIRTTNPVATEQYGSVSTDLNQGTGGNFQ

SEQ ID NO: 29815 - protein, 33 aa, Artificial Sequence
  Description of Artificial Sequence: Synthetic polypeptide
DEEEIRTTNPVATEQYGSVSVTDLQTRQVNERQ

SEQ ID NO: 29816 - protein, 32 aa, Artificial Sequence
  Description of Artificial Sequence: Synthetic polypeptide
DEEEIRTTNPVATEQYGSVSTNNLDEFGNNEN

SEQ ID NO: 29817 - protein, 32 aa, Artificial Sequence
  Description of Artificial Sequence: Synthetic polypeptide
DEEEIRTTNPVATEQYGSVSVTDNNQRGEDTY

SEQ ID NO: 29818 - protein, 31 aa, Artificial Sequence
  Description of Artificial Sequence: Synthetic polypeptide
DEEEIRTTNPVATEQYGSVSMNLVNTGVENG

SEQ ID NO: 29819 - protein, 33 aa, Artificial Sequence
  Description of Artificial Sequence: Synthetic polypeptide
DEEEIRTTNPVATEQYGSVSTNNLDQANEGGNN

SEQ ID NO: 29820 - protein, 29 aa, Artificial Sequence
  Description of Artificial Sequence: Synthetic peptide
DEDEIRTTNPVATEQYGTVSTNDQGANTT

SEQ ID NO: 29821 - protein, 30 aa, Artificial Sequence
  Description of Artificial Sequence: Synthetic polypeptide
DEAEIRTTNPVATEQYGSVSANLQHGTEAQ

SEQ ID NO: 29822 - protein, 31 aa, Artificial Sequence
  Description of Artificial Sequence: Synthetic polypeptide
DEDEIRTTNPVATEQYGTVSTNAQGEGNNDR

SEQ ID NO: 29823 - protein, 30 aa, Artificial Sequence
  Description of Artificial Sequence: Synthetic polypeptide
DEEEIRTTNPVATEQYGSVSTDLHQMSTDV

SEQ ID NO: 29824 - protein, 33 aa, Artificial Sequence
  Description of Artificial Sequence: Synthetic polypeptide
DEEEIRTTNPVATEQYGSVSITPNQLQRIGLQE

SEQ ID NO: 29825 - protein, 32 aa, Artificial Sequence
  Description of Artificial Sequence: Synthetic polypeptide
DEEEIRTTNPVATEQYGSVSTYNLSNFGGNIG

SEQ ID NO: 29826 - protein, 32 aa, Artificial Sequence
  Description of Artificial Sequence: Synthetic polypeptide
DEEEIRTTNPVATEQYGSVSQTNLQDENENEE

SEQ ID NO: 29827 - protein, 30 aa, Artificial Sequence
  Description of Artificial Sequence: Synthetic polypeptide
DEDEIRTTNPVATEQYGVVTSTGNLQQGTS

SEQ ID NO: 29828 - protein, 30 aa, Artificial Sequence
  Description of Artificial Sequence: Synthetic polypeptide
DEDEIRTTNPVATEQYGSVSVQNLNGNNNR

SEQ ID NO: 29829 - protein, 31 aa, Artificial Sequence
  Description of Artificial Sequence: Synthetic polypeptide
DEDEIRTTNPVATEQYGVVTSTNLQAGNTNS

SEQ ID NO: 29830 - protein, 30 aa, Artificial Sequence
  Description of Artificial Sequence: Synthetic polypeptide
DEDEIRTTNPVATEQYGVVTSTNLQSGTTS

SEQ ID NO: 29831 - protein, 30 aa, Artificial Sequence
  Description of Artificial Sequence: Synthetic polypeptide
DEEEIRTTNPVATEQYGSVSTDTNDRGEGL

SEQ ID NO: 29832 - protein, 29 aa, Artificial Sequence
  Description of Artificial Sequence: Synthetic peptide
DEAEIRTTNPVATEQYGSVCQTAPIRMNR

SEQ ID NO: 29833 - protein, 30 aa, Artificial Sequence
  Description of Artificial Sequence: Synthetic polypeptide
DEEEIRTTNPVATEQYGSVSTDVEERGDQQ

SEQ ID NO: 29834 - protein, 31 aa, Artificial Sequence
  Description of Artificial Sequence: Synthetic polypeptide
DEEEIRTTNPVATEQYGSVSNLPNELQGDND

SEQ ID NO: 29835 - protein, 31 aa, Artificial Sequence
  Description of Artificial Sequence: Synthetic polypeptide
DEEEIRTTNPVATEQYGSVSTNLQTVTPEQD

SEQ ID NO: 29836 - protein, 33 aa, Artificial Sequence
  Description of Artificial Sequence: Synthetic polypeptide
DEEEIRTTNPVATEQYGSVSPTPNLQRESNDEI

SEQ ID NO: 29837 - protein, 33 aa, Artificial Sequence
  Description of Artificial Sequence: Synthetic polypeptide
DEEEIRTTNPVATEQYGSVSTYNLQNQNGGNID

SEQ ID NO: 29838 - protein, 33 aa, Artificial Sequence
  Description of Artificial Sequence: Synthetic polypeptide
DEEEIRTTNPVATEQYGSVSTYNLQNQNGENEI

SEQ ID NO: 29839 - protein, 33 aa, Artificial Sequence
  Description of Artificial Sequence: Synthetic polypeptide
DEEEIRTTNPVATEQYGSVSPTPNLQLRQLIRE

SEQ ID NO: 29840 - protein, 30 aa, Artificial Sequence
  Description of Artificial Sequence: Synthetic polypeptide
DEECIRTTNPVAYEQYGCVCSTGNPQRGNN

SEQ ID NO: 29841 - protein, 32 aa, Artificial Sequence
  Description of Artificial Sequence: Synthetic polypeptide
DEEEIRTTNPVATEQYGSVSTDLEQEGGIERS

SEQ ID NO: 29842 - protein, 33 aa, Artificial Sequence
  Description of Artificial Sequence: Synthetic polypeptide
DEEEIRTTNPVATEQYGSVSTNNLQHVGQNQLM

SEQ ID NO: 29843 - protein, 30 aa, Artificial Sequence
  Description of Artificial Sequence: Synthetic polypeptide
DEEEIRTTNPVATEQYGSVSTDVESTDGDR

SEQ ID NO: 29844 - protein, 32 aa, Artificial Sequence
  Description of Artificial Sequence: Synthetic polypeptide
DEEEIRTTNPVATEQYGSVSPTPNDHQQRLIR

SEQ ID NO: 29845 - protein, 32 aa, Artificial Sequence
  Description of Artificial Sequence: Synthetic polypeptide
DEEEIRTTNPVATEQYGSVSITNVPQERDIIR

SEQ ID NO: 29846 - protein, 33 aa, Artificial Sequence
  Description of Artificial Sequence: Synthetic polypeptide
DEEEIRTTNPVATEQYGSVSTNNLQNNEMGNNG

SEQ ID NO: 29847 - protein, 32 aa, Artificial Sequence
  Description of Artificial Sequence: Synthetic polypeptide
DEEEIRTTNPVATEQYGSVSTNLQTQGLEASG

SEQ ID NO: 29848 - protein, 32 aa, Artificial Sequence
  Description of Artificial Sequence: Synthetic polypeptide
DEEEIRTTNPVATEQYGSVSTNNLQNVGGEGE

SEQ ID NO: 29849 - protein, 31 aa, Artificial Sequence
  Description of Artificial Sequence: Synthetic polypeptide
DEEEIRTTNPVATEQYGSVSTDLELRTEGSE

SEQ ID NO: 29850 - protein, 33 aa, Artificial Sequence
  Description of Artificial Sequence: Synthetic polypeptide
DEEEIRTTNPVATEQYGSVSTYNLNQMRLEDDR

SEQ ID NO: 29851 - protein, 32 aa, Artificial Sequence
  Description of Artificial Sequence: Synthetic polypeptide
DEEEIRTTNPVATEQYGSVSTDVLQTIGNNQD

SEQ ID NO: 29852 - protein, 28 aa, Artificial Sequence
  Description of Artificial Sequence: Synthetic peptide
DEDEIATTNPVAYEQYGSVSANLMQGNT

SEQ ID NO: 29853 - protein, 30 aa, Artificial Sequence
  Description of Artificial Sequence: Synthetic polypeptide
DEEEIRTTNPVATEQYGSVSTDLDSTNVQA

SEQ ID NO: 29854 - protein, 32 aa, Artificial Sequence
  Description of Artificial Sequence: Synthetic polypeptide
DEEEIRTTNPVATEQYGSVSTDLDQRMMEPRL

SEQ ID NO: 29855 - protein, 30 aa, Artificial Sequence
  Description of Artificial Sequence: Synthetic polypeptide
DEECIRTTNPVAAEQYGQVSTNNVQRGNDN

SEQ ID NO: 29856 - protein, 33 aa, Artificial Sequence
  Description of Artificial Sequence: Synthetic polypeptide
DEEEIRTTNPVATEQYGSVSTNNLQAVEGNGNN

SEQ ID NO: 29857 - protein, 32 aa, Artificial Sequence
  Description of Artificial Sequence: Synthetic polypeptide
DEEEIRTTNPVATEQYGSVSTDNVIQEGGNED

SEQ ID NO: 29858 - protein, 32 aa, Artificial Sequence
  Description of Artificial Sequence: Synthetic polypeptide
DEEEIRTTNPVATEQYGSVSVTMLQPRIGEEQ

SEQ ID NO: 29859 - protein, 31 aa, Artificial Sequence
  Description of Artificial Sequence: Synthetic polypeptide
DEEEIRTTNPVATEQYGSVSVTMLQGQNLED

SEQ ID NO: 29860 - protein, 31 aa, Artificial Sequence
  Description of Artificial Sequence: Synthetic polypeptide
DEDEIRTTNPVATEQYGSVSYYNLDQGGNNN

SEQ ID NO: 29861 - protein, 30 aa, Artificial Sequence
  Description of Artificial Sequence: Synthetic polypeptide
DEEEIRTTNPVATEQYGSVSFNDQRSSEGM

SEQ ID NO: 29862 - protein, 30 aa, Artificial Sequence
  Description of Artificial Sequence: Synthetic polypeptide
DEEEIRTTNPVATEQYGSVSCMDLDRADRD

SEQ ID NO: 29863 - protein, 32 aa, Artificial Sequence
  Description of Artificial Sequence: Synthetic polypeptide
DEEEIRTTNPVATEQYGSVSTNNLHQHFGEDQ

SEQ ID NO: 29864 - protein, 33 aa, Artificial Sequence
  Description of Artificial Sequence: Synthetic polypeptide
DEEEIRTTNPVATEQYGSVSTDTIQPRGPNDRQ

SEQ ID NO: 29865 - protein, 31 aa, Artificial Sequence
  Description of Artificial Sequence: Synthetic polypeptide
DEDEIATTNPVAYEQYGSVSTNLQRGDDNEA

SEQ ID NO: 29866 - protein, 30 aa, Artificial Sequence
  Description of Artificial Sequence: Synthetic polypeptide
DEDEIATTNPVAYEQYGSVSTNLQNGDNNS

SEQ ID NO: 29867 - protein, 30 aa, Artificial Sequence
  Description of Artificial Sequence: Synthetic polypeptide
DEDEIATTNPVAYEQYGSVSTNLQHGDNDQ

SEQ ID NO: 29868 - protein, 32 aa, Artificial Sequence
  Description of Artificial Sequence: Synthetic polypeptide
DEEEIRTTNPVATEQYGSVSPTSLQRIGLQEM

SEQ ID NO: 29869 - protein, 31 aa, Artificial Sequence
  Description of Artificial Sequence: Synthetic polypeptide
DEEEIRTTNPVATEQYGSVSVTLLQRNILQD

SEQ ID NO: 29870 - protein, 31 aa, Artificial Sequence
  Description of Artificial Sequence: Synthetic polypeptide
DEEEIRTTNPVATEQYGSVSTNNLLTGVVLP

SEQ ID NO: 29871 - protein, 30 aa, Artificial Sequence
  Description of Artificial Sequence: Synthetic polypeptide
DEEEIRTTNPVATEQYGSVSNGIGGQRGDF

SEQ ID NO: 29872 - protein, 31 aa, Artificial Sequence
  Description of Artificial Sequence: Synthetic polypeptide
DEEEIRTTNPVATEQYGSVSTNLQVNLEIVQ

SEQ ID NO: 29873 - protein, 31 aa, Artificial Sequence
  Description of Artificial Sequence: Synthetic polypeptide
DEEEIRTTNPVATEQYGSVSTDLHQESTQNV

SEQ ID NO: 29874 - protein, 28 aa, Artificial Sequence
  Description of Artificial Sequence: Synthetic peptide
DEATIRTTNPLATEQFGSVSFNLQSGNF

SEQ ID NO: 29875 - protein, 31 aa, Artificial Sequence
  Description of Artificial Sequence: Synthetic polypeptide
DEEEIRTTNPVATEQYGSVSVTMETQRGIGL

SEQ ID NO: 29876 - protein, 32 aa, Artificial Sequence
  Description of Artificial Sequence: Synthetic polypeptide
DEEEIRTTNPVATEQYGSVSTYNLSNAEGGNQ

SEQ ID NO: 29877 - protein, 30 aa, Artificial Sequence
  Description of Artificial Sequence: Synthetic polypeptide
DEEEIRTTNPVATEQYGSVSTDLHDGDFDG

SEQ ID NO: 29878 - protein, 32 aa, Artificial Sequence
  Description of Artificial Sequence: Synthetic polypeptide
DEEEIRTTNPVATEQYGSVSTNNLNQMGVEPP

SEQ ID NO: 29879 - protein, 33 aa, Artificial Sequence
  Description of Artificial Sequence: Synthetic polypeptide
DEEEIRTTNPVATEQYGSVSTYNLSGQNGGNIQ

SEQ ID NO: 29880 - protein, 32 aa, Artificial Sequence
  Description of Artificial Sequence: Synthetic polypeptide
DEEEIRTTNPVATEQYGSVSTYNLSGFEGGNI

SEQ ID NO: 29881 - protein, 28 aa, Artificial Sequence
  Description of Artificial Sequence: Synthetic peptide
DEECSATTNPIAYEQYGTVSTNLQRGNL

SEQ ID NO: 29882 - protein, 31 aa, Artificial Sequence
  Description of Artificial Sequence: Synthetic polypeptide
DEEEIRTTNPVATEQYGSVSTNLQVIVEAEN

SEQ ID NO: 29883 - protein, 31 aa, Artificial Sequence
  Description of Artificial Sequence: Synthetic polypeptide
DEEEIRTTNPVATEQYGSVSPTQLQQGFPVI

SEQ ID NO: 29884 - protein, 33 aa, Artificial Sequence
  Description of Artificial Sequence: Synthetic polypeptide
DEEEIRTTNPVATEQYGSVSTNNLNQNEFGNNN

SEQ ID NO: 29885 - protein, 33 aa, Artificial Sequence
  Description of Artificial Sequence: Synthetic polypeptide
DEEEIRTTNPVATEQYGSVSTNNLNQRGEVQSN

SEQ ID NO: 29886 - protein, 32 aa, Artificial Sequence
  Description of Artificial Sequence: Synthetic polypeptide
DEEEIRTTNPVATEQYGSVSNLNLDDRGDNNE

SEQ ID NO: 29887 - protein, 31 aa, Artificial Sequence
  Description of Artificial Sequence: Synthetic polypeptide
DEEEIRTTNPVATEQYGSVSPTPNVQGRLIL

SEQ ID NO: 29888 - protein, 30 aa, Artificial Sequence
  Description of Artificial Sequence: Synthetic polypeptide
DEDEIRTTNPVATEQYGSVSVTNTQNEGTQ

SEQ ID NO: 29889 - protein, 29 aa, Artificial Sequence
  Description of Artificial Sequence: Synthetic peptide
DEDEIRTTNPVATEQYGVVTNTNLQSGDS

SEQ ID NO: 29890 - protein, 31 aa, Artificial Sequence
  Description of Artificial Sequence: Synthetic polypeptide
DEDEIATTNPVATEQYGCVSTNLQLMGDNNR

SEQ ID NO: 29891 - protein, 33 aa, Artificial Sequence
  Description of Artificial Sequence: Synthetic polypeptide
DEEEIRTTNPVATEQYGSVSPTNLALQAGDNQQ

SEQ ID NO: 29892 - protein, 32 aa, Artificial Sequence
  Description of Artificial Sequence: Synthetic polypeptide
DEEEIRTTNPVATEQYGSVSTGAHQRFGSNAS

SEQ ID NO: 29893 - protein, 30 aa, Artificial Sequence
  Description of Artificial Sequence: Synthetic polypeptide
DEEEIRTTNPVATEQYGSVTTTLQVRVSDG

SEQ ID NO: 29894 - protein, 32 aa, Artificial Sequence
  Description of Artificial Sequence: Synthetic polypeptide
DEEEIRTTNPVATEQYGSVSTMELQNIGENNG

SEQ ID NO: 29895 - protein, 32 aa, Artificial Sequence
  Description of Artificial Sequence: Synthetic polypeptide
DEEEIRTTNPVATEQYGSVSTMELQNQGNGEI

SEQ ID NO: 29896 - protein, 32 aa, Artificial Sequence
  Description of Artificial Sequence: Synthetic polypeptide
DEEEIRTTNPVATEQYGSVQSTNLQHFGSQQE

SEQ ID NO: 29897 - protein, 30 aa, Artificial Sequence
  Description of Artificial Sequence: Synthetic polypeptide
DEAEIRTTNPVAYEQYGSVSSNLQNGGNED

SEQ ID NO: 29898 - protein, 33 aa, Artificial Sequence
  Description of Artificial Sequence: Synthetic polypeptide
DEEEIRTTNPVATEQYGSVQSTNLPMREGMERD

SEQ ID NO: 29899 - protein, 31 aa, Artificial Sequence
  Description of Artificial Sequence: Synthetic polypeptide
DEAEIRTTNPVAYEQYGSVSSNLQDGGDNDR

SEQ ID NO: 29900 - protein, 32 aa, Artificial Sequence
  Description of Artificial Sequence: Synthetic polypeptide
DEEEIRTTNPVATEQYGSVQSTNLNPRIGLVE

SEQ ID NO: 29901 - protein, 34 aa, Artificial Sequence
  Description of Artificial Sequence: Synthetic polypeptide
DEEEIRTTNPVATEQYGSVTVTNLDQGRGNNPRI

SEQ ID NO: 29902 - protein, 31 aa, Artificial Sequence
  Description of Artificial Sequence: Synthetic polypeptide
DEEEIRTTNPVATEQYGSVSPTAFLQRNEAN

SEQ ID NO: 29903 - protein, 31 aa, Artificial Sequence
  Description of Artificial Sequence: Synthetic polypeptide
DEEEIRTTNPVATEQYGSVTVTNNQEGNEQN

SEQ ID NO: 29904 - protein, 30 aa, Artificial Sequence
  Description of Artificial Sequence: Synthetic polypeptide
DEEEIRTTNPVATEQYGSVTVTNSERGEQQ

SEQ ID NO: 29905 - protein, 33 aa, Artificial Sequence
  Description of Artificial Sequence: Synthetic polypeptide
DEEEIRTTNPVATEQYGSVQSTNLDQSEVVNRV

SEQ ID NO: 29906 - protein, 32 aa, Artificial Sequence
  Description of Artificial Sequence: Synthetic polypeptide
DEEEIRTTNPVATEQYGSVSPTALIQPEGVRI

SEQ ID NO: 29907 - protein, 30 aa, Artificial Sequence
  Description of Artificial Sequence: Synthetic polypeptide
DEAEIRTTNPVAYEQYGSVSNNLQGGNGGS

SEQ ID NO: 29908 - protein, 32 aa, Artificial Sequence
  Description of Artificial Sequence: Synthetic polypeptide
DEEEIRTTNPVATEQYGSVQSTNHQRIGSEQS

SEQ ID NO: 29909 - protein, 31 aa, Artificial Sequence
  Description of Artificial Sequence: Synthetic polypeptide
DEEAIRTTNPVATEQWGSVCGTNNLQHGNNR

SEQ ID NO: 29910 - protein, 29 aa, Artificial Sequence
  Description of Artificial Sequence: Synthetic peptide
DEEEIACTNPVATEQYGCVATNLQDGNDQ

SEQ ID NO: 29911 - protein, 31 aa, Artificial Sequence
  Description of Artificial Sequence: Synthetic polypeptide
DEAEIRTTNPVAYEQYGSVISTNELSTRPNR

SEQ ID NO: 29912 - protein, 32 aa, Artificial Sequence
  Description of Artificial Sequence: Synthetic polypeptide
DEEEIRTTNPVATEQYGSVQSTNDDRNGEDER

SEQ ID NO: 29913 - protein, 32 aa, Artificial Sequence
  Description of Artificial Sequence: Synthetic polypeptide
DEEEIRTTNPVATEQYGSVVATNGLQRGLFTQ

SEQ ID NO: 29914 - protein, 31 aa, Artificial Sequence
  Description of Artificial Sequence: Synthetic polypeptide
DEAEIRTTNPVAYEQYGSVIPSTNLSERVNR

SEQ ID NO: 29915 - protein, 29 aa, Artificial Sequence
  Description of Artificial Sequence: Synthetic peptide
DEAEIRTTNPVAYEQYGSVAAANDQRGND

SEQ ID NO: 29916 - protein, 31 aa, Artificial Sequence
  Description of Artificial Sequence: Synthetic polypeptide
DEEEIRTTNPVATEQYGSVVATWLERGLQND

SEQ ID NO: 29917 - protein, 32 aa, Artificial Sequence
  Description of Artificial Sequence: Synthetic polypeptide
DEEEIRTTNPVATEQYGSVSINLQREGVVPLD

SEQ ID NO: 29918 - protein, 33 aa, Artificial Sequence
  Description of Artificial Sequence: Synthetic polypeptide
DEEEIRTTNPVATEQYGSVQSTNCIQLTQGNRL

SEQ ID NO: 29919 - protein, 32 aa, Artificial Sequence
  Description of Artificial Sequence: Synthetic polypeptide
DEEEIRTTNPVATEQYGSVQSTNCIPQIEGER

SEQ ID NO: 29920 - protein, 34 aa, Artificial Sequence
  Description of Artificial Sequence: Synthetic polypeptide
DEEEIRTTNPVATEQYGSVVCSCTNQSQRGGNRT

SEQ ID NO: 29921 - protein, 30 aa, Artificial Sequence
  Description of Artificial Sequence: Synthetic polypeptide
DEAEIRTTNPVAYEQYGSVSNNLQGGGNEG

SEQ ID NO: 29922 - protein, 30 aa, Artificial Sequence
  Description of Artificial Sequence: Synthetic polypeptide
DEAEIRTTNPVAYEQYGSVSTENLEGGNMG

SEQ ID NO: 29923 - protein, 30 aa, Artificial Sequence
  Description of Artificial Sequence: Synthetic polypeptide
DEEEIRTTNPVATEQYGSVTTQPLDNFGER

SEQ ID NO: 29924 - protein, 32 aa, Artificial Sequence
  Description of Artificial Sequence: Synthetic polypeptide
DEDEIRTTNPVATEQYGSVSTNGGPQDGDNRQ

SEQ ID NO: 29925 - protein, 32 aa, Artificial Sequence
  Description of Artificial Sequence: Synthetic polypeptide
DEEEIRTTNPVATEQYGSVSTMDLSRSGNDDN

SEQ ID NO: 29926 - protein, 31 aa, Artificial Sequence
  Description of Artificial Sequence: Synthetic polypeptide
DEEEIRTTNPVATEQYGSVSTMDMQDTGNDD

SEQ ID NO: 29927 - protein, 30 aa, Artificial Sequence
  Description of Artificial Sequence: Synthetic polypeptide
DEAEIRTTNPVATEQYGCVATNLQGAGENG

SEQ ID NO: 29928 - protein, 29 aa, Artificial Sequence
  Description of Artificial Sequence: Synthetic peptide
DEAEIRTTNPVATEQYGCVATNLQGAENS

SEQ ID NO: 29929 - protein, 32 aa, Artificial Sequence
  Description of Artificial Sequence: Synthetic polypeptide
DEAEIRTTNPVAYEQYGSVVSYTNLSQNGTNR

SEQ ID NO: 29930 - protein, 30 aa, Artificial Sequence
  Description of Artificial Sequence: Synthetic polypeptide
DEEEIRTTNPVATEQYGSVSINNLEMNMPR

SEQ ID NO: 29931 - protein, 31 aa, Artificial Sequence
  Description of Artificial Sequence: Synthetic polypeptide
DEAEIRTTNPVAYEQYGSVVSTENLQGGNSE

SEQ ID NO: 29932 - protein, 32 aa, Artificial Sequence
  Description of Artificial Sequence: Synthetic polypeptide
DEEEIRTTNPVATEQYGSVSTPNLMQRVVVPD

SEQ ID NO: 29933 - protein, 30 aa, Artificial Sequence
  Description of Artificial Sequence: Synthetic polypeptide
DEAEIRTTNPVAYEQYGSVSTVNGEQNGNT

SEQ ID NO: 29934 - protein, 32 aa, Artificial Sequence
  Description of Artificial Sequence: Synthetic polypeptide
DEAEIRTTNPVAYEQYGSVSTPNQLQDGGGNR

SEQ ID NO: 29935 - protein, 31 aa, Artificial Sequence
  Description of Artificial Sequence: Synthetic polypeptide
DEDEIRTTNPVATEIYGSVSTNPGGQQGDNR

SEQ ID NO: 29936 - protein, 33 aa, Artificial Sequence
  Description of Artificial Sequence: Synthetic polypeptide
DEEEIRTTNPVATEQYGSVSTMDNLEQGGGNNG

SEQ ID NO: 29937 - protein, 31 aa, Artificial Sequence
  Description of Artificial Sequence: Synthetic polypeptide
DEEEIRTTNPVATEQYGSVSPTALQNRTDDI

SEQ ID NO: 29938 - protein, 30 aa, Artificial Sequence
  Description of Artificial Sequence: Synthetic polypeptide
DEEEIRTTNPVATEQYGSVTTNNDNQGSRD

SEQ ID NO: 29939 - protein, 32 aa, Artificial Sequence
  Description of Artificial Sequence: Synthetic polypeptide
DEEEIRTTNPVATEQYGSVSTVLQQGMGINNS

SEQ ID NO: 29940 - protein, 30 aa, Artificial Sequence
  Description of Artificial Sequence: Synthetic polypeptide
DEEEIRTTNPVATEQYGSVSTMDQHNSNSD

SEQ ID NO: 29941 - protein, 30 aa, Artificial Sequence
  Description of Artificial Sequence: Synthetic polypeptide
DEAEIRTTNPVAYEQYGSVSTNPDQPGNPD

SEQ ID NO: 29942 - protein, 31 aa, Artificial Sequence
  Description of Artificial Sequence: Synthetic polypeptide
DEEEIRTTNPVATEQYGSVTTPLQANFGEDR

SEQ ID NO: 29943 - protein, 31 aa, Artificial Sequence
  Description of Artificial Sequence: Synthetic polypeptide
DEEEIRTTNPVATEQYGSVSINNEQAVMNDR

SEQ ID NO: 29944 - protein, 33 aa, Artificial Sequence
  Description of Artificial Sequence: Synthetic polypeptide
DEEEIRTTNPVATEQYGSVSINMNLQRGQNMVD

SEQ ID NO: 29945 - protein, 30 aa, Artificial Sequence
  Description of Artificial Sequence: Synthetic polypeptide
DEEEIRTTNPVATEQYGSVSTVLQPIDQQI

SEQ ID NO: 29946 - protein, 30 aa, Artificial Sequence
  Description of Artificial Sequence: Synthetic polypeptide
DEAEIRTTNPVAYEQYGSVSTNLQNGGDEQ

SEQ ID NO: 29947 - protein, 31 aa, Artificial Sequence
  Description of Artificial Sequence: Synthetic polypeptide
DEAEIRTTNPVAYEQYGSVSTNLQNGDNNME

SEQ ID NO: 29948 - protein, 33 aa, Artificial Sequence
  Description of Artificial Sequence: Synthetic polypeptide
DEEEIRTTNPVATEQYGSVSPTALPQRGDQYRI

SEQ ID NO: 29949 - protein, 30 aa, Artificial Sequence
  Description of Artificial Sequence: Synthetic polypeptide
DEAEIRTTNPVAYEQYGSVSTNDNQLGNEN

SEQ ID NO: 29950 - protein, 30 aa, Artificial Sequence
  Description of Artificial Sequence: Synthetic polypeptide
DEEEIRTTNPVATEQYGSVSINLVEEQLLR

SEQ ID NO: 29951 - protein, 32 aa, Artificial Sequence
  Description of Artificial Sequence: Synthetic polypeptide
DEEEIRTTNPVATEQYGSVSTMELEQGGGNIG

SEQ ID NO: 29952 - protein, 33 aa, Artificial Sequence
  Description of Artificial Sequence: Synthetic polypeptide
DEEEIRTTNPVATEQYGSVTTPNMLDQRGNEIE

SEQ ID NO: 29953 - protein, 33 aa, Artificial Sequence
  Description of Artificial Sequence: Synthetic polypeptide
DEEEIRTTNPVATEQYGSVSINLSLPRTGNNRP

SEQ ID NO: 29954 - protein, 30 aa, Artificial Sequence
  Description of Artificial Sequence: Synthetic polypeptide
DEEEIRTTNPVATEQYGSVVENNLLRENNS

SEQ ID NO: 29955 - protein, 32 aa, Artificial Sequence
  Description of Artificial Sequence: Synthetic polypeptide
DEEEIRTTNPVATEQYGSVSTMDLQPVGNGGE

SEQ ID NO: 29956 - protein, 31 aa, Artificial Sequence
  Description of Artificial Sequence: Synthetic polypeptide
DEDEIRTTNPVATEQYGSVSTNDQPAGGNDA

SEQ ID NO: 29957 - protein, 34 aa, Artificial Sequence
  Description of Artificial Sequence: Synthetic polypeptide
DEEEIRTTNPVATEQYGSVQSTNAPSQRPGGNNR

SEQ ID NO: 29958 - protein, 32 aa, Artificial Sequence
  Description of Artificial Sequence: Synthetic polypeptide
DEEEIRTTNPVATEQYGSVSTVLQGMEGNEGD

SEQ ID NO: 29959 - protein, 29 aa, Artificial Sequence
  Description of Artificial Sequence: Synthetic peptide
DEAEIRTTNPVAYEQYGSISTNLSERVNE

SEQ ID NO: 29960 - protein, 33 aa, Artificial Sequence
  Description of Artificial Sequence: Synthetic polypeptide
DEEEIRTTNPVATEQYGSVQSPTNLQRAGQVQV

SEQ ID NO: 29961 - protein, 32 aa, Artificial Sequence
  Description of Artificial Sequence: Synthetic polypeptide
DEEEIRTTNPVATEQYGSVSTVLQGMEGENGS

SEQ ID NO: 29962 - protein, 30 aa, Artificial Sequence
  Description of Artificial Sequence: Synthetic polypeptide
DEAEIRTTNPVAYEQYGSISTNLERTVNNR

SEQ ID NO: 29963 - protein, 30 aa, Artificial Sequence
  Description of Artificial Sequence: Synthetic polypeptide
DEDEIATTNPVATEQYGSVATNLQRNNMED

SEQ ID NO: 29964 - protein, 32 aa, Artificial Sequence
  Description of Artificial Sequence: Synthetic polypeptide
DEEEIRTTNPVATEQYGSVSTVLQGIIGGNQE

SEQ ID NO: 29965 - protein, 30 aa, Artificial Sequence
  Description of Artificial Sequence: Synthetic polypeptide
DEDEIATTNPVATEQYGSVATNLQRENNND

SEQ ID NO: 29966 - protein, 31 aa, Artificial Sequence
  Description of Artificial Sequence: Synthetic polypeptide
DEDEIATTNPVATEQYGSVATNLQREGNPQP

SEQ ID NO: 29967 - protein, 31 aa, Artificial Sequence
  Description of Artificial Sequence: Synthetic polypeptide
DEEAIRTTNPVATEQWGSVATNNLQHIGVNR

SEQ ID NO: 29968 - protein, 30 aa, Artificial Sequence
  Description of Artificial Sequence: Synthetic polypeptide
DEDEIATTNPVATEQYGSVATNLQREENHE

SEQ ID NO: 29969 - protein, 33 aa, Artificial Sequence
  Description of Artificial Sequence: Synthetic polypeptide
DEEEIRTTNPVATEQYGSVQSPTNLNPRFGENE

SEQ ID NO: 29970 - protein, 31 aa, Artificial Sequence
  Description of Artificial Sequence: Synthetic polypeptide
DEEEIRTTNPVATEQYGSVSPSFLLQRVNIE

SEQ ID NO: 29971 - protein, 30 aa, Artificial Sequence
  Description of Artificial Sequence: Synthetic polypeptide
DEAEIRTTNPVATEQWGEVSTNLQGGGNDE

SEQ ID NO: 29972 - protein, 32 aa, Artificial Sequence
  Description of Artificial Sequence: Synthetic polypeptide
DEEEIRTTNPVATEQYGSVQSPTNLERDDNTE

SEQ ID NO: 29973 - protein, 33 aa, Artificial Sequence
  Description of Artificial Sequence: Synthetic polypeptide
DEEEIRTTNPVATEQYGSVSPQTQLQRGENNGQ

SEQ ID NO: 29974 - protein, 30 aa, Artificial Sequence
  Description of Artificial Sequence: Synthetic polypeptide
DEAEIRTTNPVATEQWGCVSTNLQGDGNEP

SEQ ID NO: 29975 - protein, 32 aa, Artificial Sequence
  Description of Artificial Sequence: Synthetic polypeptide
DEEEIRTTNPVATEQYGSVSTNLQAMLELASR

SEQ ID NO: 29976 - protein, 30 aa, Artificial Sequence
  Description of Artificial Sequence: Synthetic polypeptide
DEDEIATTNPVATEQYGSVATNLQQGNPDV

SEQ ID NO: 29977 - protein, 31 aa, Artificial Sequence
  Description of Artificial Sequence: Synthetic polypeptide
DEAEIRTTNPVAYEQYGSISTNELSERPGNR

SEQ ID NO: 29978 - protein, 32 aa, Artificial Sequence
  Description of Artificial Sequence: Synthetic polypeptide
DEEEIRTTNPVATEQYGSVQSNTDLQERGEED

SEQ ID NO: 29979 - protein, 30 aa, Artificial Sequence
  Description of Artificial Sequence: Synthetic polypeptide
DEDEIATTNPVATEQYGSVATNLQQGNDQL

SEQ ID NO: 29980 - protein, 30 aa, Artificial Sequence
  Description of Artificial Sequence: Synthetic polypeptide
DEEEIRTTNPVATEQYGSVVPNLNQTENQE

SEQ ID NO: 29981 - protein, 33 aa, Artificial Sequence
  Description of Artificial Sequence: Synthetic polypeptide
DEEEIRTTNPVATEQYGSVVPSCANLAQRVGSR

SEQ ID NO: 29982 - protein, 30 aa, Artificial Sequence
  Description of Artificial Sequence: Synthetic polypeptide
DEAEIRTTNPVATEQYGSVTTPLQNSGQER

SEQ ID NO: 29983 - protein, 32 aa, Artificial Sequence
  Description of Artificial Sequence: Synthetic polypeptide
DEEEIRTTNPVATEQYGSVVPSCINLSGRGNE

SEQ ID NO: 29984 - protein, 29 aa, Artificial Sequence
  Description of Artificial Sequence: Synthetic peptide
DEAEIRTTNPVAYEQYGSISSTNLEDPNR

SEQ ID NO: 29985 - protein, 33 aa, Artificial Sequence
  Description of Artificial Sequence: Synthetic polypeptide
DEEEIRTTNPVATEQYGSVVPSCTGNLSTRGND

SEQ ID NO: 29986 - protein, 31 aa, Artificial Sequence
  Description of Artificial Sequence: Synthetic polypeptide
DEEEIRTTNPVATEQYGSVSMDLQEPGDERQ

SEQ ID NO: 29987 - protein, 32 aa, Artificial Sequence
  Description of Artificial Sequence: Synthetic polypeptide
DEEEIRTTNPVATEQYGSVSTVLQGMQGINGE

SEQ ID NO: 29988 - protein, 30 aa, Artificial Sequence
  Description of Artificial Sequence: Synthetic polypeptide
DEEEIRTTNPVATEQYGSVSPSNLEDLNVT

SEQ ID NO: 29989 - protein, 30 aa, Artificial Sequence
  Description of Artificial Sequence: Synthetic polypeptide
DEEEIRTTNPVATEQYGSVSPSNLERNEEF

SEQ ID NO: 29990 - protein, 32 aa, Artificial Sequence
  Description of Artificial Sequence: Synthetic polypeptide
DEEEIRTTNPVATEQYGSVSTMGLINQGGENT

SEQ ID NO: 29991 - protein, 32 aa, Artificial Sequence
  Description of Artificial Sequence: Synthetic polypeptide
DEEEIRTTNPVATEQYGSVSTVLQNDEGNEGT

SEQ ID NO: 29992 - protein, 30 aa, Artificial Sequence
  Description of Artificial Sequence: Synthetic polypeptide
DEDEIRTTNPVATEQYGSVSTNDQGQDNGA

SEQ ID NO: 29993 - protein, 31 aa, Artificial Sequence
  Description of Artificial Sequence: Synthetic polypeptide
DEEEIRTTNPVATEQYGSVSINLQQEGMPLG

SEQ ID NO: 29994 - protein, 28 aa, Artificial Sequence
  Description of Artificial Sequence: Synthetic peptide
DEAEIRTTNPVAYEQYGSTATNLERPNN

SEQ ID NO: 29995 - protein, 30 aa, Artificial Sequence
  Description of Artificial Sequence: Synthetic polypeptide
DEEEIRTTNPVATEQYGSVSPSPLERMNDE

SEQ ID NO: 29996 - protein, 32 aa, Artificial Sequence
  Description of Artificial Sequence: Synthetic polypeptide
DEAEIRTTNPVATEQWGSVVSCTNLSQTGGNR

SEQ ID NO: 29997 - protein, 31 aa, Artificial Sequence
  Description of Artificial Sequence: Synthetic polypeptide
DEAEIRTTNPVATEQWGSVSTNLQERGEDQA

SEQ ID NO: 29998 - protein, 32 aa, Artificial Sequence
  Description of Artificial Sequence: Synthetic polypeptide
DEEEIRTTNPVATEQYGSVSTMGLQMEGNGNI

SEQ ID NO: 29999 - protein, 32 aa, Artificial Sequence
  Description of Artificial Sequence: Synthetic polypeptide
DEEEIRTTNPVATEQYGSVSTVLQMDGGNEED

SEQ ID NO: 30000 - protein, 33 aa, Artificial Sequence
  Description of Artificial Sequence: Synthetic polypeptide
DEEEIRTTNPVATEQYGSVSTPNLPQRVNNDLF

SEQ ID NO: 30001 - protein, 32 aa, Artificial Sequence
  Description of Artificial Sequence: Synthetic polypeptide
DEEEIRTTNPVATEQYGSVSETNGLDQQGELS

SEQ ID NO: 30002 - protein, 29 aa, Artificial Sequence
  Description of Artificial Sequence: Synthetic peptide
DEAEIRTTNPVATEQWGSVATNLEEGNNQ

SEQ ID NO: 30003 - protein, 32 aa, Artificial Sequence
  Description of Artificial Sequence: Synthetic polypeptide
DEAEIRTTNPVATEQWGSTVVSTNLSQAGGNR

SEQ ID NO: 30004 - protein, 32 aa, Artificial Sequence
  Description of Artificial Sequence: Synthetic polypeptide
DEEEIRTTNPVATEQYGSVSTVLQLQGETGNE

SEQ ID NO: 30005 - protein, 33 aa, Artificial Sequence
  Description of Artificial Sequence: Synthetic polypeptide
DEEEIRTTNPVATEQYGSVVGSTVNLQETGTNI

SEQ ID NO: 30006 - protein, 30 aa, Artificial Sequence
  Description of Artificial Sequence: Synthetic polypeptide
DEEAIRTTNPVATEQWGSVATSNLTLGGNR

SEQ ID NO: 30007 - protein, 30 aa, Artificial Sequence
  Description of Artificial Sequence: Synthetic polypeptide
DEEAIRTTNPVATEQWGSVATNNLQVGSNA

SEQ ID NO: 30008 - protein, 30 aa, Artificial Sequence
  Description of Artificial Sequence: Synthetic polypeptide
DEDEIATTNPVATEQYGSVATPNLQNGNES

SEQ ID NO: 30009 - protein, 32 aa, Artificial Sequence
  Description of Artificial Sequence: Synthetic polypeptide
DEEEIRTTNPVATEQYGSVSTVLQLMEGGNES

SEQ ID NO: 30010 - protein, 31 aa, Artificial Sequence
  Description of Artificial Sequence: Synthetic polypeptide
DEEEIRTTNPVATEQYGSVVLTSDLQRGEGV

SEQ ID NO: 30011 - protein, 31 aa, Artificial Sequence
  Description of Artificial Sequence: Synthetic polypeptide
DEEEIRTTNPVATEQYGSVQSSNDERGEERA

SEQ ID NO: 30012 - protein, 31 aa, Artificial Sequence
  Description of Artificial Sequence: Synthetic polypeptide
DEEEIRTTNPVATEQYGSVSPSNLIQEDPER

SEQ ID NO: 30013 - protein, 28 aa, Artificial Sequence
  Description of Artificial Sequence: Synthetic peptide
DEAEIRTTNPVAYEQYGSISTNPEGPNR

SEQ ID NO: 30014 - protein, 30 aa, Artificial Sequence
  Description of Artificial Sequence: Synthetic polypeptide
DEEAIRTTNPVATEQWGSVATNNLQLGGIR

SEQ ID NO: 30015 - protein, 30 aa, Artificial Sequence
  Description of Artificial Sequence: Synthetic polypeptide
DEAEIRTTNPVAYEQYGSISTNMLTRTPNR

SEQ ID NO: 30016 - protein, 31 aa, Artificial Sequence
  Description of Artificial Sequence: Synthetic polypeptide
DEEEIRTTNPVATEQYGSVSINLGVRGPELV

SEQ ID NO: 30017 - protein, 29 aa, Artificial Sequence
  Description of Artificial Sequence: Synthetic peptide
DEEEIRTTNPVATEQYGSVSTMGQVNEIV

SEQ ID NO: 30018 - protein, 29 aa, Artificial Sequence
  Description of Artificial Sequence: Synthetic peptide
DEDEIATTNPVATEQYGSVATNLQVPDND

SEQ ID NO: 30019 - protein, 33 aa, Artificial Sequence
  Description of Artificial Sequence: Synthetic polypeptide
DEEEIRTTNPVATEQYGSVSTPNLPNMRNGMNV

SEQ ID NO: 30020 - protein, 31 aa, Artificial Sequence
  Description of Artificial Sequence: Synthetic polypeptide
DEDEIRTTNPVATEIYGSVSTNLQHDQGNQE

SEQ ID NO: 30021 - protein, 32 aa, Artificial Sequence
  Description of Artificial Sequence: Synthetic polypeptide
DEEEIRTTNPVATEQYGSVSTMDLQLNGNGNI

SEQ ID NO: 30022 - protein, 32 aa, Artificial Sequence
  Description of Artificial Sequence: Synthetic polypeptide
DEEEIRTTNPVATEQYGSVSTMDLQLDGNGDD

SEQ ID NO: 30023 - protein, 30 aa, Artificial Sequence
  Description of Artificial Sequence: Synthetic polypeptide
DEAEIRTTNPVAYEQYGVVSTPELQRPGND

SEQ ID NO: 30024 - protein, 30 aa, Artificial Sequence
  Description of Artificial Sequence: Synthetic polypeptide
DEAEIRTTNPVAYEQYGVVSTNLEQEGNSG

SEQ ID NO: 30025 - protein, 31 aa, Artificial Sequence
  Description of Artificial Sequence: Synthetic polypeptide
DEEEIRTTNPVATEQYGSVSPTDLNNNGNSG

SEQ ID NO: 30026 - protein, 32 aa, Artificial Sequence
  Description of Artificial Sequence: Synthetic polypeptide
DEEEIRTTNPVATEQYGSVSNSNLQRFMNDGQ

SEQ ID NO: 30027 - protein, 31 aa, Artificial Sequence
  Description of Artificial Sequence: Synthetic polypeptide
DEEEIRTTNPVATEQYGSVSCTNGGQRSQKF

SEQ ID NO: 30028 - protein, 29 aa, Artificial Sequence
  Description of Artificial Sequence: Synthetic peptide
DEAEIRTTNPVAYEQYGVVSTELQRPSND

SEQ ID NO: 30029 - protein, 30 aa, Artificial Sequence
  Description of Artificial Sequence: Synthetic polypeptide
DEECIRTTNPVATEQYDYSVSINLQNGSNA

SEQ ID NO: 30030 - protein, 33 aa, Artificial Sequence
  Description of Artificial Sequence: Synthetic polypeptide
DEEEIRTTNPVATEQYGSVSTVNLGQENDENIR

SEQ ID NO: 30031 - protein, 33 aa, Artificial Sequence
  Description of Artificial Sequence: Synthetic polypeptide
DEEEIRTTNPVATEQYGSVSTVNLEQDPGGNEI

SEQ ID NO: 30032 - protein, 32 aa, Artificial Sequence
  Description of Artificial Sequence: Synthetic polypeptide
DEEEIRTTNPVATEQYGSVTSTNLVGNGGNED

SEQ ID NO: 30033 - protein, 32 aa, Artificial Sequence
  Description of Artificial Sequence: Synthetic polypeptide
DEEEIRTTNPVATEQYGSVSTVNLEEVGGNPQ

SEQ ID NO: 30034 - protein, 32 aa, Artificial Sequence
  Description of Artificial Sequence: Synthetic polypeptide
DEEEIRTTNPVATEQYGSVSTLNVDQDEMGNG

SEQ ID NO: 30035 - protein, 32 aa, Artificial Sequence
  Description of Artificial Sequence: Synthetic polypeptide
DEEEIRTTNPVATEQYGSVSETNLEDDEGEND

SEQ ID NO: 30036 - protein, 32 aa, Artificial Sequence
  Description of Artificial Sequence: Synthetic polypeptide
DEEEIRTTNPVATEQYGSVSTLNQQNQGTNIF

SEQ ID NO: 30037 - protein, 29 aa, Artificial Sequence
  Description of Artificial Sequence: Synthetic peptide
DEAEIRTTNPVAYEQYGVSISTNLERPDR

SEQ ID NO: 30038 - protein, 33 aa, Artificial Sequence
  Description of Artificial Sequence: Synthetic polypeptide
DEDEIRTTNPVATEQYGSVSTNLGQNDNGNNMR

SEQ ID NO: 30039 - protein, 32 aa, Artificial Sequence
  Description of Artificial Sequence: Synthetic polypeptide
DEEEIRTTNPVATEQYGSVSISNLQTDGGNND

SEQ ID NO: 30040 - protein, 32 aa, Artificial Sequence
  Description of Artificial Sequence: Synthetic polypeptide
DEEEIRTTNPVATEQYGSVSTPNLGDVEGGNN

SEQ ID NO: 30041 - protein, 32 aa, Artificial Sequence
  Description of Artificial Sequence: Synthetic polypeptide
DEEEIRTTNPVATEQYGSVTSTNNLDFGGNEQ

SEQ ID NO: 30042 - protein, 32 aa, Artificial Sequence
  Description of Artificial Sequence: Synthetic polypeptide
DEEEIRTTNPVATEQYGSVQSTPNLQTDVNLF

SEQ ID NO: 30043 - protein, 33 aa, Artificial Sequence
  Description of Artificial Sequence: Synthetic polypeptide
DEEEIRTTNPVATEQYGSVTSTNNLQFFGSNQP

SEQ ID NO: 30044 - protein, 32 aa, Artificial Sequence
  Description of Artificial Sequence: Synthetic polypeptide
DEEEIRTTNPVATEQYGSVSTLPLEQGGENTS

SEQ ID NO: 30045 - protein, 32 aa, Artificial Sequence
  Description of Artificial Sequence: Synthetic polypeptide
DEEEIRTTNPVATEQYGSVSTVNGQSPGNGIP

SEQ ID NO: 30046 - protein, 32 aa, Artificial Sequence
  Description of Artificial Sequence: Synthetic polypeptide
DEEEIRTTNPVATEQYGSVSTPNLGDVEGNEQ

SEQ ID NO: 30047 - protein, 32 aa, Artificial Sequence
  Description of Artificial Sequence: Synthetic polypeptide
DEEEIRTTNPVATEQYGSVSPTDLIRGDNDQI

SEQ ID NO: 30048 - protein, 32 aa, Artificial Sequence
  Description of Artificial Sequence: Synthetic polypeptide
DEEEIRTTNPVATEQYGSVSPTDLINFGNDRI

SEQ ID NO: 30049 - protein, 32 aa, Artificial Sequence
  Description of Artificial Sequence: Synthetic polypeptide
DEEEIRTTNPVATEQYGSVSTLPNQLNQEDNQ

SEQ ID NO: 30050 - protein, 33 aa, Artificial Sequence
  Description of Artificial Sequence: Synthetic polypeptide
DEEEIRTTNPVATEQYGSVQSTPNLIQEQEINR

SEQ ID NO: 30051 - protein, 32 aa, Artificial Sequence
  Description of Artificial Sequence: Synthetic polypeptide
DEECIRTTNPVATEQYGCAVCSTTNDLQRGNN

SEQ ID NO: 30052 - protein, 29 aa, Artificial Sequence
  Description of Artificial Sequence: Synthetic peptide
DEAEIRTTNPVATEQYGCVCSTELQRPDD

SEQ ID NO: 30053 - protein, 32 aa, Artificial Sequence
  Description of Artificial Sequence: Synthetic polypeptide
DEEEIRTTNPVATEQYGSVSTNLQEVAESNVL

SEQ ID NO: 30054 - protein, 33 aa, Artificial Sequence
  Description of Artificial Sequence: Synthetic polypeptide
DEEEIRTTNPVATEQYGSVSTVNLIQGQGGNTQ

SEQ ID NO: 30055 - protein, 33 aa, Artificial Sequence
  Description of Artificial Sequence: Synthetic polypeptide
DEEEIRTTNPVATEQYGSVSTVNLQGIGFNNQE

SEQ ID NO: 30056 - protein, 33 aa, Artificial Sequence
  Description of Artificial Sequence: Synthetic polypeptide
DEEEIRTTNPVATEQYGSVQSTYLQERGTNDQD

SEQ ID NO: 30057 - protein, 33 aa, Artificial Sequence
  Description of Artificial Sequence: Synthetic polypeptide
DEEEIRTTNPVATEQYGSVSTNLQFGDGENEQV

SEQ ID NO: 30058 - protein, 33 aa, Artificial Sequence
  Description of Artificial Sequence: Synthetic polypeptide
DEEEIRTTNPVATEQYGSVTSTNLNQNGGGNID

SEQ ID NO: 30059 - protein, 33 aa, Artificial Sequence
  Description of Artificial Sequence: Synthetic polypeptide
DEEEIRTTNPVATEQYGSVSTVNLQGIGFNGET

SEQ ID NO: 30060 - protein, 31 aa, Artificial Sequence
  Description of Artificial Sequence: Synthetic polypeptide
DEEEIRTTNPVATEQYGSVSTLNHQDMSEDR

SEQ ID NO: 30061 - protein, 30 aa, Artificial Sequence
  Description of Artificial Sequence: Synthetic polypeptide
DEEEIRTTNPVATEQYGSVSPTDLQTDSEM

SEQ ID NO: 30062 - protein, 32 aa, Artificial Sequence
  Description of Artificial Sequence: Synthetic polypeptide
DEEEIRTTNPVATEQYGSVSTVNLQGEMNDNP

SEQ ID NO: 30063 - protein, 33 aa, Artificial Sequence
  Description of Artificial Sequence: Synthetic polypeptide
DEEEIRTTNPVATEQYGSVSTVNLQFNFGNQNA

SEQ ID NO: 30064 - protein, 33 aa, Artificial Sequence
  Description of Artificial Sequence: Synthetic polypeptide
DEEEIRTTNPVATEQYGSVSTVNLQFNFGNGQN

SEQ ID NO: 30065 - protein, 33 aa, Artificial Sequence
  Description of Artificial Sequence: Synthetic polypeptide
DEEEIRTTNPVATEQYGSVSTLNLAQNNGENNM

SEQ ID NO: 30066 - protein, 31 aa, Artificial Sequence
  Description of Artificial Sequence: Synthetic polypeptide
DEAEIRTTNPVAYEQYGVVVSTNLQMGDNER

SEQ ID NO: 30067 - protein, 32 aa, Artificial Sequence
  Description of Artificial Sequence: Synthetic polypeptide
DEEEIRTTNPVATEQYGSVSTLNLDVEGENGE

SEQ ID NO: 30068 - protein, 31 aa, Artificial Sequence
  Description of Artificial Sequence: Synthetic polypeptide
DEDEIRTTNPVATEHYGSVSTNLQGNAGEDR

SEQ ID NO: 30069 - protein, 32 aa, Artificial Sequence
  Description of Artificial Sequence: Synthetic polypeptide
DEEEIRTTNPVATEQYGSVTSTNLQFFNSNQS

SEQ ID NO: 30070 - protein, 33 aa, Artificial Sequence
  Description of Artificial Sequence: Synthetic polypeptide
DEEEIRTTNPVATEQYGSVTSTNLQLNGGNGEE

SEQ ID NO: 30071 - protein, 30 aa, Artificial Sequence
  Description of Artificial Sequence: Synthetic polypeptide
DEDEIRTTNPVATEHYGSVSTNLQMGDGEN

SEQ ID NO: 30072 - protein, 32 aa, Artificial Sequence
  Description of Artificial Sequence: Synthetic polypeptide
DEEEIRTTNPVATEQYGSVSTPNLFEFGENIN

SEQ ID NO: 30073 - protein, 33 aa, Artificial Sequence
  Description of Artificial Sequence: Synthetic polypeptide
DEEEIRTTNPVATEQYGSVSTLNLQAESGEDER

SEQ ID NO: 30074 - protein, 34 aa, Artificial Sequence
  Description of Artificial Sequence: Synthetic polypeptide
DEEEIRTTNPVATEQYGSVSTLNLQARSGLDERN

SEQ ID NO: 30075 - protein, 31 aa, Artificial Sequence
  Description of Artificial Sequence: Synthetic polypeptide
DEEEIRTTNPVATEQYGSVSNSNDQGGGNNV

SEQ ID NO: 30076 - protein, 31 aa, Artificial Sequence
  Description of Artificial Sequence: Synthetic polypeptide
DEDEIRTTNPVATEHYGSVSTNLQMGGDDRN

SEQ ID NO: 30077 - protein, 32 aa, Artificial Sequence
  Description of Artificial Sequence: Synthetic polypeptide
DEEEIRTTNPVATEQYGSVSTPNLFEFGGNQQ

SEQ ID NO: 30078 - protein, 31 aa, Artificial Sequence
  Description of Artificial Sequence: Synthetic polypeptide
DEAEIRTTNPVAYEQYGVVVSTNLQGEGNER

SEQ ID NO: 30079 - protein, 32 aa, Artificial Sequence
  Description of Artificial Sequence: Synthetic polypeptide
DEEEIRTTNPVATEQYGSVSTPNLFETNGNIN

SEQ ID NO: 30080 - protein, 33 aa, Artificial Sequence
  Description of Artificial Sequence: Synthetic polypeptide
DEEEIRTTNPVATEQYGSVSTVNLNQNEGGNFV

SEQ ID NO: 30081 - protein, 33 aa, Artificial Sequence
  Description of Artificial Sequence: Synthetic polypeptide
DEEEIRTTNPVATEQYGSVSTVNLNQIGENEFV

SEQ ID NO: 30082 - protein, 32 aa, Artificial Sequence
  Description of Artificial Sequence: Synthetic polypeptide
DEEEIRTTNPVATEQYGSVSTLNNMQNEGNNE

SEQ ID NO: 30083 - protein, 32 aa, Artificial Sequence
  Description of Artificial Sequence: Synthetic polypeptide
DEEEIRTTNPVATEQYGSVSTLNNNAQNGNND

SEQ ID NO: 30084 - protein, 32 aa, Artificial Sequence
  Description of Artificial Sequence: Synthetic polypeptide
DEEEIRTTNPVATEQYGSVTSTSNLENQGFNQ

SEQ ID NO: 30085 - protein, 33 aa, Artificial Sequence
  Description of Artificial Sequence: Synthetic polypeptide
DEEEIRTTNPVATEQYGSVTSTTENLGQEIGNT

SEQ ID NO: 30086 - protein, 32 aa, Artificial Sequence
  Description of Artificial Sequence: Synthetic polypeptide
DEEEIRTTNPVATEQYGSVSTVNDQGTGNMNQ

SEQ ID NO: 30087 - protein, 32 aa, Artificial Sequence
  Description of Artificial Sequence: Synthetic polypeptide
DEEEIRTTNPVATEQYGSVSTPNLINFEGGNE

SEQ ID NO: 30088 - protein, 32 aa, Artificial Sequence
  Description of Artificial Sequence: Synthetic polypeptide
DEEEIRTTNPVATEQYGSVSTNLQDTGMDQDL

SEQ ID NO: 30089 - protein, 31 aa, Artificial Sequence
  Description of Artificial Sequence: Synthetic polypeptide
DEEEIRTTNPVATEQYGSVSTMDEQRGPLIE

SEQ ID NO: 30090 - protein, 32 aa, Artificial Sequence
  Description of Artificial Sequence: Synthetic polypeptide
DEEEIRTTNPVATEQYGSVSPTDDGQRSQNGR

SEQ ID NO: 30091 - protein, 33 aa, Artificial Sequence
  Description of Artificial Sequence: Synthetic polypeptide
DEEEIRTTNPVATEQYGSVSTPNLIQSGFGEND

SEQ ID NO: 30092 - protein, 32 aa, Artificial Sequence
  Description of Artificial Sequence: Synthetic polypeptide
DEEEIRTTNPVATEQYGSVSPTDALQRDSERM

SEQ ID NO: 30093 - protein, 32 aa, Artificial Sequence
  Description of Artificial Sequence: Synthetic polypeptide
DEECIRTTNPVATEQYGCVCSMTGNLQFGSNR

SEQ ID NO: 30094 - protein, 31 aa, Artificial Sequence
  Description of Artificial Sequence: Synthetic polypeptide
DEEEIRTTNPVATEQYGSVTTNGLQSNGIDN

SEQ ID NO: 30095 - protein, 33 aa, Artificial Sequence
  Description of Artificial Sequence: Synthetic polypeptide
DEEEIRTTNPVATEQYGSVSPTAWLEQRSQNRT

SEQ ID NO: 30096 - protein, 32 aa, Artificial Sequence
  Description of Artificial Sequence: Synthetic polypeptide
DEEEIRTTNPVATEQYGSVSTMDIGNGQGGNE

SEQ ID NO: 30097 - protein, 29 aa, Artificial Sequence
  Description of Artificial Sequence: Synthetic peptide
DEEEIRTTNPVATEQYGSVSIPLQNLEEI

SEQ ID NO: 30098 - protein, 32 aa, Artificial Sequence
  Description of Artificial Sequence: Synthetic polypeptide
DEEEIRTTNPVATEQYGSVSTVLQSDNGNIQE

SEQ ID NO: 30099 - protein, 31 aa, Artificial Sequence
  Description of Artificial Sequence: Synthetic polypeptide
DEEEIRTTNPVATEQYGSVSPTASQQRGVEL

SEQ ID NO: 30100 - protein, 33 aa, Artificial Sequence
  Description of Artificial Sequence: Synthetic polypeptide
DEEEIRTTNPVATEQYGSVSTPNLIQVEGENEF

SEQ ID NO: 30101 - protein, 32 aa, Artificial Sequence
  Description of Artificial Sequence: Synthetic polypeptide
DEEEIRTTNPVATEQYGSVSTMDLDVRGENDG

SEQ ID NO: 30102 - protein, 32 aa, Artificial Sequence
  Description of Artificial Sequence: Synthetic polypeptide
DEEEIRTTNPVATEQYGSVSNTALQEYFGSNQ

SEQ ID NO: 30103 - protein, 33 aa, Artificial Sequence
  Description of Artificial Sequence: Synthetic polypeptide
DEEEIRTTNPVATEQYGSVSINQLQEREGNPLD

SEQ ID NO: 30104 - protein, 30 aa, Artificial Sequence
  Description of Artificial Sequence: Synthetic polypeptide
DEEAIRTTNPVATEQWGSVQTNNLQLGSNF

SEQ ID NO: 30105 - protein, 31 aa, Artificial Sequence
  Description of Artificial Sequence: Synthetic polypeptide
DEEEIRTTNPVATEQYGSVTTNLESRDEDER

SEQ ID NO: 30106 - protein, 31 aa, Artificial Sequence
  Description of Artificial Sequence: Synthetic polypeptide
DEDEIRTTNPVATEIYGSVSTNLQGGDNGDM

SEQ ID NO: 30107 - protein, 32 aa, Artificial Sequence
  Description of Artificial Sequence: Synthetic polypeptide
DEEEIRTTNPVATEQYGSVSCTNGSQRVGSFV

SEQ ID NO: 30108 - protein, 30 aa, Artificial Sequence
  Description of Artificial Sequence: Synthetic polypeptide
DEEAIRTTNPVATEQWGSVQTNNHQYGNNR

SEQ ID NO: 30109 - protein, 31 aa, Artificial Sequence
  Description of Artificial Sequence: Synthetic polypeptide
DEEAIRTTNPVATEQWGSVQTNELQHGSNRS

SEQ ID NO: 30110 - protein, 30 aa, Artificial Sequence
  Description of Artificial Sequence: Synthetic polypeptide
DEEEIRTTNPVATEQYGSVTTNLEVGGGEF

SEQ ID NO: 30111 - protein, 32 aa, Artificial Sequence
  Description of Artificial Sequence: Synthetic polypeptide
DEEEIRTTNPVATEQYGSVSTPNLMETGENIG

SEQ ID NO: 30112 - protein, 32 aa, Artificial Sequence
  Description of Artificial Sequence: Synthetic polypeptide
DEEEIRTTNPVATEQYGSVSNTANEQGGGNFE

SEQ ID NO: 30113 - protein, 30 aa, Artificial Sequence
  Description of Artificial Sequence: Synthetic polypeptide
DEEAIRTTNPVATEQWGSVGTNNHQHGSNR

SEQ ID NO: 30114 - protein, 32 aa, Artificial Sequence
  Description of Artificial Sequence: Synthetic polypeptide
DEEEIRTTNPVATEQYGSVSTVLQRQEVTERT

SEQ ID NO: 30115 - protein, 31 aa, Artificial Sequence
  Description of Artificial Sequence: Synthetic polypeptide
DEEEIRTTNPVATEQYGSVSTMDLQDSNNDD

SEQ ID NO: 30116 - protein, 32 aa, Artificial Sequence
  Description of Artificial Sequence: Synthetic polypeptide
DEEEIRTTNPVATEQYGSVSTNLQDNNASDPG

SEQ ID NO: 30117 - protein, 31 aa, Artificial Sequence
  Description of Artificial Sequence: Synthetic polypeptide
DEEEIRTTNPVATEQYGSVSIPNSLQMVNEL

SEQ ID NO: 30118 - protein, 32 aa, Artificial Sequence
  Description of Artificial Sequence: Synthetic polypeptide
DEEEIRTTNPVATEQYGSVSETNGGQGRGVVD

SEQ ID NO: 30119 - protein, 32 aa, Artificial Sequence
  Description of Artificial Sequence: Synthetic polypeptide
DEEEIRTTNPVATEQYGSVQSTNLQSDVNLDD

SEQ ID NO: 30120 - protein, 31 aa, Artificial Sequence
  Description of Artificial Sequence: Synthetic polypeptide
DEEEIRTTNPVATEQYGSVTTGNLIGGGNTQ

SEQ ID NO: 30121 - protein, 32 aa, Artificial Sequence
  Description of Artificial Sequence: Synthetic polypeptide
DEEEIRTTNPVATEQYGSVSTLPNQLQEEENQ

SEQ ID NO: 30122 - protein, 32 aa, Artificial Sequence
  Description of Artificial Sequence: Synthetic polypeptide
DEEEIRTTNPVATEQYGSVSNSNLQSEGNNNV

SEQ ID NO: 30123 - protein, 31 aa, Artificial Sequence
  Description of Artificial Sequence: Synthetic polypeptide
DEEEIRTTNPVATEQYGSVSPTDLEREQQRD

SEQ ID NO: 30124 - protein, 32 aa, Artificial Sequence
  Description of Artificial Sequence: Synthetic polypeptide
DEDEIRTTNPVATEQYGSVSTNLGHEGGDNDR

SEQ ID NO: 30125 - protein, 33 aa, Artificial Sequence
  Description of Artificial Sequence: Synthetic polypeptide
DEEEIRTTNPVATEQYGSVSTNLQEFSGSNTQA

SEQ ID NO: 30126 - protein, 33 aa, Artificial Sequence
  Description of Artificial Sequence: Synthetic polypeptide
DEEEIRTTNPVATEQYGSVTSTTNNLQQGIGNI

SEQ ID NO: 30127 - protein, 31 aa, Artificial Sequence
  Description of Artificial Sequence: Synthetic polypeptide
DEDEIRTTNPVATEIYGSVCSNNLQRDGTNA

SEQ ID NO: 30128 - protein, 31 aa, Artificial Sequence
  Description of Artificial Sequence: Synthetic polypeptide
DEEEIRTTNPVATEQYGSVSPTDLEREDDFR

SEQ ID NO: 30129 - protein, 30 aa, Artificial Sequence
  Description of Artificial Sequence: Synthetic polypeptide
DEEEIRTTNPVATEQYGSVSNSNLQSTEVN

SEQ ID NO: 30130 - protein, 31 aa, Artificial Sequence
  Description of Artificial Sequence: Synthetic polypeptide
DEEEIRTTNPVATEQYGSVSNSVLQMTGNDI

SEQ ID NO: 30131 - protein, 33 aa, Artificial Sequence
  Description of Artificial Sequence: Synthetic polypeptide
DEEEIRTTNPVATEQYGSVQSTNSIQNTQGNER

SEQ ID NO: 30132 - protein, 31 aa, Artificial Sequence
  Description of Artificial Sequence: Synthetic polypeptide
DEEEIRTTNPVATEQYGSVSTVMQGMGINES

SEQ ID NO: 30133 - protein, 33 aa, Artificial Sequence
  Description of Artificial Sequence: Synthetic polypeptide
DEEEIRTTNPVATEQYGSVSTPNLIQNDGNEDD

SEQ ID NO: 30134 - protein, 32 aa, Artificial Sequence
  Description of Artificial Sequence: Synthetic polypeptide
DEEEIRTTNPVATEQYGSVSTVMNGQGGGGND

SEQ ID NO: 30135 - protein, 32 aa, Artificial Sequence
  Description of Artificial Sequence: Synthetic polypeptide
DEEEIRTTNPVATEQYGSVQSTNPQRFNSNQV

SEQ ID NO: 30136 - protein, 33 aa, Artificial Sequence
  Description of Artificial Sequence: Synthetic polypeptide
DEEEIRTTNPVATEQYGSVTSVTDNDQRGNDGF

SEQ ID NO: 30137 - protein, 32 aa, Artificial Sequence
  Description of Artificial Sequence: Synthetic polypeptide
DEEEIRTTNPVATEQYGSVSTVMNGQGGENGD

SEQ ID NO: 30138 - protein, 32 aa, Artificial Sequence
  Description of Artificial Sequence: Synthetic polypeptide
DEEEIRTTNPVATEQYGSVQSTNPQRFGSEDV

SEQ ID NO: 30139 - protein, 31 aa, Artificial Sequence
  Description of Artificial Sequence: Synthetic polypeptide
DEDEIRTTNPVATEIYGSVSTNLQDAGNNDQ

SEQ ID NO: 30140 - protein, 32 aa, Artificial Sequence
  Description of Artificial Sequence: Synthetic polypeptide
DEEEIRTTNPVATEQYGSVSETNLDVTDGNES

SEQ ID NO: 30141 - protein, 33 aa, Artificial Sequence
  Description of Artificial Sequence: Synthetic polypeptide
DEEEIRTTNPVATEQYGSVSTPNLIQQNGNENE

SEQ ID NO: 30142 - protein, 32 aa, Artificial Sequence
  Description of Artificial Sequence: Synthetic polypeptide
DEEEIRTTNPVATEQYGSVSPTDLDTRLNDRY

SEQ ID NO: 30143 - protein, 31 aa, Artificial Sequence
  Description of Artificial Sequence: Synthetic polypeptide
DEEEIRTTNPVATEQYGSVTTDDLQRGDEDM

SEQ ID NO: 30144 - protein, 29 aa, Artificial Sequence
  Description of Artificial Sequence: Synthetic peptide
DEEEIACTNPVATEQYGCVATNLERGNES

SEQ ID NO: 30145 - protein, 31 aa, Artificial Sequence
  Description of Artificial Sequence: Synthetic polypeptide
DEEEIRTTNPVATEQYGSVTTDLQNEEDNRQ

SEQ ID NO: 30146 - protein, 30 aa, Artificial Sequence
  Description of Artificial Sequence: Synthetic polypeptide
DEEEIRTTNPVATEQYGSVSTVLSFQGEGF

SEQ ID NO: 30147 - protein, 33 aa, Artificial Sequence
  Description of Artificial Sequence: Synthetic polypeptide
DEEEIRTTNPVATEQYGSVSTMDDEQYRGDNRD

SEQ ID NO: 30148 - protein, 30 aa, Artificial Sequence
  Description of Artificial Sequence: Synthetic polypeptide
DEEEIRTTNPVATEQYGSVTTGLQPIEERS

SEQ ID NO: 30149 - protein, 31 aa, Artificial Sequence
  Description of Artificial Sequence: Synthetic polypeptide
DEEEIRTTNPVATEQYGSVSPTDLDDQGDER

SEQ ID NO: 30150 - protein, 32 aa, Artificial Sequence
  Description of Artificial Sequence: Synthetic polypeptide
DEEEIRTTNPVATEQYGSVTTGNLQGGGGNGQ

SEQ ID NO: 30151 - protein, 31 aa, Artificial Sequence
  Description of Artificial Sequence: Synthetic polypeptide
DEEEIRTTNPVATEQYGSVSTPNLETGEEIM

SEQ ID NO: 30152 - protein, 30 aa, Artificial Sequence
  Description of Artificial Sequence: Synthetic polypeptide
DEEEIRTTNPVATEQYGSVSMDLNRGEDFT

SEQ ID NO: 30153 - protein, 34 aa, Artificial Sequence
  Description of Artificial Sequence: Synthetic polypeptide
DEEEIRTTNPVATEQYGSVVPSCTNALSSRGVNR

SEQ ID NO: 30154 - protein, 31 aa, Artificial Sequence
  Description of Artificial Sequence: Synthetic polypeptide
DEEEIRTTNPVATEQYGSVQNTVNLIERGQQ

SEQ ID NO: 30155 - protein, 32 aa, Artificial Sequence
  Description of Artificial Sequence: Synthetic polypeptide
DEEEIRTTNPVATEQYGSVSTMLNQQGINGEG

SEQ ID NO: 30156 - protein, 32 aa, Artificial Sequence
  Description of Artificial Sequence: Synthetic polypeptide
DEEEIRTTNPVATEQYGSVVSTMTLQRGVEFA

SEQ ID NO: 30157 - protein, 33 aa, Artificial Sequence
  Description of Artificial Sequence: Synthetic polypeptide
DEEEIRTTNPVATEQYGSVVSTMTLQRQGVERN

SEQ ID NO: 30158 - protein, 32 aa, Artificial Sequence
  Description of Artificial Sequence: Synthetic polypeptide
DEEEIRTTNPVATEQYGSVSTMLNQQSGNGEL

SEQ ID NO: 30159 - protein, 33 aa, Artificial Sequence
  Description of Artificial Sequence: Synthetic polypeptide
DEEEIRTTNPVATEQYGSVSTNLNQEDFGNLFG

SEQ ID NO: 30160 - protein, 30 aa, Artificial Sequence
  Description of Artificial Sequence: Synthetic polypeptide
DEEEIRTTNPVATEQYGSVQNTTLQTGEID

SEQ ID NO: 30161 - protein, 30 aa, Artificial Sequence
  Description of Artificial Sequence: Synthetic polypeptide
DEEEIRTTNPVATEQYGSVSMDDQRFGQDS

SEQ ID NO: 30162 - protein, 30 aa, Artificial Sequence
  Description of Artificial Sequence: Synthetic polypeptide
DEEEIRTTNPVATEQYGSVSMDDLQGGEDN

SEQ ID NO: 30163 - protein, 31 aa, Artificial Sequence
  Description of Artificial Sequence: Synthetic polypeptide
DEEEIRTTNPVATEQYGSVSLTNEQTMVNPD

SEQ ID NO: 30164 - protein, 29 aa, Artificial Sequence
  Description of Artificial Sequence: Synthetic peptide
DEEEIRTTNPVATEQYGSVSPNNIDHGEI

SEQ ID NO: 30165 - protein, 31 aa, Artificial Sequence
  Description of Artificial Sequence: Synthetic polypeptide
DEEEIRTTNPVATEQYGSVVSTNDDRNIDDR

SEQ ID NO: 30166 - protein, 31 aa, Artificial Sequence
  Description of Artificial Sequence: Synthetic polypeptide
DEEEIRTTNPVATEQYGSVSMDALQNTGEDR

SEQ ID NO: 30167 - protein, 29 aa, Artificial Sequence
  Description of Artificial Sequence: Synthetic peptide
DEAEIRTTNPVAYEQYGNVSTNPNQGGNM

SEQ ID NO: 30168 - protein, 32 aa, Artificial Sequence
  Description of Artificial Sequence: Synthetic polypeptide
DEEEIRTTNPVATEQYGSVVSTNDQMNGDERG

SEQ ID NO: 30169 - protein, 32 aa, Artificial Sequence
  Description of Artificial Sequence: Synthetic polypeptide
DEEEIRTTNPVATEQYGSVSTNLNPEIGNGQE

SEQ ID NO: 30170 - protein, 33 aa, Artificial Sequence
  Description of Artificial Sequence: Synthetic polypeptide
DEEEIRTTNPVATEQYGSVSTPNLQNIGGNITS

SEQ ID NO: 30171 - protein, 32 aa, Artificial Sequence
  Description of Artificial Sequence: Synthetic polypeptide
DEEEIRTTNPVATEQYGSVSTMLQDGGFNGEL

SEQ ID NO: 30172 - protein, 32 aa, Artificial Sequence
  Description of Artificial Sequence: Synthetic polypeptide
DEEEIRTTNPVATEQYGSVSTNLNLDGGGNID

SEQ ID NO: 30173 - protein, 29 aa, Artificial Sequence
  Description of Artificial Sequence: Synthetic peptide
DEDEIATTNPVATEQYGSVAANLGRNMNR

SEQ ID NO: 30174 - protein, 33 aa, Artificial Sequence
  Description of Artificial Sequence: Synthetic polypeptide
DEEEIRTTNPVATEQYGSVSNTDNNLQEEGNNS

SEQ ID NO: 30175 - protein, 32 aa, Artificial Sequence
  Description of Artificial Sequence: Synthetic polypeptide
DEEEIRTTNPVATEQYGSVSTPNLQNIGGVDE

SEQ ID NO: 30176 - protein, 32 aa, Artificial Sequence
  Description of Artificial Sequence: Synthetic polypeptide
DEEEIRTTNPVATEQYGSVSTNLNFTGGNNGQ

SEQ ID NO: 30177 - protein, 33 aa, Artificial Sequence
  Description of Artificial Sequence: Synthetic polypeptide
DEEEIRTTNPVATEQYGSVSCTNLSQEGGNNPY

SEQ ID NO: 30178 - protein, 32 aa, Artificial Sequence
  Description of Artificial Sequence: Synthetic polypeptide
DEEEIRTTNPVATEQYGSVSSNALQPRSVNSY

SEQ ID NO: 30179 - protein, 31 aa, Artificial Sequence
  Description of Artificial Sequence: Synthetic polypeptide
DEDEIATTNPVATEQYGSTVSINMLQRGNTG

SEQ ID NO: 30180 - protein, 32 aa, Artificial Sequence
  Description of Artificial Sequence: Synthetic polypeptide
DEEEIRTTNPVATEQYGSVSTMLQDQGQNGEE

SEQ ID NO: 30181 - protein, 32 aa, Artificial Sequence
  Description of Artificial Sequence: Synthetic polypeptide
DEEEIRTTNPVATEQYGSVSPNMELQRDVLRP

SEQ ID NO: 30182 - protein, 32 aa, Artificial Sequence
  Description of Artificial Sequence: Synthetic polypeptide
DEEEIRTTNPVATEQYGSVSTMLPQNIGNNET

SEQ ID NO: 30183 - protein, 30 aa, Artificial Sequence
  Description of Artificial Sequence: Synthetic polypeptide
DEEEIRTTNPVATEQYGSVSPNNIDRENNA

SEQ ID NO: 30184 - protein, 33 aa, Artificial Sequence
  Description of Artificial Sequence: Synthetic polypeptide
DEAEIRTTNPVATEQYGSVVSTNLQPGDGENSR

SEQ ID NO: 30185 - protein, 31 aa, Artificial Sequence
  Description of Artificial Sequence: Synthetic polypeptide
DEEEIRTTNPVATEQYGSVQPNNLQPRGLTD

SEQ ID NO: 30186 - protein, 32 aa, Artificial Sequence
  Description of Artificial Sequence: Synthetic polypeptide
DEEEIRTTNPVATEQYGSVQPTNFLQNGEQRL

SEQ ID NO: 30187 - protein, 29 aa, Artificial Sequence
  Description of Artificial Sequence: Synthetic peptide
DEDEIATTNPVATEQYGSVAMNLQQGNPL

SEQ ID NO: 30188 - protein, 30 aa, Artificial Sequence
  Description of Artificial Sequence: Synthetic polypeptide
DEAEIRTTNPVATEHYGSVSTNLQGMGGEA

SEQ ID NO: 30189 - protein, 31 aa, Artificial Sequence
  Description of Artificial Sequence: Synthetic polypeptide
DEEEIRTTNPVATEQYGSVSTVELDPAGENG

SEQ ID NO: 30190 - protein, 30 aa, Artificial Sequence
  Description of Artificial Sequence: Synthetic polypeptide
DEEEIRTTNPVATEQYGSVSIDLQRVLIEA

SEQ ID NO: 30191 - protein, 32 aa, Artificial Sequence
  Description of Artificial Sequence: Synthetic polypeptide
DEEEIRTTNPVATEQYGSVSLTLLQREVTDNI

SEQ ID NO: 30192 - protein, 30 aa, Artificial Sequence
  Description of Artificial Sequence: Synthetic polypeptide
DEDEIATTNPVATEQYGSVAITNLQQGNEH

SEQ ID NO: 30193 - protein, 31 aa, Artificial Sequence
  Description of Artificial Sequence: Synthetic polypeptide
DEEEIRTTNPVATEQYGSVVSTDGLQRESQQ

SEQ ID NO: 30194 - protein, 32 aa, Artificial Sequence
  Description of Artificial Sequence: Synthetic polypeptide
DEEEIRTTNPVATEQYGSVQPTDLQRGVNVTD

SEQ ID NO: 30195 - protein, 29 aa, Artificial Sequence
  Description of Artificial Sequence: Synthetic peptide
DEECIRATNPVATEQYGSVSVANEQGGNL

SEQ ID NO: 30196 - protein, 30 aa, Artificial Sequence
  Description of Artificial Sequence: Synthetic polypeptide
DEAEIRTTNPVATEHYGEVSTNLQGGGNEG

SEQ ID NO: 30197 - protein, 33 aa, Artificial Sequence
  Description of Artificial Sequence: Synthetic polypeptide
DEEEIRTTNPVATEQYGSVSTPNLQNFGFNQDD

SEQ ID NO: 30198 - protein, 30 aa, Artificial Sequence
  Description of Artificial Sequence: Synthetic polypeptide
DEECIRATNPVATEQYGSVSTNVNGQLGNL

SEQ ID NO: 30199 - protein, 31 aa, Artificial Sequence
  Description of Artificial Sequence: Synthetic polypeptide
DEEEIRTTNPVATEQYGSVSTVDLQNNGPQL

SEQ ID NO: 30200 - protein, 32 aa, Artificial Sequence
  Description of Artificial Sequence: Synthetic polypeptide
DEEEIRTTNPVATEQYGSVSTMLIQEFGNQIP

SEQ ID NO: 30201 - protein, 32 aa, Artificial Sequence
  Description of Artificial Sequence: Synthetic polypeptide
DEAEIRTTNPVATEQYGSVVSTNLDQGNGNVE

SEQ ID NO: 30202 - protein, 32 aa, Artificial Sequence
  Description of Artificial Sequence: Synthetic polypeptide
DEEEIRTTNPVATEQYGSVSTPNLQNIGGGGD

SEQ ID NO: 30203 - protein, 32 aa, Artificial Sequence
  Description of Artificial Sequence: Synthetic polypeptide
DEAEIRTTNPVATEQYGSVVSTNLQAGEGNNE

SEQ ID NO: 30204 - protein, 29 aa, Artificial Sequence
  Description of Artificial Sequence: Synthetic peptide
DEEAIRTTNPVATEIYGQVTTNLQRGSEH

SEQ ID NO: 30205 - protein, 32 aa, Artificial Sequence
  Description of Artificial Sequence: Synthetic polypeptide
DEAEIRTTNPVATEQYGSVVSTNLQDGNGNDE

SEQ ID NO: 30206 - protein, 31 aa, Artificial Sequence
  Description of Artificial Sequence: Synthetic polypeptide
DEEEIRTTNPVATEQYGSVQPTDEQRGQEER

SEQ ID NO: 30207 - protein, 32 aa, Artificial Sequence
  Description of Artificial Sequence: Synthetic polypeptide
DEEEIRTTNPVATEQYGSVSTNLNQFFPSNQY

SEQ ID NO: 30208 - protein, 30 aa, Artificial Sequence
  Description of Artificial Sequence: Synthetic polypeptide
DEDEIRTTNPVAYEQWGSVSTNHQDGGENR

SEQ ID NO: 30209 - protein, 31 aa, Artificial Sequence
  Description of Artificial Sequence: Synthetic polypeptide
DEEEIRTTNPVATEQYGSVSTMLMGGENEGT

SEQ ID NO: 30210 - protein, 31 aa, Artificial Sequence
  Description of Artificial Sequence: Synthetic polypeptide
DEEEIRTTNPVATEQYGSVVSTGLEQMLDRI

SEQ ID NO: 30211 - protein, 30 aa, Artificial Sequence
  Description of Artificial Sequence: Synthetic polypeptide
DEEEIRTTNPVATEQYGSVQPTDDEQRGTL

SEQ ID NO: 30212 - protein, 31 aa, Artificial Sequence
  Description of Artificial Sequence: Synthetic polypeptide
DEDEIATTNPVATEQYGSVAATNLERGPNRP

SEQ ID NO: 30213 - protein, 32 aa, Artificial Sequence
  Description of Artificial Sequence: Synthetic polypeptide
DEEEIRTTNPVATEQYGSVVSTHEQRVGEDRI

SEQ ID NO: 30214 - protein, 30 aa, Artificial Sequence
  Description of Artificial Sequence: Synthetic polypeptide
DEEAIRTTNPVATEIYGCVTMTNLQRGSNQ

SEQ ID NO: 30215 - protein, 32 aa, Artificial Sequence
  Description of Artificial Sequence: Synthetic polypeptide
DEEEIRTTNPVATEQYGSVSTMLQDQSGGNGD

SEQ ID NO: 30216 - protein, 29 aa, Artificial Sequence
  Description of Artificial Sequence: Synthetic peptide
DEDEIRTTNPVAYEQWGSVSTNDQDHGER

SEQ ID NO: 30217 - protein, 31 aa, Artificial Sequence
  Description of Artificial Sequence: Synthetic polypeptide
DEDEIRTTNPVATEQYGSVSSTNAQNEGNLQ

SEQ ID NO: 30218 - protein, 33 aa, Artificial Sequence
  Description of Artificial Sequence: Synthetic polypeptide
DEEEIRTTNPVATEQYGSVVSTNILDQRGEDHI

SEQ ID NO: 30219 - protein, 30 aa, Artificial Sequence
  Description of Artificial Sequence: Synthetic polypeptide
DEEEIRTTNPVATEQYGSVSTVDEDMGGND

SEQ ID NO: 30220 - protein, 32 aa, Artificial Sequence
  Description of Artificial Sequence: Synthetic polypeptide
DEEEIRTTNPVATEQYGSVSTPNLQNSGQTDD

SEQ ID NO: 30221 - protein, 28 aa, Artificial Sequence
  Description of Artificial Sequence: Synthetic peptide
DEAEIRTTNPVATECYGSVATNLQDADA

SEQ ID NO: 30222 - protein, 30 aa, Artificial Sequence
  Description of Artificial Sequence: Synthetic polypeptide
DEAEIRTTNPVATECYGSVAATNEQRPNDR

SEQ ID NO: 30223 - protein, 32 aa, Artificial Sequence
  Description of Artificial Sequence: Synthetic polypeptide
DEEEIRTTNPVATEQYGSVSTMLQNQSGENQG

SEQ ID NO: 30224 - protein, 32 aa, Artificial Sequence
  Description of Artificial Sequence: Synthetic polypeptide
DEEEIRTTNPVATEQYGSVSTNLLIRDDNDAD

SEQ ID NO: 30225 - protein, 30 aa, Artificial Sequence
  Description of Artificial Sequence: Synthetic polypeptide
DEDEIRTTNPVAYEQWGSVSTNLQADGDSR

SEQ ID NO: 30226 - protein, 32 aa, Artificial Sequence
  Description of Artificial Sequence: Synthetic polypeptide
DEEEIRTTNPVATEQYGSVSTPNLQNVEGEET

SEQ ID NO: 30227 - protein, 31 aa, Artificial Sequence
  Description of Artificial Sequence: Synthetic polypeptide
DEDEIATTNPVATEQYGNVSTNLQGDHGNER

SEQ ID NO: 30228 - protein, 30 aa, Artificial Sequence
  Description of Artificial Sequence: Synthetic polypeptide
DEDEIRTTNPVATEQYGSVSNNLNFGNNNS

SEQ ID NO: 30229 - protein, 29 aa, Artificial Sequence
  Description of Artificial Sequence: Synthetic peptide
DEDEIRTTNPVATEQYGSVSNNLFGNVNQ

SEQ ID NO: 30230 - protein, 32 aa, Artificial Sequence
  Description of Artificial Sequence: Synthetic polypeptide
DEEEIRTTNPVATEQYGSVSGVNLQTSEGNGD

SEQ ID NO: 30231 - protein, 32 aa, Artificial Sequence
  Description of Artificial Sequence: Synthetic polypeptide
DEEEIRTTNPVATEQYGSVSGNLQTGDGNGGD

SEQ ID NO: 30232 - protein, 33 aa, Artificial Sequence
  Description of Artificial Sequence: Synthetic polypeptide
DEEEIRTTNPVATEQYGSVSTNLLQDVEGNEFT

SEQ ID NO: 30233 - protein, 30 aa, Artificial Sequence
  Description of Artificial Sequence: Synthetic polypeptide
DEEAIRTTNPVATEGYGCVTTTNLQRGSNQ

SEQ ID NO: 30234 - protein, 33 aa, Artificial Sequence
  Description of Artificial Sequence: Synthetic polypeptide
DEEEIRTTNPVATEQYGSVSTNLLEQLDEGNEQ

SEQ ID NO: 30235 - protein, 30 aa, Artificial Sequence
  Description of Artificial Sequence: Synthetic polypeptide
DEDEIRTTNPVAYEQWGSVSTNLQFGGNDN

SEQ ID NO: 30236 - protein, 32 aa, Artificial Sequence
  Description of Artificial Sequence: Synthetic polypeptide
DEEEIRTTNPVATEQYGSVSLTNHNDGDGENR

SEQ ID NO: 30237 - protein, 31 aa, Artificial Sequence
  Description of Artificial Sequence: Synthetic polypeptide
DEEEIRTTNPVATEQYGSVSNTEDQSGSNQT

SEQ ID NO: 30238 - protein, 32 aa, Artificial Sequence
  Description of Artificial Sequence: Synthetic polypeptide
DEEEIRTTNPVATEQYGSVSNTEGQQRGFNQT

SEQ ID NO: 30239 - protein, 33 aa, Artificial Sequence
  Description of Artificial Sequence: Synthetic polypeptide
DEEEIRTTNPVATEQYGSVSTPNLQQEIGNNED

SEQ ID NO: 30240 - protein, 30 aa, Artificial Sequence
  Description of Artificial Sequence: Synthetic polypeptide
DEECIRTTNPVATEQYGCVSCTNEQQFGNE

SEQ ID NO: 30241 - protein, 30 aa, Artificial Sequence
  Description of Artificial Sequence: Synthetic polypeptide
DEDEIRTTNPVAYEQWGSVSTNLQGGNVDN

SEQ ID NO: 30242 - protein, 32 aa, Artificial Sequence
  Description of Artificial Sequence: Synthetic polypeptide
DEEEIRTTNPVATEQYGSVSNTEGQRFGSNQS

SEQ ID NO: 30243 - protein, 31 aa, Artificial Sequence
  Description of Artificial Sequence: Synthetic polypeptide
DEEEIRTTNPVATEQYGSVSPNLQPPDIERI

SEQ ID NO: 30244 - protein, 30 aa, Artificial Sequence
  Description of Artificial Sequence: Synthetic polypeptide
DEEEIRTTNPVATEQYGSVSTTVQSLDNQQ

SEQ ID NO: 30245 - protein, 30 aa, Artificial Sequence
  Description of Artificial Sequence: Synthetic polypeptide
DEEEIRTTNPVATEQYGSVSPNLQPIPDIF

SEQ ID NO: 30246 - protein, 30 aa, Artificial Sequence
  Description of Artificial Sequence: Synthetic polypeptide
DEDEIATTNPVATEQYGCVSTNLQPMGDNA

SEQ ID NO: 30247 - protein, 28 aa, Artificial Sequence
  Description of Artificial Sequence: Synthetic peptide
DEDEIATTNPVATEQYGETSTNLQFGDS

SEQ ID NO: 30248 - protein, 31 aa, Artificial Sequence
  Description of Artificial Sequence: Synthetic polypeptide
DEAEIRTTNPVATECYGSVSSNLQGGGDNDR

SEQ ID NO: 30249 - protein, 32 aa, Artificial Sequence
  Description of Artificial Sequence: Synthetic polypeptide
DEEEIRTTNPVATEQYGSVSTMLQMFEGNGNF

SEQ ID NO: 30250 - protein, 33 aa, Artificial Sequence
  Description of Artificial Sequence: Synthetic polypeptide
DEEEIRTTNPVATEQYGSVSSTQNLGQGGENNT

SEQ ID NO: 30251 - protein, 29 aa, Artificial Sequence
  Description of Artificial Sequence: Synthetic peptide
DEDEIATTNPVATEQYGSCSTNLQHDNGE

SEQ ID NO: 30252 - protein, 30 aa, Artificial Sequence
  Description of Artificial Sequence: Synthetic polypeptide
DEAEIRTTNPVATEFYGVVSTNLQDGDNGG

SEQ ID NO: 30253 - protein, 32 aa, Artificial Sequence
  Description of Artificial Sequence: Synthetic polypeptide
DEEEIRTTNPVATEQYGSVSPNMELQRDLNTP

SEQ ID NO: 30254 - protein, 32 aa, Artificial Sequence
  Description of Artificial Sequence: Synthetic polypeptide
DEAEIRTTNPVAYEQYGISTVSTGNLSQSGNR

SEQ ID NO: 30255 - protein, 32 aa, Artificial Sequence
  Description of Artificial Sequence: Synthetic polypeptide
DEEEIRTTNPVATEQYGSVSGNLQSGEGNGEG

SEQ ID NO: 30256 - protein, 31 aa, Artificial Sequence
  Description of Artificial Sequence: Synthetic polypeptide
DEDEIRTTNPVATEQWGAVSTNLQLDGDNQR

SEQ ID NO: 30257 - protein, 33 aa, Artificial Sequence
  Description of Artificial Sequence: Synthetic polypeptide
DEEEIRTTNPVATEQYGSVSSTSYLQRGNEDIQ

SEQ ID NO: 30258 - protein, 33 aa, Artificial Sequence
  Description of Artificial Sequence: Synthetic polypeptide
DEEEIRTTNPVATEQYGSVSSTSNLQNGEGGNT

SEQ ID NO: 30259 - protein, 31 aa, Artificial Sequence
  Description of Artificial Sequence: Synthetic polypeptide
DEEEIRTTNPVATEQYGSVSTVDLERGSVQG

SEQ ID NO: 30260 - protein, 31 aa, Artificial Sequence
  Description of Artificial Sequence: Synthetic polypeptide
DEAEIRTTNPVATEEYGSVSTNLQDNGGDND

SEQ ID NO: 30261 - protein, 32 aa, Artificial Sequence
  Description of Artificial Sequence: Synthetic polypeptide
DEAEIRTTNPVATEEYGSVSTNLGQNDEGNNR

SEQ ID NO: 30262 - protein, 30 aa, Artificial Sequence
  Description of Artificial Sequence: Synthetic polypeptide
DEEEIRTTNPVATEQYGSVSTVDIDMTENR

SEQ ID NO: 30263 - protein, 30 aa, Artificial Sequence
  Description of Artificial Sequence: Synthetic polypeptide
DEAEIRTTNPVATEEYGSVSTNHQFFGSNQ

SEQ ID NO: 30264 - protein, 30 aa, Artificial Sequence
  Description of Artificial Sequence: Synthetic polypeptide
DEEEIRTTNPVATEQYGSVSTVDIDMGGER

SEQ ID NO: 30265 - protein, 32 aa, Artificial Sequence
  Description of Artificial Sequence: Synthetic polypeptide
DEEEIRTTNPVATEQYGSVSTMLQFEFGNQEP

SEQ ID NO: 30266 - protein, 31 aa, Artificial Sequence
  Description of Artificial Sequence: Synthetic polypeptide
DEEEIRTTNPVATEQYGSVSSNAPQRFNDQM

SEQ ID NO: 30267 - protein, 31 aa, Artificial Sequence
  Description of Artificial Sequence: Synthetic polypeptide
DEDEIRTTNPVATEQYGSVSPTNLNREQDER

SEQ ID NO: 30268 - protein, 31 aa, Artificial Sequence
  Description of Artificial Sequence: Synthetic polypeptide
DEAEIRTTNPVATECYGSVSTNLQGNMGENG

SEQ ID NO: 30269 - protein, 30 aa, Artificial Sequence
  Description of Artificial Sequence: Synthetic polypeptide
DEEEIRTTNPVATEQYGSVSSNAPQRNSQQ

SEQ ID NO: 30270 - protein, 30 aa, Artificial Sequence
  Description of Artificial Sequence: Synthetic polypeptide
DEAEIRTTNPVAYEQYGEVSTNLQPGGNAE

SEQ ID NO: 30271 - protein, 31 aa, Artificial Sequence
  Description of Artificial Sequence: Synthetic polypeptide
DEEEIRTTNPVATEQYGSVSSTQNVGVGNNQ

SEQ ID NO: 30272 - protein, 33 aa, Artificial Sequence
  Description of Artificial Sequence: Synthetic polypeptide
DEEEIRTTNPVATEQYGSVSSTQNLQFGEGNED

SEQ ID NO: 30273 - protein, 32 aa, Artificial Sequence
  Description of Artificial Sequence: Synthetic polypeptide
DEEEIRTTNPVATEQYGSVSTMLQFTGGNGNV

SEQ ID NO: 30274 - protein, 33 aa, Artificial Sequence
  Description of Artificial Sequence: Synthetic polypeptide
DEEEIRTTNPVATEQYGSVSTNLLQNIIGNNLG

SEQ ID NO: 30275 - protein, 31 aa, Artificial Sequence
  Description of Artificial Sequence: Synthetic polypeptide
DEAEIRTTNPVATECYGSVSTNLNQNGDNNM

SEQ ID NO: 30276 - protein, 31 aa, Artificial Sequence
  Description of Artificial Sequence: Synthetic polypeptide
DEAEIRTTNPVATECYGSVSTNLNQGGGNEN

SEQ ID NO: 30277 - protein, 32 aa, Artificial Sequence
  Description of Artificial Sequence: Synthetic polypeptide
DEEEIRTTNPVATEQYGSVSTMLQGPEGGNEQ

SEQ ID NO: 30278 - protein, 32 aa, Artificial Sequence
  Description of Artificial Sequence: Synthetic polypeptide
DEEEIRTTNPVATEQYGSVSPNLQRIMENNII

SEQ ID NO: 30279 - protein, 32 aa, Artificial Sequence
  Description of Artificial Sequence: Synthetic polypeptide
DEEEIRTTNPVATEQYGSVSTNLLQNFGSEDG

SEQ ID NO: 30280 - protein, 34 aa, Artificial Sequence
  Description of Artificial Sequence: Synthetic polypeptide
DEEEIRTTNPVATEQYGSVSCTNLSQETGTNNRV

SEQ ID NO: 30281 - protein, 33 aa, Artificial Sequence
  Description of Artificial Sequence: Synthetic polypeptide
DEEEIRTTNPVATEQYGSVSTVELTQRGGENEI

SEQ ID NO: 30282 - protein, 31 aa, Artificial Sequence
  Description of Artificial Sequence: Synthetic polypeptide
DEAEIRTTNPVATEHYGSVSTNLQPGGNDDM

SEQ ID NO: 30283 - protein, 31 aa, Artificial Sequence
  Description of Artificial Sequence: Synthetic polypeptide
DEEEIRTTNPVATEQYGSVSPNNIQTIDNRD

SEQ ID NO: 30284 - protein, 34 aa, Artificial Sequence
  Description of Artificial Sequence: Synthetic polypeptide
DEEEIRTTNPVATEQYGSVQSCTNEDSQRTGGNR

SEQ ID NO: 30285 - protein, 30 aa, Artificial Sequence
  Description of Artificial Sequence: Synthetic polypeptide
DEDEIATTNPVATEQYGSVATNLQDDGNDH

SEQ ID NO: 30286 - protein, 31 aa, Artificial Sequence
  Description of Artificial Sequence: Synthetic polypeptide
DEEEIRTTNPVATEQYGSVQQTNSTQRGADL

SEQ ID NO: 30287 - protein, 32 aa, Artificial Sequence
  Description of Artificial Sequence: Synthetic polypeptide
DEEEIRTTNPVATEQYGSVSCTNHSTSGTNNR

SEQ ID NO: 30288 - protein, 31 aa, Artificial Sequence
  Description of Artificial Sequence: Synthetic polypeptide
DEEEIRTTNPVATEQYGSVSPPPLIREGNEN

SEQ ID NO: 30289 - protein, 31 aa, Artificial Sequence
  Description of Artificial Sequence: Synthetic polypeptide
DEAEIRTTNPVATEPYGSVSTNLQQGEGNAN

SEQ ID NO: 30290 - protein, 31 aa, Artificial Sequence
  Description of Artificial Sequence: Synthetic polypeptide
DEDEIATTNPVATEQYGSVATNLQAGDNMRN

SEQ ID NO: 30291 - protein, 34 aa, Artificial Sequence
  Description of Artificial Sequence: Synthetic polypeptide
DEEEIRTTNPVATEQYGSVSTPNLQDQAGDNVRT

SEQ ID NO: 30292 - protein, 32 aa, Artificial Sequence
  Description of Artificial Sequence: Synthetic polypeptide
DEEEIRTTNPVATEQYGSVSCTNISQRTGGSF

SEQ ID NO: 30293 - protein, 33 aa, Artificial Sequence
  Description of Artificial Sequence: Synthetic polypeptide
DEEEIRTTNPVATEQYGSVSTVLNLQSEGGNED

SEQ ID NO: 30294 - protein, 31 aa, Artificial Sequence
  Description of Artificial Sequence: Synthetic polypeptide
DEAEIRTTNPVATEPYGSVSTNLNQGEDNDR

SEQ ID NO: 30295 - protein, 32 aa, Artificial Sequence
  Description of Artificial Sequence: Synthetic polypeptide
DEAEIRTTNPVATEPYGSVSTNLNQGEDGMNR

SEQ ID NO: 30296 - protein, 32 aa, Artificial Sequence
  Description of Artificial Sequence: Synthetic polypeptide
DEEEIRTTNPVATEQYGSVSIILIQREGNPLD

SEQ ID NO: 30297 - protein, 30 aa, Artificial Sequence
  Description of Artificial Sequence: Synthetic polypeptide
DEDEIATTNPVATEQYGSVATNLQDDNDRN

SEQ ID NO: 30298 - protein, 31 aa, Artificial Sequence
  Description of Artificial Sequence: Synthetic polypeptide
DEEEIRTTNPVATEQYGSVSIIGTLELGNRT

SEQ ID NO: 30299 - protein, 31 aa, Artificial Sequence
  Description of Artificial Sequence: Synthetic polypeptide
DEAEIRTTNPVAYEQYGQTVSCTGLQRVGNR

SEQ ID NO: 30300 - protein, 28 aa, Artificial Sequence
  Description of Artificial Sequence: Synthetic peptide
DEDEIATTNPVATEQYGSVATNLERSDD

SEQ ID NO: 30301 - protein, 33 aa, Artificial Sequence
  Description of Artificial Sequence: Synthetic polypeptide
DEEEIRTTNPVATEQYGSVSSTTNGPNRNGNPR

SEQ ID NO: 30302 - protein, 32 aa, Artificial Sequence
  Description of Artificial Sequence: Synthetic polypeptide
DEEEIRTTNPVATEQYGSVSTMLDQEFGNFIQ

SEQ ID NO: 30303 - protein, 30 aa, Artificial Sequence
  Description of Artificial Sequence: Synthetic polypeptide
DEEEIRTTNPVATEQYGSVSPPNLPRFQVV

SEQ ID NO: 30304 - protein, 31 aa, Artificial Sequence
  Description of Artificial Sequence: Synthetic polypeptide
DEEEIRTTNPVATEQYGSVQQTAGLDQNLNR

SEQ ID NO: 30305 - protein, 29 aa, Artificial Sequence
  Description of Artificial Sequence: Synthetic peptide
DEAEIRTTNPVATEPYGSVATNLTDGNTD

SEQ ID NO: 30306 - protein, 29 aa, Artificial Sequence
  Description of Artificial Sequence: Synthetic peptide
DEEEIRTTNPVATEQYGSVSIGLQEQMEE

SEQ ID NO: 30307 - protein, 33 aa, Artificial Sequence
  Description of Artificial Sequence: Synthetic polypeptide
DEEEIRTTNPVATEQYGSVVSCTGNALSQRVDR

SEQ ID NO: 30308 - protein, 33 aa, Artificial Sequence
  Description of Artificial Sequence: Synthetic polypeptide
DEEEIRTTNPVATEQYGSVSTNLPQDEVGNSTG

SEQ ID NO: 30309 - protein, 32 aa, Artificial Sequence
  Description of Artificial Sequence: Synthetic polypeptide
DEEEIRTTNPVATEQYGSVSTVLLQSGGENIP

SEQ ID NO: 30310 - protein, 32 aa, Artificial Sequence
  Description of Artificial Sequence: Synthetic polypeptide
DEEEIRTTNPVATEQYGSVSTNLPNDEGGNQN

SEQ ID NO: 30311 - protein, 33 aa, Artificial Sequence
  Description of Artificial Sequence: Synthetic polypeptide
DEEEIRTTNPVATEQYGSVSLTFNGLFRPENER

SEQ ID NO: 30312 - protein, 31 aa, Artificial Sequence
  Description of Artificial Sequence: Synthetic polypeptide
DEEEIRTTNPVATEQYGSVSETGNMPEGETR

SEQ ID NO: 30313 - protein, 33 aa, Artificial Sequence
  Description of Artificial Sequence: Synthetic polypeptide
DEEEIRTTNPVATEQYGSVSTNLPQQNSGNENE

SEQ ID NO: 30314 - protein, 34 aa, Artificial Sequence
  Description of Artificial Sequence: Synthetic polypeptide
DEEEIRTTNPVATEQYGSVQSCTNELSQNTGNNR

SEQ ID NO: 30315 - protein, 29 aa, Artificial Sequence
  Description of Artificial Sequence: Synthetic peptide
DEAEIRTTNPVAYEQYGSCSTNLEAAENR

SEQ ID NO: 30316 - protein, 31 aa, Artificial Sequence
  Description of Artificial Sequence: Synthetic polypeptide
DEDEIATTNPVATEQYGSVATNLQQGDNDRY

SEQ ID NO: 30317 - protein, 30 aa, Artificial Sequence
  Description of Artificial Sequence: Synthetic polypeptide
DEDEIATTNPVATEQYGSVATNLQQGDNDM

SEQ ID NO: 30318 - protein, 33 aa, Artificial Sequence
  Description of Artificial Sequence: Synthetic polypeptide
DEEEIRTTNPVATEQYGSVVPSCTNLQDTGGSR

SEQ ID NO: 30319 - protein, 31 aa, Artificial Sequence
  Description of Artificial Sequence: Synthetic polypeptide
DEAEIRTTNPVAYEQYGSIPSTNLTRTPGNR

SEQ ID NO: 30320 - protein, 33 aa, Artificial Sequence
  Description of Artificial Sequence: Synthetic polypeptide
DEEEIRTTNPVATEQYGSVSTPNLQANGGNQNV

SEQ ID NO: 30321 - protein, 33 aa, Artificial Sequence
  Description of Artificial Sequence: Synthetic polypeptide
DEEEIRTTNPVATEQYGSVQSFTNIGQRIGNPF

SEQ ID NO: 30322 - protein, 30 aa, Artificial Sequence
  Description of Artificial Sequence: Synthetic polypeptide
DEAEIRTTNPVAYEQYGSIPSCTNLERVNR

SEQ ID NO: 30323 - protein, 31 aa, Artificial Sequence
  Description of Artificial Sequence: Synthetic polypeptide
DEEEIRTTNPVATEQYGSVSINDLHERNGEQ

SEQ ID NO: 30324 - protein, 30 aa, Artificial Sequence
  Description of Artificial Sequence: Synthetic polypeptide
DEEEIRTTNPVATEQYGSVSNTDGTQSEND

SEQ ID NO: 30325 - protein, 32 aa, Artificial Sequence
  Description of Artificial Sequence: Synthetic polypeptide
DEEEIRTTNPVATEQYGSVSTMLAMRSDQENR

SEQ ID NO: 30326 - protein, 33 aa, Artificial Sequence
  Description of Artificial Sequence: Synthetic polypeptide
DEEEIRTTNPVATEQYGSVSTPNLQANGNDIGN

SEQ ID NO: 30327 - protein, 33 aa, Artificial Sequence
  Description of Artificial Sequence: Synthetic polypeptide
DEEEIRTTNPVATEQYGSVSTPNLQANGNIENE

SEQ ID NO: 30328 - protein, 29 aa, Artificial Sequence
  Description of Artificial Sequence: Synthetic peptide
DEAEIRTTNPVATEQWGAVATNDQRGNES

SEQ ID NO: 30329 - protein, 33 aa, Artificial Sequence
  Description of Artificial Sequence: Synthetic polypeptide
DEEEIRTTNPVATEQYGSVVPSCTNLSPRESNR

SEQ ID NO: 30330 - protein, 31 aa, Artificial Sequence
  Description of Artificial Sequence: Synthetic polypeptide
DEEEIRTTNPVATEQYGSVSINDLDVRNNFQ

SEQ ID NO: 30331 - protein, 34 aa, Artificial Sequence
  Description of Artificial Sequence: Synthetic polypeptide
DEEEIRTTNPVATEQYGSVVPSCTNLSPRGGINR

SEQ ID NO: 30332 - protein, 31 aa, Artificial Sequence
  Description of Artificial Sequence: Synthetic polypeptide
DEDEIATTNPVATEQYGSVATNLQESGNMRD

SEQ ID NO: 30333 - protein, 32 aa, Artificial Sequence
  Description of Artificial Sequence: Synthetic polypeptide
DEEEIRTTNPVATEQYGSVSTVLQAIGGNNEQ

SEQ ID NO: 30334 - protein, 33 aa, Artificial Sequence
  Description of Artificial Sequence: Synthetic polypeptide
DEEEIRTTNPVATEQYGSVVPSCTNLSTQGNQR

SEQ ID NO: 30335 - protein, 30 aa, Artificial Sequence
  Description of Artificial Sequence: Synthetic polypeptide
DEEEIRTTNPVATEQYGSVSPPTLERGEDQ

SEQ ID NO: 30336 - protein, 31 aa, Artificial Sequence
  Description of Artificial Sequence: Synthetic polypeptide
DEDEIATTNPVATEQYGSVATNLQERGDNQA

SEQ ID NO: 30337 - protein, 30 aa, Artificial Sequence
  Description of Artificial Sequence: Synthetic polypeptide
DEEEIRTTNPVATEQYGSVSNTDLEGIENQ

SEQ ID NO: 30338 - protein, 32 aa, Artificial Sequence
  Description of Artificial Sequence: Synthetic polypeptide
DEEEIRTTNPVATEQYGSVQSDTPLLQRGVET

SEQ ID NO: 30339 - protein, 34 aa, Artificial Sequence
  Description of Artificial Sequence: Synthetic polypeptide
DEEEIRTTNPVATEQYGSVVPSYTGNLSGRGTNR

SEQ ID NO: 30340 - protein, 31 aa, Artificial Sequence
  Description of Artificial Sequence: Synthetic polypeptide
DEEEIRTTNPVATEQYGSVSTVLPDRIDNQM

SEQ ID NO: 30341 - protein, 28 aa, Artificial Sequence
  Description of Artificial Sequence: Synthetic peptide
DEAEIRTTNPVAYEQYGSIATNGDRPNR

SEQ ID NO: 30342 - protein, 31 aa, Artificial Sequence
  Description of Artificial Sequence: Synthetic polypeptide
DEEEIRTTNPVATEQYGSVVPTDLQRFGEDM

SEQ ID NO: 30343 - protein, 32 aa, Artificial Sequence
  Description of Artificial Sequence: Synthetic polypeptide
DEEEIRTTNPVATEQYGSVSTPNLQDELGQDD

SEQ ID NO: 30344 - protein, 31 aa, Artificial Sequence
  Description of Artificial Sequence: Synthetic polypeptide
DEDEIRTTNPVATEQYGSVSTDSGQRGNSMP

SEQ ID NO: 30345 - protein, 33 aa, Artificial Sequence
  Description of Artificial Sequence: Synthetic polypeptide
DEEEIRTTNPVATEQYGSVSTPNLQFEFGNNDN

SEQ ID NO: 30346 - protein, 32 aa, Artificial Sequence
  Description of Artificial Sequence: Synthetic polypeptide
DEEEIRTTNPVATEQYGSVSPPNEQRGEENGM

SEQ ID NO: 30347 - protein, 33 aa, Artificial Sequence
  Description of Artificial Sequence: Synthetic polypeptide
DEEEIRTTNPVATEQYGSVSTPNLQFEFGNQNN

SEQ ID NO: 30348 - protein, 31 aa, Artificial Sequence
  Description of Artificial Sequence: Synthetic polypeptide
DEEEIRTTNPVATEQYGSVSTNLPMNGSEEE

SEQ ID NO: 30349 - protein, 30 aa, Artificial Sequence
  Description of Artificial Sequence: Synthetic polypeptide
DEDEIRTTNPVATEQYGSVSTAGGGDGNNR

SEQ ID NO: 30350 - protein, 30 aa, Artificial Sequence
  Description of Artificial Sequence: Synthetic polypeptide
DEAEIRTTNPVATENYGCVSTNLQGDGNHG

SEQ ID NO: 30351 - protein, 32 aa, Artificial Sequence
  Description of Artificial Sequence: Synthetic polypeptide
DEEEIRTTNPVATEQYGSVQPTNLVRGEETRT

SEQ ID NO: 30352 - protein, 32 aa, Artificial Sequence
  Description of Artificial Sequence: Synthetic polypeptide
DEEEIRTTNPVATEQYGSVSTVLDQNDGENES

SEQ ID NO: 30353 - protein, 31 aa, Artificial Sequence
  Description of Artificial Sequence: Synthetic polypeptide
DEAEIRTTNPVATEMYGSVSTNLQNGDNNMG

SEQ ID NO: 30354 - protein, 30 aa, Artificial Sequence
  Description of Artificial Sequence: Synthetic polypeptide
DEDEIATTNPVATEQYGSVATNDQRGNPDP

SEQ ID NO: 30355 - protein, 31 aa, Artificial Sequence
  Description of Artificial Sequence: Synthetic polypeptide
DEEEIRTTNPVATEQYGSVSPNNMQRLDNFL

SEQ ID NO: 30356 - protein, 33 aa, Artificial Sequence
  Description of Artificial Sequence: Synthetic polypeptide
DEEEIRTTNPVATEQYGSVSETGNLQRSTIQNI

SEQ ID NO: 30357 - protein, 30 aa, Artificial Sequence
  Description of Artificial Sequence: Synthetic polypeptide
DEDEIATTNPVATEQYGSVATNDQRGDNPQ

SEQ ID NO: 30358 - protein, 31 aa, Artificial Sequence
  Description of Artificial Sequence: Synthetic polypeptide
DEEEIRTTNPVATEQYGSVSTVLDFLGEQRE

SEQ ID NO: 30359 - protein, 30 aa, Artificial Sequence
  Description of Artificial Sequence: Synthetic polypeptide
DEDEIATTNPVATEQYGSVATNDQRDGNDD

SEQ ID NO: 30360 - protein, 30 aa, Artificial Sequence
  Description of Artificial Sequence: Synthetic polypeptide
DEEAIRTTNPVATEQLGSVATNNLQLGGNL

SEQ ID NO: 30361 - protein, 32 aa, Artificial Sequence
  Description of Artificial Sequence: Synthetic polypeptide
DEEEIRTTNPVATEQYGSVSTPNLQFNFGQDG

SEQ ID NO: 30362 - protein, 29 aa, Artificial Sequence
  Description of Artificial Sequence: Synthetic peptide
DEEEIRTTNPVATEQYGSVSMDLNREDQQ

SEQ ID NO: 30363 - protein, 30 aa, Artificial Sequence
  Description of Artificial Sequence: Synthetic polypeptide
DEDEIATTNPVATEQYGSVATNDQQGNPRD

SEQ ID NO: 30364 - protein, 29 aa, Artificial Sequence
  Description of Artificial Sequence: Synthetic peptide
DEAEIRTTNPVATEIYGSVSNNLQDGDTS

SEQ ID NO: 30365 - protein, 33 aa, Artificial Sequence
  Description of Artificial Sequence: Synthetic polypeptide
DEEEIRTTNPVATEQYGSVSTPNLQFNGGENQD

SEQ ID NO: 30366 - protein, 31 aa, Artificial Sequence
  Description of Artificial Sequence: Synthetic polypeptide
DEEEIRTTNPVATEQYGSVSTMLGEFGNEIP

SEQ ID NO: 30367 - protein, 32 aa, Artificial Sequence
  Description of Artificial Sequence: Synthetic polypeptide
DEEEIRTTNPVATEQYGSVSTVFNGQGNGNND

SEQ ID NO: 30368 - protein, 32 aa, Artificial Sequence
  Description of Artificial Sequence: Synthetic polypeptide
DEEEIRTTNPVATEQYGSVVSQNHSQNGGNNR

SEQ ID NO: 30369 - protein, 30 aa, Artificial Sequence
  Description of Artificial Sequence: Synthetic polypeptide
DEEEIRTTNPVATEQYGSVSIELLQQNVRN

SEQ ID NO: 30370 - protein, 29 aa, Artificial Sequence
  Description of Artificial Sequence: Synthetic peptide
DEDEIATTNPVATEQYGSVATANLMNGNN

SEQ ID NO: 30371 - protein, 32 aa, Artificial Sequence
  Description of Artificial Sequence: Synthetic polypeptide
DEEEIRTTNPVATEQYGSVSTVFNGQGGNNDN

SEQ ID NO: 30372 - protein, 31 aa, Artificial Sequence
  Description of Artificial Sequence: Synthetic polypeptide
DEEEIRTTNPVATEQYGSVSTVFLQTNEANT

SEQ ID NO: 30373 - protein, 32 aa, Artificial Sequence
  Description of Artificial Sequence: Synthetic polypeptide
DEEEIRTTNPVATEQYGSVQPTNLDQRGLAIL

SEQ ID NO: 30374 - protein, 31 aa, Artificial Sequence
  Description of Artificial Sequence: Synthetic polypeptide
DEECIRTTNPVATEQYGCVCSTNLNDNGQNR

SEQ ID NO: 30375 - protein, 32 aa, Artificial Sequence
  Description of Artificial Sequence: Synthetic polypeptide
DEEEIRTTNPVATEQYGSVQPTNGQPRGVARI

SEQ ID NO: 30376 - protein, 32 aa, Artificial Sequence
  Description of Artificial Sequence: Synthetic polypeptide
DEEEIRTTNPVATEQYGSVSLTFNLQRIMAED

SEQ ID NO: 30377 - protein, 32 aa, Artificial Sequence
  Description of Artificial Sequence: Synthetic polypeptide
DEEEIRTTNPVATEQYGSVSTMLGQFGSGNGE

SEQ ID NO: 30378 - protein, 30 aa, Artificial Sequence
  Description of Artificial Sequence: Synthetic polypeptide
DEAEIRTTNPVATENYGEVSTNLQGGGDGR

SEQ ID NO: 30379 - protein, 32 aa, Artificial Sequence
  Description of Artificial Sequence: Synthetic polypeptide
DEEEIRTTNPVATEQYGSVQSMNDQRDGDERQ

SEQ ID NO: 30380 - protein, 32 aa, Artificial Sequence
  Description of Artificial Sequence: Synthetic polypeptide
DEEEIRTTNPVATEQYGSVVSNTTDQRMNEER

SEQ ID NO: 30381 - protein, 31 aa, Artificial Sequence
  Description of Artificial Sequence: Synthetic polypeptide
DEEEIRTTNPVATEQYGSVSTNLNVSVNDFQ

SEQ ID NO: 30382 - protein, 31 aa, Artificial Sequence
  Description of Artificial Sequence: Synthetic polypeptide
DEEEIRTTNPVATEQYGSVSIENTQRLEENG

SEQ ID NO: 30383 - protein, 32 aa, Artificial Sequence
  Description of Artificial Sequence: Synthetic polypeptide
DEEEIRTTNPVATEQYGSVSTVLLQGGIDIRD

SEQ ID NO: 30384 - protein, 34 aa, Artificial Sequence
  Description of Artificial Sequence: Synthetic polypeptide
DEEEIRTTNPVATEQYGSVVSCTNLSQRTGGNEN

SEQ ID NO: 30385 - protein, 30 aa, Artificial Sequence
  Description of Artificial Sequence: Synthetic polypeptide
DEDEIATTNPVATEQYGSVATNLERGNMID

SEQ ID NO: 30386 - protein, 33 aa, Artificial Sequence
  Description of Artificial Sequence: Synthetic polypeptide
DEEEIRTTNPVATEQYGSVVSCTNLSTPGDNNR

SEQ ID NO: 30387 - protein, 30 aa, Artificial Sequence
  Description of Artificial Sequence: Synthetic polypeptide
DEAEIRTTNPVAYEQYGQSISTNLERFPNR

SEQ ID NO: 30388 - protein, 32 aa, Artificial Sequence
  Description of Artificial Sequence: Synthetic polypeptide
DEEEIRTTNPVATEQYGSVVSCTNSSQDGGDR

SEQ ID NO: 30389 - protein, 30 aa, Artificial Sequence
  Description of Artificial Sequence: Synthetic polypeptide
DEDEIATTNPVATEQYGSVATNLERGENDE

SEQ ID NO: 30390 - protein, 33 aa, Artificial Sequence
  Description of Artificial Sequence: Synthetic polypeptide
DEEEIRTTNPVATEQYGSVSTPNLQFGGGNEET

SEQ ID NO: 30391 - protein, 32 aa, Artificial Sequence
  Description of Artificial Sequence: Synthetic polypeptide
DEEEIRTTNPVATEQYGSVSTNLPGNIGNNST

SEQ ID NO: 30392 - protein, 32 aa, Artificial Sequence
  Description of Artificial Sequence: Synthetic polypeptide
DEEEIRTTNPVATEQYGSVVSFNLDQRMDQRQ

SEQ ID NO: 30393 - protein, 30 aa, Artificial Sequence
  Description of Artificial Sequence: Synthetic polypeptide
DEEEIRTTNPVATEQYGSVVSINDQIREDE

SEQ ID NO: 30394 - protein, 31 aa, Artificial Sequence
  Description of Artificial Sequence: Synthetic polypeptide
DEDEIATTNPVATEQYGSVATNLERGDNDRD

SEQ ID NO: 30395 - protein, 33 aa, Artificial Sequence
  Description of Artificial Sequence: Synthetic polypeptide
DEEEIRTTNPVATEQYGSVSTMLEQNRVGDNIE

SEQ ID NO: 30396 - protein, 31 aa, Artificial Sequence
  Description of Artificial Sequence: Synthetic polypeptide
DEEEIRTTNPVATEQYGSVVSNNQAQQAGIR

SEQ ID NO: 30397 - protein, 29 aa, Artificial Sequence
  Description of Artificial Sequence: Synthetic peptide
DEEEIRTTNPVATEQYGSVVSNQGNRLDE

SEQ ID NO: 30398 - protein, 30 aa, Artificial Sequence
  Description of Artificial Sequence: Synthetic polypeptide
DEEEIRTTNPVATEQYGSVSTMLERNIDFD

SEQ ID NO: 30399 - protein, 30 aa, Artificial Sequence
  Description of Artificial Sequence: Synthetic polypeptide
DEEEIRTTNPVATEQYGSVSIELLQTGQLN

SEQ ID NO: 30400 - protein, 32 aa, Artificial Sequence
  Description of Artificial Sequence: Synthetic polypeptide
DEEEIRTTNPVATEQYGSVSTMLFQDGENGEE

SEQ ID NO: 30401 - protein, 33 aa, Artificial Sequence
  Description of Artificial Sequence: Synthetic polypeptide
DEEEIRTTNPVATEQYGSVVSNTDLHQERGEND

SEQ ID NO: 30402 - protein, 30 aa, Artificial Sequence
  Description of Artificial Sequence: Synthetic polypeptide
DEEEIACTNPVATEQYGEVSEPNLQRNGGR

SEQ ID NO: 30403 - protein, 32 aa, Artificial Sequence
  Description of Artificial Sequence: Synthetic polypeptide
DEEEIRTTNPVATEQYGSVSTPNLQFNFGGEN

SEQ ID NO: 30404 - protein, 33 aa, Artificial Sequence
  Description of Artificial Sequence: Synthetic polypeptide
DEEEIRTTNPVATEQYGSVVSNTNLQIYGPNQY

SEQ ID NO: 30405 - protein, 30 aa, Artificial Sequence
  Description of Artificial Sequence: Synthetic polypeptide
DEAEIRTTNPVATENYGTVSTNLQGEGDSR

SEQ ID NO: 30406 - protein, 31 aa, Artificial Sequence
  Description of Artificial Sequence: Synthetic polypeptide
DEEEIRTTNPVATEQYGSVSIELLQRLQQRN

SEQ ID NO: 30407 - protein, 30 aa, Artificial Sequence
  Description of Artificial Sequence: Synthetic polypeptide
DEEEIACTNPVATEQYGNVSAETLQRVGNR

SEQ ID NO: 30408 - protein, 31 aa, Artificial Sequence
  Description of Artificial Sequence: Synthetic polypeptide
DEEEIRTTNPVATEQYGSVSCTNLGLLNDQD

SEQ ID NO: 30409 - protein, 32 aa, Artificial Sequence
  Description of Artificial Sequence: Synthetic polypeptide
DEEEIRTTNPVATEQYGSVQPTPNLQPRQNLN

SEQ ID NO: 30410 - protein, 33 aa, Artificial Sequence
  Description of Artificial Sequence: Synthetic polypeptide
DEEEIRTTNPVATEQYGSVSTPNLQFNFGNEGQ

SEQ ID NO: 30411 - protein, 30 aa, Artificial Sequence
  Description of Artificial Sequence: Synthetic polypeptide
DEDEIATTNPVATEQYGSVATNGQERGNDN

SEQ ID NO: 30412 - protein, 32 aa, Artificial Sequence
  Description of Artificial Sequence: Synthetic polypeptide
DEEEIRTTNPVATEQYGSVSNNLLQVGGNNIG

SEQ ID NO: 30413 - protein, 32 aa, Artificial Sequence
  Description of Artificial Sequence: Synthetic polypeptide
DEEEIRTTNPVATEQYGSVSTLNGDQGEGGNV

SEQ ID NO: 30414 - protein, 31 aa, Artificial Sequence
  Description of Artificial Sequence: Synthetic polypeptide
DEEEIRTTNPVATEQYGSVSITAQQRQNLLD

SEQ ID NO: 30415 - protein, 31 aa, Artificial Sequence
  Description of Artificial Sequence: Synthetic polypeptide
DEAEIRTTNPVATEQYGSVSTPLNNGNENRD

SEQ ID NO: 30416 - protein, 32 aa, Artificial Sequence
  Description of Artificial Sequence: Synthetic polypeptide
DEEEIRTTNPVATEQYGSVSITNDEQNGGNNG

SEQ ID NO: 30417 - protein, 31 aa, Artificial Sequence
  Description of Artificial Sequence: Synthetic polypeptide
DEEEIRTTNPVATEQYGSVSTGNGGGDGNDE

SEQ ID NO: 30418 - protein, 30 aa, Artificial Sequence
  Description of Artificial Sequence: Synthetic polypeptide
DECEICTTNPVATEQYGNVSTNLQLQDQNR

SEQ ID NO: 30419 - protein, 30 aa, Artificial Sequence
  Description of Artificial Sequence: Synthetic polypeptide
DECEICTTNPVATEQYGSVSTNLDNYGNNT

SEQ ID NO: 30420 - protein, 31 aa, Artificial Sequence
  Description of Artificial Sequence: Synthetic polypeptide
DEEEIRTTNPVATEQYGSVSTPLVQMNGSEE

SEQ ID NO: 30421 - protein, 33 aa, Artificial Sequence
  Description of Artificial Sequence: Synthetic polypeptide
DEEEIRTTNPVATEQYGSVSPTNDLTQTMNERE

SEQ ID NO: 30422 - protein, 31 aa, Artificial Sequence
  Description of Artificial Sequence: Synthetic polypeptide
DEEEIRTTNPVATEQYGSVSTPMDHGENDRS

SEQ ID NO: 30423 - protein, 32 aa, Artificial Sequence
  Description of Artificial Sequence: Synthetic polypeptide
DEDEIRTTNPVATEQYGSVSTNLQGNDGGNAE

SEQ ID NO: 30424 - protein, 32 aa, Artificial Sequence
  Description of Artificial Sequence: Synthetic polypeptide
DEEEIRTTNPVATEQYGSVSPTNDLGERNMER

SEQ ID NO: 30425 - protein, 29 aa, Artificial Sequence
  Description of Artificial Sequence: Synthetic peptide
DEECIRTTNPVATEIYGVVQTNLQNGSNQ

SEQ ID NO: 30426 - protein, 29 aa, Artificial Sequence
  Description of Artificial Sequence: Synthetic peptide
DEECIRTTNPVATEIYGVVTTELQRGSNQ

SEQ ID NO: 30427 - protein, 32 aa, Artificial Sequence
  Description of Artificial Sequence: Synthetic polypeptide
DEEEIRTTNPVATEQYGSVSTGNGGQGGNNES

SEQ ID NO: 30428 - protein, 31 aa, Artificial Sequence
  Description of Artificial Sequence: Synthetic polypeptide
DEEEIRTTNPVATEQYGSVSTPLSETVGIRL

SEQ ID NO: 30429 - protein, 30 aa, Artificial Sequence
  Description of Artificial Sequence: Synthetic polypeptide
DEECIRTTNPVATENYGQVTTNLQGDGDNR

SEQ ID NO: 30430 - protein, 30 aa, Artificial Sequence
  Description of Artificial Sequence: Synthetic polypeptide
DEECIRTTNPVATEPWDYSVSENLQRGDNR

SEQ ID NO: 30431 - protein, 30 aa, Artificial Sequence
  Description of Artificial Sequence: Synthetic polypeptide
DEEEIRTTNPVATEQYGSVSTPMDQRIEGG

SEQ ID NO: 30432 - protein, 32 aa, Artificial Sequence
  Description of Artificial Sequence: Synthetic polypeptide
DEEEIRTTNPVATEQYGSVSTPMPLNRGDPLR

SEQ ID NO: 30433 - protein, 30 aa, Artificial Sequence
  Description of Artificial Sequence: Synthetic polypeptide
DECEICTTNPVATEQYGSVSTNLNMQGDNT

SEQ ID NO: 30434 - protein, 31 aa, Artificial Sequence
  Description of Artificial Sequence: Synthetic polypeptide
DECEICTTNPVATEQYGSVSTNLNMQQGNTD

SEQ ID NO: 30435 - protein, 32 aa, Artificial Sequence
  Description of Artificial Sequence: Synthetic polypeptide
DEDEIRTTNPVATEQYGSVSTNLQGNDGDNDG

SEQ ID NO: 30436 - protein, 29 aa, Artificial Sequence
  Description of Artificial Sequence: Synthetic peptide
DEEEIRTTNPVATEQYGSVQTNVQGMIDT

SEQ ID NO: 30437 - protein, 31 aa, Artificial Sequence
  Description of Artificial Sequence: Synthetic polypeptide
DEEEIRTTNPVATEQYGSVQTNSNEQRGVQT

SEQ ID NO: 30438 - protein, 31 aa, Artificial Sequence
  Description of Artificial Sequence: Synthetic polypeptide
DECEICTTNPVATEQYGSVSTNLNMQQGNTE

SEQ ID NO: 30439 - protein, 31 aa, Artificial Sequence
  Description of Artificial Sequence: Synthetic polypeptide
DEEEIRTTNPVATEQYGSVSPTNDERGITEQ

SEQ ID NO: 30440 - protein, 31 aa, Artificial Sequence
  Description of Artificial Sequence: Synthetic polypeptide
DEEEIRTTNPVATEQYGSVSTPNAQRQVDVA

SEQ ID NO: 30441 - protein, 30 aa, Artificial Sequence
  Description of Artificial Sequence: Synthetic polypeptide
DEEEIRTTNPVATEQYGSVSLNLQNNEMEI

SEQ ID NO: 30442 - protein, 32 aa, Artificial Sequence
  Description of Artificial Sequence: Synthetic polypeptide
DEEEIRTTNPVATEQYGSVSTGNGQSGTNDES

SEQ ID NO: 30443 - protein, 31 aa, Artificial Sequence
  Description of Artificial Sequence: Synthetic polypeptide
DEAEIRTTNPVATEQYGDVSTNNQGNGNNDR

SEQ ID NO: 30444 - protein, 32 aa, Artificial Sequence
  Description of Artificial Sequence: Synthetic polypeptide
DEEEIRTTNPVATEQYGSVSPTNDLTTMNWRE

SEQ ID NO: 30445 - protein, 31 aa, Artificial Sequence
  Description of Artificial Sequence: Synthetic polypeptide
DEDEIRTTNPVATEQYGSVSTNLQGQDDGQG

SEQ ID NO: 30446 - protein, 32 aa, Artificial Sequence
  Description of Artificial Sequence: Synthetic polypeptide
DEEEIRTTNPVATEQYGSVSTALQQNQGGNIE

SEQ ID NO: 30447 - protein, 30 aa, Artificial Sequence
  Description of Artificial Sequence: Synthetic polypeptide
DEDEIRTTNPVAYEQWGEVSTNLGQEGNAR

SEQ ID NO: 30448 - protein, 31 aa, Artificial Sequence
  Description of Artificial Sequence: Synthetic polypeptide
DEEEIRTTNPVATEQYGSVQTNVQRTLENDG

SEQ ID NO: 30449 - protein, 29 aa, Artificial Sequence
  Description of Artificial Sequence: Synthetic peptide
DECEICTTNPVATDQYGVVSTALQRGNDG

SEQ ID NO: 30450 - protein, 31 aa, Artificial Sequence
  Description of Artificial Sequence: Synthetic polypeptide
DEEEIRTTNPVATEQYGSVSNNLQQDPNLMM

SEQ ID NO: 30451 - protein, 31 aa, Artificial Sequence
  Description of Artificial Sequence: Synthetic polypeptide
DEAEIRTTNPVATEQYGEVSTNLQGGGMNEA

SEQ ID NO: 30452 - protein, 31 aa, Artificial Sequence
  Description of Artificial Sequence: Synthetic polypeptide
DEEEIRTTNPVATEQYGSVSNNLQQDSNLIG

SEQ ID NO: 30453 - protein, 32 aa, Artificial Sequence
  Description of Artificial Sequence: Synthetic polypeptide
DEEEIRTTNPVATEQYGSVSTNLQNSGSETLS

SEQ ID NO: 30454 - protein, 31 aa, Artificial Sequence
  Description of Artificial Sequence: Synthetic polypeptide
DEEEIRTTNPVATEQYGSVSTPLQRLTIEGE

SEQ ID NO: 30455 - protein, 31 aa, Artificial Sequence
  Description of Artificial Sequence: Synthetic polypeptide
DEAEIRTTNPVATEQYGEVSTNLQDGGQNDE

SEQ ID NO: 30456 - protein, 31 aa, Artificial Sequence
  Description of Artificial Sequence: Synthetic polypeptide
DEAEIRTTNPVATEQYGEVSTNLNQEDGNHQ

SEQ ID NO: 30457 - protein, 31 aa, Artificial Sequence
  Description of Artificial Sequence: Synthetic polypeptide
DEDEIRTTNPVATEAYGSVSTNLQGDAGNDQ

SEQ ID NO: 30458 - protein, 31 aa, Artificial Sequence
  Description of Artificial Sequence: Synthetic polypeptide
DEAEIRTTNPVATEQYGSVSTNNHQERDMIR

SEQ ID NO: 30459 - protein, 31 aa, Artificial Sequence
  Description of Artificial Sequence: Synthetic polypeptide
DEEEIRTTNPVATEQYGSVSTGLSQSGEQEP

SEQ ID NO: 30460 - protein, 32 aa, Artificial Sequence
  Description of Artificial Sequence: Synthetic polypeptide
DEEEIRTTNPVATEQYGSVSCTNEHQERPPIR

SEQ ID NO: 30461 - protein, 32 aa, Artificial Sequence
  Description of Artificial Sequence: Synthetic polypeptide
DEEEIRTTNPVATEQYGSVSTVNQQINQGNIF

SEQ ID NO: 30462 - protein, 31 aa, Artificial Sequence
  Description of Artificial Sequence: Synthetic polypeptide
DEEEIRTTNPVATEQYGSVSTGLVASGINMT

SEQ ID NO: 30463 - protein, 29 aa, Artificial Sequence
  Description of Artificial Sequence: Synthetic peptide
DEECIRTTNPVAYEQYGQVSTENNQRDNN

SEQ ID NO: 30464 - protein, 30 aa, Artificial Sequence
  Description of Artificial Sequence: Synthetic polypeptide
DEAEIRTTNPVATEQYGEVSTNLDMGGGER

SEQ ID NO: 30465 - protein, 32 aa, Artificial Sequence
  Description of Artificial Sequence: Synthetic polypeptide
DEEEIRTTNPVATEQYGSVSTPLQSVEGNNNI

SEQ ID NO: 30466 - protein, 30 aa, Artificial Sequence
  Description of Artificial Sequence: Synthetic polypeptide
DEEEIRTTNPVATEQYGSVTNTMMQEENNR

SEQ ID NO: 30467 - protein, 30 aa, Artificial Sequence
  Description of Artificial Sequence: Synthetic polypeptide
DEECIRTTNPVATEIYGQVTTNLQMGENNR

SEQ ID NO: 30468 - protein, 30 aa, Artificial Sequence
  Description of Artificial Sequence: Synthetic polypeptide
DEAEIRTTNPVATEQYGETSTNLQRGGDSD

SEQ ID NO: 30469 - protein, 32 aa, Artificial Sequence
  Description of Artificial Sequence: Synthetic polypeptide
DEEEIRTTNPVATEQYGSVTNTNLQQAAGNAQ

SEQ ID NO: 30470 - protein, 28 aa, Artificial Sequence
  Description of Artificial Sequence: Synthetic peptide
DEAEIRTTNSVAYCQYGSVSCNLQGGDR

SEQ ID NO: 30471 - protein, 31 aa, Artificial Sequence
  Description of Artificial Sequence: Synthetic polypeptide
DEEEIRTTNPVATEQYGSVSTGNDEGGSNQT

SEQ ID NO: 30472 - protein, 32 aa, Artificial Sequence
  Description of Artificial Sequence: Synthetic polypeptide
DEEEIRTTNPVATEQYGSVSITNDMQRQDENE

SEQ ID NO: 30473 - protein, 32 aa, Artificial Sequence
  Description of Artificial Sequence: Synthetic polypeptide
DEEAIRTTNPVATEQYGSVCPTNLQRFGSNQG

SEQ ID NO: 30474 - protein, 35 aa, Artificial Sequence
  Description of Artificial Sequence: Synthetic polypeptide
DEEEIRTTNPVATEQYGSVSITNDLDQLRGENERN

SEQ ID NO: 30475 - protein, 34 aa, Artificial Sequence
  Description of Artificial Sequence: Synthetic polypeptide
DEEEIRTTNPVATEQYGSVSTGNESSQRGGNNRI

SEQ ID NO: 30476 - protein, 32 aa, Artificial Sequence
  Description of Artificial Sequence: Synthetic polypeptide
DEEEIRTTNPVATEQYGSVSTGNGTDQEGNVA

SEQ ID NO: 30477 - protein, 31 aa, Artificial Sequence
  Description of Artificial Sequence: Synthetic polypeptide
DEEAIRTTNPVATEQYGSVCSTGNDQRGSEQ

SEQ ID NO: 30478 - protein, 30 aa, Artificial Sequence
  Description of Artificial Sequence: Synthetic polypeptide
DEEEIRTTNPVATEQYGSVQTNQQLGLIIQ

SEQ ID NO: 30479 - protein, 30 aa, Artificial Sequence
  Description of Artificial Sequence: Synthetic polypeptide
DEAEIRTTNPVATEQYGCYSTINPLQRENN

SEQ ID NO: 30480 - protein, 33 aa, Artificial Sequence
  Description of Artificial Sequence: Synthetic polypeptide
DEEEIRTTNPVATEQYGSVSTGNLQFFNSNNRE

SEQ ID NO: 30481 - protein, 31 aa, Artificial Sequence
  Description of Artificial Sequence: Synthetic polypeptide
DEEEIRTTNPVATEQYGSVQTNLQQMGEIGD

SEQ ID NO: 30482 - protein, 31 aa, Artificial Sequence
  Description of Artificial Sequence: Synthetic polypeptide
DEEEIRTTNPVATEQYGSVSTALQEGGGIGE

SEQ ID NO: 30483 - protein, 31 aa, Artificial Sequence
  Description of Artificial Sequence: Synthetic polypeptide
DEEEIRTTNPVATEQYGSVSPTMNLEREEEE

SEQ ID NO: 30484 - protein, 31 aa, Artificial Sequence
  Description of Artificial Sequence: Synthetic polypeptide
DEEEIRTTNPVATEQYGSVSCTNGGARGKFG

SEQ ID NO: 30485 - protein, 31 aa, Artificial Sequence
  Description of Artificial Sequence: Synthetic polypeptide
DEEEIRTTNPVATEQYGSVTSENLDDNGERM

SEQ ID NO: 30486 - protein, 32 aa, Artificial Sequence
  Description of Artificial Sequence: Synthetic polypeptide
DEEEIRTTNPVATEQYGSVTSETNLNQNGEIM

SEQ ID NO: 30487 - protein, 32 aa, Artificial Sequence
  Description of Artificial Sequence: Synthetic polypeptide
DEAEIRTTNPVATEQYGSVSTTNALQNGDNNM

SEQ ID NO: 30488 - protein, 32 aa, Artificial Sequence
  Description of Artificial Sequence: Synthetic polypeptide
DEEEIRTTNPVATEQYGSVSTGNLQNFISNFL

SEQ ID NO: 30489 - protein, 30 aa, Artificial Sequence
  Description of Artificial Sequence: Synthetic polypeptide
DEEEIRTTNPVATEQYGSVSCTNGGLTGEF

SEQ ID NO: 30490 - protein, 33 aa, Artificial Sequence
  Description of Artificial Sequence: Synthetic polypeptide
DEEEIRTTNPVATEQYGSVSPTMLQRQGFEQRD

SEQ ID NO: 30491 - protein, 33 aa, Artificial Sequence
  Description of Artificial Sequence: Synthetic polypeptide
DEEEIRTTNPVATEQYGSVSTGNLQNIGGDNDQ

SEQ ID NO: 30492 - protein, 32 aa, Artificial Sequence
  Description of Artificial Sequence: Synthetic polypeptide
DEEEIRTTNPVATEQYGSVSPTMLNQRGEEVF

SEQ ID NO: 30493 - protein, 33 aa, Artificial Sequence
  Description of Artificial Sequence: Synthetic polypeptide
DEEEIRTTNPVATEQYGSVTSDTSNLGQNEGNA

SEQ ID NO: 30494 - protein, 33 aa, Artificial Sequence
  Description of Artificial Sequence: Synthetic polypeptide
DEEEIRTTNPVATEQYGSVSTGNLQQDEGENNG

SEQ ID NO: 30495 - protein, 33 aa, Artificial Sequence
  Description of Artificial Sequence: Synthetic polypeptide
DEEEIRTTNPVATEQYGSVSTGNLQQEGVGNEG

SEQ ID NO: 30496 - protein, 33 aa, Artificial Sequence
  Description of Artificial Sequence: Synthetic polypeptide
DEEEIRTTNPVATEQYGSVSTGNLQQGQGGNIP

SEQ ID NO: 30497 - protein, 32 aa, Artificial Sequence
  Description of Artificial Sequence: Synthetic polypeptide
DEEEIRTTNPVATEQYGSVSPTMELQRMLENT

SEQ ID NO: 30498 - protein, 32 aa, Artificial Sequence
  Description of Artificial Sequence: Synthetic polypeptide
DEEEIRTTNPVATEQYGSVSTPNDQGNFGNQN

SEQ ID NO: 30499 - protein, 31 aa, Artificial Sequence
  Description of Artificial Sequence: Synthetic polypeptide
DEEEIRTTNPVATEQYGSVSPTMELQRDLSM

SEQ ID NO: 30500 - protein, 30 aa, Artificial Sequence
  Description of Artificial Sequence: Synthetic polypeptide
DEEEIRTTNPVATEQYGSVSCTNGGNEGKF

SEQ ID NO: 30501 - protein, 29 aa, Artificial Sequence
  Description of Artificial Sequence: Synthetic peptide
DEECIRTTNPVAYEQYGQVSTMAGQRGNN

SEQ ID NO: 30502 - protein, 29 aa, Artificial Sequence
  Description of Artificial Sequence: Synthetic peptide
DEEEIRTTNPVATEQYGSVSPTLTQEQEF

SEQ ID NO: 30503 - protein, 33 aa, Artificial Sequence
  Description of Artificial Sequence: Synthetic polypeptide
DEEEIRTTNPVATEQYGSVSTGNLQQNDGDNEN

SEQ ID NO: 30504 - protein, 31 aa, Artificial Sequence
  Description of Artificial Sequence: Synthetic polypeptide
DEEEIRTTNPVATEQYGSVSCTNGGQEGKSF

SEQ ID NO: 30505 - protein, 30 aa, Artificial Sequence
  Description of Artificial Sequence: Synthetic polypeptide
DECEICTTNPVATEQYGSVSTTNLMTGDNT

SEQ ID NO: 30506 - protein, 32 aa, Artificial Sequence
  Description of Artificial Sequence: Synthetic polypeptide
DEEEIRTTNPVATEQYGSVSNNLSQVGEVFRF

SEQ ID NO: 30507 - protein, 30 aa, Artificial Sequence
  Description of Artificial Sequence: Synthetic polypeptide
DEEEIRTTNPVATEQYGSVSNNLSVSTEER

SEQ ID NO: 30508 - protein, 31 aa, Artificial Sequence
  Description of Artificial Sequence: Synthetic polypeptide
DEEEIRTTNPVATEQYGSVSNNLQSFTETRI

SEQ ID NO: 30509 - protein, 32 aa, Artificial Sequence
  Description of Artificial Sequence: Synthetic polypeptide
DEDEIRTTNPVATEQYGSVSTNLQGEGQNGQP

SEQ ID NO: 30510 - protein, 32 aa, Artificial Sequence
  Description of Artificial Sequence: Synthetic polypeptide
DEEEIRTTNPVATEQYGSVSTGNLQENFGSQD

SEQ ID NO: 30511 - protein, 33 aa, Artificial Sequence
  Description of Artificial Sequence: Synthetic polypeptide
DEEEIRTTNPVATEQYGSVSPTMNLIQRGLELT

SEQ ID NO: 30512 - protein, 31 aa, Artificial Sequence
  Description of Artificial Sequence: Synthetic polypeptide
DECEICTTNPVATEQYGSVSTNLQMQGTNQT

SEQ ID NO: 30513 - protein, 32 aa, Artificial Sequence
  Description of Artificial Sequence: Synthetic polypeptide
DEEEIRTTNPVATEQYGSVSGNLQGSGENGGD

SEQ ID NO: 30514 - protein, 30 aa, Artificial Sequence
  Description of Artificial Sequence: Synthetic polypeptide
DECEICTTNPVATEQYGSVSTNLTYGNDTQ

SEQ ID NO: 30515 - protein, 32 aa, Artificial Sequence
  Description of Artificial Sequence: Synthetic polypeptide
DEEEIRTTNPVATEQYGSVSTPNDDQGEGGNG

SEQ ID NO: 30516 - protein, 32 aa, Artificial Sequence
  Description of Artificial Sequence: Synthetic polypeptide
DEEEIRTTNPVATEQYGSVSGNLQGSGGNNGD

SEQ ID NO: 30517 - protein, 32 aa, Artificial Sequence
  Description of Artificial Sequence: Synthetic polypeptide
DEEEIRTTNPVATEQYGSVSITMNLNENGGNE

SEQ ID NO: 30518 - protein, 32 aa, Artificial Sequence
  Description of Artificial Sequence: Synthetic polypeptide
DEEEIRTTNPVATEQYGSVSTGNLDDGGGNES

SEQ ID NO: 30519 - protein, 30 aa, Artificial Sequence
  Description of Artificial Sequence: Synthetic polypeptide
DEECIRTTNPVAYEQYGQVSTINVQRGNFM

SEQ ID NO: 30520 - protein, 32 aa, Artificial Sequence
  Description of Artificial Sequence: Synthetic polypeptide
DEEEIRTTNPVATEQYGSVSTGNLDGGNGNEI

SEQ ID NO: 30521 - protein, 32 aa, Artificial Sequence
  Description of Artificial Sequence: Synthetic polypeptide
DEEEIRTTNPVATEQYGSVSTALQQFEQGTNI

SEQ ID NO: 30522 - protein, 34 aa, Artificial Sequence
  Description of Artificial Sequence: Synthetic polypeptide
DEEEIRTTNPVATEQYGSVSCTNELADRTGGNNR

SEQ ID NO: 30523 - protein, 32 aa, Artificial Sequence
  Description of Artificial Sequence: Synthetic polypeptide
DEEEIRTTNPVATEQYGSVQTNLQVVNNNDRS

SEQ ID NO: 30524 - protein, 32 aa, Artificial Sequence
  Description of Artificial Sequence: Synthetic polypeptide
DEEEIRTTNPVATEQYGSVTPTNLERMSENER

SEQ ID NO: 30525 - protein, 33 aa, Artificial Sequence
  Description of Artificial Sequence: Synthetic polypeptide
DEEEIRTTNPVATEQYGSVSTGNLGQGIGQNQD

SEQ ID NO: 30526 - protein, 32 aa, Artificial Sequence
  Description of Artificial Sequence: Synthetic polypeptide
DEEEIRTTNPVATEQYGSVSTALQQDGENISE

SEQ ID NO: 30527 - protein, 32 aa, Artificial Sequence
  Description of Artificial Sequence: Synthetic polypeptide
DEEEIRTTNPVATEQYGSVSTPNDMQARIGDI

SEQ ID NO: 30528 - protein, 32 aa, Artificial Sequence
  Description of Artificial Sequence: Synthetic polypeptide
DEEEIRTTNPVATEQYGSVSTALQPNGGNEQG

SEQ ID NO: 30529 - protein, 30 aa, Artificial Sequence
  Description of Artificial Sequence: Synthetic polypeptide
DEECIRTTNPVAYEQYGQVSTLNVQRNGNN

SEQ ID NO: 30530 - protein, 32 aa, Artificial Sequence
  Description of Artificial Sequence: Synthetic polypeptide
DEEEIRTTNPVATEQYGSVSTGNLIGEGGNGQ

SEQ ID NO: 30531 - protein, 32 aa, Artificial Sequence
  Description of Artificial Sequence: Synthetic polypeptide
DEEEIRTTNPVATEQYGSVQTNLQRMGLDVMI

SEQ ID NO: 30532 - protein, 32 aa, Artificial Sequence
  Description of Artificial Sequence: Synthetic polypeptide
DEEEIRTTNPVATEQYGSVSTGNLIGGGNTQT

SEQ ID NO: 30533 - protein, 32 aa, Artificial Sequence
  Description of Artificial Sequence: Synthetic polypeptide
DEEEIRTTNPVATEQYGSVSTGNLIVGDGNTQ

SEQ ID NO: 30534 - protein, 32 aa, Artificial Sequence
  Description of Artificial Sequence: Synthetic polypeptide
DEEEIRTTNPVATEQYGSVSTALQMVEGGNND

SEQ ID NO: 30535 - protein, 31 aa, Artificial Sequence
  Description of Artificial Sequence: Synthetic polypeptide
DEEEIRTTNPVATEQYGSVTQTNLQNIENVT

SEQ ID NO: 30536 - protein, 32 aa, Artificial Sequence
  Description of Artificial Sequence: Synthetic polypeptide
DEEEIRTTNPVATEQYGSVSTALQGFGQNIGE

SEQ ID NO: 30537 - protein, 32 aa, Artificial Sequence
  Description of Artificial Sequence: Synthetic polypeptide
DEDEIRTTNPVATEAYGSVYSYTNLQMGDENR

SEQ ID NO: 30538 - protein, 30 aa, Artificial Sequence
  Description of Artificial Sequence: Synthetic polypeptide
DEEEIRTTNPVATEQYGSVTSAVLTGGGNI

SEQ ID NO: 30539 - protein, 31 aa, Artificial Sequence
  Description of Artificial Sequence: Synthetic polypeptide
DEEEIRTTNPVATEQYGSVSTGNLPNPFHGR

SEQ ID NO: 30540 - protein, 31 aa, Artificial Sequence
  Description of Artificial Sequence: Synthetic polypeptide
DEEEIRTTNPVATEQYGSVSTGNLPNPFTER

SEQ ID NO: 30541 - protein, 30 aa, Artificial Sequence
  Description of Artificial Sequence: Synthetic polypeptide
DEEEIRTTNPVATEQYGSVTPTDSDRGEQR

SEQ ID NO: 30542 - protein, 32 aa, Artificial Sequence
  Description of Artificial Sequence: Synthetic polypeptide
DEEEIRTTNPVATEQYGSVSTGLSQDRGEQEV

SEQ ID NO: 30543 - protein, 29 aa, Artificial Sequence
  Description of Artificial Sequence: Synthetic peptide
DEECIRTTNPVATEIYGQVTTDLQRGSER

SEQ ID NO: 30544 - protein, 32 aa, Artificial Sequence
  Description of Artificial Sequence: Synthetic polypeptide
DEEEIRTTNPVATEQYGSVSCTNDSQSPGGNS

SEQ ID NO: 30545 - protein, 31 aa, Artificial Sequence
  Description of Artificial Sequence: Synthetic polypeptide
DEEEIRTTNPVATEQYGSVSTGLDQEFEARF

SEQ ID NO: 30546 - protein, 33 aa, Artificial Sequence
  Description of Artificial Sequence: Synthetic polypeptide
DEEEIRTTNPVATEQYGSVSTPLLQQRTGNEED

SEQ ID NO: 30547 - protein, 30 aa, Artificial Sequence
  Description of Artificial Sequence: Synthetic polypeptide
DEEEIRTTNPVATEQYGSVSTPLNDTIVER

SEQ ID NO: 30548 - protein, 31 aa, Artificial Sequence
  Description of Artificial Sequence: Synthetic polypeptide
DEEEIRTTNPVATEQYGSVSTGLEQLGMTLQ

SEQ ID NO: 30549 - protein, 31 aa, Artificial Sequence
  Description of Artificial Sequence: Synthetic polypeptide
DEEEIRTTNPVATEQYGSVSPTNGQNENENE

SEQ ID NO: 30550 - protein, 33 aa, Artificial Sequence
  Description of Artificial Sequence: Synthetic polypeptide
DEEEIRTTNPVATEQYGSVSTNLQQGNQGFNIN

SEQ ID NO: 30551 - protein, 31 aa, Artificial Sequence
  Description of Artificial Sequence: Synthetic polypeptide
DEEEIRTTNPVATEQYGSVSYTNYGERDNEV

SEQ ID NO: 30552 - protein, 30 aa, Artificial Sequence
  Description of Artificial Sequence: Synthetic polypeptide
DEEEIRTTNPVATEQYGSVQTVTQNNGENE

SEQ ID NO: 30553 - protein, 34 aa, Artificial Sequence
  Description of Artificial Sequence: Synthetic polypeptide
DEEEIRTTNPVATEQYGSVSYTPALSQRGGNNRN

SEQ ID NO: 30554 - protein, 32 aa, Artificial Sequence
  Description of Artificial Sequence: Synthetic polypeptide
DEEEIRTTNPVATEQYGSVQTVTLQRGSNQEE

SEQ ID NO: 30555 - protein, 32 aa, Artificial Sequence
  Description of Artificial Sequence: Synthetic polypeptide
DEEEIRTTNPVATEQYGSVSYTPNLQNGFVTQ

SEQ ID NO: 30556 - protein, 31 aa, Artificial Sequence
  Description of Artificial Sequence: Synthetic polypeptide
DEAEIRTTNPVATEQYGSVSTNLQQGGDGEA

SEQ ID NO: 30557 - protein, 30 aa, Artificial Sequence
  Description of Artificial Sequence: Synthetic polypeptide
DEECIRCTNPVATEQYGISVSCNFSQRGNL

SEQ ID NO: 30558 - protein, 32 aa, Artificial Sequence
  Description of Artificial Sequence: Synthetic polypeptide
DEEEIRTTNPVATEQYGSVSTNLQQGREVEED

SEQ ID NO: 30559 - protein, 31 aa, Artificial Sequence
  Description of Artificial Sequence: Synthetic polypeptide
DEEEIRTTNPVATEQYGSVSYTSLQMSNEFE

SEQ ID NO: 30560 - protein, 32 aa, Artificial Sequence
  Description of Artificial Sequence: Synthetic polypeptide
DEEEIRTTNPVATEQYGSVSYTWNSDFRDGNS

SEQ ID NO: 30561 - protein, 29 aa, Artificial Sequence
  Description of Artificial Sequence: Synthetic peptide
DEEEIACTNPVATEGYGSVATNLQDGNDM

SEQ ID NO: 30562 - protein, 32 aa, Artificial Sequence
  Description of Artificial Sequence: Synthetic polypeptide
DEDEIRTTNPVATEQYGSVSTNLQPQGNDNDG

SEQ ID NO: 30563 - protein, 32 aa, Artificial Sequence
  Description of Artificial Sequence: Synthetic polypeptide
DEEEIRTTNPVATEQYGSVSTGLETRQGINFL

SEQ ID NO: 30564 - protein, 32 aa, Artificial Sequence
  Description of Artificial Sequence: Synthetic polypeptide
DEEEIRTTNPVATEQYGSVSYVTLQDGENNRI

SEQ ID NO: 30565 - protein, 30 aa, Artificial Sequence
  Description of Artificial Sequence: Synthetic polypeptide
DEECIRTTNPVATEIYGCVTTNLQRGSNDS

SEQ ID NO: 30566 - protein, 30 aa, Artificial Sequence
  Description of Artificial Sequence: Synthetic polypeptide
DEEEIACTNPVATEHYGSVSTNLQQGNETM

SEQ ID NO: 30567 - protein, 32 aa, Artificial Sequence
  Description of Artificial Sequence: Synthetic polypeptide
DEAEIRTTNPVATEQYGSVSTNLQQGNDGNAG

SEQ ID NO: 30568 - protein, 32 aa, Artificial Sequence
  Description of Artificial Sequence: Synthetic polypeptide
DEEEIRTTNPVATEQYGSVSYYDNLQEQVGVR

SEQ ID NO: 30569 - protein, 32 aa, Artificial Sequence
  Description of Artificial Sequence: Synthetic polypeptide
DEEEIRTTNPVATEQYGSVSTGLEVRLANIRG

SEQ ID NO: 30570 - protein, 30 aa, Artificial Sequence
  Description of Artificial Sequence: Synthetic polypeptide
DEAEIRTTNPVATEQYGQCTSTGNLQRGDQ

SEQ ID NO: 30571 - protein, 31 aa, Artificial Sequence
  Description of Artificial Sequence: Synthetic polypeptide
DEAEIRTTNPVATEQYGSVSTNLQQMGDSGD

SEQ ID NO: 30572 - protein, 31 aa, Artificial Sequence
  Description of Artificial Sequence: Synthetic polypeptide
DEAEIRTTNPVATEQYGSVSTNLQQMGGGEA

SEQ ID NO: 30573 - protein, 32 aa, Artificial Sequence
  Description of Artificial Sequence: Synthetic polypeptide
DEAEIRTTNPVATEQYGSVSTNLQQGGGDNAN

SEQ ID NO: 30574 - protein, 31 aa, Artificial Sequence
  Description of Artificial Sequence: Synthetic polypeptide
DEEEIRTTNPVATEQYGSVSTGLARSINNQS

SEQ ID NO: 30575 - protein, 32 aa, Artificial Sequence
  Description of Artificial Sequence: Synthetic polypeptide
DEAEIRTTNPVATEQYGSVSTNLQNMEGNNEQ

SEQ ID NO: 30576 - protein, 33 aa, Artificial Sequence
  Description of Artificial Sequence: Synthetic polypeptide
DEEEIRTTNPVATEQYGSVSTNLQQGVGGGNED

SEQ ID NO: 30577 - protein, 31 aa, Artificial Sequence
  Description of Artificial Sequence: Synthetic polypeptide
DEEEIRTTNPVATEQYGSVQVTLNDQRGEQI

SEQ ID NO: 30578 - protein, 31 aa, Artificial Sequence
  Description of Artificial Sequence: Synthetic polypeptide
DEEEIRTTNPVATEQYGSVQVNGQPRGVANI

SEQ ID NO: 30579 - protein, 31 aa, Artificial Sequence
  Description of Artificial Sequence: Synthetic polypeptide
DEAEIRTTNPVATEQYGSVSTNLQHGQGDTQ

SEQ ID NO: 30580 - protein, 31 aa, Artificial Sequence
  Description of Artificial Sequence: Synthetic polypeptide
DEAEIRTTNPVATEQYGSVSTNLQHQGGDTA

SEQ ID NO: 30581 - protein, 33 aa, Artificial Sequence
  Description of Artificial Sequence: Synthetic polypeptide
DEEEIRTTNPVATEQYGSVSPTNIQMRSLDNDR

SEQ ID NO: 30582 - protein, 32 aa, Artificial Sequence
  Description of Artificial Sequence: Synthetic polypeptide
DEEEIRTTNPVATEQYGSVSPTNINQAGENED

SEQ ID NO: 30583 - protein, 31 aa, Artificial Sequence
  Description of Artificial Sequence: Synthetic polypeptide
DEEEIRTTNPVATEQYGSVSTPGQEGGGNEF

SEQ ID NO: 30584 - protein, 31 aa, Artificial Sequence
  Description of Artificial Sequence: Synthetic polypeptide
DEEEIRTTNPVATEQYGSVSTPGQNQGNNGQ

SEQ ID NO: 30585 - protein, 32 aa, Artificial Sequence
  Description of Artificial Sequence: Synthetic polypeptide
DEEEIRTTNPVATEQYGSVSPTNIETGNMDFR

SEQ ID NO: 30586 - protein, 31 aa, Artificial Sequence
  Description of Artificial Sequence: Synthetic polypeptide
DEEEIRTTNPVATEQYGSVSTPGVTMVGNER

SEQ ID NO: 30587 - protein, 31 aa, Artificial Sequence
  Description of Artificial Sequence: Synthetic polypeptide
DEEEIRTTNPVATEQYGSVSNNLNIGGNNEQ

SEQ ID NO: 30588 - protein, 30 aa, Artificial Sequence
  Description of Artificial Sequence: Synthetic polypeptide
DEEEIRTTNPVATEQYGSVSTGEHQFGEQS

SEQ ID NO: 30589 - protein, 32 aa, Artificial Sequence
  Description of Artificial Sequence: Synthetic polypeptide
DEEEIRTTNPVATEQYGSVSTGEHQRSGSDRP

SEQ ID NO: 30590 - protein, 30 aa, Artificial Sequence
  Description of Artificial Sequence: Synthetic polypeptide
DEEEIRTTNPVATEQYGSVSTGELENFGDQ

SEQ ID NO: 30591 - protein, 30 aa, Artificial Sequence
  Description of Artificial Sequence: Synthetic polypeptide
DEEEIRTTNPVATEQYGSVSTPLARDEIIQ

SEQ ID NO: 30592 - protein, 32 aa, Artificial Sequence
  Description of Artificial Sequence: Synthetic polypeptide
DEEEIRTTNPVATEQYGSVSTGELNQNFGSNI

SEQ ID NO: 30593 - protein, 32 aa, Artificial Sequence
  Description of Artificial Sequence: Synthetic polypeptide
DEEEIRTTNPVATEQYGSVSPTNIERNGDDRG

SEQ ID NO: 30594 - protein, 34 aa, Artificial Sequence
  Description of Artificial Sequence: Synthetic polypeptide
DEEEIRTTNPVATEQYGSVSITNLHQPDPGLNLR

SEQ ID NO: 30595 - protein, 32 aa, Artificial Sequence
  Description of Artificial Sequence: Synthetic polypeptide
DEEEIRTTNPVATEQYGSVSPTNHQREEENTP

SEQ ID NO: 30596 - protein, 31 aa, Artificial Sequence
  Description of Artificial Sequence: Synthetic polypeptide
DEEEIRTTNPVATEQYGSVSTNLQQMPVDIP

SEQ ID NO: 30597 - protein, 32 aa, Artificial Sequence
  Description of Artificial Sequence: Synthetic polypeptide
DEEEIRTTNPVATEQYGSVSPTNHQIGEENLE

SEQ ID NO: 30598 - protein, 31 aa, Artificial Sequence
  Description of Artificial Sequence: Synthetic polypeptide
DEEEIRTTNPVATEQYGSVSPTNHHEERGEQ

SEQ ID NO: 30599 - protein, 31 aa, Artificial Sequence
  Description of Artificial Sequence: Synthetic polypeptide
DEEEIRTTNPVATEQYGSVSTNLQQLEEIVT

SEQ ID NO: 30600 - protein, 30 aa, Artificial Sequence
  Description of Artificial Sequence: Synthetic polypeptide
DEEEIRTTNPVATEQYGSVSPTNHDRNSSE

SEQ ID NO: 30601 - protein, 29 aa, Artificial Sequence
  Description of Artificial Sequence: Synthetic peptide
DEECIRCTNPVATEQYGKVSCNFQRGGNL

SEQ ID NO: 30602 - protein, 32 aa, Artificial Sequence
  Description of Artificial Sequence: Synthetic polypeptide
DEAEIRTTNPVATEQYGSVSTNLQNEGDNNMN

SEQ ID NO: 30603 - protein, 32 aa, Artificial Sequence
  Description of Artificial Sequence: Synthetic polypeptide
DEEEIRTTNPVATEQYGSVSITNLEMQELVNF

SEQ ID NO: 30604 - protein, 31 aa, Artificial Sequence
  Description of Artificial Sequence: Synthetic polypeptide
DEEEIRTTNPVATEQYGSVSYTNGGQGGQGT

SEQ ID NO: 30605 - protein, 31 aa, Artificial Sequence
  Description of Artificial Sequence: Synthetic polypeptide
DEAEIRTTNPVATEQYGSVSTNLQNMDGGEA

SEQ ID NO: 30606 - protein, 31 aa, Artificial Sequence
  Description of Artificial Sequence: Synthetic polypeptide
DEEAIRTTNPVATEQYGSVITPLQRISNTRS

SEQ ID NO: 30607 - protein, 31 aa, Artificial Sequence
  Description of Artificial Sequence: Synthetic polypeptide
DEEEIRTTNPVATEQYGSVSTGLINVDNFRD

SEQ ID NO: 30608 - protein, 32 aa, Artificial Sequence
  Description of Artificial Sequence: Synthetic polypeptide
DEEEIRTTNPVATEQYGSVSTANLDLGGENNS

SEQ ID NO: 30609 - protein, 32 aa, Artificial Sequence
  Description of Artificial Sequence: Synthetic polypeptide
DEAEIRTTNPVATEQYGSVSTNLQQNGDNNMS

SEQ ID NO: 30610 - protein, 32 aa, Artificial Sequence
  Description of Artificial Sequence: Synthetic polypeptide
DEEEIRTTNPVATEQYGSVTISTNDQGGGGNG

SEQ ID NO: 30611 - protein, 32 aa, Artificial Sequence
  Description of Artificial Sequence: Synthetic polypeptide
DEDEIRTTNPVATEQYGSVSTNLQNMGDNDQN

SEQ ID NO: 30612 - protein, 33 aa, Artificial Sequence
  Description of Artificial Sequence: Synthetic polypeptide
DEEEIRTTNPVATEQYGSVTISTNLQGGGENIS

SEQ ID NO: 30613 - protein, 32 aa, Artificial Sequence
  Description of Artificial Sequence: Synthetic polypeptide
DEEEIRTTNPVATEQYGSVSTANDDQGEGGNA

SEQ ID NO: 30614 - protein, 31 aa, Artificial Sequence
  Description of Artificial Sequence: Synthetic polypeptide
DEAEIRTTNPVATEQYGSVSTNMNQDGGNND

SEQ ID NO: 30615 - protein, 32 aa, Artificial Sequence
  Description of Artificial Sequence: Synthetic polypeptide
DEEEIRTTNPVATEQYGSVSTGLQRVFQNIES

SEQ ID NO: 30616 - protein, 33 aa, Artificial Sequence
  Description of Artificial Sequence: Synthetic polypeptide
DEEEIRTTNPVATEQYGSVTISTNLQGSGGNNG

SEQ ID NO: 30617 - protein, 31 aa, Artificial Sequence
  Description of Artificial Sequence: Synthetic polypeptide
DEAEIRTTNPVATEQYGHVSWTNLNTGQNDR

SEQ ID NO: 30618 - protein, 32 aa, Artificial Sequence
  Description of Artificial Sequence: Synthetic polypeptide
DEDEIRTTNPVATEAYGSVCSCTNHSQRGGNR

SEQ ID NO: 30619 - protein, 32 aa, Artificial Sequence
  Description of Artificial Sequence: Synthetic polypeptide
DEEEIRTTNPVATEQYGSVSTGLQSNEGGGNN

SEQ ID NO: 30620 - protein, 32 aa, Artificial Sequence
  Description of Artificial Sequence: Synthetic polypeptide
DEEEIRTTNPVATEQYGSVSTGLQSNGTGENN

SEQ ID NO: 30621 - protein, 31 aa, Artificial Sequence
  Description of Artificial Sequence: Synthetic polypeptide
DEEEIRTTNPVATEQYGSVTMTNGIQGDGNT

SEQ ID NO: 30622 - protein, 31 aa, Artificial Sequence
  Description of Artificial Sequence: Synthetic polypeptide
DEAEIRTTNPVATEQYGSVSTNMNQGDGNNM

SEQ ID NO: 30623 - protein, 33 aa, Artificial Sequence
  Description of Artificial Sequence: Synthetic polypeptide
DEEEIRTTNPVATEQYGSVSPTNEQQARGQLND

SEQ ID NO: 30624 - protein, 32 aa, Artificial Sequence
  Description of Artificial Sequence: Synthetic polypeptide
DEEEIRTTNPVATEQYGSVSTGLQSNIGGGNE

SEQ ID NO: 30625 - protein, 30 aa, Artificial Sequence
  Description of Artificial Sequence: Synthetic polypeptide
DEEEIRTTNPVATEQYGSVSPTNEQILAAN

SEQ ID NO: 30626 - protein, 31 aa, Artificial Sequence
  Description of Artificial Sequence: Synthetic polypeptide
DEAEIRTTNPVATEQYGSVSTNMNQGEGNEN

SEQ ID NO: 30627 - protein, 29 aa, Artificial Sequence
  Description of Artificial Sequence: Synthetic peptide
DEECIRTTNPVATEIYGQVTTDLQRGENQ

SEQ ID NO: 30628 - protein, 32 aa, Artificial Sequence
  Description of Artificial Sequence: Synthetic polypeptide
DEEEIRTTNPVATEQYGSVSTALQVEFGNFTI

SEQ ID NO: 30629 - protein, 32 aa, Artificial Sequence
  Description of Artificial Sequence: Synthetic polypeptide
DEAEIRTTNPVATEQYGEVSTNLQRGDGDNEQ

SEQ ID NO: 30630 - protein, 32 aa, Artificial Sequence
  Description of Artificial Sequence: Synthetic polypeptide
DEAEIRTTNPVATEQYGEVSTNLQNDEGNNRE

SEQ ID NO: 30631 - protein, 33 aa, Artificial Sequence
  Description of Artificial Sequence: Synthetic polypeptide
DEEEIRTTNPVATEQYGSVSTGLQSVRNNEDRN

SEQ ID NO: 30632 - protein, 30 aa, Artificial Sequence
  Description of Artificial Sequence: Synthetic polypeptide
DEDEIRTTNPVAYEQWGEVSTNLDQGHGNR

SEQ ID NO: 30633 - protein, 31 aa, Artificial Sequence
  Description of Artificial Sequence: Synthetic polypeptide
DEAEIRTTNPVATEQYGEVSTNLQIGGGNDA

SEQ ID NO: 30634 - protein, 28 aa, Artificial Sequence
  Description of Artificial Sequence: Synthetic peptide
DECEICTTNPVATDQYGVVSTALQPGNQ

SEQ ID NO: 30635 - protein, 31 aa, Artificial Sequence
  Description of Artificial Sequence: Synthetic polypeptide
DEAEIRTTNPVATEQYGSVSTNMNQGGNGNS

SEQ ID NO: 30636 - protein, 31 aa, Artificial Sequence
  Description of Artificial Sequence: Synthetic polypeptide
DEAEIRTTNPVATEQYGSVSTNNAGQDNDNR

SEQ ID NO: 30637 - protein, 31 aa, Artificial Sequence
  Description of Artificial Sequence: Synthetic polypeptide
DEAEIRTTNPVATEQYGEVSTNLQGNGDNGE

SEQ ID NO: 30638 - protein, 29 aa, Artificial Sequence
  Description of Artificial Sequence: Synthetic peptide
DEDEIRTTNPVAYEQWGEVSTNLGQAGNE

SEQ ID NO: 30639 - protein, 33 aa, Artificial Sequence
  Description of Artificial Sequence: Synthetic polypeptide
DEEEIRTTNPVATEQYGSVSTPLQQRSGNNEDN

SEQ ID NO: 30640 - protein, 31 aa, Artificial Sequence
  Description of Artificial Sequence: Synthetic polypeptide
DEEEIRTTNPVATEQYGSVSPTLNLIPGEED

SEQ ID NO: 30641 - protein, 32 aa, Artificial Sequence
  Description of Artificial Sequence: Synthetic polypeptide
DEDEIRTTNPVATEQYGSVSTNLQNNGDNDEN

SEQ ID NO: 30642 - protein, 31 aa, Artificial Sequence
  Description of Artificial Sequence: Synthetic polypeptide
DEEEIRTTNPVATEQYGSVQTTNEMQRENQI

SEQ ID NO: 30643 - protein, 31 aa, Artificial Sequence
  Description of Artificial Sequence: Synthetic polypeptide
DEEEIRTTNPVATEQYGSVTDTNLQRMELVV

SEQ ID NO: 30644 - protein, 32 aa, Artificial Sequence
  Description of Artificial Sequence: Synthetic polypeptide
DEEEIRTTNPVATEQYGSVSTNLQQGESGEGN

SEQ ID NO: 30645 - protein, 31 aa, Artificial Sequence
  Description of Artificial Sequence: Synthetic polypeptide
DEEEIRTTNPVATEQYGSVSPTNGLDQSVEI

SEQ ID NO: 30646 - protein, 30 aa, Artificial Sequence
  Description of Artificial Sequence: Synthetic polypeptide
DEEEIRTTNPVATEQYGSVSTGLMPGVEQD

SEQ ID NO: 30647 - protein, 31 aa, Artificial Sequence
  Description of Artificial Sequence: Synthetic polypeptide
DEEEIRTTNPVATEQYGSVTDTWLEQRSQIR

SEQ ID NO: 30648 - protein, 31 aa, Artificial Sequence
  Description of Artificial Sequence: Synthetic polypeptide
DEEEIRTTNPVATEQYGSVSITNHHQERQET

SEQ ID NO: 30649 - protein, 29 aa, Artificial Sequence
  Description of Artificial Sequence: Synthetic peptide
DECEIATTNPVAYEQYGVVSTNLQDGNAQ

SEQ ID NO: 30650 - protein, 33 aa, Artificial Sequence
  Description of Artificial Sequence: Synthetic polypeptide
DEEEIRTTNPVATEQYGSVSTNLQQEMGNNGED

SEQ ID NO: 30651 - protein, 32 aa, Artificial Sequence
  Description of Artificial Sequence: Synthetic polypeptide
DEAEIRTTNPVATEQYGNVSTNLQGNDGQNER

SEQ ID NO: 30652 - protein, 32 aa, Artificial Sequence
  Description of Artificial Sequence: Synthetic polypeptide
DEEEIRTTNPVATEQYGSVSTANLDEDGENEA

SEQ ID NO: 30653 - protein, 29 aa, Artificial Sequence
  Description of Artificial Sequence: Synthetic peptide
DEEEIRTTNPVATEQYGSVSTGLNHDLFD

SEQ ID NO: 30654 - protein, 31 aa, Artificial Sequence
  Description of Artificial Sequence: Synthetic polypeptide
DEEAIRTTNPVATEQYGSVCSTNLQNFNQNQ

SEQ ID NO: 30655 - protein, 32 aa, Artificial Sequence
  Description of Artificial Sequence: Synthetic polypeptide
DEEEIRTTNPVATEQYGSVSTANLDDEGGNEE

SEQ ID NO: 30656 - protein, 32 aa, Artificial Sequence
  Description of Artificial Sequence: Synthetic polypeptide
DEEEIRTTNPVATEQYGSVSTANLCEQVGSDQ

SEQ ID NO: 30657 - protein, 32 aa, Artificial Sequence
  Description of Artificial Sequence: Synthetic polypeptide
DEEEIRTTNPVATEQYGSVSTPLQLEGGNEQQ

SEQ ID NO: 30658 - protein, 31 aa, Artificial Sequence
  Description of Artificial Sequence: Synthetic polypeptide
DEAEIRTTNPVATEQYGNVSTNLQAQGGNNA

SEQ ID NO: 30659 - protein, 33 aa, Artificial Sequence
  Description of Artificial Sequence: Synthetic polypeptide
DEEEIRTTNPVATEQYGSVSETNLQNITGGNGN

SEQ ID NO: 30660 - protein, 31 aa, Artificial Sequence
  Description of Artificial Sequence: Synthetic polypeptide
DEAEIRTTNPVATEQYGNVSTNLNQGDGNEN

SEQ ID NO: 30661 - protein, 32 aa, Artificial Sequence
  Description of Artificial Sequence: Synthetic polypeptide
DEDEIRTTNPVATEQYGSVSTNLQPQGGDNDQ

SEQ ID NO: 30662 - protein, 32 aa, Artificial Sequence
  Description of Artificial Sequence: Synthetic polypeptide
DEEEIRTTNPVATEQYGSVSTGLQQGGGNDIP

SEQ ID NO: 30663 - protein, 32 aa, Artificial Sequence
  Description of Artificial Sequence: Synthetic polypeptide
DEEEIRTTNPVATEQYGSVSTPLQNVEGGNGD

SEQ ID NO: 30664 - protein, 32 aa, Artificial Sequence
  Description of Artificial Sequence: Synthetic polypeptide
DEEAIRTTNPVATEQYGSVCSTGNTQRGSNDP

SEQ ID NO: 30665 - protein, 30 aa, Artificial Sequence
  Description of Artificial Sequence: Synthetic polypeptide
DEEEIRTTNPVATEQYGSVTENLEIDENER

SEQ ID NO: 30666 - protein, 29 aa, Artificial Sequence
  Description of Artificial Sequence: Synthetic peptide
DEEEIACTNPVATEPYGSVATNLQQGNDA

SEQ ID NO: 30667 - protein, 32 aa, Artificial Sequence
  Description of Artificial Sequence: Synthetic polypeptide
DEEEIRTTNPVATEQYGSVQTTNLQNGIEFRV

SEQ ID NO: 30668 - protein, 31 aa, Artificial Sequence
  Description of Artificial Sequence: Synthetic polypeptide
DEEEIRTTNPVATEQYGSVSPTNEQVQNDYT

SEQ ID NO: 30669 - protein, 29 aa, Artificial Sequence
  Description of Artificial Sequence: Synthetic peptide
DEEEIRTTNPVATEQYGSVTGNLQVETAT

SEQ ID NO: 30670 - protein, 30 aa, Artificial Sequence
  Description of Artificial Sequence: Synthetic polypeptide
DECEICTTNPCATEQYGSVVTNLQHGGNNR

SEQ ID NO: 30671 - protein, 34 aa, Artificial Sequence
  Description of Artificial Sequence: Synthetic polypeptide
DEAEIRTTNPVATEQYGISTVSTNALSQRPGGNR

SEQ ID NO: 30672 - protein, 32 aa, Artificial Sequence
  Description of Artificial Sequence: Synthetic polypeptide
DEEEIRTTNPVATEQYGSVSTPLQQNEGGNND

SEQ ID NO: 30673 - protein, 32 aa, Artificial Sequence
  Description of Artificial Sequence: Synthetic polypeptide
DEDEIATTNPVATEQYGSVSTNLQGNAGNEER

SEQ ID NO: 30674 - protein, 35 aa, Artificial Sequence
  Description of Artificial Sequence: Synthetic polypeptide
DEEEIRTTNPVATEQYGSVSPTLNLDQRMGLNERP

SEQ ID NO: 30675 - protein, 31 aa, Artificial Sequence
  Description of Artificial Sequence: Synthetic polypeptide
DEEEIRTTNPVATEQYGSVSNNLTRSVLDRA

SEQ ID NO: 30676 - protein, 32 aa, Artificial Sequence
  Description of Artificial Sequence: Synthetic polypeptide
DEEEIRTTNPVATEQYGSVSTPNLDNFGNQNQ

SEQ ID NO: 30677 - protein, 34 aa, Artificial Sequence
  Description of Artificial Sequence: Synthetic polypeptide
DEEEIRTTNPVATEQYGSVSITENILQRGNDTDQ

SEQ ID NO: 30678 - protein, 32 aa, Artificial Sequence
  Description of Artificial Sequence: Synthetic polypeptide
DEEEIRTTNPVATEQYGSVSPTENLQTAGQLQ

SEQ ID NO: 30679 - protein, 31 aa, Artificial Sequence
  Description of Artificial Sequence: Synthetic polypeptide
DEDEIRTTNPVATEGYGSVSTNLQDGNGNTN

SEQ ID NO: 30680 - protein, 33 aa, Artificial Sequence
  Description of Artificial Sequence: Synthetic polypeptide
DEEEIRTTNPVATEQYGSVSTPNLDQEEGVNND

SEQ ID NO: 30681 - protein, 32 aa, Artificial Sequence
  Description of Artificial Sequence: Synthetic polypeptide
DEEEIRTTNPVATEQYGSVSTLGLINQGGGNG

SEQ ID NO: 30682 - protein, 30 aa, Artificial Sequence
  Description of Artificial Sequence: Synthetic polypeptide
DEAEIRTTNPVATEQYGCVSEDLQRDNQRM

SEQ ID NO: 30683 - protein, 31 aa, Artificial Sequence
  Description of Artificial Sequence: Synthetic polypeptide
DEECIRTTNPVATEQWGSVATNNLDQDGGNR

SEQ ID NO: 30684 - protein, 32 aa, Artificial Sequence
  Description of Artificial Sequence: Synthetic polypeptide
DEEEIRTTNPVATEQYGSVTSTMNDQGGGENQ

SEQ ID NO: 30685 - protein, 32 aa, Artificial Sequence
  Description of Artificial Sequence: Synthetic polypeptide
DEEEIRTTNPVATEQYGSVTSTMNDQIGQGNM

SEQ ID NO: 30686 - protein, 31 aa, Artificial Sequence
  Description of Artificial Sequence: Synthetic polypeptide
DEEEIRTTNPVATEQYGSVSITELQLGLEQG

SEQ ID NO: 30687 - protein, 31 aa, Artificial Sequence
  Description of Artificial Sequence: Synthetic polypeptide
DEEEIRTTNPVATEQYGSVQTGNGLMRDGEM

SEQ ID NO: 30688 - protein, 30 aa, Artificial Sequence
  Description of Artificial Sequence: Synthetic polypeptide
DEEAIRTTNPVATEQYGCVCSTNNQFGNQS

SEQ ID NO: 30689 - protein, 30 aa, Artificial Sequence
  Description of Artificial Sequence: Synthetic polypeptide
DEEAIRTTNPVATEQYGCVCSTNPQFGNTQ

SEQ ID NO: 30690 - protein, 31 aa, Artificial Sequence
  Description of Artificial Sequence: Synthetic polypeptide
DEEEIRTTNPVATEQYGSVSNNWLDNEGNIP

SEQ ID NO: 30691 - protein, 30 aa, Artificial Sequence
  Description of Artificial Sequence: Synthetic polypeptide
DEECIRTTNPVAYEQYGTVSTINAVQRGNN

SEQ ID NO: 30692 - protein, 33 aa, Artificial Sequence
  Description of Artificial Sequence: Synthetic polypeptide
DEEEIRTTNPVATEQYGSVSTVNLQQGQEGNID

SEQ ID NO: 30693 - protein, 30 aa, Artificial Sequence
  Description of Artificial Sequence: Synthetic polypeptide
DEEEIRTTNPVATEQYGSVQTDWLVRGEDS

SEQ ID NO: 30694 - protein, 30 aa, Artificial Sequence
  Description of Artificial Sequence: Synthetic polypeptide
DEAEIRTTNPVAYERYGSVSTNLQHGGGND

SEQ ID NO: 30695 - protein, 30 aa, Artificial Sequence
  Description of Artificial Sequence: Synthetic polypeptide
DEEEIRTTNPVATEQYGSVQTDVQREGDDD

SEQ ID NO: 30696 - protein, 28 aa, Artificial Sequence
  Description of Artificial Sequence: Synthetic peptide
DEDEIATTNPVAYAQYGSVATALQRGND

SEQ ID NO: 30697 - protein, 32 aa, Artificial Sequence
  Description of Artificial Sequence: Synthetic polypeptide
DEEEIRTTNPVATEQYGSVSPTENALQRFQED

SEQ ID NO: 30698 - protein, 30 aa, Artificial Sequence
  Description of Artificial Sequence: Synthetic polypeptide
DEAEIRTTNPVAYERYGSVSTNDQNDGNDR

SEQ ID NO: 30699 - protein, 33 aa, Artificial Sequence
  Description of Artificial Sequence: Synthetic polypeptide
DEEEIRTTNPVATEQYGSVSPTEMLQRGVLERS

SEQ ID NO: 30700 - protein, 32 aa, Artificial Sequence
  Description of Artificial Sequence: Synthetic polypeptide
DEEEIRTTNPVATEQYGSVSPTEMLQRGLLTE

SEQ ID NO: 30701 - protein, 33 aa, Artificial Sequence
  Description of Artificial Sequence: Synthetic polypeptide
DEEEIRTTNPVATEQYGSVSTPNLDQEVGNNED

SEQ ID NO: 30702 - protein, 32 aa, Artificial Sequence
  Description of Artificial Sequence: Synthetic polypeptide
DEEEIRTTNPVATEQYGSVSPTELTERGDEER

SEQ ID NO: 30703 - protein, 33 aa, Artificial Sequence
  Description of Artificial Sequence: Synthetic polypeptide
DEEEIRTTNPVATEQYGSVTSTMNLENGQGGNQ

SEQ ID NO: 30704 - protein, 33 aa, Artificial Sequence
  Description of Artificial Sequence: Synthetic polypeptide
DEEEIRTTNPVATEQYGSVSPTENHQTRGNLQT

SEQ ID NO: 30705 - protein, 33 aa, Artificial Sequence
  Description of Artificial Sequence: Synthetic polypeptide
DEEEIRTTNPVATEQYGSVTSTLNLQQEVAGNN

SEQ ID NO: 30706 - protein, 32 aa, Artificial Sequence
  Description of Artificial Sequence: Synthetic polypeptide
DEEEIRTTNPVATEQYGSVSNNVQQARGVVER

SEQ ID NO: 30707 - protein, 30 aa, Artificial Sequence
  Description of Artificial Sequence: Synthetic polypeptide
DEEEIRTTNPVATEQYGSVQTMLQLGELQT

SEQ ID NO: 30708 - protein, 31 aa, Artificial Sequence
  Description of Artificial Sequence: Synthetic polypeptide
DEEEIRTTNPVATEQYGSVSSVFLQRINEPN

SEQ ID NO: 30709 - protein, 31 aa, Artificial Sequence
  Description of Artificial Sequence: Synthetic polypeptide
DEEEIRTTNPVATEQYGSVQTNDDRGLNEHS

SEQ ID NO: 30710 - protein, 31 aa, Artificial Sequence
  Description of Artificial Sequence: Synthetic polypeptide
DEEEIRTTNPVATEQYGSVSTINLFTDEDRN

SEQ ID NO: 30711 - protein, 32 aa, Artificial Sequence
  Description of Artificial Sequence: Synthetic polypeptide
DEEEIRTTNPVATEQYGSVTSTGNLQGGSEDA

SEQ ID NO: 30712 - protein, 30 aa, Artificial Sequence
  Description of Artificial Sequence: Synthetic polypeptide
DEDEIRTTNPVATEGYGEVSTNLQGGNEDN

SEQ ID NO: 30713 - protein, 32 aa, Artificial Sequence
  Description of Artificial Sequence: Synthetic polypeptide
DEEEIRTTNPVATEQYGSVTSTGNLQGNSNDS

SEQ ID NO: 30714 - protein, 30 aa, Artificial Sequence
  Description of Artificial Sequence: Synthetic polypeptide
DEAEIRTTNPVATEQYGCVSTELQNGSNVT

SEQ ID NO: 30715 - protein, 33 aa, Artificial Sequence
  Description of Artificial Sequence: Synthetic polypeptide
DEEEIRTTNPVATEQYGSVSETNLQGVGGNGND

SEQ ID NO: 30716 - protein, 32 aa, Artificial Sequence
  Description of Artificial Sequence: Synthetic polypeptide
DEEEIRTTNPVATEQYGSVTSTLGLQGGGNES

SEQ ID NO: 30717 - protein, 32 aa, Artificial Sequence
  Description of Artificial Sequence: Synthetic polypeptide
DEEEIRTTNPVATEQYGSVSTPNLDIEGENIV

SEQ ID NO: 30718 - protein, 33 aa, Artificial Sequence
  Description of Artificial Sequence: Synthetic polypeptide
DEEEIRTTNPVATEQYGSVSPTFNLQDGLEIRA

SEQ ID NO: 30719 - protein, 32 aa, Artificial Sequence
  Description of Artificial Sequence: Synthetic polypeptide
DEEEIRTTNPVATEQYGSVSPTFNLIDRDNED

SEQ ID NO: 30720 - protein, 32 aa, Artificial Sequence
  Description of Artificial Sequence: Synthetic polypeptide
DEEEIRTTNPVATEQYGSVTSTLLNQGVGNSG

SEQ ID NO: 30721 - protein, 32 aa, Artificial Sequence
  Description of Artificial Sequence: Synthetic polypeptide
DEEEIRTTNPVATEQYGSVTSTLLQDGVGNEG

SEQ ID NO: 30722 - protein, 32 aa, Artificial Sequence
  Description of Artificial Sequence: Synthetic polypeptide
DEEEIRTTNPVATEQYGSVSTPNLDIEGNEDV

SEQ ID NO: 30723 - protein, 30 aa, Artificial Sequence
  Description of Artificial Sequence: Synthetic polypeptide
DEEEIRTTNPVATEQYGSVSTISHQRTDDN

SEQ ID NO: 30724 - protein, 31 aa, Artificial Sequence
  Description of Artificial Sequence: Synthetic polypeptide
DEEEIRTTNPVATEQYGSVSTIVQGIGNMGD

SEQ ID NO: 30725 - protein, 29 aa, Artificial Sequence
  Description of Artificial Sequence: Synthetic peptide
DEEEIRTTNPVATEQYGSVQTNAEGENEE

SEQ ID NO: 30726 - protein, 32 aa, Artificial Sequence
  Description of Artificial Sequence: Synthetic polypeptide
DEEEIRTTNPVATEQYGSVSSTVNNQISGNEV

SEQ ID NO: 30727 - protein, 32 aa, Artificial Sequence
  Description of Artificial Sequence: Synthetic polypeptide
DEEEIRTTNPVATEQYGSVSITGNGQGGGNEE

SEQ ID NO: 30728 - protein, 33 aa, Artificial Sequence
  Description of Artificial Sequence: Synthetic polypeptide
DEEEIRTTNPVATEQYGSVSSTVNLQNQGNEFD

SEQ ID NO: 30729 - protein, 31 aa, Artificial Sequence
  Description of Artificial Sequence: Synthetic polypeptide
DEAEIRTTNPVATEQYGCVSQTNLQRGDEDQ

SEQ ID NO: 30730 - protein, 32 aa, Artificial Sequence
  Description of Artificial Sequence: Synthetic polypeptide
DEEEIRTTNPVATEQYGSVSTPNLDIIEGENG

SEQ ID NO: 30731 - protein, 30 aa, Artificial Sequence
  Description of Artificial Sequence: Synthetic polypeptide
DEECIRTTNPVATEQWGSVACGNLQLGGNR

SEQ ID NO: 30732 - protein, 33 aa, Artificial Sequence
  Description of Artificial Sequence: Synthetic polypeptide
DEEEIRTTNPVATEQYGSVSNNTTNLQYGNNTE

SEQ ID NO: 30733 - protein, 30 aa, Artificial Sequence
  Description of Artificial Sequence: Synthetic polypeptide
DEEEIRTTNPVATEQYGSVQTMTLQGLEFR

SEQ ID NO: 30734 - protein, 32 aa, Artificial Sequence
  Description of Artificial Sequence: Synthetic polypeptide
DEEEIRTTNPVATEQYGSVSNNVLQLDGNNIG

SEQ ID NO: 30735 - protein, 30 aa, Artificial Sequence
  Description of Artificial Sequence: Synthetic polypeptide
DEEEIRTTNPVATEQYGSVQTMLQRLEQDT

SEQ ID NO: 30736 - protein, 33 aa, Artificial Sequence
  Description of Artificial Sequence: Synthetic polypeptide
DEEEIRTTNPVATEQYGSVSTLDLDQLRGENEV

SEQ ID NO: 30737 - protein, 30 aa, Artificial Sequence
  Description of Artificial Sequence: Synthetic polypeptide
DEECIRTTNPVAYEQYGWVSTINVQRGNNE

SEQ ID NO: 30738 - protein, 32 aa, Artificial Sequence
  Description of Artificial Sequence: Synthetic polypeptide
DEEEIRTTNPVATEQYGSVSPTFNLQNEVNGD

SEQ ID NO: 30739 - protein, 31 aa, Artificial Sequence
  Description of Artificial Sequence: Synthetic polypeptide
DEEEIRTTNPVATEQYGSVSPTEDLERGIVV

SEQ ID NO: 30740 - protein, 30 aa, Artificial Sequence
  Description of Artificial Sequence: Synthetic polypeptide
DEDEIRTTNPVATEGYGTVSTNLQGDGNQN

SEQ ID NO: 30741 - protein, 30 aa, Artificial Sequence
  Description of Artificial Sequence: Synthetic polypeptide
DEECIRTTNPVAYEQYSEEVSTNLQIGNDR

SEQ ID NO: 30742 - protein, 30 aa, Artificial Sequence
  Description of Artificial Sequence: Synthetic polypeptide
DEAEIRTTNPVAYERWGSVSTNLQDGGNTR

SEQ ID NO: 30743 - protein, 31 aa, Artificial Sequence
  Description of Artificial Sequence: Synthetic polypeptide
DEDEIRTTNPVATEHYGSVSTNLNQEGDNSD

SEQ ID NO: 30744 - protein, 32 aa, Artificial Sequence
  Description of Artificial Sequence: Synthetic polypeptide
DEEEIRTTNPVATEQYGSVSTPNLDVNFGNQT

SEQ ID NO: 30745 - protein, 29 aa, Artificial Sequence
  Description of Artificial Sequence: Synthetic peptide
DEECIATTNPVAYEQYGQVSTANVQRGNN

SEQ ID NO: 30746 - protein, 33 aa, Artificial Sequence
  Description of Artificial Sequence: Synthetic polypeptide
DEEEIRTTNPVATEQYGSVSTLLQQRSGNEEDP

SEQ ID NO: 30747 - protein, 32 aa, Artificial Sequence
  Description of Artificial Sequence: Synthetic polypeptide
DEEEIRTTNPVATEQYGSVSTPNLDVTVGNES

SEQ ID NO: 30748 - protein, 32 aa, Artificial Sequence
  Description of Artificial Sequence: Synthetic polypeptide
DEEEIRTTNPVATEQYGSVTSTNDDRNGQDRC

SEQ ID NO: 30749 - protein, 32 aa, Artificial Sequence
  Description of Artificial Sequence: Synthetic polypeptide
DEEEIRTTNPVATEQYGSVSTPNLEFTGGNIQ

SEQ ID NO: 30750 - protein, 32 aa, Artificial Sequence
  Description of Artificial Sequence: Synthetic polypeptide
DEEEIRTTNPVATEQYGSVSMDLTQRFGEVRD

SEQ ID NO: 30751 - protein, 33 aa, Artificial Sequence
  Description of Artificial Sequence: Synthetic polypeptide
DEEEIRTTNPVATEQYGSVSTVNLQGIGGNQIE

SEQ ID NO: 30752 - protein, 34 aa, Artificial Sequence
  Description of Artificial Sequence: Synthetic polypeptide
DEEEIRTTNPVATEQYGSVQSVTNELSQNGGNNR

SEQ ID NO: 30753 - protein, 32 aa, Artificial Sequence
  Description of Artificial Sequence: Synthetic polypeptide
DEEEIRTTNPVATEQYGSVTSTNGLIQGGIVT

SEQ ID NO: 30754 - protein, 32 aa, Artificial Sequence
  Description of Artificial Sequence: Synthetic polypeptide
DEDEIRTTNPVATEQYGSVSTNLNGMGGDNAR

SEQ ID NO: 30755 - protein, 31 aa, Artificial Sequence
  Description of Artificial Sequence: Synthetic polypeptide
DEEEIRTTNPVATEQYGSVTSTNHQNFGEQS

SEQ ID NO: 30756 - protein, 30 aa, Artificial Sequence
  Description of Artificial Sequence: Synthetic polypeptide
DEEEIRTTNPVATEQYGSVSNSLDDNGSNG

SEQ ID NO: 30757 - protein, 31 aa, Artificial Sequence
  Description of Artificial Sequence: Synthetic polypeptide
DEEEIRTTNPVATEQYGSVTSTNLDWASMNG

SEQ ID NO: 30758 - protein, 31 aa, Artificial Sequence
  Description of Artificial Sequence: Synthetic polypeptide
DEDEIRTTNPVATEQYGSVSTNLGSEGGSDR

SEQ ID NO: 30759 - protein, 33 aa, Artificial Sequence
  Description of Artificial Sequence: Synthetic polypeptide
DEEEIRTTNPVATEQYGSVSTPNLEQGEGENTS

SEQ ID NO: 30760 - protein, 30 aa, Artificial Sequence
  Description of Artificial Sequence: Synthetic polypeptide
DEDEIRTTNPVATEHYGSVSTNLQGDGDQN

SEQ ID NO: 30761 - protein, 32 aa, Artificial Sequence
  Description of Artificial Sequence: Synthetic polypeptide
DEEEIRTTNPVATEQYGSVSTLNDGQGEIGNV

SEQ ID NO: 30762 - protein, 32 aa, Artificial Sequence
  Description of Artificial Sequence: Synthetic polypeptide
DEEEIRTTNPVATEQYGSVTSTNLFGGGNQTE

SEQ ID NO: 30763 - protein, 30 aa, Artificial Sequence
  Description of Artificial Sequence: Synthetic polypeptide
DEDEIATTNPVATEQYGSVTTTNPERGGNR

SEQ ID NO: 30764 - protein, 31 aa, Artificial Sequence
  Description of Artificial Sequence: Synthetic polypeptide
DEECIRTTNPVATEQWGSVVATNNLQSGGNR

SEQ ID NO: 30765 - protein, 32 aa, Artificial Sequence
  Description of Artificial Sequence: Synthetic polypeptide
DEEEIRTTNPVATEQYGSVTSTNLFQGGEGQQ

SEQ ID NO: 30766 - protein, 32 aa, Artificial Sequence
  Description of Artificial Sequence: Synthetic polypeptide
DEEEIRTTNPVATEQYGSVSTLNDQGEMGNQE

SEQ ID NO: 30767 - protein, 30 aa, Artificial Sequence
  Description of Artificial Sequence: Synthetic polypeptide
DEEEIRTTNPVATEQYGSVSPTDLYSEQDR

SEQ ID NO: 30768 - protein, 29 aa, Artificial Sequence
  Description of Artificial Sequence: Synthetic peptide
DEEEIRTTNPVATEQYGSVSNSLDTGSDG

SEQ ID NO: 30769 - protein, 31 aa, Artificial Sequence
  Description of Artificial Sequence: Synthetic polypeptide
DEEEIRTTNPVATEQYGSVTSTNHQNGSDDP

SEQ ID NO: 30770 - protein, 30 aa, Artificial Sequence
  Description of Artificial Sequence: Synthetic polypeptide
DEDEIATTNPVATETYGSVSTNLQMGGDNH

SEQ ID NO: 30771 - protein, 33 aa, Artificial Sequence
  Description of Artificial Sequence: Synthetic polypeptide
DEEEIRTTNPVATEQYGSVSPTDNLTQRNSDRG

SEQ ID NO: 30772 - protein, 31 aa, Artificial Sequence
  Description of Artificial Sequence: Synthetic polypeptide
DEEEIRTTNPVATEQYGSVQTALQRMGQAQD

SEQ ID NO: 30773 - protein, 31 aa, Artificial Sequence
  Description of Artificial Sequence: Synthetic polypeptide
DEEEIRTTNPVATEQYGSVSTPNLDRSTQSN

SEQ ID NO: 30774 - protein, 30 aa, Artificial Sequence
  Description of Artificial Sequence: Synthetic polypeptide
DEEEIRTTNPVATEQYGSVSTLLETIGPDQ

SEQ ID NO: 30775 - protein, 31 aa, Artificial Sequence
  Description of Artificial Sequence: Synthetic polypeptide
DEECIRTTNPVATEQWGSVATNNLQELGDNR

SEQ ID NO: 30776 - protein, 31 aa, Artificial Sequence
  Description of Artificial Sequence: Synthetic polypeptide
DEEEIRTTNPVATEQYGSVSTLLGTHGSNEK

SEQ ID NO: 30777 - protein, 33 aa, Artificial Sequence
  Description of Artificial Sequence: Synthetic polypeptide
DEEEIRTTNPVATEQYGSVTSTMNLNQNGGNGN

SEQ ID NO: 30778 - protein, 33 aa, Artificial Sequence
  Description of Artificial Sequence: Synthetic polypeptide
DEEEIRTTNPVATEQYGSVSPTDNSEQGRDNQR

SEQ ID NO: 30779 - protein, 31 aa, Artificial Sequence
  Description of Artificial Sequence: Synthetic polypeptide
DEEEIRTTNPVATEQYGSVSTLLLENIGDQR

SEQ ID NO: 30780 - protein, 33 aa, Artificial Sequence
  Description of Artificial Sequence: Synthetic polypeptide
DEEEIRTTNPVATEQYGSVSTVNLQNSGGNEFQ

SEQ ID NO: 30781 - protein, 32 aa, Artificial Sequence
  Description of Artificial Sequence: Synthetic polypeptide
DEDEIRTTNPVATEQYGSVSTNLNPGGDGNAR

SEQ ID NO: 30782 - protein, 30 aa, Artificial Sequence
  Description of Artificial Sequence: Synthetic polypeptide
DEEEIRTTNPVATEQYGSVQTDDLQRVDIF

SEQ ID NO: 30783 - protein, 28 aa, Artificial Sequence
  Description of Artificial Sequence: Synthetic peptide
DEDEIATTNPVATTQYGCVATNLERGNT

SEQ ID NO: 30784 - protein, 30 aa, Artificial Sequence
  Description of Artificial Sequence: Synthetic polypeptide
DEECIRTTNPVATEQWGSVATNNLQPGVER

SEQ ID NO: 30785 - protein, 31 aa, Artificial Sequence
  Description of Artificial Sequence: Synthetic polypeptide
DEECIRTTNPVATEQWGSVATNNLQTGGNNR

SEQ ID NO: 30786 - protein, 32 aa, Artificial Sequence
  Description of Artificial Sequence: Synthetic polypeptide
DEEEIRTTNPVATEQYGSVSTLLLGTQGGNEN

SEQ ID NO: 30787 - protein, 31 aa, Artificial Sequence
  Description of Artificial Sequence: Synthetic polypeptide
DEDEIRTTNPVATEQYGSVSTNLNMGGDDGR

SEQ ID NO: 30788 - protein, 31 aa, Artificial Sequence
  Description of Artificial Sequence: Synthetic polypeptide
DEEEIRTTNPVATEQYGSVSSTTTLEGGNEF

SEQ ID NO: 30789 - protein, 30 aa, Artificial Sequence
  Description of Artificial Sequence: Synthetic polypeptide
DEEEIRTTNPVATEQYGSVSMDMIQGGNEQ

SEQ ID NO: 30790 - protein, 32 aa, Artificial Sequence
  Description of Artificial Sequence: Synthetic polypeptide
DEEEIRTTNPVATEQYGSVSTLLQDEGGNDEI

SEQ ID NO: 30791 - protein, 32 aa, Artificial Sequence
  Description of Artificial Sequence: Synthetic polypeptide
DEEEIRTTNPVATEQYGSVSTPNLDVEGGNES

SEQ ID NO: 30792 - protein, 33 aa, Artificial Sequence
  Description of Artificial Sequence: Synthetic polypeptide
DEEEIRTTNPVATEQYGSVSTNLQFRDGVTPEA

SEQ ID NO: 30793 - protein, 33 aa, Artificial Sequence
  Description of Artificial Sequence: Synthetic polypeptide
DEEEIRTTNPVATEQYGSVSTVNLQNIGGNTLE

SEQ ID NO: 30794 - protein, 32 aa, Artificial Sequence
  Description of Artificial Sequence: Synthetic polypeptide
DEEEIRTTNPVATEQYGSVSNPNLQRGVEGLD

SEQ ID NO: 30795 - protein, 33 aa, Artificial Sequence
  Description of Artificial Sequence: Synthetic polypeptide
DEEEIRTTNPVATEQYGSVSTNLQFGQGGNEQG

SEQ ID NO: 30796 - protein, 31 aa, Artificial Sequence
  Description of Artificial Sequence: Synthetic polypeptide
DEECIRTTNPVATEQWGSVATTNNLQLGGNR

SEQ ID NO: 30797 - protein, 32 aa, Artificial Sequence
  Description of Artificial Sequence: Synthetic polypeptide
DEEEIRTTNPVATEQYGSVSTVNLQNIGGDDG

SEQ ID NO: 30798 - protein, 33 aa, Artificial Sequence
  Description of Artificial Sequence: Synthetic polypeptide
DEEEIRTTNPVATEQYGSVSTVNLQNFGFNQNT

SEQ ID NO: 30799 - protein, 33 aa, Artificial Sequence
  Description of Artificial Sequence: Synthetic polypeptide
DEEEIRTTNPVATEQYGSVSNPPNGLQRVGENG

SEQ ID NO: 30800 - protein, 30 aa, Artificial Sequence
  Description of Artificial Sequence: Synthetic polypeptide
DEECIRTTNPVAYEQYSEEVSTNLQEQGNR

SEQ ID NO: 30801 - protein, 33 aa, Artificial Sequence
  Description of Artificial Sequence: Synthetic polypeptide
DEEEIRTTNPVATEQYGSVSTVNLQLEGGNEDD

SEQ ID NO: 30802 - protein, 33 aa, Artificial Sequence
  Description of Artificial Sequence: Synthetic polypeptide
DEEEIRTTNPVATEQYGSVSTPNLDQRIGIMFE

SEQ ID NO: 30803 - protein, 30 aa, Artificial Sequence
  Description of Artificial Sequence: Synthetic polypeptide
DEEEIRTTNPVATEQYGSVSNNSQSMTEER

SEQ ID NO: 30804 - protein, 33 aa, Artificial Sequence
  Description of Artificial Sequence: Synthetic polypeptide
DEEEIRTTNPVATEQYGSVSNNSNLQQRGDNNE

SEQ ID NO: 30805 - protein, 32 aa, Artificial Sequence
  Description of Artificial Sequence: Synthetic polypeptide
DEEEIRTTNPVATEQYGSVTSTGELQGGSNDN

SEQ ID NO: 30806 - protein, 33 aa, Artificial Sequence
  Description of Artificial Sequence: Synthetic polypeptide
DEEEIRTTNPVATEQYGSVTSTANLQGSGGNEF

SEQ ID NO: 30807 - protein, 32 aa, Artificial Sequence
  Description of Artificial Sequence: Synthetic polypeptide
DEEEIRTTNPVATEQYGSVSTGNSQPSGEDNE

SEQ ID NO: 30808 - protein, 31 aa, Artificial Sequence
  Description of Artificial Sequence: Synthetic polypeptide
DEEEIRTTNPVATEQYGSVQTNLIERGEMTV

SEQ ID NO: 30809 - protein, 31 aa, Artificial Sequence
  Description of Artificial Sequence: Synthetic polypeptide
DEEEIRTTNPVATEQYGSVTSTDLQEEGDEQ

SEQ ID NO: 30810 - protein, 29 aa, Artificial Sequence
  Description of Artificial Sequence: Synthetic peptide
DEECIRTTNPVAYEQYGQVSTQNVTRGNN

SEQ ID NO: 30811 - protein, 32 aa, Artificial Sequence
  Description of Artificial Sequence: Synthetic polypeptide
DEDEIRTTNPVATECYGSVSTNLQGNAGNGER

SEQ ID NO: 30812 - protein, 31 aa, Artificial Sequence
  Description of Artificial Sequence: Synthetic polypeptide
DEDEIRTTNPVATECYGSVSTNLQGQGDERN

SEQ ID NO: 30813 - protein, 32 aa, Artificial Sequence
  Description of Artificial Sequence: Synthetic polypeptide
DEEEIRTTNPVATEQYGSVSITLDQRGGEERG

SEQ ID NO: 30814 - protein, 30 aa, Artificial Sequence
  Description of Artificial Sequence: Synthetic polypeptide
DEAEIRTTNPVATEQYGSVSTVLTIGNIHG

SEQ ID NO: 30815 - protein, 33 aa, Artificial Sequence
  Description of Artificial Sequence: Synthetic polypeptide
DEEEIRTTNPVATEQYGSVSTPNELQNFGNNQN

SEQ ID NO: 30816 - protein, 29 aa, Artificial Sequence
  Description of Artificial Sequence: Synthetic peptide
DEEEIRTTNPVATEQYGSVSTGNVVTNLQ

SEQ ID NO: 30817 - protein, 32 aa, Artificial Sequence
  Description of Artificial Sequence: Synthetic polypeptide
DEEEIRTTNPVATEQYGSVSPTLDQRGNQFED

SEQ ID NO: 30818 - protein, 32 aa, Artificial Sequence
  Description of Artificial Sequence: Synthetic polypeptide
DEEEIRTTNPVATEQYGSVQTNGQPRGVGGRI

SEQ ID NO: 30819 - protein, 31 aa, Artificial Sequence
  Description of Artificial Sequence: Synthetic polypeptide
DEEEIRTTNPVATEQYGSVSNNNTITTRGNM

SEQ ID NO: 30820 - protein, 30 aa, Artificial Sequence
  Description of Artificial Sequence: Synthetic polypeptide
DEDEIRTTNPVATECYGSVSTNLQHQGDDN

SEQ ID NO: 30821 - protein, 31 aa, Artificial Sequence
  Description of Artificial Sequence: Synthetic polypeptide
DEEEIRTTNPVATEQYGSVSPTLDQRDLERP

SEQ ID NO: 30822 - protein, 31 aa, Artificial Sequence
  Description of Artificial Sequence: Synthetic polypeptide
DEDEIRTTNPVATECYGSVSTNLQQEGGNSD

SEQ ID NO: 30823 - protein, 32 aa, Artificial Sequence
  Description of Artificial Sequence: Synthetic polypeptide
DEDEIRTTNPVATECYGSVSTNLQQPGQDNDR

SEQ ID NO: 30824 - protein, 32 aa, Artificial Sequence
  Description of Artificial Sequence: Synthetic polypeptide
DEEEIRTTNPVATEQYGSVTSTEMLQFFGSNQ

SEQ ID NO: 30825 - protein, 32 aa, Artificial Sequence
  Description of Artificial Sequence: Synthetic polypeptide
DEAEIRTTNPVATEQYGCVSTNLQSNGDNGER

SEQ ID NO: 30826 - protein, 31 aa, Artificial Sequence
  Description of Artificial Sequence: Synthetic polypeptide
DEAEIRTTNPVATEQYGCVSTNLQQMGDNEH

SEQ ID NO: 30827 - protein, 31 aa, Artificial Sequence
  Description of Artificial Sequence: Synthetic polypeptide
DEAEIRTTNPVATEQYGCVSTNLQPGAGNNG

SEQ ID NO: 30828 - protein, 31 aa, Artificial Sequence
  Description of Artificial Sequence: Synthetic polypeptide
DEEEIRTTNPVATEQYGSVSETNLQLIIVQN

SEQ ID NO: 30829 - protein, 31 aa, Artificial Sequence
  Description of Artificial Sequence: Synthetic polypeptide
DEEEIRTTNPVATEQYGSVSPTLDQRDFLRE

SEQ ID NO: 30830 - protein, 31 aa, Artificial Sequence
  Description of Artificial Sequence: Synthetic polypeptide
DEEAIRTTNPVATEQYGCVSTNTQFFGSNRT

SEQ ID NO: 30831 - protein, 31 aa, Artificial Sequence
  Description of Artificial Sequence: Synthetic polypeptide
DEEEIRTTNPVATEQYGSVSPTLDDQIRGEH

SEQ ID NO: 30832 - protein, 30 aa, Artificial Sequence
  Description of Artificial Sequence: Synthetic polypeptide
DEEEIRTTNPVATEQYGSVSTGTEGRNNEV

SEQ ID NO: 30833 - protein, 31 aa, Artificial Sequence
  Description of Artificial Sequence: Synthetic polypeptide
DEAEIRTTNPVATEQYGCVSTNLQNGAGNSG

SEQ ID NO: 30834 - protein, 31 aa, Artificial Sequence
  Description of Artificial Sequence: Synthetic polypeptide
DEDEIRTTNPVATECYGSVSTNLQPQGDNDA

SEQ ID NO: 30835 - protein, 33 aa, Artificial Sequence
  Description of Artificial Sequence: Synthetic polypeptide
DEEEIRTTNPVATEQYGSVTSSTENLSQGIGNM

SEQ ID NO: 30836 - protein, 30 aa, Artificial Sequence
  Description of Artificial Sequence: Synthetic polypeptide
DEECIRTTNPVAYEQYGQVSTQNHSQRGNN

SEQ ID NO: 30837 - protein, 31 aa, Artificial Sequence
  Description of Artificial Sequence: Synthetic polypeptide
DEDEIRTTNPVATECYGAVSTNLQGGDGNQR

SEQ ID NO: 30838 - protein, 30 aa, Artificial Sequence
  Description of Artificial Sequence: Synthetic polypeptide
DECEICTTNPVATEQYGSVSTTNLSQGNTQ

SEQ ID NO: 30839 - protein, 30 aa, Artificial Sequence
  Description of Artificial Sequence: Synthetic polypeptide
DEECIRTTNPVAYEQYGQVSTPNVQRGNNS

SEQ ID NO: 30840 - protein, 32 aa, Artificial Sequence
  Description of Artificial Sequence: Synthetic polypeptide
DEEEIRTTNPVATEQYGSVSTALPNRNGMNPV

SEQ ID NO: 30841 - protein, 30 aa, Artificial Sequence
  Description of Artificial Sequence: Synthetic polypeptide
DEEEIRTTNPVATEQYGSVTSNLERLENET

SEQ ID NO: 30842 - protein, 32 aa, Artificial Sequence
  Description of Artificial Sequence: Synthetic polypeptide
DEEEIRTTNPVATEQYGSVSTPNDQNDGFNQN

SEQ ID NO: 30843 - protein, 31 aa, Artificial Sequence
  Description of Artificial Sequence: Synthetic polypeptide
DEEEIRTTNPVATEQYGSVTSNNLDEGGNEQ

SEQ ID NO: 30844 - protein, 32 aa, Artificial Sequence
  Description of Artificial Sequence: Synthetic polypeptide
DEEEIRTTNPVATEQYGSVSTALNQEDGNGNI

SEQ ID NO: 30845 - protein, 32 aa, Artificial Sequence
  Description of Artificial Sequence: Synthetic polypeptide
DEEEIRTTNPVATEQYGSVSTALNLDEGGNEA

SEQ ID NO: 30846 - protein, 31 aa, Artificial Sequence
  Description of Artificial Sequence: Synthetic polypeptide
DEECIRTTNPVATEQWDYSVSGANLQRGDNR

SEQ ID NO: 30847 - protein, 30 aa, Artificial Sequence
  Description of Artificial Sequence: Synthetic polypeptide
DEEEIRTTNPVATEQYGSVSNNLYGGSQDQ

SEQ ID NO: 30848 - protein, 32 aa, Artificial Sequence
  Description of Artificial Sequence: Synthetic polypeptide
DEEEIRTTNPVATEQYGSVSNNMLFQENGQNE

SEQ ID NO: 30849 - protein, 31 aa, Artificial Sequence
  Description of Artificial Sequence: Synthetic polypeptide
DEEEIRTTNPVATEQYGSVSNNNLEEPTNER

SEQ ID NO: 30850 - protein, 31 aa, Artificial Sequence
  Description of Artificial Sequence: Synthetic polypeptide
DEEEIRTTNPVATEQYGSVSPTLLQRDLLMP

SEQ ID NO: 30851 - protein, 31 aa, Artificial Sequence
  Description of Artificial Sequence: Synthetic polypeptide
DEEEIRTTNPVATEQYGSVSCTNGGQGYGKF

SEQ ID NO: 30852 - protein, 30 aa, Artificial Sequence
  Description of Artificial Sequence: Synthetic polypeptide
DEECIRTTNPVATEQWDYSVSINMQRGDNR

SEQ ID NO: 30853 - protein, 32 aa, Artificial Sequence
  Description of Artificial Sequence: Synthetic polypeptide
DEEEIRTTNPVATEQYGSVSNNNLQGGGNQGG

SEQ ID NO: 30854 - protein, 34 aa, Artificial Sequence
  Description of Artificial Sequence: Synthetic polypeptide
DEEEIRTTNPVATEQYGSVSTGNMLSQHGGNNRW

SEQ ID NO: 30855 - protein, 33 aa, Artificial Sequence
  Description of Artificial Sequence: Synthetic polypeptide
DEEEIRTTNPVATEQYGSVTSNTENLNQEIGNM

SEQ ID NO: 30856 - protein, 31 aa, Artificial Sequence
  Description of Artificial Sequence: Synthetic polypeptide
DEEEIRTTNPVATEQYGSVSPTLLLRTGEQG

SEQ ID NO: 30857 - protein, 31 aa, Artificial Sequence
  Description of Artificial Sequence: Synthetic polypeptide
DEEEIRTTNPVATEQYGSVTSNTIDQRGEEN

SEQ ID NO: 30858 - protein, 31 aa, Artificial Sequence
  Description of Artificial Sequence: Synthetic polypeptide
DEAEIRTTNPVATEQYGSVSTTQDHQNGNER

SEQ ID NO: 30859 - protein, 32 aa, Artificial Sequence
  Description of Artificial Sequence: Synthetic polypeptide
DEEEIRTTNPVATEQYGSVSCTNGGQREGESF

SEQ ID NO: 30860 - protein, 32 aa, Artificial Sequence
  Description of Artificial Sequence: Synthetic polypeptide
DEEEIRTTNPVATEQYGSVSTGNMQGNGNENE

SEQ ID NO: 30861 - protein, 32 aa, Artificial Sequence
  Description of Artificial Sequence: Synthetic polypeptide
DEEEIRTTNPVATEQYGSVSTGNMQNNGGNGE

SEQ ID NO: 30862 - protein, 31 aa, Artificial Sequence
  Description of Artificial Sequence: Synthetic polypeptide
DEEEIRTTNPVATEQYGSVTSPNSLDRGEEN

SEQ ID NO: 30863 - protein, 31 aa, Artificial Sequence
  Description of Artificial Sequence: Synthetic polypeptide
DEEEIRTTNPVATEQYGSVTSPTLDQVGNDL

SEQ ID NO: 30864 - protein, 32 aa, Artificial Sequence
  Description of Artificial Sequence: Synthetic polypeptide
DEEEIRTTNPVATEQYGSVSTPNDTHRGENHT

SEQ ID NO: 30865 - protein, 32 aa, Artificial Sequence
  Description of Artificial Sequence: Synthetic polypeptide
DEEEIRTTNPVATEQYGSVSCTNGGQREGMDF

SEQ ID NO: 30866 - protein, 32 aa, Artificial Sequence
  Description of Artificial Sequence: Synthetic polypeptide
DEEEIRTTNPVATEQYGSVSTGNNLGIGGNTQ

SEQ ID NO: 30867 - protein, 30 aa, Artificial Sequence
  Description of Artificial Sequence: Synthetic polypeptide
DEEAIRTTNPVATEQYGCVSTNSSQFGGNE

SEQ ID NO: 30868 - protein, 32 aa, Artificial Sequence
  Description of Artificial Sequence: Synthetic polypeptide
DEAEIRTTNPVATEQYGCVSTNLQNDEGNNGR

SEQ ID NO: 30869 - protein, 31 aa, Artificial Sequence
  Description of Artificial Sequence: Synthetic polypeptide
DEAEIRTTNPVATEQYGCVSTNLQMGDGGNG

SEQ ID NO: 30870 - protein, 31 aa, Artificial Sequence
  Description of Artificial Sequence: Synthetic polypeptide
DEEEIRTTNPVATEQYGSVSITILQDTIEER

SEQ ID NO: 30871 - protein, 30 aa, Artificial Sequence
  Description of Artificial Sequence: Synthetic polypeptide
DEAEIRTTNPVCTEGYGSVSVPNLQRGEND

SEQ ID NO: 30872 - protein, 30 aa, Artificial Sequence
  Description of Artificial Sequence: Synthetic polypeptide
DEEAIRTTNPVATEQYGCVSTNLNDNGQNQ

SEQ ID NO: 30873 - protein, 32 aa, Artificial Sequence
  Description of Artificial Sequence: Synthetic polypeptide
DEEEIRTTNPVATEQYGSVSITGNLEEEGNPL

SEQ ID NO: 30874 - protein, 31 aa, Artificial Sequence
  Description of Artificial Sequence: Synthetic polypeptide
DEEEIRTTNPVATEQYGSVQTNDDRVGQERI

SEQ ID NO: 30875 - protein, 32 aa, Artificial Sequence
  Description of Artificial Sequence: Synthetic polypeptide
DEEEIRTTNPVATEQYGSVSNNPLLQQRDELR

SEQ ID NO: 30876 - protein, 31 aa, Artificial Sequence
  Description of Artificial Sequence: Synthetic polypeptide
DEECIRTTNPVATEQWGESVSPDNHQRGDNR

SEQ ID NO: 30877 - protein, 33 aa, Artificial Sequence
  Description of Artificial Sequence: Synthetic polypeptide
DEEEIRTTNPVATEQYGSVSTVNLQSIGFNENA

SEQ ID NO: 30878 - protein, 30 aa, Artificial Sequence
  Description of Artificial Sequence: Synthetic polypeptide
DEEEIRTTNPVATEQYGSVSTIALNGTNDA

SEQ ID NO: 30879 - protein, 30 aa, Artificial Sequence
  Description of Artificial Sequence: Synthetic polypeptide
DEAEIRTTNPVCTEGYGSVSNPNLQRGNDM

SEQ ID NO: 30880 - protein, 31 aa, Artificial Sequence
  Description of Artificial Sequence: Synthetic polypeptide
DEEEIRTTNPVATEQYGSVSTIGLEIRMERE

SEQ ID NO: 30881 - protein, 31 aa, Artificial Sequence
  Description of Artificial Sequence: Synthetic polypeptide
DEEEIRTTNPVATEQYGSVSTPNHQAFGSDQ

SEQ ID NO: 30882 - protein, 31 aa, Artificial Sequence
  Description of Artificial Sequence: Synthetic polypeptide
DEEEIRTTNPVATEQYGSVSSVLQDSGNEIM

SEQ ID NO: 30883 - protein, 31 aa, Artificial Sequence
  Description of Artificial Sequence: Synthetic polypeptide
DEEEIRTTNPVATEQYGSVSTPNIGNNGNGG

SEQ ID NO: 30884 - protein, 32 aa, Artificial Sequence
  Description of Artificial Sequence: Synthetic polypeptide
DEEEIRTTNPVATEQYGSVSTILQNRNGIDGM

SEQ ID NO: 30885 - protein, 33 aa, Artificial Sequence
  Description of Artificial Sequence: Synthetic polypeptide
DEEEIRTTNPVATEQYGSVSPTGLSQREGNFQD

SEQ ID NO: 30886 - protein, 32 aa, Artificial Sequence
  Description of Artificial Sequence: Synthetic polypeptide
DEEEIRTTNPVATEQYGSVSTPNLAQTGEIEA

SEQ ID NO: 30887 - protein, 29 aa, Artificial Sequence
  Description of Artificial Sequence: Synthetic peptide
DEAEIRTTNPVAYQQYGCVSTNLERGNTE

SEQ ID NO: 30888 - protein, 32 aa, Artificial Sequence
  Description of Artificial Sequence: Synthetic polypeptide
DEEEIRTTNPVATEQYGSVSTPNLDDFGNIEA

SEQ ID NO: 30889 - protein, 28 aa, Artificial Sequence
  Description of Artificial Sequence: Synthetic peptide
DEECIRTTNPVAYEQYGSVSTHETRVNT

SEQ ID NO: 30890 - protein, 32 aa, Artificial Sequence
  Description of Artificial Sequence: Synthetic polypeptide
DEEEIRTTNPVATEQYGSVSITGNLDGGGNGQ

SEQ ID NO: 30891 - protein, 31 aa, Artificial Sequence
  Description of Artificial Sequence: Synthetic polypeptide
DEAEIRTTNPVATEQYGCVSTMDDLMERGNR

SEQ ID NO: 30892 - protein, 32 aa, Artificial Sequence
  Description of Artificial Sequence: Synthetic polypeptide
DEEEIRTTNPVATEQYGSVSTINDQENGTNVT

SEQ ID NO: 30893 - protein, 30 aa, Artificial Sequence
  Description of Artificial Sequence: Synthetic polypeptide
DEDEIRTTNPVATEGWGSVSTNLQGGDNQN

SEQ ID NO: 30894 - protein, 32 aa, Artificial Sequence
  Description of Artificial Sequence: Synthetic polypeptide
DEEEIRTTNPVATEQYGSVSTINDQQGNGNGT

SEQ ID NO: 30895 - protein, 32 aa, Artificial Sequence
  Description of Artificial Sequence: Synthetic polypeptide
DEEEIRTTNPVATEQYGSVSTPNLDEFGGNEQ

SEQ ID NO: 30896 - protein, 32 aa, Artificial Sequence
  Description of Artificial Sequence: Synthetic polypeptide
DEEEIRTTNPVATEQYGSVSTINGLIETGNLE

SEQ ID NO: 30897 - protein, 31 aa, Artificial Sequence
  Description of Artificial Sequence: Synthetic polypeptide
DEEEIRTTNPVATEQYGSVTSTEPGQHFNRN

SEQ ID NO: 30898 - protein, 31 aa, Artificial Sequence
  Description of Artificial Sequence: Synthetic polypeptide
DEEEIRTTNPVATEQYGSVSSVLARYGEEVR

SEQ ID NO: 30899 - protein, 32 aa, Artificial Sequence
  Description of Artificial Sequence: Synthetic polypeptide
DEEEIRTTNPVATEQYGSVSTPNLDGFGNNGQ

SEQ ID NO: 30900 - protein, 33 aa, Artificial Sequence
  Description of Artificial Sequence: Synthetic polypeptide
DEEEIRTTNPVATEQYGSVSPTHNQQQRGPNDF

SEQ ID NO: 30901 - protein, 34 aa, Artificial Sequence
  Description of Artificial Sequence: Synthetic polypeptide
DEEEIRTTNPVATEQYGSVTSMTENLSQGIGNNR

SEQ ID NO: 30902 - protein, 32 aa, Artificial Sequence
  Description of Artificial Sequence: Synthetic polypeptide
DEEEIRTTNPVATEQYGSVSITGNLQEQGAEL

SEQ ID NO: 30903 - protein, 32 aa, Artificial Sequence
  Description of Artificial Sequence: Synthetic polypeptide
DEEEIRTTNPVATEQYGSVSPTILQTGENEMI

SEQ ID NO: 30904 - protein, 31 aa, Artificial Sequence
  Description of Artificial Sequence: Synthetic polypeptide
DEEEIRTTNPVATEQYGSVSTADQFFNSNRA

SEQ ID NO: 30905 - protein, 31 aa, Artificial Sequence
  Description of Artificial Sequence: Synthetic polypeptide
DEAEIRTTNPVATEQYGCVSTNLQMDGNNES

SEQ ID NO: 30906 - protein, 31 aa, Artificial Sequence
  Description of Artificial Sequence: Synthetic polypeptide
DEAEIRTTNPVATEQYGCVSTNLQLGDGNGH

SEQ ID NO: 30907 - protein, 31 aa, Artificial Sequence
  Description of Artificial Sequence: Synthetic polypeptide
DEAEIRTTNPVATEQYGCVSTNLQIGGGNEI

SEQ ID NO: 30908 - protein, 31 aa, Artificial Sequence
  Description of Artificial Sequence: Synthetic polypeptide
DEAEIRTTNPVATEQYGCVSTNLQHNGTNDQ

SEQ ID NO: 30909 - protein, 31 aa, Artificial Sequence
  Description of Artificial Sequence: Synthetic polypeptide
DEAEIRTTNPVATEQYGCVSTNLQHGQGNGM

SEQ ID NO: 30910 - protein, 31 aa, Artificial Sequence
  Description of Artificial Sequence: Synthetic polypeptide
DEEEIRTTNPVATEQYGSVSITIDQESGNGP

SEQ ID NO: 30911 - protein, 31 aa, Artificial Sequence
  Description of Artificial Sequence: Synthetic polypeptide
DEAEIRTTNPVATEQYGCVSTNLQGNGENGA

SEQ ID NO: 30912 - protein, 31 aa, Artificial Sequence
  Description of Artificial Sequence: Synthetic polypeptide
DEAEIRTTNPVATEQYGSVSTVNGGQDMGNM

SEQ ID NO: 30913 - protein, 31 aa, Artificial Sequence
  Description of Artificial Sequence: Synthetic polypeptide
DEDEIRTTNPVATECYGTVSTNLQGNDSGNR

SEQ ID NO: 30914 - protein, 31 aa, Artificial Sequence
  Description of Artificial Sequence: Synthetic polypeptide
DEAEIRTTNPVATEQYGCVSTNLQGGGQNGS

SEQ ID NO: 30915 - protein, 31 aa, Artificial Sequence
  Description of Artificial Sequence: Synthetic polypeptide
DEAEIRTTNPVATEQYGCVSTNLQGEAGNGS

SEQ ID NO: 30916 - protein, 32 aa, Artificial Sequence
  Description of Artificial Sequence: Synthetic polypeptide
DEEEIRTTNPVATEQYGSVSTPNGLERENVEL

SEQ ID NO: 30917 - protein, 31 aa, Artificial Sequence
  Description of Artificial Sequence: Synthetic polypeptide
DEAEIRTTNPVATEQYGCVSTNLQGDGNNGP

SEQ ID NO: 30918 - protein, 31 aa, Artificial Sequence
  Description of Artificial Sequence: Synthetic polypeptide
DEAEIRTTNPVATEQYGCVSTNLQGDGNNGD

SEQ ID NO: 30919 - protein, 31 aa, Artificial Sequence
  Description of Artificial Sequence: Synthetic polypeptide
DEAEIRTTNPVATEQYGSVSTVNGHGQDGNH

SEQ ID NO: 30920 - protein, 31 aa, Artificial Sequence
  Description of Artificial Sequence: Synthetic polypeptide
DEAEIRTTNPVATEQYGCVSTNLQGDGDNGG

SEQ ID NO: 30921 - protein, 31 aa, Artificial Sequence
  Description of Artificial Sequence: Synthetic polypeptide
DEAEIRTTNPVATEQYGSVSTVNGQGEGNEE

SEQ ID NO: 30922 - protein, 32 aa, Artificial Sequence
  Description of Artificial Sequence: Synthetic polypeptide
DEDEIRTTNPVATEEYGSVSTNLQRDGNNGDQ

SEQ ID NO: 30923 - protein, 30 aa, Artificial Sequence
  Description of Artificial Sequence: Synthetic polypeptide
DEAEIRTTNPVATEQYGCVSTNLQGAGEPD

SEQ ID NO: 30924 - protein, 33 aa, Artificial Sequence
  Description of Artificial Sequence: Synthetic polypeptide
DEEEIRTTNPVATEQYGSVSITGNLQRGVLGEG

SEQ ID NO: 30925 - protein, 28 aa, Artificial Sequence
  Description of Artificial Sequence: Synthetic peptide
DEAEIRTTNPVCYEQYGSCSTNLERPNS

SEQ ID NO: 30926 - protein, 31 aa, Artificial Sequence
  Description of Artificial Sequence: Synthetic polypeptide
DEAEIRTTNPVATEQYGCVSTNLQGAGDNNP

SEQ ID NO: 30927 - protein, 29 aa, Artificial Sequence
  Description of Artificial Sequence: Synthetic peptide
DEAEIRTTNPVCTEHYGSVSMPDLQRGND

SEQ ID NO: 30928 - protein, 33 aa, Artificial Sequence
  Description of Artificial Sequence: Synthetic polypeptide
DEEEIRTTNPVATEQYGSVSTNLQGRGGDIPMQ

SEQ ID NO: 30929 - protein, 31 aa, Artificial Sequence
  Description of Artificial Sequence: Synthetic polypeptide
DEAEIRTTNPVATEQYGCVSTNLQANGDNDM

SEQ ID NO: 30930 - protein, 31 aa, Artificial Sequence
  Description of Artificial Sequence: Synthetic polypeptide
DEEEIRTTNPVATEQYGSVSSYLQDSFGDRG

SEQ ID NO: 30931 - protein, 32 aa, Artificial Sequence
  Description of Artificial Sequence: Synthetic polypeptide
DEEEIRTTNPVATEQYGSVSCTNGGQREGQFD

SEQ ID NO: 30932 - protein, 31 aa, Artificial Sequence
  Description of Artificial Sequence: Synthetic polypeptide
DEAEIRTTNPVATEQYGCVSTNLNQGDGNDG

SEQ ID NO: 30933 - protein, 33 aa, Artificial Sequence
  Description of Artificial Sequence: Synthetic polypeptide
DEEEIRTTNPVATEQYGSVSTVNLQSIGINMEE

SEQ ID NO: 30934 - protein, 33 aa, Artificial Sequence
  Description of Artificial Sequence: Synthetic polypeptide
DEEEIRTTNPVATEQYGSVSTSNLQSVEGGNEE

SEQ ID NO: 30935 - protein, 31 aa, Artificial Sequence
  Description of Artificial Sequence: Synthetic polypeptide
DEEEIRTTNPVATEQYGSVYMNNLDQNGDRM

SEQ ID NO: 30936 - protein, 32 aa, Artificial Sequence
  Description of Artificial Sequence: Synthetic polypeptide
FEEEIRTTNPVATEQYGSVSTTNLQGGGNGQG

SEQ ID NO: 30937 - protein, 32 aa, Artificial Sequence
  Description of Artificial Sequence: Synthetic polypeptide
AEEEIRTTNPVATEQYGSVSVTNLGQEEEGNT

SEQ ID NO: 30938 - protein, 31 aa, Artificial Sequence
  Description of Artificial Sequence: Synthetic polypeptide
AEEEIRTTNPVATEQYGSVSVTNLGAGTNQD

SEQ ID NO: 30939 - protein, 32 aa, Artificial Sequence
  Description of Artificial Sequence: Synthetic polypeptide
AEEEIRTTNPVATEQYGSVSVTNLEQVGNNIG

SEQ ID NO: 30940 - protein, 32 aa, Artificial Sequence
  Description of Artificial Sequence: Synthetic polypeptide
AEEEIRTTNPVATEQYGSVSVTNLEQGVGTNI

SEQ ID NO: 30941 - protein, 32 aa, Artificial Sequence
  Description of Artificial Sequence: Synthetic polypeptide
AEEEIRTTNPVATEQYGSVSVTNLEQGIGNAI

SEQ ID NO: 30942 - protein, 32 aa, Artificial Sequence
  Description of Artificial Sequence: Synthetic polypeptide
AEEEIRTTNPVATEQYGSVSVTNLEQGEGNGE

SEQ ID NO: 30943 - protein, 31 aa, Artificial Sequence
  Description of Artificial Sequence: Synthetic polypeptide
AEEEIRTTNPVATEQYGSVSVTNLDTNGNEG

SEQ ID NO: 30944 - protein, 32 aa, Artificial Sequence
  Description of Artificial Sequence: Synthetic polypeptide
AEEEIRTTNPVATEQYGSVSVTNLDQGNGNNE

SEQ ID NO: 30945 - protein, 32 aa, Artificial Sequence
  Description of Artificial Sequence: Synthetic polypeptide
AEEEIRTTNPVATEQYGSVSVTNLGQNIGEND

SEQ ID NO: 30946 - protein, 31 aa, Artificial Sequence
  Description of Artificial Sequence: Synthetic polypeptide
AEEEIRTTNPVATEQYGSVSVTNLDEFGNNS

SEQ ID NO: 30947 - protein, 31 aa, Artificial Sequence
  Description of Artificial Sequence: Synthetic polypeptide
AEEEIRTTNPVATEQYGSVSVTNEQQQGNED

SEQ ID NO: 30948 - protein, 31 aa, Artificial Sequence
  Description of Artificial Sequence: Synthetic polypeptide
DEEEIRTTNPVATEQYGCVYSTNHQNGSNII

SEQ ID NO: 30949 - protein, 30 aa, Artificial Sequence
  Description of Artificial Sequence: Synthetic polypeptide
AEEEIRTTNPVATEQYGSVSVTNDVQEENN

SEQ ID NO: 30950 - protein, 33 aa, Artificial Sequence
  Description of Artificial Sequence: Synthetic polypeptide
DEEEIRTTNPCATEQYGSVDSITNLDQVGNERF

SEQ ID NO: 30951 - protein, 30 aa, Artificial Sequence
  Description of Artificial Sequence: Synthetic polypeptide
AEEEIRTTNPVATEQYGSVSVTNDQQQENA

SEQ ID NO: 30952 - protein, 31 aa, Artificial Sequence
  Description of Artificial Sequence: Synthetic polypeptide
AEEEIRTTNPVATEQYGSVSVTNDQQIIGNQ

SEQ ID NO: 30953 - protein, 31 aa, Artificial Sequence
  Description of Artificial Sequence: Synthetic polypeptide
AEEEIRTTNPVATEQYGSVSVTNDQLGNGNT

SEQ ID NO: 30954 - protein, 31 aa, Artificial Sequence
  Description of Artificial Sequence: Synthetic polypeptide
AEEEIRTTNPVATEQYGSVSVTNDQIGGNQV

SEQ ID NO: 30955 - protein, 29 aa, Artificial Sequence
  Description of Artificial Sequence: Synthetic peptide
QEEGIRTTNPVATEQYGSVSTNLSNLNGV

SEQ ID NO: 30956 - protein, 30 aa, Artificial Sequence
  Description of Artificial Sequence: Synthetic polypeptide
AEEEIRTTNPVATEQYGSVSVTNDQIETNQ

SEQ ID NO: 30957 - protein, 32 aa, Artificial Sequence
  Description of Artificial Sequence: Synthetic polypeptide
AEEEIRTTNPVATEQYGSVSVTNLGQQNQGNP

SEQ ID NO: 30958 - protein, 32 aa, Artificial Sequence
  Description of Artificial Sequence: Synthetic polypeptide
AEEEIRTTNPVATEQYGSVSVTNLLGQNGNDT

SEQ ID NO: 30959 - protein, 32 aa, Artificial Sequence
  Description of Artificial Sequence: Synthetic polypeptide
AEEEIRTTNPVATEQYGSVSVTNLQGILGINE

SEQ ID NO: 30960 - protein, 31 aa, Artificial Sequence
  Description of Artificial Sequence: Synthetic polypeptide
DEEEIRTTNPCATEQYGSVCQTNLQRGSQTA

SEQ ID NO: 30961 - protein, 32 aa, Artificial Sequence
  Description of Artificial Sequence: Synthetic polypeptide
AEEEIRTTNPVATEQYGSVSVTNLQAGGNANQ

SEQ ID NO: 30962 - protein, 32 aa, Artificial Sequence
  Description of Artificial Sequence: Synthetic polypeptide
AEEEIRTTNPVATEQYGSVSVTNLNQQSGING

SEQ ID NO: 30963 - protein, 29 aa, Artificial Sequence
  Description of Artificial Sequence: Synthetic peptide
DEEEIRTTNPCATEQYGSVCSNGGRGNSK

SEQ ID NO: 30964 - protein, 29 aa, Artificial Sequence
  Description of Artificial Sequence: Synthetic peptide
DEEEIRTTNPCATEQYGSVCSVNIFRGED

SEQ ID NO: 30965 - protein, 32 aa, Artificial Sequence
  Description of Artificial Sequence: Synthetic polypeptide
AEEEIRTTNPVATEQYGSVSVTNLNQGQGGND

SEQ ID NO: 30966 - protein, 32 aa, Artificial Sequence
  Description of Artificial Sequence: Synthetic polypeptide
AEEEIRTTNPVATEQYGSVSVTNLNQGNGNEN

SEQ ID NO: 30967 - protein, 30 aa, Artificial Sequence
  Description of Artificial Sequence: Synthetic polypeptide
AEEEIRTTNPVATEQYGSVSVTNLIGNENG

SEQ ID NO: 30968 - protein, 32 aa, Artificial Sequence
  Description of Artificial Sequence: Synthetic polypeptide
AEEEIRTTNPVATEQYGSVSVTNLNQGGNNNE

SEQ ID NO: 30969 - protein, 31 aa, Artificial Sequence
  Description of Artificial Sequence: Synthetic polypeptide
AEEEIRTTNPVATEQYGSVSVTNLNLVGNGN

SEQ ID NO: 30970 - protein, 31 aa, Artificial Sequence
  Description of Artificial Sequence: Synthetic polypeptide
AEEEIRTTNPVATEQYGSVSVTNLNLEVGNS

SEQ ID NO: 30971 - protein, 31 aa, Artificial Sequence
  Description of Artificial Sequence: Synthetic polypeptide
AEEEIRTTNPVATEQYGSVSVTNLMNGGNDT

SEQ ID NO: 30972 - protein, 30 aa, Artificial Sequence
  Description of Artificial Sequence: Synthetic polypeptide
DEEEIRTTNPCATEQYGSVCSYNIARFGND

SEQ ID NO: 30973 - protein, 32 aa, Artificial Sequence
  Description of Artificial Sequence: Synthetic polypeptide
AEEEIRTTNPVATEQYGSVSVTNLLQQGTNSN

SEQ ID NO: 30974 - protein, 30 aa, Artificial Sequence
  Description of Artificial Sequence: Synthetic polypeptide
DEEEIRTTNPCATEQYGSVCSYNIIRGNDA

SEQ ID NO: 30975 - protein, 32 aa, Artificial Sequence
  Description of Artificial Sequence: Synthetic polypeptide
AEEEIRTTNPVATEQYGSVSVTNLLQIGENVN

SEQ ID NO: 30976 - protein, 31 aa, Artificial Sequence
  Description of Artificial Sequence: Synthetic polypeptide
AEEEIRTTNPVATEQYGSVSVTNLLIGGNLN

SEQ ID NO: 30977 - protein, 31 aa, Artificial Sequence
  Description of Artificial Sequence: Synthetic polypeptide
AEEEIRTTNPVATEQYGSVSVTNLNLVGNIN

SEQ ID NO: 30978 - protein, 32 aa, Artificial Sequence
  Description of Artificial Sequence: Synthetic polypeptide
AEEEIRTTNPVATEQYGSVSVTNLQGNLGNNA

SEQ ID NO: 30979 - protein, 29 aa, Artificial Sequence
  Description of Artificial Sequence: Synthetic peptide
DEEEIRTTNPCATEQYGSVEVTALARGGE

SEQ ID NO: 30980 - protein, 28 aa, Artificial Sequence
  Description of Artificial Sequence: Synthetic peptide
QEENICTTNPVATEQYGSVSNNSQRENS

SEQ ID NO: 30981 - protein, 30 aa, Artificial Sequence
  Description of Artificial Sequence: Synthetic polypeptide
AEEEIRTTNPVATEQYGSVSVTDQGQGGND

SEQ ID NO: 30982 - protein, 30 aa, Artificial Sequence
  Description of Artificial Sequence: Synthetic polypeptide
AEEEIRTTNPVATEQYGSVSVTDGQGGNEE

SEQ ID NO: 30983 - protein, 28 aa, Artificial Sequence
  Description of Artificial Sequence: Synthetic peptide
QEGEIACTNPIATEQYGSVSCNLMRGNR

SEQ ID NO: 30984 - protein, 32 aa, Artificial Sequence
  Description of Artificial Sequence: Synthetic polypeptide
DEEEIRTTNPCATEQYGSVIEPTNLQRGVNQF

SEQ ID NO: 30985 - protein, 32 aa, Artificial Sequence
  Description of Artificial Sequence: Synthetic polypeptide
DEEEIRTTNPVATEQYGCVTSTENLQFFGSNA

SEQ ID NO: 30986 - protein, 32 aa, Artificial Sequence
  Description of Artificial Sequence: Synthetic polypeptide
DEEEIRTTNPVATEQYGCVTSTELQNFGSNRG

SEQ ID NO: 30987 - protein, 33 aa, Artificial Sequence
  Description of Artificial Sequence: Synthetic polypeptide
DEEEIRTTNPVATEQYGCVSYTNLDQRGDEVRI

SEQ ID NO: 30988 - protein, 28 aa, Artificial Sequence
  Description of Artificial Sequence: Synthetic peptide
QEGEIAPTNPCATEQYGIVSENLQRGNR

SEQ ID NO: 30989 - protein, 32 aa, Artificial Sequence
  Description of Artificial Sequence: Synthetic polypeptide
DEEEIRTTNPVATEQYGCVTSTNNLQGFGSND

SEQ ID NO: 30990 - protein, 32 aa, Artificial Sequence
  Description of Artificial Sequence: Synthetic polypeptide
DEEEIRTTNPVATEQYGCVSWTELENERGMNR

SEQ ID NO: 30991 - protein, 31 aa, Artificial Sequence
  Description of Artificial Sequence: Synthetic polypeptide
DEEEIRTTNPCATEQYGSVIETNLQRGVEPA

SEQ ID NO: 30992 - protein, 32 aa, Artificial Sequence
  Description of Artificial Sequence: Synthetic polypeptide
AEEEIRTTNPVATEQYGSVSVSTNLQQGENNE

SEQ ID NO: 30993 - protein, 32 aa, Artificial Sequence
  Description of Artificial Sequence: Synthetic polypeptide
AEEEIRTTNPVATEQYGSVSVSTNLQMGNNGQ

SEQ ID NO: 30994 - protein, 31 aa, Artificial Sequence
  Description of Artificial Sequence: Synthetic polypeptide
DEEEIRTTNPCATEQYGSVIETNLQRNVNPC

SEQ ID NO: 30995 - protein, 30 aa, Artificial Sequence
  Description of Artificial Sequence: Synthetic polypeptide
AEEEIRTTNPVATEQYGSVSVSTNDEVGND

SEQ ID NO: 30996 - protein, 32 aa, Artificial Sequence
  Description of Artificial Sequence: Synthetic polypeptide
DEEEIRTTNPCATEQYGSVIVTGNLQRGENID

SEQ ID NO: 30997 - protein, 31 aa, Artificial Sequence
  Description of Artificial Sequence: Synthetic polypeptide
DEEEIRTTNPCATEQYGSVIYTNEQRVGNHD

SEQ ID NO: 30998 - protein, 31 aa, Artificial Sequence
  Description of Artificial Sequence: Synthetic polypeptide
AEEEIRTTNPVATEQYGSVSVQTNEQQGNGI

SEQ ID NO: 30999 - protein, 30 aa, Artificial Sequence
  Description of Artificial Sequence: Synthetic polypeptide
DEEEIRTTNPVATEQYGCVSWQNNQRSINT

SEQ ID NO: 31000 - protein, 28 aa, Artificial Sequence
  Description of Artificial Sequence: Synthetic peptide
DEEEIRTTNPCATEQYGSVGTNDQVEDC

SEQ ID NO: 31001 - protein, 31 aa, Artificial Sequence
  Description of Artificial Sequence: Synthetic polypeptide
AEEEIRTTNPVATEQYGSVSVTENGQGGNNG

SEQ ID NO: 31002 - protein, 32 aa, Artificial Sequence
  Description of Artificial Sequence: Synthetic polypeptide
DEEEIRTTNPVATEQYGCVVSCTNSSQRVSNR

SEQ ID NO: 31003 - protein, 31 aa, Artificial Sequence
  Description of Artificial Sequence: Synthetic polypeptide
AEEEIRTTNPVATEQYGSVSVTNDQAGNGTE

SEQ ID NO: 31004 - protein, 31 aa, Artificial Sequence
  Description of Artificial Sequence: Synthetic polypeptide
DEEEIRTTNPVATEQYGCVYKTNDIQQNGNR

SEQ ID NO: 31005 - protein, 31 aa, Artificial Sequence
  Description of Artificial Sequence: Synthetic polypeptide
DEEEIRTTNPCATEQYGSVIATNLDQSGNHA

SEQ ID NO: 31006 - protein, 32 aa, Artificial Sequence
  Description of Artificial Sequence: Synthetic polypeptide
DEEEIRTTNPCATEQYGSVIATNLQRGGGNGQ

SEQ ID NO: 31007 - protein, 31 aa, Artificial Sequence
  Description of Artificial Sequence: Synthetic polypeptide
AEEEIRTTNPVATEQYGSVSVTNAGGQVGNA

SEQ ID NO: 31008 - protein, 31 aa, Artificial Sequence
  Description of Artificial Sequence: Synthetic polypeptide
AEEEIRTTNPVATEQYGSVSVTNAEQIGENN

SEQ ID NO: 31009 - protein, 28 aa, Artificial Sequence
  Description of Artificial Sequence: Synthetic peptide
QEENICTTNPVATEQYGSVSVNSQTGNS

SEQ ID NO: 31010 - protein, 31 aa, Artificial Sequence
  Description of Artificial Sequence: Synthetic polypeptide
AEEEIRTTNPVATEQYGSVSVTLNQQNGNPT

SEQ ID NO: 31011 - protein, 34 aa, Artificial Sequence
  Description of Artificial Sequence: Synthetic polypeptide
DEEEIRTTNPVATEQYGCVVPSCTMNLSQRGSNR

SEQ ID NO: 31012 - protein, 31 aa, Artificial Sequence
  Description of Artificial Sequence: Synthetic polypeptide
AEEEIRTTNPVATEQYGSVSVTLLQGQIGNE

SEQ ID NO: 31013 - protein, 30 aa, Artificial Sequence
  Description of Artificial Sequence: Synthetic polypeptide
AEEEIRTTNPVATEQYGSVSVTGGTQGGNV

SEQ ID NO: 31014 - protein, 30 aa, Artificial Sequence
  Description of Artificial Sequence: Synthetic polypeptide
AEEEIRTTNPVATEQYGSVSVTENQMGNNS

SEQ ID NO: 31015 - protein, 31 aa, Artificial Sequence
  Description of Artificial Sequence: Synthetic polypeptide
DEEEIRTTNPCATEQYGSVIECTNLARGNEA

SEQ ID NO: 31016 - protein, 32 aa, Artificial Sequence
  Description of Artificial Sequence: Synthetic polypeptide
DEEEIRTTNPVATEQYGCVVSTNLQNFGSENQ

SEQ ID NO: 31017 - protein, 32 aa, Artificial Sequence
  Description of Artificial Sequence: Synthetic polypeptide
AEEEIRTTNPVATEQYGSVSVTENNLQAGTNE

SEQ ID NO: 31018 - protein, 28 aa, Artificial Sequence
  Description of Artificial Sequence: Synthetic peptide
QEEVICTTNPVAYEQYGSVSSNSQRGNA

SEQ ID NO: 31019 - protein, 31 aa, Artificial Sequence
  Description of Artificial Sequence: Synthetic polypeptide
DEEEIRTTNPVATEQYGCVVSTNDQNFGSER

SEQ ID NO: 31020 - protein, 29 aa, Artificial Sequence
  Description of Artificial Sequence: Synthetic peptide
QEGAIRTTNPVATEQYGSFSNTNLEIGNR

SEQ ID NO: 31021 - protein, 31 aa, Artificial Sequence
  Description of Artificial Sequence: Synthetic polypeptide
AEEEIRTTNPVATEQYGSVSVTGNEQQGNQE

SEQ ID NO: 31022 - protein, 32 aa, Artificial Sequence
  Description of Artificial Sequence: Synthetic polypeptide
AEEEIRTTNPVATEQYGSVSVTNLQGSNGINI

SEQ ID NO: 31023 - protein, 32 aa, Artificial Sequence
  Description of Artificial Sequence: Synthetic polypeptide
AEEEIRTTNPVATEQYGSVSVTNLQGTEGINN

SEQ ID NO: 31024 - protein, 32 aa, Artificial Sequence
  Description of Artificial Sequence: Synthetic polypeptide
AEEEIRTTNPVATEQYGSVSVTNLQGTLGGNV

SEQ ID NO: 31025 - protein, 31 aa, Artificial Sequence
  Description of Artificial Sequence: Synthetic polypeptide
DEEEIRTTNPCATEQYGSVATNLQRETEGRD

SEQ ID NO: 31026 - protein, 32 aa, Artificial Sequence
  Description of Artificial Sequence: Synthetic polypeptide
AEEEIRTTNPVATEQYGSVSVTNNLQFGENSE

SEQ ID NO: 31027 - protein, 31 aa, Artificial Sequence
  Description of Artificial Sequence: Synthetic polypeptide
AEEEIRTTNPVATEQYGSVSVTNNLQEGETQ

SEQ ID NO: 31028 - protein, 32 aa, Artificial Sequence
  Description of Artificial Sequence: Synthetic polypeptide
AEEEIRTTNPVATEQYGSVSVTNNLQEGENNV

SEQ ID NO: 31029 - protein, 32 aa, Artificial Sequence
  Description of Artificial Sequence: Synthetic polypeptide
AEEEIRTTNPVATEQYGSVSVTNNLQEGENDT

SEQ ID NO: 31030 - protein, 32 aa, Artificial Sequence
  Description of Artificial Sequence: Synthetic polypeptide
AEEEIRTTNPVATEQYGSVSVTNNLQDGNQSG

SEQ ID NO: 31031 - protein, 32 aa, Artificial Sequence
  Description of Artificial Sequence: Synthetic polypeptide
AEEEIRTTNPVATEQYGSVSVTNNLQDEGENG

SEQ ID NO: 31032 - protein, 31 aa, Artificial Sequence
  Description of Artificial Sequence: Synthetic polypeptide
AEEEIRTTNPVATEQYGSVSVTNNLNTVGNN

SEQ ID NO: 31033 - protein, 31 aa, Artificial Sequence
  Description of Artificial Sequence: Synthetic polypeptide
QEEEVRTTNPVATEGYGSVSTENGDQRIGNR

SEQ ID NO: 31034 - protein, 30 aa, Artificial Sequence
  Description of Artificial Sequence: Synthetic polypeptide
DEEEIRTTNPCATEQYGSVATNLQRNDLVM

SEQ ID NO: 31035 - protein, 30 aa, Artificial Sequence
  Description of Artificial Sequence: Synthetic polypeptide
DEEEIRTTNPCATEQYGSVATNLQRNEEDN

SEQ ID NO: 31036 - protein, 32 aa, Artificial Sequence
  Description of Artificial Sequence: Synthetic polypeptide
QEEEVRTTNPVATEQYGSVSTENLDQRIGENF

SEQ ID NO: 31037 - protein, 32 aa, Artificial Sequence
  Description of Artificial Sequence: Synthetic polypeptide
QEEEVRTTNPVATEQYGSVSTENLDQRIGNGM

SEQ ID NO: 31038 - protein, 30 aa, Artificial Sequence
  Description of Artificial Sequence: Synthetic polypeptide
DEEEIRTTNPCATEQYGSVATNLQRNPEAD

SEQ ID NO: 31039 - protein, 32 aa, Artificial Sequence
  Description of Artificial Sequence: Synthetic polypeptide
QEEEVRTTNPVATEQYGSVSTENLDQRIGNTG

SEQ ID NO: 31040 - protein, 32 aa, Artificial Sequence
  Description of Artificial Sequence: Synthetic polypeptide
AEEEIRTTNPVATEQYGSVSVTNNLGQQGNSE

SEQ ID NO: 31041 - protein, 32 aa, Artificial Sequence
  Description of Artificial Sequence: Synthetic polypeptide
AEEEIRTTNPVATEQYGSVSVTNNLEQVGNNG

SEQ ID NO: 31042 - protein, 32 aa, Artificial Sequence
  Description of Artificial Sequence: Synthetic polypeptide
AEEEIRTTNPVATEQYGSVSVTNNLEQVGNAG

SEQ ID NO: 31043 - protein, 32 aa, Artificial Sequence
  Description of Artificial Sequence: Synthetic polypeptide
QEEEVRTTNPVATEQYGSVSTENLDQREGGNT

SEQ ID NO: 31044 - protein, 28 aa, Artificial Sequence
  Description of Artificial Sequence: Synthetic peptide
DEEEIRTTNPCATEQYGSVATTLALGPE

SEQ ID NO: 31045 - protein, 31 aa, Artificial Sequence
  Description of Artificial Sequence: Synthetic polypeptide
DEEEIRTTNPCATEQYGSVATNLQRDQDGDD

SEQ ID NO: 31046 - protein, 31 aa, Artificial Sequence
  Description of Artificial Sequence: Synthetic polypeptide
DEEEIRTTNPCATEQYGSVATNLQQAGDNLA

SEQ ID NO: 31047 - protein, 29 aa, Artificial Sequence
  Description of Artificial Sequence: Synthetic peptide
QEEEIRTTNPVCTEHYGSVSMPNIQRGNL

SEQ ID NO: 31048 - protein, 31 aa, Artificial Sequence
  Description of Artificial Sequence: Synthetic polypeptide
AEEEIRTTNPVATEQYGSVSVTNNLVLGNNM

SEQ ID NO: 31049 - protein, 31 aa, Artificial Sequence
  Description of Artificial Sequence: Synthetic polypeptide
AEEEIRTTNPVATEQYGSVSVTNNLQVNGTI

SEQ ID NO: 31050 - protein, 32 aa, Artificial Sequence
  Description of Artificial Sequence: Synthetic polypeptide
AEEEIRTTNPVATEQYGSVSVTNNLQTTGNND

SEQ ID NO: 31051 - protein, 31 aa, Artificial Sequence
  Description of Artificial Sequence: Synthetic polypeptide
AEEEIRTTNPVATEQYGSVSVTNNLQTGIGQ

SEQ ID NO: 31052 - protein, 32 aa, Artificial Sequence
  Description of Artificial Sequence: Synthetic polypeptide
AEEEIRTTNPVATEQYGSVSVTNNLQSGSNSN

SEQ ID NO: 31053 - protein, 32 aa, Artificial Sequence
  Description of Artificial Sequence: Synthetic polypeptide
AEEEIRTTNPVATEQYGSVSVTNNLQQSGNME

SEQ ID NO: 31054 - protein, 32 aa, Artificial Sequence
  Description of Artificial Sequence: Synthetic polypeptide
AEEEIRTTNPVATEQYGSVSVTNNLQQQGNTQ

SEQ ID NO: 31055 - protein, 31 aa, Artificial Sequence
  Description of Artificial Sequence: Synthetic polypeptide
AEEEIRTTNPVATEQYGSVSVTNNLQLTGGN

SEQ ID NO: 31056 - protein, 31 aa, Artificial Sequence
  Description of Artificial Sequence: Synthetic polypeptide
AEEEIRTTNPVATEQYGSVSVTNNLQQQANV

SEQ ID NO: 31057 - protein, 32 aa, Artificial Sequence
  Description of Artificial Sequence: Synthetic polypeptide
AEEEIRTTNPVATEQYGSVSVTNNLQQGNNSQ

SEQ ID NO: 31058 - protein, 31 aa, Artificial Sequence
  Description of Artificial Sequence: Synthetic polypeptide
DEEEIRTTNPCATEQYGSVATNLQDEGDTRM

SEQ ID NO: 31059 - protein, 31 aa, Artificial Sequence
  Description of Artificial Sequence: Synthetic polypeptide
QEEEISTTNPVATEQYGSVSTGMNEEQDGNR

SEQ ID NO: 31060 - protein, 32 aa, Artificial Sequence
  Description of Artificial Sequence: Synthetic polypeptide
AEEEIRTTNPVATEQYGSVSVTNNLQQGNEIA

SEQ ID NO: 31061 - protein, 30 aa, Artificial Sequence
  Description of Artificial Sequence: Synthetic polypeptide
DEEEIRTTNPCATEQYGSVATNLQDGEDAE

SEQ ID NO: 31062 - protein, 31 aa, Artificial Sequence
  Description of Artificial Sequence: Synthetic polypeptide
QEEELRTTNPVATEQYGSVSTANLDQDIGNN

SEQ ID NO: 31063 - protein, 32 aa, Artificial Sequence
  Description of Artificial Sequence: Synthetic polypeptide
QEEELRTTNPVATEQYGSVSTVNLDQLIGTNR

SEQ ID NO: 31064 - protein, 31 aa, Artificial Sequence
  Description of Artificial Sequence: Synthetic polypeptide
AEEEIRTTNPVATEQYGSVSVTNNLQNQNQD

SEQ ID NO: 31065 - protein, 32 aa, Artificial Sequence
  Description of Artificial Sequence: Synthetic polypeptide
AEEEIRTTNPVATEQYGSVSVTNNLQQNGNGG

SEQ ID NO: 31066 - protein, 32 aa, Artificial Sequence
  Description of Artificial Sequence: Synthetic polypeptide
AEEEIRTTNPVATEQYGSVSVTNNLEQQGENF

SEQ ID NO: 31067 - protein, 32 aa, Artificial Sequence
  Description of Artificial Sequence: Synthetic polypeptide
DEEEIRTTNPVATEQYGDVNSDTNLNRGMNIG

SEQ ID NO: 31068 - protein, 28 aa, Artificial Sequence
  Description of Artificial Sequence: Synthetic peptide
DEEEIRTTNPCATEQYGSVATVLASGSE

SEQ ID NO: 31069 - protein, 32 aa, Artificial Sequence
  Description of Artificial Sequence: Synthetic polypeptide
AEEEIRTTNPVATEQYGSVSVTNLQQQDGGNA

SEQ ID NO: 31070 - protein, 31 aa, Artificial Sequence
  Description of Artificial Sequence: Synthetic polypeptide
DEEEIRTTNPCATEQYGSVCATNLLQRENHA

SEQ ID NO: 31071 - protein, 32 aa, Artificial Sequence
  Description of Artificial Sequence: Synthetic polypeptide
AEEEIRTTNPVATEQYGSVSVTNLQQLGINEQ

SEQ ID NO: 31072 - protein, 32 aa, Artificial Sequence
  Description of Artificial Sequence: Synthetic polypeptide
AEEEIRTTNPVATEQYGSVSVTNLQQGVGNQI

SEQ ID NO: 31073 - protein, 31 aa, Artificial Sequence
  Description of Artificial Sequence: Synthetic polypeptide
DEEEIRTTNPCATEQYGSVCATNLQPDGNHA

SEQ ID NO: 31074 - protein, 31 aa, Artificial Sequence
  Description of Artificial Sequence: Synthetic polypeptide
DEEEIRTTNPVATEQYGCWSTINPLQRENSN

SEQ ID NO: 31075 - protein, 32 aa, Artificial Sequence
  Description of Artificial Sequence: Synthetic polypeptide
AEEEIRTTNPVATEQYGSVSVTNLQQEGNLGD

SEQ ID NO: 31076 - protein, 32 aa, Artificial Sequence
  Description of Artificial Sequence: Synthetic polypeptide
AEEEIRTTNPVATEQYGSVSVTNLQQDTGNQG

SEQ ID NO: 31077 - protein, 29 aa, Artificial Sequence
  Description of Artificial Sequence: Synthetic peptide
DEEEIRTTNPCATEQYGSVATWLARGKED

SEQ ID NO: 31078 - protein, 32 aa, Artificial Sequence
  Description of Artificial Sequence: Synthetic polypeptide
AEEEIRTTNPVATEQYGSVSVTNLQQDNGNVN

SEQ ID NO: 31079 - protein, 32 aa, Artificial Sequence
  Description of Artificial Sequence: Synthetic polypeptide
AEEEIRTTNPVATEQYGSVSVTNLQQDGGNED

SEQ ID NO: 31080 - protein, 31 aa, Artificial Sequence
  Description of Artificial Sequence: Synthetic polypeptide
AEEEIRTTNPVATEQYGSVSVTNLQQDEENE

SEQ ID NO: 31081 - protein, 32 aa, Artificial Sequence
  Description of Artificial Sequence: Synthetic polypeptide
AEEEIRTTNPVATEQYGSVSVTNLQQAGTNSE

SEQ ID NO: 31082 - protein, 32 aa, Artificial Sequence
  Description of Artificial Sequence: Synthetic polypeptide
AEEEIRTTNPVATEQYGSVSVTNLQNQSGINS

SEQ ID NO: 31083 - protein, 32 aa, Artificial Sequence
  Description of Artificial Sequence: Synthetic polypeptide
AEEEIRTTNPVATEQYGSVSVTNLQNNGGNLD

SEQ ID NO: 31084 - protein, 32 aa, Artificial Sequence
  Description of Artificial Sequence: Synthetic polypeptide
AEEEIRTTNPVATEQYGSVSVTNLQNILGNDE

SEQ ID NO: 31085 - protein, 32 aa, Artificial Sequence
  Description of Artificial Sequence: Synthetic polypeptide
AEEEIRTTNPVATEQYGSVSVTNLQNIIGNND

SEQ ID NO: 31086 - protein, 32 aa, Artificial Sequence
  Description of Artificial Sequence: Synthetic polypeptide
AEEEIRTTNPVATEQYGSVSVTNLQNIGTNNS

SEQ ID NO: 31087 - protein, 32 aa, Artificial Sequence
  Description of Artificial Sequence: Synthetic polypeptide
AEEEIRTTNPVATEQYGSVSVTNLQQDNGNDN

SEQ ID NO: 31088 - protein, 32 aa, Artificial Sequence
  Description of Artificial Sequence: Synthetic polypeptide
AEEEIRTTNPVATEQYGSVSVTNLQQQGENDQ

SEQ ID NO: 31089 - protein, 32 aa, Artificial Sequence
  Description of Artificial Sequence: Synthetic polypeptide
AEEEIRTTNPVATEQYGSVSVTNLQQQGENNA

SEQ ID NO: 31090 - protein, 32 aa, Artificial Sequence
  Description of Artificial Sequence: Synthetic polypeptide
AEEEIRTTNPVATEQYGSVSVTNLQQQIGNDE

SEQ ID NO: 31091 - protein, 31 aa, Artificial Sequence
  Description of Artificial Sequence: Synthetic polypeptide
DEEEIRTTNPVATEQYGDVMETNLNRGINGG

SEQ ID NO: 31092 - protein, 31 aa, Artificial Sequence
  Description of Artificial Sequence: Synthetic polypeptide
AEEEIRTTNPVATEQYGSVSVTNNGQVGNAT

SEQ ID NO: 31093 - protein, 31 aa, Artificial Sequence
  Description of Artificial Sequence: Synthetic polypeptide
AEEEIRTTNPVATEQYGSVSVTNNGQIQGNE

SEQ ID NO: 31094 - protein, 32 aa, Artificial Sequence
  Description of Artificial Sequence: Synthetic polypeptide
DEEEIRTTNPVATEQYGDVGSTNLQSGGENIP

SEQ ID NO: 31095 - protein, 30 aa, Artificial Sequence
  Description of Artificial Sequence: Synthetic polypeptide
QEEGIRTTNPVATEQYGSVSTNDLSNLNRN

SEQ ID NO: 31096 - protein, 29 aa, Artificial Sequence
  Description of Artificial Sequence: Synthetic peptide
QEEGIRTTNPVATEQYGSVSTNGFEGENN

SEQ ID NO: 31097 - protein, 30 aa, Artificial Sequence
  Description of Artificial Sequence: Synthetic polypeptide
QEEGIRTTNPVATEQYGSVSTNGLENGENG

SEQ ID NO: 31098 - protein, 31 aa, Artificial Sequence
  Description of Artificial Sequence: Synthetic polypeptide
AEEEIRTTNPVATEQYGSVSVTNLVQTTNND

SEQ ID NO: 31099 - protein, 32 aa, Artificial Sequence
  Description of Artificial Sequence: Synthetic polypeptide
AEEEIRTTNPVATEQYGSVSVTNLTQQGENNE

SEQ ID NO: 31100 - protein, 31 aa, Artificial Sequence
  Description of Artificial Sequence: Synthetic polypeptide
AEEEIRTTNPVATEQYGSVSVTNLSNEQGNS

SEQ ID NO: 31101 - protein, 32 aa, Artificial Sequence
  Description of Artificial Sequence: Synthetic polypeptide
AEEEIRTTNPVATEQYGSVSVTNLQYGNINNP

SEQ ID NO: 31102 - protein, 31 aa, Artificial Sequence
  Description of Artificial Sequence: Synthetic polypeptide
AEEEIRTTNPVATEQYGSVSVTNLQVEDTNG

SEQ ID NO: 31103 - protein, 32 aa, Artificial Sequence
  Description of Artificial Sequence: Synthetic polypeptide
AEEEIRTTNPVATEQYGSVSVTNLQTGNGGGT

SEQ ID NO: 31104 - protein, 31 aa, Artificial Sequence
  Description of Artificial Sequence: Synthetic polypeptide
AEEEIRTTNPVATEQYGSVSVTNLQTGGEGT

SEQ ID NO: 31105 - protein, 32 aa, Artificial Sequence
  Description of Artificial Sequence: Synthetic polypeptide
AEEEIRTTNPVATEQYGSVSVTNLQSIGTNNE

SEQ ID NO: 31106 - protein, 32 aa, Artificial Sequence
  Description of Artificial Sequence: Synthetic polypeptide
AEEEIRTTNPVATEQYGSVSVTNLQQSGTNQT

SEQ ID NO: 31107 - protein, 32 aa, Artificial Sequence
  Description of Artificial Sequence: Synthetic polypeptide
AEEEIRTTNPVATEQYGSVSVTNLQQSGSNIN

SEQ ID NO: 31108 - protein, 32 aa, Artificial Sequence
  Description of Artificial Sequence: Synthetic polypeptide
AEEEIRTTNPVATEQYGSVSVTNLQQSGNNTV

SEQ ID NO: 31109 - protein, 32 aa, Artificial Sequence
  Description of Artificial Sequence: Synthetic polypeptide
AEEEIRTTNPVATEQYGSVSVTNLQQSGINTT

SEQ ID NO: 31110 - protein, 32 aa, Artificial Sequence
  Description of Artificial Sequence: Synthetic polypeptide
AEEEIRTTNPVATEQYGSVSVNTNTLQNGNNA

SEQ ID NO: 31111 - protein, 32 aa, Artificial Sequence
  Description of Artificial Sequence: Synthetic polypeptide
DEEEIRTTNPCATEQYGSVPAVTNLSQSVGNR

SEQ ID NO: 31112 - protein, 28 aa, Artificial Sequence
  Description of Artificial Sequence: Synthetic peptide
QEGEIAPTNPCSTEQYGSVSTNLQSGNR

SEQ ID NO: 31113 - protein, 30 aa, Artificial Sequence
  Description of Artificial Sequence: Synthetic polypeptide
AEEEIRTTNPVATEQYGSVSVNQQVGTINT

SEQ ID NO: 31114 - protein, 32 aa, Artificial Sequence
  Description of Artificial Sequence: Synthetic polypeptide
DEEEIRTTNPCATEQYGSVSVTNNLQQGNSAE

SEQ ID NO: 31115 - protein, 31 aa, Artificial Sequence
  Description of Artificial Sequence: Synthetic polypeptide
DEEEIRTTNPVATEQYGCVSTNTQYFNSNRF

SEQ ID NO: 31116 - protein, 32 aa, Artificial Sequence
  Description of Artificial Sequence: Synthetic polypeptide
DEEEIRTTNPCATEQYGSVSVTTNLQPGNGAG

SEQ ID NO: 31117 - protein, 29 aa, Artificial Sequence
  Description of Artificial Sequence: Synthetic peptide
REEEIRTTNPVATEQYGCVATALQENGDR

SEQ ID NO: 31118 - protein, 31 aa, Artificial Sequence
  Description of Artificial Sequence: Synthetic polypeptide
DEEEIRTTNPVATEQYGCVSTNTQYFGSDRM

SEQ ID NO: 31119 - protein, 31 aa, Artificial Sequence
  Description of Artificial Sequence: Synthetic polypeptide
DEEEIRTTNPVATEQYGCVSTNTQTFGSNAS

SEQ ID NO: 31120 - protein, 31 aa, Artificial Sequence
  Description of Artificial Sequence: Synthetic polypeptide
DEEEIRTTNPCATEQYGSVSVVTNIQEQGND

SEQ ID NO: 31121 - protein, 32 aa, Artificial Sequence
  Description of Artificial Sequence: Synthetic polypeptide
DEEEIRTTNPVATEQYGCVSTNTDQSFGSNRT

SEQ ID NO: 31122 - protein, 30 aa, Artificial Sequence
  Description of Artificial Sequence: Synthetic polypeptide
DEEEIRTTNPCATEQYGSVSVTNNFQGEND

SEQ ID NO: 31123 - protein, 31 aa, Artificial Sequence
  Description of Artificial Sequence: Synthetic polypeptide
DEEEIRTTNPVATEQYGCVSTNSHQERDMGR

SEQ ID NO: 31124 - protein, 31 aa, Artificial Sequence
  Description of Artificial Sequence: Synthetic polypeptide
DEEEIRTTNPVATEQYGCVSTNPQRFQSNTQ

SEQ ID NO: 31125 - protein, 29 aa, Artificial Sequence
  Description of Artificial Sequence: Synthetic peptide
DEEEIRTTNPCATEQYGSVSVYNQNQGND

SEQ ID NO: 31126 - protein, 28 aa, Artificial Sequence
  Description of Artificial Sequence: Synthetic peptide
SAEEIATTNPVATAQYGSVSTELQNGND

SEQ ID NO: 31127 - protein, 29 aa, Artificial Sequence
  Description of Artificial Sequence: Synthetic peptide
SAEEIATTNPVATAQYGSVSTGLDQRGNM

SEQ ID NO: 31128 - protein, 29 aa, Artificial Sequence
  Description of Artificial Sequence: Synthetic peptide
SAEEIATTNPVATAQYGSVSTGLQRGDNA

SEQ ID NO: 31129 - protein, 29 aa, Artificial Sequence
  Description of Artificial Sequence: Synthetic peptide
SAEEIATTNPVATAQYGSVSTGLQRGNTV

SEQ ID NO: 31130 - protein, 28 aa, Artificial Sequence
  Description of Artificial Sequence: Synthetic peptide
DEEEIRTTNPCATEQYGSVSYEIFGGND

SEQ ID NO: 31131 - protein, 29 aa, Artificial Sequence
  Description of Artificial Sequence: Synthetic peptide
DEEEIRTTNPCATEQYGSVSYENINRGQD

SEQ ID NO: 31132 - protein, 32 aa, Artificial Sequence
  Description of Artificial Sequence: Synthetic polypeptide
DEEEIRTTNPCATEQYGSVSVVTTNLQEGNGA

SEQ ID NO: 31133 - protein, 30 aa, Artificial Sequence
  Description of Artificial Sequence: Synthetic polypeptide
DEEEIRTTNPCATEQYGSVSYNEDFREGND

SEQ ID NO: 31134 - protein, 31 aa, Artificial Sequence
  Description of Artificial Sequence: Synthetic polypeptide
QNEEIRTTNPVATEQYGVVSTMNLQQDGPNR

SEQ ID NO: 31135 - protein, 31 aa, Artificial Sequence
  Description of Artificial Sequence: Synthetic polypeptide
DEEEIRTTNPCATEQYGSVSVTNIGARGNDQ

SEQ ID NO: 31136 - protein, 30 aa, Artificial Sequence
  Description of Artificial Sequence: Synthetic polypeptide
DEEEIRTTNPVATEQYGCVSTPPERGSNQG

SEQ ID NO: 31137 - protein, 31 aa, Artificial Sequence
  Description of Artificial Sequence: Synthetic polypeptide
DEEEIRTTNPCATEQYGSVSTVSNEQEQGND

SEQ ID NO: 31138 - protein, 32 aa, Artificial Sequence
  Description of Artificial Sequence: Synthetic polypeptide
DEEEIRTTNPVATEQYGCVSTPNMLQERPNQM

SEQ ID NO: 31139 - protein, 30 aa, Artificial Sequence
  Description of Artificial Sequence: Synthetic polypeptide
DEEEIRTTNPVATEQYGCVSTPLQFPSNQY

SEQ ID NO: 31140 - protein, 28 aa, Artificial Sequence
  Description of Artificial Sequence: Synthetic peptide
QEQEIATTNPVATEQYGSVSTDLQHGEI

SEQ ID NO: 31141 - protein, 29 aa, Artificial Sequence
  Description of Artificial Sequence: Synthetic peptide
DEEEIRTTNPCATEQYGSVSVANINEGND

SEQ ID NO: 31142 - protein, 29 aa, Artificial Sequence
  Description of Artificial Sequence: Synthetic peptide
QEQEISATNPVATEQYGEVSAENLQRGNR

SEQ ID NO: 31143 - protein, 29 aa, Artificial Sequence
  Description of Artificial Sequence: Synthetic peptide
DEEEIRTTNPCATEQYGSVSVENIPRVNL

SEQ ID NO: 31144 - protein, 28 aa, Artificial Sequence
  Description of Artificial Sequence: Synthetic peptide
QEYEIRGTNPVATEQYGSVITNLQHGEQ

SEQ ID NO: 31145 - protein, 29 aa, Artificial Sequence
  Description of Artificial Sequence: Synthetic peptide
DEEEIRTTNPCATEQYGSVSVENNFEGND

SEQ ID NO: 31146 - protein, 30 aa, Artificial Sequence
  Description of Artificial Sequence: Synthetic polypeptide
DEEEIRTTNPCATEQYGSVSVNGIQEQGND

SEQ ID NO: 31147 - protein, 29 aa, Artificial Sequence
  Description of Artificial Sequence: Synthetic peptide
DEEEIRTTNPCATEQYGSVSVNIFHGNDA

SEQ ID NO: 31148 - protein, 29 aa, Artificial Sequence
  Description of Artificial Sequence: Synthetic peptide
DEEEIRTTNPCATEQYGSVSVNIFRGEDQ

SEQ ID NO: 31149 - protein, 30 aa, Artificial Sequence
  Description of Artificial Sequence: Synthetic polypeptide
DEEEIRTTNPCATEQYGSVSVNIIRDGNDD

SEQ ID NO: 31150 - protein, 28 aa, Artificial Sequence
  Description of Artificial Sequence: Synthetic peptide
QESEIATTNPVAYEQYGSVATNLQSGSR

SEQ ID NO: 31151 - protein, 28 aa, Artificial Sequence
  Description of Artificial Sequence: Synthetic peptide
QESEIRCTNPIATEQYGSVSENLMHGNR

SEQ ID NO: 31152 - protein, 29 aa, Artificial Sequence
  Description of Artificial Sequence: Synthetic peptide
DEEEIRTTNPCATEQYGSVSVQNILGGND

SEQ ID NO: 31153 - protein, 28 aa, Artificial Sequence
  Description of Artificial Sequence: Synthetic peptide
DEEEIRTTNPCATEQYGSVSVTISRVND

SEQ ID NO: 31154 - protein, 30 aa, Artificial Sequence
  Description of Artificial Sequence: Synthetic polypeptide
DEEEIRTTNPCATEQYGSVSVNDIITRGND

SEQ ID NO: 31155 - protein, 30 aa, Artificial Sequence
  Description of Artificial Sequence: Synthetic polypeptide
DEEEIRTTNPCATEQYGSVSYNEDFRGNDQ

SEQ ID NO: 31156 - protein, 28 aa, Artificial Sequence
  Description of Artificial Sequence: Synthetic peptide
SAEEIATTNPVATEQWGTVSMNLQQGNR

SEQ ID NO: 31157 - protein, 29 aa, Artificial Sequence
  Description of Artificial Sequence: Synthetic peptide
SAEEIATTNPVATEQWGTVSTNLQHGDNR

SEQ ID NO: 31158 - protein, 28 aa, Artificial Sequence
  Description of Artificial Sequence: Synthetic peptide
DEEEIRTTNPCATEQYGSVTTVLAQGME

SEQ ID NO: 31159 - protein, 31 aa, Artificial Sequence
  Description of Artificial Sequence: Synthetic polypeptide
DEEEIRTTNPCATEQYGSVTVTNLQQGTNSE

SEQ ID NO: 31160 - protein, 31 aa, Artificial Sequence
  Description of Artificial Sequence: Synthetic polypeptide
DEEEIRTTNPCATEQYGSVTVTNNLQSGNSA

SEQ ID NO: 31161 - protein, 29 aa, Artificial Sequence
  Description of Artificial Sequence: Synthetic peptide
SEAEIATTNPVATEQYGSVAATNLERGNN

SEQ ID NO: 31162 - protein, 31 aa, Artificial Sequence
  Description of Artificial Sequence: Synthetic polypeptide
DEEEIRTTNPCATEQYGSVVCVNLQRGNQEW

SEQ ID NO: 31163 - protein, 29 aa, Artificial Sequence
  Description of Artificial Sequence: Synthetic peptide
SEAEIATTNPVATEQYGSVATNLQAGDSR

SEQ ID NO: 31164 - protein, 29 aa, Artificial Sequence
  Description of Artificial Sequence: Synthetic peptide
DEEEIRTTNPCATEQYGSVVSDNIFNGND

SEQ ID NO: 31165 - protein, 31 aa, Artificial Sequence
  Description of Artificial Sequence: Synthetic polypeptide
SEAEIATTNPVATEQYGSVSTNLQNDEGNNR

SEQ ID NO: 31166 - protein, 28 aa, Artificial Sequence
  Description of Artificial Sequence: Synthetic peptide
DEEEIRTTNPCATEQYGSVTTPLASGEE

SEQ ID NO: 31167 - protein, 31 aa, Artificial Sequence
  Description of Artificial Sequence: Synthetic polypeptide
DEEEIRTTNPVATEQYGCVSTNNHQGFGNQM

SEQ ID NO: 31168 - protein, 28 aa, Artificial Sequence
  Description of Artificial Sequence: Synthetic peptide
DEEEIRTTNPCATEQYGSVVTMLAAGDE

SEQ ID NO: 31169 - protein, 29 aa, Artificial Sequence
  Description of Artificial Sequence: Synthetic peptide
SEAEIRATNPVATEQYGSVVTNLQHGNQD

SEQ ID NO: 31170 - protein, 29 aa, Artificial Sequence
  Description of Artificial Sequence: Synthetic peptide
SEAEIRCTNPIATEQYGSVSENLIMRGNR

SEQ ID NO: 31171 - protein, 28 aa, Artificial Sequence
  Description of Artificial Sequence: Synthetic peptide
SEAEIRCTNPIATEQYGSVSENLMGGNR

SEQ ID NO: 31172 - protein, 28 aa, Artificial Sequence
  Description of Artificial Sequence: Synthetic peptide
SEAEIRCTNPIATEQYGSVSENLMRGMR

SEQ ID NO: 31173 - protein, 28 aa, Artificial Sequence
  Description of Artificial Sequence: Synthetic peptide
SEAEIRCTNPIATSQYGSVSENLMRGNR

SEQ ID NO: 31174 - protein, 28 aa, Artificial Sequence
  Description of Artificial Sequence: Synthetic peptide
SEAEIRCTNPVATEQWGSVVTNLQHGNQ

SEQ ID NO: 31175 - protein, 29 aa, Artificial Sequence
  Description of Artificial Sequence: Synthetic peptide
SEAEIRCTNPVATEQYGSVATNLQHGNDQ

SEQ ID NO: 31176 - protein, 33 aa, Artificial Sequence
  Description of Artificial Sequence: Synthetic polypeptide
DEEEIRTTNPCATEQYGSVVSYTNLSQRTVGDR

SEQ ID NO: 31177 - protein, 29 aa, Artificial Sequence
  Description of Artificial Sequence: Synthetic peptide
DEEEIRTTNPCATEQYGSVTTELAAGNVE

SEQ ID NO: 31178 - protein, 32 aa, Artificial Sequence
  Description of Artificial Sequence: Synthetic polypeptide
DEEEIRTTNPVATEQYGCVSTNNLQSFGSDQR

SEQ ID NO: 31179 - protein, 28 aa, Artificial Sequence
  Description of Artificial Sequence: Synthetic peptide
SEAEIAATNPVATEQYGSVATNLQNGNQ

SEQ ID NO: 31180 - protein, 28 aa, Artificial Sequence
  Description of Artificial Sequence: Synthetic peptide
SAEEIATTNPVATEQWGTVSTNLQSGNV

SEQ ID NO: 31181 - protein, 29 aa, Artificial Sequence
  Description of Artificial Sequence: Synthetic peptide
SAEEIATTNPVATEQYGVVSTNLQDGENM

SEQ ID NO: 31182 - protein, 30 aa, Artificial Sequence
  Description of Artificial Sequence: Synthetic polypeptide
SAEEIATTNPVATEQYGVVSTNLQDGPNVR

SEQ ID NO: 31183 - protein, 28 aa, Artificial Sequence
  Description of Artificial Sequence: Synthetic peptide
SAEEICTTNPVATYQYGSVSTALQHGNP

SEQ ID NO: 31184 - protein, 28 aa, Artificial Sequence
  Description of Artificial Sequence: Synthetic peptide
SAEEIRATNPVATEQWGTVSTNLQEGNH

SEQ ID NO: 31185 - protein, 28 aa, Artificial Sequence
  Description of Artificial Sequence: Synthetic peptide
SAEEIRCTNPIATEQYGSVSENLMRGNI

SEQ ID NO: 31186 - protein, 28 aa, Artificial Sequence
  Description of Artificial Sequence: Synthetic peptide
SAEEIRCTNPIATEQYGSVSENQMRGNR

SEQ ID NO: 31187 - protein, 29 aa, Artificial Sequence
  Description of Artificial Sequence: Synthetic peptide
SCEEIRCTNPIATEQYGSVSENLMRGNRM

SEQ ID NO: 31188 - protein, 28 aa, Artificial Sequence
  Description of Artificial Sequence: Synthetic peptide
SCEEIRCTNPIATFQYGSVSENLARGNR

SEQ ID NO: 31189 - protein, 30 aa, Artificial Sequence
  Description of Artificial Sequence: Synthetic polypeptide
SCEEIRTTNPVATEQWGAVSTNLQEVGNRD

SEQ ID NO: 31190 - protein, 28 aa, Artificial Sequence
  Description of Artificial Sequence: Synthetic peptide
SCEEIRTTNPVATEQWGFVSTNQVEGNR

SEQ ID NO: 31191 - protein, 28 aa, Artificial Sequence
  Description of Artificial Sequence: Synthetic peptide
SDEEIRCTNPIATDQYGSVSENLMRGNR

SEQ ID NO: 31192 - protein, 28 aa, Artificial Sequence
  Description of Artificial Sequence: Synthetic peptide
SDEEIRCTNPIATEQYGNVSENLMRGNR

SEQ ID NO: 31193 - protein, 28 aa, Artificial Sequence
  Description of Artificial Sequence: Synthetic peptide
SDEEIRCTNPIATEQYGSVSEGLMRGNR

SEQ ID NO: 31194 - protein, 29 aa, Artificial Sequence
  Description of Artificial Sequence: Synthetic peptide
SDEEIRCTNPIATEQYGSVSENLMRFGNR

SEQ ID NO: 31195 - protein, 28 aa, Artificial Sequence
  Description of Artificial Sequence: Synthetic peptide
SDEEIRCTNPIATEQYGSVSENLMRGNG

SEQ ID NO: 31196 - protein, 28 aa, Artificial Sequence
  Description of Artificial Sequence: Synthetic peptide
SDEEIRCTNPIATEQYGSVSENLMRGSR

SEQ ID NO: 31197 - protein, 28 aa, Artificial Sequence
  Description of Artificial Sequence: Synthetic peptide
SDEEIRCTNPVATEQYGNVAENLMRGNR

SEQ ID NO: 31198 - protein, 34 aa, Artificial Sequence
  Description of Artificial Sequence: Synthetic polypeptide
DEEEIRTTNPCATEQYGSVSYTNLSQRTVGNNRW

SEQ ID NO: 31199 - protein, 31 aa, Artificial Sequence
  Description of Artificial Sequence: Synthetic polypeptide
DEEEIRTTNPCATEQYGSVSTVNQQEQGNSD

SEQ ID NO: 31200 - protein, 29 aa, Artificial Sequence
  Description of Artificial Sequence: Synthetic peptide
QEEEIRTTNPVAYEQYGSVATNLQAPNDN

SEQ ID NO: 31201 - protein, 32 aa, Artificial Sequence
  Description of Artificial Sequence: Synthetic polypeptide
AEEEIRTTNPVATEQYGSVSTVVNLQIGNEDT

SEQ ID NO: 31202 - protein, 28 aa, Artificial Sequence
  Description of Artificial Sequence: Synthetic peptide
QENEIRTTNPVATECYGSVSECLQRENL

SEQ ID NO: 31203 - protein, 28 aa, Artificial Sequence
  Description of Artificial Sequence: Synthetic peptide
DEEEIRTTNPCATEQYGSVPTVLAIGEE

SEQ ID NO: 31204 - protein, 29 aa, Artificial Sequence
  Description of Artificial Sequence: Synthetic peptide
QEGEIATTNPCSTEQYGSVSTNLQSGMNR

SEQ ID NO: 31205 - protein, 28 aa, Artificial Sequence
  Description of Artificial Sequence: Synthetic peptide
DEEEIRTTNPCATEQYGSVPTVMARGDE

SEQ ID NO: 31206 - protein, 31 aa, Artificial Sequence
  Description of Artificial Sequence: Synthetic polypeptide
DEEEIRTTNPVATEQYGCVSWEEHQRGSNRL

SEQ ID NO: 31207 - protein, 28 aa, Artificial Sequence
  Description of Artificial Sequence: Synthetic peptide
DEEEIRTTNPCATEQYGSVPTWLAGGDE

SEQ ID NO: 31208 - protein, 28 aa, Artificial Sequence
  Description of Artificial Sequence: Synthetic peptide
QEGEIATTNPVATECYGSVSCNLQSGTR

SEQ ID NO: 31209 - protein, 29 aa, Artificial Sequence
  Description of Artificial Sequence: Synthetic peptide
DEEEIRTTNPCATEQYGSVPTWLARGEED

SEQ ID NO: 31210 - protein, 29 aa, Artificial Sequence
  Description of Artificial Sequence: Synthetic peptide
DEEEIRTTNPCATEQYGSVPTWLARGGEA

SEQ ID NO: 31211 - protein, 29 aa, Artificial Sequence
  Description of Artificial Sequence: Synthetic peptide
DEEEIRTTNPCATEQYGSVPTQLARGQDE

SEQ ID NO: 31212 - protein, 32 aa, Artificial Sequence
  Description of Artificial Sequence: Synthetic polypeptide
DEEEIRTTNPVATEQYGCVSVSMNLQRFNSNI

SEQ ID NO: 31213 - protein, 32 aa, Artificial Sequence
  Description of Artificial Sequence: Synthetic polypeptide
DEEEIRTTNPVATEQYGCVSVSENLNQRNSNI

SEQ ID NO: 31214 - protein, 29 aa, Artificial Sequence
  Description of Artificial Sequence: Synthetic peptide
DEEEIRTTNPCATEQYGSVPVTVLARGQE

SEQ ID NO: 31215 - protein, 28 aa, Artificial Sequence
  Description of Artificial Sequence: Synthetic peptide
QEGEIRCTNPCSSEQYGSVSENLQRGNR

SEQ ID NO: 31216 - protein, 28 aa, Artificial Sequence
  Description of Artificial Sequence: Synthetic peptide
QEGEIRCTNPCSTEQYGSVSENLMRGNR

SEQ ID NO: 31217 - protein, 28 aa, Artificial Sequence
  Description of Artificial Sequence: Synthetic peptide
QEGEIRCTNPISTEQYGSVSENLMRGNR

SEQ ID NO: 31218 - protein, 31 aa, Artificial Sequence
  Description of Artificial Sequence: Synthetic polypeptide
DEEEIRTTNPVATEQYGCVSTYDQRFGSERL

SEQ ID NO: 31219 - protein, 28 aa, Artificial Sequence
  Description of Artificial Sequence: Synthetic peptide
QEGEIRCTNPISTEQYGSVSENLQRGTR

SEQ ID NO: 31220 - protein, 30 aa, Artificial Sequence
  Description of Artificial Sequence: Synthetic polypeptide
DEEEIRTTNPCATEQYGSVSCVNISFRGND

SEQ ID NO: 31221 - protein, 31 aa, Artificial Sequence
  Description of Artificial Sequence: Synthetic polypeptide
DEEEIRTTNPVATEQYGCVSVSMNLQNSSNI

SEQ ID NO: 31222 - protein, 32 aa, Artificial Sequence
  Description of Artificial Sequence: Synthetic polypeptide
DEEEIRTTNPVATEQYGCVSTWNLQHFGSNNQ

SEQ ID NO: 31223 - protein, 28 aa, Artificial Sequence
  Description of Artificial Sequence: Synthetic peptide
DEEEIRTTNPCATEQYGSVPTHLADGDD

SEQ ID NO: 31224 - protein, 29 aa, Artificial Sequence
  Description of Artificial Sequence: Synthetic peptide
DEEEIRTTNPCATEQYGSVPTALASRGVE

SEQ ID NO: 31225 - protein, 31 aa, Artificial Sequence
  Description of Artificial Sequence: Synthetic polypeptide
DEEEIRTTNPVATEQYGCVSWNLERFGSNTQ

SEQ ID NO: 31226 - protein, 30 aa, Artificial Sequence
  Description of Artificial Sequence: Synthetic polypeptide
DEEEIRTTNPVATEQYGCVSWMNLIYGSQR

SEQ ID NO: 31227 - protein, 31 aa, Artificial Sequence
  Description of Artificial Sequence: Synthetic polypeptide
AEEEIRTTNPVATEQYGSVSVNNLQQNGNMN

SEQ ID NO: 31228 - protein, 31 aa, Artificial Sequence
  Description of Artificial Sequence: Synthetic polypeptide
AEEEIRTTNPVATEQYGSVSVNNLQIGNQNE

SEQ ID NO: 31229 - protein, 30 aa, Artificial Sequence
  Description of Artificial Sequence: Synthetic polypeptide
DEEEIRTTNPVATEQYGCVSWGNTQNGSNA

SEQ ID NO: 31230 - protein, 30 aa, Artificial Sequence
  Description of Artificial Sequence: Synthetic polypeptide
AEEEIRTTNPVATEQYGSVSVNLQQGTAGQ

SEQ ID NO: 31231 - protein, 30 aa, Artificial Sequence
  Description of Artificial Sequence: Synthetic polypeptide
AEEEIRTTNPVATEQYGSVSVNLQGGDTGQ

SEQ ID NO: 31232 - protein, 30 aa, Artificial Sequence
  Description of Artificial Sequence: Synthetic polypeptide
AEEEIRTTNPVATEQYGSVSVNLELQGNQG

SEQ ID NO: 31233 - protein, 30 aa, Artificial Sequence
  Description of Artificial Sequence: Synthetic polypeptide
DEEEIRTTNPVATEQYGCVSWELQGFGSER

SEQ ID NO: 31234 - protein, 31 aa, Artificial Sequence
  Description of Artificial Sequence: Synthetic polypeptide
DEEEIRTTNPVATEQYGCVSWGNLERSGGNQ

SEQ ID NO: 31235 - protein, 30 aa, Artificial Sequence
  Description of Artificial Sequence: Synthetic polypeptide
DEEEIRTTNPVATEQYGCVSWENLNNGSNL

SEQ ID NO: 31236 - protein, 30 aa, Artificial Sequence
  Description of Artificial Sequence: Synthetic polypeptide
DEEEIRTTNPVATEQYGCVSWENLNGGSQR

SEQ ID NO: 31237 - protein, 28 aa, Artificial Sequence
  Description of Artificial Sequence: Synthetic peptide
DEEEIRTTNPCATEQYGSVPNVLARGVE

SEQ ID NO: 31238 - protein, 29 aa, Artificial Sequence
  Description of Artificial Sequence: Synthetic peptide
DEEEIRTTNPVATEQYGCVSWELQYGSQQ

SEQ ID NO: 31239 - protein, 30 aa, Artificial Sequence
  Description of Artificial Sequence: Synthetic polypeptide
AEEEIRTTNPVATEQYGSVSVENLQQGTGQ

SEQ ID NO: 31240 - protein, 33 aa, Artificial Sequence
  Description of Artificial Sequence: Synthetic polypeptide
DEEEIRTTNPCATEQYGSVPSYTNAASQRVGNR

SEQ ID NO: 31241 - protein, 33 aa, Artificial Sequence
  Description of Artificial Sequence: Synthetic polypeptide
DEEEIRTTNPCATEQYGSVPSYTNELSQRVGSR

SEQ ID NO: 31242 - protein, 32 aa, Artificial Sequence
  Description of Artificial Sequence: Synthetic polypeptide
DEEEIRTTNPCATEQYGSVPSYTNLSQSVGND

SEQ ID NO: 31243 - protein, 30 aa, Artificial Sequence
  Description of Artificial Sequence: Synthetic polypeptide
AEEEIRTTNPVATEQYGSVSVGNNQEGNNS

SEQ ID NO: 31244 - protein, 29 aa, Artificial Sequence
  Description of Artificial Sequence: Synthetic peptide
QEHEIATTNPVATEQYGSVSTILEQRGDT

SEQ ID NO: 31245 - protein, 28 aa, Artificial Sequence
  Description of Artificial Sequence: Synthetic peptide
QENEIACTNPIATEQYGSVSENLMRGNR

SEQ ID NO: 31246 - protein, 32 aa, Artificial Sequence
  Description of Artificial Sequence: Synthetic polypeptide
DEEEIRTTNPVATEQYGCVSTVNLQSFGSNFQ

SEQ ID NO: 31247 - protein, 28 aa, Artificial Sequence
  Description of Artificial Sequence: Synthetic peptide
QENEIATTNPVATEQYGDVSECLQRGER

SEQ ID NO: 31248 - protein, 28 aa, Artificial Sequence
  Description of Artificial Sequence: Synthetic peptide
QENEIATTNPVATEQYGEASENLQRGER

SEQ ID NO: 31249 - protein, 28 aa, Artificial Sequence
  Description of Artificial Sequence: Synthetic peptide
QENEIATTNPVATEQYGEASENLQRGGR

SEQ ID NO: 31250 - protein, 28 aa, Artificial Sequence
  Description of Artificial Sequence: Synthetic peptide
QENEIATTNPVATEQYGEVSENLQRGEL

SEQ ID NO: 31251 - protein, 30 aa, Artificial Sequence
  Description of Artificial Sequence: Synthetic polypeptide
DEEEIRTTNPCATEQYGSVSTNNGQIGEQD

SEQ ID NO: 31252 - protein, 31 aa, Artificial Sequence
  Description of Artificial Sequence: Synthetic polypeptide
DEEEIRTTNPCATEQYGSVSTNNGQPRGEID

SEQ ID NO: 31253 - protein, 31 aa, Artificial Sequence
  Description of Artificial Sequence: Synthetic polypeptide
DEEEIRTTNPVATEQYGCVSTTEPQRGSERS

SEQ ID NO: 31254 - protein, 32 aa, Artificial Sequence
  Description of Artificial Sequence: Synthetic polypeptide
DEEEIRTTNPCATEQYGSVSTPNTLTEIQGNR

SEQ ID NO: 31255 - protein, 28 aa, Artificial Sequence
  Description of Artificial Sequence: Synthetic peptide
QENEIATTNPVATECYGSVSECLQRGER

SEQ ID NO: 31256 - protein, 31 aa, Artificial Sequence
  Description of Artificial Sequence: Synthetic polypeptide
DEEEIRTTNPCATEQYGSVSTTLQVGNENND

SEQ ID NO: 31257 - protein, 31 aa, Artificial Sequence
  Description of Artificial Sequence: Synthetic polypeptide
DEEEIRTTNPVATEQYGCVSTTELQHGSNAP

SEQ ID NO: 31258 - protein, 33 aa, Artificial Sequence
  Description of Artificial Sequence: Synthetic polypeptide
DEEEIRTTNPCATEQYGSVSTTPALPQRNGNPR

SEQ ID NO: 31259 - protein, 30 aa, Artificial Sequence
  Description of Artificial Sequence: Synthetic polypeptide
DEEEIRTTNPVATEQYGCVSTTELQHGSEF

SEQ ID NO: 31260 - protein, 30 aa, Artificial Sequence
  Description of Artificial Sequence: Synthetic polypeptide
DEEEIRTTNPCATEQYGSVSTTQGRGVNVD

SEQ ID NO: 31261 - protein, 28 aa, Artificial Sequence
  Description of Artificial Sequence: Synthetic peptide
QENEIRTTNPIATEQYGDVSENLQREER

SEQ ID NO: 31262 - protein, 28 aa, Artificial Sequence
  Description of Artificial Sequence: Synthetic peptide
QENEIRTTNPIATEQYGSVSENLMRENL

SEQ ID NO: 31263 - protein, 30 aa, Artificial Sequence
  Description of Artificial Sequence: Synthetic polypeptide
DEEEIRTTNPCATEQYGSVSTVNIQEQGED

SEQ ID NO: 31264 - protein, 28 aa, Artificial Sequence
  Description of Artificial Sequence: Synthetic peptide
QENEIRTTNPVATECYGSVSECLMRENR

SEQ ID NO: 31265 - protein, 30 aa, Artificial Sequence
  Description of Artificial Sequence: Synthetic polypeptide
DEEEIRTTNPCATEQYGSVSTTLQVSPEER

SEQ ID NO: 31266 - protein, 30 aa, Artificial Sequence
  Description of Artificial Sequence: Synthetic polypeptide
DEEEIRTTNPCATEQYGSVSTNLQQPDDTQ

SEQ ID NO: 31267 - protein, 32 aa, Artificial Sequence
  Description of Artificial Sequence: Synthetic polypeptide
DEEEIRTTNPCATEQYGSVSTNLQINQGGNGG

SEQ ID NO: 31268 - protein, 31 aa, Artificial Sequence
  Description of Artificial Sequence: Synthetic polypeptide
DEEEIRTTNPCATEQYGSVSTNLQAGPESDA

SEQ ID NO: 31269 - protein, 28 aa, Artificial Sequence
  Description of Artificial Sequence: Synthetic peptide
QENEIACTNPVATECYGSVSENLMRGNR

SEQ ID NO: 31270 - protein, 30 aa, Artificial Sequence
  Description of Artificial Sequence: Synthetic polypeptide
DEEEIRTTNPVATEQYGCVSTVNLDQEIDQ

SEQ ID NO: 31271 - protein, 31 aa, Artificial Sequence
  Description of Artificial Sequence: Synthetic polypeptide
DEEEIRTTNPVATEQYGCVSTVNHQFFGSNQ

SEQ ID NO: 31272 - protein, 30 aa, Artificial Sequence
  Description of Artificial Sequence: Synthetic polypeptide
DEEEIRTTNPVATEQYGCVSTVNDNRNGSQ

SEQ ID NO: 31273 - protein, 28 aa, Artificial Sequence
  Description of Artificial Sequence: Synthetic peptide
QENEIACTNPVATEQYGDVSENLQRGER

SEQ ID NO: 31274 - protein, 29 aa, Artificial Sequence
  Description of Artificial Sequence: Synthetic peptide
DEEEIRTTNPCATEQYGSVSPPNIFIGND

SEQ ID NO: 31275 - protein, 30 aa, Artificial Sequence
  Description of Artificial Sequence: Synthetic polypeptide
DEEEIRTTNPVATEQYGCVSTVLTGGIDRQ

SEQ ID NO: 31276 - protein, 29 aa, Artificial Sequence
  Description of Artificial Sequence: Synthetic peptide
DEEEIRTTNPVATEQYGCVSTVLIRNQES

SEQ ID NO: 31277 - protein, 31 aa, Artificial Sequence
  Description of Artificial Sequence: Synthetic polypeptide
DEEEIRTTNPVATEQYGCVSTVDLQRGDEDV

SEQ ID NO: 31278 - protein, 31 aa, Artificial Sequence
  Description of Artificial Sequence: Synthetic polypeptide
DEEEIRTTNPVATEQYGCVSTTVNLDQRDDQ

SEQ ID NO: 31279 - protein, 31 aa, Artificial Sequence
  Description of Artificial Sequence: Synthetic polypeptide
DEEEIRTTNPVATEQYGCVSTTNMQRNEDRM

SEQ ID NO: 31280 - protein, 28 aa, Artificial Sequence
  Description of Artificial Sequence: Synthetic peptide
QENEIACTNPVATEQYGEVSENLQRGER

SEQ ID NO: 31281 - protein, 32 aa, Artificial Sequence
  Description of Artificial Sequence: Synthetic polypeptide
DEEEIRTTNPVATEQYGCVSTTNLQNFGSNTQ

SEQ ID NO: 31282 - protein, 32 aa, Artificial Sequence
  Description of Artificial Sequence: Synthetic polypeptide
DEEEIRTTNPVATEQYGCVSTTNLERGNNQED

SEQ ID NO: 31283 - protein, 32 aa, Artificial Sequence
  Description of Artificial Sequence: Synthetic polypeptide
DEEEIRTTNPVATEQYGCVSTTNHQERNSNRT

SEQ ID NO: 31284 - protein, 30 aa, Artificial Sequence
  Description of Artificial Sequence: Synthetic polypeptide
DEEEIRTTNPVATEQYGCVSTTNGNQNGEF

SEQ ID NO: 31285 - protein, 32 aa, Artificial Sequence
  Description of Artificial Sequence: Synthetic polypeptide
DEEEIRTTNPVATEQYGCVSTTGNLQYFGSDR

SEQ ID NO: 31286 - protein, 32 aa, Artificial Sequence
  Description of Artificial Sequence: Synthetic polypeptide
DEEEIRTTNPCATEQYGSVSTNLIQQGEEGRN

SEQ ID NO: 31287 - protein, 28 aa, Artificial Sequence
  Description of Artificial Sequence: Synthetic peptide
QENEIATTNPIATEQYGDVSECLQRGNR

SEQ ID NO: 31288 - protein, 31 aa, Artificial Sequence
  Description of Artificial Sequence: Synthetic polypeptide
DEEEIRTTNPVATEQYGCVSTTDLQRENNVL

SEQ ID NO: 31289 - protein, 30 aa, Artificial Sequence
  Description of Artificial Sequence: Synthetic polypeptide
QEEEIRTTNPVAYEQYGSVATNLQAGNDAN

SEQ ID NO: 31290 - protein, 30 aa, Artificial Sequence
  Description of Artificial Sequence: Synthetic polypeptide
DEEEIRTTNPCATEQYGSVANNLQMGPSRD

SEQ ID NO: 31291 - protein, 30 aa, Artificial Sequence
  Description of Artificial Sequence: Synthetic polypeptide
QEEEIRTTNPVATESYGSVSNTNLHRGLQN

SEQ ID NO: 31292 - protein, 31 aa, Artificial Sequence
  Description of Artificial Sequence: Synthetic polypeptide
AEEEIRTTNPVATEQYGSVVSNNNLQGIGNA

SEQ ID NO: 31293 - protein, 31 aa, Artificial Sequence
  Description of Artificial Sequence: Synthetic polypeptide
AEEEIRTTNPVATEQYGSVVSNNLNQNGNNI

SEQ ID NO: 31294 - protein, 31 aa, Artificial Sequence
  Description of Artificial Sequence: Synthetic polypeptide
AEEEIRTTNPVATEQYGSVVSNNLNQNGNNG

SEQ ID NO: 31295 - protein, 29 aa, Artificial Sequence
  Description of Artificial Sequence: Synthetic peptide
DEEEIRTTNPCATEFYGSVATNHERGNAE

SEQ ID NO: 31296 - protein, 30 aa, Artificial Sequence
  Description of Artificial Sequence: Synthetic polypeptide
AEEEIRTTNPVATEQYGSVVSNNLGIGENG

SEQ ID NO: 31297 - protein, 32 aa, Artificial Sequence
  Description of Artificial Sequence: Synthetic polypeptide
DEEEIRTTNPVATEQYGEVSWTNIDNDRGMNR

SEQ ID NO: 31298 - protein, 31 aa, Artificial Sequence
  Description of Artificial Sequence: Synthetic polypeptide
DEEEIRTTNPVATEQYGEVSWTELDNRGMER

SEQ ID NO: 31299 - protein, 30 aa, Artificial Sequence
  Description of Artificial Sequence: Synthetic polypeptide
DEEEIRTTNPVATEQYGEVSTYDQFFGSNQ

SEQ ID NO: 31300 - protein, 29 aa, Artificial Sequence
  Description of Artificial Sequence: Synthetic peptide
DEEEIRTTNPCATEEYGSVQTNHGRGGNA

SEQ ID NO: 31301 - protein, 28 aa, Artificial Sequence
  Description of Artificial Sequence: Synthetic peptide
QEEEIATVNPVATEQYGVVSDNLQHGNK

SEQ ID NO: 31302 - protein, 30 aa, Artificial Sequence
  Description of Artificial Sequence: Synthetic polypeptide
QEEEICTTNPTATAQYGSVATNLQDRGNDR

SEQ ID NO: 31303 - protein, 31 aa, Artificial Sequence
  Description of Artificial Sequence: Synthetic polypeptide
QEEEICTTNPTATEQYGSVATNLQHRAGNDR

SEQ ID NO: 31304 - protein, 31 aa, Artificial Sequence
  Description of Artificial Sequence: Synthetic polypeptide
QEEEICTTNPVATEMYGSVSTNLQDGGNDRH

SEQ ID NO: 31305 - protein, 29 aa, Artificial Sequence
  Description of Artificial Sequence: Synthetic peptide
DEEEIRTTNPCATEGYGSCCSTNLANGNW

SEQ ID NO: 31306 - protein, 30 aa, Artificial Sequence
  Description of Artificial Sequence: Synthetic polypeptide
QEEEICTTNPVATEPYGSVATNLQRDGGNH

SEQ ID NO: 31307 - protein, 31 aa, Artificial Sequence
  Description of Artificial Sequence: Synthetic polypeptide
QEEEICTTNPVATEPYGSVSANLQDRGNDRQ

SEQ ID NO: 31308 - protein, 29 aa, Artificial Sequence
  Description of Artificial Sequence: Synthetic peptide
QEEEICTTNPVATEPYGSVSTNLQNGDEQ

SEQ ID NO: 31309 - protein, 30 aa, Artificial Sequence
  Description of Artificial Sequence: Synthetic polypeptide
QEEEICTTNPVATEPYGSVSTNLQNPGDRN

SEQ ID NO: 31310 - protein, 31 aa, Artificial Sequence
  Description of Artificial Sequence: Synthetic polypeptide
AEEEIRTTNPVATEQYGSVVNSTNNNQDGNE

SEQ ID NO: 31311 - protein, 29 aa, Artificial Sequence
  Description of Artificial Sequence: Synthetic peptide
QEEEICTTNPVATEQWGSVSTNLQNGDTL

SEQ ID NO: 31312 - protein, 29 aa, Artificial Sequence
  Description of Artificial Sequence: Synthetic peptide
DEEEIRTTNPCATEEYGSVETNHNGRGNA

SEQ ID NO: 31313 - protein, 30 aa, Artificial Sequence
  Description of Artificial Sequence: Synthetic polypeptide
AEEEIRTTNPVATEQYGSVVSTNLGGATND

SEQ ID NO: 31314 - protein, 32 aa, Artificial Sequence
  Description of Artificial Sequence: Synthetic polypeptide
AEEEIRTTNPVATEQYGSVVSTNQLQNNGIND

SEQ ID NO: 31315 - protein, 31 aa, Artificial Sequence
  Description of Artificial Sequence: Synthetic polypeptide
AEEEIRTTNPVATEQYGSVVSTNNQNGNAIG

SEQ ID NO: 31316 - protein, 30 aa, Artificial Sequence
  Description of Artificial Sequence: Synthetic polypeptide
AEEEIRTTNPVATEQYGSVVSTNNQENEND

SEQ ID NO: 31317 - protein, 32 aa, Artificial Sequence
  Description of Artificial Sequence: Synthetic polypeptide
AEEEIRTTNPVATEQYGSVVSTNNLQNGNNNA

SEQ ID NO: 31318 - protein, 31 aa, Artificial Sequence
  Description of Artificial Sequence: Synthetic polypeptide
AEEEIRTTNPVATEQYGSVVSTNNLGGDGND

SEQ ID NO: 31319 - protein, 30 aa, Artificial Sequence
  Description of Artificial Sequence: Synthetic polypeptide
AEEEIRTTNPVATEQYGSVVSTNNGITGNG

SEQ ID NO: 31320 - protein, 32 aa, Artificial Sequence
  Description of Artificial Sequence: Synthetic polypeptide
AEEEIRTTNPVATEQYGSVVSTNLQNGNNNGS

SEQ ID NO: 31321 - protein, 32 aa, Artificial Sequence
  Description of Artificial Sequence: Synthetic polypeptide
AEEEIRTTNPVATEQYGSVVSTNLQAGSNNDE

SEQ ID NO: 31322 - protein, 31 aa, Artificial Sequence
  Description of Artificial Sequence: Synthetic polypeptide
AEEEIRTTNPVATEQYGSVVSTNGQEQIGNN

SEQ ID NO: 31323 - protein, 32 aa, Artificial Sequence
  Description of Artificial Sequence: Synthetic polypeptide
AEEEIRTTNPVATEQYGSVVSTNLNQNGNNGQ

SEQ ID NO: 31324 - protein, 32 aa, Artificial Sequence
  Description of Artificial Sequence: Synthetic polypeptide
AEEEIRTTNPVATEQYGSVVSTNLLQNGNGNA

SEQ ID NO: 31325 - protein, 31 aa, Artificial Sequence
  Description of Artificial Sequence: Synthetic polypeptide
AEEEIRTTNPVATEQYGSVVSTNLLGGTNNG

SEQ ID NO: 31326 - protein, 30 aa, Artificial Sequence
  Description of Artificial Sequence: Synthetic polypeptide
AEEEIRTTNPVATEQYGSVVSTNLGTTING

SEQ ID NO: 31327 - protein, 31 aa, Artificial Sequence
  Description of Artificial Sequence: Synthetic polypeptide
AEEEIRTTNPVATEQYGSVVSTNLGSTGNGN

SEQ ID NO: 31328 - protein, 31 aa, Artificial Sequence
  Description of Artificial Sequence: Synthetic polypeptide
AEEEIRTTNPVATEQYGSVVSTNLGGTGENG

SEQ ID NO: 31329 - protein, 31 aa, Artificial Sequence
  Description of Artificial Sequence: Synthetic polypeptide
AEEEIRTTNPVATEQYGSVVSTNLGGNTGNG

SEQ ID NO: 31330 - protein, 32 aa, Artificial Sequence
  Description of Artificial Sequence: Synthetic polypeptide
AEEEIRTTNPVATEQYGSVVSTNLGGNNGNNR

SEQ ID NO: 31331 - protein, 30 aa, Artificial Sequence
  Description of Artificial Sequence: Synthetic polypeptide
AEEEIRTTNPVATEQYGSVVSTNLGGDENG

SEQ ID NO: 31332 - protein, 31 aa, Artificial Sequence
  Description of Artificial Sequence: Synthetic polypeptide
AEEEIRTTNPVATEQYGSVVSTNLNLQGNNE

SEQ ID NO: 31333 - protein, 30 aa, Artificial Sequence
  Description of Artificial Sequence: Synthetic polypeptide
QEEEICTTNPVATEQYGNVSVTMLQGGPNR

SEQ ID NO: 31334 - protein, 29 aa, Artificial Sequence
  Description of Artificial Sequence: Synthetic peptide
DEEEIRTTNPCATEGYGSCSSNLARFGNQ

SEQ ID NO: 31335 - protein, 29 aa, Artificial Sequence
  Description of Artificial Sequence: Synthetic peptide
QEEEICTTNPVATEQYGSVAITNLERGVT

SEQ ID NO: 31336 - protein, 28 aa, Artificial Sequence
  Description of Artificial Sequence: Synthetic peptide
DEEEIRTTNPCATEGYGVCSTNLNGGNH

SEQ ID NO: 31337 - protein, 29 aa, Artificial Sequence
  Description of Artificial Sequence: Synthetic peptide
DEEEIRTTNPCATEMYGSVATNHGRAGNA

SEQ ID NO: 31338 - protein, 31 aa, Artificial Sequence
  Description of Artificial Sequence: Synthetic polypeptide
QEEEICTTNPVATEQYGSVATNLQRPGDERE

SEQ ID NO: 31339 - protein, 30 aa, Artificial Sequence
  Description of Artificial Sequence: Synthetic polypeptide
QEEEICTTNPVATEQYGSVATNLQRQNTEM

SEQ ID NO: 31340 - protein, 30 aa, Artificial Sequence
  Description of Artificial Sequence: Synthetic polypeptide
QEEEICTTNPVATEQYGSVATNLQRVNDLA

SEQ ID NO: 31341 - protein, 30 aa, Artificial Sequence
  Description of Artificial Sequence: Synthetic polypeptide
QEEEICTTNPVATEQYGSVATNLQRVNNND

SEQ ID NO: 31342 - protein, 30 aa, Artificial Sequence
  Description of Artificial Sequence: Synthetic polypeptide
QEEEICTTNPVATEQYGSVATNLQSDGNMN

SEQ ID NO: 31343 - protein, 30 aa, Artificial Sequence
  Description of Artificial Sequence: Synthetic polypeptide
QEEEICTTNPVATEQYGSVATNLQSGNLEE

SEQ ID NO: 31344 - protein, 31 aa, Artificial Sequence
  Description of Artificial Sequence: Synthetic polypeptide
QEEEICTTNPVATEQYGSVATNLQQDGNIRM

SEQ ID NO: 31345 - protein, 31 aa, Artificial Sequence
  Description of Artificial Sequence: Synthetic polypeptide
AEEEIRTTNPVATEQYGSVTTTNLQENGGND

SEQ ID NO: 31346 - protein, 29 aa, Artificial Sequence
  Description of Artificial Sequence: Synthetic peptide
QEEEICTTNPVATEQYGSVATNNQREGPQ

SEQ ID NO: 31347 - protein, 29 aa, Artificial Sequence
  Description of Artificial Sequence: Synthetic peptide
AEEEIRTTNPVATEQYGSVTTNMQTMVLR

SEQ ID NO: 31348 - protein, 31 aa, Artificial Sequence
  Description of Artificial Sequence: Synthetic polypeptide
AEEEIRTTNPVATEQYGSVTTNLQQQNGNSE

SEQ ID NO: 31349 - protein, 29 aa, Artificial Sequence
  Description of Artificial Sequence: Synthetic peptide
AEEEIRTTNPVATEQYGSVTTGLQRTSVY

SEQ ID NO: 31350 - protein, 31 aa, Artificial Sequence
  Description of Artificial Sequence: Synthetic polypeptide
AEEEIRTTNPVATEQYGSVTSTNNNQNDGNL

SEQ ID NO: 31351 - protein, 31 aa, Artificial Sequence
  Description of Artificial Sequence: Synthetic polypeptide
AEEEIRTTNPVATEQYGSVTSTNLQQQNNNN

SEQ ID NO: 31352 - protein, 31 aa, Artificial Sequence
  Description of Artificial Sequence: Synthetic polypeptide
AEEEIRTTNPVATEQYGSVTSTNLQNQNNNM

SEQ ID NO: 31353 - protein, 32 aa, Artificial Sequence
  Description of Artificial Sequence: Synthetic polypeptide
AEEEIRTTNPVATEQYGSVTSTNLQNQENGNV

SEQ ID NO: 31354 - protein, 31 aa, Artificial Sequence
  Description of Artificial Sequence: Synthetic polypeptide
AEEEIRTTNPVATEQYGSVTTSTNNQEEGNS

SEQ ID NO: 31355 - protein, 30 aa, Artificial Sequence
  Description of Artificial Sequence: Synthetic polypeptide
QEEEICTTNPVATEQYGSVATNLQQDGNFF

SEQ ID NO: 31356 - protein, 30 aa, Artificial Sequence
  Description of Artificial Sequence: Synthetic polypeptide
DEEEIRTTNPCATEGYGSVCSTWNDERGNW

SEQ ID NO: 31357 - protein, 30 aa, Artificial Sequence
  Description of Artificial Sequence: Synthetic polypeptide
QEEEICTTNPVATEQYGSVATNLQNDGNTV

SEQ ID NO: 31358 - protein, 32 aa, Artificial Sequence
  Description of Artificial Sequence: Synthetic polypeptide
QEEEICTTNPVATEQYGSVASATNLSRGGGNR

SEQ ID NO: 31359 - protein, 29 aa, Artificial Sequence
  Description of Artificial Sequence: Synthetic peptide
DEEEIRTTNPCATEGYGSCSTNLAYGNQG

SEQ ID NO: 31360 - protein, 29 aa, Artificial Sequence
  Description of Artificial Sequence: Synthetic peptide
DEEEIRTTNPCATEGYGSCSTNLPGNGNH

SEQ ID NO: 31361 - protein, 30 aa, Artificial Sequence
  Description of Artificial Sequence: Synthetic polypeptide
QEEEICTTNPVATEQYGSVATNLDQEGNGV

SEQ ID NO: 31362 - protein, 30 aa, Artificial Sequence
  Description of Artificial Sequence: Synthetic polypeptide
DEEEIRTTNPCATEGYGSCSTNLSARTGNP

SEQ ID NO: 31363 - protein, 30 aa, Artificial Sequence
  Description of Artificial Sequence: Synthetic polypeptide
QEEEICTTNPVATEQYGSVATNLQAGNNPL

SEQ ID NO: 31364 - protein, 31 aa, Artificial Sequence
  Description of Artificial Sequence: Synthetic polypeptide
QEEEICTTNPVATEQYGSVATNLQDDGNNRD

SEQ ID NO: 31365 - protein, 29 aa, Artificial Sequence
  Description of Artificial Sequence: Synthetic peptide
DEEEIRTTNPCATEGYGSCSWNLARGNQS

SEQ ID NO: 31366 - protein, 31 aa, Artificial Sequence
  Description of Artificial Sequence: Synthetic polypeptide
QEEEICTTNPVATEQYGSVATNLQEAGVNDR

SEQ ID NO: 31367 - protein, 30 aa, Artificial Sequence
  Description of Artificial Sequence: Synthetic polypeptide
QEEEICTTNPVATEQYGSVATNLQEVGNEQ

SEQ ID NO: 31368 - protein, 29 aa, Artificial Sequence
  Description of Artificial Sequence: Synthetic peptide
QEEEICTTNPVATEQYGSVATNLQEVNQD

SEQ ID NO: 31369 - protein, 29 aa, Artificial Sequence
  Description of Artificial Sequence: Synthetic peptide
DEEEIRTTNPCATEGYGSVATNDGRGNAL

SEQ ID NO: 31370 - protein, 30 aa, Artificial Sequence
  Description of Artificial Sequence: Synthetic polypeptide
QEEEICTTNPVATEQYGSVATNLQGNGNTL

SEQ ID NO: 31371 - protein, 30 aa, Artificial Sequence
  Description of Artificial Sequence: Synthetic polypeptide
QEEEICTTNPVATEQYGSVATNLQGVGERN

SEQ ID NO: 31372 - protein, 29 aa, Artificial Sequence
  Description of Artificial Sequence: Synthetic peptide
QEEEICTTNPVATEQYGSVATNLQHDNHE

SEQ ID NO: 31373 - protein, 30 aa, Artificial Sequence
  Description of Artificial Sequence: Synthetic polypeptide
QEEEICTTNPVATEQYGSVATNLQHGENED

SEQ ID NO: 31374 - protein, 30 aa, Artificial Sequence
  Description of Artificial Sequence: Synthetic polypeptide
QEEEICTTNPVATEQYGSVATNLQHGNETL

SEQ ID NO: 31375 - protein, 29 aa, Artificial Sequence
  Description of Artificial Sequence: Synthetic peptide
QEEEICTTNPVATEQYGSVATNLQMPNPL

SEQ ID NO: 31376 - protein, 30 aa, Artificial Sequence
  Description of Artificial Sequence: Synthetic polypeptide
DEEEIRTTNPCATEGYGSVCSTNLDAGGNW

SEQ ID NO: 31377 - protein, 29 aa, Artificial Sequence
  Description of Artificial Sequence: Synthetic peptide
AEEEIRTTNPVATEQYGSVVSTPPQHGTM

SEQ ID NO: 31378 - protein, 31 aa, Artificial Sequence
  Description of Artificial Sequence: Synthetic polypeptide
AEEEIRTTNPVATEQYGSVTSTNLQNNENNE

SEQ ID NO: 31379 - protein, 31 aa, Artificial Sequence
  Description of Artificial Sequence: Synthetic polypeptide
AEEEIRTTNPVATEQYGSVVSTTNLQENNAE

SEQ ID NO: 31380 - protein, 32 aa, Artificial Sequence
  Description of Artificial Sequence: Synthetic polypeptide
AEEEIRTTNPVATEQYGSVVSTTNLQNGNNNA

SEQ ID NO: 31381 - protein, 30 aa, Artificial Sequence
  Description of Artificial Sequence: Synthetic polypeptide
QEEEIATTNPVATEQYGSVATNLQRQNDAL

SEQ ID NO: 31382 - protein, 30 aa, Artificial Sequence
  Description of Artificial Sequence: Synthetic polypeptide
QEEEIATTNPVATEQYGSVATNLQTDGNDQ

SEQ ID NO: 31383 - protein, 32 aa, Artificial Sequence
  Description of Artificial Sequence: Synthetic polypeptide
DEEEIRTTNPVATEQYGISVACTRLSQRVGER

SEQ ID NO: 31384 - protein, 34 aa, Artificial Sequence
  Description of Artificial Sequence: Synthetic polypeptide
DEEEIRTTNPVATEQYGISTVSTNLSQPSGANRF

SEQ ID NO: 31385 - protein, 32 aa, Artificial Sequence
  Description of Artificial Sequence: Synthetic polypeptide
DEEEIRTTNPVATEQYGICVSDTNLQNFGSNQ

SEQ ID NO: 31386 - protein, 30 aa, Artificial Sequence
  Description of Artificial Sequence: Synthetic polypeptide
QEEEIATTNPVATEQYGSVSANLQDNNGNQ

SEQ ID NO: 31387 - protein, 30 aa, Artificial Sequence
  Description of Artificial Sequence: Synthetic polypeptide
QEEEIATTNPVATEQYGSVSANLQEAGNDF

SEQ ID NO: 31388 - protein, 30 aa, Artificial Sequence
  Description of Artificial Sequence: Synthetic polypeptide
QEEEIATTNPVATEQYGSVSANLQEAGNEE

SEQ ID NO: 31389 - protein, 33 aa, Artificial Sequence
  Description of Artificial Sequence: Synthetic polypeptide
DEEEIRTTNPVATEQYGISVCSTTNLQNGNGAS

SEQ ID NO: 31390 - protein, 31 aa, Artificial Sequence
  Description of Artificial Sequence: Synthetic polypeptide
QEEEIATTNPVATEQYGSVSANLQEREGNDG

SEQ ID NO: 31391 - protein, 30 aa, Artificial Sequence
  Description of Artificial Sequence: Synthetic polypeptide
QEEEIATTNPVATEQYGSVSANLQREVNDH

SEQ ID NO: 31392 - protein, 30 aa, Artificial Sequence
  Description of Artificial Sequence: Synthetic polypeptide
QEEEIATTNPVATEQYGSVSANPQREGNDS

SEQ ID NO: 31393 - protein, 30 aa, Artificial Sequence
  Description of Artificial Sequence: Synthetic polypeptide
QEEEIATTNPVATEQYGSVSANTQENGENR

SEQ ID NO: 31394 - protein, 31 aa, Artificial Sequence
  Description of Artificial Sequence: Synthetic polypeptide
QEEEIATTNPVATEQYGSVSPTNLQEAGNDQ

SEQ ID NO: 31395 - protein, 31 aa, Artificial Sequence
  Description of Artificial Sequence: Synthetic polypeptide
QEEEIATTNPVATEQYGSVSTNLQDGPNEDM

SEQ ID NO: 31396 - protein, 31 aa, Artificial Sequence
  Description of Artificial Sequence: Synthetic polypeptide
QEEEIATTNPVATEQYGSVSTNLQENNGNEQ

SEQ ID NO: 31397 - protein, 30 aa, Artificial Sequence
  Description of Artificial Sequence: Synthetic polypeptide
QEEEIATTNPVATEQYGSVSTNLQGGQPED

SEQ ID NO: 31398 - protein, 30 aa, Artificial Sequence
  Description of Artificial Sequence: Synthetic polypeptide
AEEEIRTTNPVATEQYGSVVTTNLQQQNTN

SEQ ID NO: 31399 - protein, 31 aa, Artificial Sequence
  Description of Artificial Sequence: Synthetic polypeptide
QEEEIATTNPVATEQYGSVSANLQREGNESQ

SEQ ID NO: 31400 - protein, 30 aa, Artificial Sequence
  Description of Artificial Sequence: Synthetic polypeptide
AEEEIRTTNPVATEQYGSVVTTNLQQANNA

SEQ ID NO: 31401 - protein, 30 aa, Artificial Sequence
  Description of Artificial Sequence: Synthetic polypeptide
QEEEIATTNPVATEQYGSVATNLQRNANME

SEQ ID NO: 31402 - protein, 29 aa, Artificial Sequence
  Description of Artificial Sequence: Synthetic peptide
QEEEIATTNPVATEQYGSVATNLQNNSNE

SEQ ID NO: 31403 - protein, 28 aa, Artificial Sequence
  Description of Artificial Sequence: Synthetic peptide
QEEEIATTNPVATEQYGEASEVLQRGER

SEQ ID NO: 31404 - protein, 28 aa, Artificial Sequence
  Description of Artificial Sequence: Synthetic peptide
QEEEIATTNPVATEQYGSVAANLQDVNM

SEQ ID NO: 31405 - protein, 30 aa, Artificial Sequence
  Description of Artificial Sequence: Synthetic polypeptide
DEEEIRTTNPCATEAYGSVCSTNLAGGNTS

SEQ ID NO: 31406 - protein, 28 aa, Artificial Sequence
  Description of Artificial Sequence: Synthetic peptide
DEEEIRTTNPCATEAYGSVQTNDGQGNA

SEQ ID NO: 31407 - protein, 32 aa, Artificial Sequence
  Description of Artificial Sequence: Synthetic polypeptide
DEEEIRTTNPVATEQYGIVNSTNLQQRGTQSE

SEQ ID NO: 31408 - protein, 31 aa, Artificial Sequence
  Description of Artificial Sequence: Synthetic polypeptide
DEEEIRTTNPVATEQYGIVGSTDNLQQENGE

SEQ ID NO: 31409 - protein, 29 aa, Artificial Sequence
  Description of Artificial Sequence: Synthetic peptide
QEEEIATTNPVATEQYGSVAMNDQQGENR

SEQ ID NO: 31410 - protein, 28 aa, Artificial Sequence
  Description of Artificial Sequence: Synthetic peptide
QEEEIATTNPVATEQYGSVATALANGER

SEQ ID NO: 31411 - protein, 33 aa, Artificial Sequence
  Description of Artificial Sequence: Synthetic polypeptide
DEEEIRTTNPVATEQYGISVPSENLSQRGGNNQ

SEQ ID NO: 31412 - protein, 32 aa, Artificial Sequence
  Description of Artificial Sequence: Synthetic polypeptide
AEEEIRTTNPVATEQYGSVVTTTNNLQGGNQR

SEQ ID NO: 31413 - protein, 28 aa, Artificial Sequence
  Description of Artificial Sequence: Synthetic peptide
QEEEIATTNPVATEQYGSVATNLERPDD

SEQ ID NO: 31414 - protein, 30 aa, Artificial Sequence
  Description of Artificial Sequence: Synthetic polypeptide
QEEEIATTNPVATEQYGSVATNLNERGDND

SEQ ID NO: 31415 - protein, 31 aa, Artificial Sequence
  Description of Artificial Sequence: Synthetic polypeptide
DEEEIRTTNPCATEAYGSVTSTNLQAGTNTM

SEQ ID NO: 31416 - protein, 34 aa, Artificial Sequence
  Description of Artificial Sequence: Synthetic polypeptide
DEEEIRTTNPVATEQYGISVVHCTNELSQRGNNR

SEQ ID NO: 31417 - protein, 31 aa, Artificial Sequence
  Description of Artificial Sequence: Synthetic polypeptide
AEEEIRTTNPVATEQYGSVVTTTNLQDGNVS

SEQ ID NO: 31418 - protein, 31 aa, Artificial Sequence
  Description of Artificial Sequence: Synthetic polypeptide
QEEEIATTNPVATEQYGSVATNLQAVGDNRE

SEQ ID NO: 31419 - protein, 31 aa, Artificial Sequence
  Description of Artificial Sequence: Synthetic polypeptide
DEEEIRTTNPCATEAYGSVTSVTNLQAGNNT

SEQ ID NO: 31420 - protein, 30 aa, Artificial Sequence
  Description of Artificial Sequence: Synthetic polypeptide
QEEEIATTNPVATEQYGSVATNLQNDGNFQ

SEQ ID NO: 31421 - protein, 30 aa, Artificial Sequence
  Description of Artificial Sequence: Synthetic polypeptide
DEEEIRTTNPCATEAYGSVTSTNLEQGTNP

SEQ ID NO: 31422 - protein, 31 aa, Artificial Sequence
  Description of Artificial Sequence: Synthetic polypeptide
AEEEIRTTNPVATEQYGSVVTTNLQNGNNED

SEQ ID NO: 31423 - protein, 30 aa, Artificial Sequence
  Description of Artificial Sequence: Synthetic polypeptide
AEEEIRTTNPVATEQYGSVVTTNLQNGDGE

SEQ ID NO: 31424 - protein, 31 aa, Artificial Sequence
  Description of Artificial Sequence: Synthetic polypeptide
AEEEIRTTNPVATEQYGSVVTTNLQLGGNLT

SEQ ID NO: 31425 - protein, 31 aa, Artificial Sequence
  Description of Artificial Sequence: Synthetic polypeptide
AEEEIRTTNPVATEQYGSVVTNQLQQEGGNI

SEQ ID NO: 31426 - protein, 34 aa, Artificial Sequence
  Description of Artificial Sequence: Synthetic polypeptide
DEEEIRTTNPVATEQYGFTVSMTENLSQERIGNR

SEQ ID NO: 31427 - protein, 29 aa, Artificial Sequence
  Description of Artificial Sequence: Synthetic peptide
DEEEIRTTNPCATEEYGSVATNDGQQGNA

SEQ ID NO: 31428 - protein, 31 aa, Artificial Sequence
  Description of Artificial Sequence: Synthetic polypeptide
AEEEIRTTNPVATEQYGSVVTNLQPGNNVTI

SEQ ID NO: 31429 - protein, 28 aa, Artificial Sequence
  Description of Artificial Sequence: Synthetic peptide
DEEEIRTTNPCATEEYGSVATNDGYGNE

SEQ ID NO: 31430 - protein, 31 aa, Artificial Sequence
  Description of Artificial Sequence: Synthetic polypeptide
AEEEIRTTNPVATEQYGSVVTNLQNGSNVII

SEQ ID NO: 31431 - protein, 31 aa, Artificial Sequence
  Description of Artificial Sequence: Synthetic polypeptide
QEEEIATTNPVGTEQYGSICSTINLQMRGNR

SEQ ID NO: 31432 - protein, 29 aa, Artificial Sequence
  Description of Artificial Sequence: Synthetic peptide
DEEEIRTTNPCATEEYGSVATNEGGRGNA

SEQ ID NO: 31433 - protein, 29 aa, Artificial Sequence
  Description of Artificial Sequence: Synthetic peptide
AEEEIRTTNPVATEQYGSVVTNQQNVNVD

SEQ ID NO: 31434 - protein, 28 aa, Artificial Sequence
  Description of Artificial Sequence: Synthetic peptide
DEEEIRTTNPCATEEYGSVATNGGTGND

SEQ ID NO: 31435 - protein, 29 aa, Artificial Sequence
  Description of Artificial Sequence: Synthetic peptide
DEEEIRTTNPCATEEYGSVATNHGRGNAG

SEQ ID NO: 31436 - protein, 31 aa, Artificial Sequence
  Description of Artificial Sequence: Synthetic polypeptide
AEEEIRTTNPVATEQYGSVVTANLNQQEGNV

SEQ ID NO: 31437 - protein, 29 aa, Artificial Sequence
  Description of Artificial Sequence: Synthetic peptide
DEEEIRTTNPCATEEYGSVATNHGRSGNA

SEQ ID NO: 31438 - protein, 29 aa, Artificial Sequence
  Description of Artificial Sequence: Synthetic peptide
DEEEIRTTNPCATEEYGSVATNHSGRGNV

SEQ ID NO: 31439 - protein, 31 aa, Artificial Sequence
  Description of Artificial Sequence: Synthetic polypeptide
AEEEIRTTNPVATEQYGSVVTANLNQDGNNG

SEQ ID NO: 31440 - protein, 31 aa, Artificial Sequence
  Description of Artificial Sequence: Synthetic polypeptide
AEEEIRTTNPVATEQYGSVVTANLGNQIGNL

SEQ ID NO: 31441 - protein, 28 aa, Artificial Sequence
  Description of Artificial Sequence: Synthetic peptide
DEEEIRTTNPCATEEYGSVATNQGEGNA

SEQ ID NO: 31442 - protein, 32 aa, Artificial Sequence
  Description of Artificial Sequence: Synthetic polypeptide
AEEEIRTTNPVATEQYGSVVSVTNNLQNGNNA

SEQ ID NO: 31443 - protein, 28 aa, Artificial Sequence
  Description of Artificial Sequence: Synthetic peptide
DEEEIRTTNPCATEEYGSVATNGNGGNA

SEQ ID NO: 31444 - protein, 28 aa, Artificial Sequence
  Description of Artificial Sequence: Synthetic peptide
DEEEIRTTNPCATEEYGKVATNHGRGNM

SEQ ID NO: 31445 - protein, 30 aa, Artificial Sequence
  Description of Artificial Sequence: Synthetic polypeptide
AEEEIRTTNPVATEQYGSVVTNTNLGIGND

SEQ ID NO: 31446 - protein, 29 aa, Artificial Sequence
  Description of Artificial Sequence: Synthetic peptide
QEEEIATTNPVAYEQYGSVSTNDQNNGNQ

SEQ ID NO: 31447 - protein, 28 aa, Artificial Sequence
  Description of Artificial Sequence: Synthetic peptide
DEEEIRTTNPCATECWGSCSTNDARGNA

SEQ ID NO: 31448 - protein, 31 aa, Artificial Sequence
  Description of Artificial Sequence: Synthetic polypeptide
AEEEIRTTNPVATEQYGSVVTTNLQAGANNE

SEQ ID NO: 31449 - protein, 29 aa, Artificial Sequence
  Description of Artificial Sequence: Synthetic peptide
DEEEIRTTNPCATECYGSCSTNLAGQGNA

SEQ ID NO: 31450 - protein, 32 aa, Artificial Sequence
  Description of Artificial Sequence: Synthetic polypeptide
DEEEIRTTNPVATEQYGHVSPTNLNRPGMNVE

SEQ ID NO: 31451 - protein, 31 aa, Artificial Sequence
  Description of Artificial Sequence: Synthetic polypeptide
QEEEIATTNPVATEQYGSVSVNLQREGNDTA

SEQ ID NO: 31452 - protein, 28 aa, Artificial Sequence
  Description of Artificial Sequence: Synthetic peptide
QEEEIATTNPVATEQYGVVPDNLQHGNK

SEQ ID NO: 31453 - protein, 30 aa, Artificial Sequence
  Description of Artificial Sequence: Synthetic polypeptide
AEEEIRTTNPVATEQYGSVVTTNLGEEGNG

SEQ ID NO: 31454 - protein, 31 aa, Artificial Sequence
  Description of Artificial Sequence: Synthetic polypeptide
AEEEIRTTNPVATEQYGSVVTTNLEQGGNLE

SEQ ID NO: 31455 - protein, 28 aa, Artificial Sequence
  Description of Artificial Sequence: Synthetic peptide
QEEEIATTNPVATEQYGVVPENLQSGNQ

SEQ ID NO: 31456 - protein, 30 aa, Artificial Sequence
  Description of Artificial Sequence: Synthetic polypeptide
AEEEIRTTNPVATEQYGSVVTTNDNQQGNE

SEQ ID NO: 31457 - protein, 29 aa, Artificial Sequence
  Description of Artificial Sequence: Synthetic peptide
QEEEIATTNPVATESYGSVATNLQQGDRQ

SEQ ID NO: 31458 - protein, 30 aa, Artificial Sequence
  Description of Artificial Sequence: Synthetic polypeptide
QEEEIATTNPVATETYGSVSTNLQDGNDLH

SEQ ID NO: 31459 - protein, 32 aa, Artificial Sequence
  Description of Artificial Sequence: Synthetic polypeptide
AEEEIRTTNPVATEQYGSVVTSVTNLQQGNSA

SEQ ID NO: 31460 - protein, 32 aa, Artificial Sequence
  Description of Artificial Sequence: Synthetic polypeptide
AEEEIRTTNPVATEQYGSVVTSTTNLQNGNNA

SEQ ID NO: 31461 - protein, 31 aa, Artificial Sequence
  Description of Artificial Sequence: Synthetic polypeptide
DEEEIRTTNPVATEQYGHCVAATNLQENNPR

SEQ ID NO: 31462 - protein, 31 aa, Artificial Sequence
  Description of Artificial Sequence: Synthetic polypeptide
AEEEIRTTNPVATEQYGSVVTSTNNQSGNGT

SEQ ID NO: 31463 - protein, 29 aa, Artificial Sequence
  Description of Artificial Sequence: Synthetic peptide
QEEEIATTNPVAYEPYGSVSTNLQQGDDR

SEQ ID NO: 31464 - protein, 32 aa, Artificial Sequence
  Description of Artificial Sequence: Synthetic polypeptide
AEEEIRTTNPVATEQYGSVVTSTNLQGNGNGE

SEQ ID NO: 31465 - protein, 29 aa, Artificial Sequence
  Description of Artificial Sequence: Synthetic peptide
QEEEIATTNPVAYEQYGSVATNLQNGDNE

SEQ ID NO: 31466 - protein, 32 aa, Artificial Sequence
  Description of Artificial Sequence: Synthetic polypeptide
AEEEIRTTNPVATEQYGSVVSTTNLQNGNNAT

SEQ ID NO: 31467 - protein, 30 aa, Artificial Sequence
  Description of Artificial Sequence: Synthetic polypeptide
SEAEIRTTNPVATEQYGSVATNLQRNPNED

SEQ ID NO: 31468 - protein, 30 aa, Artificial Sequence
  Description of Artificial Sequence: Synthetic polypeptide
QEEEICTTNPVATEQYGSVSANLQDNDNRE

SEQ ID NO: 31469 - protein, 29 aa, Artificial Sequence
  Description of Artificial Sequence: Synthetic peptide
QEEEICTTNPVATEQYGSVSANLQNDNEQ

SEQ ID NO: 31470 - protein, 30 aa, Artificial Sequence
  Description of Artificial Sequence: Synthetic polypeptide
AEEEIRTTNPVATEQYGSVSVTTDQGNGNQ

SEQ ID NO: 31471 - protein, 30 aa, Artificial Sequence
  Description of Artificial Sequence: Synthetic polypeptide
QEEEIRTTNPVATEQYGSVSAINLDEAGNS

SEQ ID NO: 31472 - protein, 31 aa, Artificial Sequence
  Description of Artificial Sequence: Synthetic polypeptide
AEEEIRTTNPVATEQYGSVSVTSNQQQTGNQ

SEQ ID NO: 31473 - protein, 31 aa, Artificial Sequence
  Description of Artificial Sequence: Synthetic polypeptide
AEEEIRTTNPVATEQYGSVSVTSNQQAGNED

SEQ ID NO: 31474 - protein, 32 aa, Artificial Sequence
  Description of Artificial Sequence: Synthetic polypeptide
AEEEIRTTNPVATEQYGSVSVTSNQLQNGNNN

SEQ ID NO: 31475 - protein, 32 aa, Artificial Sequence
  Description of Artificial Sequence: Synthetic polypeptide
DEEEIRTTNPVATEQYGDVSTNLQGSGVNGET

SEQ ID NO: 31476 - protein, 32 aa, Artificial Sequence
  Description of Artificial Sequence: Synthetic polypeptide
AEEEIRTTNPVATEQYGSVSVTSNLQQNDGNQ

SEQ ID NO: 31477 - protein, 31 aa, Artificial Sequence
  Description of Artificial Sequence: Synthetic polypeptide
AEEEIRTTNPVATEQYGSVSVTSNLQNVNNV

SEQ ID NO: 31478 - protein, 31 aa, Artificial Sequence
  Description of Artificial Sequence: Synthetic polypeptide
DEEEIRTTNPVATEQYGDVSTNLQQNSEPNE

SEQ ID NO: 31479 - protein, 32 aa, Artificial Sequence
  Description of Artificial Sequence: Synthetic polypeptide
AEEEIRTTNPVATEQYGSVSVTSNLQNGGNNG

SEQ ID NO: 31480 - protein, 32 aa, Artificial Sequence
  Description of Artificial Sequence: Synthetic polypeptide
AEEEIRTTNPVATEQYGSVSVTSNLQNDGNEA

SEQ ID NO: 31481 - protein, 31 aa, Artificial Sequence
  Description of Artificial Sequence: Synthetic polypeptide
QEEEIRTTNPVATEQYGSVSAWNLSDENGNR

SEQ ID NO: 31482 - protein, 29 aa, Artificial Sequence
  Description of Artificial Sequence: Synthetic peptide
QEEEIRTTNPVATEQYGSVSEACPNRGNV

SEQ ID NO: 31483 - protein, 31 aa, Artificial Sequence
  Description of Artificial Sequence: Synthetic polypeptide
AEEEIRTTNPVATEQYGSVSVTSNEQTGNVE

SEQ ID NO: 31484 - protein, 31 aa, Artificial Sequence
  Description of Artificial Sequence: Synthetic polypeptide
AEEEIRTTNPVATEQYGSVSVTSNEQTGGNE

SEQ ID NO: 31485 - protein, 30 aa, Artificial Sequence
  Description of Artificial Sequence: Synthetic polypeptide
AEEEIRTTNPVATEQYGSVSVTQQQQNGNE

SEQ ID NO: 31486 - protein, 31 aa, Artificial Sequence
  Description of Artificial Sequence: Synthetic polypeptide
AEEEIRTTNPVATEQYGSVSVTQNGQNGNNN

SEQ ID NO: 31487 - protein, 30 aa, Artificial Sequence
  Description of Artificial Sequence: Synthetic polypeptide
AEEEIRTTNPVATEQYGSVSVTQGQGGNQG

SEQ ID NO: 31488 - protein, 32 aa, Artificial Sequence
  Description of Artificial Sequence: Synthetic polypeptide
AEEEIRTTNPVATEQYGSVSVTSNLQNDTGNS

SEQ ID NO: 31489 - protein, 32 aa, Artificial Sequence
  Description of Artificial Sequence: Synthetic polypeptide
DEEEIRTTNPVATEQYGDVSTNLPQFEIGGNG

SEQ ID NO: 31490 - protein, 30 aa, Artificial Sequence
  Description of Artificial Sequence: Synthetic polypeptide
AEEEIRTTNPVATEQYGSVSVTTGVQGGNM

SEQ ID NO: 31491 - protein, 31 aa, Artificial Sequence
  Description of Artificial Sequence: Synthetic polypeptide
AEEEIRTTNPVATEQYGSVSVTTNGQVGNNM

SEQ ID NO: 31492 - protein, 31 aa, Artificial Sequence
  Description of Artificial Sequence: Synthetic polypeptide
DEEEIRTTNPCATEQYGCVCQTNLQRFGNNA

SEQ ID NO: 31493 - protein, 30 aa, Artificial Sequence
  Description of Artificial Sequence: Synthetic polypeptide
DEEEIRTTNPCATEQYGCVCQTNLQYGNTA

SEQ ID NO: 31494 - protein, 32 aa, Artificial Sequence
  Description of Artificial Sequence: Synthetic polypeptide
DEEEIRTTNPVATEQYGDVSTPNLIQGGNGQQ

SEQ ID NO: 31495 - protein, 31 aa, Artificial Sequence
  Description of Artificial Sequence: Synthetic polypeptide
QEEEIRTTNPVATEQYGSVATNLQEAGNENQ

SEQ ID NO: 31496 - protein, 32 aa, Artificial Sequence
  Description of Artificial Sequence: Synthetic polypeptide
AEEEIRTTNPVATEQYGSVSVTTNLQNQNNIR

SEQ ID NO: 31497 - protein, 31 aa, Artificial Sequence
  Description of Artificial Sequence: Synthetic polypeptide
AEEEIRTTNPVATEQYGSVSVTTNLQNGDGE

SEQ ID NO: 31498 - protein, 31 aa, Artificial Sequence
  Description of Artificial Sequence: Synthetic polypeptide
AEEEIRTTNPVATEQYGSVSVTTNLQMGESE

SEQ ID NO: 31499 - protein, 32 aa, Artificial Sequence
  Description of Artificial Sequence: Synthetic polypeptide
AEEEIRTTNPVATEQYGSVSVTTNLQLGGNQS

SEQ ID NO: 31500 - protein, 31 aa, Artificial Sequence
  Description of Artificial Sequence: Synthetic polypeptide
AEEEIRTTNPVATEQYGSVSVTTLQQSGINE

SEQ ID NO: 31501 - protein, 32 aa, Artificial Sequence
  Description of Artificial Sequence: Synthetic polypeptide
AEEEIRTTNPVATEQYGSVSVTTNLQGDGINE

SEQ ID NO: 31502 - protein, 31 aa, Artificial Sequence
  Description of Artificial Sequence: Synthetic polypeptide
AEEEIRTTNPVATEQYGSVSVTTNLNYGGNI

SEQ ID NO: 31503 - protein, 30 aa, Artificial Sequence
  Description of Artificial Sequence: Synthetic polypeptide
QEEEIRTTNPVATEQYGSVATNLQRNPDGS

SEQ ID NO: 31504 - protein, 31 aa, Artificial Sequence
  Description of Artificial Sequence: Synthetic polypeptide
QEEEIRTTNPVATEQYGSVATNLQVPGNTEE

SEQ ID NO: 31505 - protein, 29 aa, Artificial Sequence
  Description of Artificial Sequence: Synthetic peptide
QEEEIRTTNPVATEQYGSVATNLTDGDDS

SEQ ID NO: 31506 - protein, 32 aa, Artificial Sequence
  Description of Artificial Sequence: Synthetic polypeptide
QEEEIRTTNPVATEQYGSVATSNLEQRAENIR

SEQ ID NO: 31507 - protein, 29 aa, Artificial Sequence
  Description of Artificial Sequence: Synthetic peptide
QEEEIRTTNPVATEQYGSVAYTALQNGFD

SEQ ID NO: 31508 - protein, 32 aa, Artificial Sequence
  Description of Artificial Sequence: Synthetic polypeptide
DEEEIRTTNPVATEQYGDVSTNNLQQEMGNND

SEQ ID NO: 31509 - protein, 32 aa, Artificial Sequence
  Description of Artificial Sequence: Synthetic polypeptide
QEEEIRTTNPVATEQYGSVETSNLVQRNENER

SEQ ID NO: 31510 - protein, 32 aa, Artificial Sequence
  Description of Artificial Sequence: Synthetic polypeptide
AEEEIRTTNPVATEQYGSVSVTTNLQFNGNNT

SEQ ID NO: 31511 - protein, 31 aa, Artificial Sequence
  Description of Artificial Sequence: Synthetic polypeptide
DEEEIRTTNPVATEQYGDVSTNLFEMGENNG

SEQ ID NO: 31512 - protein, 31 aa, Artificial Sequence
  Description of Artificial Sequence: Synthetic polypeptide
AEEEIRTTNPVATEQYGSVSVTNTQQDGGND

SEQ ID NO: 31513 - protein, 31 aa, Artificial Sequence
  Description of Artificial Sequence: Synthetic polypeptide
AEEEIRTTNPVATEQYGSVSVTNTQIYGTNQ

SEQ ID NO: 31514 - protein, 32 aa, Artificial Sequence
  Description of Artificial Sequence: Synthetic polypeptide
AEEEIRTTNPVATEQYGSVSVTNQLQNGNNLD

SEQ ID NO: 31515 - protein, 32 aa, Artificial Sequence
  Description of Artificial Sequence: Synthetic polypeptide
AEEEIRTTNPVATEQYGSVSVTNQLEQQQGNN

SEQ ID NO: 31516 - protein, 32 aa, Artificial Sequence
  Description of Artificial Sequence: Synthetic polypeptide
AEEEIRTTNPVATEQYGSVSVTNQLEQQGNDG

SEQ ID NO: 31517 - protein, 31 aa, Artificial Sequence
  Description of Artificial Sequence: Synthetic polypeptide
AEEEIRTTNPVATEQYGSVSVTNQEQGGNFE

SEQ ID NO: 31518 - protein, 31 aa, Artificial Sequence
  Description of Artificial Sequence: Synthetic polypeptide
DEEEIRTTNPCATEQYGSCHATGNLQRGNID

SEQ ID NO: 31519 - protein, 31 aa, Artificial Sequence
  Description of Artificial Sequence: Synthetic polypeptide
DEEEIRTTNPCATEQYGSCIYTNLQREGNDD

SEQ ID NO: 31520 - protein, 31 aa, Artificial Sequence
  Description of Artificial Sequence: Synthetic polypeptide
AEEEIRTTNPVATEQYGSVSVTNNQQTGNLS

SEQ ID NO: 31521 - protein, 31 aa, Artificial Sequence
  Description of Artificial Sequence: Synthetic polypeptide
AEEEIRTTNPVATEQYGSVSVTNNQQSGINN

SEQ ID NO: 31522 - protein, 32 aa, Artificial Sequence
  Description of Artificial Sequence: Synthetic polypeptide
AEEEIRTTNPVATEQYGSVSVTNQLQNGNNQA

SEQ ID NO: 31523 - protein, 30 aa, Artificial Sequence
  Description of Artificial Sequence: Synthetic polypeptide
AEEEIRTTNPVATEQYGSVSVTNNQQQNNS

SEQ ID NO: 31524 - protein, 31 aa, Artificial Sequence
  Description of Artificial Sequence: Synthetic polypeptide
AEEEIRTTNPVATEQYGSVSVTNNQLAGGNN

SEQ ID NO: 31525 - protein, 30 aa, Artificial Sequence
  Description of Artificial Sequence: Synthetic polypeptide
DEEEIRTTNPCATEQYGSVAATNLQHGDSA

SEQ ID NO: 31526 - protein, 31 aa, Artificial Sequence
  Description of Artificial Sequence: Synthetic polypeptide
DEEEIRTTNPCATEQYGSVAATNLQHGGNDA

SEQ ID NO: 31527 - protein, 32 aa, Artificial Sequence
  Description of Artificial Sequence: Synthetic polypeptide
AEEEIRTTNPVATEQYGSVSVTNNNLQSGNMT

SEQ ID NO: 31528 - protein, 31 aa, Artificial Sequence
  Description of Artificial Sequence: Synthetic polypeptide
DEEEIRTTNPCATEQYGSVAATNLQHGNQAE

SEQ ID NO: 31529 - protein, 32 aa, Artificial Sequence
  Description of Artificial Sequence: Synthetic polypeptide
DEEEIRTTNPCATEQYGSVAATNLQRGDNSAD

SEQ ID NO: 31530 - protein, 28 aa, Artificial Sequence
  Description of Artificial Sequence: Synthetic peptide
QEEEIRTTNPVATESYGCIAINLQMGNR

SEQ ID NO: 31531 - protein, 30 aa, Artificial Sequence
  Description of Artificial Sequence: Synthetic polypeptide
QEEEIRTTNPVATESYGSVSLTNLHGGDQR

SEQ ID NO: 31532 - protein, 32 aa, Artificial Sequence
  Description of Artificial Sequence: Synthetic polypeptide
AEEEIRTTNPVATEQYGSVSVTNNQLQAGNEN

SEQ ID NO: 31533 - protein, 32 aa, Artificial Sequence
  Description of Artificial Sequence: Synthetic polypeptide
AEEEIRTTNPVATEQYGSVSVTNQLQQGANGN

SEQ ID NO: 31534 - protein, 32 aa, Artificial Sequence
  Description of Artificial Sequence: Synthetic polypeptide
AEEEIRTTNPVATEQYGSVSVTNQLQQVGNNI

SEQ ID NO: 31535 - protein, 32 aa, Artificial Sequence
  Description of Artificial Sequence: Synthetic polypeptide
AEEEIRTTNPVATEQYGSVSVTNQLQTTGNDE

SEQ ID NO: 31536 - protein, 31 aa, Artificial Sequence
  Description of Artificial Sequence: Synthetic polypeptide
AEEEIRTTNPVATEQYGSVSVTNTQGNGNQE

SEQ ID NO: 31537 - protein, 31 aa, Artificial Sequence
  Description of Artificial Sequence: Synthetic polypeptide
AEEEIRTTNPVATEQYGSVSVTNTLQNGIQD

SEQ ID NO: 31538 - protein, 32 aa, Artificial Sequence
  Description of Artificial Sequence: Synthetic polypeptide
AEEEIRTTNPVATEQYGSVSVTNTLGQNNGNP

SEQ ID NO: 31539 - protein, 31 aa, Artificial Sequence
  Description of Artificial Sequence: Synthetic polypeptide
AEEEIRTTNPVATEQYGSVSVTNTEQVGNII

SEQ ID NO: 31540 - protein, 31 aa, Artificial Sequence
  Description of Artificial Sequence: Synthetic polypeptide
QEEEIRTTNPVATEQYGSVSEINCPQDRGNK

SEQ ID NO: 31541 - protein, 29 aa, Artificial Sequence
  Description of Artificial Sequence: Synthetic peptide
QEEEIRTTNPVATEQYGSVSEVCPNRGNV

SEQ ID NO: 31542 - protein, 29 aa, Artificial Sequence
  Description of Artificial Sequence: Synthetic peptide
QEEEIRTTNPVATEQYGSVSEVCPQRENG

SEQ ID NO: 31543 - protein, 33 aa, Artificial Sequence
  Description of Artificial Sequence: Synthetic polypeptide
QEEEIRTTNPVATEQYGSVSGTSNLIQRGENMD

SEQ ID NO: 31544 - protein, 32 aa, Artificial Sequence
  Description of Artificial Sequence: Synthetic polypeptide
QEEEIRTTNPVATEQYGSVSGTSNLQDGNGNS

SEQ ID NO: 31545 - protein, 32 aa, Artificial Sequence
  Description of Artificial Sequence: Synthetic polypeptide
DEEEIRTTNPVATEQYGDVSTGNLQQGIGQND

SEQ ID NO: 31546 - protein, 32 aa, Artificial Sequence
  Description of Artificial Sequence: Synthetic polypeptide
DEEEIRTTNPCATEQYGQCVCSTNLQEGGSNR

SEQ ID NO: 31547 - protein, 31 aa, Artificial Sequence
  Description of Artificial Sequence: Synthetic polypeptide
AEEEIRTTNPVATEQYGSVSVTNQQQTGNEE

SEQ ID NO: 31548 - protein, 31 aa, Artificial Sequence
  Description of Artificial Sequence: Synthetic polypeptide
AEEEIRTTNPVATEQYGSVSVTNQQQSGNEF

SEQ ID NO: 31549 - protein, 31 aa, Artificial Sequence
  Description of Artificial Sequence: Synthetic polypeptide
DEEEIRTTNPVATEQYGDVSTDLQGIGNNNL

SEQ ID NO: 31550 - protein, 31 aa, Artificial Sequence
  Description of Artificial Sequence: Synthetic polypeptide
AEEEIRTTNPVATEQYGSVSVTNQQQQIGNV

SEQ ID NO: 31551 - protein, 32 aa, Artificial Sequence
  Description of Artificial Sequence: Synthetic polypeptide
DEEEIRTTNPVATEQYGDVSPTNLNRPGMNED

SEQ ID NO: 31552 - protein, 30 aa, Artificial Sequence
  Description of Artificial Sequence: Synthetic polypeptide
AEEEIRTTNPVATEQYGSVSVTNQQQNGTQ

SEQ ID NO: 31553 - protein, 32 aa, Artificial Sequence
  Description of Artificial Sequence: Synthetic polypeptide
DEEEIRTTNPVATEQYGDVSGTNLQFGGGNNG

SEQ ID NO: 31554 - protein, 30 aa, Artificial Sequence
  Description of Artificial Sequence: Synthetic polypeptide
QEEEIRTTNPVATEQYGSVSTNANTTGTNL

SEQ ID NO: 31555 - protein, 32 aa, Artificial Sequence
  Description of Artificial Sequence: Synthetic polypeptide
AEEEIRTTNPVATEQYGSVSVTTNLQQIGNTN

SEQ ID NO: 31556 - protein, 30 aa, Artificial Sequence
  Description of Artificial Sequence: Synthetic polypeptide
QEEEICTTNPVATEQYGSVSANLQEVGNDE

SEQ ID NO: 31557 - protein, 32 aa, Artificial Sequence
  Description of Artificial Sequence: Synthetic polypeptide
AEEEIRTTNPVATEQYGSVSVTTNLQQLGNNE

SEQ ID NO: 31558 - protein, 32 aa, Artificial Sequence
  Description of Artificial Sequence: Synthetic polypeptide
AEEEIRTTNPVATEQYGSVSVTTNLQQQGNST

SEQ ID NO: 31559 - protein, 31 aa, Artificial Sequence
  Description of Artificial Sequence: Synthetic polypeptide
AEEEIRTTNPVATEQYGSVSVVNNLQAGNQN

SEQ ID NO: 31560 - protein, 30 aa, Artificial Sequence
  Description of Artificial Sequence: Synthetic polypeptide
QEEEICTTNPVAYEQYGSVSTNLQHGNDSD

SEQ ID NO: 31561 - protein, 33 aa, Artificial Sequence
  Description of Artificial Sequence: Synthetic polypeptide
DEEEIRTTNPVATEQYGESVSTNMLQESNSNIR

SEQ ID NO: 31562 - protein, 28 aa, Artificial Sequence
  Description of Artificial Sequence: Synthetic peptide
QEEEIRATNPCATEQYGSVSENLMGGND

SEQ ID NO: 31563 - protein, 30 aa, Artificial Sequence
  Description of Artificial Sequence: Synthetic polypeptide
QEEEIRATNPVATEQYGSVATNLQEAGNSE

SEQ ID NO: 31564 - protein, 31 aa, Artificial Sequence
  Description of Artificial Sequence: Synthetic polypeptide
QEEEIRATNPVATEQYGSVSTNLQHGENDDQ

SEQ ID NO: 31565 - protein, 31 aa, Artificial Sequence
  Description of Artificial Sequence: Synthetic polypeptide
QEEEIRATNPVATEQYGSVSTNLQHGENQEQ

SEQ ID NO: 31566 - protein, 30 aa, Artificial Sequence
  Description of Artificial Sequence: Synthetic polypeptide
AEEEIRTTNPVATEQYGSVSVTVQGQGGNL

SEQ ID NO: 31567 - protein, 29 aa, Artificial Sequence
  Description of Artificial Sequence: Synthetic peptide
QEEEICTTNPVAYEQYGSVATNLQNGNTV

SEQ ID NO: 31568 - protein, 28 aa, Artificial Sequence
  Description of Artificial Sequence: Synthetic peptide
QEEEIRCTNPIATEQYGEVSENLMRGNK

SEQ ID NO: 31569 - protein, 28 aa, Artificial Sequence
  Description of Artificial Sequence: Synthetic peptide
QEEEIRCTNPIATEQYGVVAENLQRGDR

SEQ ID NO: 31570 - protein, 28 aa, Artificial Sequence
  Description of Artificial Sequence: Synthetic peptide
QEEEIRCTNPIATEQYGVVASNLQRGDR

SEQ ID NO: 31571 - protein, 28 aa, Artificial Sequence
  Description of Artificial Sequence: Synthetic peptide
QEEEIRCTNPVATEQYGSASENLMRGEK

SEQ ID NO: 31572 - protein, 32 aa, Artificial Sequence
  Description of Artificial Sequence: Synthetic polypeptide
AEEEIRTTNPVATEQYGSVSVTVNLQSGSNNT

SEQ ID NO: 31573 - protein, 33 aa, Artificial Sequence
  Description of Artificial Sequence: Synthetic polypeptide
DEEEIRTTNPVATEQYGESVLSTPNLNIVGQNR

SEQ ID NO: 31574 - protein, 28 aa, Artificial Sequence
  Description of Artificial Sequence: Synthetic peptide
QEEEIRCTNPVATEQYGSASEVLQRGEK

SEQ ID NO: 31575 - protein, 32 aa, Artificial Sequence
  Description of Artificial Sequence: Synthetic polypeptide
AEEEIRTTNPVATEQYGSVSVTVNLQQGENNL

SEQ ID NO: 31576 - protein, 32 aa, Artificial Sequence
  Description of Artificial Sequence: Synthetic polypeptide
AEEEIRTTNPVATEQYGSVSVTVNLQGAGGNG

SEQ ID NO: 31577 - protein, 30 aa, Artificial Sequence
  Description of Artificial Sequence: Synthetic polypeptide
QEEEIRCTNPIATEQYGSVSEMNLMNRGNR

SEQ ID NO: 31578 - protein, 30 aa, Artificial Sequence
  Description of Artificial Sequence: Synthetic polypeptide
QEEEIRCTNPVATEQYGSVSTNLQPGDTSE

SEQ ID NO: 31579 - protein, 33 aa, Artificial Sequence
  Description of Artificial Sequence: Synthetic polypeptide
DEEEIRTTNPVATEQYGETVPSCTNLSQRGGNL

SEQ ID NO: 31580 - protein, 31 aa, Artificial Sequence
  Description of Artificial Sequence: Synthetic polypeptide
QEEEICTTNPVATEQYGSVSTNLTRGDNEID

SEQ ID NO: 31581 - protein, 31 aa, Artificial Sequence
  Description of Artificial Sequence: Synthetic polypeptide
QEEEICTTNPVATEQYGSVSANLQREGNDTV

SEQ ID NO: 31582 - protein, 30 aa, Artificial Sequence
  Description of Artificial Sequence: Synthetic polypeptide
QEEEICTTNPVATEQYGSVSANLQSGPDRM

SEQ ID NO: 31583 - protein, 30 aa, Artificial Sequence
  Description of Artificial Sequence: Synthetic polypeptide
QEEEICTTNPVATEQYGSVSTGNPDRGNPD

SEQ ID NO: 31584 - protein, 31 aa, Artificial Sequence
  Description of Artificial Sequence: Synthetic polypeptide
QEEEICTTNPVATEQYGSVSTNLDQEGDNEA

SEQ ID NO: 31585 - protein, 30 aa, Artificial Sequence
  Description of Artificial Sequence: Synthetic polypeptide
QEEEICTTNPVATEQYGSVSTNLDRGDGEL

SEQ ID NO: 31586 - protein, 31 aa, Artificial Sequence
  Description of Artificial Sequence: Synthetic polypeptide
QEEEICTTNPVATEQYGSVSTNLDRGDNEKM

SEQ ID NO: 31587 - protein, 31 aa, Artificial Sequence
  Description of Artificial Sequence: Synthetic polypeptide
QEEEICTTNPVATEQYGSVSTNLDRGDNNIA

SEQ ID NO: 31588 - protein, 30 aa, Artificial Sequence
  Description of Artificial Sequence: Synthetic polypeptide
QEEEICTTNPVATEQYGSVSTNLQDLNDTA

SEQ ID NO: 31589 - protein, 33 aa, Artificial Sequence
  Description of Artificial Sequence: Synthetic polypeptide
DEEEIRTTNPVATEQYGETVSCTNGSQRGGNER

SEQ ID NO: 31590 - protein, 30 aa, Artificial Sequence
  Description of Artificial Sequence: Synthetic polypeptide
QEEEICTTNPVATEQYGSVSTNLQENDNEA

SEQ ID NO: 31591 - protein, 30 aa, Artificial Sequence
  Description of Artificial Sequence: Synthetic polypeptide
QEEEICTTNPVATEQYGSVSTNLQQGDEQM

SEQ ID NO: 31592 - protein, 32 aa, Artificial Sequence
  Description of Artificial Sequence: Synthetic polypeptide
AEEEIRTTNPVATEQYGSVSVVTNLQVNGTNI

SEQ ID NO: 31593 - protein, 32 aa, Artificial Sequence
  Description of Artificial Sequence: Synthetic polypeptide
AEEEIRTTNPVATEQYGSVSVVTNLQNIGNTE

SEQ ID NO: 31594 - protein, 32 aa, Artificial Sequence
  Description of Artificial Sequence: Synthetic polypeptide
AEEEIRTTNPVATEQYGSVSVVTNLQNGQNEG

SEQ ID NO: 31595 - protein, 31 aa, Artificial Sequence
  Description of Artificial Sequence: Synthetic polypeptide
AEEEIRTTNPVATEQYGSVSVVTNLDEFGNT

SEQ ID NO: 31596 - protein, 31 aa, Artificial Sequence
  Description of Artificial Sequence: Synthetic polypeptide
QEEEICTTNPVATEQYGSVSTNLQSDGNEMF

SEQ ID NO: 31597 - protein, 30 aa, Artificial Sequence
  Description of Artificial Sequence: Synthetic polypeptide
QEEEICTTNPVATEQYGSVSTNLQTDDNDN

SEQ ID NO: 31598 - protein, 29 aa, Artificial Sequence
  Description of Artificial Sequence: Synthetic peptide
QEEEICTTNPVATEQYGSVSTNLTDGDDM

SEQ ID NO: 31599 - protein, 31 aa, Artificial Sequence
  Description of Artificial Sequence: Synthetic polypeptide
QEEEICTTNPVATEQYGSVSTNLQHGNNMDD

SEQ ID NO: 31600 - protein, 32 aa, Artificial Sequence
  Description of Artificial Sequence: Synthetic polypeptide
AEEEIRTTNPVATEQYGSVSVTVNLLQNGNNG

SEQ ID NO: 31601 - protein, 29 aa, Artificial Sequence
  Description of Artificial Sequence: Synthetic peptide
DEEEIRTTNPCATEPYGSCSTNLAAGNDD

SEQ ID NO: 31602 - protein, 29 aa, Artificial Sequence
  Description of Artificial Sequence: Synthetic peptide
DEEEIRTTNPCATEPYGSCSTNLAAGNNH

SEQ ID NO: 31603 - protein, 32 aa, Artificial Sequence
  Description of Artificial Sequence: Synthetic polypeptide
DEEEIRTTNPVATEQYGDVSWTNLNEVEGMNR

SEQ ID NO: 31604 - protein, 32 aa, Artificial Sequence
  Description of Artificial Sequence: Synthetic polypeptide
DEEEIRTTNPVATEQYGDVSVDTNLNRGMNEG

SEQ ID NO: 31605 - protein, 30 aa, Artificial Sequence
  Description of Artificial Sequence: Synthetic polypeptide
QEEEIRTTNPVATEQYGCVAATNLQDGNTP

SEQ ID NO: 31606 - protein, 29 aa, Artificial Sequence
  Description of Artificial Sequence: Synthetic peptide
QEEEIRTTNPVATEQYGCVATNLQQGDLL

SEQ ID NO: 31607 - protein, 32 aa, Artificial Sequence
  Description of Artificial Sequence: Synthetic polypeptide
DEEEIRTTNPVATEQYGDVSTSNLQVNGGNEL

SEQ ID NO: 31608 - protein, 32 aa, Artificial Sequence
  Description of Artificial Sequence: Synthetic polypeptide
DEEEIRTTNPVATEQYGDVSTSNLQQEFGNGN

SEQ ID NO: 31609 - protein, 30 aa, Artificial Sequence
  Description of Artificial Sequence: Synthetic polypeptide
QEEEIRTTNPVATEQYGHVSAMNLDEFGNR

SEQ ID NO: 31610 - protein, 31 aa, Artificial Sequence
  Description of Artificial Sequence: Synthetic polypeptide
QEEEIRTTNPVATEQYGMVSTNLQQGSSNSD

SEQ ID NO: 31611 - protein, 31 aa, Artificial Sequence
  Description of Artificial Sequence: Synthetic polypeptide
AEEEIRTTNPVATEQYGSVSVTTNQLEAGNN

SEQ ID NO: 31612 - protein, 32 aa, Artificial Sequence
  Description of Artificial Sequence: Synthetic polypeptide
DEEEIRTTNPVATEQYGDVSTSNLQGFEGENG

SEQ ID NO: 31613 - protein, 32 aa, Artificial Sequence
  Description of Artificial Sequence: Synthetic polypeptide
DEEEIRTTNPVATEQYGDVSTQNLQGSGQNNG

SEQ ID NO: 31614 - protein, 28 aa, Artificial Sequence
  Description of Artificial Sequence: Synthetic peptide
QEEEIRTTNPVATEQYGSASEVLQREEK

SEQ ID NO: 31615 - protein, 30 aa, Artificial Sequence
  Description of Artificial Sequence: Synthetic polypeptide
QEEEIRTTNPVATEQYGSCSAGNLDEDGNR

SEQ ID NO: 31616 - protein, 32 aa, Artificial Sequence
  Description of Artificial Sequence: Synthetic polypeptide
AEEEIRTTNPVATEQYGSVSVTTNLQTGNEVS

SEQ ID NO: 31617 - protein, 29 aa, Artificial Sequence
  Description of Artificial Sequence: Synthetic peptide
QEEEIRTTNPVATEQYGSVATALQAGFDG

SEQ ID NO: 31618 - protein, 32 aa, Artificial Sequence
  Description of Artificial Sequence: Synthetic polypeptide
AEEEIRTTNPVATEQYGSVSVTTNLQQTTGND

SEQ ID NO: 31619 - protein, 32 aa, Artificial Sequence
  Description of Artificial Sequence: Synthetic polypeptide
AEEEIRTTNPVATEQYGSVSVTTNLQQSGENS

SEQ ID NO: 31620 - protein, 29 aa, Artificial Sequence
  Description of Artificial Sequence: Synthetic peptide
QEEEIRTTNPVATEQYGSVATALQNGEFS

SEQ ID NO: 31621 - protein, 32 aa, Artificial Sequence
  Description of Artificial Sequence: Synthetic polypeptide
DEEEIRTTNPVATEQYGDVSTQNLQNEMGNLP

SEQ ID NO: 31622 - protein, 31 aa, Artificial Sequence
  Description of Artificial Sequence: Synthetic polypeptide
AEEEIRTTNPVATEQYGSVSVTTNQNQEGND

SEQ ID NO: 31623 - protein, 31 aa, Artificial Sequence
  Description of Artificial Sequence: Synthetic polypeptide
DEEEIRTTNPVATEQYGDVVGTNLNRGMNEG

SEQ ID NO: 31624 - protein, 28 aa, Artificial Sequence
  Description of Artificial Sequence: Synthetic peptide
QEEEIRTTNPVATECYGTTSTNEQRDNF

SEQ ID NO: 31625 - protein, 31 aa, Artificial Sequence
  Description of Artificial Sequence: Synthetic polypeptide
AEEEIRTTNPVATEQYGSVSVTVNLENNGNF

SEQ ID NO: 31626 - protein, 31 aa, Artificial Sequence
  Description of Artificial Sequence: Synthetic polypeptide
AEEEIRTTNPVATEQYGSVSVTVNEQQQGNE

SEQ ID NO: 31627 - protein, 28 aa, Artificial Sequence
  Description of Artificial Sequence: Synthetic peptide
DEEEIRTTNPCATEPYGSCSTNLAASNL

SEQ ID NO: 31628 - protein, 28 aa, Artificial Sequence
  Description of Artificial Sequence: Synthetic peptide
QEEEIRPTNPCATEQYGSVSCNLMSGTR

SEQ ID NO: 31629 - protein, 28 aa, Artificial Sequence
  Description of Artificial Sequence: Synthetic peptide
DEEEIRTTNPCATEPYGSCSTNLAPGPQ

SEQ ID NO: 31630 - protein, 28 aa, Artificial Sequence
  Description of Artificial Sequence: Synthetic peptide
QEEEIRSTNPVATEGYGVVASTLQRGDR

SEQ ID NO: 31631 - protein, 28 aa, Artificial Sequence
  Description of Artificial Sequence: Synthetic peptide
QEEEIRSTNPVATEGYGVVSSTLQRGDR

SEQ ID NO: 31632 - protein, 30 aa, Artificial Sequence
  Description of Artificial Sequence: Synthetic polypeptide
AEEEIRTTNPVATEQYGSVSVTVGQGGNAE

SEQ ID NO: 31633 - protein, 32 aa, Artificial Sequence
  Description of Artificial Sequence: Synthetic polypeptide
DEEEIRTTNPVATEQYGECVSTCNLQLMGDNW

SEQ ID NO: 31634 - protein, 30 aa, Artificial Sequence
  Description of Artificial Sequence: Synthetic polypeptide
DEEEIRTTNPCATEPYGSTCSTNLSARGNW

SEQ ID NO: 31635 - protein, 32 aa, Artificial Sequence
  Description of Artificial Sequence: Synthetic polypeptide
DEEEIRTTNPVATEQYGDVVSTSNLQVEMGNI

SEQ ID NO: 31636 - protein, 28 aa, Artificial Sequence
  Description of Artificial Sequence: Synthetic peptide
QEEEIRTTNPIATECYGSVSECLQHENR

SEQ ID NO: 31637 - protein, 28 aa, Artificial Sequence
  Description of Artificial Sequence: Synthetic peptide
QEEEIRTTNPIATEQYGDVSENLMHENR

SEQ ID NO: 31638 - protein, 28 aa, Artificial Sequence
  Description of Artificial Sequence: Synthetic peptide
QEEEIRTTNPIATEQYGSVSECLMHGNL

SEQ ID NO: 31639 - protein, 28 aa, Artificial Sequence
  Description of Artificial Sequence: Synthetic peptide
QEEEIRTTNPIATEQYGSVSENLMHENL

SEQ ID NO: 31640 - protein, 33 aa, Artificial Sequence
  Description of Artificial Sequence: Synthetic polypeptide
QEEEIRTTNPVATEAYGSVVPSCTNMLSQRGNR

SEQ ID NO: 31641 - protein, 28 aa, Artificial Sequence
  Description of Artificial Sequence: Synthetic peptide
QEEEIRTTNPVATECYGDVSENLMHGER

SEQ ID NO: 31642 - protein, 31 aa, Artificial Sequence
  Description of Artificial Sequence: Synthetic polypeptide
DEEEIRTTNPVATEQYGDVVSENLGQFGNFP

SEQ ID NO: 31643 - protein, 31 aa, Artificial Sequence
  Description of Artificial Sequence: Synthetic polypeptide
AEEEIRTTNPVATEQYGSVSVTTNQQEGNNY

SEQ ID NO: 31644 - protein, 30 aa, Artificial Sequence
  Description of Artificial Sequence: Synthetic polypeptide
QEEEIRTTNPVATEQYGSVATNLERGPDQL

SEQ ID NO: 31645 - protein, 32 aa, Artificial Sequence
  Description of Artificial Sequence: Synthetic polypeptide
DEEEIRTTNPVATEQYGKTVPSCTNLSQFGNQ

SEQ ID NO: 31646 - protein, 29 aa, Artificial Sequence
  Description of Artificial Sequence: Synthetic peptide
SECEIRATNPVATEQYGSVETNLQFGNQV

SEQ ID NO: 31647 - protein, 29 aa, Artificial Sequence
  Description of Artificial Sequence: Synthetic peptide
SECEIRATNPVATEQYGSVETNLQYGNNQ

SEQ ID NO: 31648 - protein, 28 aa, Artificial Sequence
  Description of Artificial Sequence: Synthetic peptide
SEEEIRCTNPIATEQYGMVSENLMNGNR

SEQ ID NO: 31649 - protein, 29 aa, Artificial Sequence
  Description of Artificial Sequence: Synthetic peptide
SEEEIRCTNPIATEQYGMVSENLMYRGNR

SEQ ID NO: 31650 - protein, 29 aa, Artificial Sequence
  Description of Artificial Sequence: Synthetic peptide
SEEEIRCTNPIATEQYGMVSQENLMRGNR

SEQ ID NO: 31651 - protein, 30 aa, Artificial Sequence
  Description of Artificial Sequence: Synthetic polypeptide
SEEEIRCTNPIATEQYGNSSVSENLMRGNR

SEQ ID NO: 31652 - protein, 28 aa, Artificial Sequence
  Description of Artificial Sequence: Synthetic peptide
SEEEIRCTNPIATEQYGNVSENEMRGNR

SEQ ID NO: 31653 - protein, 28 aa, Artificial Sequence
  Description of Artificial Sequence: Synthetic peptide
SEEEIRCTNPIATEQYGNVSENLMRSNR

SEQ ID NO: 31654 - protein, 30 aa, Artificial Sequence
  Description of Artificial Sequence: Synthetic polypeptide
DEEEIRTTNPVATEQYGCVSSNDQRGIDES

SEQ ID NO: 31655 - protein, 29 aa, Artificial Sequence
  Description of Artificial Sequence: Synthetic peptide
DEEEIRTTNPEATEQYGSVPTWLFRGDIE

SEQ ID NO: 31656 - protein, 28 aa, Artificial Sequence
  Description of Artificial Sequence: Synthetic peptide
SEEEIRCTNPIATEQYGMVSENKMRGNR

SEQ ID NO: 31657 - protein, 30 aa, Artificial Sequence
  Description of Artificial Sequence: Synthetic polypeptide
SEEEIRCTNPIATEQYGQSVSENLGMRGNR

SEQ ID NO: 31658 - protein, 28 aa, Artificial Sequence
  Description of Artificial Sequence: Synthetic peptide
SEEEIRCTNPIATEQYGQVSENLMLGNR

SEQ ID NO: 31659 - protein, 29 aa, Artificial Sequence
  Description of Artificial Sequence: Synthetic peptide
SEEEIRCTNPIATEQYGRCVSENLMRGNR

SEQ ID NO: 31660 - protein, 29 aa, Artificial Sequence
  Description of Artificial Sequence: Synthetic peptide
SEEEIRCTNPIATEQYGRVSENLMDRGNR

SEQ ID NO: 31661 - protein, 29 aa, Artificial Sequence
  Description of Artificial Sequence: Synthetic peptide
SEEEIRCTNPIATEQYGRVSNENLMRGNR

SEQ ID NO: 31662 - protein, 30 aa, Artificial Sequence
  Description of Artificial Sequence: Synthetic polypeptide
DEEEIRTTNPVATEQYGCVSSNDQGGNEQE

SEQ ID NO: 31663 - protein, 30 aa, Artificial Sequence
  Description of Artificial Sequence: Synthetic polypeptide
DEEEIRTTNPEATEQYGSVPTWLMARGKNE

SEQ ID NO: 31664 - protein, 28 aa, Artificial Sequence
  Description of Artificial Sequence: Synthetic peptide
SEEEIRCTNPIATEQYGSASENCMRGNR

SEQ ID NO: 31665 - protein, 29 aa, Artificial Sequence
  Description of Artificial Sequence: Synthetic peptide
DEEEIRTTNPEATEQYGSVPTYLARGQQS

SEQ ID NO: 31666 - protein, 29 aa, Artificial Sequence
  Description of Artificial Sequence: Synthetic peptide
SEEEIRCTNPIATEQYGQSVSENLMRGNL

SEQ ID NO: 31667 - protein, 28 aa, Artificial Sequence
  Description of Artificial Sequence: Synthetic peptide
SEEEIRCTNPIATEQYGSASENLMHGNR

SEQ ID NO: 31668 - protein, 29 aa, Artificial Sequence
  Description of Artificial Sequence: Synthetic peptide
SEEEIRCTNPIATEQYGLVSVENLMRGNR

SEQ ID NO: 31669 - protein, 30 aa, Artificial Sequence
  Description of Artificial Sequence: Synthetic polypeptide
SEEEIRCTNPIATEQYGKSVSENLDMRGNR

SEQ ID NO: 31670 - protein, 28 aa, Artificial Sequence
  Description of Artificial Sequence: Synthetic peptide
SEEEIRCTNPIATEQYGCVSENLMRGNM

SEQ ID NO: 31671 - protein, 29 aa, Artificial Sequence
  Description of Artificial Sequence: Synthetic peptide
SEEEIRCTNPIATEQYGCVSENQLMRGNR

SEQ ID NO: 31672 - protein, 29 aa, Artificial Sequence
  Description of Artificial Sequence: Synthetic peptide
DEEEIRTTNPEATEQYGSVPTPLARGSVQ

SEQ ID NO: 31673 - protein, 28 aa, Artificial Sequence
  Description of Artificial Sequence: Synthetic peptide
DEEEIRTTNPEATEQYGSVPTWLAAGLE

SEQ ID NO: 31674 - protein, 28 aa, Artificial Sequence
  Description of Artificial Sequence: Synthetic peptide
SEEEIRCTNPIATEQYGDVSECLMRGNR

SEQ ID NO: 31675 - protein, 29 aa, Artificial Sequence
  Description of Artificial Sequence: Synthetic peptide
SEEEIRCTNPIATEQYGDVSENLMNRGNR

SEQ ID NO: 31676 - protein, 28 aa, Artificial Sequence
  Description of Artificial Sequence: Synthetic peptide
SEEEIRCTNPIATEQYGDVSENLMRENR

SEQ ID NO: 31677 - protein, 28 aa, Artificial Sequence
  Description of Artificial Sequence: Synthetic peptide
SEEEIRCTNPIATEQYGDVSENLMRGER

SEQ ID NO: 31678 - protein, 28 aa, Artificial Sequence
  Description of Artificial Sequence: Synthetic peptide
SEEEIRCTNPIATEQYGKVSEGLMRGNR

SEQ ID NO: 31679 - protein, 29 aa, Artificial Sequence
  Description of Artificial Sequence: Synthetic peptide
DEEEIRTTNPEATEQYGSVPTWLARGDQE

SEQ ID NO: 31680 - protein, 29 aa, Artificial Sequence
  Description of Artificial Sequence: Synthetic peptide
DEEEIRTTNPEATEQYGSVPTWLARGSKV

SEQ ID NO: 31681 - protein, 28 aa, Artificial Sequence
  Description of Artificial Sequence: Synthetic peptide
SEEEIRCTNPIATEQYGEVSENLMRANR

SEQ ID NO: 31682 - protein, 28 aa, Artificial Sequence
  Description of Artificial Sequence: Synthetic peptide
SEEEIRCTNPIATEQYGFVSENLMRGNF

SEQ ID NO: 31683 - protein, 29 aa, Artificial Sequence
  Description of Artificial Sequence: Synthetic peptide
SEEEIRCTNPIATEQYGHVSENLMRGNIR

SEQ ID NO: 31684 - protein, 28 aa, Artificial Sequence
  Description of Artificial Sequence: Synthetic peptide
SEEEIRCTNPIATEQYGIVSCNLMRGTR

SEQ ID NO: 31685 - protein, 29 aa, Artificial Sequence
  Description of Artificial Sequence: Synthetic peptide
SEEEIRCTNPIATEQYGIVSENDLMRGNR

SEQ ID NO: 31686 - protein, 28 aa, Artificial Sequence
  Description of Artificial Sequence: Synthetic peptide
SEEEIRCTNPIATEQYGIVSENEMRGNR

SEQ ID NO: 31687 - protein, 29 aa, Artificial Sequence
  Description of Artificial Sequence: Synthetic peptide
SEEEIRCTNPIATEQYGIVSENLMFRGNR

SEQ ID NO: 31688 - protein, 31 aa, Artificial Sequence
  Description of Artificial Sequence: Synthetic polypeptide
SEEEIRCTNPIATEQYGESVSEQNLMQRGNR

SEQ ID NO: 31689 - protein, 28 aa, Artificial Sequence
  Description of Artificial Sequence: Synthetic peptide
SEEEIRCTNPIATEQYGCVSENLIRPNR

SEQ ID NO: 31690 - protein, 29 aa, Artificial Sequence
  Description of Artificial Sequence: Synthetic peptide
SEEEIRCTNPIATEQYGSASENLMRGNRS

SEQ ID NO: 31691 - protein, 29 aa, Artificial Sequence
  Description of Artificial Sequence: Synthetic peptide
SEEEIRCTNPIATEQYGSAVSENLENGNR

SEQ ID NO: 31692 - protein, 28 aa, Artificial Sequence
  Description of Artificial Sequence: Synthetic peptide
SEEEIRCTNPIATEQYGSTAENLMRGNR

SEQ ID NO: 31693 - protein, 28 aa, Artificial Sequence
  Description of Artificial Sequence: Synthetic peptide
SEEEIRCTNPIATEQYGSTSEELMRGNR

SEQ ID NO: 31694 - protein, 29 aa, Artificial Sequence
  Description of Artificial Sequence: Synthetic peptide
SEEEIRCTNPIATEQYGSTVAENLMRGNR

SEQ ID NO: 31695 - protein, 29 aa, Artificial Sequence
  Description of Artificial Sequence: Synthetic peptide
SEEEIRCTNPIATEQYGSTVRENLMRGNR

SEQ ID NO: 31696 - protein, 29 aa, Artificial Sequence
  Description of Artificial Sequence: Synthetic peptide
SEEEIRCTNPIATEQYGSTVSEFLMRGNR

SEQ ID NO: 31697 - protein, 29 aa, Artificial Sequence
  Description of Artificial Sequence: Synthetic peptide
SEEEIRCTNPIATEQYGSTVSEMLMRGNR

SEQ ID NO: 31698 - protein, 30 aa, Artificial Sequence
  Description of Artificial Sequence: Synthetic polypeptide
SEEEIRCTNPIATEQYGSTVSENLMRGNRG

SEQ ID NO: 31699 - protein, 29 aa, Artificial Sequence
  Description of Artificial Sequence: Synthetic peptide
SEEEIRCTNPIATEQYGSTVSENLMRGPR

SEQ ID NO: 31700 - protein, 30 aa, Artificial Sequence
  Description of Artificial Sequence: Synthetic polypeptide
SEEEIRCTNPIATEQYGSSVSSNLERGNDR

SEQ ID NO: 31701 - protein, 30 aa, Artificial Sequence
  Description of Artificial Sequence: Synthetic polypeptide
SEEEIRCTNPIATEQYGSTVSENLMRPGNR

SEQ ID NO: 31702 - protein, 29 aa, Artificial Sequence
  Description of Artificial Sequence: Synthetic peptide
SEEEIRCTNPIATEQYGSTVSENYMRGNR

SEQ ID NO: 31703 - protein, 29 aa, Artificial Sequence
  Description of Artificial Sequence: Synthetic peptide
SEEEIRCTNPIATEQYGSVAEENLMRGNR

SEQ ID NO: 31704 - protein, 28 aa, Artificial Sequence
  Description of Artificial Sequence: Synthetic peptide
SEEEIRCTNPIATEQYGSVAETLMRGNR

SEQ ID NO: 31705 - protein, 29 aa, Artificial Sequence
  Description of Artificial Sequence: Synthetic peptide
SEEEIRCTNPIATEQYGSVAEVNLMRGNR

SEQ ID NO: 31706 - protein, 29 aa, Artificial Sequence
  Description of Artificial Sequence: Synthetic peptide
SEEEIRCTNPIATEQYGSVAQNLMRGGNR

SEQ ID NO: 31707 - protein, 29 aa, Artificial Sequence
  Description of Artificial Sequence: Synthetic peptide
SEEEIRCTNPIATEQYGSVASENLMRGPR

SEQ ID NO: 31708 - protein, 29 aa, Artificial Sequence
  Description of Artificial Sequence: Synthetic peptide
SEEEIRCTNPIATEQYGSVCENLDMRGNR

SEQ ID NO: 31709 - protein, 29 aa, Artificial Sequence
  Description of Artificial Sequence: Synthetic peptide
SEEEIRCTNPIATEQYGSVCENQLMRGNR

SEQ ID NO: 31710 - protein, 30 aa, Artificial Sequence
  Description of Artificial Sequence: Synthetic polypeptide
SEEEIRCTNPIATEQYGSTVSENLMRSGNR

SEQ ID NO: 31711 - protein, 28 aa, Artificial Sequence
  Description of Artificial Sequence: Synthetic peptide
SEEEIRCTNPIATEQYGSASEVLMRGNR

SEQ ID NO: 31712 - protein, 29 aa, Artificial Sequence
  Description of Artificial Sequence: Synthetic peptide
SEEEIRCTNPIATEQYGSSVSEQLMRGNR

SEQ ID NO: 31713 - protein, 30 aa, Artificial Sequence
  Description of Artificial Sequence: Synthetic polypeptide
SEEEIRCTNPIATEQYGSSVSENLMGRGNR

SEQ ID NO: 31714 - protein, 31 aa, Artificial Sequence
  Description of Artificial Sequence: Synthetic polypeptide
AEEEIRTTNPVATEQYGSVSTTVQLQEGGNT

SEQ ID NO: 31715 - protein, 30 aa, Artificial Sequence
  Description of Artificial Sequence: Synthetic polypeptide
AEEEIRTTNPVATEQYGSVSTTVQEQEGNQ

SEQ ID NO: 31716 - protein, 30 aa, Artificial Sequence
  Description of Artificial Sequence: Synthetic polypeptide
AEEEIRTTNPVATEQYGSVSTTVQAGINTI

SEQ ID NO: 31717 - protein, 31 aa, Artificial Sequence
  Description of Artificial Sequence: Synthetic polypeptide
AEEEIRTTNPVATEQYGSVSTTVNTQEGNNQ

SEQ ID NO: 31718 - protein, 29 aa, Artificial Sequence
  Description of Artificial Sequence: Synthetic peptide
SEEEIRCTNPIATEQYGSCSENLMIRGNR

SEQ ID NO: 31719 - protein, 30 aa, Artificial Sequence
  Description of Artificial Sequence: Synthetic polypeptide
SEEEIRCTNPIATEQYGSCVSENFLMRGNR

SEQ ID NO: 31720 - protein, 30 aa, Artificial Sequence
  Description of Artificial Sequence: Synthetic polypeptide
SEEEIRCTNPIATEQYGSCVWSENLMRGNR

SEQ ID NO: 31721 - protein, 28 aa, Artificial Sequence
  Description of Artificial Sequence: Synthetic peptide
SEEEIRCTNPIATEQYGSFSENEMRGNR

SEQ ID NO: 31722 - protein, 29 aa, Artificial Sequence
  Description of Artificial Sequence: Synthetic peptide
SEEEIRCTNPIATEQYGSSVSENLMHGNR

SEQ ID NO: 31723 - protein, 28 aa, Artificial Sequence
  Description of Artificial Sequence: Synthetic peptide
SEEEIRCTNPIATEQYGSISENRMRGNR

SEQ ID NO: 31724 - protein, 30 aa, Artificial Sequence
  Description of Artificial Sequence: Synthetic polypeptide
SEEEIRCTNPIATEQYGSIVSENLMGRGNR

SEQ ID NO: 31725 - protein, 30 aa, Artificial Sequence
  Description of Artificial Sequence: Synthetic polypeptide
SEEEIRCTNPIATEQYGSIVSENLMRMGNR

SEQ ID NO: 31726 - protein, 30 aa, Artificial Sequence
  Description of Artificial Sequence: Synthetic polypeptide
SEEEIRCTNPIATEQYGSIVSENLYMRGNR

SEQ ID NO: 31727 - protein, 29 aa, Artificial Sequence
  Description of Artificial Sequence: Synthetic peptide
SEEEIRCTNPIATEQYGSKVSENLMDGNR

SEQ ID NO: 31728 - protein, 30 aa, Artificial Sequence
  Description of Artificial Sequence: Synthetic polypeptide
SEEEIRCTNPIATEQYGSLVSENLMSRGNR

SEQ ID NO: 31729 - protein, 29 aa, Artificial Sequence
  Description of Artificial Sequence: Synthetic peptide
SEEEIRCTNPIATEQYGSMVSENAMRGNR

SEQ ID NO: 31730 - protein, 30 aa, Artificial Sequence
  Description of Artificial Sequence: Synthetic polypeptide
SEEEIRCTNPIATEQYGSMVVSENLMRGNR

SEQ ID NO: 31731 - protein, 30 aa, Artificial Sequence
  Description of Artificial Sequence: Synthetic polypeptide
SEEEIRCTNPIATEQYGSSVSEMNLARGNR

SEQ ID NO: 31732 - protein, 30 aa, Artificial Sequence
  Description of Artificial Sequence: Synthetic polypeptide
DEEEIRTTNPVATEQYGCVSSEPQRGSERT

SEQ ID NO: 31733 - protein, 29 aa, Artificial Sequence
  Description of Artificial Sequence: Synthetic peptide
DEEEIRTTNPEATEQYGSVPTPLARFGEQ

SEQ ID NO: 31734 - protein, 29 aa, Artificial Sequence
  Description of Artificial Sequence: Synthetic peptide
SEEEIRCTNPIATEQYGCVSENLARFGNR

SEQ ID NO: 31735 - protein, 28 aa, Artificial Sequence
  Description of Artificial Sequence: Synthetic peptide
SEEEIRCTNPIATEQYGCVSANLIRGNQ

SEQ ID NO: 31736 - protein, 29 aa, Artificial Sequence
  Description of Artificial Sequence: Synthetic peptide
SEEEIRCTNPIATECYGSVSENLMRGVNR

SEQ ID NO: 31737 - protein, 28 aa, Artificial Sequence
  Description of Artificial Sequence: Synthetic peptide
SEEEIRCTNPIATECYGSVSVNLMEGNR

SEQ ID NO: 31738 - protein, 29 aa, Artificial Sequence
  Description of Artificial Sequence: Synthetic peptide
SEEEIRCTNPIATECYGSVSYENLMRGNR

SEQ ID NO: 31739 - protein, 29 aa, Artificial Sequence
  Description of Artificial Sequence: Synthetic peptide
SEEEIRCTNPIATEEYGSVFSENLMRGNR

SEQ ID NO: 31740 - protein, 28 aa, Artificial Sequence
  Description of Artificial Sequence: Synthetic peptide
SEEEIRCTNPIATEEYGSVSENLMEGNR

SEQ ID NO: 31741 - protein, 28 aa, Artificial Sequence
  Description of Artificial Sequence: Synthetic peptide
SEEEIRCTNPIATEFYGCVSENLMRGNR

SEQ ID NO: 31742 - protein, 31 aa, Artificial Sequence
  Description of Artificial Sequence: Synthetic polypeptide
AEEEIRTTNPVATEQYGSVSTVNEQSGVNTA

SEQ ID NO: 31743 - protein, 31 aa, Artificial Sequence
  Description of Artificial Sequence: Synthetic polypeptide
AEEEIRTTNPVATEQYGSVSTVNEQQEGNIN

SEQ ID NO: 31744 - protein, 28 aa, Artificial Sequence
  Description of Artificial Sequence: Synthetic peptide
SEEEIRCTNPIATECYGSVSENLMRGNL

SEQ ID NO: 31745 - protein, 29 aa, Artificial Sequence
  Description of Artificial Sequence: Synthetic peptide
SEEEIRCTNPIATEGYGSVSENLERFGNR

SEQ ID NO: 31746 - protein, 28 aa, Artificial Sequence
  Description of Artificial Sequence: Synthetic peptide
SEEEIRCTNPIATEGYGSVSENLERGIR

SEQ ID NO: 31747 - protein, 29 aa, Artificial Sequence
  Description of Artificial Sequence: Synthetic peptide
SEEEIRCTNPIATEGYGSVSENLMFRGNR

SEQ ID NO: 31748 - protein, 29 aa, Artificial Sequence
  Description of Artificial Sequence: Synthetic peptide
SEEEIRCTNPIATEGYGSVSENLMRGNRY

SEQ ID NO: 31749 - protein, 29 aa, Artificial Sequence
  Description of Artificial Sequence: Synthetic peptide
DEEEIRTTNPEATEQYGSTVPTHLARGSE

SEQ ID NO: 31750 - protein, 28 aa, Artificial Sequence
  Description of Artificial Sequence: Synthetic peptide
SEEEIRCTNPIATEHYGSVSENLMCGNR

SEQ ID NO: 31751 - protein, 29 aa, Artificial Sequence
  Description of Artificial Sequence: Synthetic peptide
SEEEIRCTNPIATEHYGSVSENLMRGGNR

SEQ ID NO: 31752 - protein, 28 aa, Artificial Sequence
  Description of Artificial Sequence: Synthetic peptide
SEEEIRCTNPIATEIYGSVSENLMGGNR

SEQ ID NO: 31753 - protein, 29 aa, Artificial Sequence
  Description of Artificial Sequence: Synthetic peptide
SEEEIRCTNPIATEIYGSVSENLMRGNRD

SEQ ID NO: 31754 - protein, 31 aa, Artificial Sequence
  Description of Artificial Sequence: Synthetic polypeptide
AEEEIRTTNPVATEQYGSVSTVNEQEGNTEN

SEQ ID NO: 31755 - protein, 28 aa, Artificial Sequence
  Description of Artificial Sequence: Synthetic peptide
SEEEIRCTNPIATEMYGSVSENTMRGNR

SEQ ID NO: 31756 - protein, 28 aa, Artificial Sequence
  Description of Artificial Sequence: Synthetic peptide
SEEEIRCTNPIATECYGSVSENLMRGNG

SEQ ID NO: 31757 - protein, 28 aa, Artificial Sequence
  Description of Artificial Sequence: Synthetic peptide
SEEEIRCTNPIATECYGSVSENLMRGER

SEQ ID NO: 31758 - protein, 32 aa, Artificial Sequence
  Description of Artificial Sequence: Synthetic polypeptide
DEEEIRTTNPVATEQYGCVSTDLQQREDNDRI

SEQ ID NO: 31759 - protein, 30 aa, Artificial Sequence
  Description of Artificial Sequence: Synthetic polypeptide
DEEEIRTTNPVATEQYGCVSTDLQIDGDGQ

SEQ ID NO: 31760 - protein, 31 aa, Artificial Sequence
  Description of Artificial Sequence: Synthetic polypeptide
DEEEIRTTNPVATEQYGCVSTDLDQQGLEER

SEQ ID NO: 31761 - protein, 28 aa, Artificial Sequence
  Description of Artificial Sequence: Synthetic peptide
SEEEIRCTNPIASEQYGSVSENCMRGNR

SEQ ID NO: 31762 - protein, 29 aa, Artificial Sequence
  Description of Artificial Sequence: Synthetic peptide
SEEEIRCTNPIASEQYGSVSENLMGRGNR

SEQ ID NO: 31763 - protein, 28 aa, Artificial Sequence
  Description of Artificial Sequence: Synthetic peptide
SEEEIRCTNPIASEQYGSVSENLMRGNY

SEQ ID NO: 31764 - protein, 29 aa, Artificial Sequence
  Description of Artificial Sequence: Synthetic peptide
SEEEIRCTNPIATAQYGSVSENLDMRGNR

SEQ ID NO: 31765 - protein, 29 aa, Artificial Sequence
  Description of Artificial Sequence: Synthetic peptide
SEEEIRCTNPIATCQYGSVSENALMRGNR

SEQ ID NO: 31766 - protein, 31 aa, Artificial Sequence
  Description of Artificial Sequence: Synthetic polypeptide
AEEEIRTTNPVATEQYGSVSTVNGGQTGNQD

SEQ ID NO: 31767 - protein, 29 aa, Artificial Sequence
  Description of Artificial Sequence: Synthetic peptide
SEEEIRCTNPIATCQYGSVSENLMRHGNR

SEQ ID NO: 31768 - protein, 29 aa, Artificial Sequence
  Description of Artificial Sequence: Synthetic peptide
DEEEIRTTNPEATEQYGCVCSWNIFRGND

SEQ ID NO: 31769 - protein, 31 aa, Artificial Sequence
  Description of Artificial Sequence: Synthetic polypeptide
DEEEIRTTNPVATEQYGCVSTDDLQGEGNEL

SEQ ID NO: 31770 - protein, 31 aa, Artificial Sequence
  Description of Artificial Sequence: Synthetic polypeptide
AEEEIRTTNPVATEQYGSVSTVNGNQEQGNA

SEQ ID NO: 31771 - protein, 29 aa, Artificial Sequence
  Description of Artificial Sequence: Synthetic peptide
SEEEIRCTNPIATECYGCSVSENLMRGNR

SEQ ID NO: 31772 - protein, 28 aa, Artificial Sequence
  Description of Artificial Sequence: Synthetic peptide
DEEEIRTTNPEATEQYGEVSYNIFHGND

SEQ ID NO: 31773 - protein, 31 aa, Artificial Sequence
  Description of Artificial Sequence: Synthetic polypeptide
DEEEIRTTNPVATEQYGCVSTALQFIGSNQS

SEQ ID NO: 31774 - protein, 30 aa, Artificial Sequence
  Description of Artificial Sequence: Synthetic polypeptide
DEEEIRTTNPVATEQYGCVSTALQFGSDTQ

SEQ ID NO: 31775 - protein, 28 aa, Artificial Sequence
  Description of Artificial Sequence: Synthetic peptide
SEEEIRCTNPIATECYGSVSENLMRENR

SEQ ID NO: 31776 - protein, 28 aa, Artificial Sequence
  Description of Artificial Sequence: Synthetic peptide
SEEEIRCTNPIATDQYGCVSENLMRGNR

SEQ ID NO: 31777 - protein, 31 aa, Artificial Sequence
  Description of Artificial Sequence: Synthetic polypeptide
AEEEIRTTNPVATEQYGSVSTVLQSGTTNNQ

SEQ ID NO: 31778 - protein, 28 aa, Artificial Sequence
  Description of Artificial Sequence: Synthetic peptide
SEEEIRCTNPIATENYGSVSENTMRGNR

SEQ ID NO: 31779 - protein, 28 aa, Artificial Sequence
  Description of Artificial Sequence: Synthetic peptide
SEEEIRCTNPIATEPYGSISENLMRGNR

SEQ ID NO: 31780 - protein, 29 aa, Artificial Sequence
  Description of Artificial Sequence: Synthetic peptide
SEEEIRCTNPIATEQWGSVSENLMRGNGR

SEQ ID NO: 31781 - protein, 29 aa, Artificial Sequence
  Description of Artificial Sequence: Synthetic peptide
SEEEIRCTNPIATEQWGSVSENLMRGNRV

SEQ ID NO: 31782 - protein, 29 aa, Artificial Sequence
  Description of Artificial Sequence: Synthetic peptide
SEEEIRCTNPIATEQWGSVSENLQREGNG

SEQ ID NO: 31783 - protein, 29 aa, Artificial Sequence
  Description of Artificial Sequence: Synthetic peptide
SEEEIRCTNPIATEQWGSVSENLTRGGNR

SEQ ID NO: 31784 - protein, 31 aa, Artificial Sequence
  Description of Artificial Sequence: Synthetic polypeptide
DEEEIRTTNPVATEQYGCVSSNLQYFGSNQG

SEQ ID NO: 31785 - protein, 29 aa, Artificial Sequence
  Description of Artificial Sequence: Synthetic peptide
SEEEIRCTNPIATEQWGSVSGNLMRPGNR

SEQ ID NO: 31786 - protein, 30 aa, Artificial Sequence
  Description of Artificial Sequence: Synthetic polypeptide
SEEEIRCTNPIATEQYGASGVSENLMRGNR

SEQ ID NO: 31787 - protein, 30 aa, Artificial Sequence
  Description of Artificial Sequence: Synthetic polypeptide
SEEEIRCTNPIATEQYGASVSENLPMRGNR

SEQ ID NO: 31788 - protein, 28 aa, Artificial Sequence
  Description of Artificial Sequence: Synthetic peptide
SEEEIRCTNPIATEQWGSVSENLMRGNA

SEQ ID NO: 31789 - protein, 28 aa, Artificial Sequence
  Description of Artificial Sequence: Synthetic peptide
DEEEIRTTNPEATEQYGSVPTALAHGEA

SEQ ID NO: 31790 - protein, 32 aa, Artificial Sequence
  Description of Artificial Sequence: Synthetic polypeptide
DEEEIRTTNPVATEQYGCVSSNLQIGNNQQRI

SEQ ID NO: 31791 - protein, 29 aa, Artificial Sequence
  Description of Artificial Sequence: Synthetic peptide
SEEEIRCTNPIATEQYGAVSENLMRGNIR

SEQ ID NO: 31792 - protein, 29 aa, Artificial Sequence
  Description of Artificial Sequence: Synthetic peptide
SEEEIRCTNPIATEQYGAVSNENLMRGNR

SEQ ID NO: 31793 - protein, 30 aa, Artificial Sequence
  Description of Artificial Sequence: Synthetic polypeptide
SEEEIRCTNPIATEQYGCSGVSENLMRGNR

SEQ ID NO: 31794 - protein, 30 aa, Artificial Sequence
  Description of Artificial Sequence: Synthetic polypeptide
SEEEIRCTNPIATEQYGCSVSCNLMRGGNR

SEQ ID NO: 31795 - protein, 29 aa, Artificial Sequence
  Description of Artificial Sequence: Synthetic peptide
DEEEIRTTNPEATEQYGSVPTELARGEQG

SEQ ID NO: 31796 - protein, 29 aa, Artificial Sequence
  Description of Artificial Sequence: Synthetic peptide
SEEEIRCTNPIATEQYGCVCSSNLTRGNR

SEQ ID NO: 31797 - protein, 29 aa, Artificial Sequence
  Description of Artificial Sequence: Synthetic peptide
DEEEIRTTNPEATEQYGSVPTEVLARGDC

SEQ ID NO: 31798 - protein, 28 aa, Artificial Sequence
  Description of Artificial Sequence: Synthetic peptide
SEEEIRCTNPIATEQYGATSENLMRGNR

SEQ ID NO: 31799 - protein, 28 aa, Artificial Sequence
  Description of Artificial Sequence: Synthetic peptide
SEEEIRCTNPIATEQWGSVSENLMRGDR

SEQ ID NO: 31800 - protein, 28 aa, Artificial Sequence
  Description of Artificial Sequence: Synthetic peptide
SEEEIRCTNPIATEQWGSVSENLMAGNR

SEQ ID NO: 31801 - protein, 30 aa, Artificial Sequence
  Description of Artificial Sequence: Synthetic polypeptide
DEEEIRTTNPVATEQYGCVSTAHQNGSQRV

SEQ ID NO: 31802 - protein, 29 aa, Artificial Sequence
  Description of Artificial Sequence: Synthetic peptide
SEEEIRCTNPIATEPYGSISENLQQRGNR

SEQ ID NO: 31803 - protein, 29 aa, Artificial Sequence
  Description of Artificial Sequence: Synthetic peptide
SEEEIRCTNPIATEPYGSISMNLQQRGNR

SEQ ID NO: 31804 - protein, 31 aa, Artificial Sequence
  Description of Artificial Sequence: Synthetic polypeptide
DEEEIRTTNPVATEQYGCVSTAHQRFGSNVS

SEQ ID NO: 31805 - protein, 31 aa, Artificial Sequence
  Description of Artificial Sequence: Synthetic polypeptide
AEEEIRTTNPVATEQYGSVSTVLQQEGGNNN

SEQ ID NO: 31806 - protein, 30 aa, Artificial Sequence
  Description of Artificial Sequence: Synthetic polypeptide
SEEEIRCTNPIATEPYGSVSEENLMQRGNR

SEQ ID NO: 31807 - protein, 31 aa, Artificial Sequence
  Description of Artificial Sequence: Synthetic polypeptide
AEEEIRTTNPVATEQYGSVSTVLQGEGGNQT

SEQ ID NO: 31808 - protein, 31 aa, Artificial Sequence
  Description of Artificial Sequence: Synthetic polypeptide
AEEEIRTTNPVATEQYGSVSTVLQEEGGNTN

SEQ ID NO: 31809 - protein, 29 aa, Artificial Sequence
  Description of Artificial Sequence: Synthetic peptide
SEEEIRCTNPIATEPYGSVSENALMRGNR

SEQ ID NO: 31810 - protein, 29 aa, Artificial Sequence
  Description of Artificial Sequence: Synthetic peptide
SEEEIRCTNPIATEPYGSVSENLGRGGNR

SEQ ID NO: 31811 - protein, 28 aa, Artificial Sequence
  Description of Artificial Sequence: Synthetic peptide
SEEEIRCTNPIATEPYGSVSENLMDGNR

SEQ ID NO: 31812 - protein, 31 aa, Artificial Sequence
  Description of Artificial Sequence: Synthetic polypeptide
AEEEIRTTNPVATEQYGSVSTVLNQEGGNTT

SEQ ID NO: 31813 - protein, 29 aa, Artificial Sequence
  Description of Artificial Sequence: Synthetic peptide
SEEEIRCTNPIATEPYGSVSENLMRGNWR

SEQ ID NO: 31814 - protein, 28 aa, Artificial Sequence
  Description of Artificial Sequence: Synthetic peptide
SEEEIRCTNPIATEPYGSVSENLMRGQR

SEQ ID NO: 31815 - protein, 30 aa, Artificial Sequence
  Description of Artificial Sequence: Synthetic polypeptide
AEEEIRTTNPVATEQYGSVSTVGTQDGNIG

SEQ ID NO: 31816 - protein, 29 aa, Artificial Sequence
  Description of Artificial Sequence: Synthetic peptide
SEEEIRCTNPIATEPYGSVSIENLMRGNR

SEQ ID NO: 31817 - protein, 29 aa, Artificial Sequence
  Description of Artificial Sequence: Synthetic peptide
SEEEIRCTNPIATEQFGSVFSENLMRGNR

SEQ ID NO: 31818 - protein, 29 aa, Artificial Sequence
  Description of Artificial Sequence: Synthetic peptide
SEEEIRCTNPIATEQFGSVSENLMRGMNR

SEQ ID NO: 31819 - protein, 28 aa, Artificial Sequence
  Description of Artificial Sequence: Synthetic peptide
SEEEIRCTNPIATEQFGSVTENLMRGNR

SEQ ID NO: 31820 - protein, 28 aa, Artificial Sequence
  Description of Artificial Sequence: Synthetic peptide
SEEEIRCTNPIATEQWGDVSENLMRGNR

SEQ ID NO: 31821 - protein, 30 aa, Artificial Sequence
  Description of Artificial Sequence: Synthetic polypeptide
DEEEIRTTNPEATEQYGSVSYNIDNRGNDS

SEQ ID NO: 31822 - protein, 29 aa, Artificial Sequence
  Description of Artificial Sequence: Synthetic peptide
SEEEIRCTNPIATEQYGSVCSSNLANGNR

SEQ ID NO: 31823 - protein, 29 aa, Artificial Sequence
  Description of Artificial Sequence: Synthetic peptide
SEEEIRCTNPIATEQYGSVCSSNLMRGER

SEQ ID NO: 31824 - protein, 29 aa, Artificial Sequence
  Description of Artificial Sequence: Synthetic peptide
SEEEIRCTNPIATEQYGSVCSYNLMYGNR

SEQ ID NO: 31825 - protein, 29 aa, Artificial Sequence
  Description of Artificial Sequence: Synthetic peptide
SEEEIRCTNPIATEQYGSVSENCLMRGNL

SEQ ID NO: 31826 - protein, 29 aa, Artificial Sequence
  Description of Artificial Sequence: Synthetic peptide
SEEEIRCTNPIATEQYGSVSENCLMRGNN

SEQ ID NO: 31827 - protein, 29 aa, Artificial Sequence
  Description of Artificial Sequence: Synthetic peptide
DEEEIRTTNPEATRQYGQVYTDLQRGSNS

SEQ ID NO: 31828 - protein, 28 aa, Artificial Sequence
  Description of Artificial Sequence: Synthetic peptide
SEEEIRCTNPIATEQYGSVSENCMRGER

SEQ ID NO: 31829 - protein, 28 aa, Artificial Sequence
  Description of Artificial Sequence: Synthetic peptide
SEEEIRCTNPIATEQYGSVSENCMRGNK

SEQ ID NO: 31830 - protein, 29 aa, Artificial Sequence
  Description of Artificial Sequence: Synthetic peptide
SEEEIRCTNPIATEQYGSVSENELMRVNR

SEQ ID NO: 31831 - protein, 28 aa, Artificial Sequence
  Description of Artificial Sequence: Synthetic peptide
DEEEIRTTNPEATTQYGCVPTDLQRGEF

SEQ ID NO: 31832 - protein, 29 aa, Artificial Sequence
  Description of Artificial Sequence: Synthetic peptide
SEEEIRCTNPIATEQYGSVSENEMRGENR

SEQ ID NO: 31833 - protein, 29 aa, Artificial Sequence
  Description of Artificial Sequence: Synthetic peptide
SEEEIRCTNPIATEQYGSVSENCGMRGNR

SEQ ID NO: 31834 - protein, 28 aa, Artificial Sequence
  Description of Artificial Sequence: Synthetic peptide
SEEEIRCTNPIATEQYGSVSENEMRGNY

SEQ ID NO: 31835 - protein, 28 aa, Artificial Sequence
  Description of Artificial Sequence: Synthetic peptide
SEEEIRCTNPIATEQYGSVSENFMEGNR

SEQ ID NO: 31836 - protein, 29 aa, Artificial Sequence
  Description of Artificial Sequence: Synthetic peptide
SEEEIRCTNPIATEQYGSVSENGLMRKNR

SEQ ID NO: 31837 - protein, 32 aa, Artificial Sequence
  Description of Artificial Sequence: Synthetic polypeptide
AEEEIRTTNPVATEQYGSVSTTTNLQSGNDNN

SEQ ID NO: 31838 - protein, 28 aa, Artificial Sequence
  Description of Artificial Sequence: Synthetic peptide
SEEEIRCTNPIATEQYGSVSENGMHGNR

SEQ ID NO: 31839 - protein, 29 aa, Artificial Sequence
  Description of Artificial Sequence: Synthetic peptide
SEEEIRCTNPIATEQYGSVSENGMRGNPR

SEQ ID NO: 31840 - protein, 32 aa, Artificial Sequence
  Description of Artificial Sequence: Synthetic polypeptide
AEEEIRTTNPVATEQYGSVSTTTNLQQQGNSN

SEQ ID NO: 31841 - protein, 30 aa, Artificial Sequence
  Description of Artificial Sequence: Synthetic polypeptide
SEEEIRCTNPIATEQYGSVSENILMRGNYR

SEQ ID NO: 31842 - protein, 30 aa, Artificial Sequence
  Description of Artificial Sequence: Synthetic polypeptide
SEEEIRCTNPIATEQYGSVSENILMRMGNR

SEQ ID NO: 31843 - protein, 28 aa, Artificial Sequence
  Description of Artificial Sequence: Synthetic peptide
SEEEIRCTNPIATEQYGSVSENEMRRNR

SEQ ID NO: 31844 - protein, 29 aa, Artificial Sequence
  Description of Artificial Sequence: Synthetic peptide
SEEEIRCTNPIATEQYGSVSENIMPRGNR

SEQ ID NO: 31845 - protein, 29 aa, Artificial Sequence
  Description of Artificial Sequence: Synthetic peptide
DEEEIRTTNPEATRQYGQVPTDLQRGNGN

SEQ ID NO: 31846 - protein, 29 aa, Artificial Sequence
  Description of Artificial Sequence: Synthetic peptide
SEEEIRCTNPIATEQYGSVSEMNSMRGNR

SEQ ID NO: 31847 - protein, 29 aa, Artificial Sequence
  Description of Artificial Sequence: Synthetic peptide
SEEEIRCTNPIATEQYGSVSEHLMRGNPR

SEQ ID NO: 31848 - protein, 28 aa, Artificial Sequence
  Description of Artificial Sequence: Synthetic peptide
SEEEIRCTNPIATEQYGSVSEILMAGNR

SEQ ID NO: 31849 - protein, 29 aa, Artificial Sequence
  Description of Artificial Sequence: Synthetic peptide
SEEEIRCTNPIATEQYGSVSEINHMRGNR

SEQ ID NO: 31850 - protein, 29 aa, Artificial Sequence
  Description of Artificial Sequence: Synthetic peptide
SEEEIRCTNPIATEQYGSVSEINIMRGNR

SEQ ID NO: 31851 - protein, 30 aa, Artificial Sequence
  Description of Artificial Sequence: Synthetic polypeptide
SEEEIRCTNPIATEQYGSVSEINLMRGENR

SEQ ID NO: 31852 - protein, 31 aa, Artificial Sequence
  Description of Artificial Sequence: Synthetic polypeptide
DEEEIRTTNPVATEQYGCVSNTNLQRFSDQA

SEQ ID NO: 31853 - protein, 30 aa, Artificial Sequence
  Description of Artificial Sequence: Synthetic polypeptide
SEEEIRCTNPIATEQYGSVSEINLPMRGNR

SEQ ID NO: 31854 - protein, 29 aa, Artificial Sequence
  Description of Artificial Sequence: Synthetic peptide
SEEEIRCTNPIATEQYGSVSEKLMRGNAR

SEQ ID NO: 31855 - protein, 29 aa, Artificial Sequence
  Description of Artificial Sequence: Synthetic peptide
DEEEIRTTNPEATRQYGQVPTDLQRGNDE

SEQ ID NO: 31856 - protein, 29 aa, Artificial Sequence
  Description of Artificial Sequence: Synthetic peptide
SEEEIRCTNPIATEQYGSVSEKLMRGNGR

SEQ ID NO: 31857 - protein, 30 aa, Artificial Sequence
  Description of Artificial Sequence: Synthetic polypeptide
SEEEIRCTNPIATEQYGSVSELNLMERGNR

SEQ ID NO: 31858 - protein, 30 aa, Artificial Sequence
  Description of Artificial Sequence: Synthetic polypeptide
SEEEIRCTNPIATEQYGSVSELNLMTRGNR

SEQ ID NO: 31859 - protein, 29 aa, Artificial Sequence
  Description of Artificial Sequence: Synthetic peptide
SEEEIRCTNPIATEQYGSVSEMLMRGQNR

SEQ ID NO: 31860 - protein, 30 aa, Artificial Sequence
  Description of Artificial Sequence: Synthetic polypeptide
SEEEIRCTNPIATEQYGSVSEMNILMRGNR

SEQ ID NO: 31861 - protein, 29 aa, Artificial Sequence
  Description of Artificial Sequence: Synthetic peptide
DEEEIRTTNPEATRQYGQVPTDLQARGNF

SEQ ID NO: 31862 - protein, 30 aa, Artificial Sequence
  Description of Artificial Sequence: Synthetic polypeptide
SEEEIRCTNPIATEQYGSVSEMNLEMRGNR

SEQ ID NO: 31863 - protein, 29 aa, Artificial Sequence
  Description of Artificial Sequence: Synthetic peptide
SEEEIRCTNPIATEQYGSVSEMNLMRENR

SEQ ID NO: 31864 - protein, 30 aa, Artificial Sequence
  Description of Artificial Sequence: Synthetic polypeptide
SEEEIRCTNPIATEQYGSVSEMNLMRGINR

SEQ ID NO: 31865 - protein, 29 aa, Artificial Sequence
  Description of Artificial Sequence: Synthetic peptide
SEEEIRCTNPIATEQYGSVSELLMRLGNR

SEQ ID NO: 31866 - protein, 28 aa, Artificial Sequence
  Description of Artificial Sequence: Synthetic peptide
SEEEIRCTNPIATEQYGSVSENIMQGNR

SEQ ID NO: 31867 - protein, 30 aa, Artificial Sequence
  Description of Artificial Sequence: Synthetic polypeptide
SEEEIRCTNPIATEQYGSVSENIMQRNGNR

SEQ ID NO: 31868 - protein, 28 aa, Artificial Sequence
  Description of Artificial Sequence: Synthetic peptide
SEEEIRCTNPIATEQYGSVSENIMRGNH

SEQ ID NO: 31869 - protein, 29 aa, Artificial Sequence
  Description of Artificial Sequence: Synthetic peptide
SEEEIRCTNPIATEQYGSVSENLGRGGDR

SEQ ID NO: 31870 - protein, 28 aa, Artificial Sequence
  Description of Artificial Sequence: Synthetic peptide
DEEEIRTTNPFATEQYGSVETGDDPGND

SEQ ID NO: 31871 - protein, 29 aa, Artificial Sequence
  Description of Artificial Sequence: Synthetic peptide
SEEEIRCTNPIATEQYGSVSENLHMRGYR

SEQ ID NO: 31872 - protein, 30 aa, Artificial Sequence
  Description of Artificial Sequence: Synthetic polypeptide
SEEEIRCTNPIATEQYGSVSENLHRPGGNR

SEQ ID NO: 31873 - protein, 29 aa, Artificial Sequence
  Description of Artificial Sequence: Synthetic peptide
SEEEIRCTNPIATEQYGSVSENLIMVGNR

SEQ ID NO: 31874 - protein, 30 aa, Artificial Sequence
  Description of Artificial Sequence: Synthetic polypeptide
SEEEIRCTNPIATEQYGSVSENLIRGENNR

SEQ ID NO: 31875 - protein, 30 aa, Artificial Sequence
  Description of Artificial Sequence: Synthetic polypeptide
SEEEIRCTNPIATEQYGSVSENLLMRGHNR

SEQ ID NO: 31876 - protein, 30 aa, Artificial Sequence
  Description of Artificial Sequence: Synthetic polypeptide
SEEEIRCTNPIATEQYGSVSENLLMRGNRA

SEQ ID NO: 31877 - protein, 29 aa, Artificial Sequence
  Description of Artificial Sequence: Synthetic peptide
DEEEIRTTNPFATEQYGSVCSYNQFRGVD

SEQ ID NO: 31878 - protein, 30 aa, Artificial Sequence
  Description of Artificial Sequence: Synthetic polypeptide
SEEEIRCTNPIATEQYGSVSENLLMRLGNR

SEQ ID NO: 31879 - protein, 28 aa, Artificial Sequence
  Description of Artificial Sequence: Synthetic peptide
SEEEIRCTNPIATEQYGSVSENLMAENR

SEQ ID NO: 31880 - protein, 29 aa, Artificial Sequence
  Description of Artificial Sequence: Synthetic peptide
SEEEIRCTNPIATEQYGSVSENLMAGNRW

SEQ ID NO: 31881 - protein, 29 aa, Artificial Sequence
  Description of Artificial Sequence: Synthetic peptide
SEEEIRCTNPIATEQYGSVSENLMDGGNR

SEQ ID NO: 31882 - protein, 29 aa, Artificial Sequence
  Description of Artificial Sequence: Synthetic peptide
SEEEIRCTNPIATEQYGSVSENLMDIGNR

SEQ ID NO: 31883 - protein, 30 aa, Artificial Sequence
  Description of Artificial Sequence: Synthetic polypeptide
SEEEIRCTNPIATEQYGSVSENLMDREGNR

SEQ ID NO: 31884 - protein, 29 aa, Artificial Sequence
  Description of Artificial Sequence: Synthetic peptide
SEEEIRCTNPIATEQYGSVSENLMDYGNR

SEQ ID NO: 31885 - protein, 30 aa, Artificial Sequence
  Description of Artificial Sequence: Synthetic polypeptide
SEEEIRCTNPIATEQYGSVSENLMERGNER

SEQ ID NO: 31886 - protein, 29 aa, Artificial Sequence
  Description of Artificial Sequence: Synthetic peptide
SEEEIRCTNPIATEQYGSVSENLMFGNRM

SEQ ID NO: 31887 - protein, 28 aa, Artificial Sequence
  Description of Artificial Sequence: Synthetic peptide
DEEEIRTTNPFATEQYGSVHTGLCDGED

SEQ ID NO: 31888 - protein, 30 aa, Artificial Sequence
  Description of Artificial Sequence: Synthetic polypeptide
SEEEIRCTNPIATEQYGSVSENLGMRGNRD

SEQ ID NO: 31889 - protein, 30 aa, Artificial Sequence
  Description of Artificial Sequence: Synthetic polypeptide
SEEEIRCTNPIATEQYGSVSENLGMNRGNR

SEQ ID NO: 31890 - protein, 29 aa, Artificial Sequence
  Description of Artificial Sequence: Synthetic peptide
SEEEIRCTNPIATEQYGSVSENLGMHGNR

SEQ ID NO: 31891 - protein, 29 aa, Artificial Sequence
  Description of Artificial Sequence: Synthetic peptide
SEEEIRCTNPIATEQYGSVSENIMRGNRH

SEQ ID NO: 31892 - protein, 28 aa, Artificial Sequence
  Description of Artificial Sequence: Synthetic peptide
SEEEIRCTNPIATEQYGSVSENIMRGQR

SEQ ID NO: 31893 - protein, 32 aa, Artificial Sequence
  Description of Artificial Sequence: Synthetic polypeptide
AEEEIRTTNPVATEQYGSVSTTTNLQQGINDT

SEQ ID NO: 31894 - protein, 32 aa, Artificial Sequence
  Description of Artificial Sequence: Synthetic polypeptide
AEEEIRTTNPVATEQYGSVSTTTNLQQGINAE

SEQ ID NO: 31895 - protein, 29 aa, Artificial Sequence
  Description of Artificial Sequence: Synthetic peptide
SEEEIRCTNPIATEQYGSVSENIMRNGNR

SEQ ID NO: 31896 - protein, 28 aa, Artificial Sequence
  Description of Artificial Sequence: Synthetic peptide
SEEEIRCTNPIATEQYGSVSENIMTGNR

SEQ ID NO: 31897 - protein, 32 aa, Artificial Sequence
  Description of Artificial Sequence: Synthetic polypeptide
AEEEIRTTNPVATEQYGSVSTTTNLQGQGTNM

SEQ ID NO: 31898 - protein, 32 aa, Artificial Sequence
  Description of Artificial Sequence: Synthetic polypeptide
DEEEIRTTNPVATEQYGCVSNTNHQRSGSNPQ

SEQ ID NO: 31899 - protein, 32 aa, Artificial Sequence
  Description of Artificial Sequence: Synthetic polypeptide
AEEEIRTTNPVATEQYGSVSTTTNLQEIGNNQ

SEQ ID NO: 31900 - protein, 32 aa, Artificial Sequence
  Description of Artificial Sequence: Synthetic polypeptide
AEEEIRTTNPVATEQYGSVSTTTNLQDGNNVS

SEQ ID NO: 31901 - protein, 30 aa, Artificial Sequence
  Description of Artificial Sequence: Synthetic polypeptide
SEEEIRCTNPIATEQYGSVSENLDMVRGNR

SEQ ID NO: 31902 - protein, 30 aa, Artificial Sequence
  Description of Artificial Sequence: Synthetic polypeptide
SEEEIRCTNPIATEQYGSVSENLDVRGGNR

SEQ ID NO: 31903 - protein, 30 aa, Artificial Sequence
  Description of Artificial Sequence: Synthetic polypeptide
DEEEIRTTNPVATEQYGCVSNTNGNQYGQQ

SEQ ID NO: 31904 - protein, 30 aa, Artificial Sequence
  Description of Artificial Sequence: Synthetic polypeptide
SEEEIRCTNPIATEQYGSVSENLEDREGNR

SEQ ID NO: 31905 - protein, 29 aa, Artificial Sequence
  Description of Artificial Sequence: Synthetic peptide
DEEEIRTTNPFATEQYGSVCSYNHFNGND

SEQ ID NO: 31906 - protein, 30 aa, Artificial Sequence
  Description of Artificial Sequence: Synthetic polypeptide
DEEEIRTTNPFATEQYGSVCSYNIVRGGND

SEQ ID NO: 31907 - protein, 29 aa, Artificial Sequence
  Description of Artificial Sequence: Synthetic peptide
SEEEIRCTNPIATEQYGSVSENLEMMGNR

SEQ ID NO: 31908 - protein, 30 aa, Artificial Sequence
  Description of Artificial Sequence: Synthetic polypeptide
SEEEIRCTNPIATEQYGSVSENLERGNERE

SEQ ID NO: 31909 - protein, 30 aa, Artificial Sequence
  Description of Artificial Sequence: Synthetic polypeptide
SEEEIRCTNPIATEQYGSVSENLERGNQRD

SEQ ID NO: 31910 - protein, 32 aa, Artificial Sequence
  Description of Artificial Sequence: Synthetic polypeptide
DEEEIRTTNPVATEQYGCVSNTNLQYGGSERF

SEQ ID NO: 31911 - protein, 30 aa, Artificial Sequence
  Description of Artificial Sequence: Synthetic polypeptide
AEEEIRTTNPVATEQYGSVSTVNLENNQNI

SEQ ID NO: 31912 - protein, 31 aa, Artificial Sequence
  Description of Artificial Sequence: Synthetic polypeptide
AEEEIRTTNPVATEQYGSVSTTTNNQQGNGQ

SEQ ID NO: 31913 - protein, 30 aa, Artificial Sequence
  Description of Artificial Sequence: Synthetic polypeptide
SEEEIRCTNPIATEQYGSVSEGNLMRGNSR

SEQ ID NO: 31914 - protein, 30 aa, Artificial Sequence
  Description of Artificial Sequence: Synthetic polypeptide
SEEEIRCTNPIATEQYGSVMSENLMGRGNR

SEQ ID NO: 31915 - protein, 28 aa, Artificial Sequence
  Description of Artificial Sequence: Synthetic peptide
SEEEIRCTNPIATEQYGSVNENLMRGNV

SEQ ID NO: 31916 - protein, 28 aa, Artificial Sequence
  Description of Artificial Sequence: Synthetic peptide
SEEEIRCTNPIATEQYGSVNENLMSGNR

SEQ ID NO: 31917 - protein, 29 aa, Artificial Sequence
  Description of Artificial Sequence: Synthetic peptide
SEEEIRCTNPIATEQYGSVNSENLMRGTR

SEQ ID NO: 31918 - protein, 30 aa, Artificial Sequence
  Description of Artificial Sequence: Synthetic polypeptide
SEEEIRCTNPIATEQYGSVNSENLMRLGNR

SEQ ID NO: 31919 - protein, 30 aa, Artificial Sequence
  Description of Artificial Sequence: Synthetic polypeptide
SEEEIRCTNPIATEQYGSVNSEQNLMRGNR

SEQ ID NO: 31920 - protein, 28 aa, Artificial Sequence
  Description of Artificial Sequence: Synthetic peptide
SEEEIRCTNPIATEQYGSVPENCMRGNR

SEQ ID NO: 31921 - protein, 28 aa, Artificial Sequence
  Description of Artificial Sequence: Synthetic peptide
SEEEIRCTNPIATEQYGSVPENLMHGNR

SEQ ID NO: 31922 - protein, 29 aa, Artificial Sequence
  Description of Artificial Sequence: Synthetic peptide
SEEEIRCTNPIATEQYGSVLSENLMRGNK

SEQ ID NO: 31923 - protein, 28 aa, Artificial Sequence
  Description of Artificial Sequence: Synthetic peptide
SEEEIRCTNPIATEQYGSVPENLMRENR

SEQ ID NO: 31924 - protein, 29 aa, Artificial Sequence
  Description of Artificial Sequence: Synthetic peptide
DEEEIRTTNPEATQQYGCVPTDLQRGSNQ

SEQ ID NO: 31925 - protein, 30 aa, Artificial Sequence
  Description of Artificial Sequence: Synthetic polypeptide
DEEEIRTTNPVATEQYGCVSSEELQRGSEQ

SEQ ID NO: 31926 - protein, 30 aa, Artificial Sequence
  Description of Artificial Sequence: Synthetic polypeptide
SEEEIRCTNPIATEQYGSVPSENLMRGNRD

SEQ ID NO: 31927 - protein, 30 aa, Artificial Sequence
  Description of Artificial Sequence: Synthetic polypeptide
SEEEIRCTNPIATEQYGSVPSENLMRGSNR

SEQ ID NO: 31928 - protein, 29 aa, Artificial Sequence
  Description of Artificial Sequence: Synthetic peptide
SEEEIRCTNPIATEQYGSVQNENLMRGNR

SEQ ID NO: 31929 - protein, 30 aa, Artificial Sequence
  Description of Artificial Sequence: Synthetic polypeptide
SEEEIRCTNPIATEQYGSVQSAENLMRGNR

SEQ ID NO: 31930 - protein, 30 aa, Artificial Sequence
  Description of Artificial Sequence: Synthetic polypeptide
SEEEIRCTNPIATEQYGSVQSENLMRGNHR

SEQ ID NO: 31931 - protein, 30 aa, Artificial Sequence
  Description of Artificial Sequence: Synthetic polypeptide
SEEEIRCTNPIATEQYGSVQSENLMRLGNR

SEQ ID NO: 31932 - protein, 28 aa, Artificial Sequence
  Description of Artificial Sequence: Synthetic peptide
SEEEIRCTNPIATEQYGSVPENLMRKNR

SEQ ID NO: 31933 - protein, 28 aa, Artificial Sequence
  Description of Artificial Sequence: Synthetic peptide
SEEEIRCTNPIATEQYGSVRENLMDGNR

SEQ ID NO: 31934 - protein, 30 aa, Artificial Sequence
  Description of Artificial Sequence: Synthetic polypeptide
SEEEIRCTNPIATEQYGSVLSENLMRGNGR

SEQ ID NO: 31935 - protein, 30 aa, Artificial Sequence
  Description of Artificial Sequence: Synthetic polypeptide
SEEEIRCTNPIATEQYGSVKSEMNLMRGNR

SEQ ID NO: 31936 - protein, 29 aa, Artificial Sequence
  Description of Artificial Sequence: Synthetic peptide
SEEEIRCTNPIATEQYGSVFENLDMRGNR

SEQ ID NO: 31937 - protein, 29 aa, Artificial Sequence
  Description of Artificial Sequence: Synthetic peptide
SEEEIRCTNPIATEQYGSVFENLMRGNIR

SEQ ID NO: 31938 - protein, 31 aa, Artificial Sequence
  Description of Artificial Sequence: Synthetic polypeptide
AEEEIRTTNPVATEQYGSVSTTVNNEGGNQR

SEQ ID NO: 31939 - protein, 30 aa, Artificial Sequence
  Description of Artificial Sequence: Synthetic polypeptide
SEEEIRCTNPIATEQYGSVFSENLMRGTNR

SEQ ID NO: 31940 - protein, 30 aa, Artificial Sequence
  Description of Artificial Sequence: Synthetic polypeptide
SEEEIRCTNPIATEQYGSVFSENLMRYGNR

SEQ ID NO: 31941 - protein, 29 aa, Artificial Sequence
  Description of Artificial Sequence: Synthetic peptide
SEEEIRCTNPIATEQYGSVGEGNLMRGNR

SEQ ID NO: 31942 - protein, 32 aa, Artificial Sequence
  Description of Artificial Sequence: Synthetic polypeptide
AEEEIRTTNPVATEQYGSVSTTVNLQNDGNVE

SEQ ID NO: 31943 - protein, 28 aa, Artificial Sequence
  Description of Artificial Sequence: Synthetic peptide
SEEEIRCTNPIATEQYGSVGENLMRGMR

SEQ ID NO: 31944 - protein, 30 aa, Artificial Sequence
  Description of Artificial Sequence: Synthetic polypeptide
SEEEIRCTNPIATEQYGSVKSNENLMRGNR

SEQ ID NO: 31945 - protein, 29 aa, Artificial Sequence
  Description of Artificial Sequence: Synthetic peptide
SEEEIRCTNPIATEQYGSVGENLMRGTNR

SEQ ID NO: 31946 - protein, 29 aa, Artificial Sequence
  Description of Artificial Sequence: Synthetic peptide
SEEEIRCTNPIATEQYGSVGSENNMRGNR

SEQ ID NO: 31947 - protein, 31 aa, Artificial Sequence
  Description of Artificial Sequence: Synthetic polypeptide
DEEEIRTTNPVATEQYGCVSSELQRFGSERG

SEQ ID NO: 31948 - protein, 29 aa, Artificial Sequence
  Description of Artificial Sequence: Synthetic peptide
SEEEIRCTNPIATEQYGSVHSENLMRGNC

SEQ ID NO: 31949 - protein, 29 aa, Artificial Sequence
  Description of Artificial Sequence: Synthetic peptide
SEEEIRCTNPIATEQYGSVIENLMSRGNR

SEQ ID NO: 31950 - protein, 29 aa, Artificial Sequence
  Description of Artificial Sequence: Synthetic peptide
SEEEIRCTNPIATEQYGSVILENLMRGNR

SEQ ID NO: 31951 - protein, 29 aa, Artificial Sequence
  Description of Artificial Sequence: Synthetic peptide
SEEEIRCTNPIATEQYGSVISENLMRGFR

SEQ ID NO: 31952 - protein, 29 aa, Artificial Sequence
  Description of Artificial Sequence: Synthetic peptide
SEEEIRCTNPIATEQYGSVISENLMRGNW

SEQ ID NO: 31953 - protein, 29 aa, Artificial Sequence
  Description of Artificial Sequence: Synthetic peptide
DEEEIRTTNPEATHQYGQVPTDLSQRGNQ

SEQ ID NO: 31954 - protein, 29 aa, Artificial Sequence
  Description of Artificial Sequence: Synthetic peptide
SEEEIRCTNPIATEQYGSVGSENDMRGNR

SEQ ID NO: 31955 - protein, 30 aa, Artificial Sequence
  Description of Artificial Sequence: Synthetic polypeptide
SEEEIRCTNPIATEQYGSVRSEGNLMRGNR

SEQ ID NO: 31956 - protein, 29 aa, Artificial Sequence
  Description of Artificial Sequence: Synthetic peptide
SEEEIRCTNPIATEQYGSVRSENLMRGNI

SEQ ID NO: 31957 - protein, 30 aa, Artificial Sequence
  Description of Artificial Sequence: Synthetic polypeptide
SEEEIRCTNPIATEQYGSVRSENLMRQGNR

SEQ ID NO: 31958 - protein, 28 aa, Artificial Sequence
  Description of Artificial Sequence: Synthetic peptide
SEEEIRCTNPIATEQYGSVSECLMRGFR

SEQ ID NO: 31959 - protein, 29 aa, Artificial Sequence
  Description of Artificial Sequence: Synthetic peptide
SEEEIRCTNPIATEQYGSVSECLMSRGNR

SEQ ID NO: 31960 - protein, 28 aa, Artificial Sequence
  Description of Artificial Sequence: Synthetic peptide
DEEEIRTTNPEATQQYGQVPTDLGRGNF

SEQ ID NO: 31961 - protein, 29 aa, Artificial Sequence
  Description of Artificial Sequence: Synthetic peptide
SEEEIRCTNPIATEQYGSVSEDLMMRGNR

SEQ ID NO: 31962 - protein, 29 aa, Artificial Sequence
  Description of Artificial Sequence: Synthetic peptide
SEEEIRCTNPIATEQYGSVSEDLMPRGNR

SEQ ID NO: 31963 - protein, 28 aa, Artificial Sequence
  Description of Artificial Sequence: Synthetic peptide
SEEEIRCTNPIATEQYGSVSEDLMQGNR

SEQ ID NO: 31964 - protein, 30 aa, Artificial Sequence
  Description of Artificial Sequence: Synthetic polypeptide
SEEEIRCTNPIATEQYGSVSEDNLMRGHNR

SEQ ID NO: 31965 - protein, 29 aa, Artificial Sequence
  Description of Artificial Sequence: Synthetic peptide
DEEEIRTTNPEATQQYGQVPTDLQRGGNE

SEQ ID NO: 31966 - protein, 29 aa, Artificial Sequence
  Description of Artificial Sequence: Synthetic peptide
SEEEIRCTNPIATEQYGSVSEANPMRGNR

SEQ ID NO: 31967 - protein, 28 aa, Artificial Sequence
  Description of Artificial Sequence: Synthetic peptide
SEEEIRCTNPIATEQYGSVSEDQMRGNR

SEQ ID NO: 31968 - protein, 30 aa, Artificial Sequence
  Description of Artificial Sequence: Synthetic polypeptide
SEEEIRCTNPIATEQYGSVSEENLMRGNYR

SEQ ID NO: 31969 - protein, 30 aa, Artificial Sequence
  Description of Artificial Sequence: Synthetic polypeptide
SEEEIRCTNPIATEQYGSVSEENLMVRGNR

SEQ ID NO: 31970 - protein, 29 aa, Artificial Sequence
  Description of Artificial Sequence: Synthetic peptide
SEEEIRCTNPIATEQYGSVSEENNMRGNR

SEQ ID NO: 31971 - protein, 29 aa, Artificial Sequence
  Description of Artificial Sequence: Synthetic peptide
SEEEIRCTNPIATEQYGSVSEFLAMRGNR

SEQ ID NO: 31972 - protein, 28 aa, Artificial Sequence
  Description of Artificial Sequence: Synthetic peptide
SEEEIRCTNPIATEQYGSVSEGLMRGNE

SEQ ID NO: 31973 - protein, 28 aa, Artificial Sequence
  Description of Artificial Sequence: Synthetic peptide
SEEEIRCTNPIATEQYGSVSEGLMSGNR

SEQ ID NO: 31974 - protein, 29 aa, Artificial Sequence
  Description of Artificial Sequence: Synthetic peptide
SEEEIRCTNPIATEQYGSVSEGLYMRGNR

SEQ ID NO: 31975 - protein, 29 aa, Artificial Sequence
  Description of Artificial Sequence: Synthetic peptide
DEEEIRTTNPEATRQYGNVPTDLQRGNEF

SEQ ID NO: 31976 - protein, 29 aa, Artificial Sequence
  Description of Artificial Sequence: Synthetic peptide
SEEEIRCTNPIATEQYGSVSEENLMRGNT

SEQ ID NO: 31977 - protein, 31 aa, Artificial Sequence
  Description of Artificial Sequence: Synthetic polypeptide
AEEEIRTTNPVATEQYGSVSTTTNQQEGNVT

SEQ ID NO: 31978 - protein, 28 aa, Artificial Sequence
  Description of Artificial Sequence: Synthetic peptide
DEEEIRTTNPEATQQYGQVPTDIQRGNS

SEQ ID NO: 31979 - protein, 29 aa, Artificial Sequence
  Description of Artificial Sequence: Synthetic peptide
SEEEIRCTNPIATEQYGSVSEALMMRGNR

SEQ ID NO: 31980 - protein, 29 aa, Artificial Sequence
  Description of Artificial Sequence: Synthetic peptide
SEEEIRCTNPIATEQYGSVSAEGLMRGNR

SEQ ID NO: 31981 - protein, 30 aa, Artificial Sequence
  Description of Artificial Sequence: Synthetic polypeptide
SEEEIRCTNPIATEQYGSVSAENLMRGFNR

SEQ ID NO: 31982 - protein, 30 aa, Artificial Sequence
  Description of Artificial Sequence: Synthetic polypeptide
SEEEIRCTNPIATEQYGSVSAENLMRGNDR

SEQ ID NO: 31983 - protein, 29 aa, Artificial Sequence
  Description of Artificial Sequence: Synthetic peptide
SEEEIRCTNPIATEQYGSVSAENLMRGNT

SEQ ID NO: 31984 - protein, 30 aa, Artificial Sequence
  Description of Artificial Sequence: Synthetic polypeptide
SEEEIRCTNPIATEQYGSVSAENLMVRGNR

SEQ ID NO: 31985 - protein, 29 aa, Artificial Sequence
  Description of Artificial Sequence: Synthetic peptide
SEEEIRCTNPIATEQYGSVSANLMRGNEM

SEQ ID NO: 31986 - protein, 29 aa, Artificial Sequence
  Description of Artificial Sequence: Synthetic peptide
SEEEIRCTNPIATEQYGSVSANWMERGNR

SEQ ID NO: 31987 - protein, 29 aa, Artificial Sequence
  Description of Artificial Sequence: Synthetic peptide
SEEEIRCTNPIATEQYGSVSCEILMRGNR

SEQ ID NO: 31988 - protein, 31 aa, Artificial Sequence
  Description of Artificial Sequence: Synthetic polypeptide
DEEEIRTTNPVATEQYGCVSNTYDQFGSNRS

SEQ ID NO: 31989 - protein, 29 aa, Artificial Sequence
  Description of Artificial Sequence: Synthetic peptide
DEEEIRTTNPEATQQYGQVAPTDLQRGNA

SEQ ID NO: 31990 - protein, 28 aa, Artificial Sequence
  Description of Artificial Sequence: Synthetic peptide
DEEEIRTTNPEATQQYGQVATDLQGGNF

SEQ ID NO: 31991 - protein, 29 aa, Artificial Sequence
  Description of Artificial Sequence: Synthetic peptide
SEEEIRCTNPIATEQYGSVSCNEMRGENR

SEQ ID NO: 31992 - protein, 28 aa, Artificial Sequence
  Description of Artificial Sequence: Synthetic peptide
SEEEIRCTNPIATEQYGSVSCNLMSGNS

SEQ ID NO: 31993 - protein, 28 aa, Artificial Sequence
  Description of Artificial Sequence: Synthetic peptide
SEEEIRCTNPIATEQYGSVSCNLMSGTR

SEQ ID NO: 31994 - protein, 29 aa, Artificial Sequence
  Description of Artificial Sequence: Synthetic peptide
SEEEIRCTNPIATEQYGSVSCNLPMRGNG

SEQ ID NO: 31995 - protein, 30 aa, Artificial Sequence
  Description of Artificial Sequence: Synthetic polypeptide
SEEEIRCTNPIATEQYGSVSCNLTERGNDR

SEQ ID NO: 31996 - protein, 29 aa, Artificial Sequence
  Description of Artificial Sequence: Synthetic peptide
SEEEIRCTNPIATEQYGSVSCNLVMRTNR

SEQ ID NO: 31997 - protein, 30 aa, Artificial Sequence
  Description of Artificial Sequence: Synthetic polypeptide
SEEEIRCTNPIATEQYGSVSDENLSMRGNR

SEQ ID NO: 31998 - protein, 29 aa, Artificial Sequence
  Description of Artificial Sequence: Synthetic peptide
SEEEIRCTNPIATEQYGSVSDENWMRGNR

SEQ ID NO: 31999 - protein, 29 aa, Artificial Sequence
  Description of Artificial Sequence: Synthetic peptide
SEEEIRCTNPIATEQYGSVSEGNLMRGYR

SEQ ID NO: 32000 - protein, 31 aa, Artificial Sequence
  Description of Artificial Sequence: Synthetic polypeptide
DEEEIRTTNPVATEQYGCVSTDLQSIGGNPQ

SEQ ID NO: 32001 - protein, 31 aa, Artificial Sequence
  Description of Artificial Sequence: Synthetic polypeptide
AEEEIRTTNPVATEQYGSVSTVNLENNVGNE

SEQ ID NO: 32002 - protein, 31 aa, Artificial Sequence
  Description of Artificial Sequence: Synthetic polypeptide
AEEEIRTTNPVATEQYGSVSTVNLENQGNQQ

SEQ ID NO: 32003 - protein, 30 aa, Artificial Sequence
  Description of Artificial Sequence: Synthetic polypeptide
DEEEIRTTNPVATEQYGCVSTNHQFPSNQS

SEQ ID NO: 32004 - protein, 30 aa, Artificial Sequence
  Description of Artificial Sequence: Synthetic polypeptide
SEEEIATTNPVATEGYGSVSTNLQQGDDRY

SEQ ID NO: 32005 - protein, 29 aa, Artificial Sequence
  Description of Artificial Sequence: Synthetic peptide
SEEEIATTNPVATEGYGVVSTNLQQGDRE

SEQ ID NO: 32006 - protein, 30 aa, Artificial Sequence
  Description of Artificial Sequence: Synthetic polypeptide
SEEEIATTNPVATEHYGSVSTNLQQDNERM

SEQ ID NO: 32007 - protein, 29 aa, Artificial Sequence
  Description of Artificial Sequence: Synthetic peptide
SEEEIATTNPVATEMWGSVATNLERGNDR

SEQ ID NO: 32008 - protein, 31 aa, Artificial Sequence
  Description of Artificial Sequence: Synthetic polypeptide
DEEEIRTTNPVATEQYGCVSTNHFQRNSNAT

SEQ ID NO: 32009 - protein, 29 aa, Artificial Sequence
  Description of Artificial Sequence: Synthetic peptide
SEEEIATTNPVATEQWGNVSVTMLQGGNR

SEQ ID NO: 32010 - protein, 30 aa, Artificial Sequence
  Description of Artificial Sequence: Synthetic polypeptide
SEEEIATTNPVATEQWGSVATNDQRGNQRA

SEQ ID NO: 32011 - protein, 29 aa, Artificial Sequence
  Description of Artificial Sequence: Synthetic peptide
SEEEIATTNPVATEAYGSVSTNLQQGDTA

SEQ ID NO: 32012 - protein, 30 aa, Artificial Sequence
  Description of Artificial Sequence: Synthetic polypeptide
DEEEIRTTNPVATEQYGCVSTNHEHFGSNV

SEQ ID NO: 32013 - protein, 29 aa, Artificial Sequence
  Description of Artificial Sequence: Synthetic peptide
SEEEIATTNPVATEQWGSVSTNLQGGDDI

SEQ ID NO: 32014 - protein, 29 aa, Artificial Sequence
  Description of Artificial Sequence: Synthetic peptide
SEEEIATTNPVATEQYGCVATNLQQGNQM

SEQ ID NO: 32015 - protein, 28 aa, Artificial Sequence
  Description of Artificial Sequence: Synthetic peptide
DEEEIRTTNPVATEQYGCVSTNGESIDN

SEQ ID NO: 32016 - protein, 32 aa, Artificial Sequence
  Description of Artificial Sequence: Synthetic polypeptide
DEEEIRTTNPVATEQYGCVSTNETQGFGSNRT

SEQ ID NO: 32017 - protein, 32 aa, Artificial Sequence
  Description of Artificial Sequence: Synthetic polypeptide
SEEEIATTNPVATEQYGSVASATNLQEAGNDR

SEQ ID NO: 32018 - protein, 28 aa, Artificial Sequence
  Description of Artificial Sequence: Synthetic peptide
SEEEIATTNPVATEQYGSVATALQPGPQ

SEQ ID NO: 32019 - protein, 29 aa, Artificial Sequence
  Description of Artificial Sequence: Synthetic peptide
SEEEIATTNPVATEQYGSVATALTQDGND

SEQ ID NO: 32020 - protein, 30 aa, Artificial Sequence
  Description of Artificial Sequence: Synthetic polypeptide
DEEEIRTTNPVATEQYGCVSTNDQSNSNQM

SEQ ID NO: 32021 - protein, 30 aa, Artificial Sequence
  Description of Artificial Sequence: Synthetic polypeptide
SEEEIATTNPVATEQWGSVSPNLQQGNDRD

SEQ ID NO: 32022 - protein, 31 aa, Artificial Sequence
  Description of Artificial Sequence: Synthetic polypeptide
DEEEIRTTNPVATEQYGCVSTNDQRFNSNQA

SEQ ID NO: 32023 - protein, 28 aa, Artificial Sequence
  Description of Artificial Sequence: Synthetic peptide
SEEEIATTNPIATEQYGSVSENLQHEER

SEQ ID NO: 32024 - protein, 28 aa, Artificial Sequence
  Description of Artificial Sequence: Synthetic peptide
SEEEIATTNPIATEQYGEVSENLMRGER

SEQ ID NO: 32025 - protein, 28 aa, Artificial Sequence
  Description of Artificial Sequence: Synthetic peptide
SEEEIACTNPVATEQYGSVSTNLTDGDM

SEQ ID NO: 32026 - protein, 29 aa, Artificial Sequence
  Description of Artificial Sequence: Synthetic peptide
SEEEIACTNPVATEQYGVVSTNLQDGNEA

SEQ ID NO: 32027 - protein, 30 aa, Artificial Sequence
  Description of Artificial Sequence: Synthetic polypeptide
DEEEIRTTNPVATEQYGCVSTNLEIFGSDQ

SEQ ID NO: 32028 - protein, 28 aa, Artificial Sequence
  Description of Artificial Sequence: Synthetic peptide
SEEEIAPTNPCATEQYGIVSCNLQSGNR

SEQ ID NO: 32029 - protein, 28 aa, Artificial Sequence
  Description of Artificial Sequence: Synthetic peptide
SEEEIAPTNPIASEQYGSVSCNLQRGTR

SEQ ID NO: 32030 - protein, 30 aa, Artificial Sequence
  Description of Artificial Sequence: Synthetic polypeptide
DEEEIRTTNPVATEQYGCVSTNLDMGDEEA

SEQ ID NO: 32031 - protein, 28 aa, Artificial Sequence
  Description of Artificial Sequence: Synthetic peptide
SEEEIASTNPIATEQYGSMSENLMRGNR

SEQ ID NO: 32032 - protein, 31 aa, Artificial Sequence
  Description of Artificial Sequence: Synthetic polypeptide
DEEEIRTTNPVATEQYGCVSTNLDIGNENEG

SEQ ID NO: 32033 - protein, 31 aa, Artificial Sequence
  Description of Artificial Sequence: Synthetic polypeptide
DEEEIRTTNPVATEQYGCVSTNHQHNSNNRM

SEQ ID NO: 32034 - protein, 29 aa, Artificial Sequence
  Description of Artificial Sequence: Synthetic peptide
SEEEIASTNPVATEQYGSVSENLMSRGQR

SEQ ID NO: 32035 - protein, 28 aa, Artificial Sequence
  Description of Artificial Sequence: Synthetic peptide
SEEEIASTNPVCTEQYGSVSENLQSGNQ

SEQ ID NO: 32036 - protein, 28 aa, Artificial Sequence
  Description of Artificial Sequence: Synthetic peptide
SEEEIASTNPVCTEQYGVVSDNLQRGNQ

SEQ ID NO: 32037 - protein, 28 aa, Artificial Sequence
  Description of Artificial Sequence: Synthetic peptide
SEEEIASTNPVCTEQYGVVSENLQRGNQ

SEQ ID NO: 32038 - protein, 28 aa, Artificial Sequence
  Description of Artificial Sequence: Synthetic peptide
SEEEIASVNPVCTEQYGSVSDNLQRGNQ

SEQ ID NO: 32039 - protein, 32 aa, Artificial Sequence
  Description of Artificial Sequence: Synthetic polypeptide
DEEEIRTTNPVATEQYGCVSTNIPQTTDGNRN

SEQ ID NO: 32040 - protein, 31 aa, Artificial Sequence
  Description of Artificial Sequence: Synthetic polypeptide
DEEEIRTTNPVATEQYGCVSTNHQRNSNTAS

SEQ ID NO: 32041 - protein, 29 aa, Artificial Sequence
  Description of Artificial Sequence: Synthetic peptide
DEEEIRTTNPCATVQYGQVPTELQRGNQD

SEQ ID NO: 32042 - protein, 31 aa, Artificial Sequence
  Description of Artificial Sequence: Synthetic polypeptide
DEEEIRTTNPVATEQYGCVSTNHQHRTSMDR

SEQ ID NO: 32043 - protein, 28 aa, Artificial Sequence
  Description of Artificial Sequence: Synthetic peptide
SEEEIASTNPVCTEQYGSVSDNLQSGNQ

SEQ ID NO: 32044 - protein, 30 aa, Artificial Sequence
  Description of Artificial Sequence: Synthetic polypeptide
DEEEIRTTNPVATEQYGCVSTNDQHFGSEA

SEQ ID NO: 32045 - protein, 30 aa, Artificial Sequence
  Description of Artificial Sequence: Synthetic polypeptide
DEEEIRTTNPVATEQYGCVSTNDQATENGQ

SEQ ID NO: 32046 - protein, 30 aa, Artificial Sequence
  Description of Artificial Sequence: Synthetic polypeptide
SEEEIATTNPVATEQYGSVATNLQADGNDD

SEQ ID NO: 32047 - protein, 30 aa, Artificial Sequence
  Description of Artificial Sequence: Synthetic polypeptide
SEEEIATTNPVATEQYGSVSTNLQQGDEDA

SEQ ID NO: 32048 - protein, 31 aa, Artificial Sequence
  Description of Artificial Sequence: Synthetic polypeptide
SEEEIATTNPVATEQYGSVSTPDLQSRENRP

SEQ ID NO: 32049 - protein, 31 aa, Artificial Sequence
  Description of Artificial Sequence: Synthetic polypeptide
SEEEIATTNPVATEQYGTVASATNLQDQGNR

SEQ ID NO: 32050 - protein, 31 aa, Artificial Sequence
  Description of Artificial Sequence: Synthetic polypeptide
SEEEIATTNPVATEQYGTVASATNLQERGNQ

SEQ ID NO: 32051 - protein, 31 aa, Artificial Sequence
  Description of Artificial Sequence: Synthetic polypeptide
DEEEIRTTNPVATEQYGCVSTGNTQRFGSVQ

SEQ ID NO: 32052 - protein, 30 aa, Artificial Sequence
  Description of Artificial Sequence: Synthetic polypeptide
AEEEIRTTNPVATEQYGSVSTVNSNLGTNG

SEQ ID NO: 32053 - protein, 31 aa, Artificial Sequence
  Description of Artificial Sequence: Synthetic polypeptide
AEEEIRTTNPVATEQYGSVSTVNQQVGIQNT

SEQ ID NO: 32054 - protein, 31 aa, Artificial Sequence
  Description of Artificial Sequence: Synthetic polypeptide
DEEEIRTTNPVATEQYGCVSTGNLQNTSNAS

SEQ ID NO: 32055 - protein, 31 aa, Artificial Sequence
  Description of Artificial Sequence: Synthetic polypeptide
SEEEIATTNPVATEQYGSVSTNLQDQGNDQA

SEQ ID NO: 32056 - protein, 28 aa, Artificial Sequence
  Description of Artificial Sequence: Synthetic peptide
SEEEICCTNPIATEQYGSVSENLMGGNR

SEQ ID NO: 32057 - protein, 28 aa, Artificial Sequence
  Description of Artificial Sequence: Synthetic peptide
SEEEICCTNPIATEQYGSVSETLMRGNR

SEQ ID NO: 32058 - protein, 32 aa, Artificial Sequence
  Description of Artificial Sequence: Synthetic polypeptide
DEEEIRTTNPCAYEQWGSVSYTNLSQRVGNRP

SEQ ID NO: 32059 - protein, 31 aa, Artificial Sequence
  Description of Artificial Sequence: Synthetic polypeptide
DEEEIRTTNPVATEQYGCVSTGLHQNGSNQN

SEQ ID NO: 32060 - protein, 32 aa, Artificial Sequence
  Description of Artificial Sequence: Synthetic polypeptide
DEEEIRTTNPVATEQYGCVSTGEEHQRGSNRP

SEQ ID NO: 32061 - protein, 30 aa, Artificial Sequence
  Description of Artificial Sequence: Synthetic polypeptide
DEEEIRTTNPVATEQYGCVSTEWHQSGSNA

SEQ ID NO: 32062 - protein, 30 aa, Artificial Sequence
  Description of Artificial Sequence: Synthetic polypeptide
DEEEIRTTNPVATEQYGCVSTEWHQGGSER

SEQ ID NO: 32063 - protein, 30 aa, Artificial Sequence
  Description of Artificial Sequence: Synthetic polypeptide
AEEEIRTTNPVATEQYGSVSTVNQQLQTNN

SEQ ID NO: 32064 - protein, 31 aa, Artificial Sequence
  Description of Artificial Sequence: Synthetic polypeptide
DEEEIRTTNPCAYEQYGSVAATNLQRGGNEA

SEQ ID NO: 32065 - protein, 29 aa, Artificial Sequence
  Description of Artificial Sequence: Synthetic peptide
SEEEICCTNPIATEQYGSVSENLMRGNRD

SEQ ID NO: 32066 - protein, 30 aa, Artificial Sequence
  Description of Artificial Sequence: Synthetic polypeptide
SEEEIATTNPVATEQYGSVSTNLQDGPPED

SEQ ID NO: 32067 - protein, 30 aa, Artificial Sequence
  Description of Artificial Sequence: Synthetic polypeptide
SEEEIATTNPVATEQYGSVSTGNPDRGNPE

SEQ ID NO: 32068 - protein, 31 aa, Artificial Sequence
  Description of Artificial Sequence: Synthetic polypeptide
SEEEIATTNPVATEQYGSVSTGNLQQGNEHA

SEQ ID NO: 32069 - protein, 30 aa, Artificial Sequence
  Description of Artificial Sequence: Synthetic polypeptide
SEEEIATTNPVATEQYGSVATNLQADPNRN

SEQ ID NO: 32070 - protein, 31 aa, Artificial Sequence
  Description of Artificial Sequence: Synthetic polypeptide
DEEEIRTTNPVATEQYGCVSTNDHQSNSNRT

SEQ ID NO: 32071 - protein, 31 aa, Artificial Sequence
  Description of Artificial Sequence: Synthetic polypeptide
DEEEIRTTNPVATEQYGCVSTNDHQRNSNQF

SEQ ID NO: 32072 - protein, 32 aa, Artificial Sequence
  Description of Artificial Sequence: Synthetic polypeptide
SEEEIATTNPVATEQYGSVATNLQARAGENDR

SEQ ID NO: 32073 - protein, 30 aa, Artificial Sequence
  Description of Artificial Sequence: Synthetic polypeptide
SEEEIATTNPVATEQYGSVATNLQDPGERE

SEQ ID NO: 32074 - protein, 31 aa, Artificial Sequence
  Description of Artificial Sequence: Synthetic polypeptide
DEEEIRTTNPVATEQYGCVSTNDGQERDMIR

SEQ ID NO: 32075 - protein, 31 aa, Artificial Sequence
  Description of Artificial Sequence: Synthetic polypeptide
DEEEIRTTNPVATEQYGCVSTNDERGITNID

SEQ ID NO: 32076 - protein, 30 aa, Artificial Sequence
  Description of Artificial Sequence: Synthetic polypeptide
SEEEIATTNPVATEQYGSVATNLQNDGNMF

SEQ ID NO: 32077 - protein, 32 aa, Artificial Sequence
  Description of Artificial Sequence: Synthetic polypeptide
DEEEIRTTNPVATEQYGCVSTMNLQFFNSDRE

SEQ ID NO: 32078 - protein, 30 aa, Artificial Sequence
  Description of Artificial Sequence: Synthetic polypeptide
SEEEIATTNPVATEQYGSVATNLQNNGNDQ

SEQ ID NO: 32079 - protein, 30 aa, Artificial Sequence
  Description of Artificial Sequence: Synthetic polypeptide
SEEEIATTNPVATEQYGSVATNLQNPGENP

SEQ ID NO: 32080 - protein, 30 aa, Artificial Sequence
  Description of Artificial Sequence: Synthetic polypeptide
SEEEIATTNPVATEQYGSVATNLQQGNPDF

SEQ ID NO: 32081 - protein, 30 aa, Artificial Sequence
  Description of Artificial Sequence: Synthetic polypeptide
SEEEIATTNPVATEQYGSVATNLQRQANEY

SEQ ID NO: 32082 - protein, 31 aa, Artificial Sequence
  Description of Artificial Sequence: Synthetic polypeptide
AEEEIRTTNPVATEQYGSVSTVNVNENNGNR

SEQ ID NO: 32083 - protein, 32 aa, Artificial Sequence
  Description of Artificial Sequence: Synthetic polypeptide
SEEEIATTNPVATEQYGSVATSNLEQRGENDR

SEQ ID NO: 32084 - protein, 32 aa, Artificial Sequence
  Description of Artificial Sequence: Synthetic polypeptide
DEEEIRTTNPCAYEPYGSVSYTGNLSQRVGNR

SEQ ID NO: 32085 - protein, 30 aa, Artificial Sequence
  Description of Artificial Sequence: Synthetic polypeptide
DEEEIRTTNPVATEQYGCVSTLISDRGNNE

SEQ ID NO: 32086 - protein, 29 aa, Artificial Sequence
  Description of Artificial Sequence: Synthetic peptide
SEEEIATTNPVATEQYGSVCSTTDQRGPM

SEQ ID NO: 32087 - protein, 32 aa, Artificial Sequence
  Description of Artificial Sequence: Synthetic polypeptide
DEEEIRTTNPVATEQYGCVSTINHQEFFGSNR

SEQ ID NO: 32088 - protein, 30 aa, Artificial Sequence
  Description of Artificial Sequence: Synthetic polypeptide
SEEEIACTNPVATEQYGSVSTNLQVGNPEE

SEQ ID NO: 32089 - protein, 30 aa, Artificial Sequence
  Description of Artificial Sequence: Synthetic polypeptide
SEEEICTTNPVATEGYGSVSTNLQQGDNQA

SEQ ID NO: 32090 - protein, 30 aa, Artificial Sequence
  Description of Artificial Sequence: Synthetic polypeptide
SEEEIACTNPVATEQYGSVSTNLQNNGDNP

SEQ ID NO: 32091 - protein, 28 aa, Artificial Sequence
  Description of Artificial Sequence: Synthetic peptide
SEEEIACTNPVATEQYGSVSENLMHGER

SEQ ID NO: 32092 - protein, 28 aa, Artificial Sequence
  Description of Artificial Sequence: Synthetic peptide
SEEEIACTNPIATEGYGSVSENLMRGNR

SEQ ID NO: 32093 - protein, 28 aa, Artificial Sequence
  Description of Artificial Sequence: Synthetic peptide
SEEEIACTNPIATEQYGEASENLQRGNR

SEQ ID NO: 32094 - protein, 28 aa, Artificial Sequence
  Description of Artificial Sequence: Synthetic peptide
SEEEIACTNPIATEQYGEVSENLMRGNR

SEQ ID NO: 32095 - protein, 28 aa, Artificial Sequence
  Description of Artificial Sequence: Synthetic peptide
SEEEIACTNPIATEQYGEVSENLQRGGR

SEQ ID NO: 32096 - protein, 29 aa, Artificial Sequence
  Description of Artificial Sequence: Synthetic peptide
SEEEIACTNPIATEQYGNVSENLQSRGNR

SEQ ID NO: 32097 - protein, 31 aa, Artificial Sequence
  Description of Artificial Sequence: Synthetic polypeptide
DEEEIRTTNPVATEQYGCVSTNLQNSGSDQF

SEQ ID NO: 32098 - protein, 30 aa, Artificial Sequence
  Description of Artificial Sequence: Synthetic polypeptide
DEEEIRTTNPVATEQYGCVSTNLQNISDQY

SEQ ID NO: 32099 - protein, 28 aa, Artificial Sequence
  Description of Artificial Sequence: Synthetic peptide
SEEEIACTNPIATEQYGSVSENLMHGNR

SEQ ID NO: 32100 - protein, 28 aa, Artificial Sequence
  Description of Artificial Sequence: Synthetic peptide
SEEEIACTNPIASEQYGSVSENLQRGTR

SEQ ID NO: 32101 - protein, 28 aa, Artificial Sequence
  Description of Artificial Sequence: Synthetic peptide
SEEEIACTNPIATEQYGSVSENLMRGER

SEQ ID NO: 32102 - protein, 28 aa, Artificial Sequence
  Description of Artificial Sequence: Synthetic peptide
SEEEIACTNPIATEQYGSVSENLMRGNK

SEQ ID NO: 32103 - protein, 28 aa, Artificial Sequence
  Description of Artificial Sequence: Synthetic peptide
SEEEIACTNPIATEQYGSVSENLMRGNQ

SEQ ID NO: 32104 - protein, 29 aa, Artificial Sequence
  Description of Artificial Sequence: Synthetic peptide
SEEEIACTNPIATEQYGSVSENLMSRGNR

SEQ ID NO: 32105 - protein, 28 aa, Artificial Sequence
  Description of Artificial Sequence: Synthetic peptide
SEEEIACTNPIATEQYGSVSEVLMRGNR

SEQ ID NO: 32106 - protein, 28 aa, Artificial Sequence
  Description of Artificial Sequence: Synthetic peptide
SEEEIACTNPIATEQYGSVSEYLMRGNR

SEQ ID NO: 32107 - protein, 28 aa, Artificial Sequence
  Description of Artificial Sequence: Synthetic peptide
SEEEIACTNPIATEQYGVVSENLMRGNR

SEQ ID NO: 32108 - protein, 28 aa, Artificial Sequence
  Description of Artificial Sequence: Synthetic peptide
SEEEIACTNPICTEQYGSVSENLMRGNR

SEQ ID NO: 32109 - protein, 28 aa, Artificial Sequence
  Description of Artificial Sequence: Synthetic peptide
SEEEIACTNPICTEQYGSVSENLQRGNQ

SEQ ID NO: 32110 - protein, 28 aa, Artificial Sequence
  Description of Artificial Sequence: Synthetic peptide
SEEEIACTNPIATEQYGSVSENLMRGGR

SEQ ID NO: 32111 - protein, 28 aa, Artificial Sequence
  Description of Artificial Sequence: Synthetic peptide
SEEEIACTNPICTEQYGSVSENLQSGNR

SEQ ID NO: 32112 - protein, 28 aa, Artificial Sequence
  Description of Artificial Sequence: Synthetic peptide
SEEEIACTNPCATEQYGIVSCNLMRGNR

SEQ ID NO: 32113 - protein, 29 aa, Artificial Sequence
  Description of Artificial Sequence: Synthetic peptide
SEECIRCTNPIATEQYGSVSENLMRGNRI

SEQ ID NO: 32114 - protein, 29 aa, Artificial Sequence
  Description of Artificial Sequence: Synthetic peptide
SECEIRCTNPIATEQYGSVSENVLMRGNR

SEQ ID NO: 32115 - protein, 29 aa, Artificial Sequence
  Description of Artificial Sequence: Synthetic peptide
DEEEIRTTNPVATEQYGCVSTNNDNRDDN

SEQ ID NO: 32116 - protein, 28 aa, Artificial Sequence
  Description of Artificial Sequence: Synthetic peptide
SEDEIRCTNPIATEQYGSVSENEMRGNR

SEQ ID NO: 32117 - protein, 29 aa, Artificial Sequence
  Description of Artificial Sequence: Synthetic peptide
SEDEIRCTNPIATEQYGSVSENLERGNRA

SEQ ID NO: 32118 - protein, 28 aa, Artificial Sequence
  Description of Artificial Sequence: Synthetic peptide
SEDEIRCTNPIATEQYGSVSENLMRWNR

SEQ ID NO: 32119 - protein, 28 aa, Artificial Sequence
  Description of Artificial Sequence: Synthetic peptide
SEDEIRCTNPIATEQYGSVSENLNRGDR

SEQ ID NO: 32120 - protein, 29 aa, Artificial Sequence
  Description of Artificial Sequence: Synthetic peptide
SEDEIRCTNPIATEQYGSVSENLTMRGNR

SEQ ID NO: 32121 - protein, 29 aa, Artificial Sequence
  Description of Artificial Sequence: Synthetic peptide
SEDEIRCTNPVATEQYGSVFCTNLQHGNQ

SEQ ID NO: 32122 - protein, 28 aa, Artificial Sequence
  Description of Artificial Sequence: Synthetic peptide
SEEDIRCTNPIATEQYGSVSENLMYGNR

SEQ ID NO: 32123 - protein, 29 aa, Artificial Sequence
  Description of Artificial Sequence: Synthetic peptide
SEDEIRCTNPVATEQYGSVTTNLQHGNMQ

SEQ ID NO: 32124 - protein, 30 aa, Artificial Sequence
  Description of Artificial Sequence: Synthetic polypeptide
SEDEIRTTNPVATEQYGEVSTNLQHDNGNH

SEQ ID NO: 32125 - protein, 28 aa, Artificial Sequence
  Description of Artificial Sequence: Synthetic peptide
SEEAIRCTNPIATEIYGSVSENLMRGNR

SEQ ID NO: 32126 - protein, 29 aa, Artificial Sequence
  Description of Artificial Sequence: Synthetic peptide
SEEAIRCTNPIATEQYGASVSENLIRGNR

SEQ ID NO: 32127 - protein, 29 aa, Artificial Sequence
  Description of Artificial Sequence: Synthetic peptide
SEEAIRCTNPIATTEQYGSVSENLMRGNR

SEQ ID NO: 32128 - protein, 30 aa, Artificial Sequence
  Description of Artificial Sequence: Synthetic polypeptide
SEEAIRTTNPVATEQWGSVATNNLQLGVNR

SEQ ID NO: 32129 - protein, 31 aa, Artificial Sequence
  Description of Artificial Sequence: Synthetic polypeptide
DEEEIRTTNPVATEQYGCVSTNLQYSGSEQS

SEQ ID NO: 32130 - protein, 31 aa, Artificial Sequence
  Description of Artificial Sequence: Synthetic polypeptide
DEEEIRTTNPVATEQYGCVSTNLQTSINNQS

SEQ ID NO: 32131 - protein, 28 aa, Artificial Sequence
  Description of Artificial Sequence: Synthetic peptide
SEECIRCTNPIATEQYGSVSENLMEGNR

SEQ ID NO: 32132 - protein, 29 aa, Artificial Sequence
  Description of Artificial Sequence: Synthetic peptide
SEDEIRTTNPVATEQYGCVATNLQMGEER

SEQ ID NO: 32133 - protein, 30 aa, Artificial Sequence
  Description of Artificial Sequence: Synthetic polypeptide
DEEEIRTTNPVATEQYGCVSTNLQNFMSVQ

SEQ ID NO: 32134 - protein, 28 aa, Artificial Sequence
  Description of Artificial Sequence: Synthetic peptide
SEEEIACTNPISTEQYGSVSENLMRGNR

SEQ ID NO: 32135 - protein, 28 aa, Artificial Sequence
  Description of Artificial Sequence: Synthetic peptide
SEEEIACTNPTATEQYGSVSENLMTGNR

SEQ ID NO: 32136 - protein, 29 aa, Artificial Sequence
  Description of Artificial Sequence: Synthetic peptide
SEEEIACTNPVATEQYGSVATNLQAGNNQ

SEQ ID NO: 32137 - protein, 29 aa, Artificial Sequence
  Description of Artificial Sequence: Synthetic peptide
SEEEIACTNPVATEQYGSVATNLQDTNRL

SEQ ID NO: 32138 - protein, 31 aa, Artificial Sequence
  Description of Artificial Sequence: Synthetic polypeptide
DEEEIRTTNPVATEQYGCVSTNLIHGDNDQI

SEQ ID NO: 32139 - protein, 32 aa, Artificial Sequence
  Description of Artificial Sequence: Synthetic polypeptide
DEEEIRTTNPVATEQYGCVSTNLHQGFGSNQQ

SEQ ID NO: 32140 - protein, 28 aa, Artificial Sequence
  Description of Artificial Sequence: Synthetic peptide
DEEEIRTTNPCATESYGSVAPNHGRGNQ

SEQ ID NO: 32141 - protein, 29 aa, Artificial Sequence
  Description of Artificial Sequence: Synthetic peptide
DEEEIRTTNPCATESYGSVATNDGARGNA

SEQ ID NO: 32142 - protein, 29 aa, Artificial Sequence
  Description of Artificial Sequence: Synthetic peptide
DEEEIRTTNPCATESYGSVATNHERQGND

SEQ ID NO: 32143 - protein, 29 aa, Artificial Sequence
  Description of Artificial Sequence: Synthetic peptide
DEEEIRTTNPCATESYGSVATNHPRGNIL

SEQ ID NO: 32144 - protein, 32 aa, Artificial Sequence
  Description of Artificial Sequence: Synthetic polypeptide
DEEEIRTTNPVATEQYGCVSTNLNNRIGSNQF

SEQ ID NO: 32145 - protein, 29 aa, Artificial Sequence
  Description of Artificial Sequence: Synthetic peptide
DEEEIRTTNPCATESYGSVATNQHGRGNE

SEQ ID NO: 32146 - protein, 30 aa, Artificial Sequence
  Description of Artificial Sequence: Synthetic polypeptide
AEEEIRTTNPVATEQYGSVSTVTNLLQGEG

SEQ ID NO: 32147 - protein, 31 aa, Artificial Sequence
  Description of Artificial Sequence: Synthetic polypeptide
SEEEIACTNPVATEQYGSVATNLQRDGNPRP

SEQ ID NO: 32148 - protein, 32 aa, Artificial Sequence
  Description of Artificial Sequence: Synthetic polypeptide
DEEEIRTTNPVATEQYGCVSTNLFQNSGSNQS

SEQ ID NO: 32149 - protein, 29 aa, Artificial Sequence
  Description of Artificial Sequence: Synthetic peptide
SEEEIACTNPVATEQYGSVATNLQRINAD

SEQ ID NO: 32150 - protein, 29 aa, Artificial Sequence
  Description of Artificial Sequence: Synthetic peptide
DEEEIRTTNPCATEVYGSVATNNHGRGNA

SEQ ID NO: 32151 - protein, 31 aa, Artificial Sequence
  Description of Artificial Sequence: Synthetic polypeptide
DEEEIRTTNPVATEQYGCVSTNLEYFGSNNQ

SEQ ID NO: 32152 - protein, 29 aa, Artificial Sequence
  Description of Artificial Sequence: Synthetic peptide
DEEEIRTTNPCATMQYGQVPTDELQRGNE

SEQ ID NO: 32153 - protein, 29 aa, Artificial Sequence
  Description of Artificial Sequence: Synthetic peptide
SEEEIACTNPVATEQYGSVSAENLERGNL

SEQ ID NO: 32154 - protein, 29 aa, Artificial Sequence
  Description of Artificial Sequence: Synthetic peptide
DEEEIRTTNPCATESYGSVATTLHERGNA

SEQ ID NO: 32155 - protein, 28 aa, Artificial Sequence
  Description of Artificial Sequence: Synthetic peptide
DEEEIRTTNPCATESYGSCSTHLARGVD

SEQ ID NO: 32156 - protein, 32 aa, Artificial Sequence
  Description of Artificial Sequence: Synthetic polypeptide
DEEEIRTTNPVATEQYGCVSTNLNQHSGSNDT

SEQ ID NO: 32157 - protein, 28 aa, Artificial Sequence
  Description of Artificial Sequence: Synthetic peptide
DEEEIRTTNPCATERYGSVATNHGSGNA

SEQ ID NO: 32158 - protein, 28 aa, Artificial Sequence
  Description of Artificial Sequence: Synthetic peptide
SEEEIACTNPTATEQYGSVSENLNRGER

SEQ ID NO: 32159 - protein, 32 aa, Artificial Sequence
  Description of Artificial Sequence: Synthetic polypeptide
DEEEIRTTNPVATEQYGCVSTNLQMGLNEDEI

SEQ ID NO: 32160 - protein, 31 aa, Artificial Sequence
  Description of Artificial Sequence: Synthetic polypeptide
DEEEIRTTNPVATEQYGCVSTNLQMDQNDEI

SEQ ID NO: 32161 - protein, 31 aa, Artificial Sequence
  Description of Artificial Sequence: Synthetic polypeptide
DEEEIRTTNPVATEQYGCVSTNLQLGSEPEE

SEQ ID NO: 32162 - protein, 30 aa, Artificial Sequence
  Description of Artificial Sequence: Synthetic polypeptide
DEEEIRTTNPVATEQYGCVSTNLQIYSLDI

SEQ ID NO: 32163 - protein, 30 aa, Artificial Sequence
  Description of Artificial Sequence: Synthetic polypeptide
SEEEIACTNPVATEAYGSVSTNLQDQGNRM

SEQ ID NO: 32164 - protein, 29 aa, Artificial Sequence
  Description of Artificial Sequence: Synthetic peptide
SEEEIACTNPVATEAYGSVSTNLQQGDRN

SEQ ID NO: 32165 - protein, 29 aa, Artificial Sequence
  Description of Artificial Sequence: Synthetic peptide
SEEEIACTNPVATEAYGSVSTNLQSGNQM

SEQ ID NO: 32166 - protein, 28 aa, Artificial Sequence
  Description of Artificial Sequence: Synthetic peptide
SEEEIACTNPVATECYGDVSENLQRGER

SEQ ID NO: 32167 - protein, 28 aa, Artificial Sequence
  Description of Artificial Sequence: Synthetic peptide
SEEEIACTNPVATECYGSVSENLMRGER

SEQ ID NO: 32168 - protein, 31 aa, Artificial Sequence
  Description of Artificial Sequence: Synthetic polypeptide
DEEEIRTTNPVATEQYGCVSTNLQFFQSNTA

SEQ ID NO: 32169 - protein, 29 aa, Artificial Sequence
  Description of Artificial Sequence: Synthetic peptide
SEEEIACTNPVATEGYGSVATNLQGGNDR

SEQ ID NO: 32170 - protein, 29 aa, Artificial Sequence
  Description of Artificial Sequence: Synthetic peptide
SEEEIACTNPVATEPYGSVATNLQQGNRQ

SEQ ID NO: 32171 - protein, 31 aa, Artificial Sequence
  Description of Artificial Sequence: Synthetic polypeptide
DEEEIRTTNPVATEQYGCVSTNLQEFSSNDS

SEQ ID NO: 32172 - protein, 31 aa, Artificial Sequence
  Description of Artificial Sequence: Synthetic polypeptide
DEEEIRTTNPVATEQYGCVSTNLQEFFGDAS

SEQ ID NO: 32173 - protein, 32 aa, Artificial Sequence
  Description of Artificial Sequence: Synthetic polypeptide
DEEEIRTTNPVATEQYGCVSTNLPIGPNQDRI

SEQ ID NO: 32174 - protein, 31 aa, Artificial Sequence
  Description of Artificial Sequence: Synthetic polypeptide
DEEEIRTTNPVATEQYGCVSTNLNQNISNDY

SEQ ID NO: 32175 - protein, 29 aa, Artificial Sequence
  Description of Artificial Sequence: Synthetic peptide
SEEEIACTNPVATEQYGSVATNLQAANTR

SEQ ID NO: 32176 - protein, 32 aa, Artificial Sequence
  Description of Artificial Sequence: Synthetic polypeptide
DEEEIRTTNPVATEQYGCVSTNLNQNFGSNQF

SEQ ID NO: 32177 - protein, 29 aa, Artificial Sequence
  Description of Artificial Sequence: Synthetic peptide
SEEEIACTNPVATEQYGSVSTNLQGGDDL

SEQ ID NO: 32178 - protein, 29 aa, Artificial Sequence
  Description of Artificial Sequence: Synthetic peptide
SECEIRATNPVATEQYGSVETNLQIGNEQ

SEQ ID NO: 32179 - protein, 30 aa, Artificial Sequence
  Description of Artificial Sequence: Synthetic polypeptide
SEEEICTTNPVATEIYGSVATNLQNRGNDQ

SEQ ID NO: 32180 - protein, 31 aa, Artificial Sequence
  Description of Artificial Sequence: Synthetic polypeptide
AEEEIRTTNPVATEQYGSVSTVNQNQTGNSA

SEQ ID NO: 32181 - protein, 32 aa, Artificial Sequence
  Description of Artificial Sequence: Synthetic polypeptide
AEEEIRTTNPVATEQYGSVSTVNLQNEQGNIA

SEQ ID NO: 32182 - protein, 31 aa, Artificial Sequence
  Description of Artificial Sequence: Synthetic polypeptide
AEEEIRTTNPVATEQYGSVSTVNLQNDVNTA

SEQ ID NO: 32183 - protein, 30 aa, Artificial Sequence
  Description of Artificial Sequence: Synthetic polypeptide
DEEEIRTTNPVATEQYGCVSTEEQYFGSDR

SEQ ID NO: 32184 - protein, 30 aa, Artificial Sequence
  Description of Artificial Sequence: Synthetic polypeptide
SEEEIRCTNPAATEQYGSVSGELNLMRGNR

SEQ ID NO: 32185 - protein, 29 aa, Artificial Sequence
  Description of Artificial Sequence: Synthetic peptide
SEEEIRCTNPAATEQYGSVSIENLMGGNR

SEQ ID NO: 32186 - protein, 31 aa, Artificial Sequence
  Description of Artificial Sequence: Synthetic polypeptide
DEEEIRTTNPVATEQYGCVSTEEPQRSGSER

SEQ ID NO: 32187 - protein, 29 aa, Artificial Sequence
  Description of Artificial Sequence: Synthetic peptide
SEEEIRCTNPAATEQYGSVSINMGMRGNR

SEQ ID NO: 32188 - protein, 29 aa, Artificial Sequence
  Description of Artificial Sequence: Synthetic peptide
SEEEIRCTNPAATEQYGSVSLNLMREGNS

SEQ ID NO: 32189 - protein, 30 aa, Artificial Sequence
  Description of Artificial Sequence: Synthetic polypeptide
DEEEIRTTNPVATEQYGCVSTEGHQNGSQR

SEQ ID NO: 32190 - protein, 30 aa, Artificial Sequence
  Description of Artificial Sequence: Synthetic polypeptide
SEEEIRCTNPAATEQYGSVSSENLMRGPNR

SEQ ID NO: 32191 - protein, 31 aa, Artificial Sequence
  Description of Artificial Sequence: Synthetic polypeptide
DEEEIRTTNPVATEQYGCVSTEEPQRGSENQ

SEQ ID NO: 32192 - protein, 32 aa, Artificial Sequence
  Description of Artificial Sequence: Synthetic polypeptide
DEEEIRTTNPVATEQYGCVSTEELQRGSNFQL

SEQ ID NO: 32193 - protein, 29 aa, Artificial Sequence
  Description of Artificial Sequence: Synthetic peptide
SEEEIRCTNPAATEQYGSVYENLEVRGNR

SEQ ID NO: 32194 - protein, 30 aa, Artificial Sequence
  Description of Artificial Sequence: Synthetic polypeptide
DEEEIRTTNPVATEQYGCVSTEEIQSGSND

SEQ ID NO: 32195 - protein, 28 aa, Artificial Sequence
  Description of Artificial Sequence: Synthetic peptide
DEEEIRTTNPEATCQYGCVPTDLQGGNA

SEQ ID NO: 32196 - protein, 28 aa, Artificial Sequence
  Description of Artificial Sequence: Synthetic peptide
SEEEIRCTNPCATEQYGCVSENLMNGNR

SEQ ID NO: 32197 - protein, 28 aa, Artificial Sequence
  Description of Artificial Sequence: Synthetic peptide
SEEEIRCTNPCATEQYGCVSSNLMRGER

SEQ ID NO: 32198 - protein, 28 aa, Artificial Sequence
  Description of Artificial Sequence: Synthetic peptide
DEEEIRTTNPEATCQYGCVPTDLQRQNQ

SEQ ID NO: 32199 - protein, 30 aa, Artificial Sequence
  Description of Artificial Sequence: Synthetic polypeptide
SEEEIRCTNPAATEQYGSVVSENNLMRGNR

SEQ ID NO: 32200 - protein, 32 aa, Artificial Sequence
  Description of Artificial Sequence: Synthetic polypeptide
AEEEIRTTNPVATEQYGSVSTVNLQIGGNNTN

SEQ ID NO: 32201 - protein, 29 aa, Artificial Sequence
  Description of Artificial Sequence: Synthetic peptide
SEEEIRCTNPAATEQYGSVSENLMNGNLR

SEQ ID NO: 32202 - protein, 28 aa, Artificial Sequence
  Description of Artificial Sequence: Synthetic peptide
SEEEIRCTNPAATEQYGSVSENLERENQ

SEQ ID NO: 32203 - protein, 30 aa, Artificial Sequence
  Description of Artificial Sequence: Synthetic polypeptide
SEEEIRCTNPAATEQYGSVCSENLMREGNR

SEQ ID NO: 32204 - protein, 28 aa, Artificial Sequence
  Description of Artificial Sequence: Synthetic peptide
DEEEIRTTNPDATEQYGVVATCPIRGNS

SEQ ID NO: 32205 - protein, 32 aa, Artificial Sequence
  Description of Artificial Sequence: Synthetic polypeptide
AEEEIRTTNPVATEQYGSVSTVNLQQQGNIQN

SEQ ID NO: 32206 - protein, 32 aa, Artificial Sequence
  Description of Artificial Sequence: Synthetic polypeptide
AEEEIRTTNPVATEQYGSVSTVNLQQQGGNIG

SEQ ID NO: 32207 - protein, 30 aa, Artificial Sequence
  Description of Artificial Sequence: Synthetic polypeptide
SEEEIRCTNPAATEQYGSVMSLNLMRDGNR

SEQ ID NO: 32208 - protein, 29 aa, Artificial Sequence
  Description of Artificial Sequence: Synthetic peptide
SEEEIRCTNPAATEQYGSVPSENLMRGNM

SEQ ID NO: 32209 - protein, 29 aa, Artificial Sequence
  Description of Artificial Sequence: Synthetic peptide
SEEEIRCTNPAATEQYGSVSAENNMRGNR

SEQ ID NO: 32210 - protein, 29 aa, Artificial Sequence
  Description of Artificial Sequence: Synthetic peptide
SEEEIRCTNPAATEQYGSVSEMNLMRGNG

SEQ ID NO: 32211 - protein, 29 aa, Artificial Sequence
  Description of Artificial Sequence: Synthetic peptide
SEEEIRCTNPAATEQYGSVSENLERGNAD

SEQ ID NO: 32212 - protein, 28 aa, Artificial Sequence
  Description of Artificial Sequence: Synthetic peptide
SEEEIRCTNPAATEQYGSVSENEMVGNR

SEQ ID NO: 32213 - protein, 32 aa, Artificial Sequence
  Description of Artificial Sequence: Synthetic polypeptide
AEEEIRTTNPVATEQYGSVSTVNLQQIGGNVT

SEQ ID NO: 32214 - protein, 29 aa, Artificial Sequence
  Description of Artificial Sequence: Synthetic peptide
DEEEIRTTNPEATAQYGQVPTDLQRGNAP

SEQ ID NO: 32215 - protein, 32 aa, Artificial Sequence
  Description of Artificial Sequence: Synthetic polypeptide
AEEEIRTTNPVATEQYGSVSTVNLQQGQTQNQ

SEQ ID NO: 32216 - protein, 32 aa, Artificial Sequence
  Description of Artificial Sequence: Synthetic polypeptide
AEEEIRTTNPVATEQYGSVSTVNLQQGINEQN

SEQ ID NO: 32217 - protein, 32 aa, Artificial Sequence
  Description of Artificial Sequence: Synthetic polypeptide
AEEEIRTTNPVATEQYGSVSTVNLQQGENGSG

SEQ ID NO: 32218 - protein, 32 aa, Artificial Sequence
  Description of Artificial Sequence: Synthetic polypeptide
AEEEIRTTNPVATEQYGSVSTVNLQQEGNQGQ

SEQ ID NO: 32219 - protein, 31 aa, Artificial Sequence
  Description of Artificial Sequence: Synthetic polypeptide
AEEEIRTTNPVATEQYGSVSTVNLQNTANNE

SEQ ID NO: 32220 - protein, 31 aa, Artificial Sequence
  Description of Artificial Sequence: Synthetic polypeptide
DEEEIRTTNPVATEQYGCVSTEGHQRFGSNL

SEQ ID NO: 32221 - protein, 32 aa, Artificial Sequence
  Description of Artificial Sequence: Synthetic polypeptide
AEEEIRTTNPVATEQYGSVSTVNLQQIGNNTV

SEQ ID NO: 32222 - protein, 31 aa, Artificial Sequence
  Description of Artificial Sequence: Synthetic polypeptide
AEEEIRTTNPVATEQYGSVSTVNLQGTVNTT

SEQ ID NO: 32223 - protein, 31 aa, Artificial Sequence
  Description of Artificial Sequence: Synthetic polypeptide
AEEEIRTTNPVATEQYGSVSTVNLQGQIQNE

SEQ ID NO: 32224 - protein, 30 aa, Artificial Sequence
  Description of Artificial Sequence: Synthetic polypeptide
SEEEIRCTNPCATEQYGSLVQSENLDRGNR

SEQ ID NO: 32225 - protein, 28 aa, Artificial Sequence
  Description of Artificial Sequence: Synthetic peptide
SEEEIRCTNPEATEQYGSVSEHMMRGNR

SEQ ID NO: 32226 - protein, 30 aa, Artificial Sequence
  Description of Artificial Sequence: Synthetic polypeptide
SEEEIRCTNPEATEQYGSVSEMNLMRGNVR

SEQ ID NO: 32227 - protein, 31 aa, Artificial Sequence
  Description of Artificial Sequence: Synthetic polypeptide
AEEEIRTTNPVATEQYGSVSTVNLLQQQNNG

SEQ ID NO: 32228 - protein, 28 aa, Artificial Sequence
  Description of Artificial Sequence: Synthetic peptide
SEEEIRCTNPEATEQYGSVSENSMRYNR

SEQ ID NO: 32229 - protein, 30 aa, Artificial Sequence
  Description of Artificial Sequence: Synthetic polypeptide
SEEEIRCTNPFATEQYGSVSENLERGANDR

SEQ ID NO: 32230 - protein, 29 aa, Artificial Sequence
  Description of Artificial Sequence: Synthetic peptide
SEEEIRCTNPIACEQYGSVSENLMGRGNR

SEQ ID NO: 32231 - protein, 31 aa, Artificial Sequence
  Description of Artificial Sequence: Synthetic polypeptide
AEEEIRTTNPVATEQYGSVSTVNLLQGNEQG

SEQ ID NO: 32232 - protein, 29 aa, Artificial Sequence
  Description of Artificial Sequence: Synthetic peptide
SEEEIRCTNPIACEQYGSVSENVLMRGNR

SEQ ID NO: 32233 - protein, 31 aa, Artificial Sequence
  Description of Artificial Sequence: Synthetic polypeptide
DEEEIRTTNPEATEQYGCVCGTNLQRGSNTA

SEQ ID NO: 32234 - protein, 29 aa, Artificial Sequence
  Description of Artificial Sequence: Synthetic peptide
SEEEIRCTNPIADEQYGSVSENLMRGNER

SEQ ID NO: 32235 - protein, 30 aa, Artificial Sequence
  Description of Artificial Sequence: Synthetic polypeptide
AEEEIRTTNPVATEQYGSVSTVNLINENGE

SEQ ID NO: 32236 - protein, 29 aa, Artificial Sequence
  Description of Artificial Sequence: Synthetic peptide
SEEEIRCTNPIAFEQYGSVSENLMRGNRQ

SEQ ID NO: 32237 - protein, 29 aa, Artificial Sequence
  Description of Artificial Sequence: Synthetic peptide
SEEEIRCTNPIAFEQYGSVSENYLMRGNR

SEQ ID NO: 32238 - protein, 29 aa, Artificial Sequence
  Description of Artificial Sequence: Synthetic peptide
SEEEIRCTNPIAFEQYGSVSSENLMRGNR

SEQ ID NO: 32239 - protein, 30 aa, Artificial Sequence
  Description of Artificial Sequence: Synthetic polypeptide
DEEEIRTTNPVATEQYGCVSTDLQYLNDEI

SEQ ID NO: 32240 - protein, 29 aa, Artificial Sequence
  Description of Artificial Sequence: Synthetic peptide
SEEEIRCTNPIAHEQYGSVSEWNLMRGNR

SEQ ID NO: 32241 - protein, 29 aa, Artificial Sequence
  Description of Artificial Sequence: Synthetic peptide
SEEEIRCTNPIAHEQYGSVTSENLMRGNR

SEQ ID NO: 32242 - protein, 32 aa, Artificial Sequence
  Description of Artificial Sequence: Synthetic polypeptide
DEEEIRTTNPVATEQYGCVSTDLQYFGSNNRS

SEQ ID NO: 32243 - protein, 29 aa, Artificial Sequence
  Description of Artificial Sequence: Synthetic peptide
SEEEIRCTNPIAFEQYGSVISENLMRGNR

SEQ ID NO: 32244 - protein, 30 aa, Artificial Sequence
  Description of Artificial Sequence: Synthetic polypeptide
DEEEIRTTNPVATEQYGCVSTEAHQGGSNL

SEQ ID NO: 32245 - protein, 31 aa, Artificial Sequence
  Description of Artificial Sequence: Synthetic polypeptide
DEEEIRTTNPVATEQYGCVSTEAHQSGSNRT

SEQ ID NO: 32246 - protein, 31 aa, Artificial Sequence
  Description of Artificial Sequence: Synthetic polypeptide
DEEEIRTTNPVATEQYGCVSTEALQSGSNQS

SEQ ID NO: 32247 - protein, 31 aa, Artificial Sequence
  Description of Artificial Sequence: Synthetic polypeptide
AEEEIRTTNPVATEQYGSVSTVNLQEVNTNA

SEQ ID NO: 32248 - protein, 30 aa, Artificial Sequence
  Description of Artificial Sequence: Synthetic polypeptide
SEEEIRCTNPCATEQYGSVCSENLIRGNQR

SEQ ID NO: 32249 - protein, 32 aa, Artificial Sequence
  Description of Artificial Sequence: Synthetic polypeptide
DEEEIRTTNPVATEQYGCVSTEEHQRGSNTRN

SEQ ID NO: 32250 - protein, 31 aa, Artificial Sequence
  Description of Artificial Sequence: Synthetic polypeptide
DEEEIRTTNPVATEQYGCVSTEEHQNGSNRG

SEQ ID NO: 32251 - protein, 29 aa, Artificial Sequence
  Description of Artificial Sequence: Synthetic peptide
DEEEIRTTNPEATDQYGQVACTDLQRGNF

SEQ ID NO: 32252 - protein, 32 aa, Artificial Sequence
  Description of Artificial Sequence: Synthetic polypeptide
AEEEIRTTNPVATEQYGSVSTVNLQENNGNSG

SEQ ID NO: 32253 - protein, 29 aa, Artificial Sequence
  Description of Artificial Sequence: Synthetic peptide
DEEEIRTTNPEATDQYGQVPTDELQRGND

SEQ ID NO: 32254 - protein, 29 aa, Artificial Sequence
  Description of Artificial Sequence: Synthetic peptide
SEEEIRCTNPCATEQYGSVNTENLERGNQ

SEQ ID NO: 32255 - protein, 32 aa, Artificial Sequence
  Description of Artificial Sequence: Synthetic polypeptide
AEEEIRTTNPVATEQYGSVSTVNLQEGNINQN

SEQ ID NO: 32256 - protein, 32 aa, Artificial Sequence
  Description of Artificial Sequence: Synthetic polypeptide
DEEEIRTTNPVATEQYGCVSTEEDLQYSGSNR

SEQ ID NO: 32257 - protein, 30 aa, Artificial Sequence
  Description of Artificial Sequence: Synthetic polypeptide
DEEEIRTTNPVATEQYGCVSTEDPQRGSEV

SEQ ID NO: 32258 - protein, 29 aa, Artificial Sequence
  Description of Artificial Sequence: Synthetic peptide
DEEEIRTTNPEATEHYGSVSTNHQNLGEQ

SEQ ID NO: 32259 - protein, 32 aa, Artificial Sequence
  Description of Artificial Sequence: Synthetic polypeptide
AEEEIRTTNPVATEQYGSVSTVNLNQEQGGND

SEQ ID NO: 32260 - protein, 29 aa, Artificial Sequence
  Description of Artificial Sequence: Synthetic peptide
SEEEIRCTNPCATEQYGSVSNENLMRGVR

SEQ ID NO: 32261 - protein, 32 aa, Artificial Sequence
  Description of Artificial Sequence: Synthetic polypeptide
AEEEIRTTNPVATEQYGSVSTVNLNQENENIR

SEQ ID NO: 32262 - protein, 32 aa, Artificial Sequence
  Description of Artificial Sequence: Synthetic polypeptide
DEEEIRTTNPEATEPYGTSVSTVNLQDRIMNR

SEQ ID NO: 32263 - protein, 30 aa, Artificial Sequence
  Description of Artificial Sequence: Synthetic polypeptide
SEEEIRCTNPCATEQYGSVSNENSLERGNR

SEQ ID NO: 32264 - protein, 31 aa, Artificial Sequence
  Description of Artificial Sequence: Synthetic polypeptide
AEEEIRTTNPVATEQYGSVSTVNLNQEDTNE

SEQ ID NO: 32265 - protein, 31 aa, Artificial Sequence
  Description of Artificial Sequence: Synthetic polypeptide
DEEEIRTTNPVATEQYGCVSTEDLQFFGNQT

SEQ ID NO: 32266 - protein, 30 aa, Artificial Sequence
  Description of Artificial Sequence: Synthetic polypeptide
SEEEIRCTNPAATEQYGSVCSDENLERGNR

SEQ ID NO: 32267 - protein, 31 aa, Artificial Sequence
  Description of Artificial Sequence: Synthetic polypeptide
AEEEIRTTNPVATEQYGSVSTVNQQDNGNGD

SEQ ID NO: 32268 - protein, 31 aa, Artificial Sequence
  Description of Artificial Sequence: Synthetic polypeptide
SEEEIRATNPVATEQYGSVATNDQRGENTRS

SEQ ID NO: 32269 - protein, 29 aa, Artificial Sequence
  Description of Artificial Sequence: Synthetic peptide
SEEEIRATNPVATEQWGSVATNLDRGNDQ

SEQ ID NO: 32270 - protein, 29 aa, Artificial Sequence
  Description of Artificial Sequence: Synthetic peptide
SEEEICTTNPVATEQYGSVATNLQHDDNH

SEQ ID NO: 32271 - protein, 30 aa, Artificial Sequence
  Description of Artificial Sequence: Synthetic polypeptide
SEEEICTTNPVATEQYGSVATNLQMGNETM

SEQ ID NO: 32272 - protein, 32 aa, Artificial Sequence
  Description of Artificial Sequence: Synthetic polypeptide
DEEEIRTTNPVATEQYGCVSTENDQRFGSNPQ

SEQ ID NO: 32273 - protein, 31 aa, Artificial Sequence
  Description of Artificial Sequence: Synthetic polypeptide
DEEEIRTTNPVATEQYGCVSTEMHQNFGSNR

SEQ ID NO: 32274 - protein, 29 aa, Artificial Sequence
  Description of Artificial Sequence: Synthetic peptide
DEEEIRTTNPVATEQYGCVSTELTRNSDD

SEQ ID NO: 32275 - protein, 30 aa, Artificial Sequence
  Description of Artificial Sequence: Synthetic polypeptide
SEEEICTTNPVATEQYGSVATNLQQGNEQF

SEQ ID NO: 32276 - protein, 31 aa, Artificial Sequence
  Description of Artificial Sequence: Synthetic polypeptide
DEEEIRTTNPVATEQYGCVSTELQRFDSNFQ

SEQ ID NO: 32277 - protein, 30 aa, Artificial Sequence
  Description of Artificial Sequence: Synthetic polypeptide
SEEEICTTNPVATEQYGSVATNLQSGNDQL

SEQ ID NO: 32278 - protein, 31 aa, Artificial Sequence
  Description of Artificial Sequence: Synthetic polypeptide
DEEEIRTTNPVATEQYGCVSTENLQAGSEQY

SEQ ID NO: 32279 - protein, 29 aa, Artificial Sequence
  Description of Artificial Sequence: Synthetic peptide
SEEEICTTNPVATEQYGSVATNLQTDNTN

SEQ ID NO: 32280 - protein, 30 aa, Artificial Sequence
  Description of Artificial Sequence: Synthetic polypeptide
SEEEICTTNPVATEQYGSVSTNLDTGDNEQ

SEQ ID NO: 32281 - protein, 30 aa, Artificial Sequence
  Description of Artificial Sequence: Synthetic polypeptide
SEEEICTTNPVATEQYGSVSTNLQAAPNME

SEQ ID NO: 32282 - protein, 30 aa, Artificial Sequence
  Description of Artificial Sequence: Synthetic polypeptide
SEEEICTTNPVATEQYGSVSTNLQADNNDE

SEQ ID NO: 32283 - protein, 31 aa, Artificial Sequence
  Description of Artificial Sequence: Synthetic polypeptide
AEEEIRTTNPVATEQYGSVSTVNNQQIGNQN

SEQ ID NO: 32284 - protein, 30 aa, Artificial Sequence
  Description of Artificial Sequence: Synthetic polypeptide
SEEEICTTNPVATEQYGSVSTNLQGGDDDI

SEQ ID NO: 32285 - protein, 29 aa, Artificial Sequence
  Description of Artificial Sequence: Synthetic peptide
SEEEICTTNPVATEQYGSVSTNLQGPDDA

SEQ ID NO: 32286 - protein, 31 aa, Artificial Sequence
  Description of Artificial Sequence: Synthetic polypeptide
SEEEICTTNPVATEQYGSVSVNLQHGDNDRD

SEQ ID NO: 32287 - protein, 30 aa, Artificial Sequence
  Description of Artificial Sequence: Synthetic polypeptide
SEEEICTTNPVATESYGSVATNLQERGNEG

SEQ ID NO: 32288 - protein, 31 aa, Artificial Sequence
  Description of Artificial Sequence: Synthetic polypeptide
DEEEIRTTNPVATEQYGCVSTELQNFGNFIP

SEQ ID NO: 32289 - protein, 29 aa, Artificial Sequence
  Description of Artificial Sequence: Synthetic peptide
SEEEICTTNPVATESYGSVATNLQHDGNQ

SEQ ID NO: 32290 - protein, 29 aa, Artificial Sequence
  Description of Artificial Sequence: Synthetic peptide
SEEEICTTNPVATEQYGSVATNLQDGAMP

SEQ ID NO: 32291 - protein, 29 aa, Artificial Sequence
  Description of Artificial Sequence: Synthetic peptide
SEEEICTTNPVATEQYGSVATNLQADNNE

SEQ ID NO: 32292 - protein, 30 aa, Artificial Sequence
  Description of Artificial Sequence: Synthetic polypeptide
SEEEICTTNPVATEMYGSVATNLQERGNVM

SEQ ID NO: 32293 - protein, 31 aa, Artificial Sequence
  Description of Artificial Sequence: Synthetic polypeptide
DEEEIRTTNPCAYEQYGSVATNLQRGNNAEM

SEQ ID NO: 32294 - protein, 30 aa, Artificial Sequence
  Description of Artificial Sequence: Synthetic polypeptide
SEEEICTTNPVATEMYGSVSTNLQGGDTRA

SEQ ID NO: 32295 - protein, 30 aa, Artificial Sequence
  Description of Artificial Sequence: Synthetic polypeptide
SEEEICTTNPVATEMYGSVSTNLQRDGDDL

SEQ ID NO: 32296 - protein, 31 aa, Artificial Sequence
  Description of Artificial Sequence: Synthetic polypeptide
DEEEIRTTNPCAYEQYGSVATNLQRTDNDRE

SEQ ID NO: 32297 - protein, 29 aa, Artificial Sequence
  Description of Artificial Sequence: Synthetic peptide
DEEEIRTTNPVATEQYGCVSTEPQRISEL

SEQ ID NO: 32298 - protein, 31 aa, Artificial Sequence
  Description of Artificial Sequence: Synthetic polypeptide
DEEEIRTTNPVATEQYGCVSTEPQHGSENRS

SEQ ID NO: 32299 - protein, 28 aa, Artificial Sequence
  Description of Artificial Sequence: Synthetic peptide
SEEEICTTNPVATEPYGSVSAALQDGND

SEQ ID NO: 32300 - protein, 32 aa, Artificial Sequence
  Description of Artificial Sequence: Synthetic polypeptide
DEEEIRTTNPVATEQYGCVSTENLQNGSNNAG

SEQ ID NO: 32301 - protein, 30 aa, Artificial Sequence
  Description of Artificial Sequence: Synthetic polypeptide
SEEEICTTNPVATEPYGSVSTNLQGDGNIP

SEQ ID NO: 32302 - protein, 32 aa, Artificial Sequence
  Description of Artificial Sequence: Synthetic polypeptide
DEEEIRTTNPVATEQYGCVSTEPHQRFGSNRA

SEQ ID NO: 32303 - protein, 33 aa, Artificial Sequence
  Description of Artificial Sequence: Synthetic polypeptide
DEEEIRTTNPCAYEQYGSVSYTNELSQRVGNRM

SEQ ID NO: 32304 - protein, 31 aa, Artificial Sequence
  Description of Artificial Sequence: Synthetic polypeptide
DEEEIRTTNPVATEQYGCVSTEPHQNGSNRP

SEQ ID NO: 32305 - protein, 31 aa, Artificial Sequence
  Description of Artificial Sequence: Synthetic polypeptide
DEEEIRTTNPVATEQYGCVSTEPHERFGSNR

SEQ ID NO: 32306 - protein, 29 aa, Artificial Sequence
  Description of Artificial Sequence: Synthetic peptide
SEEEICTTNPVATEQYGNVSVTMLQGGNA

SEQ ID NO: 32307 - protein, 29 aa, Artificial Sequence
  Description of Artificial Sequence: Synthetic peptide
SEEEICTTNPVATEQYGSVAITNLQVGDA

SEQ ID NO: 32308 - protein, 33 aa, Artificial Sequence
  Description of Artificial Sequence: Synthetic polypeptide
DEEEIRTTNPVATEQYGCVSTENLQRFQSNTRP

SEQ ID NO: 32309 - protein, 30 aa, Artificial Sequence
  Description of Artificial Sequence: Synthetic polypeptide
SEEEICTTNPVATEQYGSVATNLERGDNEA

SEQ ID NO: 32310 - protein, 30 aa, Artificial Sequence
  Description of Artificial Sequence: Synthetic polypeptide
SEEEICTTNPVATEPYGSVSTNLQGQGNMI

SEQ ID NO: 32311 - protein, 31 aa, Artificial Sequence
  Description of Artificial Sequence: Synthetic polypeptide
DEEEIRTTNPVATEQYGCVSTELQAGSNTQS

SEQ ID NO: 32312 - protein, 30 aa, Artificial Sequence
  Description of Artificial Sequence: Synthetic polypeptide
DEEEIRTTNPVATEQYGCVSTELIHGSNQS

SEQ ID NO: 32313 - protein, 29 aa, Artificial Sequence
  Description of Artificial Sequence: Synthetic peptide
SEEEICTTNPVAYEPYGSVATNLQRGNED

SEQ ID NO: 32314 - protein, 28 aa, Artificial Sequence
  Description of Artificial Sequence: Synthetic peptide
SEEEIQCTNPIATMQYGSVSENLMRGNR

SEQ ID NO: 32315 - protein, 28 aa, Artificial Sequence
  Description of Artificial Sequence: Synthetic peptide
SEEEIRATNPAATEQYGSVSENGMRGNA

SEQ ID NO: 32316 - protein, 29 aa, Artificial Sequence
  Description of Artificial Sequence: Synthetic peptide
DEEEIRTTNPDATEGYGSCSTNPARWGNI

SEQ ID NO: 32317 - protein, 29 aa, Artificial Sequence
  Description of Artificial Sequence: Synthetic peptide
SEEEIRATNPCATEQYGSVSENLMDGENR

SEQ ID NO: 32318 - protein, 31 aa, Artificial Sequence
  Description of Artificial Sequence: Synthetic polypeptide
AEEEIRTTNPVATEQYGSVSTVNNLQVQEND

SEQ ID NO: 32319 - protein, 29 aa, Artificial Sequence
  Description of Artificial Sequence: Synthetic peptide
SEEEIRATNPCATEQYGSVSENLMERGNL

SEQ ID NO: 32320 - protein, 28 aa, Artificial Sequence
  Description of Artificial Sequence: Synthetic peptide
SEEEIRATNPCATEQYGSVSENLMGENR

SEQ ID NO: 32321 - protein, 28 aa, Artificial Sequence
  Description of Artificial Sequence: Synthetic peptide
SEEEIRATNPCATEQYGSVSENLMNGNE

SEQ ID NO: 32322 - protein, 29 aa, Artificial Sequence
  Description of Artificial Sequence: Synthetic peptide
SEEEIQCTNPIATEQYGSVSENLMRFGNR

SEQ ID NO: 32323 - protein, 29 aa, Artificial Sequence
  Description of Artificial Sequence: Synthetic peptide
SEEEIRATNPCATEQYGSVSENLMQGNDR

SEQ ID NO: 32324 - protein, 28 aa, Artificial Sequence
  Description of Artificial Sequence: Synthetic peptide
SEEEIRATNPCATEQYGSVSNNLMDGNM

SEQ ID NO: 32325 - protein, 31 aa, Artificial Sequence
  Description of Artificial Sequence: Synthetic polypeptide
SEEEIRATNPIATEQYGSVSVNDLQMRGNRD

SEQ ID NO: 32326 - protein, 29 aa, Artificial Sequence
  Description of Artificial Sequence: Synthetic peptide
SEEEIRATNPVATEHYGSVSTNLQSGMQM

SEQ ID NO: 32327 - protein, 29 aa, Artificial Sequence
  Description of Artificial Sequence: Synthetic peptide
SEEEIRATNPVATEHYGVVSTNLQQGDRA

SEQ ID NO: 32328 - protein, 29 aa, Artificial Sequence
  Description of Artificial Sequence: Synthetic peptide
SEEEIRATNPVATEHYGVVSTNLQQGNAM

SEQ ID NO: 32329 - protein, 31 aa, Artificial Sequence
  Description of Artificial Sequence: Synthetic polypeptide
AEEEIRTTNPVATEQYGSVSTVNNDENNGNR

SEQ ID NO: 32330 - protein, 30 aa, Artificial Sequence
  Description of Artificial Sequence: Synthetic polypeptide
AEEEIRTTNPVATEQYGSVSTVNNDEGGNQ

SEQ ID NO: 32331 - protein, 31 aa, Artificial Sequence
  Description of Artificial Sequence: Synthetic polypeptide
DEEEIRTTNPVATEQYGCVSTEHQRSNSDRT

SEQ ID NO: 32332 - protein, 28 aa, Artificial Sequence
  Description of Artificial Sequence: Synthetic peptide
SEEEIRATNPCATEQYGSVSENLTTGNM

SEQ ID NO: 32333 - protein, 29 aa, Artificial Sequence
  Description of Artificial Sequence: Synthetic peptide
SEEEIQCTNPIATEQYGSVSENLLMRGNR

SEQ ID NO: 32334 - protein, 28 aa, Artificial Sequence
  Description of Artificial Sequence: Synthetic peptide
SEEEIQCTNPIATEQWGSVSENLMRGNR

SEQ ID NO: 32335 - protein, 28 aa, Artificial Sequence
  Description of Artificial Sequence: Synthetic peptide
SEEEINCTNPIATEQYGSVSENYMRGNR

SEQ ID NO: 32336 - protein, 28 aa, Artificial Sequence
  Description of Artificial Sequence: Synthetic peptide
SEEEICTTNPVAYEQYGSVATNLQFGED

SEQ ID NO: 32337 - protein, 30 aa, Artificial Sequence
  Description of Artificial Sequence: Synthetic polypeptide
DEEEIRTTNPVATEQYGCVSTELENFGSNV

SEQ ID NO: 32338 - protein, 30 aa, Artificial Sequence
  Description of Artificial Sequence: Synthetic polypeptide
DEEEIRTTNPDATEAYGSTCSTNLSARGND

SEQ ID NO: 32339 - protein, 29 aa, Artificial Sequence
  Description of Artificial Sequence: Synthetic peptide
DEEEIRTTNPDATEGYGSCSTNLARGIDD

SEQ ID NO: 32340 - protein, 29 aa, Artificial Sequence
  Description of Artificial Sequence: Synthetic peptide
SEEEIDCTNPIATEQYGSVSENLMRGNRE

SEQ ID NO: 32341 - protein, 28 aa, Artificial Sequence
  Description of Artificial Sequence: Synthetic peptide
SEEEIDCTNPIAYEQYGSVSENLMRGNR

SEQ ID NO: 32342 - protein, 29 aa, Artificial Sequence
  Description of Artificial Sequence: Synthetic peptide
SEEEIGCTNPIATEQYGSVSECNLMRGNR

SEQ ID NO: 32343 - protein, 30 aa, Artificial Sequence
  Description of Artificial Sequence: Synthetic polypeptide
DEEEIRTTNPDATEGYGSCSTNLARGNIDQ

SEQ ID NO: 32344 - protein, 28 aa, Artificial Sequence
  Description of Artificial Sequence: Synthetic peptide
SEEEIGCTNPIATEQYGSVSEILMRGNR

SEQ ID NO: 32345 - protein, 30 aa, Artificial Sequence
  Description of Artificial Sequence: Synthetic polypeptide
SEEEIGTTNPVATEQYGSVASTQLQEGNGV

SEQ ID NO: 32346 - protein, 28 aa, Artificial Sequence
  Description of Artificial Sequence: Synthetic peptide
SEEEIHCTNPIATEEYGSVSENLMRGNR

SEQ ID NO: 32347 - protein, 28 aa, Artificial Sequence
  Description of Artificial Sequence: Synthetic peptide
SEEEIHCTNPIATEQYGSVSENLMRVNR

SEQ ID NO: 32348 - protein, 29 aa, Artificial Sequence
  Description of Artificial Sequence: Synthetic peptide
SEEEIICTNPIATEQYGSVVSENLMRGNR

SEQ ID NO: 32349 - protein, 28 aa, Artificial Sequence
  Description of Artificial Sequence: Synthetic peptide
DEEEIRTTNPDATEGYGSCSTNLARNQE

SEQ ID NO: 32350 - protein, 29 aa, Artificial Sequence
  Description of Artificial Sequence: Synthetic peptide
SEEEIKCTNPIATEQYGSVDSENLMRGNR

SEQ ID NO: 32351 - protein, 28 aa, Artificial Sequence
  Description of Artificial Sequence: Synthetic peptide
SEEEIKCTNPIATEQYGSVSENLMRGDR

SEQ ID NO: 32352 - protein, 29 aa, Artificial Sequence
  Description of Artificial Sequence: Synthetic peptide
SEEEIKCTNPIATEQYGSVSMENLMRGNR

SEQ ID NO: 32353 - protein, 29 aa, Artificial Sequence
  Description of Artificial Sequence: Synthetic peptide
DEEEIRTTNPDATEGYGSCSTNLATGNWN

SEQ ID NO: 32354 - protein, 28 aa, Artificial Sequence
  Description of Artificial Sequence: Synthetic peptide
SEEEINCTNPIATEQYGSVSENLMRGLR

SEQ ID NO: 32355 - protein, 31 aa, Artificial Sequence
  Description of Artificial Sequence: Synthetic polypeptide
DEEEIRTTNPVATEQYGCVSTEHQRFNSNRS

SEQ ID NO: 32356 - protein, 33 aa, Artificial Sequence
  Description of Artificial Sequence: Synthetic polypeptide
DEEEIRTTNPVATEQYGKTVPSYTNLSQSGNNR

SEQ ID NO: 32357 - protein, 33 aa, Artificial Sequence
  Description of Artificial Sequence: Synthetic polypeptide
DEEEIRTTNPVATEQYGKTVSCTGNLQQTGNNR

SEQ ID NO: 32358 - protein, 33 aa, Artificial Sequence
  Description of Artificial Sequence: Synthetic polypeptide
DEEEIRTTNPVATEQYGKTVSCTNALQRGGNDE

SEQ ID NO: 32359 - protein, 31 aa, Artificial Sequence
  Description of Artificial Sequence: Synthetic polypeptide
DTEEIRCTNPVATEQYGSVVSTNLQNGTERH

SEQ ID NO: 32360 - protein, 30 aa, Artificial Sequence
  Description of Artificial Sequence: Synthetic polypeptide
DTEEIRCTNPVATERYGSVVSTNLSQNGTR

SEQ ID NO: 32361 - protein, 29 aa, Artificial Sequence
  Description of Artificial Sequence: Synthetic peptide
DTEEIRSTNPVATEQYGSISTNMQGGNEN

SEQ ID NO: 32362 - protein, 30 aa, Artificial Sequence
  Description of Artificial Sequence: Synthetic polypeptide
DTEEIRSTNPVATEQYGSVSTNLQANNGQM

SEQ ID NO: 32363 - protein, 30 aa, Artificial Sequence
  Description of Artificial Sequence: Synthetic polypeptide
DTEEIRSTNPVATEQYGSVSTNLQNANGQF

SEQ ID NO: 32364 - protein, 31 aa, Artificial Sequence
  Description of Artificial Sequence: Synthetic polypeptide
DTEEIRSTNPVATEQYGSVSTNLQNENGTQR

SEQ ID NO: 32365 - protein, 31 aa, Artificial Sequence
  Description of Artificial Sequence: Synthetic polypeptide
DTEEIRSTNPVATEQYGSVSTNLQQQVNGQR

SEQ ID NO: 32366 - protein, 31 aa, Artificial Sequence
  Description of Artificial Sequence: Synthetic polypeptide
DTEEIRSTNPVATEQYGSVVSTNLSQNGTYR

SEQ ID NO: 32367 - protein, 31 aa, Artificial Sequence
  Description of Artificial Sequence: Synthetic polypeptide
DTEEIRCTNPVATEQYGSVVSTNLQDGITDR

SEQ ID NO: 32368 - protein, 31 aa, Artificial Sequence
  Description of Artificial Sequence: Synthetic polypeptide
DEEEIRATNPVATEQYGTVSHTNDVQGTGNR

SEQ ID NO: 32369 - protein, 31 aa, Artificial Sequence
  Description of Artificial Sequence: Synthetic polypeptide
DEEEIRATNPVATEQYGTVSMTNLNQGFGNQ

SEQ ID NO: 32370 - protein, 31 aa, Artificial Sequence
  Description of Artificial Sequence: Synthetic polypeptide
DEEEIRATNPVATEQYGTVSVTNLNQGGNVA

SEQ ID NO: 32371 - protein, 29 aa, Artificial Sequence
  Description of Artificial Sequence: Synthetic peptide
DTEEIRTTNPCATEAYGSVSVNLNQNENR

SEQ ID NO: 32372 - protein, 29 aa, Artificial Sequence
  Description of Artificial Sequence: Synthetic peptide
DTEEIRTTNPCATEAYGSVSVNLQEENQR

SEQ ID NO: 32373 - protein, 29 aa, Artificial Sequence
  Description of Artificial Sequence: Synthetic peptide
DTEEIRTTNPCATEAYGSVSVNLQQGENE

SEQ ID NO: 32374 - protein, 30 aa, Artificial Sequence
  Description of Artificial Sequence: Synthetic polypeptide
DTEEIRTTNPCATEAYGSVSVNLQRGEENE

SEQ ID NO: 32375 - protein, 28 aa, Artificial Sequence
  Description of Artificial Sequence: Synthetic peptide
DTEEIRTTNPCATEAYGSVSVNLQYENG

SEQ ID NO: 32376 - protein, 29 aa, Artificial Sequence
  Description of Artificial Sequence: Synthetic peptide
DTEEIRTTNPCATEHYGSVSCNLQAENHR

SEQ ID NO: 32377 - protein, 31 aa, Artificial Sequence
  Description of Artificial Sequence: Synthetic polypeptide
DEEEIRATNPVATEQYGTVSHTQNDDQGGNR

SEQ ID NO: 32378 - protein, 29 aa, Artificial Sequence
  Description of Artificial Sequence: Synthetic peptide
DTEEIRTTNPCATEHYGSVSCNLQDHENR

SEQ ID NO: 32379 - protein, 32 aa, Artificial Sequence
  Description of Artificial Sequence: Synthetic polypeptide
DEEEIRATNPVATEQYGTVSCTNELSQGGGNR

SEQ ID NO: 32380 - protein, 31 aa, Artificial Sequence
  Description of Artificial Sequence: Synthetic polypeptide
DTEEIRCTNPVATEQYGSTVSTNLQNGDTER

SEQ ID NO: 32381 - protein, 30 aa, Artificial Sequence
  Description of Artificial Sequence: Synthetic polypeptide
DEEEIRATNPVATEQYGSVSVNQESGSNNR

SEQ ID NO: 32382 - protein, 31 aa, Artificial Sequence
  Description of Artificial Sequence: Synthetic polypeptide
DEEEIRATNPVATEQYGSVSVNSQDEGSNSR

SEQ ID NO: 32383 - protein, 30 aa, Artificial Sequence
  Description of Artificial Sequence: Synthetic polypeptide
DTEEIRATNPVATEQYGSVSVTNMQTGNNF

SEQ ID NO: 32384 - protein, 29 aa, Artificial Sequence
  Description of Artificial Sequence: Synthetic peptide
DTEEIRATNPVATEQYGSVVATNLQAGTD

SEQ ID NO: 32385 - protein, 30 aa, Artificial Sequence
  Description of Artificial Sequence: Synthetic polypeptide
DTEEIRATNPVATEQYGSVVNSTNLQNGTG

SEQ ID NO: 32386 - protein, 30 aa, Artificial Sequence
  Description of Artificial Sequence: Synthetic polypeptide
DTEEIRATNPVATEQYGSVVSTDLQNGITR

SEQ ID NO: 32387 - protein, 31 aa, Artificial Sequence
  Description of Artificial Sequence: Synthetic polypeptide
DTEEIRATNPVATEQYGSVVSTNLDQNGETR

SEQ ID NO: 32388 - protein, 30 aa, Artificial Sequence
  Description of Artificial Sequence: Synthetic polypeptide
DTEEIRATNPVATEQYGSVVSTNLGQNGTI

SEQ ID NO: 32389 - protein, 31 aa, Artificial Sequence
  Description of Artificial Sequence: Synthetic polypeptide
DTEEIRCTNPVATEQYGSTVSTNLSQNGETR

SEQ ID NO: 32390 - protein, 29 aa, Artificial Sequence
  Description of Artificial Sequence: Synthetic peptide
DTEEIRATNPVATEQYGSVVSTNLNNGTE

SEQ ID NO: 32391 - protein, 30 aa, Artificial Sequence
  Description of Artificial Sequence: Synthetic polypeptide
DTEEIRATNPVATEQYGSVVSTNLQNGTDD

SEQ ID NO: 32392 - protein, 31 aa, Artificial Sequence
  Description of Artificial Sequence: Synthetic polypeptide
DEEEIRTTNPVATEQYGSCSTNLTQNNEERF

SEQ ID NO: 32393 - protein, 31 aa, Artificial Sequence
  Description of Artificial Sequence: Synthetic polypeptide
DTEEIRATNPVATEQYGSVVSVTNLQNGTNG

SEQ ID NO: 32394 - protein, 31 aa, Artificial Sequence
  Description of Artificial Sequence: Synthetic polypeptide
DEEEIRTTNPVATEQYGSCSTNLQSSNNDEI

SEQ ID NO: 32395 - protein, 29 aa, Artificial Sequence
  Description of Artificial Sequence: Synthetic peptide
DTEEIRATNPVAYEQWGSTVSTNLQNGTR

SEQ ID NO: 32396 - protein, 30 aa, Artificial Sequence
  Description of Artificial Sequence: Synthetic polypeptide
DTEEIRCTNPVATEQYGCVVSTNLQNGSDR

SEQ ID NO: 32397 - protein, 30 aa, Artificial Sequence
  Description of Artificial Sequence: Synthetic polypeptide
DTEEIRCTNPVATEQYGSCSTNMQRGNENA

SEQ ID NO: 32398 - protein, 31 aa, Artificial Sequence
  Description of Artificial Sequence: Synthetic polypeptide
DTEEIRCTNPVATEQYGSQVSTNLQNGSDRI

SEQ ID NO: 32399 - protein, 31 aa, Artificial Sequence
  Description of Artificial Sequence: Synthetic polypeptide
DTEEIRATNPVATEQYGSVVSTNLQDNGTGR

SEQ ID NO: 32400 - protein, 30 aa, Artificial Sequence
  Description of Artificial Sequence: Synthetic polypeptide
DEEEIRATNPVATEQYGSVSVNQDTGSNSR

SEQ ID NO: 32401 - protein, 29 aa, Artificial Sequence
  Description of Artificial Sequence: Synthetic peptide
DTEEIRTTNPCATEHYGSVSCNLQRMEGR

SEQ ID NO: 32402 - protein, 30 aa, Artificial Sequence
  Description of Artificial Sequence: Synthetic polypeptide
DTEEIRTTNPCATEHYGSVSFNELQRVTNR

SEQ ID NO: 32403 - protein, 30 aa, Artificial Sequence
  Description of Artificial Sequence: Synthetic polypeptide
DEEEIRTTNPVATEQYGSCSTNLDYMENFQ

SEQ ID NO: 32404 - protein, 29 aa, Artificial Sequence
  Description of Artificial Sequence: Synthetic peptide
DTEEIRTTNPQATEWYGSVSFGNLERVNR

SEQ ID NO: 32405 - protein, 30 aa, Artificial Sequence
  Description of Artificial Sequence: Synthetic polypeptide
DTEEIRTTNPVATCQYGSVSTNGVQNGNTM

SEQ ID NO: 32406 - protein, 31 aa, Artificial Sequence
  Description of Artificial Sequence: Synthetic polypeptide
DTEEIRTTNPVATDQYGSVSTENGAQNGNQR

SEQ ID NO: 32407 - protein, 30 aa, Artificial Sequence
  Description of Artificial Sequence: Synthetic polypeptide
DTEEIRTTNPVATDQYGSVSTNGVQEGNHV

SEQ ID NO: 32408 - protein, 31 aa, Artificial Sequence
  Description of Artificial Sequence: Synthetic polypeptide
DTEEIRTTNPVATDQYGSVSTTNGVQEGNIR

SEQ ID NO: 32409 - protein, 30 aa, Artificial Sequence
  Description of Artificial Sequence: Synthetic polypeptide
DTEEIRTTNPVATEQWGAVTSTELQRGTVR

SEQ ID NO: 32410 - protein, 29 aa, Artificial Sequence
  Description of Artificial Sequence: Synthetic peptide
DTEEIRTTNPVATEQWGSVSSTLLQAGTD

SEQ ID NO: 32411 - protein, 29 aa, Artificial Sequence
  Description of Artificial Sequence: Synthetic peptide
DTEEIRTTNPQATEHYGSVSWNLQRNNVQ

SEQ ID NO: 32412 - protein, 29 aa, Artificial Sequence
  Description of Artificial Sequence: Synthetic peptide
DTEEIRTTNPVATEQWGSVTSTELQSGTD

SEQ ID NO: 32413 - protein, 30 aa, Artificial Sequence
  Description of Artificial Sequence: Synthetic polypeptide
DEEEIRTTNPVATEQYGSCSTNLAGVENDS

SEQ ID NO: 32414 - protein, 29 aa, Artificial Sequence
  Description of Artificial Sequence: Synthetic peptide
DTEEIRTTNPVATEQWGSVTSTLLQLGTG

SEQ ID NO: 32415 - protein, 31 aa, Artificial Sequence
  Description of Artificial Sequence: Synthetic polypeptide
DEEEIRTTNPVATEQYGSCSTNKHQERDDIR

SEQ ID NO: 32416 - protein, 29 aa, Artificial Sequence
  Description of Artificial Sequence: Synthetic peptide
DTEEIRTTNPVATEQWGSVTSTLLQRNTE

SEQ ID NO: 32417 - protein, 31 aa, Artificial Sequence
  Description of Artificial Sequence: Synthetic polypeptide
DEEEIRTTNPVATEQYGSCSTNHHQERDMMR

SEQ ID NO: 32418 - protein, 30 aa, Artificial Sequence
  Description of Artificial Sequence: Synthetic polypeptide
DEEEIRTTNPVATEQYGSCSTNGPMSGNEE

SEQ ID NO: 32419 - protein, 31 aa, Artificial Sequence
  Description of Artificial Sequence: Synthetic polypeptide
DEEEIRTTNPVATEQYGSCSTNGDSNGNDRF

SEQ ID NO: 32420 - protein, 30 aa, Artificial Sequence
  Description of Artificial Sequence: Synthetic polypeptide
DTEEIRTTNPVATEQYGSVQTNEQVEGNET

SEQ ID NO: 32421 - protein, 30 aa, Artificial Sequence
  Description of Artificial Sequence: Synthetic polypeptide
DTEEIRTTNPVATEQWGSVTSTLLQDGGTR

SEQ ID NO: 32422 - protein, 30 aa, Artificial Sequence
  Description of Artificial Sequence: Synthetic polypeptide
DTEEIRTTNPCATEHYGSVSCQNLSQRENR

SEQ ID NO: 32423 - protein, 32 aa, Artificial Sequence
  Description of Artificial Sequence: Synthetic polypeptide
DEEEIRTTNPVATEQYGSCSTNLEQMNNNNRD

SEQ ID NO: 32424 - protein, 29 aa, Artificial Sequence
  Description of Artificial Sequence: Synthetic peptide
DTEEIRTTNPQATEHYGSVSFNLQRENSF

SEQ ID NO: 32425 - protein, 29 aa, Artificial Sequence
  Description of Artificial Sequence: Synthetic peptide
DTEEIRTTNPCATEHYGSVSWNLQDENDR

SEQ ID NO: 32426 - protein, 31 aa, Artificial Sequence
  Description of Artificial Sequence: Synthetic polypeptide
DEEEIRTTNPVATEQYGSCSTNLNTTGEGDR

SEQ ID NO: 32427 - protein, 28 aa, Artificial Sequence
  Description of Artificial Sequence: Synthetic peptide
DTEEIRTTNPCATEPYGSVSANLQAEND

SEQ ID NO: 32428 - protein, 29 aa, Artificial Sequence
  Description of Artificial Sequence: Synthetic peptide
DTEEIRTTNPCATESYGSVSVNLQREEER

SEQ ID NO: 32429 - protein, 29 aa, Artificial Sequence
  Description of Artificial Sequence: Synthetic peptide
DTEEIRTTNPCATESYGSVSVNLQREEND

SEQ ID NO: 32430 - protein, 31 aa, Artificial Sequence
  Description of Artificial Sequence: Synthetic polypeptide
DEEEIRATNPVATEQYGVVSSTTNLQQGGNF

SEQ ID NO: 32431 - protein, 29 aa, Artificial Sequence
  Description of Artificial Sequence: Synthetic peptide
DTEEIRTTNPCAYEPYGSVSANLQREGNT

SEQ ID NO: 32432 - protein, 31 aa, Artificial Sequence
  Description of Artificial Sequence: Synthetic polypeptide
DEEEIRATNPVATEQYGVVSTTNLLQGGNEP

SEQ ID NO: 32433 - protein, 30 aa, Artificial Sequence
  Description of Artificial Sequence: Synthetic polypeptide
DTEEIRTTNPQATEHYGSVSFNLQRVENRL

SEQ ID NO: 32434 - protein, 31 aa, Artificial Sequence
  Description of Artificial Sequence: Synthetic polypeptide
DEEEIRATNPVATEQYGVVSTTNLLQGGNQQ

SEQ ID NO: 32435 - protein, 29 aa, Artificial Sequence
  Description of Artificial Sequence: Synthetic peptide
DTEEIRTTNPEATEHYGSVSWGNLQGENR

SEQ ID NO: 32436 - protein, 31 aa, Artificial Sequence
  Description of Artificial Sequence: Synthetic polypeptide
DTEEIRTTNPLATEAYGSVSINELSQREGNR

SEQ ID NO: 32437 - protein, 29 aa, Artificial Sequence
  Description of Artificial Sequence: Synthetic peptide
DTEEIRTTNPQATEHYGSVCSWNLQGNNR

SEQ ID NO: 32438 - protein, 29 aa, Artificial Sequence
  Description of Artificial Sequence: Synthetic peptide
DTEEIRTTNPQATEHYGSVSFNLQNEMNR

SEQ ID NO: 32439 - protein, 31 aa, Artificial Sequence
  Description of Artificial Sequence: Synthetic polypeptide
DEEEIRATNPVATEQYGVVSTTNLQQGGNSN

SEQ ID NO: 32440 - protein, 31 aa, Artificial Sequence
  Description of Artificial Sequence: Synthetic polypeptide
DEEEIRTTNPVATEQYGSCSTNLLQQSGQDE

SEQ ID NO: 32441 - protein, 29 aa, Artificial Sequence
  Description of Artificial Sequence: Synthetic peptide
DTEEIRTTNPQATEHYGSVSFNLQREERQ

SEQ ID NO: 32442 - protein, 30 aa, Artificial Sequence
  Description of Artificial Sequence: Synthetic polypeptide
DTEEIRTTNPQATEHYGSVSFNLQRENIRE

SEQ ID NO: 32443 - protein, 29 aa, Artificial Sequence
  Description of Artificial Sequence: Synthetic peptide
DTEEIRTTNPEATEHYGSVSFMNLQRVNT

SEQ ID NO: 32444 - protein, 31 aa, Artificial Sequence
  Description of Artificial Sequence: Synthetic polypeptide
DEEEIRATNPVATEQYGSVSVNQDRSGSNSR

SEQ ID NO: 32445 - protein, 30 aa, Artificial Sequence
  Description of Artificial Sequence: Synthetic polypeptide
DEEEIRATNPVATEQYGSVSVNQDQGTNLR

SEQ ID NO: 32446 - protein, 31 aa, Artificial Sequence
  Description of Artificial Sequence: Synthetic polypeptide
DTEEIRATNPVATEQYGSVSTTNLQAGNNQF

SEQ ID NO: 32447 - protein, 30 aa, Artificial Sequence
  Description of Artificial Sequence: Synthetic polypeptide
DSEEIRTTNPVGTEQWGVVSTGNLQRGSVR

SEQ ID NO: 32448 - protein, 28 aa, Artificial Sequence
  Description of Artificial Sequence: Synthetic peptide
DSEEIRTTNPVGTEQWGVVSTNLQHGDH

SEQ ID NO: 32449 - protein, 29 aa, Artificial Sequence
  Description of Artificial Sequence: Synthetic peptide
DSEEIRTTNPVGTEQWGVVSTNLQQGDDR

SEQ ID NO: 32450 - protein, 29 aa, Artificial Sequence
  Description of Artificial Sequence: Synthetic peptide
DSEEIRTTNPVGTEQWGVVSTNLQRGDQM

SEQ ID NO: 32451 - protein, 31 aa, Artificial Sequence
  Description of Artificial Sequence: Synthetic polypeptide
DEEEIRATNPVATEQYGSVSTNLQQDGPDDD

SEQ ID NO: 32452 - protein, 28 aa, Artificial Sequence
  Description of Artificial Sequence: Synthetic peptide
DSEEIRTTNPVSTEQWGMVSTPLQRGEI

SEQ ID NO: 32453 - protein, 28 aa, Artificial Sequence
  Description of Artificial Sequence: Synthetic peptide
DSEEISTTNPVATCQYGSVSTNPIAGNQ

SEQ ID NO: 32454 - protein, 31 aa, Artificial Sequence
  Description of Artificial Sequence: Synthetic polypeptide
DEEEIRATNPVATEQYGSVSTNLQQTENPEE

SEQ ID NO: 32455 - protein, 28 aa, Artificial Sequence
  Description of Artificial Sequence: Synthetic peptide
DSEEIRTTNPVGTEQWGVVSTALQRGDQ

SEQ ID NO: 32456 - protein, 28 aa, Artificial Sequence
  Description of Artificial Sequence: Synthetic peptide
DSEVIRTTNPVATEQYGCVSTNHNRVNL

SEQ ID NO: 32457 - protein, 31 aa, Artificial Sequence
  Description of Artificial Sequence: Synthetic polypeptide
DSGEIRTTNPVATEQYGKVSTNMLSQLGMNR

SEQ ID NO: 32458 - protein, 31 aa, Artificial Sequence
  Description of Artificial Sequence: Synthetic polypeptide
DSGEIRTTNPVATEQYGSTVSTNMLQLTGMR

SEQ ID NO: 32459 - protein, 31 aa, Artificial Sequence
  Description of Artificial Sequence: Synthetic polypeptide
DSGEIRTTNPVATEQYGSVSTNMHSQHGMNR

SEQ ID NO: 32460 - protein, 30 aa, Artificial Sequence
  Description of Artificial Sequence: Synthetic polypeptide
DSGEIRTTNPVATEQYGSVSTNMLSQLGMQ

SEQ ID NO: 32461 - protein, 31 aa, Artificial Sequence
  Description of Artificial Sequence: Synthetic polypeptide
DSGEIRTTNPVATEQYGSVSTNMLSQSGTMR

SEQ ID NO: 32462 - protein, 30 aa, Artificial Sequence
  Description of Artificial Sequence: Synthetic polypeptide
DSGEIRTTNPVATEQYGSVSTNNNLQLGMI

SEQ ID NO: 32463 - protein, 30 aa, Artificial Sequence
  Description of Artificial Sequence: Synthetic polypeptide
DSGEIRTTNPVAYEQYGSVSYTNALQLGMR

SEQ ID NO: 32464 - protein, 29 aa, Artificial Sequence
  Description of Artificial Sequence: Synthetic peptide
DSSEIRTTNPVATMHYGSVSTNLSQRVNM

SEQ ID NO: 32465 - protein, 30 aa, Artificial Sequence
  Description of Artificial Sequence: Synthetic polypeptide
DSEVIRTTNPVATEQYGCVSTNHQRGVNDL

SEQ ID NO: 32466 - protein, 32 aa, Artificial Sequence
  Description of Artificial Sequence: Synthetic polypeptide
DSSEIRTTNPVAYEQYGSVVSYTNLSQRGTNR

SEQ ID NO: 32467 - protein, 29 aa, Artificial Sequence
  Description of Artificial Sequence: Synthetic peptide
DSEEIRTTNPVGTEQWGTVSTNLQYGSVR

SEQ ID NO: 32468 - protein, 31 aa, Artificial Sequence
  Description of Artificial Sequence: Synthetic polypeptide
DEEEIRATNPVATEQYGSVSTNLQDQGGDLE

SEQ ID NO: 32469 - protein, 32 aa, Artificial Sequence
  Description of Artificial Sequence: Synthetic polypeptide
DEEEIRATNPVATEQYGSVSTGNLQEQGNEQQ

SEQ ID NO: 32470 - protein, 30 aa, Artificial Sequence
  Description of Artificial Sequence: Synthetic polypeptide
DSEEIRTTNPVCTEQWGMVVSTNLQREVNR

SEQ ID NO: 32471 - protein, 30 aa, Artificial Sequence
  Description of Artificial Sequence: Synthetic polypeptide
DSEEIRTTNPVGTEQWGCTVSTNLQRGGSR

SEQ ID NO: 32472 - protein, 31 aa, Artificial Sequence
  Description of Artificial Sequence: Synthetic polypeptide
DEEEIRATNPVATEQYGSVSTLNTQGDGGNG

SEQ ID NO: 32473 - protein, 29 aa, Artificial Sequence
  Description of Artificial Sequence: Synthetic peptide
DSEEIRTTNPVGTEQWGKVSTNLSQNGVR

SEQ ID NO: 32474 - protein, 30 aa, Artificial Sequence
  Description of Artificial Sequence: Synthetic polypeptide
DEEEIRATNPVATEQYGSVSTNLDGPDNQD

SEQ ID NO: 32475 - protein, 29 aa, Artificial Sequence
  Description of Artificial Sequence: Synthetic peptide
DSEEIRTTNPVGTEQWGMFVETNLQRGER

SEQ ID NO: 32476 - protein, 29 aa, Artificial Sequence
  Description of Artificial Sequence: Synthetic peptide
DSEEIRTTNPVGTEQWGMFVSTNLQGGGR

SEQ ID NO: 32477 - protein, 29 aa, Artificial Sequence
  Description of Artificial Sequence: Synthetic peptide
DSEEIRTTNPVGTEQWGTVSTNLQRFGVA

SEQ ID NO: 32478 - protein, 29 aa, Artificial Sequence
  Description of Artificial Sequence: Synthetic peptide
DSEEIRTTNPVGTEQWGMVSTNGQRGEDR

SEQ ID NO: 32479 - protein, 28 aa, Artificial Sequence
  Description of Artificial Sequence: Synthetic peptide
DSEEIRTTNPVGTEQWGMVSTNLQHGQE

SEQ ID NO: 32480 - protein, 29 aa, Artificial Sequence
  Description of Artificial Sequence: Synthetic peptide
DSEEIRTTNPVGTEQWGMVSTNLQRDGME

SEQ ID NO: 32481 - protein, 31 aa, Artificial Sequence
  Description of Artificial Sequence: Synthetic polypeptide
DSEEIRTTNPVGTEQWGMVSTNLQREGDQNR

SEQ ID NO: 32482 - protein, 29 aa, Artificial Sequence
  Description of Artificial Sequence: Synthetic peptide
DSEEIRTTNPVGTEQWGMVSTNLQREIRD

SEQ ID NO: 32483 - protein, 29 aa, Artificial Sequence
  Description of Artificial Sequence: Synthetic peptide
DSEEIRTTNPVGTEQWGMVSTNLTERGGR

SEQ ID NO: 32484 - protein, 29 aa, Artificial Sequence
  Description of Artificial Sequence: Synthetic peptide
DSEEIRTTNPVGTEQWGMVSTPLQRGVRP

SEQ ID NO: 32485 - protein, 30 aa, Artificial Sequence
  Description of Artificial Sequence: Synthetic polypeptide
DSEEIRTTNPVGTEQWGSMVSTMNLQRGVS

SEQ ID NO: 32486 - protein, 29 aa, Artificial Sequence
  Description of Artificial Sequence: Synthetic peptide
DSEEIRTTNPVGTEQWGTVSENLQRGDRL

SEQ ID NO: 32487 - protein, 30 aa, Artificial Sequence
  Description of Artificial Sequence: Synthetic polypeptide
DSEEIRTTNPVGTEQWGMVSTNLQGGGNER

SEQ ID NO: 32488 - protein, 32 aa, Artificial Sequence
  Description of Artificial Sequence: Synthetic polypeptide
DSTEIRTTNPVATEAYGSTVSTTNLSQRSGNR

SEQ ID NO: 32489 - protein, 29 aa, Artificial Sequence
  Description of Artificial Sequence: Synthetic peptide
DTAEIATTNPVATAQYGSVSTNPDRGNPR

SEQ ID NO: 32490 - protein, 31 aa, Artificial Sequence
  Description of Artificial Sequence: Synthetic polypeptide
DEEEIRATNPVATEQYGSVSTPLQREQNLID

SEQ ID NO: 32491 - protein, 30 aa, Artificial Sequence
  Description of Artificial Sequence: Synthetic polypeptide
DTEEIRATNPVATEQWGSVVSTNLQHGTER

SEQ ID NO: 32492 - protein, 30 aa, Artificial Sequence
  Description of Artificial Sequence: Synthetic polypeptide
DTEEIRATNPVATEQYGSTVSTNIQNGTDR

SEQ ID NO: 32493 - protein, 30 aa, Artificial Sequence
  Description of Artificial Sequence: Synthetic polypeptide
DTEEIRATNPVATEQYGSVSNTNQQQGNLN

SEQ ID NO: 32494 - protein, 30 aa, Artificial Sequence
  Description of Artificial Sequence: Synthetic polypeptide
DTEEIRATNPVATEQYGSVSSTNMQQGNNS

SEQ ID NO: 32495 - protein, 30 aa, Artificial Sequence
  Description of Artificial Sequence: Synthetic polypeptide
DTEEIRATNPVATEQYGSVSSTNMQTGNNN

SEQ ID NO: 32496 - protein, 30 aa, Artificial Sequence
  Description of Artificial Sequence: Synthetic polypeptide
DTEEIRATNPVATEQYGSVSSTNQQIGNNI

SEQ ID NO: 32497 - protein, 30 aa, Artificial Sequence
  Description of Artificial Sequence: Synthetic polypeptide
DTEEIRATNPVATEQYGSVSSTNSQTGNNP

SEQ ID NO: 32498 - protein, 30 aa, Artificial Sequence
  Description of Artificial Sequence: Synthetic polypeptide
DEEEIRTTNPVATEQYGSCSTNNDNRGDDQ

SEQ ID NO: 32499 - protein, 31 aa, Artificial Sequence
  Description of Artificial Sequence: Synthetic polypeptide
DEEEIRTTNPVATEQYGSCSTNPGPRGNQHE

SEQ ID NO: 32500 - protein, 29 aa, Artificial Sequence
  Description of Artificial Sequence: Synthetic peptide
DTEEIRATNPVATEQYGSVSSTTMQEGNN

SEQ ID NO: 32501 - protein, 29 aa, Artificial Sequence
  Description of Artificial Sequence: Synthetic peptide
DEEEIRTTNPVATEQYGSCSTNMMRVVDE

SEQ ID NO: 32502 - protein, 31 aa, Artificial Sequence
  Description of Artificial Sequence: Synthetic polypeptide
DTEEIRATNPVATEQYGSVSTNLQNMNGQNG

SEQ ID NO: 32503 - protein, 31 aa, Artificial Sequence
  Description of Artificial Sequence: Synthetic polypeptide
DTEEIRATNPVATEQYGSVSTNLQQGNGLQD

SEQ ID NO: 32504 - protein, 32 aa, Artificial Sequence
  Description of Artificial Sequence: Synthetic polypeptide
DTEEIRATNPVATEQYGSVSTNNQLQAGNGQR

SEQ ID NO: 32505 - protein, 28 aa, Artificial Sequence
  Description of Artificial Sequence: Synthetic peptide
AENEIACTNPIATEQYGEVSENLQRGNR

SEQ ID NO: 32506 - protein, 30 aa, Artificial Sequence
  Description of Artificial Sequence: Synthetic polypeptide
DEEEIRATNPVATEQYGSVSVNNDVGSNLR

SEQ ID NO: 32507 - protein, 30 aa, Artificial Sequence
  Description of Artificial Sequence: Synthetic polypeptide
DEEEIRATNPVATEQYGSVSVNQDGGNNNR

SEQ ID NO: 32508 - protein, 30 aa, Artificial Sequence
  Description of Artificial Sequence: Synthetic polypeptide
DEEEIRATNPVATEQYGSVSVNQDIGSNQR

SEQ ID NO: 32509 - protein, 31 aa, Artificial Sequence
  Description of Artificial Sequence: Synthetic polypeptide
DTEEIRATNPVATEQYGSVSTMNLQAGNGQE

SEQ ID NO: 32510 - protein, 29 aa, Artificial Sequence
  Description of Artificial Sequence: Synthetic peptide
DTEEICTTNPVATTQYGSVSTNQGGGNER

SEQ ID NO: 32511 - protein, 31 aa, Artificial Sequence
  Description of Artificial Sequence: Synthetic polypeptide
DEEEIRTTNPVATEQYGSCSTNPHPRGNQEI

SEQ ID NO: 32512 - protein, 29 aa, Artificial Sequence
  Description of Artificial Sequence: Synthetic peptide
DEEEIRTTNPVATEQYGSCSTNPMRVEDD

SEQ ID NO: 32513 - protein, 28 aa, Artificial Sequence
  Description of Artificial Sequence: Synthetic peptide
DTAEIRTTNPCATEPYGSVSANLQRENT

SEQ ID NO: 32514 - protein, 28 aa, Artificial Sequence
  Description of Artificial Sequence: Synthetic peptide
DTAEIRTTNPVATEQYGCCSTDLQTGIR

SEQ ID NO: 32515 - protein, 28 aa, Artificial Sequence
  Description of Artificial Sequence: Synthetic peptide
DTAEIRTTNPVATEQYGCCSTDLQYGNS

SEQ ID NO: 32516 - protein, 28 aa, Artificial Sequence
  Description of Artificial Sequence: Synthetic peptide
DTAEIRTTNPVATEQYGCCSTTLQHGNA

SEQ ID NO: 32517 - protein, 28 aa, Artificial Sequence
  Description of Artificial Sequence: Synthetic peptide
DTAEIRTTNPVATEQYGCCSTVLQGGNQ

SEQ ID NO: 32518 - protein, 29 aa, Artificial Sequence
  Description of Artificial Sequence: Synthetic peptide
DTAEIRTTNPVATEQYGCCSTVLQHGNRV

SEQ ID NO: 32519 - protein, 29 aa, Artificial Sequence
  Description of Artificial Sequence: Synthetic peptide
DTAEIRTTNPVATEQYGCVCSTVDQHGNR

SEQ ID NO: 32520 - protein, 29 aa, Artificial Sequence
  Description of Artificial Sequence: Synthetic peptide
DTAEIRTTNPVATEQYGNVNSTVLQLGNA

SEQ ID NO: 32521 - protein, 29 aa, Artificial Sequence
  Description of Artificial Sequence: Synthetic peptide
DTAEIRTTNPVATEQYGTTSTVLEQSGNR

SEQ ID NO: 32522 - protein, 28 aa, Artificial Sequence
  Description of Artificial Sequence: Synthetic peptide
DTAEIRTTNPVATEQYGTTSTVNQEGNR

SEQ ID NO: 32523 - protein, 28 aa, Artificial Sequence
  Description of Artificial Sequence: Synthetic peptide
DTAEIRTTNPVATEQYGVCSTVLQHGNS

SEQ ID NO: 32524 - protein, 32 aa, Artificial Sequence
  Description of Artificial Sequence: Synthetic polypeptide
DEEEIRATNPVATEQYGSVSTQNLIQGGGNFD

SEQ ID NO: 32525 - protein, 30 aa, Artificial Sequence
  Description of Artificial Sequence: Synthetic polypeptide
DTDEIRTTNPVATEQYGSVSTNVNQLGMER

SEQ ID NO: 32526 - protein, 32 aa, Artificial Sequence
  Description of Artificial Sequence: Synthetic polypeptide
DEEEIRATNPVATEQYGSVSTTNLNQTGGNNG

SEQ ID NO: 32527 - protein, 29 aa, Artificial Sequence
  Description of Artificial Sequence: Synthetic peptide
DTEEIATTNPCATEPYGSVSANLQRENER

SEQ ID NO: 32528 - protein, 31 aa, Artificial Sequence
  Description of Artificial Sequence: Synthetic polypeptide
DEEEIRTTNPVATEQYGSCSTNPYQRTQDNF

SEQ ID NO: 32529 - protein, 30 aa, Artificial Sequence
  Description of Artificial Sequence: Synthetic polypeptide
DTEEIATTNPVATEQFGSVSMNLERGGNER

SEQ ID NO: 32530 - protein, 29 aa, Artificial Sequence
  Description of Artificial Sequence: Synthetic peptide
DEEEIRTTNPVATEQYGSCSTNPVSGTEE

SEQ ID NO: 32531 - protein, 29 aa, Artificial Sequence
  Description of Artificial Sequence: Synthetic peptide
DTEEICTTNPVATTQYGSVSTNLNMGGNS

SEQ ID NO: 32532 - protein, 31 aa, Artificial Sequence
  Description of Artificial Sequence: Synthetic polypeptide
DTEEIRTTNPVATEQYGTVSTTNLQAGDNSG

SEQ ID NO: 32533 - protein, 30 aa, Artificial Sequence
  Description of Artificial Sequence: Synthetic polypeptide
DEEEIRTTNPVATEQYGSCSTNDVRDDGRD

SEQ ID NO: 32534 - protein, 30 aa, Artificial Sequence
  Description of Artificial Sequence: Synthetic polypeptide
DTEEIRTTNPVATGQYGSVSTNGVDNGNHR

SEQ ID NO: 32535 - protein, 32 aa, Artificial Sequence
  Description of Artificial Sequence: Synthetic polypeptide
DEEEIRTTNPVATEQYGSCSTNDQVRMENSRI

SEQ ID NO: 32536 - protein, 32 aa, Artificial Sequence
  Description of Artificial Sequence: Synthetic polypeptide
EEEEIRTTNPVATEQYGSVSTNLIQEGSENQD

SEQ ID NO: 32537 - protein, 30 aa, Artificial Sequence
  Description of Artificial Sequence: Synthetic polypeptide
EEEEIRTTNPVATEQYGSVSTNLQEETEGT

SEQ ID NO: 32538 - protein, 32 aa, Artificial Sequence
  Description of Artificial Sequence: Synthetic polypeptide
EEEEIRTTNPVATEQYGSVSTNLQERPNNITD

SEQ ID NO: 32539 - protein, 30 aa, Artificial Sequence
  Description of Artificial Sequence: Synthetic polypeptide
DEEEIRCTNPIATEQYGSVSATNLMHGEDR

SEQ ID NO: 32540 - protein, 29 aa, Artificial Sequence
  Description of Artificial Sequence: Synthetic peptide
AEENICTTNPVATEQYGSVSTMNSQAGNS

SEQ ID NO: 32541 - protein, 29 aa, Artificial Sequence
  Description of Artificial Sequence: Synthetic peptide
DEEEIRCTNPIATEQYGSVSEDLMHEGNR

SEQ ID NO: 32542 - protein, 29 aa, Artificial Sequence
  Description of Artificial Sequence: Synthetic peptide
DEEEIRCTNPIATEQYGSVSEDLMRKGPR

SEQ ID NO: 32543 - protein, 29 aa, Artificial Sequence
  Description of Artificial Sequence: Synthetic peptide
AEEGICTTNPVATEQYGSVSMNSQRGNSF

SEQ ID NO: 32544 - protein, 32 aa, Artificial Sequence
  Description of Artificial Sequence: Synthetic polypeptide
DEEEIRTTNPVATEQYGSCSEINLQRGENELI

SEQ ID NO: 32545 - protein, 28 aa, Artificial Sequence
  Description of Artificial Sequence: Synthetic peptide
AEEGIATTNPVATEQYGSVATNLSMMNR

SEQ ID NO: 32546 - protein, 30 aa, Artificial Sequence
  Description of Artificial Sequence: Synthetic polypeptide
DEEEIRCTNPIATEQYGSVSEEDLQMQGNR

SEQ ID NO: 32547 - protein, 31 aa, Artificial Sequence
  Description of Artificial Sequence: Synthetic polypeptide
AEEEVRTTNPVATEQYGSVSTGNLDQDIGNF

SEQ ID NO: 32548 - protein, 31 aa, Artificial Sequence
  Description of Artificial Sequence: Synthetic polypeptide
EEEEIRTTNPVATEQYGSVSTNLQTEVANYG

SEQ ID NO: 32549 - protein, 32 aa, Artificial Sequence
  Description of Artificial Sequence: Synthetic polypeptide
EEEEIRTTNPVATEQYGSVSTNLSQRQNEDTV

SEQ ID NO: 32550 - protein, 31 aa, Artificial Sequence
  Description of Artificial Sequence: Synthetic polypeptide
EEEEIRTTNPVATEQYGSVSTNLVRGEEMVD

SEQ ID NO: 32551 - protein, 32 aa, Artificial Sequence
  Description of Artificial Sequence: Synthetic polypeptide
EEEEIRTTNPVATEQYGSVSTNNLQIEMVNRY

SEQ ID NO: 32552 - protein, 31 aa, Artificial Sequence
  Description of Artificial Sequence: Synthetic polypeptide
EEEEIRTTNPVATEQYGSVSTPNLENGTPNE

SEQ ID NO: 32553 - protein, 32 aa, Artificial Sequence
  Description of Artificial Sequence: Synthetic polypeptide
EEEEIRTTNPVATEQYGSVSTPNLQNGIEVRT

SEQ ID NO: 32554 - protein, 32 aa, Artificial Sequence
  Description of Artificial Sequence: Synthetic polypeptide
EEEEIRTTNPVATEQYGSVSTNLQNLGIEVRG

SEQ ID NO: 32555 - protein, 32 aa, Artificial Sequence
  Description of Artificial Sequence: Synthetic polypeptide
EEEEIRTTNPVATEQYGSVSTPNLQQRPENIG

SEQ ID NO: 32556 - protein, 30 aa, Artificial Sequence
  Description of Artificial Sequence: Synthetic polypeptide
DEEEIRCTNPIATEQYGSVSAENLMRGNDL

SEQ ID NO: 32557 - protein, 31 aa, Artificial Sequence
  Description of Artificial Sequence: Synthetic polypeptide
EEEEIRTTNPVATEQYGSVSTNLEEVGLNIV

SEQ ID NO: 32558 - protein, 31 aa, Artificial Sequence
  Description of Artificial Sequence: Synthetic polypeptide
DEEEIRCTNPIATECYGSVSENLPQREGENR

SEQ ID NO: 32559 - protein, 32 aa, Artificial Sequence
  Description of Artificial Sequence: Synthetic polypeptide
EEEEIRTTNPVATEQYGSVSINLQGVRGELRE

SEQ ID NO: 32560 - protein, 29 aa, Artificial Sequence
  Description of Artificial Sequence: Synthetic peptide
DEEEIRCTNPIATEQWGSTSENLARGNYR

SEQ ID NO: 32561 - protein, 31 aa, Artificial Sequence
  Description of Artificial Sequence: Synthetic polypeptide
EEEEIRTTNPVATEQYGSVSLTNLQINANGF

SEQ ID NO: 32562 - protein, 32 aa, Artificial Sequence
  Description of Artificial Sequence: Synthetic polypeptide
EEEEIRTTNPVATEQYGSVSLTNLVRGLENED

SEQ ID NO: 32563 - protein, 30 aa, Artificial Sequence
  Description of Artificial Sequence: Synthetic polypeptide
EEEEIRTTNPVATEQYGSVSMNQEERENRL

SEQ ID NO: 32564 - protein, 32 aa, Artificial Sequence
  Description of Artificial Sequence: Synthetic polypeptide
EEEEIRTTNPVATEQYGSVSMTNLETRGPERD

SEQ ID NO: 32565 - protein, 32 aa, Artificial Sequence
  Description of Artificial Sequence: Synthetic polypeptide
EEEEIRTTNPVATEQYGSVSNSNLQQHGENYR

SEQ ID NO: 32566 - protein, 30 aa, Artificial Sequence
  Description of Artificial Sequence: Synthetic polypeptide
AEEQIRTTNPVATEQYGSVSTNLSELGNLQ

SEQ ID NO: 32567 - protein, 31 aa, Artificial Sequence
  Description of Artificial Sequence: Synthetic polypeptide
EEEEIRTTNPVATEQYGSVSPNLQQGQGEER

SEQ ID NO: 32568 - protein, 28 aa, Artificial Sequence
  Description of Artificial Sequence: Synthetic peptide
DEEEIRCTNPIATEQWGSVSENLMAGDR

SEQ ID NO: 32569 - protein, 31 aa, Artificial Sequence
  Description of Artificial Sequence: Synthetic polypeptide
EEEEIRTTNPVATEQYGSVSPTNNQQLGELR

SEQ ID NO: 32570 - protein, 31 aa, Artificial Sequence
  Description of Artificial Sequence: Synthetic polypeptide
EEEEIRTTNPVATEQYGSVSTELQRELNQDP

SEQ ID NO: 32571 - protein, 31 aa, Artificial Sequence
  Description of Artificial Sequence: Synthetic polypeptide
EEEEIRTTNPVATEQYGSVSTGLQRVHNEDP

SEQ ID NO: 32572 - protein, 29 aa, Artificial Sequence
  Description of Artificial Sequence: Synthetic peptide
AEEQIRTTNPVATEQYGSVSTNLSNMDNL

SEQ ID NO: 32573 - protein, 29 aa, Artificial Sequence
  Description of Artificial Sequence: Synthetic peptide
AEEQIRTTNPVATEQYGSVSTNLSMTENL

SEQ ID NO: 32574 - protein, 29 aa, Artificial Sequence
  Description of Artificial Sequence: Synthetic peptide
AEEQIRTTNPVATEQYGSVSTNLSMNQNL

SEQ ID NO: 32575 - protein, 30 aa, Artificial Sequence
  Description of Artificial Sequence: Synthetic polypeptide
AEEQIRTTNPVATEQYGSVSTNLSMELGNF

SEQ ID NO: 32576 - protein, 33 aa, Artificial Sequence
  Description of Artificial Sequence: Synthetic polypeptide
DEEEIRTTNPVATEQYGSCSLGNMLSQRVGNNR

SEQ ID NO: 32577 - protein, 33 aa, Artificial Sequence
  Description of Artificial Sequence: Synthetic polypeptide
EEEEIRTTNPVATEQYGSVSTPNLSQRGINDTV

SEQ ID NO: 32578 - protein, 32 aa, Artificial Sequence
  Description of Artificial Sequence: Synthetic polypeptide
EEEEIRTTNPVATEQYGSVSTSNLVEVGENYR

SEQ ID NO: 32579 - protein, 32 aa, Artificial Sequence
  Description of Artificial Sequence: Synthetic polypeptide
EEEEIRTTNPVATEQYGSVSTSNVVQRLENYR

SEQ ID NO: 32580 - protein, 31 aa, Artificial Sequence
  Description of Artificial Sequence: Synthetic polypeptide
EEEELRTTNPVATEQYGSVSTTNLDQSIGNN

SEQ ID NO: 32581 - protein, 29 aa, Artificial Sequence
  Description of Artificial Sequence: Synthetic peptide
DEEEIRTTNPVATEQYGSCPTDLERNEQR

SEQ ID NO: 32582 - protein, 33 aa, Artificial Sequence
  Description of Artificial Sequence: Synthetic polypeptide
DEEEIRTTNPVATEQYGSCPSLGNMLSQRDGNR

SEQ ID NO: 32583 - protein, 29 aa, Artificial Sequence
  Description of Artificial Sequence: Synthetic peptide
EEPEIRTTNPVATDWYGSVSTNLQRTNDQ

SEQ ID NO: 32584 - protein, 28 aa, Artificial Sequence
  Description of Artificial Sequence: Synthetic peptide
ENAEIRTTNPVATEQYGCCSTVLQHGNR

SEQ ID NO: 32585 - protein, 31 aa, Artificial Sequence
  Description of Artificial Sequence: Synthetic polypeptide
AEEEISTTNPVATEQYGSVSTNSLFQVRGEF

SEQ ID NO: 32586 - protein, 30 aa, Artificial Sequence
  Description of Artificial Sequence: Synthetic polypeptide
DEEEIRCTNPVATEIYGCVAATNLEREGNR

SEQ ID NO: 32587 - protein, 31 aa, Artificial Sequence
  Description of Artificial Sequence: Synthetic polypeptide
DEEEIRTTNPVATEQYGSCNSTNLEREGDQV

SEQ ID NO: 32588 - protein, 31 aa, Artificial Sequence
  Description of Artificial Sequence: Synthetic polypeptide
DEEEIRCTNPIATEQYGTVSMENLQQRNGNR

SEQ ID NO: 32589 - protein, 31 aa, Artificial Sequence
  Description of Artificial Sequence: Synthetic polypeptide
ENEEIRTTNPVATEQYGVVSTNLQGDAGDNR

SEQ ID NO: 32590 - protein, 30 aa, Artificial Sequence
  Description of Artificial Sequence: Synthetic polypeptide
ENEEIRTTNPVAYEQYGVVSTNLQDGPNMR

SEQ ID NO: 32591 - protein, 28 aa, Artificial Sequence
  Description of Artificial Sequence: Synthetic peptide
DEEEIRCTNPVATEPYGTVSMDLMQGNR

SEQ ID NO: 32592 - protein, 29 aa, Artificial Sequence
  Description of Artificial Sequence: Synthetic peptide
DEEEIRCTNPVATEPYGTVSMEDLQQGNR

SEQ ID NO: 32593 - protein, 28 aa, Artificial Sequence
  Description of Artificial Sequence: Synthetic peptide
ETAEIRTTNPVATEQYGTASTQLQHGNR

SEQ ID NO: 32594 - protein, 31 aa, Artificial Sequence
  Description of Artificial Sequence: Synthetic polypeptide
ETEEIATTNPVATEQYGSVSMTNLDRGNQNR

SEQ ID NO: 32595 - protein, 32 aa, Artificial Sequence
  Description of Artificial Sequence: Synthetic polypeptide
DEEEIRTTNPVATEQYGSCITQNVQRVGDNDR

SEQ ID NO: 32596 - protein, 29 aa, Artificial Sequence
  Description of Artificial Sequence: Synthetic peptide
FEEEIRCTNPIATEQYGSVSENLMRGDER

SEQ ID NO: 32597 - protein, 30 aa, Artificial Sequence
  Description of Artificial Sequence: Synthetic polypeptide
FEEEIRCTNPIATEQYGSVYSENLMRGNGR

SEQ ID NO: 32598 - protein, 30 aa, Artificial Sequence
  Description of Artificial Sequence: Synthetic polypeptide
ENEEIRTTNPVATEQYGVVSTNLQGDGNNA

SEQ ID NO: 32599 - protein, 31 aa, Artificial Sequence
  Description of Artificial Sequence: Synthetic polypeptide
DEEEIRCTNPIATEQYGTVSMENLQMRNGNR

SEQ ID NO: 32600 - protein, 31 aa, Artificial Sequence
  Description of Artificial Sequence: Synthetic polypeptide
EEEELRTTNPVATEQYGSVSTQNLDQDNGNT

SEQ ID NO: 32601 - protein, 31 aa, Artificial Sequence
  Description of Artificial Sequence: Synthetic polypeptide
DEEEIRTTNPVATEQYGSCSAGNDLQDSDNR

SEQ ID NO: 32602 - protein, 30 aa, Artificial Sequence
  Description of Artificial Sequence: Synthetic polypeptide
EEEEIRTTNPVATEQYGSVSTTNLEQGLTV

SEQ ID NO: 32603 - protein, 29 aa, Artificial Sequence
  Description of Artificial Sequence: Synthetic peptide
DEEEIRCTNPIATEQYGSVSENWMEPGNR

SEQ ID NO: 32604 - protein, 31 aa, Artificial Sequence
  Description of Artificial Sequence: Synthetic polypeptide
DEEEIRTTNPVATEQYGSCSDNYLQQSGQDR

SEQ ID NO: 32605 - protein, 32 aa, Artificial Sequence
  Description of Artificial Sequence: Synthetic polypeptide
DEEEIRCTNPIATEQYGSVSSTTNLNRGMNPR

SEQ ID NO: 32606 - protein, 29 aa, Artificial Sequence
  Description of Artificial Sequence: Synthetic peptide
DEEEIRTTNPVATEQYGSCSCTNLDNLEN

SEQ ID NO: 32607 - protein, 31 aa, Artificial Sequence
  Description of Artificial Sequence: Synthetic polypeptide
EEEEIRTTNPVATEQYGSVSYNLQNGIEVRE

SEQ ID NO: 32608 - protein, 28 aa, Artificial Sequence
  Description of Artificial Sequence: Synthetic peptide
DEEEIRCTNPIATEQYGSVSTDLMHGEL

SEQ ID NO: 32609 - protein, 30 aa, Artificial Sequence
  Description of Artificial Sequence: Synthetic polypeptide
EEEEIRTTNPVATEQYGSVTTGLQRNNINN

SEQ ID NO: 32610 - protein, 32 aa, Artificial Sequence
  Description of Artificial Sequence: Synthetic polypeptide
DEEEIRCTNPIATEQYGSVSTEPNLPNRNGNR

SEQ ID NO: 32611 - protein, 31 aa, Artificial Sequence
  Description of Artificial Sequence: Synthetic polypeptide
EEEEIRTTNPVATEQYGSVVTDNQQRPGSNE

SEQ ID NO: 32612 - protein, 28 aa, Artificial Sequence
  Description of Artificial Sequence: Synthetic peptide
DEEEIRCTNPIATEQYGTISENIQQGNR

SEQ ID NO: 32613 - protein, 30 aa, Artificial Sequence
  Description of Artificial Sequence: Synthetic polypeptide
DEEEIRCTNPIATEQYGTVSEDNLVERGNR

SEQ ID NO: 32614 - protein, 30 aa, Artificial Sequence
  Description of Artificial Sequence: Synthetic polypeptide
EEEEIRTTNPVATEQYGVVSTNLQGNAGEY

SEQ ID NO: 32615 - protein, 31 aa, Artificial Sequence
  Description of Artificial Sequence: Synthetic polypeptide
EEEEIRTTNPVATESYGSVSPTNLEHRGQQR

SEQ ID NO: 32616 - protein, 30 aa, Artificial Sequence
  Description of Artificial Sequence: Synthetic polypeptide
EEEEIRTTNPVAYEQYGSVPPTNLQIGGPR

SEQ ID NO: 32617 - protein, 32 aa, Artificial Sequence
  Description of Artificial Sequence: Synthetic polypeptide
EEEEIRTTNPVAYEQYGSVSCTGNLQRGGNNM

SEQ ID NO: 32618 - protein, 32 aa, Artificial Sequence
  Description of Artificial Sequence: Synthetic polypeptide
EEEEIRTTNPVAYEQYGSVSCTNLQRTGGNNT

SEQ ID NO: 32619 - protein, 32 aa, Artificial Sequence
  Description of Artificial Sequence: Synthetic polypeptide
EEEEIRTTNPVAYEQYGSVVSCTGNLQPGGNR

SEQ ID NO: 32620 - protein, 31 aa, Artificial Sequence
  Description of Artificial Sequence: Synthetic polypeptide
EEEEIRTTNPVGTEQYGSVSTMNLEQRDCNI

SEQ ID NO: 32621 - protein, 28 aa, Artificial Sequence
  Description of Artificial Sequence: Synthetic peptide
AEESIRTTNPVATEEYGCKSINLQRGNE

SEQ ID NO: 32622 - protein, 28 aa, Artificial Sequence
  Description of Artificial Sequence: Synthetic peptide
DSEEIRTTNPVCTEQWGMVSMDLQRGVR

SEQ ID NO: 32623 - protein, 29 aa, Artificial Sequence
  Description of Artificial Sequence: Synthetic peptide
AEETIRTTNPVATEQYGSVSTNLSMNLNP

SEQ ID NO: 32624 - protein, 29 aa, Artificial Sequence
  Description of Artificial Sequence: Synthetic peptide
DEEEIRCTNPIATECYGSVSEINLMRGNG

SEQ ID NO: 32625 - protein, 28 aa, Artificial Sequence
  Description of Artificial Sequence: Synthetic peptide
DTEEISTTNPVATTQYGSVSTNPNAGNG

SEQ ID NO: 32626 - protein, 28 aa, Artificial Sequence
  Description of Artificial Sequence: Synthetic peptide
DTEEISTTNPVATTQYGSVSTNPSNGNA

SEQ ID NO: 32627 - protein, 28 aa, Artificial Sequence
  Description of Artificial Sequence: Synthetic peptide
DTEEISTTNPVATTQYGSVSTNQMGGNI

SEQ ID NO: 32628 - protein, 28 aa, Artificial Sequence
  Description of Artificial Sequence: Synthetic peptide
DTETIRTTNPVATEQYGAVSTNGQGVNE

SEQ ID NO: 32629 - protein, 28 aa, Artificial Sequence
  Description of Artificial Sequence: Synthetic peptide
DTETIRTTNPVATEQYGNVSTNHQEVNG

SEQ ID NO: 32630 - protein, 29 aa, Artificial Sequence
  Description of Artificial Sequence: Synthetic peptide
DTGEIRTTNPVATEQYGSVSTNTLQLNMD

SEQ ID NO: 32631 - protein, 30 aa, Artificial Sequence
  Description of Artificial Sequence: Synthetic polypeptide
DTGEIRTTNPVATEQYGSVSTTNVLQLGMT

SEQ ID NO: 32632 - protein, 30 aa, Artificial Sequence
  Description of Artificial Sequence: Synthetic polypeptide
DTGEIRTTNPVATEQYGSVSTVNTLQLGMA

SEQ ID NO: 32633 - protein, 28 aa, Artificial Sequence
  Description of Artificial Sequence: Synthetic peptide
DTEEISTTNPVATTQYGSVSTNPATGNN

SEQ ID NO: 32634 - protein, 29 aa, Artificial Sequence
  Description of Artificial Sequence: Synthetic peptide
DTQEIRTTNPVATEQYGCVTSTVLQVGNV

SEQ ID NO: 32635 - protein, 30 aa, Artificial Sequence
  Description of Artificial Sequence: Synthetic polypeptide
DTTEIRTTNPVATEQYGSVNSTVLQAGVNQ

SEQ ID NO: 32636 - protein, 30 aa, Artificial Sequence
  Description of Artificial Sequence: Synthetic polypeptide
DTTEIRTTNPVATEQYGSVSTNTLQLGGEA

SEQ ID NO: 32637 - protein, 30 aa, Artificial Sequence
  Description of Artificial Sequence: Synthetic polypeptide
DEEEIRATNPVATETYGFVSDTNQFQGGNR

SEQ ID NO: 32638 - protein, 31 aa, Artificial Sequence
  Description of Artificial Sequence: Synthetic polypeptide
DEEEIRTTNPVATEQYGSCSTLNLQVSDQNQ

SEQ ID NO: 32639 - protein, 31 aa, Artificial Sequence
  Description of Artificial Sequence: Synthetic polypeptide
DTTEIRTTNPVATEQYGSVSTTNVLQLGNME

SEQ ID NO: 32640 - protein, 31 aa, Artificial Sequence
  Description of Artificial Sequence: Synthetic polypeptide
DEEEIRTTNPVATEQYGSCSTLNLEQVTQNQ

SEQ ID NO: 32641 - protein, 31 aa, Artificial Sequence
  Description of Artificial Sequence: Synthetic polypeptide
DEEEIRATNPVATETYGSVSTNLQDGNNQGG

SEQ ID NO: 32642 - protein, 29 aa, Artificial Sequence
  Description of Artificial Sequence: Synthetic peptide
DTTEIRTTNPVATEQYGVVNSTGLQHGNQ

SEQ ID NO: 32643 - protein, 29 aa, Artificial Sequence
  Description of Artificial Sequence: Synthetic peptide
DTTEIRTTNPVATEQYGNVNSTVLQIGNQ

SEQ ID NO: 32644 - protein, 31 aa, Artificial Sequence
  Description of Artificial Sequence: Synthetic polypeptide
DEEEIRTTNPVATEQYGSCSTLNLEQVDNQE

SEQ ID NO: 32645 - protein, 32 aa, Artificial Sequence
  Description of Artificial Sequence: Synthetic polypeptide
DEEEIRTTNPVATEQYGSCSTNDLDQGGMDRD

SEQ ID NO: 32646 - protein, 29 aa, Artificial Sequence
  Description of Artificial Sequence: Synthetic peptide
DTEEIRYTNPVATEQYGSKVSTNQQNGTD

SEQ ID NO: 32647 - protein, 30 aa, Artificial Sequence
  Description of Artificial Sequence: Synthetic polypeptide
DTEEIRTTNPVATTQYGSVSTNGVQGGNGE

SEQ ID NO: 32648 - protein, 30 aa, Artificial Sequence
  Description of Artificial Sequence: Synthetic polypeptide
DTEEIRTTNPVATTQYGSVSTNQVQNGNGI

SEQ ID NO: 32649 - protein, 31 aa, Artificial Sequence
  Description of Artificial Sequence: Synthetic polypeptide
DTEEIRTTNPVATTQYGSVSTTNGDQNGNHR

SEQ ID NO: 32650 - protein, 30 aa, Artificial Sequence
  Description of Artificial Sequence: Synthetic polypeptide
DEEEIRTTNPVATEQYGSCSTNDQRNIVED

SEQ ID NO: 32651 - protein, 28 aa, Artificial Sequence
  Description of Artificial Sequence: Synthetic peptide
DTEEIRTTNPVGTEQWGMVSTNLQSGEE

SEQ ID NO: 32652 - protein, 28 aa, Artificial Sequence
  Description of Artificial Sequence: Synthetic peptide
DTEEIRTTNPVGTEQWGTVSTNLQQGVI

SEQ ID NO: 32653 - protein, 28 aa, Artificial Sequence
  Description of Artificial Sequence: Synthetic peptide
DTEEIRTTNPVSTEQWGMVSTNLQYGVE

SEQ ID NO: 32654 - protein, 28 aa, Artificial Sequence
  Description of Artificial Sequence: Synthetic peptide
DTEEIRTTNPVTTEQWGTVSTNLQNGVE

SEQ ID NO: 32655 - protein, 31 aa, Artificial Sequence
  Description of Artificial Sequence: Synthetic polypeptide
DEEEIRATNPVATEQYGYVSMTNLFEGGGNR

SEQ ID NO: 32656 - protein, 32 aa, Artificial Sequence
  Description of Artificial Sequence: Synthetic polypeptide
DEEEIRTTNPVATEQYGSCSTNDQHAGENERI

SEQ ID NO: 32657 - protein, 31 aa, Artificial Sequence
  Description of Artificial Sequence: Synthetic polypeptide
DEEEIRTTNPVATEQYGSCSTNDLQGSENMI

SEQ ID NO: 32658 - protein, 31 aa, Artificial Sequence
  Description of Artificial Sequence: Synthetic polypeptide
DTEEIRYTNPVATEQYGSFVDSTNLQNSGTR

SEQ ID NO: 32659 - protein, 29 aa, Artificial Sequence
  Description of Artificial Sequence: Synthetic peptide
DTEEIRYTNPVATEQYGSFVSTNLQNDTV

SEQ ID NO: 32660 - protein, 30 aa, Artificial Sequence
  Description of Artificial Sequence: Synthetic polypeptide
DTEEIRYTNPVATEQYGSKNSTNLQNGTRG

SEQ ID NO: 32661 - protein, 30 aa, Artificial Sequence
  Description of Artificial Sequence: Synthetic polypeptide
DTEEIRYTNPVATEQYGSKVCSTNLQNGTQ

SEQ ID NO: 32662 - protein, 30 aa, Artificial Sequence
  Description of Artificial Sequence: Synthetic polypeptide
DTEEIRYTNPVATEQYGSKVSTDDLQNGTR

SEQ ID NO: 32663 - protein, 31 aa, Artificial Sequence
  Description of Artificial Sequence: Synthetic polypeptide
DTEEIRYTNPVATEQYGSKVSTMNLQNGTAR

SEQ ID NO: 32664 - protein, 30 aa, Artificial Sequence
  Description of Artificial Sequence: Synthetic polypeptide
DTEEIRYTNPVATEQYGSKVSTNLQNNQTR

SEQ ID NO: 32665 - protein, 30 aa, Artificial Sequence
  Description of Artificial Sequence: Synthetic polypeptide
DEEEIRTTNPVATEQYGSCSTNDLQGTFEI

SEQ ID NO: 32666 - protein, 33 aa, Artificial Sequence
  Description of Artificial Sequence: Synthetic polypeptide
DEEEIRTTNPVATEQYGSCSTLNLEQARSGDER

SEQ ID NO: 32667 - protein, 31 aa, Artificial Sequence
  Description of Artificial Sequence: Synthetic polypeptide
DEEEIRTTNPVATEQYGSCSTISLQRGEDFS

SEQ ID NO: 32668 - protein, 29 aa, Artificial Sequence
  Description of Artificial Sequence: Synthetic peptide
DEEEIRTTNPVATEQYGSCSTILMPRVDE

SEQ ID NO: 32669 - protein, 33 aa, Artificial Sequence
  Description of Artificial Sequence: Synthetic polypeptide
DEEEIRTTNPVATEQYGSCSPTENDSQRDGNER

SEQ ID NO: 32670 - protein, 30 aa, Artificial Sequence
  Description of Artificial Sequence: Synthetic polypeptide
EEEEIRTTNPVATEQYGSVATALQENENFR

SEQ ID NO: 32671 - protein, 32 aa, Artificial Sequence
  Description of Artificial Sequence: Synthetic polypeptide
DEEEIRTTNPVATEQYGSCSNTENDLQRGVDD

SEQ ID NO: 32672 - protein, 34 aa, Artificial Sequence
  Description of Artificial Sequence: Synthetic polypeptide
DEEEIRTTNPVATEQYGSCSNTENDLQRGNNERD

SEQ ID NO: 32673 - protein, 32 aa, Artificial Sequence
  Description of Artificial Sequence: Synthetic polypeptide
DEEEIRTTNPVATEQYGSCSNTDNNLQRGDQQ

SEQ ID NO: 32674 - protein, 31 aa, Artificial Sequence
  Description of Artificial Sequence: Synthetic polypeptide
DEEEIRTTNPVATEQYGSCSNSNLDRGVNDQ

SEQ ID NO: 32675 - protein, 31 aa, Artificial Sequence
  Description of Artificial Sequence: Synthetic polypeptide
EEEEIRTTNPVATEQYGSVATLMLQEQGFNR

SEQ ID NO: 32676 - protein, 29 aa, Artificial Sequence
  Description of Artificial Sequence: Synthetic peptide
EEEEIRTTNPVATEQYGSVATTWLENGDR

SEQ ID NO: 32677 - protein, 31 aa, Artificial Sequence
  Description of Artificial Sequence: Synthetic polypeptide
DEEEIRATNPVTTEQYGSVSTNLQNGIGTND

SEQ ID NO: 32678 - protein, 29 aa, Artificial Sequence
  Description of Artificial Sequence: Synthetic peptide
EEEEIRTTNPVATEQYGSVAVLLQNGFER

SEQ ID NO: 32679 - protein, 28 aa, Artificial Sequence
  Description of Artificial Sequence: Synthetic peptide
AEGEIACTNPVATEQYGEVSCNLQRGGR

SEQ ID NO: 32680 - protein, 31 aa, Artificial Sequence
  Description of Artificial Sequence: Synthetic polypeptide
EEEEIRTTNPVATEQYGSVETALQENGNFVR

SEQ ID NO: 32681 - protein, 33 aa, Artificial Sequence
  Description of Artificial Sequence: Synthetic polypeptide
EEEEIRTTNPVATEQYGSVGTSNLEQRGENYRI

SEQ ID NO: 32682 - protein, 31 aa, Artificial Sequence
  Description of Artificial Sequence: Synthetic polypeptide
EEEEIRTTNPVATEQYGSVISAENLNEFGNR

SEQ ID NO: 32683 - protein, 31 aa, Artificial Sequence
  Description of Artificial Sequence: Synthetic polypeptide
DEEEIRTTNPVATEQYGSCSLTWLERGFERT

SEQ ID NO: 32684 - protein, 32 aa, Artificial Sequence
  Description of Artificial Sequence: Synthetic polypeptide
DEEEIRTTNPVATEQYGSCSLNPNMLQMRDNR

SEQ ID NO: 32685 - protein, 30 aa, Artificial Sequence
  Description of Artificial Sequence: Synthetic polypeptide
EEEEIRTTNPVATEQYGSVPTLTLQENGFR

SEQ ID NO: 32686 - protein, 28 aa, Artificial Sequence
  Description of Artificial Sequence: Synthetic peptide
DEEEIRCTNPIATECYGAVSENLMPGNR

SEQ ID NO: 32687 - protein, 28 aa, Artificial Sequence
  Description of Artificial Sequence: Synthetic peptide
AEGEIACTNPVATEQYGEVSENLQRGGR

SEQ ID NO: 32688 - protein, 32 aa, Artificial Sequence
  Description of Artificial Sequence: Synthetic polypeptide
EEEEIRTTNPVATEQYGSAVSTNLQRDGVTEA

SEQ ID NO: 32689 - protein, 32 aa, Artificial Sequence
  Description of Artificial Sequence: Synthetic polypeptide
EEEEIRTTNPVATEQYGCVCSTNLQRFGSNAV

SEQ ID NO: 32690 - protein, 31 aa, Artificial Sequence
  Description of Artificial Sequence: Synthetic polypeptide
DEEEIRTTNPVATEQYGSCSSTNLVRDEDVR

SEQ ID NO: 32691 - protein, 30 aa, Artificial Sequence
  Description of Artificial Sequence: Synthetic polypeptide
DEEEIRTTNPVATEQYGSCSTGTERGGNSP

SEQ ID NO: 32692 - protein, 31 aa, Artificial Sequence
  Description of Artificial Sequence: Synthetic polypeptide
DEEEIRTTNPVATEQYGSCSTDNNQRGEDPQ

SEQ ID NO: 32693 - protein, 29 aa, Artificial Sequence
  Description of Artificial Sequence: Synthetic peptide
EEAEIRCTNPVATEQYGSVVTNLQHGDNQ

SEQ ID NO: 32694 - protein, 31 aa, Artificial Sequence
  Description of Artificial Sequence: Synthetic polypeptide
DEEEIRTTNPVATEQYGSCSTDNLDQRPDPQ

SEQ ID NO: 32695 - protein, 31 aa, Artificial Sequence
  Description of Artificial Sequence: Synthetic polypeptide
EEAEIRTTNPVATEQYGSVSTNLQGDGNNEQ

SEQ ID NO: 32696 - protein, 32 aa, Artificial Sequence
  Description of Artificial Sequence: Synthetic polypeptide
DEEEIRTTNPVATEQYGSCSTDNDLQHRGDIQ

SEQ ID NO: 32697 - protein, 30 aa, Artificial Sequence
  Description of Artificial Sequence: Synthetic polypeptide
DEEEIRTTNPVATEQYGSCSTDLTNGENYQ

SEQ ID NO: 32698 - protein, 31 aa, Artificial Sequence
  Description of Artificial Sequence: Synthetic polypeptide
DEEEIRATNPVAYEQYGKTVSCTNLSQGGNR

SEQ ID NO: 32699 - protein, 31 aa, Artificial Sequence
  Description of Artificial Sequence: Synthetic polypeptide
DEEEIRATNPVAYEQYGKVSVTNLSQGGNNR

SEQ ID NO: 32700 - protein, 31 aa, Artificial Sequence
  Description of Artificial Sequence: Synthetic polypeptide
DEEEIRTTNPVATEQYGSCSTDLTGTGENQR

SEQ ID NO: 32701 - protein, 30 aa, Artificial Sequence
  Description of Artificial Sequence: Synthetic polypeptide
EEEEIACTNPVATEQYGSVSTNLQNGNPEQ

SEQ ID NO: 32702 - protein, 32 aa, Artificial Sequence
  Description of Artificial Sequence: Synthetic polypeptide
EEEEIATTNPVATEAYGSVVSTNLSQRGGNNR

SEQ ID NO: 32703 - protein, 29 aa, Artificial Sequence
  Description of Artificial Sequence: Synthetic peptide
EEEEIATTNPVATEQYGSVATALQDGPDR

SEQ ID NO: 32704 - protein, 30 aa, Artificial Sequence
  Description of Artificial Sequence: Synthetic polypeptide
EEEEIATTNPVATEQYGSVATNLQDGNMEM

SEQ ID NO: 32705 - protein, 30 aa, Artificial Sequence
  Description of Artificial Sequence: Synthetic polypeptide
DEEEIRATNPVAYEQYGTVSTNLSQSNPNR

SEQ ID NO: 32706 - protein, 30 aa, Artificial Sequence
  Description of Artificial Sequence: Synthetic polypeptide
EEEEIATTNPVATEQYGSVSANNQRGENLV

SEQ ID NO: 32707 - protein, 32 aa, Artificial Sequence
  Description of Artificial Sequence: Synthetic polypeptide
EEEEIATTNPVATEQYGSVSCTNLSQRGGNNG

SEQ ID NO: 32708 - protein, 30 aa, Artificial Sequence
  Description of Artificial Sequence: Synthetic polypeptide
EEEEICTTNPCATEQYGSVATNLQHDGNGR

SEQ ID NO: 32709 - protein, 30 aa, Artificial Sequence
  Description of Artificial Sequence: Synthetic polypeptide
DEEEIRTTNPVATEQYGSCSTDDQQDGNNT

SEQ ID NO: 32710 - protein, 31 aa, Artificial Sequence
  Description of Artificial Sequence: Synthetic polypeptide
EEEEIRTTNPVATEQYGSVSAGNPQTDGMNR

SEQ ID NO: 32711 - protein, 29 aa, Artificial Sequence
  Description of Artificial Sequence: Synthetic peptide
DSEEIRTTNPVCTEQWGMVCSTNLQGGVR

SEQ ID NO: 32712 - protein, 28 aa, Artificial Sequence
  Description of Artificial Sequence: Synthetic peptide
DSEEIRTTNPVCTEQWGECSTPLQRGER

SEQ ID NO: 32713 - protein, 31 aa, Artificial Sequence
  Description of Artificial Sequence: Synthetic polypeptide
DSEEIRTTNPVAYEQYGSVSTNLSQQTSNNR

SEQ ID NO: 32714 - protein, 31 aa, Artificial Sequence
  Description of Artificial Sequence: Synthetic polypeptide
DEVEIRTTNPVAYEQWGSVSTNLQGEDGNTR

SEQ ID NO: 32715 - protein, 30 aa, Artificial Sequence
  Description of Artificial Sequence: Synthetic polypeptide
DEVEIRTTNPVAYEQWGSVSTNLQMGDNNK

SEQ ID NO: 32716 - protein, 30 aa, Artificial Sequence
  Description of Artificial Sequence: Synthetic polypeptide
DEEEIRATNPVATEQWGSVSVNDDRGSNSR

SEQ ID NO: 32717 - protein, 29 aa, Artificial Sequence
  Description of Artificial Sequence: Synthetic peptide
DEEEIRATNPVATEQWGTVSTALQENGNA

SEQ ID NO: 32718 - protein, 30 aa, Artificial Sequence
  Description of Artificial Sequence: Synthetic polypeptide
DEVEIRTTNPVAYERYGSVSTNLQDGGNGQ

SEQ ID NO: 32719 - protein, 31 aa, Artificial Sequence
  Description of Artificial Sequence: Synthetic polypeptide
DEEEIRATNPVATEQYGAVSITNLFQDGGNV

SEQ ID NO: 32720 - protein, 32 aa, Artificial Sequence
  Description of Artificial Sequence: Synthetic polypeptide
DEEEIRATNPVATEQYGAVSMTNLFQDGGNER

SEQ ID NO: 32721 - protein, 29 aa, Artificial Sequence
  Description of Artificial Sequence: Synthetic peptide
DEWEIRTTNPVATDQYGSVYTQDLQRGED

SEQ ID NO: 32722 - protein, 30 aa, Artificial Sequence
  Description of Artificial Sequence: Synthetic polypeptide
DEVEIRTTNPVAYEQWGSVSTNLQDGDNQT

SEQ ID NO: 32723 - protein, 28 aa, Artificial Sequence
  Description of Artificial Sequence: Synthetic peptide
AENEIACTNPVATEQYGEASTNLQRGGR

SEQ ID NO: 32724 - protein, 32 aa, Artificial Sequence
  Description of Artificial Sequence: Synthetic polypeptide
DEEEIRTTNPVATEQYGSGVNATNLQRNEERD

SEQ ID NO: 32725 - protein, 29 aa, Artificial Sequence
  Description of Artificial Sequence: Synthetic peptide
DEYEIRTTNPVATDQYGSVNTQQQRGNDQ

SEQ ID NO: 32726 - protein, 31 aa, Artificial Sequence
  Description of Artificial Sequence: Synthetic polypeptide
DEEEIRATNPVATEQYGCVAITNLEQDEGNR

SEQ ID NO: 32727 - protein, 31 aa, Artificial Sequence
  Description of Artificial Sequence: Synthetic polypeptide
DEEEIRATNPVATEQYGCVAITNLTQGGNQR

SEQ ID NO: 32728 - protein, 30 aa, Artificial Sequence
  Description of Artificial Sequence: Synthetic polypeptide
DEEEIRATNPVATEQYGCVAMTNLEQGGDR

SEQ ID NO: 32729 - protein, 30 aa, Artificial Sequence
  Description of Artificial Sequence: Synthetic polypeptide
DEYEIRTTNPVATEQYGSVSTDYQRGEDGQ

SEQ ID NO: 32730 - protein, 31 aa, Artificial Sequence
  Description of Artificial Sequence: Synthetic polypeptide
DEEEIRTTNPVATEQYGSGSINLQEVGEENS

SEQ ID NO: 32731 - protein, 30 aa, Artificial Sequence
  Description of Artificial Sequence: Synthetic polypeptide
DEEEIRTTNPVATEQYGSGSGNWQRVGEEN

SEQ ID NO: 32732 - protein, 32 aa, Artificial Sequence
  Description of Artificial Sequence: Synthetic polypeptide
DEEEIRTTNPVATEQYGSGVNSANLQRNEERQ

SEQ ID NO: 32733 - protein, 31 aa, Artificial Sequence
  Description of Artificial Sequence: Synthetic polypeptide
DEEEIRATNPVATEQYGCVSATNLDQGGNDD

SEQ ID NO: 32734 - protein, 32 aa, Artificial Sequence
  Description of Artificial Sequence: Synthetic polypeptide
DEEEIRTTNPVATEQYGSGVSTNLQRNEEMID

SEQ ID NO: 32735 - protein, 31 aa, Artificial Sequence
  Description of Artificial Sequence: Synthetic polypeptide
DEVEIRTTNPVATEQYGVVSTNLQTGGGNDQ

SEQ ID NO: 32736 - protein, 31 aa, Artificial Sequence
  Description of Artificial Sequence: Synthetic polypeptide
DEVEIRTTNPVATEQYGSVSTNNGGDTQGNR

SEQ ID NO: 32737 - protein, 31 aa, Artificial Sequence
  Description of Artificial Sequence: Synthetic polypeptide
DEVEIRTTNPVATEQYGSVSTNPQGDGGGNI

SEQ ID NO: 32738 - protein, 32 aa, Artificial Sequence
  Description of Artificial Sequence: Synthetic polypeptide
DEEEIRTTNPVATEQYGSINVTNLQPRIGVDR

SEQ ID NO: 32739 - protein, 32 aa, Artificial Sequence
  Description of Artificial Sequence: Synthetic polypeptide
DEVEIRTTNPVATEQYGSVSTPNLQFNNGNDN

SEQ ID NO: 32740 - protein, 32 aa, Artificial Sequence
  Description of Artificial Sequence: Synthetic polypeptide
DEVEIRTTNPVATEQYGSVSTPNLQFNVGNEG

SEQ ID NO: 32741 - protein, 32 aa, Artificial Sequence
  Description of Artificial Sequence: Synthetic polypeptide
DEEEIRTTNPVATEQYGSICTATELEQREGNR

SEQ ID NO: 32742 - protein, 32 aa, Artificial Sequence
  Description of Artificial Sequence: Synthetic polypeptide
DEVEIRTTNPVATEQYGSVSTPNLQTMGNSEV

SEQ ID NO: 32743 - protein, 31 aa, Artificial Sequence
  Description of Artificial Sequence: Synthetic polypeptide
DEEEIRTTNPVATEQYGSICSSPNMLQRDNA

SEQ ID NO: 32744 - protein, 31 aa, Artificial Sequence
  Description of Artificial Sequence: Synthetic polypeptide
DEVEIRTTNPVATESYGSVSTNLQEGGNNGS

SEQ ID NO: 32745 - protein, 32 aa, Artificial Sequence
  Description of Artificial Sequence: Synthetic polypeptide
DEVEIRTTNPVATEQYGSVSTQNLEQNGGNED

SEQ ID NO: 32746 - protein, 32 aa, Artificial Sequence
  Description of Artificial Sequence: Synthetic polypeptide
DEVEIRTTNPVATEQYGSVSTTNLQIGGGNIG

SEQ ID NO: 32747 - protein, 32 aa, Artificial Sequence
  Description of Artificial Sequence: Synthetic polypeptide
DEVEIRTTNPVATEQYGSVSTTNNQNHGDNVR

SEQ ID NO: 32748 - protein, 33 aa, Artificial Sequence
  Description of Artificial Sequence: Synthetic polypeptide
DEVEIRTTNPVATEQYGSVSTVNGDQERGGNAR

SEQ ID NO: 32749 - protein, 32 aa, Artificial Sequence
  Description of Artificial Sequence: Synthetic polypeptide
DEEEIRATNPVATEQWGSTSMTGNLDQRIGNR

SEQ ID NO: 32750 - protein, 30 aa, Artificial Sequence
  Description of Artificial Sequence: Synthetic polypeptide
DEVEIRTTNPVATEQYGSVSVSNGERFGDR

SEQ ID NO: 32751 - protein, 31 aa, Artificial Sequence
  Description of Artificial Sequence: Synthetic polypeptide
DEVEIRTTNPVATEQYGSVTSTNLGDNGNTV

SEQ ID NO: 32752 - protein, 32 aa, Artificial Sequence
  Description of Artificial Sequence: Synthetic polypeptide
DEVEIRTTNPVATEQYGSVTSTNLQFGNGNDN

SEQ ID NO: 32753 - protein, 32 aa, Artificial Sequence
  Description of Artificial Sequence: Synthetic polypeptide
DEVEIRTTNPVATEQYGVVSTNGGQERGGNER

SEQ ID NO: 32754 - protein, 32 aa, Artificial Sequence
  Description of Artificial Sequence: Synthetic polypeptide
DEVEIRTTNPVATEQYGSVSTTNGDQERGGNS

SEQ ID NO: 32755 - protein, 30 aa, Artificial Sequence
  Description of Artificial Sequence: Synthetic polypeptide
DEEEIRATNPVATEQYGCVSMTNLDEGGNQ

SEQ ID NO: 32756 - protein, 31 aa, Artificial Sequence
  Description of Artificial Sequence: Synthetic polypeptide
DEEEIRATNPVATEQYGDVSMTNLFQGEGER

SEQ ID NO: 32757 - protein, 30 aa, Artificial Sequence
  Description of Artificial Sequence: Synthetic polypeptide
DEYEIYTTNPVATEQYGSVSTNLNFGGNGT

SEQ ID NO: 32758 - protein, 31 aa, Artificial Sequence
  Description of Artificial Sequence: Synthetic polypeptide
DEEEIRATNPVATEQYGFVSTTVLFQGGNRA

SEQ ID NO: 32759 - protein, 32 aa, Artificial Sequence
  Description of Artificial Sequence: Synthetic polypeptide
DMEEIRSTNPVATEQYGSVSPTNDLQQRDGQR

SEQ ID NO: 32760 - protein, 32 aa, Artificial Sequence
  Description of Artificial Sequence: Synthetic polypeptide
DMEEIRSTNPVATEQYGSVSTNDLEQRNGQRD

SEQ ID NO: 32761 - protein, 31 aa, Artificial Sequence
  Description of Artificial Sequence: Synthetic polypeptide
DEEEIRATNPVATEQYGIVSMTNDFQGNGNR

SEQ ID NO: 32762 - protein, 31 aa, Artificial Sequence
  Description of Artificial Sequence: Synthetic polypeptide
DMEEIRSTNPVATEQYGSVSTNWLEARNGQR

SEQ ID NO: 32763 - protein, 32 aa, Artificial Sequence
  Description of Artificial Sequence: Synthetic polypeptide
DEEEIRATNPVATEQYGKVPSCTNLSQGGNNR

SEQ ID NO: 32764 - protein, 28 aa, Artificial Sequence
  Description of Artificial Sequence: Synthetic peptide
AENEIACTNPVATEQYGEASENLQRGNR

SEQ ID NO: 32765 - protein, 30 aa, Artificial Sequence
  Description of Artificial Sequence: Synthetic polypeptide
DEEEIRATNPVATEQYGMVSMTNDFQGGNV

SEQ ID NO: 32766 - protein, 29 aa, Artificial Sequence
  Description of Artificial Sequence: Synthetic peptide
DMEEIRSTNPVATEQYGSSSTNNQEGNNP

SEQ ID NO: 32767 - protein, 28 aa, Artificial Sequence
  Description of Artificial Sequence: Synthetic peptide
DNEEIATTNPVATAQYGSVSTNPDRGEM

SEQ ID NO: 32768 - protein, 29 aa, Artificial Sequence
  Description of Artificial Sequence: Synthetic peptide
DNEEIRTTNPAATEMYGSVSANEQERENR

SEQ ID NO: 32769 - protein, 30 aa, Artificial Sequence
  Description of Artificial Sequence: Synthetic polypeptide
DEEEIRATNPVATEQYGNVSMTNIEVVGNR

SEQ ID NO: 32770 - protein, 32 aa, Artificial Sequence
  Description of Artificial Sequence: Synthetic polypeptide
DEEEIRATNPVATEQYGNVSMTNVLVQVGNVR

SEQ ID NO: 32771 - protein, 31 aa, Artificial Sequence
  Description of Artificial Sequence: Synthetic polypeptide
DEEEIRATNPVATEQYGNVSPTNEFQVGNQR

SEQ ID NO: 32772 - protein, 29 aa, Artificial Sequence
  Description of Artificial Sequence: Synthetic peptide
DNEEISTTNPVATDQYGSVSTNPVINGNR

SEQ ID NO: 32773 - protein, 30 aa, Artificial Sequence
  Description of Artificial Sequence: Synthetic polypeptide
DNEEISTTNPVATTQYGSVSTMNPSERGNR

SEQ ID NO: 32774 - protein, 30 aa, Artificial Sequence
  Description of Artificial Sequence: Synthetic polypeptide
DNEEISTTNPVATTQYGSVSTNDPMQRGQR

SEQ ID NO: 32775 - protein, 30 aa, Artificial Sequence
  Description of Artificial Sequence: Synthetic polypeptide
DEEEIRATNPVATEQYGNVYMTNEVQVGNR

SEQ ID NO: 32776 - protein, 29 aa, Artificial Sequence
  Description of Artificial Sequence: Synthetic peptide
DNEEIATTNPVATTQYGSVSTNPMGGNNR

SEQ ID NO: 32777 - protein, 28 aa, Artificial Sequence
  Description of Artificial Sequence: Synthetic peptide
DMEEIRSTNPVATEQYGSSSTNMQRSEN

SEQ ID NO: 32778 - protein, 29 aa, Artificial Sequence
  Description of Artificial Sequence: Synthetic peptide
DMEEIRSTNPVATEQYGSSSTNIQTGVNN

SEQ ID NO: 32779 - protein, 30 aa, Artificial Sequence
  Description of Artificial Sequence: Synthetic polypeptide
DMEEIRCTNPVATEQYGSSSTNMQRGNNEN

SEQ ID NO: 32780 - protein, 30 aa, Artificial Sequence
  Description of Artificial Sequence: Synthetic polypeptide
DEYEIYTTNPVATEQYGSVSTNLNGNGNGT

SEQ ID NO: 32781 - protein, 29 aa, Artificial Sequence
  Description of Artificial Sequence: Synthetic peptide
DEYVIRTTNPVATEQYGMVETNPQTVGNR

SEQ ID NO: 32782 - protein, 29 aa, Artificial Sequence
  Description of Artificial Sequence: Synthetic peptide
DEYVIRTTNPVATEQYGMVETTNEQRENR

SEQ ID NO: 32783 - protein, 31 aa, Artificial Sequence
  Description of Artificial Sequence: Synthetic polypeptide
DGEEIRTTNPVATEQWGSVNSTGLLQRGGTR

SEQ ID NO: 32784 - protein, 29 aa, Artificial Sequence
  Description of Artificial Sequence: Synthetic peptide
DGEEIRTTNPVATEQWGSVTATLLQRGTD

SEQ ID NO: 32785 - protein, 29 aa, Artificial Sequence
  Description of Artificial Sequence: Synthetic peptide
DGEEIRTTNPVATEQWGSVTSELLQRGTI

SEQ ID NO: 32786 - protein, 30 aa, Artificial Sequence
  Description of Artificial Sequence: Synthetic polypeptide
DGEEIRTTNPVATEQWGSVTSEMVLQRGTR

SEQ ID NO: 32787 - protein, 31 aa, Artificial Sequence
  Description of Artificial Sequence: Synthetic polypeptide
DGEEIRTTNPVATEQWGSVTSTGDLQDRGTR

SEQ ID NO: 32788 - protein, 30 aa, Artificial Sequence
  Description of Artificial Sequence: Synthetic polypeptide
DGEEIRTTNPVATEQWGSVTSTLLQDGGTR

SEQ ID NO: 32789 - protein, 30 aa, Artificial Sequence
  Description of Artificial Sequence: Synthetic polypeptide
DGEEIRTTNPVATEQWGSVTSTLLQNRGTG

SEQ ID NO: 32790 - protein, 31 aa, Artificial Sequence
  Description of Artificial Sequence: Synthetic polypeptide
DGEEIRTTNPVATEQWGSVTSTLLQRGDTIR

SEQ ID NO: 32791 - protein, 30 aa, Artificial Sequence
  Description of Artificial Sequence: Synthetic polypeptide
DGEEIRTTNPVATEQWGSVTSTVLQRGTID

SEQ ID NO: 32792 - protein, 30 aa, Artificial Sequence
  Description of Artificial Sequence: Synthetic polypeptide
DEEEIRATNPVATEQYGFVSMTNEFEGGNR

SEQ ID NO: 32793 - protein, 30 aa, Artificial Sequence
  Description of Artificial Sequence: Synthetic polypeptide
DGGEIRTTNPVATEQYGSVSTENNLQLGGI

SEQ ID NO: 32794 - protein, 28 aa, Artificial Sequence
  Description of Artificial Sequence: Synthetic peptide
DLTDIRTTNPCATEQWGSVSVNLQTGNR

SEQ ID NO: 32795 - protein, 31 aa, Artificial Sequence
  Description of Artificial Sequence: Synthetic polypeptide
DEEEIRATNPVATEQYGFVSMTNLFQGGNGV

SEQ ID NO: 32796 - protein, 31 aa, Artificial Sequence
  Description of Artificial Sequence: Synthetic polypeptide
DEEEIRATNPVATEQYGFVSMTNLNQGPGNN

SEQ ID NO: 32797 - protein, 32 aa, Artificial Sequence
  Description of Artificial Sequence: Synthetic polypeptide
DMEEIGTTNPVATEQYGSVSTNDLQERMGNNQ

SEQ ID NO: 32798 - protein, 28 aa, Artificial Sequence
  Description of Artificial Sequence: Synthetic peptide
DMEEIRCTNPVATEQYGSSSTNMDEGNN

SEQ ID NO: 32799 - protein, 32 aa, Artificial Sequence
  Description of Artificial Sequence: Synthetic polypeptide
DEEEIRTTNPVATEQYGSISLGNMLSQSVGNR

SEQ ID NO: 32800 - protein, 31 aa, Artificial Sequence
  Description of Artificial Sequence: Synthetic polypeptide
DEEEIRATNPVATEQYGQVSMTNLFQGGNIN

SEQ ID NO: 32801 - protein, 31 aa, Artificial Sequence
  Description of Artificial Sequence: Synthetic polypeptide
DEEEIRTTNPVATEQYGSISLMNMLQIDNRE

SEQ ID NO: 32802 - protein, 31 aa, Artificial Sequence
  Description of Artificial Sequence: Synthetic polypeptide
DEVEIRTTNPVATEQYGSVSTNNDQRGEDGL

SEQ ID NO: 32803 - protein, 32 aa, Artificial Sequence
  Description of Artificial Sequence: Synthetic polypeptide
DEVEIRTTNPVATEQYGSVNSTNLQFNVGNEN

SEQ ID NO: 32804 - protein, 32 aa, Artificial Sequence
  Description of Artificial Sequence: Synthetic polypeptide
DEEEINTTNPVATEQYGSVSTNSLSQVRGTES

SEQ ID NO: 32805 - protein, 32 aa, Artificial Sequence
  Description of Artificial Sequence: Synthetic polypeptide
DEEEINTTNPVATEQYGSVSTNSLTQVRMGEF

SEQ ID NO: 32806 - protein, 32 aa, Artificial Sequence
  Description of Artificial Sequence: Synthetic polypeptide
DEEEINTTNPVATEQYGSVSTVNSLQQVRGEF

SEQ ID NO: 32807 - protein, 31 aa, Artificial Sequence
  Description of Artificial Sequence: Synthetic polypeptide
DEVEIRTTNPVATEQYGSVSMNDQMVGNDRI

SEQ ID NO: 32808 - protein, 31 aa, Artificial Sequence
  Description of Artificial Sequence: Synthetic polypeptide
DEEEINTTNPVATEQYGTVSTNSLNQVRGEF

SEQ ID NO: 32809 - protein, 31 aa, Artificial Sequence
  Description of Artificial Sequence: Synthetic polypeptide
DEVEIRTTNPVATEQYGSVSNNDAQTRGNEM

SEQ ID NO: 32810 - protein, 28 aa, Artificial Sequence
  Description of Artificial Sequence: Synthetic peptide
AENEIACTNPVATEQYGVASENLQRGNR

SEQ ID NO: 32811 - protein, 31 aa, Artificial Sequence
  Description of Artificial Sequence: Synthetic polypeptide
DEVEIRTTNPVATEQYGSVISTVNTQREGLF

SEQ ID NO: 32812 - protein, 28 aa, Artificial Sequence
  Description of Artificial Sequence: Synthetic peptide
DEVEIRTTNPVATEQYGSVSNNLDPNED

SEQ ID NO: 32813 - protein, 31 aa, Artificial Sequence
  Description of Artificial Sequence: Synthetic polypeptide
DEVEIRTTNPVATEQYGSVSTAGDQHGDNER

SEQ ID NO: 32814 - protein, 28 aa, Artificial Sequence
  Description of Artificial Sequence: Synthetic peptide
AENEIACTNPVATEQYGTASTNLQRGGR

SEQ ID NO: 32815 - protein, 32 aa, Artificial Sequence
  Description of Artificial Sequence: Synthetic polypeptide
DEVEIRTTNPVATEQYGSVSTDDDQRGSNQRV

SEQ ID NO: 32816 - protein, 31 aa, Artificial Sequence
  Description of Artificial Sequence: Synthetic polypeptide
DEVEIRTTNPVATEQYGSVSTDDQRGDNQDV

SEQ ID NO: 32817 - protein, 33 aa, Artificial Sequence
  Description of Artificial Sequence: Synthetic polypeptide
DEVEIRTTNPVATEQYGSVSTDNDNNQDRGNNR

SEQ ID NO: 32818 - protein, 32 aa, Artificial Sequence
  Description of Artificial Sequence: Synthetic polypeptide
DEVEIRTTNPVATEQYGSVSTDNDNNQRGGNM

SEQ ID NO: 32819 - protein, 31 aa, Artificial Sequence
  Description of Artificial Sequence: Synthetic polypeptide
DEEEIQTTNPVATEAYGSVSCLNELSQRDNR

SEQ ID NO: 32820 - protein, 32 aa, Artificial Sequence
  Description of Artificial Sequence: Synthetic polypeptide
DEVEIRTTNPVATEQYGSVSTDNLGDNGNNMR

SEQ ID NO: 32821 - protein, 32 aa, Artificial Sequence
  Description of Artificial Sequence: Synthetic polypeptide
DEEEIRTTNPVATEQYGSISTNLQQVVQVNTR

SEQ ID NO: 32822 - protein, 29 aa, Artificial Sequence
  Description of Artificial Sequence: Synthetic peptide
AENEIACTNPVATEQYGSVSTNLQDHGER

SEQ ID NO: 32823 - protein, 31 aa, Artificial Sequence
  Description of Artificial Sequence: Synthetic polypeptide
DEVEIRTTNPVATEQYGSVISTNTGQREGTA

SEQ ID NO: 32824 - protein, 31 aa, Artificial Sequence
  Description of Artificial Sequence: Synthetic polypeptide
DEVEIRTTNPVATEQYGSVCSTMHEQRGGND

SEQ ID NO: 32825 - protein, 32 aa, Artificial Sequence
  Description of Artificial Sequence: Synthetic polypeptide
DEEEINTTNPVATEQYGSVPSTNSLSQVRGEG

SEQ ID NO: 32826 - protein, 31 aa, Artificial Sequence
  Description of Artificial Sequence: Synthetic polypeptide
DEVEIRTTNPVATECYGSVSTNLQEGGGNGE

SEQ ID NO: 32827 - protein, 31 aa, Artificial Sequence
  Description of Artificial Sequence: Synthetic polypeptide
DEVEIRTTNPVATECYGTVSTNLQGDSGDNR

SEQ ID NO: 32828 - protein, 31 aa, Artificial Sequence
  Description of Artificial Sequence: Synthetic polypeptide
DEVEIRTTNPVATEIYGSVSTNLQGEGNGDM

SEQ ID NO: 32829 - protein, 31 aa, Artificial Sequence
  Description of Artificial Sequence: Synthetic polypeptide
DEEEINTTNPVATEQYGSVSTNDLFQVAGEF

SEQ ID NO: 32830 - protein, 33 aa, Artificial Sequence
  Description of Artificial Sequence: Synthetic polypeptide
DEEEINTTNPVATEQYGSVSTNELSQVRGGENQ

SEQ ID NO: 32831 - protein, 31 aa, Artificial Sequence
  Description of Artificial Sequence: Synthetic polypeptide
DEVEIRTTNPVATEQYGCVSTGNLGGDGNER

SEQ ID NO: 32832 - protein, 31 aa, Artificial Sequence
  Description of Artificial Sequence: Synthetic polypeptide
DEVEIRTTNPVATEQYGCVSTNLGDGGGNER

SEQ ID NO: 32833 - protein, 32 aa, Artificial Sequence
  Description of Artificial Sequence: Synthetic polypeptide
DEEEINTTNPVATEQYGSVSTNSLGQVRGDEF

SEQ ID NO: 32834 - protein, 30 aa, Artificial Sequence
  Description of Artificial Sequence: Synthetic polypeptide
DEVEIRTTNPVATEQYGCVSTNLGGDGNEQ

SEQ ID NO: 32835 - protein, 31 aa, Artificial Sequence
  Description of Artificial Sequence: Synthetic polypeptide
DEEEINTTNPVATEQYGSVSTNNLFQVDGEF

SEQ ID NO: 32836 - protein, 31 aa, Artificial Sequence
  Description of Artificial Sequence: Synthetic polypeptide
DEVEIRTTNPVATEQYGEVSTNGDGERGGNR

SEQ ID NO: 32837 - protein, 31 aa, Artificial Sequence
  Description of Artificial Sequence: Synthetic polypeptide
DEVEIRTTNPVATEQYGEVSTNLQGEGGNNA

SEQ ID NO: 32838 - protein, 31 aa, Artificial Sequence
  Description of Artificial Sequence: Synthetic polypeptide
DEVEIRTTNPVATEQYGEVSTNLQMGDGNDE

SEQ ID NO: 32839 - protein, 32 aa, Artificial Sequence
  Description of Artificial Sequence: Synthetic polypeptide
DEEEINTTNPVATEQYGSVSTNSLFQVRGEEE

SEQ ID NO: 32840 - protein, 31 aa, Artificial Sequence
  Description of Artificial Sequence: Synthetic polypeptide
DEVEIRTTNPVATEQYGSVATNLQGDGNNDE

SEQ ID NO: 32841 - protein, 32 aa, Artificial Sequence
  Description of Artificial Sequence: Synthetic polypeptide
DEVEIRTTNPVATEQYGSVCSTELLTREGQNR

SEQ ID NO: 32842 - protein, 31 aa, Artificial Sequence
  Description of Artificial Sequence: Synthetic polypeptide
DEVEIRTTNPVATEQYGSVCSTELQNGSERL

SEQ ID NO: 32843 - protein, 31 aa, Artificial Sequence
  Description of Artificial Sequence: Synthetic polypeptide
DEVEIRTTNPVATEQYGCVSTNLNGDAGNER

SEQ ID NO: 32844 - protein, 29 aa, Artificial Sequence
  Description of Artificial Sequence: Synthetic peptide
AENEIACTNPVATEQYGSVSTNLEDRGGR

SEQ ID NO: 32845 - protein, 31 aa, Artificial Sequence
  Description of Artificial Sequence: Synthetic polypeptide
DEVEIRTTNPVATEQYGSVSTELDQGNGNEG

SEQ ID NO: 32846 - protein, 29 aa, Artificial Sequence
  Description of Artificial Sequence: Synthetic peptide
AENEIACTNPVATEQYGSVASENLQRGER

SEQ ID NO: 32847 - protein, 31 aa, Artificial Sequence
  Description of Artificial Sequence: Synthetic polypeptide
DEEEIRTTNPVATEQYGSISLPNMLSQHVNR

SEQ ID NO: 32848 - protein, 32 aa, Artificial Sequence
  Description of Artificial Sequence: Synthetic polypeptide
DEVEIRTTNPVATEQYGSVSTNLQFNEGGGNN

SEQ ID NO: 32849 - protein, 32 aa, Artificial Sequence
  Description of Artificial Sequence: Synthetic polypeptide
DEVEIRTTNPVATEQYGSVSTNLQFNEGNNEG

SEQ ID NO: 32850 - protein, 32 aa, Artificial Sequence
  Description of Artificial Sequence: Synthetic polypeptide
DEVEIRTTNPVATEQYGSVSTNLQFNVGNEGN

SEQ ID NO: 32851 - protein, 32 aa, Artificial Sequence
  Description of Artificial Sequence: Synthetic polypeptide
DEVEIRTTNPVATEQYGSVSTNLQGGEGNNEK

SEQ ID NO: 32852 - protein, 32 aa, Artificial Sequence
  Description of Artificial Sequence: Synthetic polypeptide
DEVEIRTTNPVATEQYGSVSTNLQGMGGDNQT

SEQ ID NO: 32853 - protein, 28 aa, Artificial Sequence
  Description of Artificial Sequence: Synthetic peptide
AENEIACTNPVATEQYGEVSTNLQRGGD

SEQ ID NO: 32854 - protein, 28 aa, Artificial Sequence
  Description of Artificial Sequence: Synthetic peptide
AENEIACTNPVATEQYGEVSKNLQRGGR

SEQ ID NO: 32855 - protein, 31 aa, Artificial Sequence
  Description of Artificial Sequence: Synthetic polypeptide
DEEEIRATNPVATEGYGSVSTNLQDGNGNQG

SEQ ID NO: 32856 - protein, 28 aa, Artificial Sequence
  Description of Artificial Sequence: Synthetic peptide
AENEIACTNPVATEQYGEVSENLQRGQR

SEQ ID NO: 32857 - protein, 28 aa, Artificial Sequence
  Description of Artificial Sequence: Synthetic peptide
AENEIACTNPVATEQYGEVSENLQRGER

SEQ ID NO: 32858 - protein, 28 aa, Artificial Sequence
  Description of Artificial Sequence: Synthetic peptide
AENEIACTNPVATEQYGEVSENLQRGDR

SEQ ID NO: 32859 - protein, 28 aa, Artificial Sequence
  Description of Artificial Sequence: Synthetic peptide
AENEIACTNPVATEQYGEVSENLQFGNR

SEQ ID NO: 32860 - protein, 28 aa, Artificial Sequence
  Description of Artificial Sequence: Synthetic peptide
AENEIACTNPVATEQYGEVSCNLQRGTR

SEQ ID NO: 32861 - protein, 28 aa, Artificial Sequence
  Description of Artificial Sequence: Synthetic peptide
AENEIACTNPVATEQYGEVSCNLQRGGR

SEQ ID NO: 32862 - protein, 32 aa, Artificial Sequence
  Description of Artificial Sequence: Synthetic polypeptide
DEVEIRTTNPVATEQYGSVSTNLQVQGGNIEQ

SEQ ID NO: 32863 - protein, 31 aa, Artificial Sequence
  Description of Artificial Sequence: Synthetic polypeptide
DEVEIRTTNPVATEQYGSVSTNMQNRSDQRG

SEQ ID NO: 32864 - protein, 31 aa, Artificial Sequence
  Description of Artificial Sequence: Synthetic polypeptide
DEVEIRTTNPVATEQYGSVSTNNDQGGNDGE

SEQ ID NO: 32865 - protein, 28 aa, Artificial Sequence
  Description of Artificial Sequence: Synthetic peptide
AENEIACTNPVATEQYGEVSENLQRGGR

SEQ ID NO: 32866 - protein, 32 aa, Artificial Sequence
  Description of Artificial Sequence: Synthetic polypeptide
DEVEIRTTNPVATEQYGSVSTNLGQENGDNSP

SEQ ID NO: 32867 - protein, 28 aa, Artificial Sequence
  Description of Artificial Sequence: Synthetic peptide
AENEIACTNPVATEQYGIVSCNLQRGGR

SEQ ID NO: 32868 - protein, 28 aa, Artificial Sequence
  Description of Artificial Sequence: Synthetic peptide
AENEIACTNPVATEQYGIVSCNLQRGTR

SEQ ID NO: 32869 - protein, 31 aa, Artificial Sequence
  Description of Artificial Sequence: Synthetic polypeptide
DEVEIRTTNPVATEQYGSVSTGDNQGGHGNR

SEQ ID NO: 32870 - protein, 31 aa, Artificial Sequence
  Description of Artificial Sequence: Synthetic polypeptide
DEEEIRTTNPVATEQYGSISTMNLQVVENDG

SEQ ID NO: 32871 - protein, 28 aa, Artificial Sequence
  Description of Artificial Sequence: Synthetic peptide
AENEIACTNPVATEQYGSASTNLERGGR

SEQ ID NO: 32872 - protein, 30 aa, Artificial Sequence
  Description of Artificial Sequence: Synthetic polypeptide
DEVEIRTTNPVATEQYGSVSTGGDQHGNEQ

SEQ ID NO: 32873 - protein, 28 aa, Artificial Sequence
  Description of Artificial Sequence: Synthetic peptide
AENEIACTNPVATEQYGSASFNLQRGGR

SEQ ID NO: 32874 - protein, 28 aa, Artificial Sequence
  Description of Artificial Sequence: Synthetic peptide
AENEIACTNPVATEQYGSASENLQRGGR

SEQ ID NO: 32875 - protein, 32 aa, Artificial Sequence
  Description of Artificial Sequence: Synthetic polypeptide
DEEEIRTTNPVATEQYGSISTGNLQRMIELRI

SEQ ID NO: 32876 - protein, 29 aa, Artificial Sequence
  Description of Artificial Sequence: Synthetic peptide
AENEIACTNPVATEQYGSASEINLQRGNR

SEQ ID NO: 32877 - protein, 32 aa, Artificial Sequence
  Description of Artificial Sequence: Synthetic polypeptide
DEVEIRTTNPVATEQYGSVSTGNLEQNDGNDD

SEQ ID NO: 32878 - protein, 32 aa, Artificial Sequence
  Description of Artificial Sequence: Synthetic polypeptide
DEVEIRTTNPVATEQYGSVSTGNLQQIGGGNI

SEQ ID NO: 32879 - protein, 33 aa, Artificial Sequence
  Description of Artificial Sequence: Synthetic polypeptide
DEVEIRTTNPVATEQYGSVSTGNPLGQEDGDNR

SEQ ID NO: 32880 - protein, 31 aa, Artificial Sequence
  Description of Artificial Sequence: Synthetic polypeptide
DEVEIRTTNPVATEQYGSVSTGPEGQDGNQR

SEQ ID NO: 32881 - protein, 32 aa, Artificial Sequence
  Description of Artificial Sequence: Synthetic polypeptide
DEVEIRTTNPVATEQYGSVSTNDGDQRGNDGA

SEQ ID NO: 32882 - protein, 31 aa, Artificial Sequence
  Description of Artificial Sequence: Synthetic polypeptide
DEVEIRTTNPVATEQYGSVSTNDGGQQNGNA

SEQ ID NO: 32883 - protein, 31 aa, Artificial Sequence
  Description of Artificial Sequence: Synthetic polypeptide
DEVEIRTTNPVATEQYGSVSTNDLQTFGGEQ

SEQ ID NO: 32884 - protein, 32 aa, Artificial Sequence
  Description of Artificial Sequence: Synthetic polypeptide
DEVEIRTTNPVATEQYGSVSTNDMQNRGDQRD

SEQ ID NO: 32885 - protein, 28 aa, Artificial Sequence
  Description of Artificial Sequence: Synthetic peptide
AENEIACTNPVATEQYGNVSENLQRGQR

SEQ ID NO: 32886 - protein, 32 aa, Artificial Sequence
  Description of Artificial Sequence: Synthetic polypeptide
DEEEIRTTNPVATEQYGSISNTNLIRGENVEV

SEQ ID NO: 32887 - protein, 30 aa, Artificial Sequence
  Description of Artificial Sequence: Synthetic polypeptide
DEEEIRTTNPVATEQYGSISMNIQQQNGNH

SEQ ID NO: 32888 - protein, 31 aa, Artificial Sequence
  Description of Artificial Sequence: Synthetic polypeptide
DEVEIRTTNPVATEQYGSVSTNNDQRNFNDG

SEQ ID NO: 32889 - protein, 28 aa, Artificial Sequence
  Description of Artificial Sequence: Synthetic peptide
FEEEIRTTNPVATEEYGCYSIMLQGGNR

SEQ ID NO: 32890 - protein, 33 aa, Artificial Sequence
  Description of Artificial Sequence: Synthetic polypeptide
DEEEIRTTNPVATEQYGSFVSDENDDQRGNDRI

SEQ ID NO: 32891 - protein, 29 aa, Artificial Sequence
  Description of Artificial Sequence: Synthetic peptide
DNEEISTTNPVATTQYGSVSTNPGMSGNR

SEQ ID NO: 32892 - protein, 29 aa, Artificial Sequence
  Description of Artificial Sequence: Synthetic peptide
DSEEIRSTNPVATEQWGSSSTNMQRGNNS

SEQ ID NO: 32893 - protein, 32 aa, Artificial Sequence
  Description of Artificial Sequence: Synthetic polypeptide
DEEEIRTTNPVATEQYGSCSVNLDQNREGDRG

SEQ ID NO: 32894 - protein, 30 aa, Artificial Sequence
  Description of Artificial Sequence: Synthetic polypeptide
DSEEIRSTNPVATEQYGSIPSTNFSQRGNN

SEQ ID NO: 32895 - protein, 31 aa, Artificial Sequence
  Description of Artificial Sequence: Synthetic polypeptide
DEEEIRTTNPVATEQYGSCSVNLDQNGGDER

SEQ ID NO: 32896 - protein, 31 aa, Artificial Sequence
  Description of Artificial Sequence: Synthetic polypeptide
DEEEIRTTNPVATEQYGSCSTWNLEQVDNQQ

SEQ ID NO: 32897 - protein, 29 aa, Artificial Sequence
  Description of Artificial Sequence: Synthetic peptide
DSEEIRSTNPVATEQYGSISTNDSQSGNN

SEQ ID NO: 32898 - protein, 30 aa, Artificial Sequence
  Description of Artificial Sequence: Synthetic polypeptide
DSEEIRSTNPVATEQYGSISTNGSQRGGNE

SEQ ID NO: 32899 - protein, 28 aa, Artificial Sequence
  Description of Artificial Sequence: Synthetic peptide
DSEEIRSTNPVATEQYGSSTTNMQHGND

SEQ ID NO: 32900 - protein, 29 aa, Artificial Sequence
  Description of Artificial Sequence: Synthetic peptide
DSEEIRSTNPVATEQWGSSSTNMQRGNDE

SEQ ID NO: 32901 - protein, 31 aa, Artificial Sequence
  Description of Artificial Sequence: Synthetic polypeptide
DEEEIRTTNPVATEQYGSCSTVLQRMGSEID

SEQ ID NO: 32902 - protein, 32 aa, Artificial Sequence
  Description of Artificial Sequence: Synthetic polypeptide
DSEEIRSTNPVATEQYGSVPSTNALQARNGSR

SEQ ID NO: 32903 - protein, 30 aa, Artificial Sequence
  Description of Artificial Sequence: Synthetic polypeptide
DEEEIRTTNPVATEQYGSCSTVLEGGIDRS

SEQ ID NO: 32904 - protein, 32 aa, Artificial Sequence
  Description of Artificial Sequence: Synthetic polypeptide
DSEEIRSTNPVATEQYGSVVSTNMLQNGGTNR

SEQ ID NO: 32905 - protein, 31 aa, Artificial Sequence
  Description of Artificial Sequence: Synthetic polypeptide
DEEEIRATNPVATEQYGSVSAANNDRGSNSR

SEQ ID NO: 32906 - protein, 31 aa, Artificial Sequence
  Description of Artificial Sequence: Synthetic polypeptide
DEEEIRTTNPVATEQYGSCSTTSLQIGNDQS

SEQ ID NO: 32907 - protein, 30 aa, Artificial Sequence
  Description of Artificial Sequence: Synthetic polypeptide
DSEEIRSTNPVAYEQYGSVSTNLQARNVSR

SEQ ID NO: 32908 - protein, 30 aa, Artificial Sequence
  Description of Artificial Sequence: Synthetic polypeptide
DEEEIRATNPVATEQYGSVSANNDRGSNDN

SEQ ID NO: 32909 - protein, 28 aa, Artificial Sequence
  Description of Artificial Sequence: Synthetic peptide
DSEEIRTTNPCATEEYGSVATNHGRGNS

SEQ ID NO: 32910 - protein, 31 aa, Artificial Sequence
  Description of Artificial Sequence: Synthetic polypeptide
DSEEIRSTNPVATEQYGSVCSTNLQENFGQR

SEQ ID NO: 32911 - protein, 31 aa, Artificial Sequence
  Description of Artificial Sequence: Synthetic polypeptide
DSEEIRTTNPCATEHYGSVSCFNLSQRVGNR

SEQ ID NO: 32912 - protein, 31 aa, Artificial Sequence
  Description of Artificial Sequence: Synthetic polypeptide
DEEEIRTTNPVATEQYGSCSVNLEDNRGDRM

SEQ ID NO: 32913 - protein, 29 aa, Artificial Sequence
  Description of Artificial Sequence: Synthetic peptide
DSEEIRSTNPVATEAYGSISTNSSQRGNN

SEQ ID NO: 32914 - protein, 31 aa, Artificial Sequence
  Description of Artificial Sequence: Synthetic polypeptide
DSEEIATTNPVATEQWGSVSCTNLSQRGGNL

SEQ ID NO: 32915 - protein, 32 aa, Artificial Sequence
  Description of Artificial Sequence: Synthetic polypeptide
DSEEIATTNPVATEQYGSTVSCINELSQRGNR

SEQ ID NO: 32916 - protein, 30 aa, Artificial Sequence
  Description of Artificial Sequence: Synthetic polypeptide
DSEEIATTNPVATTQYGSVSTNPSTRGNNR

SEQ ID NO: 32917 - protein, 32 aa, Artificial Sequence
  Description of Artificial Sequence: Synthetic polypeptide
DEEEIRTTNPVATEQYGSCVSCTPLQNEETNR

SEQ ID NO: 32918 - protein, 32 aa, Artificial Sequence
  Description of Artificial Sequence: Synthetic polypeptide
DSEEIATTNPVAYEQYGSVVSTNLSQRGGNNR

SEQ ID NO: 32919 - protein, 31 aa, Artificial Sequence
  Description of Artificial Sequence: Synthetic polypeptide
DSEEIATTNPVAYERYGSVSTNALQRPGGNR

SEQ ID NO: 32920 - protein, 29 aa, Artificial Sequence
  Description of Artificial Sequence: Synthetic peptide
DSEEIATTNPVGTEQWGCVSTNLSQRGVR

SEQ ID NO: 32921 - protein, 28 aa, Artificial Sequence
  Description of Artificial Sequence: Synthetic peptide
DSEEIATTNPVGTEQWGMVSTNLQMGER

SEQ ID NO: 32922 - protein, 31 aa, Artificial Sequence
  Description of Artificial Sequence: Synthetic polypeptide
DSEEIRSTNPVATEAYGSVPSTNLQARTGQR

SEQ ID NO: 32923 - protein, 31 aa, Artificial Sequence
  Description of Artificial Sequence: Synthetic polypeptide
DSEEICTTNPMATEQYGSVPTNLSQNRGNNR

SEQ ID NO: 32924 - protein, 30 aa, Artificial Sequence
  Description of Artificial Sequence: Synthetic polypeptide
DEEEIRTTNPVATEQYGSCSVVYLQQGQDR

SEQ ID NO: 32925 - protein, 31 aa, Artificial Sequence
  Description of Artificial Sequence: Synthetic polypeptide
DEEEIRTTNPVATEQYGSCSVTTDQPRGHSR

SEQ ID NO: 32926 - protein, 32 aa, Artificial Sequence
  Description of Artificial Sequence: Synthetic polypeptide
DEEEIRTTNPVATEQYGSCSVTPLDQSRGNIQ

SEQ ID NO: 32927 - protein, 30 aa, Artificial Sequence
  Description of Artificial Sequence: Synthetic polypeptide
DSEEIRATNPVATEQYGSASTNMQRNGNEN

SEQ ID NO: 32928 - protein, 30 aa, Artificial Sequence
  Description of Artificial Sequence: Synthetic polypeptide
DSEEIRATNPVATEQYGSVVATNLQNGTDR

SEQ ID NO: 32929 - protein, 32 aa, Artificial Sequence
  Description of Artificial Sequence: Synthetic polypeptide
DEEEIRTTNPVATEQYGSCSVTNLIRQLTNQR

SEQ ID NO: 32930 - protein, 30 aa, Artificial Sequence
  Description of Artificial Sequence: Synthetic polypeptide
DSEEIRATNPVATEQYGSVVSTNHQNGGTR

SEQ ID NO: 32931 - protein, 31 aa, Artificial Sequence
  Description of Artificial Sequence: Synthetic polypeptide
DSEEIRCTNPVATEQYGSVVSTNLSQNGTTR

SEQ ID NO: 32932 - protein, 31 aa, Artificial Sequence
  Description of Artificial Sequence: Synthetic polypeptide
DEEEIRTTNPVATEQYGSCSWNPNMLQIDNR

SEQ ID NO: 32933 - protein, 30 aa, Artificial Sequence
  Description of Artificial Sequence: Synthetic polypeptide
DEEEIRTTNPVATEQYGSCSTSLVRDDDGR

SEQ ID NO: 32934 - protein, 31 aa, Artificial Sequence
  Description of Artificial Sequence: Synthetic polypeptide
DSEEIRTTNPLATEHYGSVSCINELQREGNR

SEQ ID NO: 32935 - protein, 31 aa, Artificial Sequence
  Description of Artificial Sequence: Synthetic polypeptide
DSEEIRTTNPLATEHYGSVSFNELSQRVGNR

SEQ ID NO: 32936 - protein, 32 aa, Artificial Sequence
  Description of Artificial Sequence: Synthetic polypeptide
DSEEIRTTNPVATEQYGSVSCINELSQRGNND

SEQ ID NO: 32937 - protein, 29 aa, Artificial Sequence
  Description of Artificial Sequence: Synthetic peptide
DEEEIRTTNPVATEQYGSCSTPLYRDDQD

SEQ ID NO: 32938 - protein, 32 aa, Artificial Sequence
  Description of Artificial Sequence: Synthetic polypeptide
DSEEIRTTNPVATEQYGSVSTNALSDRGGNNG

SEQ ID NO: 32939 - protein, 34 aa, Artificial Sequence
  Description of Artificial Sequence: Synthetic polypeptide
DSEEIRTTNPVATEQYGSVSTNALSQRPGGNNRW

SEQ ID NO: 32940 - protein, 30 aa, Artificial Sequence
  Description of Artificial Sequence: Synthetic polypeptide
DEEEIRTTNPVATEQYGSCSTPLVRIDTQR

SEQ ID NO: 32941 - protein, 33 aa, Artificial Sequence
  Description of Artificial Sequence: Synthetic polypeptide
DSEEIRTTNPVATEQYGSVVSTNLSQRTVTNYR

SEQ ID NO: 32942 - protein, 32 aa, Artificial Sequence
  Description of Artificial Sequence: Synthetic polypeptide
DSEEIRTTNPVATEQYGVVSYTNLSQRGGNNV

SEQ ID NO: 32943 - protein, 32 aa, Artificial Sequence
  Description of Artificial Sequence: Synthetic polypeptide
DSEEIRTTNPVATERYGSVSTNALSTRPGGNR

SEQ ID NO: 32944 - protein, 32 aa, Artificial Sequence
  Description of Artificial Sequence: Synthetic polypeptide
DSEEIRTTNPVATEQYGSVPSCTNGSQRGSNF

SEQ ID NO: 32945 - protein, 29 aa, Artificial Sequence
  Description of Artificial Sequence: Synthetic peptide
DEEEIRTTNPVATEQYGSCSTPLVMDDQR

SEQ ID NO: 32946 - protein, 31 aa, Artificial Sequence
  Description of Artificial Sequence: Synthetic polypeptide
DSEEIRTTNPVATHQYGSVSTNAVQNVGNNR

SEQ ID NO: 32947 - protein, 31 aa, Artificial Sequence
  Description of Artificial Sequence: Synthetic polypeptide
DSEEIRTTNPVATHQYGSVSTNGVSQNGNLR

SEQ ID NO: 32948 - protein, 31 aa, Artificial Sequence
  Description of Artificial Sequence: Synthetic polypeptide
DEEEIRTTNPVATEQYGSCSTPLQSGGNIQQ

SEQ ID NO: 32949 - protein, 31 aa, Artificial Sequence
  Description of Artificial Sequence: Synthetic polypeptide
DEEEIRATNPVATEQYGSVSTDLQGGGNNEP

SEQ ID NO: 32950 - protein, 31 aa, Artificial Sequence
  Description of Artificial Sequence: Synthetic polypeptide
DSEEIRTTNPVAYEQWGSVSTNLSQSGNNRM

SEQ ID NO: 32951 - protein, 30 aa, Artificial Sequence
  Description of Artificial Sequence: Synthetic polypeptide
DSEEIRTTNPVAYEQYGEVSTNMHPQQGNR

SEQ ID NO: 32952 - protein, 31 aa, Artificial Sequence
  Description of Artificial Sequence: Synthetic polypeptide
DSEEIRTTNPVAYEQYGSTVSTNLQMGGNII

SEQ ID NO: 32953 - protein, 31 aa, Artificial Sequence
  Description of Artificial Sequence: Synthetic polypeptide
DSEEIRTTNPVAYEQYGSVSCINELSQRGNP

SEQ ID NO: 32954 - protein, 31 aa, Artificial Sequence
  Description of Artificial Sequence: Synthetic polypeptide
DSEEIRTTNPVATHQYGSVSTGNGDQGGNHR

SEQ ID NO: 32955 - protein, 33 aa, Artificial Sequence
  Description of Artificial Sequence: Synthetic polypeptide
DSEEIRTTNPVATEQYGSTVSCTNLSQRTVNDR

SEQ ID NO: 32956 - protein, 32 aa, Artificial Sequence
  Description of Artificial Sequence: Synthetic polypeptide
DSEEIRTTNPVATEQYGSTVSCTNHSQGGPNR

SEQ ID NO: 32957 - protein, 32 aa, Artificial Sequence
  Description of Artificial Sequence: Synthetic polypeptide
DEEEIRATNPVATEQYGSVSGTNLQDTGGNNG

SEQ ID NO: 32958 - protein, 30 aa, Artificial Sequence
  Description of Artificial Sequence: Synthetic polypeptide
DEEEIRATNPVATEQYGSVSANQDRGSESR

SEQ ID NO: 32959 - protein, 32 aa, Artificial Sequence
  Description of Artificial Sequence: Synthetic polypeptide
DSEEIRTTNPVATEAYGQSVSCTNLSQNGGNR

SEQ ID NO: 32960 - protein, 32 aa, Artificial Sequence
  Description of Artificial Sequence: Synthetic polypeptide
DSEEIRTTNPVATEAYGSVSCTNLSQAGGNRV

SEQ ID NO: 32961 - protein, 30 aa, Artificial Sequence
  Description of Artificial Sequence: Synthetic polypeptide
DEEEIRTTNPVATEQYGSCSTQLQRSTEEG

SEQ ID NO: 32962 - protein, 31 aa, Artificial Sequence
  Description of Artificial Sequence: Synthetic polypeptide
DSEEIRTTNPVATEPYGSVFCTNLQSGGNNR

SEQ ID NO: 32963 - protein, 32 aa, Artificial Sequence
  Description of Artificial Sequence: Synthetic polypeptide
DSEEIRTTNPVATEPYGSVSCTNLSQNNGGNR

SEQ ID NO: 32964 - protein, 29 aa, Artificial Sequence
  Description of Artificial Sequence: Synthetic peptide
DSEEIRTTNPVATEQWGCVTSTLLQRGTQ

SEQ ID NO: 32965 - protein, 31 aa, Artificial Sequence
  Description of Artificial Sequence: Synthetic polypeptide
DSEEIRTTNPVATEQWGISVPSTGELQRGTR

SEQ ID NO: 32966 - protein, 30 aa, Artificial Sequence
  Description of Artificial Sequence: Synthetic polypeptide
DEEEIRATNPVATEQYGSVSDTALGQGENG

SEQ ID NO: 32967 - protein, 31 aa, Artificial Sequence
  Description of Artificial Sequence: Synthetic polypeptide
DSEEIRTTNPVATEQWGSVPSTGLAQRGTTR

SEQ ID NO: 32968 - protein, 32 aa, Artificial Sequence
  Description of Artificial Sequence: Synthetic polypeptide
DSEEIRTTNPVATEQWGSVSCTNLSQRGGPQR

SEQ ID NO: 32969 - protein, 31 aa, Artificial Sequence
  Description of Artificial Sequence: Synthetic polypeptide
DSEEIRTTNPVATEQWGSVTSTDHLQDRGTR

SEQ ID NO: 32970 - protein, 30 aa, Artificial Sequence
  Description of Artificial Sequence: Synthetic polypeptide
DSEEIRTTNPVATEQWGSVTSTLDQDRGTR

SEQ ID NO: 32971 - protein, 29 aa, Artificial Sequence
  Description of Artificial Sequence: Synthetic peptide
DSEEIRTTNPVATEQWGSVTSTLLERGTQ

SEQ ID NO: 32972 - protein, 30 aa, Artificial Sequence
  Description of Artificial Sequence: Synthetic polypeptide
DSEEIRTTNPVATEQWGSVTSTLLQRDTRG

SEQ ID NO: 32973 - protein, 31 aa, Artificial Sequence
  Description of Artificial Sequence: Synthetic polypeptide
DSEEIRTTNPVATEQWGSVVPSTGELQRGSR

SEQ ID NO: 32974 - protein, 32 aa, Artificial Sequence
  Description of Artificial Sequence: Synthetic polypeptide
DSEEIRTTNPVATEQWGSVVSTTLSQRGTTNR

SEQ ID NO: 32975 - protein, 30 aa, Artificial Sequence
  Description of Artificial Sequence: Synthetic polypeptide
DEEEIRTTNPVATEQYGSCSTQLDRSGIEG

SEQ ID NO: 32976 - protein, 33 aa, Artificial Sequence
  Description of Artificial Sequence: Synthetic polypeptide
DSEEIRTTNPVATEQYGQSTVSCTNALQRGGNE

SEQ ID NO: 32977 - protein, 29 aa, Artificial Sequence
  Description of Artificial Sequence: Synthetic peptide
DSEEIATTNPVATAQYGSVSANPDRGNDR

SEQ ID NO: 32978 - protein, 30 aa, Artificial Sequence
  Description of Artificial Sequence: Synthetic polypeptide
DNEEISTTNPVATTQYGSVSTNPGDRGNGR

SEQ ID NO: 32979 - protein, 29 aa, Artificial Sequence
  Description of Artificial Sequence: Synthetic peptide
DSEDIRTTNPVATEQYGCVSTNHQRANNL

SEQ ID NO: 32980 - protein, 28 aa, Artificial Sequence
  Description of Artificial Sequence: Synthetic peptide
DSEDIATTNPVATEQYGCVSTNHQRQNF

SEQ ID NO: 32981 - protein, 28 aa, Artificial Sequence
  Description of Artificial Sequence: Synthetic peptide
DQAEIRTTNPVATEQYGCCSTVEQGGNR

SEQ ID NO: 32982 - protein, 31 aa, Artificial Sequence
  Description of Artificial Sequence: Synthetic polypeptide
DEEEIRATNPVATEQYGSVATNDQRDGNESH

SEQ ID NO: 32983 - protein, 29 aa, Artificial Sequence
  Description of Artificial Sequence: Synthetic peptide
DEEEIRATNPVATEQYGSVATNDTRVNEE

SEQ ID NO: 32984 - protein, 28 aa, Artificial Sequence
  Description of Artificial Sequence: Synthetic peptide
DQAEIRTTNPVATEQYGCCSTVLQEGGR

SEQ ID NO: 32985 - protein, 29 aa, Artificial Sequence
  Description of Artificial Sequence: Synthetic peptide
DEEEIRATNPVATEQYGSVATNLDRNPPP

SEQ ID NO: 32986 - protein, 28 aa, Artificial Sequence
  Description of Artificial Sequence: Synthetic peptide
DQAEIRTTNPVATEQYGCCSTVLQPENR

SEQ ID NO: 32987 - protein, 28 aa, Artificial Sequence
  Description of Artificial Sequence: Synthetic peptide
DQAEIRTTNPVATEQYGCCSTYLQHGER

SEQ ID NO: 32988 - protein, 28 aa, Artificial Sequence
  Description of Artificial Sequence: Synthetic peptide
DQAEIRTTNPVATEQYGCCSTYLQHGNF

SEQ ID NO: 32989 - protein, 29 aa, Artificial Sequence
  Description of Artificial Sequence: Synthetic peptide
DQAEIRTTNPVATEQYGCCSTPLQEHGNR

SEQ ID NO: 32990 - protein, 28 aa, Artificial Sequence
  Description of Artificial Sequence: Synthetic peptide
DEEEIRATNPVATEQYGSVATNLEMPEQ

SEQ ID NO: 32991 - protein, 30 aa, Artificial Sequence
  Description of Artificial Sequence: Synthetic polypeptide
DEEEIRATNPVATEQYGSVATNLERDPNEM

SEQ ID NO: 32992 - protein, 29 aa, Artificial Sequence
  Description of Artificial Sequence: Synthetic peptide
DQAEIRTTNPVATEQYGCYSTVLQHGNDR

SEQ ID NO: 32993 - protein, 28 aa, Artificial Sequence
  Description of Artificial Sequence: Synthetic peptide
DQAEIRTTNPVATEQYGKCSTVHQHGNR

SEQ ID NO: 32994 - protein, 29 aa, Artificial Sequence
  Description of Artificial Sequence: Synthetic peptide
DQAEIRTTNPVATEQYGSCCSSVLQHGNR

SEQ ID NO: 32995 - protein, 29 aa, Artificial Sequence
  Description of Artificial Sequence: Synthetic peptide
DEEEIRATNPVATEQYGSVATNLERPEGA

SEQ ID NO: 32996 - protein, 32 aa, Artificial Sequence
  Description of Artificial Sequence: Synthetic polypeptide
DEEEIRATNPVATEQYGSVATNLERPGENPRY

SEQ ID NO: 32997 - protein, 29 aa, Artificial Sequence
  Description of Artificial Sequence: Synthetic peptide
DQAEIRTTNPVATEQYGTCSTVLQHGNRT

SEQ ID NO: 32998 - protein, 28 aa, Artificial Sequence
  Description of Artificial Sequence: Synthetic peptide
DQAEIRTTNPVAYEQYGQCSTVLQHGNR

SEQ ID NO: 32999 - protein, 31 aa, Artificial Sequence
  Description of Artificial Sequence: Synthetic polypeptide
DEEEIRATNPVATEQYGSVATNLERDENDRQ

SEQ ID NO: 33000 - protein, 31 aa, Artificial Sequence
  Description of Artificial Sequence: Synthetic polypeptide
DEEEIRATNPVATEQYGSVATNLQAGPNEEQ

SEQ ID NO: 33001 - protein, 28 aa, Artificial Sequence
  Description of Artificial Sequence: Synthetic peptide
DQAEIRTTNPVATEQYGCCSTGLQHGNH

SEQ ID NO: 33002 - protein, 29 aa, Artificial Sequence
  Description of Artificial Sequence: Synthetic peptide
DQAEIRTTNPVATEQYGCCSTELQHGNTR

SEQ ID NO: 33003 - protein, 32 aa, Artificial Sequence
  Description of Artificial Sequence: Synthetic polypeptide
DEEEIRTTNPVATEQYGSFVSCTNGGQRGVKF

SEQ ID NO: 33004 - protein, 29 aa, Artificial Sequence
  Description of Artificial Sequence: Synthetic peptide
DNEEISTTNPVATTQYGSVSTNPMLGNQR

SEQ ID NO: 33005 - protein, 28 aa, Artificial Sequence
  Description of Artificial Sequence: Synthetic peptide
DNEEISTTNPVATTQYGSVSTNPMREND

SEQ ID NO: 33006 - protein, 28 aa, Artificial Sequence
  Description of Artificial Sequence: Synthetic peptide
DNEEISTTNPVATTQYGSVSTNPMRGQE

SEQ ID NO: 33007 - protein, 29 aa, Artificial Sequence
  Description of Artificial Sequence: Synthetic peptide
DNEEISTTNPVATTQYGSVSTNPMRSNDR

SEQ ID NO: 33008 - protein, 30 aa, Artificial Sequence
  Description of Artificial Sequence: Synthetic polypeptide
DNEEISTTNPVATTQYGSVSTPNPVVRGNR

SEQ ID NO: 33009 - protein, 29 aa, Artificial Sequence
  Description of Artificial Sequence: Synthetic peptide
DNEEISTTNPVATWQYGSVSTNIVRGENF

SEQ ID NO: 33010 - protein, 30 aa, Artificial Sequence
  Description of Artificial Sequence: Synthetic polypeptide
DNEEISTTNPVATWQYGSVSTPNQMRGNRQ

SEQ ID NO: 33011 - protein, 28 aa, Artificial Sequence
  Description of Artificial Sequence: Synthetic peptide
DQAEIRTTNPVATEQYGCCSTELQHGVR

SEQ ID NO: 33012 - protein, 29 aa, Artificial Sequence
  Description of Artificial Sequence: Synthetic peptide
DNETIRTTNPVATEQYGAVSTNHQVRNNQ

SEQ ID NO: 33013 - protein, 28 aa, Artificial Sequence
  Description of Artificial Sequence: Synthetic peptide
DQAEIRTTNPVATEQWGCCSTGLQHGNR

SEQ ID NO: 33014 - protein, 28 aa, Artificial Sequence
  Description of Artificial Sequence: Synthetic peptide
DQAEIRTTNPVATEQYGCCATTLQHGNR

SEQ ID NO: 33015 - protein, 29 aa, Artificial Sequence
  Description of Artificial Sequence: Synthetic peptide
DQAEIRTTNPVATEQYGCCGSTVLQNGNR

SEQ ID NO: 33016 - protein, 29 aa, Artificial Sequence
  Description of Artificial Sequence: Synthetic peptide
DQAEIRTTNPVATEQYGCCSCTSLQHGNR

SEQ ID NO: 33017 - protein, 28 aa, Artificial Sequence
  Description of Artificial Sequence: Synthetic peptide
DQAEIRTTNPVATEQYGCCSEVLQTGNR

SEQ ID NO: 33018 - protein, 29 aa, Artificial Sequence
  Description of Artificial Sequence: Synthetic peptide
DQAEIRTTNPVATEQYGCCSNTALQHGNR

SEQ ID NO: 33019 - protein, 29 aa, Artificial Sequence
  Description of Artificial Sequence: Synthetic peptide
DQAEIRTTNPVATEQYGCCSPTVLQTGNR

SEQ ID NO: 33020 - protein, 29 aa, Artificial Sequence
  Description of Artificial Sequence: Synthetic peptide
DQAEIRTTNPVATEQYGCCSTDLQHGNRM

SEQ ID NO: 33021 - protein, 32 aa, Artificial Sequence
  Description of Artificial Sequence: Synthetic polypeptide
DEEEIRATNPVATEQYGSTSMTENLEARDGNR

SEQ ID NO: 33022 - protein, 28 aa, Artificial Sequence
  Description of Artificial Sequence: Synthetic peptide
DQDEIATTNPVATEQYGCCSTVLQHGNR

SEQ ID NO: 33023 - protein, 29 aa, Artificial Sequence
  Description of Artificial Sequence: Synthetic peptide
DQDEIRTTNPVATEQYGCCTSTVLQHGNR

SEQ ID NO: 33024 - protein, 30 aa, Artificial Sequence
  Description of Artificial Sequence: Synthetic polypeptide
DQEEIATTNPVATHQYGSVSTNGMQNGNER

SEQ ID NO: 33025 - protein, 30 aa, Artificial Sequence
  Description of Artificial Sequence: Synthetic polypeptide
DQEEIRTTNPVATHQYGSVSTNGEQNGNHD

SEQ ID NO: 33026 - protein, 30 aa, Artificial Sequence
  Description of Artificial Sequence: Synthetic polypeptide
DQEEIRTTNPVATHQYGSVSTNGQQNGNHV

SEQ ID NO: 33027 - protein, 31 aa, Artificial Sequence
  Description of Artificial Sequence: Synthetic polypeptide
DQEEIRTTNPVATHQYGSVSTNGVQDQGNHR

SEQ ID NO: 33028 - protein, 30 aa, Artificial Sequence
  Description of Artificial Sequence: Synthetic polypeptide
DQEEIRTTNPVATHQYGSVSTNGVQNENNR

SEQ ID NO: 33029 - protein, 30 aa, Artificial Sequence
  Description of Artificial Sequence: Synthetic polypeptide
DQEEIRTTNPVATHQYGSVSTNGVQNGDGR

SEQ ID NO: 33030 - protein, 31 aa, Artificial Sequence
  Description of Artificial Sequence: Synthetic polypeptide
DQEEIRTTNPVATHQYGSVSTNGVQNGNDRL

SEQ ID NO: 33031 - protein, 30 aa, Artificial Sequence
  Description of Artificial Sequence: Synthetic polypeptide
DQEEIRTTNPVATHQYGSVSTNGVQNGNDT

SEQ ID NO: 33032 - protein, 30 aa, Artificial Sequence
  Description of Artificial Sequence: Synthetic polypeptide
DQEEIRTTNPVATHQYGSVSTNGVQQGNHE

SEQ ID NO: 33033 - protein, 30 aa, Artificial Sequence
  Description of Artificial Sequence: Synthetic polypeptide
DQEEIRTTNPVATHQYGSVSTNGDQNGNPA

SEQ ID NO: 33034 - protein, 31 aa, Artificial Sequence
  Description of Artificial Sequence: Synthetic polypeptide
DQEEIRTTNPVATSQYGSVSTNGVQNGNHRD

SEQ ID NO: 33035 - protein, 28 aa, Artificial Sequence
  Description of Artificial Sequence: Synthetic peptide
DQEEISTTNPVATCQYGSVSTNPIRGDQ

SEQ ID NO: 33036 - protein, 28 aa, Artificial Sequence
  Description of Artificial Sequence: Synthetic peptide
DQSEIKTTNPVATEQYGCCSTVLQHGNR

SEQ ID NO: 33037 - protein, 32 aa, Artificial Sequence
  Description of Artificial Sequence: Synthetic polypeptide
DEEEIRTTNPVATEQYGSCYSTNLQLGEGENE

SEQ ID NO: 33038 - protein, 28 aa, Artificial Sequence
  Description of Artificial Sequence: Synthetic peptide
DSAEIRTTNPVATEQYGCCSTVLQHGNE

SEQ ID NO: 33039 - protein, 30 aa, Artificial Sequence
  Description of Artificial Sequence: Synthetic polypeptide
DEEEIRTTNPVATEQYGSCWTNLQTEENDQ

SEQ ID NO: 33040 - protein, 29 aa, Artificial Sequence
  Description of Artificial Sequence: Synthetic peptide
DSDEIRTTNPVGTEQWGMVSTENLQRGER

SEQ ID NO: 33041 - protein, 29 aa, Artificial Sequence
  Description of Artificial Sequence: Synthetic peptide
DSECIRTTNPVATEQYGKVSTNHQRVTNG

SEQ ID NO: 33042 - protein, 28 aa, Artificial Sequence
  Description of Artificial Sequence: Synthetic peptide
DSEDIATTNPVATEQYGCVSTNEQRVNQ

SEQ ID NO: 33043 - protein, 30 aa, Artificial Sequence
  Description of Artificial Sequence: Synthetic polypeptide
DQEEIRTTNPVATWQYGSVSTNGEQNGNVQ

SEQ ID NO: 33044 - protein, 31 aa, Artificial Sequence
  Description of Artificial Sequence: Synthetic polypeptide
DQEEIRTTNPVATHQYGSVSTNEVQSGGNNR

SEQ ID NO: 33045 - protein, 31 aa, Artificial Sequence
  Description of Artificial Sequence: Synthetic polypeptide
DQEEIRTTNPVATHQYGSVSTNEVPQNGNNR

SEQ ID NO: 33046 - protein, 30 aa, Artificial Sequence
  Description of Artificial Sequence: Synthetic polypeptide
DQEEIRTTNPVATHQYGSVSTEGVQNGNVR

SEQ ID NO: 33047 - protein, 30 aa, Artificial Sequence
  Description of Artificial Sequence: Synthetic polypeptide
DEEEIRATNPVATEQYGSVATNLQEAENGQ

SEQ ID NO: 33048 - protein, 31 aa, Artificial Sequence
  Description of Artificial Sequence: Synthetic polypeptide
DEEEIRATNPVATEQYGSVATNLQEAGNVED

SEQ ID NO: 33049 - protein, 30 aa, Artificial Sequence
  Description of Artificial Sequence: Synthetic polypeptide
DQEEIRCTNPVATEQYGCVSTNLQARSGQQ

SEQ ID NO: 33050 - protein, 30 aa, Artificial Sequence
  Description of Artificial Sequence: Synthetic polypeptide
DQEEIRSTNPVATEQYGSVSTNLQENSGQQ

SEQ ID NO: 33051 - protein, 31 aa, Artificial Sequence
  Description of Artificial Sequence: Synthetic polypeptide
DQEEIRSTNPVAYEQYGSVSTNALQARTGQR

SEQ ID NO: 33052 - protein, 31 aa, Artificial Sequence
  Description of Artificial Sequence: Synthetic polypeptide
DEEEIRATNPVATEQYGSVATNLQERNSNEG

SEQ ID NO: 33053 - protein, 30 aa, Artificial Sequence
  Description of Artificial Sequence: Synthetic polypeptide
DEEEIRATNPVATEQYGSVATNLQERSDEG

SEQ ID NO: 33054 - protein, 31 aa, Artificial Sequence
  Description of Artificial Sequence: Synthetic polypeptide
DQEEIRTTNPVATDQYGSVSTDNGEQNGNVR

SEQ ID NO: 33055 - protein, 31 aa, Artificial Sequence
  Description of Artificial Sequence: Synthetic polypeptide
DEEEIRATNPVATEQYGSVATNLQGNAEERY

SEQ ID NO: 33056 - protein, 30 aa, Artificial Sequence
  Description of Artificial Sequence: Synthetic polypeptide
DEEEIRATNPVATEQYGSVATNLQNGEDAV

SEQ ID NO: 33057 - protein, 30 aa, Artificial Sequence
  Description of Artificial Sequence: Synthetic polypeptide
DQEEIRTTNPVATDQYGSVSTNGVANGNQR

SEQ ID NO: 33058 - protein, 30 aa, Artificial Sequence
  Description of Artificial Sequence: Synthetic polypeptide
DEEEIRATNPVATEQYGSVATNLQREPDEA

SEQ ID NO: 33059 - protein, 30 aa, Artificial Sequence
  Description of Artificial Sequence: Synthetic polypeptide
DEEEIRATNPVATEQYGSVATPNLDDGNEH

SEQ ID NO: 33060 - protein, 31 aa, Artificial Sequence
  Description of Artificial Sequence: Synthetic polypeptide
DEEEIRATNPVATEQYGSVATPNLDQRQEND

SEQ ID NO: 33061 - protein, 31 aa, Artificial Sequence
  Description of Artificial Sequence: Synthetic polypeptide
DQEEIRTTNPVATEQYGSVCSTELQNGSNQS

SEQ ID NO: 33062 - protein, 32 aa, Artificial Sequence
  Description of Artificial Sequence: Synthetic polypeptide
DQEEIRTTNPVATEQYGSVCSTENLQNGSNQE

SEQ ID NO: 33063 - protein, 30 aa, Artificial Sequence
  Description of Artificial Sequence: Synthetic polypeptide
DEEEIRATNPVATEQYGSVATPNLTGGNDE

SEQ ID NO: 33064 - protein, 30 aa, Artificial Sequence
  Description of Artificial Sequence: Synthetic polypeptide
DQEEIRTTNPVATHQYGKVSTNEVQNGNYR

SEQ ID NO: 33065 - protein, 31 aa, Artificial Sequence
  Description of Artificial Sequence: Synthetic polypeptide
DQEEIRTTNPVATHQYGSVSCTNEHQNGNYR

SEQ ID NO: 33066 - protein, 28 aa, Artificial Sequence
  Description of Artificial Sequence: Synthetic peptide
DSEDIATTNPVATEQYGEVSTNDQRVNL

SEQ ID NO: 33067 - protein, 30 aa, Artificial Sequence
  Description of Artificial Sequence: Synthetic polypeptide
FEEEIRTTNPVATEFYGSVSTNNQQVGNDE

SEQ ID NO: 33068 - protein, 31 aa, Artificial Sequence
  Description of Artificial Sequence: Synthetic polypeptide
FEEEIRTTNPVATEGYGSVSTNLQGGGNGND

SEQ ID NO: 33069 - protein, 33 aa, Artificial Sequence
  Description of Artificial Sequence: Synthetic polypeptide
FEEEIRTTNPVATEQYGCVSTENLNQRFGSNYR

SEQ ID NO: 33070 - protein, 32 aa, Artificial Sequence
  Description of Artificial Sequence: Synthetic polypeptide
DEEEIRTTNPVATEQYGNVISTNLQGGGNGGQ

SEQ ID NO: 33071 - protein, 31 aa, Artificial Sequence
  Description of Artificial Sequence: Synthetic polypeptide
NEEEIRTTNPVATEQYGSVSTTNNLQPNSER

SEQ ID NO: 33072 - protein, 30 aa, Artificial Sequence
  Description of Artificial Sequence: Synthetic polypeptide
NEEEIRTTNPVATEQYGSVSVDNLDEFQNR

SEQ ID NO: 33073 - protein, 30 aa, Artificial Sequence
  Description of Artificial Sequence: Synthetic polypeptide
NEEEIRTTNPVATEQYGSVSWINLPEFGNV

SEQ ID NO: 33074 - protein, 32 aa, Artificial Sequence
  Description of Artificial Sequence: Synthetic polypeptide
DEEEIRTTNPVATEQYGNTIATNPLQPRDGNR

SEQ ID NO: 33075 - protein, 28 aa, Artificial Sequence
  Description of Artificial Sequence: Synthetic peptide
NEEEIRTTNPVATEQYGSWSTIQQNQGR

SEQ ID NO: 33076 - protein, 29 aa, Artificial Sequence
  Description of Artificial Sequence: Synthetic peptide
NEEEIRTTNPVATEQYGSYSTEHLQGQGR

SEQ ID NO: 33077 - protein, 29 aa, Artificial Sequence
  Description of Artificial Sequence: Synthetic peptide
NEEEIRTTNPVATEQYGSYSTEPQRQSGR

SEQ ID NO: 33078 - protein, 32 aa, Artificial Sequence
  Description of Artificial Sequence: Synthetic polypeptide
DEEEIRTTNPVATEQYGNVNSGNLQRGNNNEG

SEQ ID NO: 33079 - protein, 29 aa, Artificial Sequence
  Description of Artificial Sequence: Synthetic peptide
NEEEIRTTNPVATKQYGSVATNDIQRGED

SEQ ID NO: 33080 - protein, 28 aa, Artificial Sequence
  Description of Artificial Sequence: Synthetic peptide
NEEEIRTTNPVAYEAYGSCSTHLQRVGR

SEQ ID NO: 33081 - protein, 29 aa, Artificial Sequence
  Description of Artificial Sequence: Synthetic peptide
DEEEIRSTNPVATEQYGNVSTSNLNNANT

SEQ ID NO: 33082 - protein, 29 aa, Artificial Sequence
  Description of Artificial Sequence: Synthetic peptide
NEEEIRTTNPVGTEQYGSVSNMNMERGNC

SEQ ID NO: 33083 - protein, 32 aa, Artificial Sequence
  Description of Artificial Sequence: Synthetic polypeptide
NEEEVRTTNPVATEQYGSVCSTGNHDQRIGNR

SEQ ID NO: 33084 - protein, 30 aa, Artificial Sequence
  Description of Artificial Sequence: Synthetic polypeptide
NEGEIRTTNPVATEQYGSVEDTNLQIGSQR

SEQ ID NO: 33085 - protein, 29 aa, Artificial Sequence
  Description of Artificial Sequence: Synthetic peptide
NEGEIRTTNPVATEQYGSVWTNLEIGSLR

SEQ ID NO: 33086 - protein, 30 aa, Artificial Sequence
  Description of Artificial Sequence: Synthetic polypeptide
DEEEIRSTNPVATEQYGSVAVNIDRGSNSR

SEQ ID NO: 33087 - protein, 29 aa, Artificial Sequence
  Description of Artificial Sequence: Synthetic peptide
DEEEIRTTNPVATEQYGMVSTQTNQFTNN

SEQ ID NO: 33088 - protein, 31 aa, Artificial Sequence
  Description of Artificial Sequence: Synthetic polypeptide
NEEEIRTTNPVATLQYGSVSTNVITQRGNDI

SEQ ID NO: 33089 - protein, 29 aa, Artificial Sequence
  Description of Artificial Sequence: Synthetic peptide
NEQEIRTTNPVATEQYGSVWTNLQIGSFE

SEQ ID NO: 33090 - protein, 32 aa, Artificial Sequence
  Description of Artificial Sequence: Synthetic polypeptide
DEEEIRTTNPVATEQYGNVSGTNLQMNGGNNA

SEQ ID NO: 33091 - protein, 32 aa, Artificial Sequence
  Description of Artificial Sequence: Synthetic polypeptide
NEEEIRTTNPVATEQYGSVSPTNLEQRDNNDQ

SEQ ID NO: 33092 - protein, 30 aa, Artificial Sequence
  Description of Artificial Sequence: Synthetic polypeptide
NEEEIRTTNPVATEQYGSVSAQNQDEFGNR

SEQ ID NO: 33093 - protein, 30 aa, Artificial Sequence
  Description of Artificial Sequence: Synthetic polypeptide
NEEEIRTTNPVATEQYGSVSAWNGDEPGNR

SEQ ID NO: 33094 - protein, 31 aa, Artificial Sequence
  Description of Artificial Sequence: Synthetic polypeptide
NEEEIRTTNPVATEQYGSVSAWNGLDGMGNR

SEQ ID NO: 33095 - protein, 32 aa, Artificial Sequence
  Description of Artificial Sequence: Synthetic polypeptide
DEEEIRTTNPVATEQYGNVSTNLQAQGGNGNA

SEQ ID NO: 33096 - protein, 31 aa, Artificial Sequence
  Description of Artificial Sequence: Synthetic polypeptide
DEEEIRTTNPVATEQYGNVSTNLDQEMGDII

SEQ ID NO: 33097 - protein, 31 aa, Artificial Sequence
  Description of Artificial Sequence: Synthetic polypeptide
NEEEIRTTNPVATEQYGSVSAWNLEEFGMNR

SEQ ID NO: 33098 - protein, 31 aa, Artificial Sequence
  Description of Artificial Sequence: Synthetic polypeptide
NEEEIRTTNPVATEQYGSVSAYNLDEFGNVR

SEQ ID NO: 33099 - protein, 31 aa, Artificial Sequence
  Description of Artificial Sequence: Synthetic polypeptide
NEEEIRTTNPVATEQYGSVSDWNLDEFGNRG

SEQ ID NO: 33100 - protein, 30 aa, Artificial Sequence
  Description of Artificial Sequence: Synthetic polypeptide
NEEEIRTTNPVATEQYGSVSPWNLDEFGNH

SEQ ID NO: 33101 - protein, 31 aa, Artificial Sequence
  Description of Artificial Sequence: Synthetic polypeptide
NEEEIRTTNPVATEQYGSVSLWNLDEFGDNR

SEQ ID NO: 33102 - protein, 31 aa, Artificial Sequence
  Description of Artificial Sequence: Synthetic polypeptide
NEEEIRTTNPVATEQYGSVSNAWNLTEFGNR

SEQ ID NO: 33103 - protein, 30 aa, Artificial Sequence
  Description of Artificial Sequence: Synthetic polypeptide
NEEEIRTTNPVATEQYGSVSNGNLDEFGNG

SEQ ID NO: 33104 - protein, 30 aa, Artificial Sequence
  Description of Artificial Sequence: Synthetic polypeptide
NEEEIRTTNPVATEQYGSVSNWNNDEFGNR

SEQ ID NO: 33105 - protein, 31 aa, Artificial Sequence
  Description of Artificial Sequence: Synthetic polypeptide
NEEEIRTTNPVATEQYGSVSPDNLDEFGNNR

SEQ ID NO: 33106 - protein, 30 aa, Artificial Sequence
  Description of Artificial Sequence: Synthetic polypeptide
NEEEIRTTNPVATEQYGSVSPMNLVEFGNV

SEQ ID NO: 33107 - protein, 32 aa, Artificial Sequence
  Description of Artificial Sequence: Synthetic polypeptide
DEEEIRTTNPVATEQYGNVSSTGNLQQGGNNA

SEQ ID NO: 33108 - protein, 32 aa, Artificial Sequence
  Description of Artificial Sequence: Synthetic polypeptide
DEEEIRTTNPVATEQYGNVSITNVQRGGSERA

SEQ ID NO: 33109 - protein, 30 aa, Artificial Sequence
  Description of Artificial Sequence: Synthetic polypeptide
NEEEIRTTNPVATEQYGSVSPTNHVMRENN

SEQ ID NO: 33110 - protein, 31 aa, Artificial Sequence
  Description of Artificial Sequence: Synthetic polypeptide
NEEEIRTTNPVATEQYGSVSMAGNLDEFGNR

SEQ ID NO: 33111 - protein, 30 aa, Artificial Sequence
  Description of Artificial Sequence: Synthetic polypeptide
NEQEIRTTNPVATEQYGSVWTYNLQIGSQR

SEQ ID NO: 33112 - protein, 32 aa, Artificial Sequence
  Description of Artificial Sequence: Synthetic polypeptide
DEEEIRTTNPVATEQYGMVSTNNLQQGGGNIG

SEQ ID NO: 33113 - protein, 32 aa, Artificial Sequence
  Description of Artificial Sequence: Synthetic polypeptide
DEEEIRTTNPVATEQYGMVSTNNLQENGGNIN

SEQ ID NO: 33114 - protein, 32 aa, Artificial Sequence
  Description of Artificial Sequence: Synthetic polypeptide
DEEEIRSTNPVATEQYGSVSTNLQEGTGGNEN

SEQ ID NO: 33115 - protein, 30 aa, Artificial Sequence
  Description of Artificial Sequence: Synthetic polypeptide
NETEIRTTNPVATEEYGSVSTNLQGNEGNA

SEQ ID NO: 33116 - protein, 31 aa, Artificial Sequence
  Description of Artificial Sequence: Synthetic polypeptide
DEEEIRTTNPVATEQYGMVSTDNVTQGGNID

SEQ ID NO: 33117 - protein, 29 aa, Artificial Sequence
  Description of Artificial Sequence: Synthetic peptide
NETEIRTTNPVATEMWGSVSTNLQGGNDE

SEQ ID NO: 33118 - protein, 31 aa, Artificial Sequence
  Description of Artificial Sequence: Synthetic polypeptide
DEEEIRTTNPVATEQYGMVSTDNTQENGNGD

SEQ ID NO: 33119 - protein, 31 aa, Artificial Sequence
  Description of Artificial Sequence: Synthetic polypeptide
DEEEIRTTNPVATEQYGMVSTDNQTQNGNED

SEQ ID NO: 33120 - protein, 32 aa, Artificial Sequence
  Description of Artificial Sequence: Synthetic polypeptide
DEEEIRTTNPVATEQYGMVSTDNLIQGGGNED

SEQ ID NO: 33121 - protein, 32 aa, Artificial Sequence
  Description of Artificial Sequence: Synthetic polypeptide
AEEEIRTTNPVATEQYGSVVVTTNLQQGTGNR

SEQ ID NO: 33122 - protein, 30 aa, Artificial Sequence
  Description of Artificial Sequence: Synthetic polypeptide
NETEIRTTNPVATECYGSVSTNLQGDGNTD

SEQ ID NO: 33123 - protein, 31 aa, Artificial Sequence
  Description of Artificial Sequence: Synthetic polypeptide
AEEEIRTTNPVATEQYGSVVVTTNLQQGQNT

SEQ ID NO: 33124 - protein, 31 aa, Artificial Sequence
  Description of Artificial Sequence: Synthetic polypeptide
NETEIRTTNPVATEQYGSVSTNMQGEGDNDR

SEQ ID NO: 33125 - protein, 32 aa, Artificial Sequence
  Description of Artificial Sequence: Synthetic polypeptide
DEEEIRTTNPVATEQYGMVGSTNLVQGQGNND

SEQ ID NO: 33126 - protein, 31 aa, Artificial Sequence
  Description of Artificial Sequence: Synthetic polypeptide
DEEEIRTTNPVATEQYGMVGSTNLQMGGEFE

SEQ ID NO: 33127 - protein, 31 aa, Artificial Sequence
  Description of Artificial Sequence: Synthetic polypeptide
NETEIRTTNPVATEWYGSVSTNLQHNGDNDR

SEQ ID NO: 33128 - protein, 31 aa, Artificial Sequence
  Description of Artificial Sequence: Synthetic polypeptide
DEEEIRTTNPVATEQYGMVGSTNLQFNGEGT

SEQ ID NO: 33129 - protein, 30 aa, Artificial Sequence
  Description of Artificial Sequence: Synthetic polypeptide
NMEEIRTTNPVATEQYGVVSTGNLQDGPNN

SEQ ID NO: 33130 - protein, 30 aa, Artificial Sequence
  Description of Artificial Sequence: Synthetic polypeptide
NMEEIRTTNPVATEQYGVVSTNLQDDNPNR

SEQ ID NO: 33131 - protein, 32 aa, Artificial Sequence
  Description of Artificial Sequence: Synthetic polypeptide
DEEEIRTTNPVATEQYGMVGSTNLNQVGGNIG

SEQ ID NO: 33132 - protein, 30 aa, Artificial Sequence
  Description of Artificial Sequence: Synthetic polypeptide
NETEIRTTNPVATEMYGSVSTNLQGEGDND

SEQ ID NO: 33133 - protein, 30 aa, Artificial Sequence
  Description of Artificial Sequence: Synthetic polypeptide
NETEIRTTNPVATECYGSVSTNLQGDEGND

SEQ ID NO: 33134 - protein, 31 aa, Artificial Sequence
  Description of Artificial Sequence: Synthetic polypeptide
DEEEIRSTNPVATEQYGSVSTNAQQDNIGNF

SEQ ID NO: 33135 - protein, 32 aa, Artificial Sequence
  Description of Artificial Sequence: Synthetic polypeptide
DEEEIRTTNPVATEQYGMVSTNLDQEIGNGEE

SEQ ID NO: 33136 - protein, 32 aa, Artificial Sequence
  Description of Artificial Sequence: Synthetic polypeptide
DEEEIRTTNPVATEQYGMVSTNNLQEGGGNQG

SEQ ID NO: 33137 - protein, 32 aa, Artificial Sequence
  Description of Artificial Sequence: Synthetic polypeptide
DEEEIRTTNPVATEQYGMVSTNNLNQNIGNEG

SEQ ID NO: 33138 - protein, 29 aa, Artificial Sequence
  Description of Artificial Sequence: Synthetic peptide
NEREIRTTNPVATEQYGSVCWTNLQNGQL

SEQ ID NO: 33139 - protein, 29 aa, Artificial Sequence
  Description of Artificial Sequence: Synthetic peptide
NEREIRTTNPVATEQYGSVFTNLQIGQQA

SEQ ID NO: 33140 - protein, 29 aa, Artificial Sequence
  Description of Artificial Sequence: Synthetic peptide
NEREIRTTNPVATEQYGSVGTENLQIGDA

SEQ ID NO: 33141 - protein, 30 aa, Artificial Sequence
  Description of Artificial Sequence: Synthetic polypeptide
NEREIRTTNPVATEQYGSVQTNLQPIEGSR

SEQ ID NO: 33142 - protein, 30 aa, Artificial Sequence
  Description of Artificial Sequence: Synthetic polypeptide
NEREIRTTNPVATEQYGSVVTNLQPIGQSR

SEQ ID NO: 33143 - protein, 30 aa, Artificial Sequence
  Description of Artificial Sequence: Synthetic polypeptide
NEREIRTTNPVATEQYGSVWNTNLQIGSQR

SEQ ID NO: 33144 - protein, 32 aa, Artificial Sequence
  Description of Artificial Sequence: Synthetic polypeptide
DEEEIRTTNPVATEQYGMVSTNLVQQGGNGGD

SEQ ID NO: 33145 - protein, 29 aa, Artificial Sequence
  Description of Artificial Sequence: Synthetic peptide
NEREIRTTNPVATEQYGSVWTNLIQIGSQ

SEQ ID NO: 33146 - protein, 30 aa, Artificial Sequence
  Description of Artificial Sequence: Synthetic polypeptide
NESEIATTNPVATEQYGSVSWTDNLQTGSR

SEQ ID NO: 33147 - protein, 32 aa, Artificial Sequence
  Description of Artificial Sequence: Synthetic polypeptide
DEEEIRTTNPVATEQYGMVSTNLQTDGGNINS

SEQ ID NO: 33148 - protein, 30 aa, Artificial Sequence
  Description of Artificial Sequence: Synthetic polypeptide
NESEIRTTNPVATEQYGSVTTNLQIGDSER

SEQ ID NO: 33149 - protein, 28 aa, Artificial Sequence
  Description of Artificial Sequence: Synthetic peptide
NESEIRTTNPVATEQYGSVWTDIQDGSR

SEQ ID NO: 33150 - protein, 29 aa, Artificial Sequence
  Description of Artificial Sequence: Synthetic peptide
NESEIRTTNPVATEQYGSVWTNDQDGQSR

SEQ ID NO: 33151 - protein, 30 aa, Artificial Sequence
  Description of Artificial Sequence: Synthetic polypeptide
NESEIRTTNPVATEQYGSVWTNLSQMGTSR

SEQ ID NO: 33152 - protein, 29 aa, Artificial Sequence
  Description of Artificial Sequence: Synthetic peptide
NESEIRTTNPVAYEQYGSVATNLDQIGSR

SEQ ID NO: 33153 - protein, 28 aa, Artificial Sequence
  Description of Artificial Sequence: Synthetic peptide
NESEIRTTNPVAYEQYGSVATNLQSGSV

SEQ ID NO: 33154 - protein, 30 aa, Artificial Sequence
  Description of Artificial Sequence: Synthetic polypeptide
DEEEIRSTNPVATEQYGSVSTDDQQGTGNT

SEQ ID NO: 33155 - protein, 31 aa, Artificial Sequence
  Description of Artificial Sequence: Synthetic polypeptide
NEEEIRTTNPVATEQYGSVSAPNLSDEFGNR

SEQ ID NO: 33156 - protein, 30 aa, Artificial Sequence
  Description of Artificial Sequence: Synthetic polypeptide
NNEEIGTTNPVATEQYGYVVSTNLQDGLNR

SEQ ID NO: 33157 - protein, 31 aa, Artificial Sequence
  Description of Artificial Sequence: Synthetic polypeptide
NEEEIRTTNPVATEQYGSVSANNLDEFGNER

SEQ ID NO: 33158 - protein, 32 aa, Artificial Sequence
  Description of Artificial Sequence: Synthetic polypeptide
DEEEIRTTNPVATEQYGNVSTNLQQGGGNQNA

SEQ ID NO: 33159 - protein, 29 aa, Artificial Sequence
  Description of Artificial Sequence: Synthetic peptide
NEEEIATTNPVATESYGSVATNLQGGNDQ

SEQ ID NO: 33160 - protein, 29 aa, Artificial Sequence
  Description of Artificial Sequence: Synthetic peptide
NEEEIATTNPVAYEQYGSVAATNLQNGNL

SEQ ID NO: 33161 - protein, 29 aa, Artificial Sequence
  Description of Artificial Sequence: Synthetic peptide
NEEEIATTNPVAYEQYGSVATNLQAPPNR

SEQ ID NO: 33162 - protein, 29 aa, Artificial Sequence
  Description of Artificial Sequence: Synthetic peptide
NEEEIATTNPVAYEQYGSVATNLQDGNNS

SEQ ID NO: 33163 - protein, 29 aa, Artificial Sequence
  Description of Artificial Sequence: Synthetic peptide
NEEEIATTNPVAYEQYGSVATNLQNDGNS

SEQ ID NO: 33164 - protein, 29 aa, Artificial Sequence
  Description of Artificial Sequence: Synthetic peptide
NEEEIATTNPVAYEQYGSVATNLQNGMNV

SEQ ID NO: 33165 - protein, 29 aa, Artificial Sequence
  Description of Artificial Sequence: Synthetic peptide
NEEEIATTNPVAYEQYGSVATNLQNGNSN

SEQ ID NO: 33166 - protein, 28 aa, Artificial Sequence
  Description of Artificial Sequence: Synthetic peptide
NEEEIATTNPVAYEQYGSVATNLQNGQE

SEQ ID NO: 33167 - protein, 30 aa, Artificial Sequence
  Description of Artificial Sequence: Synthetic polypeptide
NEEEIATTNPVATEQYGSVSSTLNNQDGNA

SEQ ID NO: 33168 - protein, 29 aa, Artificial Sequence
  Description of Artificial Sequence: Synthetic peptide
NEEEIATTNPVAYEQYGSVATNLQQGDRN

SEQ ID NO: 33169 - protein, 32 aa, Artificial Sequence
  Description of Artificial Sequence: Synthetic polypeptide
DEEEIRTTNPVATEQYGQCVCSNSNLQRGSNA

SEQ ID NO: 33170 - protein, 32 aa, Artificial Sequence
  Description of Artificial Sequence: Synthetic polypeptide
DEEEIRTTNPVATEQYGQCVCSMTNDQGGSNR

SEQ ID NO: 33171 - protein, 30 aa, Artificial Sequence
  Description of Artificial Sequence: Synthetic polypeptide
NEEEICTTNPTATEQYGSVPTNLQHDGNGR

SEQ ID NO: 33172 - protein, 30 aa, Artificial Sequence
  Description of Artificial Sequence: Synthetic polypeptide
NEEEIRATNPVATEQYGSVATNLQEAGNEN

SEQ ID NO: 33173 - protein, 33 aa, Artificial Sequence
  Description of Artificial Sequence: Synthetic polypeptide
DEEEIRTTNPVATEQYGQCICSTNLQERFGSNR

SEQ ID NO: 33174 - protein, 30 aa, Artificial Sequence
  Description of Artificial Sequence: Synthetic polypeptide
DEEEIRPTNPVATEAYGSVSVNQDRGGNTR

SEQ ID NO: 33175 - protein, 29 aa, Artificial Sequence
  Description of Artificial Sequence: Synthetic peptide
NEEEIRCTNPIATEQYGSVSECLERGNDR

SEQ ID NO: 33176 - protein, 33 aa, Artificial Sequence
  Description of Artificial Sequence: Synthetic polypeptide
DEEEIRTTNPVATEQYGQCAVSTENLQNFGSNR

SEQ ID NO: 33177 - protein, 29 aa, Artificial Sequence
  Description of Artificial Sequence: Synthetic peptide
DEEEIRPTNPVASEQYGSVSCPALNSGNR

SEQ ID NO: 33178 - protein, 30 aa, Artificial Sequence
  Description of Artificial Sequence: Synthetic polypeptide
NEEEIRTTNPVATEPYGSVSAWNLEEYGNR

SEQ ID NO: 33179 - protein, 33 aa, Artificial Sequence
  Description of Artificial Sequence: Synthetic polypeptide
DEEEIRTTNPVATEQYGQCVCSTNDLQNGSNNR

SEQ ID NO: 33180 - protein, 30 aa, Artificial Sequence
  Description of Artificial Sequence: Synthetic polypeptide
NEEEIATTNPVATEQYGSVATNLQQGNPEE

SEQ ID NO: 33181 - protein, 29 aa, Artificial Sequence
  Description of Artificial Sequence: Synthetic peptide
AEEEIRTTNPVATEQYGTVENNNLQYQNR

SEQ ID NO: 33182 - protein, 30 aa, Artificial Sequence
  Description of Artificial Sequence: Synthetic polypeptide
DEEEIRGTNPVATEQYGSVSVNDDRGSQSR

SEQ ID NO: 33183 - protein, 31 aa, Artificial Sequence
  Description of Artificial Sequence: Synthetic polypeptide
DEEEIRTTNPVATEQYGQCVSTELARGSNQG

SEQ ID NO: 33184 - protein, 29 aa, Artificial Sequence
  Description of Artificial Sequence: Synthetic peptide
NEEEIATTNPVATEQYGSASTGLQREQGR

SEQ ID NO: 33185 - protein, 30 aa, Artificial Sequence
  Description of Artificial Sequence: Synthetic polypeptide
NEEEIATTNPVATEQYGSCSTALQRQMGDR

SEQ ID NO: 33186 - protein, 32 aa, Artificial Sequence
  Description of Artificial Sequence: Synthetic polypeptide
DEEEIRTTNPVATEQYGQCVSNTNLQHGSNQG

SEQ ID NO: 33187 - protein, 28 aa, Artificial Sequence
  Description of Artificial Sequence: Synthetic peptide
NEEEIATTNPVATEQYGSCSTHLQDLGR

SEQ ID NO: 33188 - protein, 32 aa, Artificial Sequence
  Description of Artificial Sequence: Synthetic polypeptide
DEEEIRTTNPVATEQYGQCVSNTNDQRGSNQQ

SEQ ID NO: 33189 - protein, 30 aa, Artificial Sequence
  Description of Artificial Sequence: Synthetic polypeptide
NEEEIATTNPVATEQYGSVSAGNLDDFGNR

SEQ ID NO: 33190 - protein, 32 aa, Artificial Sequence
  Description of Artificial Sequence: Synthetic polypeptide
DEEEIRTTNPVATEQYGQCVSMTNTQGGSNRS

SEQ ID NO: 33191 - protein, 30 aa, Artificial Sequence
  Description of Artificial Sequence: Synthetic polypeptide
DEEEIRGTNPVATEQYGSVSYTNGGQGGQG

SEQ ID NO: 33192 - protein, 29 aa, Artificial Sequence
  Description of Artificial Sequence: Synthetic peptide
NEEEIATTNPVATEQYGSVATALQNNGDR

SEQ ID NO: 33193 - protein, 30 aa, Artificial Sequence
  Description of Artificial Sequence: Synthetic polypeptide
AEEEIRTTNPVATEQYGSVYTNLLFNGNQG

SEQ ID NO: 33194 - protein, 30 aa, Artificial Sequence
  Description of Artificial Sequence: Synthetic polypeptide
NEEEIATTNPVATEQYGSVATNLQDGDDRN

SEQ ID NO: 33195 - protein, 29 aa, Artificial Sequence
  Description of Artificial Sequence: Synthetic peptide
NEEEIATTNPVATEQYGSVATNLQDGDSM

SEQ ID NO: 33196 - protein, 29 aa, Artificial Sequence
  Description of Artificial Sequence: Synthetic peptide
NEEEIATTNPVATEQYGSVATNLQDPGDN

SEQ ID NO: 33197 - protein, 30 aa, Artificial Sequence
  Description of Artificial Sequence: Synthetic polypeptide
NEEEIATTNPVATEQYGSVATNLQNGNPET

SEQ ID NO: 33198 - protein, 30 aa, Artificial Sequence
  Description of Artificial Sequence: Synthetic polypeptide
NEEEIATTNPVATEQYGSVATNLQQGNEQA

SEQ ID NO: 33199 - protein, 31 aa, Artificial Sequence
  Description of Artificial Sequence: Synthetic polypeptide
DEEEIRTTNPVATEQYGQCVSMTNHQGGSNF

SEQ ID NO: 33200 - protein, 32 aa, Artificial Sequence
  Description of Artificial Sequence: Synthetic polypeptide
DEEEIRPTNPVATEQYGSVSCVNEQDRGTNNR

SEQ ID NO: 33201 - protein, 32 aa, Artificial Sequence
  Description of Artificial Sequence: Synthetic polypeptide
DEEEIRTTNPVATEQYGNVVSSTNLQSDGNQF

SEQ ID NO: 33202 - protein, 30 aa, Artificial Sequence
  Description of Artificial Sequence: Synthetic polypeptide
NEEEIRTTNPVATEQYGCSCSTELQRFQDR

SEQ ID NO: 33203 - protein, 31 aa, Artificial Sequence
  Description of Artificial Sequence: Synthetic polypeptide
NEEEIRTTNPVATEQYGSLSTHNLEQERQGR

SEQ ID NO: 33204 - protein, 28 aa, Artificial Sequence
  Description of Artificial Sequence: Synthetic peptide
NEEEIRTTNPVATEQYGSLSTHQQRIGV

SEQ ID NO: 33205 - protein, 29 aa, Artificial Sequence
  Description of Artificial Sequence: Synthetic peptide
NEEEIRTTNPVATEQYGSSSTELQRQSDV

SEQ ID NO: 33206 - protein, 30 aa, Artificial Sequence
  Description of Artificial Sequence: Synthetic polypeptide
NEEEIRTTNPVATEQYGSSSTELQRQSGRM

SEQ ID NO: 33207 - protein, 30 aa, Artificial Sequence
  Description of Artificial Sequence: Synthetic polypeptide
NEEEIRTTNPVATEQYGSVATNIQENGNMA

SEQ ID NO: 33208 - protein, 30 aa, Artificial Sequence
  Description of Artificial Sequence: Synthetic polypeptide
NEEEIRTTNPVATEQYGSVCSTGLQREQGV

SEQ ID NO: 33209 - protein, 29 aa, Artificial Sequence
  Description of Artificial Sequence: Synthetic peptide
NEEEIRTTNPVATEQYGSVLSEHLQNQGR

SEQ ID NO: 33210 - protein, 31 aa, Artificial Sequence
  Description of Artificial Sequence: Synthetic polypeptide
DEEEIRTTNPVATEQYGNVSWTELNGGMNGR

SEQ ID NO: 33211 - protein, 29 aa, Artificial Sequence
  Description of Artificial Sequence: Synthetic peptide
NEEEIRTTNPVATEQYGSLSTHLVQRQGQ

SEQ ID NO: 33212 - protein, 30 aa, Artificial Sequence
  Description of Artificial Sequence: Synthetic polypeptide
NEEEIRTTNPVATEQYGSVNSTNDQMNMNQ

SEQ ID NO: 33213 - protein, 31 aa, Artificial Sequence
  Description of Artificial Sequence: Synthetic polypeptide
DEEEIRTTNPVATEQYGNVSTQNGQGGGNNA

SEQ ID NO: 33214 - protein, 30 aa, Artificial Sequence
  Description of Artificial Sequence: Synthetic polypeptide
NEEEIRTTNPVATEQYGSVSADNLDEFGNT

SEQ ID NO: 33215 - protein, 30 aa, Artificial Sequence
  Description of Artificial Sequence: Synthetic polypeptide
NEEEIRTTNPVATEQYGSVSADNLDEHGNP

SEQ ID NO: 33216 - protein, 31 aa, Artificial Sequence
  Description of Artificial Sequence: Synthetic polypeptide
NEEEIRTTNPVATEQYGSVSAENLDEFGNRG

SEQ ID NO: 33217 - protein, 30 aa, Artificial Sequence
  Description of Artificial Sequence: Synthetic polypeptide
NEEEIRTTNPVATEQYGSVSAENLDEFGVR

SEQ ID NO: 33218 - protein, 32 aa, Artificial Sequence
  Description of Artificial Sequence: Synthetic polypeptide
DEEEIRTTNPVATEQYGNVSTNQQQQDGMNRG

SEQ ID NO: 33219 - protein, 30 aa, Artificial Sequence
  Description of Artificial Sequence: Synthetic polypeptide
NEEEIRTTNPVATEQYGSVSAGNLGEFGNE

SEQ ID NO: 33220 - protein, 31 aa, Artificial Sequence
  Description of Artificial Sequence: Synthetic polypeptide
NEEEIRTTNPVATEQYGSVSAINLGDEFGNR

SEQ ID NO: 33221 - protein, 33 aa, Artificial Sequence
  Description of Artificial Sequence: Synthetic polypeptide
NEEEIRTTNPVATEQYGSVNTSNLEQRGGENSR

SEQ ID NO: 33222 - protein, 29 aa, Artificial Sequence
  Description of Artificial Sequence: Synthetic peptide
NEEEIRTTNPVATEQYGSLSTHLQSQDGR

SEQ ID NO: 33223 - protein, 29 aa, Artificial Sequence
  Description of Artificial Sequence: Synthetic peptide
NEEEIRTTNPVATEQYGSLSTHLQRQSGQ

SEQ ID NO: 33224 - protein, 30 aa, Artificial Sequence
  Description of Artificial Sequence: Synthetic polypeptide
NEEEIRTTNPVATEQYGSLSTHLQRQFDRI

SEQ ID NO: 33225 - protein, 30 aa, Artificial Sequence
  Description of Artificial Sequence: Synthetic polypeptide
NEEEIRTTNPVATEQYGCVSTNLENRIDNT

SEQ ID NO: 33226 - protein, 31 aa, Artificial Sequence
  Description of Artificial Sequence: Synthetic polypeptide
DEEEIRPTNPVATEQYGSVSVNQSTRGGNSR

SEQ ID NO: 33227 - protein, 29 aa, Artificial Sequence
  Description of Artificial Sequence: Synthetic peptide
NEEEIRTTNPVATEQYGQTSITVLQRQGR

SEQ ID NO: 33228 - protein, 32 aa, Artificial Sequence
  Description of Artificial Sequence: Synthetic polypeptide
DEEEIRTTNPVATEQYGNVVSSTNLQDGENQF

SEQ ID NO: 33229 - protein, 29 aa, Artificial Sequence
  Description of Artificial Sequence: Synthetic peptide
NEEEIRTTNPVATEQYGSASNTDLQRQGT

SEQ ID NO: 33230 - protein, 30 aa, Artificial Sequence
  Description of Artificial Sequence: Synthetic polypeptide
NEEEIRTTNPVATEQYGSASTDLQRFQGGT

SEQ ID NO: 33231 - protein, 30 aa, Artificial Sequence
  Description of Artificial Sequence: Synthetic polypeptide
NEEEIRTTNPVATEQYGSCSTGELQDRQGR

SEQ ID NO: 33232 - protein, 30 aa, Artificial Sequence
  Description of Artificial Sequence: Synthetic polypeptide
NEEEIRTTNPVATEQYGSCSTHDLQDGQGR

SEQ ID NO: 33233 - protein, 29 aa, Artificial Sequence
  Description of Artificial Sequence: Synthetic peptide
NEEEIRTTNPVATEQYGSCSTIDDQRQGR

SEQ ID NO: 33234 - protein, 32 aa, Artificial Sequence
  Description of Artificial Sequence: Synthetic polypeptide
NEEEIRTTNPVATEQYGSIISTNNLEQRGENT

SEQ ID NO: 33235 - protein, 30 aa, Artificial Sequence
  Description of Artificial Sequence: Synthetic polypeptide
NEEEIRTTNPVATEQYGSISPTPLQERQGR

SEQ ID NO: 33236 - protein, 29 aa, Artificial Sequence
  Description of Artificial Sequence: Synthetic peptide
NEEEIRTTNPVATEQYGSISTHLQRQSEQ

SEQ ID NO: 33237 - protein, 32 aa, Artificial Sequence
  Description of Artificial Sequence: Synthetic polypeptide
NEEEIRTTNPVATEQYGSISTHMLSQRVGENR

SEQ ID NO: 33238 - protein, 29 aa, Artificial Sequence
  Description of Artificial Sequence: Synthetic peptide
NEEEIRTTNPVATEQYGSLSITVLQRQGV

SEQ ID NO: 33239 - protein, 30 aa, Artificial Sequence
  Description of Artificial Sequence: Synthetic polypeptide
NEEEIRTTNPVATEQYGSLSITVLQTQGNL

SEQ ID NO: 33240 - protein, 29 aa, Artificial Sequence
  Description of Artificial Sequence: Synthetic peptide
NEEEIRTTNPVATEQYGSLSPEVLQRQGR

SEQ ID NO: 33241 - protein, 30 aa, Artificial Sequence
  Description of Artificial Sequence: Synthetic polypeptide
NEEEIRTTNPVATEQYGSLSTHGLQRQGDQ

SEQ ID NO: 33242 - protein, 29 aa, Artificial Sequence
  Description of Artificial Sequence: Synthetic peptide
NEEEIRTTNPVATEQYGSLSTHLQEQGID

SEQ ID NO: 33243 - protein, 30 aa, Artificial Sequence
  Description of Artificial Sequence: Synthetic polypeptide
NEEEIRTTNPVATEQYGSLSTHLQRITGQE

SEQ ID NO: 33244 - protein, 31 aa, Artificial Sequence
  Description of Artificial Sequence: Synthetic polypeptide
AEEEIRTTNPVATEQYGSVVVVTNLQDGGNE

SEQ ID NO: 33245 - protein, 31 aa, Artificial Sequence
  Description of Artificial Sequence: Synthetic polypeptide
NEEEIATTNPVATEQWGSVSTDNLQNGDNTR

SEQ ID NO: 33246 - protein, 30 aa, Artificial Sequence
  Description of Artificial Sequence: Synthetic polypeptide
NNEEIRTTNPVATEQYGAVSTLLQQDGPNR

SEQ ID NO: 33247 - protein, 30 aa, Artificial Sequence
  Description of Artificial Sequence: Synthetic polypeptide
NNEEIRTTNPVATEQYGTVSHSNLQDGPNR

SEQ ID NO: 33248 - protein, 32 aa, Artificial Sequence
  Description of Artificial Sequence: Synthetic polypeptide
DEEEIRTTNPVATEQYGKVVPSTGNLSQRVDR

SEQ ID NO: 33249 - protein, 29 aa, Artificial Sequence
  Description of Artificial Sequence: Synthetic peptide
DEEEIRTTNPAATEQYGSVPTDLIERGPE

SEQ ID NO: 33250 - protein, 32 aa, Artificial Sequence
  Description of Artificial Sequence: Synthetic polypeptide
DEEEIRTTNPVATEQYGKVSYTNLSQRTPGSQ

SEQ ID NO: 33251 - protein, 32 aa, Artificial Sequence
  Description of Artificial Sequence: Synthetic polypeptide
AEEEIRTTNPVATEQYGSVVVATNLQQGENNR

SEQ ID NO: 33252 - protein, 30 aa, Artificial Sequence
  Description of Artificial Sequence: Synthetic polypeptide
DEEEIRTTNPAATEQYGSVPTDNLIRGPEF

SEQ ID NO: 33253 - protein, 28 aa, Artificial Sequence
  Description of Artificial Sequence: Synthetic peptide
QEEEIACTNPVATEQYGSVSENCQHGER

SEQ ID NO: 33254 - protein, 30 aa, Artificial Sequence
  Description of Artificial Sequence: Synthetic polypeptide
QEEEIACTNPVATEQYGSVSTNDQRENDRE

SEQ ID NO: 33255 - protein, 29 aa, Artificial Sequence
  Description of Artificial Sequence: Synthetic peptide
QEEEIACTNPVATEQYGSVSTNLQAPNND

SEQ ID NO: 33256 - protein, 33 aa, Artificial Sequence
  Description of Artificial Sequence: Synthetic polypeptide
DEEEIRTTNPVATEQYGKVVSCTGNLSQQTGNR

SEQ ID NO: 33257 - protein, 30 aa, Artificial Sequence
  Description of Artificial Sequence: Synthetic polypeptide
QEEEIACTNPVATEQYGSVSTNLQEGENND

SEQ ID NO: 33258 - protein, 29 aa, Artificial Sequence
  Description of Artificial Sequence: Synthetic peptide
QEEEIACTNPVAYEQYGSVSTNLQHGNAM

SEQ ID NO: 33259 - protein, 29 aa, Artificial Sequence
  Description of Artificial Sequence: Synthetic peptide
DEEEIRTTNPAATEQYGSVSGGNGGDGND

SEQ ID NO: 33260 - protein, 29 aa, Artificial Sequence
  Description of Artificial Sequence: Synthetic peptide
DEEEIRTTNPAATEQYGSVSGNIFDGNVQ

SEQ ID NO: 33261 - protein, 29 aa, Artificial Sequence
  Description of Artificial Sequence: Synthetic peptide
DEEEIRTTNPAATEQYGSVSGNIIDGEND

SEQ ID NO: 33262 - protein, 29 aa, Artificial Sequence
  Description of Artificial Sequence: Synthetic peptide
DEEEIRTTNPAATEQYGSVSNDNIFDGND

SEQ ID NO: 33263 - protein, 28 aa, Artificial Sequence
  Description of Artificial Sequence: Synthetic peptide
QEEEIAPTNPISTEQYGSVSENLMRGNR

SEQ ID NO: 33264 - protein, 32 aa, Artificial Sequence
  Description of Artificial Sequence: Synthetic polypeptide
DEEEIRTTNPVATEQYGKVSCWGNELNRGTNR

SEQ ID NO: 33265 - protein, 29 aa, Artificial Sequence
  Description of Artificial Sequence: Synthetic peptide
DEEEIRTTNPCATAQYGQVPTMDLQRGNF

SEQ ID NO: 33266 - protein, 29 aa, Artificial Sequence
  Description of Artificial Sequence: Synthetic peptide
QEEEIACTNPVATEVYGVVSTNLQERGER

SEQ ID NO: 33267 - protein, 29 aa, Artificial Sequence
  Description of Artificial Sequence: Synthetic peptide
DEEEIRTTNPCATCQYGCVPTDLQRGNFS

SEQ ID NO: 33268 - protein, 30 aa, Artificial Sequence
  Description of Artificial Sequence: Synthetic polypeptide
QEEEIACTNPVATEQYGSVATNLQRGENED

SEQ ID NO: 33269 - protein, 29 aa, Artificial Sequence
  Description of Artificial Sequence: Synthetic peptide
QEEEIACTNPVATEQYGSVATNLQQGNEE

SEQ ID NO: 33270 - protein, 29 aa, Artificial Sequence
  Description of Artificial Sequence: Synthetic peptide
DEEEIRTTNPAATEQYGSVCTDLARGQGG

SEQ ID NO: 33271 - protein, 32 aa, Artificial Sequence
  Description of Artificial Sequence: Synthetic polypeptide
AEEEIRTTNPVATEQYGSVVVSTNLQNGNMNE

SEQ ID NO: 33272 - protein, 32 aa, Artificial Sequence
  Description of Artificial Sequence: Synthetic polypeptide
AEEEIRTTNPVATEQYGSVVVSTNLQLNGNNG

SEQ ID NO: 33273 - protein, 32 aa, Artificial Sequence
  Description of Artificial Sequence: Synthetic polypeptide
AEEEIRTTNPVATEQYGSVVVSTNLQDNGNGN

SEQ ID NO: 33274 - protein, 32 aa, Artificial Sequence
  Description of Artificial Sequence: Synthetic polypeptide
AEEEIRTTNPVATEQYGSVVVSTNLGQQGGNI

SEQ ID NO: 33275 - protein, 32 aa, Artificial Sequence
  Description of Artificial Sequence: Synthetic polypeptide
AEEEIRTTNPVATEQYGSVVVSTNLGGQNGND

SEQ ID NO: 33276 - protein, 31 aa, Artificial Sequence
  Description of Artificial Sequence: Synthetic polypeptide
AEEEIRTTNPVATEQYGSVVVSTNLGGQGNP

SEQ ID NO: 33277 - protein, 31 aa, Artificial Sequence
  Description of Artificial Sequence: Synthetic polypeptide
DEEEIRTTNPAATEQYGSVIATNLQGGGNAA

SEQ ID NO: 33278 - protein, 28 aa, Artificial Sequence
  Description of Artificial Sequence: Synthetic peptide
DEEEIRTTNPAATEQYGSVPEALARGDG

SEQ ID NO: 33279 - protein, 32 aa, Artificial Sequence
  Description of Artificial Sequence: Synthetic polypeptide
DEEEIRTTNPAATEQYGSVIATNLQRAGNDAD

SEQ ID NO: 33280 - protein, 29 aa, Artificial Sequence
  Description of Artificial Sequence: Synthetic peptide
QEEEIACTNPVATEQYGSVATNLQAGNTA

SEQ ID NO: 33281 - protein, 32 aa, Artificial Sequence
  Description of Artificial Sequence: Synthetic polypeptide
AEEEIRTTNPVATEQYGSVVVSTANLNQTGND

SEQ ID NO: 33282 - protein, 32 aa, Artificial Sequence
  Description of Artificial Sequence: Synthetic polypeptide
AEEEIRTTNPVATEQYGSVVVSSTNLEQGGNY

SEQ ID NO: 33283 - protein, 32 aa, Artificial Sequence
  Description of Artificial Sequence: Synthetic polypeptide
AEEEIRTTNPVATEQYGSVVVSNTNLEQGGND

SEQ ID NO: 33284 - protein, 29 aa, Artificial Sequence
  Description of Artificial Sequence: Synthetic peptide
QEEEIACTNPVATEQYGSVATNLQDGNAQ

SEQ ID NO: 33285 - protein, 31 aa, Artificial Sequence
  Description of Artificial Sequence: Synthetic polypeptide
AEEEIRTTNPVATEQYGSVVVSNNLQGIGNT

SEQ ID NO: 33286 - protein, 32 aa, Artificial Sequence
  Description of Artificial Sequence: Synthetic polypeptide
DEEEIRTTNPAATEQYGSVIMTNLQREGENGI

SEQ ID NO: 33287 - protein, 31 aa, Artificial Sequence
  Description of Artificial Sequence: Synthetic polypeptide
AEEEIRTTNPVATEQYGSVVVNTNLQVGGNN

SEQ ID NO: 33288 - protein, 32 aa, Artificial Sequence
  Description of Artificial Sequence: Synthetic polypeptide
DEEEIRTTNPAATEQYGSVIATNLQRGGNGDN

SEQ ID NO: 33289 - protein, 28 aa, Artificial Sequence
  Description of Artificial Sequence: Synthetic peptide
DEEEIRTTNPCATCQYGVVTTDLQGGNF

SEQ ID NO: 33290 - protein, 32 aa, Artificial Sequence
  Description of Artificial Sequence: Synthetic polypeptide
DEEEIRTTNPVATEQYGKVPSCTDLSQRGGNQ

SEQ ID NO: 33291 - protein, 29 aa, Artificial Sequence
  Description of Artificial Sequence: Synthetic peptide
DEEEIRTTNPCATDQYGQVPTTLQRGNQQ

SEQ ID NO: 33292 - protein, 29 aa, Artificial Sequence
  Description of Artificial Sequence: Synthetic peptide
QEEEIATTNPVATEPYGSVSTNLQQGDQE

SEQ ID NO: 33293 - protein, 29 aa, Artificial Sequence
  Description of Artificial Sequence: Synthetic peptide
DEEEIRTTNPCATEAYGSTSTNLAGGNGT

SEQ ID NO: 33294 - protein, 28 aa, Artificial Sequence
  Description of Artificial Sequence: Synthetic peptide
DEEEIRTTNPCATEAYGSTSTNLAGNQT

SEQ ID NO: 33295 - protein, 29 aa, Artificial Sequence
  Description of Artificial Sequence: Synthetic peptide
DEEEIRTTNPCATEAYGSTSTNLELGGNT

SEQ ID NO: 33296 - protein, 29 aa, Artificial Sequence
  Description of Artificial Sequence: Synthetic peptide
QEEEIATTNPVATEQWGSVSENLQHGNVD

SEQ ID NO: 33297 - protein, 29 aa, Artificial Sequence
  Description of Artificial Sequence: Synthetic peptide
DEEEIRTTNPCATEAYGSTSTNLETGNVG

SEQ ID NO: 33298 - protein, 30 aa, Artificial Sequence
  Description of Artificial Sequence: Synthetic polypeptide
QEEEIATTNPVATEQWGSVSTNLQHGENDQ

SEQ ID NO: 33299 - protein, 29 aa, Artificial Sequence
  Description of Artificial Sequence: Synthetic peptide
DEEEIRTTNPCATEAYGSTSTNLNANGNT

SEQ ID NO: 33300 - protein, 30 aa, Artificial Sequence
  Description of Artificial Sequence: Synthetic polypeptide
QEEEIATTNPVATEPYGSVATNLQRDGNHE

SEQ ID NO: 33301 - protein, 29 aa, Artificial Sequence
  Description of Artificial Sequence: Synthetic peptide
QEEEIATTNPVATEQWGSVSVNLQQGDRN

SEQ ID NO: 33302 - protein, 30 aa, Artificial Sequence
  Description of Artificial Sequence: Synthetic polypeptide
QEEEIATTNPVATEQYGCVATNLQRAGPNQ

SEQ ID NO: 33303 - protein, 30 aa, Artificial Sequence
  Description of Artificial Sequence: Synthetic polypeptide
QEEEIATTNPVATEQYGCVSTNLQQGNPEE

SEQ ID NO: 33304 - protein, 32 aa, Artificial Sequence
  Description of Artificial Sequence: Synthetic polypeptide
DEEEIRTTNPVATEQYGKTVSTNALSQGGENE

SEQ ID NO: 33305 - protein, 30 aa, Artificial Sequence
  Description of Artificial Sequence: Synthetic polypeptide
AEEEIRTTNPVATEQYGSVVTVNNLGIGNQ

SEQ ID NO: 33306 - protein, 32 aa, Artificial Sequence
  Description of Artificial Sequence: Synthetic polypeptide
DEEEIRTTNPVATEQYGKTVSTNAGSQRGNNE

SEQ ID NO: 33307 - protein, 33 aa, Artificial Sequence
  Description of Artificial Sequence: Synthetic polypeptide
DEEEIRTTNPVATEQYGKTVSTGNLSQGEGGNR

SEQ ID NO: 33308 - protein, 29 aa, Artificial Sequence
  Description of Artificial Sequence: Synthetic peptide
DEEEIRTTNPCATEAYGSVATNHGRTGNA

SEQ ID NO: 33309 - protein, 33 aa, Artificial Sequence
  Description of Artificial Sequence: Synthetic polypeptide
DEEEIRTTNPVATEQYGKTVSCTNALSQRGNPE

SEQ ID NO: 33310 - protein, 32 aa, Artificial Sequence
  Description of Artificial Sequence: Synthetic polypeptide
DEEEIRTTNPVATEQYGKTVSTNLSQSGTNNQ

SEQ ID NO: 33311 - protein, 29 aa, Artificial Sequence
  Description of Artificial Sequence: Synthetic peptide
QEEEIATTNPVATEMYGSVSTNDQEGNDQ

SEQ ID NO: 33312 - protein, 30 aa, Artificial Sequence
  Description of Artificial Sequence: Synthetic polypeptide
QEEEIATTNPVATEMYGSVATNLQERGQDR

SEQ ID NO: 33313 - protein, 30 aa, Artificial Sequence
  Description of Artificial Sequence: Synthetic polypeptide
DEEEIRTTNPCATEAYGSCSTNLSARGGNQ

SEQ ID NO: 33314 - protein, 28 aa, Artificial Sequence
  Description of Artificial Sequence: Synthetic peptide
DEEEIRTTNPCATDQYGTVATELQQGND

SEQ ID NO: 33315 - protein, 33 aa, Artificial Sequence
  Description of Artificial Sequence: Synthetic polypeptide
DEEEIRTTNPVATEQYGKTVVSTNMLSQQGGNR

SEQ ID NO: 33316 - protein, 29 aa, Artificial Sequence
  Description of Artificial Sequence: Synthetic peptide
DEEEIRTTNPCATDQYGTVSTTDLQMGNA

SEQ ID NO: 33317 - protein, 28 aa, Artificial Sequence
  Description of Artificial Sequence: Synthetic peptide
DEEEIRTTNPCATDQYGTVTTDLQAGNV

SEQ ID NO: 33318 - protein, 28 aa, Artificial Sequence
  Description of Artificial Sequence: Synthetic peptide
DEEEIRTTNPCATDQYGTVTTTLQMGNQ

SEQ ID NO: 33319 - protein, 29 aa, Artificial Sequence
  Description of Artificial Sequence: Synthetic peptide
DEEEIRTTNPCATDQYGTVTTTNLQQGNF

SEQ ID NO: 33320 - protein, 28 aa, Artificial Sequence
  Description of Artificial Sequence: Synthetic peptide
DEEEIRTTNPCATDQYGTVVTDLQNGNN

SEQ ID NO: 33321 - protein, 28 aa, Artificial Sequence
  Description of Artificial Sequence: Synthetic peptide
QEEEIATTNPVATECYGDVSENLQHGNL

SEQ ID NO: 33322 - protein, 29 aa, Artificial Sequence
  Description of Artificial Sequence: Synthetic peptide
QEEEIATTNPVATECYGSVSTNLLRENIN

SEQ ID NO: 33323 - protein, 29 aa, Artificial Sequence
  Description of Artificial Sequence: Synthetic peptide
DEEEIRTTNPCATEAYGSCSTNLAPGNQD

SEQ ID NO: 33324 - protein, 31 aa, Artificial Sequence
  Description of Artificial Sequence: Synthetic polypeptide
AEEEIRTTNPVATEQYGSVVTVTNLQNGTNE

SEQ ID NO: 33325 - protein, 31 aa, Artificial Sequence
  Description of Artificial Sequence: Synthetic polypeptide
AEEEIRTTNPVATEQYGSVVTVTNLQLTGNI

SEQ ID NO: 33326 - protein, 30 aa, Artificial Sequence
  Description of Artificial Sequence: Synthetic polypeptide
QEEEIATTNPVATEGYGSVSTNLQNDGNMF

SEQ ID NO: 33327 - protein, 30 aa, Artificial Sequence
  Description of Artificial Sequence: Synthetic polypeptide
QEEEIATTNPVATEGYGSVSTNLQQGDERA

SEQ ID NO: 33328 - protein, 28 aa, Artificial Sequence
  Description of Artificial Sequence: Synthetic peptide
QEEEIATTNPVATEGYGVVATNLQNGNL

SEQ ID NO: 33329 - protein, 29 aa, Artificial Sequence
  Description of Artificial Sequence: Synthetic peptide
QEEEIATTNPVATEGYGVVSTNLQQGNME

SEQ ID NO: 33330 - protein, 29 aa, Artificial Sequence
  Description of Artificial Sequence: Synthetic peptide
QEEEIATTNPVATEHYGAVSTNLQGGNDD

SEQ ID NO: 33331 - protein, 30 aa, Artificial Sequence
  Description of Artificial Sequence: Synthetic polypeptide
QEEEIATTNPVATEHYGSVSTNLQDGMNDL

SEQ ID NO: 33332 - protein, 29 aa, Artificial Sequence
  Description of Artificial Sequence: Synthetic peptide
QEEEIATTNPVATEHYGVVSTNLQQGGNH

SEQ ID NO: 33333 - protein, 30 aa, Artificial Sequence
  Description of Artificial Sequence: Synthetic polypeptide
DEEEIRTTNPAATEQYGSVCSTMTQLGNTT

SEQ ID NO: 33334 - protein, 31 aa, Artificial Sequence
  Description of Artificial Sequence: Synthetic polypeptide
DEEEIRTTNPVATEQYGMVGSNTNLQFGEGT

SEQ ID NO: 33335 - protein, 32 aa, Artificial Sequence
  Description of Artificial Sequence: Synthetic polypeptide
AEEEIRTTNPVATEQYGSVVVSTNLQQGEANV

SEQ ID NO: 33336 - protein, 32 aa, Artificial Sequence
  Description of Artificial Sequence: Synthetic polypeptide
AEEEIRTTNPVATEQYGSVVVSTNLQQGTNIG

SEQ ID NO: 33337 - protein, 31 aa, Artificial Sequence
  Description of Artificial Sequence: Synthetic polypeptide
AEEEIRTTNPVATEQYGSVVVTNLQQIGGNN

SEQ ID NO: 33338 - protein, 30 aa, Artificial Sequence
  Description of Artificial Sequence: Synthetic polypeptide
NNEEIRTTNPVATEQYGVVSTNLQDGPNEG

SEQ ID NO: 33339 - protein, 31 aa, Artificial Sequence
  Description of Artificial Sequence: Synthetic polypeptide
AEEEIRTTNPVATEQYGSVVVTNLQQGSNDE

SEQ ID NO: 33340 - protein, 29 aa, Artificial Sequence
  Description of Artificial Sequence: Synthetic peptide
DEEEIRTCNPVATEQYGSVSTGGQGNQED

SEQ ID NO: 33341 - protein, 30 aa, Artificial Sequence
  Description of Artificial Sequence: Synthetic polypeptide
NNEEIRTTNPVATEQYGVVSTNLQDGPNGQ

SEQ ID NO: 33342 - protein, 31 aa, Artificial Sequence
  Description of Artificial Sequence: Synthetic polypeptide
AEEEIRTTNPVATEQYGSVVVTNLQNGNNGN

SEQ ID NO: 33343 - protein, 29 aa, Artificial Sequence
  Description of Artificial Sequence: Synthetic peptide
NNEEIRTTNPVATEQYGVVSTNLQDNPNN

SEQ ID NO: 33344 - protein, 31 aa, Artificial Sequence
  Description of Artificial Sequence: Synthetic polypeptide
AEEEIRTTNPVATEQYGSVVVTNLQEGGNNV

SEQ ID NO: 33345 - protein, 31 aa, Artificial Sequence
  Description of Artificial Sequence: Synthetic polypeptide
AEEEIRTTNPVATEQYGSVVVTNLQQVGNGD

SEQ ID NO: 33346 - protein, 31 aa, Artificial Sequence
  Description of Artificial Sequence: Synthetic polypeptide
AEEEIRTTNPVATEQYGSVVVTNLQDGNGNL

SEQ ID NO: 33347 - protein, 31 aa, Artificial Sequence
  Description of Artificial Sequence: Synthetic polypeptide
AEEEIRTTNPVATEQYGSVVVTNLNQTGEND

SEQ ID NO: 33348 - protein, 30 aa, Artificial Sequence
  Description of Artificial Sequence: Synthetic polypeptide
NNEEIRTTNPVATEQYGVVSTNLQDTPNYR

SEQ ID NO: 33349 - protein, 30 aa, Artificial Sequence
  Description of Artificial Sequence: Synthetic polypeptide
AEEEIRTTNPVATEQYGSVVVTNLNQGENE

SEQ ID NO: 33350 - protein, 30 aa, Artificial Sequence
  Description of Artificial Sequence: Synthetic polypeptide
NNEEIRTTNPVATEQYGVVSTNLQGDGDNG

SEQ ID NO: 33351 - protein, 29 aa, Artificial Sequence
  Description of Artificial Sequence: Synthetic peptide
DEEEIRTCNPVATEQYGSVSTHLERNQFE

SEQ ID NO: 33352 - protein, 31 aa, Artificial Sequence
  Description of Artificial Sequence: Synthetic polypeptide
AEEEIRTTNPVATEQYGSVVVTNLLQNGNNA

SEQ ID NO: 33353 - protein, 31 aa, Artificial Sequence
  Description of Artificial Sequence: Synthetic polypeptide
AEEEIRTTNPVATEQYGSVVVTNLLEQGGNQ

SEQ ID NO: 33354 - protein, 30 aa, Artificial Sequence
  Description of Artificial Sequence: Synthetic polypeptide
NNEEIRTTNPVATEQYGVVSTNLQNDGGNT

SEQ ID NO: 33355 - protein, 31 aa, Artificial Sequence
  Description of Artificial Sequence: Synthetic polypeptide
AEEEIRTTNPVATEQYGSVVVTNLQDGGNTA

SEQ ID NO: 33356 - protein, 29 aa, Artificial Sequence
  Description of Artificial Sequence: Synthetic peptide
NNEEIRTTNPVATEQYGVVSTNQQDGANV

SEQ ID NO: 33357 - protein, 31 aa, Artificial Sequence
  Description of Artificial Sequence: Synthetic polypeptide
AEEEIRTTNPVATEQYGSVVVTNLQSGVDNT

SEQ ID NO: 33358 - protein, 31 aa, Artificial Sequence
  Description of Artificial Sequence: Synthetic polypeptide
AEEEIRTTNPVATEQYGSVVVTNLQVGGNNG

SEQ ID NO: 33359 - protein, 31 aa, Artificial Sequence
  Description of Artificial Sequence: Synthetic polypeptide
AEEEIRTTNPVATEQYGSVVVTNQLQNQGNM

SEQ ID NO: 33360 - protein, 28 aa, Artificial Sequence
  Description of Artificial Sequence: Synthetic peptide
DEEEIRSVNPVCTEQYGVVSENLQAGNA

SEQ ID NO: 33361 - protein, 28 aa, Artificial Sequence
  Description of Artificial Sequence: Synthetic peptide
DEEEIRSVNPVCTEQYGVVSENLQSGNA

SEQ ID NO: 33362 - protein, 28 aa, Artificial Sequence
  Description of Artificial Sequence: Synthetic peptide
DEEEIRSVNPVCTEQYGVVSENLQSGNQ

SEQ ID NO: 33363 - protein, 30 aa, Artificial Sequence
  Description of Artificial Sequence: Synthetic polypeptide
NNEEIRTTNPVATEQYGVTSTNLEQDGPNR

SEQ ID NO: 33364 - protein, 29 aa, Artificial Sequence
  Description of Artificial Sequence: Synthetic peptide
NNEEIRTTNPVATEQYGVVSTDLQDGGNP

SEQ ID NO: 33365 - protein, 29 aa, Artificial Sequence
  Description of Artificial Sequence: Synthetic peptide
NNEEIRTTNPVATEQYGVVSTELQQGPNV

SEQ ID NO: 33366 - protein, 29 aa, Artificial Sequence
  Description of Artificial Sequence: Synthetic peptide
DEEEIRTCNPVATEQYGCVSTHPLQGNQE

SEQ ID NO: 33367 - protein, 31 aa, Artificial Sequence
  Description of Artificial Sequence: Synthetic polypeptide
AEEEIRTTNPVATEQYGSVVVTNLQVEGING

SEQ ID NO: 33368 - protein, 30 aa, Artificial Sequence
  Description of Artificial Sequence: Synthetic polypeptide
NNEEIRTTNPVATEQYGVVSTNDLQDGQNE

SEQ ID NO: 33369 - protein, 30 aa, Artificial Sequence
  Description of Artificial Sequence: Synthetic polypeptide
DEEEIRTCNPVATEQYGSVSTERLQGNNQE

SEQ ID NO: 33370 - protein, 30 aa, Artificial Sequence
  Description of Artificial Sequence: Synthetic polypeptide
NNEEIRTTNPVATEQYGVVSTNLEQDDENR

SEQ ID NO: 33371 - protein, 29 aa, Artificial Sequence
  Description of Artificial Sequence: Synthetic peptide
NNEEIRTTNPVATEQYGVVSTNLFDDPNR

SEQ ID NO: 33372 - protein, 30 aa, Artificial Sequence
  Description of Artificial Sequence: Synthetic polypeptide
DEEEIRTCNPVATEQYGSVSTGDLQRNEGE

SEQ ID NO: 33373 - protein, 30 aa, Artificial Sequence
  Description of Artificial Sequence: Synthetic polypeptide
DEEEIRTCNPVATEQYGSVSTGGGQGGNQE

SEQ ID NO: 33374 - protein, 30 aa, Artificial Sequence
  Description of Artificial Sequence: Synthetic polypeptide
NNEEIRTTNPVATEQYGVVSTNLQDGGENI

SEQ ID NO: 33375 - protein, 30 aa, Artificial Sequence
  Description of Artificial Sequence: Synthetic polypeptide
NNEEIRTTNPVATEQYGVVSTNLQDGGNND

SEQ ID NO: 33376 - protein, 31 aa, Artificial Sequence
  Description of Artificial Sequence: Synthetic polypeptide
AEEEIRTTNPVATEQYGSVVVTNLQVGQGNE

SEQ ID NO: 33377 - protein, 30 aa, Artificial Sequence
  Description of Artificial Sequence: Synthetic polypeptide
NNEEIRTTNPVATEQYGVVSTNELIDGPNR

SEQ ID NO: 33378 - protein, 30 aa, Artificial Sequence
  Description of Artificial Sequence: Synthetic polypeptide
DEEEIRTCNPVATEQYGSVSTLLQRNSQIE

SEQ ID NO: 33379 - protein, 30 aa, Artificial Sequence
  Description of Artificial Sequence: Synthetic polypeptide
NNEEIRTTNPVATEQYGVVSTTNLQDGPNV

SEQ ID NO: 33380 - protein, 31 aa, Artificial Sequence
  Description of Artificial Sequence: Synthetic polypeptide
DEEEIRTCNPVATEQYGSVSTNGDLDQRNQE

SEQ ID NO: 33381 - protein, 29 aa, Artificial Sequence
  Description of Artificial Sequence: Synthetic peptide
QEEEIACTNPVATEPYGSVSTNLQRDNML

SEQ ID NO: 33382 - protein, 28 aa, Artificial Sequence
  Description of Artificial Sequence: Synthetic peptide
QEEEIACTNPVATEQYGCVATNLQAGND

SEQ ID NO: 33383 - protein, 28 aa, Artificial Sequence
  Description of Artificial Sequence: Synthetic peptide
DEEEIRTTNPAATEEYGSVATNHGRGEA

SEQ ID NO: 33384 - protein, 28 aa, Artificial Sequence
  Description of Artificial Sequence: Synthetic peptide
DEEEIRTTNPAATEFYGSVATNEGQGND

SEQ ID NO: 33385 - protein, 28 aa, Artificial Sequence
  Description of Artificial Sequence: Synthetic peptide
DEEEIRTTNPAATEFYGSVATNPGFGNG

SEQ ID NO: 33386 - protein, 29 aa, Artificial Sequence
  Description of Artificial Sequence: Synthetic peptide
QEEEIACTNPVATEQYGCVATNLQREGNE

SEQ ID NO: 33387 - protein, 28 aa, Artificial Sequence
  Description of Artificial Sequence: Synthetic peptide
DEEEIRTTNPAATEGYGSCSTNLARTQD

SEQ ID NO: 33388 - protein, 30 aa, Artificial Sequence
  Description of Artificial Sequence: Synthetic polypeptide
DEEEIRTTNPAATEGYGSVCSTNLADGNDD

SEQ ID NO: 33389 - protein, 29 aa, Artificial Sequence
  Description of Artificial Sequence: Synthetic peptide
QEEEIACTNPVATEPYGSVSTNLQQGDRL

SEQ ID NO: 33390 - protein, 32 aa, Artificial Sequence
  Description of Artificial Sequence: Synthetic polypeptide
AEEEIRTTNPVATEQYGSVVVSTNNNQQGNLR

SEQ ID NO: 33391 - protein, 28 aa, Artificial Sequence
  Description of Artificial Sequence: Synthetic peptide
QEEEIACTNPVATEQYGDVSENLQREER

SEQ ID NO: 33392 - protein, 31 aa, Artificial Sequence
  Description of Artificial Sequence: Synthetic polypeptide
DEEEIRTTNPAATEGYGSVCSTNLARGNGDG

SEQ ID NO: 33393 - protein, 31 aa, Artificial Sequence
  Description of Artificial Sequence: Synthetic polypeptide
DEEEIRTTNPAATEGYGSVCSTNLDRGQNIN

SEQ ID NO: 33394 - protein, 30 aa, Artificial Sequence
  Description of Artificial Sequence: Synthetic polypeptide
DEEEIRTTNPAATEGYGSVNSTNLARGGDD

SEQ ID NO: 33395 - protein, 32 aa, Artificial Sequence
  Description of Artificial Sequence: Synthetic polypeptide
AEEEIRTTNPVATEQYGSVVVSTNNLNQNGNL

SEQ ID NO: 33396 - protein, 28 aa, Artificial Sequence
  Description of Artificial Sequence: Synthetic peptide
DEEEIRTTNPAATEIYGSVATNMGTGNA

SEQ ID NO: 33397 - protein, 31 aa, Artificial Sequence
  Description of Artificial Sequence: Synthetic polypeptide
DEEEIRTTNPAATEQYGQCVCSTEVLQRGNA

SEQ ID NO: 33398 - protein, 32 aa, Artificial Sequence
  Description of Artificial Sequence: Synthetic polypeptide
AEEEIRTTNPVATEQYGSVVVSTNLQQQGTNV

SEQ ID NO: 33399 - protein, 28 aa, Artificial Sequence
  Description of Artificial Sequence: Synthetic peptide
QEEEIACTNPVATEQYGDVSECLQRENR

SEQ ID NO: 33400 - protein, 31 aa, Artificial Sequence
  Description of Artificial Sequence: Synthetic polypeptide
DEEEIRTTNCVATEQYGSYSTTNLQQGTNPD

SEQ ID NO: 33401 - protein, 29 aa, Artificial Sequence
  Description of Artificial Sequence: Synthetic peptide
QEEEIACTNPVATEHYGVVSTNLQRGNNH

SEQ ID NO: 33402 - protein, 28 aa, Artificial Sequence
  Description of Artificial Sequence: Synthetic peptide
QEEEIACTNPIATEGYGSVSENLMRGNR

SEQ ID NO: 33403 - protein, 30 aa, Artificial Sequence
  Description of Artificial Sequence: Synthetic polypeptide
NQEEIATTNPVATEQYGVVSTNLSQDGGNR

SEQ ID NO: 33404 - protein, 29 aa, Artificial Sequence
  Description of Artificial Sequence: Synthetic peptide
DEEEIRTCNPVATEQYGSVSTPLQSNSQQ

SEQ ID NO: 33405 - protein, 29 aa, Artificial Sequence
  Description of Artificial Sequence: Synthetic peptide
NSEEIRTTNPVATEQYGVVSTNDQNGSNQ

SEQ ID NO: 33406 - protein, 30 aa, Artificial Sequence
  Description of Artificial Sequence: Synthetic polypeptide
NSEEIRTTNPVATEQYGVVSTNHSQDGGNR

SEQ ID NO: 33407 - protein, 30 aa, Artificial Sequence
  Description of Artificial Sequence: Synthetic polypeptide
DEEEIRTCNPVATEQYGSVSTRPLQRNQEI

SEQ ID NO: 33408 - protein, 30 aa, Artificial Sequence
  Description of Artificial Sequence: Synthetic polypeptide
NSEEIRTTNPVAYEQYGVVSTNALQDGGNR

SEQ ID NO: 33409 - protein, 30 aa, Artificial Sequence
  Description of Artificial Sequence: Synthetic polypeptide
DEEEIRTCNPVATEQYGSVSTSLLQRNSFE

SEQ ID NO: 33410 - protein, 30 aa, Artificial Sequence
  Description of Artificial Sequence: Synthetic polypeptide
NTEEIRATNPVATEQYGSVVSTNLIQNGTR

SEQ ID NO: 33411 - protein, 28 aa, Artificial Sequence
  Description of Artificial Sequence: Synthetic peptide
PEEVICTTNPVATEQYGSVSMNDQHGNS

SEQ ID NO: 33412 - protein, 29 aa, Artificial Sequence
  Description of Artificial Sequence: Synthetic peptide
DEEEIRTCNPVATEQYGSVSTTDGQRNQE

SEQ ID NO: 33413 - protein, 30 aa, Artificial Sequence
  Description of Artificial Sequence: Synthetic polypeptide
DEEEIRTCNPVATEQYGSVSTTLGEQRNQE

SEQ ID NO: 33414 - protein, 29 aa, Artificial Sequence
  Description of Artificial Sequence: Synthetic peptide
QAEEIATTNPVATEQYGSVATNLQAGDND

SEQ ID NO: 33415 - protein, 29 aa, Artificial Sequence
  Description of Artificial Sequence: Synthetic peptide
DEEEIRTCNPVATEQYGSVSTYLQDNEQE

SEQ ID NO: 33416 - protein, 31 aa, Artificial Sequence
  Description of Artificial Sequence: Synthetic polypeptide
DEEEIRTTNPVATEQYGMVDSTYMHNQRGNQ

SEQ ID NO: 33417 - protein, 30 aa, Artificial Sequence
  Description of Artificial Sequence: Synthetic polypeptide
DEEEIRTTNPVATEQYGMVCQTNQEITGNR

SEQ ID NO: 33418 - protein, 33 aa, Artificial Sequence
  Description of Artificial Sequence: Synthetic polypeptide
DEEEIRTTNPVATEQYGMTSMTENDLGQRIGNR

SEQ ID NO: 33419 - protein, 28 aa, Artificial Sequence
  Description of Artificial Sequence: Synthetic peptide
DEEEIRTCNPVATEQYGSYSTHDQRNQE

SEQ ID NO: 33420 - protein, 29 aa, Artificial Sequence
  Description of Artificial Sequence: Synthetic peptide
QEAEIATTNPVATEQYGSVATNLERGNDV

SEQ ID NO: 33421 - protein, 32 aa, Artificial Sequence
  Description of Artificial Sequence: Synthetic polypeptide
AEEEIRTTNPVATEQYGSVVVSVTNLQDNGNG

SEQ ID NO: 33422 - protein, 32 aa, Artificial Sequence
  Description of Artificial Sequence: Synthetic polypeptide
AEEEIRTTNPVATEQYGSVVVSTNLQQGQGNN

SEQ ID NO: 33423 - protein, 29 aa, Artificial Sequence
  Description of Artificial Sequence: Synthetic peptide
SEEEIRCTNPIATEQYGSVSENLMFMGNR

SEQ ID NO: 33424 - protein, 30 aa, Artificial Sequence
  Description of Artificial Sequence: Synthetic polypeptide
NEEEIATTNPVATEQWGSVSTDNLQHGNQM

SEQ ID NO: 33425 - protein, 30 aa, Artificial Sequence
  Description of Artificial Sequence: Synthetic polypeptide
NEEEIATTNPVATEQWGSVATNLQQGNTRQ

SEQ ID NO: 33426 - protein, 32 aa, Artificial Sequence
  Description of Artificial Sequence: Synthetic polypeptide
DEEEIRCTNPVATEQYGSVSDVLQRYGSENRL

SEQ ID NO: 33427 - protein, 30 aa, Artificial Sequence
  Description of Artificial Sequence: Synthetic polypeptide
FNEEIRTTNPVATEQYGVVSTNLPEDGPNR

SEQ ID NO: 33428 - protein, 29 aa, Artificial Sequence
  Description of Artificial Sequence: Synthetic peptide
DEEEIRCTNPVATEQYGSVSEILMAAENR

SEQ ID NO: 33429 - protein, 30 aa, Artificial Sequence
  Description of Artificial Sequence: Synthetic polypeptide
AEEEIRTTNPVATEYYGSVSTFQVQANGNR

SEQ ID NO: 33430 - protein, 31 aa, Artificial Sequence
  Description of Artificial Sequence: Synthetic polypeptide
AEEEIRTTNPVATEVYGSVSSTNLQRGTMEM

SEQ ID NO: 33431 - protein, 30 aa, Artificial Sequence
  Description of Artificial Sequence: Synthetic polypeptide
AEEEIRTTNPVATETYGSVSTTVLQSGINT

SEQ ID NO: 33432 - protein, 30 aa, Artificial Sequence
  Description of Artificial Sequence: Synthetic polypeptide
DEEEIRTTNPVATEQYGSAPTNDQRHNIEN

SEQ ID NO: 33433 - protein, 30 aa, Artificial Sequence
  Description of Artificial Sequence: Synthetic polypeptide
GEEEIRCTNPIATEQYGSVSVNDLMRQGNR

SEQ ID NO: 33434 - protein, 31 aa, Artificial Sequence
  Description of Artificial Sequence: Synthetic polypeptide
DEEEIRCTNPVATEQYGSVSCVNQDRGENNR

SEQ ID NO: 33435 - protein, 31 aa, Artificial Sequence
  Description of Artificial Sequence: Synthetic polypeptide
GEEEIRTTNPVATEEYGSVSNTNLERGDQRQ

SEQ ID NO: 33436 - protein, 29 aa, Artificial Sequence
  Description of Artificial Sequence: Synthetic peptide
GQEEIATTNPVATEQWGTVSTNLQEGNER

SEQ ID NO: 33437 - protein, 31 aa, Artificial Sequence
  Description of Artificial Sequence: Synthetic polypeptide
DEEEIRCTNPVATEQYGSVSEPNGQMRGNPV

SEQ ID NO: 33438 - protein, 30 aa, Artificial Sequence
  Description of Artificial Sequence: Synthetic polypeptide
HEEEIATTNPVATEQYGSVSTNDQRNDNEY

SEQ ID NO: 33439 - protein, 31 aa, Artificial Sequence
  Description of Artificial Sequence: Synthetic polypeptide
DEEEIRTTNPVATEQYGSAITTNLQPGELNE

SEQ ID NO: 33440 - protein, 31 aa, Artificial Sequence
  Description of Artificial Sequence: Synthetic polypeptide
HEEEIRTTNPVATDQYGSVSTNLQRENANFY

SEQ ID NO: 33441 - protein, 30 aa, Artificial Sequence
  Description of Artificial Sequence: Synthetic polypeptide
HEEEIRTTNPVATEQWGSVSTNLQGNANDQ

SEQ ID NO: 33442 - protein, 31 aa, Artificial Sequence
  Description of Artificial Sequence: Synthetic polypeptide
HEEEIRTTNPVATEQWGSVSTNLQRDNDNDY

SEQ ID NO: 33443 - protein, 31 aa, Artificial Sequence
  Description of Artificial Sequence: Synthetic polypeptide
DEEEIRTTNPVATEQYGSAIPTNLQPQGERD

SEQ ID NO: 33444 - protein, 31 aa, Artificial Sequence
  Description of Artificial Sequence: Synthetic polypeptide
DEEEIRCTNPVATEQYGSVSEINLPMRGENG

SEQ ID NO: 33445 - protein, 32 aa, Artificial Sequence
  Description of Artificial Sequence: Synthetic polypeptide
HEEEIRTTNPVATEQYGSVSETNNLQRNENNY

SEQ ID NO: 33446 - protein, 31 aa, Artificial Sequence
  Description of Artificial Sequence: Synthetic polypeptide
DEEEIRCTNPVATEQYGSVSCNEPQDRGENG

SEQ ID NO: 33447 - protein, 29 aa, Artificial Sequence
  Description of Artificial Sequence: Synthetic peptide
FEEGITTTNPVATEQYGSVSMPNEQRGNS

SEQ ID NO: 33448 - protein, 32 aa, Artificial Sequence
  Description of Artificial Sequence: Synthetic polypeptide
FEEEIRTTNPVATEQYGSVSTVNLQATGGNEA

SEQ ID NO: 33449 - protein, 32 aa, Artificial Sequence
  Description of Artificial Sequence: Synthetic polypeptide
FEEEIRTTNPVATEQYGSVSTVNLQMTGENEE

SEQ ID NO: 33450 - protein, 31 aa, Artificial Sequence
  Description of Artificial Sequence: Synthetic polypeptide
AEEEIRTTNPVAYEQYGSVATNLQANGDNRS

SEQ ID NO: 33451 - protein, 32 aa, Artificial Sequence
  Description of Artificial Sequence: Synthetic polypeptide
DEEEIRCTNPVATEQYGSVATNLQTRDGNEDV

SEQ ID NO: 33452 - protein, 32 aa, Artificial Sequence
  Description of Artificial Sequence: Synthetic polypeptide
FEEEIRTTNPVATEQYGSVSTVNLQNTGNVAN

SEQ ID NO: 33453 - protein, 31 aa, Artificial Sequence
  Description of Artificial Sequence: Synthetic polypeptide
DEEEIRCTNPVATEQYGSVATNLQTRGPEQV

SEQ ID NO: 33454 - protein, 29 aa, Artificial Sequence
  Description of Artificial Sequence: Synthetic peptide
DEEEIRCTNPVATEQYGSVATWLNQVNNM

SEQ ID NO: 33455 - protein, 33 aa, Artificial Sequence
  Description of Artificial Sequence: Synthetic polypeptide
FEEEIRTTNPVATEQYGSVSVVSNLQQRGENYR

SEQ ID NO: 33456 - protein, 31 aa, Artificial Sequence
  Description of Artificial Sequence: Synthetic polypeptide
DEEEIRCTNPVATEQYGSVSATDLMREGNDL

SEQ ID NO: 33457 - protein, 31 aa, Artificial Sequence
  Description of Artificial Sequence: Synthetic polypeptide
DEEEIRCTNPVATEQYGSVCSEDNLMFEGNR

SEQ ID NO: 33458 - protein, 30 aa, Artificial Sequence
  Description of Artificial Sequence: Synthetic polypeptide
FEEEIRTTNPVATEQYGSVYNTPNLQRNEG

SEQ ID NO: 33459 - protein, 30 aa, Artificial Sequence
  Description of Artificial Sequence: Synthetic polypeptide
DEEEIRCTNPVATEQYGSVCTNLQNINNTL

SEQ ID NO: 33460 - protein, 30 aa, Artificial Sequence
  Description of Artificial Sequence: Synthetic polypeptide
FEEEIRTTNPVATESYGSVSNVNLHRGMQR

SEQ ID NO: 33461 - protein, 32 aa, Artificial Sequence
  Description of Artificial Sequence: Synthetic polypeptide
FEEEIRTTNPVATESYGSVSPTNLQHREGEQR

SEQ ID NO: 33462 - protein, 29 aa, Artificial Sequence
  Description of Artificial Sequence: Synthetic peptide
AEEEIRTTNPVAYEPYGCISINLQRGNNR

SEQ ID NO: 33463 - protein, 33 aa, Artificial Sequence
  Description of Artificial Sequence: Synthetic polypeptide
DEEEIRTTNPVATEQYGSASCLPNMLQRVGNNR

SEQ ID NO: 33464 - protein, 29 aa, Artificial Sequence
  Description of Artificial Sequence: Synthetic peptide
FEEEITTTNPVATEQYGNVSVTGLQGGNE

SEQ ID NO: 33465 - protein, 32 aa, Artificial Sequence
  Description of Artificial Sequence: Synthetic polypeptide
FEEEVRTTNPVATEQYGSVSTWNLDQEIGNNR

SEQ ID NO: 33466 - protein, 31 aa, Artificial Sequence
  Description of Artificial Sequence: Synthetic polypeptide
DEEEIRCTNPVATEQYGSVCSTDGLMFEGNR

SEQ ID NO: 33467 - protein, 31 aa, Artificial Sequence
  Description of Artificial Sequence: Synthetic polypeptide
DEEEIRTTNPVATEQYGSAGANLQRNGNNEQ

SEQ ID NO: 33468 - protein, 31 aa, Artificial Sequence
  Description of Artificial Sequence: Synthetic polypeptide
HEEEIRTTNPVATEQYGSVSPTNLQRNAEEY

SEQ ID NO: 33469 - protein, 31 aa, Artificial Sequence
  Description of Artificial Sequence: Synthetic polypeptide
HEEEIRTTNPVATEQYGSVSTELQRNANFGE

SEQ ID NO: 33470 - protein, 28 aa, Artificial Sequence
  Description of Artificial Sequence: Synthetic peptide
KENEIAATNPVATECYGSVSTELQRGNY

SEQ ID NO: 33471 - protein, 31 aa, Artificial Sequence
  Description of Artificial Sequence: Synthetic polypeptide
DEEEIRCTNPVATEQYGSVSTNLQPRESEED

SEQ ID NO: 33472 - protein, 28 aa, Artificial Sequence
  Description of Artificial Sequence: Synthetic peptide
LEEEIACTNPVATEQYGEASENLQRGGR

SEQ ID NO: 33473 - protein, 30 aa, Artificial Sequence
  Description of Artificial Sequence: Synthetic polypeptide
LEEEIRTTNPIGTEQYGSVSTMNLQRQDNI

SEQ ID NO: 33474 - protein, 30 aa, Artificial Sequence
  Description of Artificial Sequence: Synthetic polypeptide
LEEEIRTTNPVGTEQYGSVSDMNLEQRDNI

SEQ ID NO: 33475 - protein, 31 aa, Artificial Sequence
  Description of Artificial Sequence: Synthetic polypeptide
LEEEIRTTNPVGTEQYGSVSTMNLQQRDDNI

SEQ ID NO: 33476 - protein, 29 aa, Artificial Sequence
  Description of Artificial Sequence: Synthetic peptide
LEEGICTTNPVATEQYGSVSSNVIQRGNS

SEQ ID NO: 33477 - protein, 32 aa, Artificial Sequence
  Description of Artificial Sequence: Synthetic polypeptide
DEEEIRCTNPVATEQYGSVSTNLQRFGSEFDP

SEQ ID NO: 33478 - protein, 30 aa, Artificial Sequence
  Description of Artificial Sequence: Synthetic polypeptide
IEEEIRTTNPVATEQYGSVSTDLGQTEDNE

SEQ ID NO: 33479 - protein, 30 aa, Artificial Sequence
  Description of Artificial Sequence: Synthetic polypeptide
AEEEIRTTNPVATEQYGVVVTSTNLQDGQE

SEQ ID NO: 33480 - protein, 31 aa, Artificial Sequence
  Description of Artificial Sequence: Synthetic polypeptide
AEEEIRTTNPVATEQYGVVVSTNNLEQGGND

SEQ ID NO: 33481 - protein, 31 aa, Artificial Sequence
  Description of Artificial Sequence: Synthetic polypeptide
AEEEIRTTNPVATEQYGVVVSTNLQNGNNAG

SEQ ID NO: 33482 - protein, 31 aa, Artificial Sequence
  Description of Artificial Sequence: Synthetic polypeptide
DEEEIRCTNPVATEQYGSVSTNLQSMSNDNY

SEQ ID NO: 33483 - protein, 31 aa, Artificial Sequence
  Description of Artificial Sequence: Synthetic polypeptide
DEEEIRCTNPVATEQYGSVSTPNGNMRGNPV

SEQ ID NO: 33484 - protein, 29 aa, Artificial Sequence
  Description of Artificial Sequence: Synthetic peptide
MEEEIATTNPVATEQYGCVSGTPLQGDNR

SEQ ID NO: 33485 - protein, 30 aa, Artificial Sequence
  Description of Artificial Sequence: Synthetic polypeptide
DEEEIRTTNPVATEQYGQWGLPNMLQRDNR

SEQ ID NO: 33486 - protein, 31 aa, Artificial Sequence
  Description of Artificial Sequence: Synthetic polypeptide
DEEEIRCTNPVATEQYGSVSVGNHDRGSNSR

SEQ ID NO: 33487 - protein, 30 aa, Artificial Sequence
  Description of Artificial Sequence: Synthetic polypeptide
DEEEIRCTNPVATEQYGSVSVNWDDGSNSR

SEQ ID NO: 33488 - protein, 31 aa, Artificial Sequence
  Description of Artificial Sequence: Synthetic polypeptide
AEEEIRTTNPVATEQYGVVVSTTNLQNGNNG

SEQ ID NO: 33489 - protein, 31 aa, Artificial Sequence
  Description of Artificial Sequence: Synthetic polypeptide
DEEEIRTTNPVATEQYGSACHMTNLQRVVNG

SEQ ID NO: 33490 - protein, 29 aa, Artificial Sequence
  Description of Artificial Sequence: Synthetic peptide
DEEEIRTTNPVATEQYGSACSTDLERNEI

SEQ ID NO: 33491 - protein, 30 aa, Artificial Sequence
  Description of Artificial Sequence: Synthetic polypeptide
HSEEIRTTNPVATDQYGSVSTTLQRGNQFG

SEQ ID NO: 33492 - protein, 31 aa, Artificial Sequence
  Description of Artificial Sequence: Synthetic polypeptide
HEEEIRTTNPVATEQYGSVSTMNNQRNANFY

SEQ ID NO: 33493 - protein, 31 aa, Artificial Sequence
  Description of Artificial Sequence: Synthetic polypeptide
HEEEIRTTNPVATEQYGSVSTNLQGNANDEH

SEQ ID NO: 33494 - protein, 32 aa, Artificial Sequence
  Description of Artificial Sequence: Synthetic polypeptide
HEEEIRTTNPVATEQYGSVSTNLQRNNANDAN

SEQ ID NO: 33495 - protein, 31 aa, Artificial Sequence
  Description of Artificial Sequence: Synthetic polypeptide
AEEEIRTTNPVATESYGSVSTTNLNTGNDQR

SEQ ID NO: 33496 - protein, 30 aa, Artificial Sequence
  Description of Artificial Sequence: Synthetic polypeptide
AEEEIRTTNPVATESYGSVSTNQQQGNGNQ

SEQ ID NO: 33497 - protein, 30 aa, Artificial Sequence
  Description of Artificial Sequence: Synthetic polypeptide
AEEEIRTTNPVATESYGSVSTNLQYQGAAV

SEQ ID NO: 33498 - protein, 32 aa, Artificial Sequence
  Description of Artificial Sequence: Synthetic polypeptide
HEEEIRTTNPVATEQYGSVSTNLQRVNANEDT

SEQ ID NO: 33499 - protein, 31 aa, Artificial Sequence
  Description of Artificial Sequence: Synthetic polypeptide
AEEEIRTTNPVATESYGSVSNTNLTNGNDQR

SEQ ID NO: 33500 - protein, 31 aa, Artificial Sequence
  Description of Artificial Sequence: Synthetic polypeptide
AEEEIRTTNPVATESYGSVSNTNLQTNNDQR

SEQ ID NO: 33501 - protein, 31 aa, Artificial Sequence
  Description of Artificial Sequence: Synthetic polypeptide
DEEEIRCTNPVATEQYGSVSSTALMMRGMNV

SEQ ID NO: 33502 - protein, 31 aa, Artificial Sequence
  Description of Artificial Sequence: Synthetic polypeptide
AEEEIRTTNPVATESYGSVSNTNLNRGTTQR

SEQ ID NO: 33503 - protein, 32 aa, Artificial Sequence
  Description of Artificial Sequence: Synthetic polypeptide
HEEEIRTTNPVATEQYGSVSTSNEGQRGENNI

SEQ ID NO: 33504 - protein, 30 aa, Artificial Sequence
  Description of Artificial Sequence: Synthetic polypeptide
AEEEIRTTNPVATESYGSVSNTNLNIGEQR

SEQ ID NO: 33505 - protein, 32 aa, Artificial Sequence
  Description of Artificial Sequence: Synthetic polypeptide
HEEEIRTTNPVATEQYGTSVSTNLQRNANFCV

SEQ ID NO: 33506 - protein, 32 aa, Artificial Sequence
  Description of Artificial Sequence: Synthetic polypeptide
DEEEIRCTNPVATEQYGSVSSTENLPNRGNPV

SEQ ID NO: 33507 - protein, 33 aa, Artificial Sequence
  Description of Artificial Sequence: Synthetic polypeptide
DEEEIRCTNPVATEQYGSVSSTNLMMRNGMNPR

SEQ ID NO: 33508 - protein, 28 aa, Artificial Sequence
  Description of Artificial Sequence: Synthetic peptide
HENEIACTNPVATEQYGEVSENLQRGGR

SEQ ID NO: 33509 - protein, 29 aa, Artificial Sequence
  Description of Artificial Sequence: Synthetic peptide
HENEIRTTNPVATWPYGSVSTNLQRTGSQ

SEQ ID NO: 33510 - protein, 30 aa, Artificial Sequence
  Description of Artificial Sequence: Synthetic polypeptide
HSEEIRTTNPVATDQYGSVSTTLQRGNDQV

SEQ ID NO: 33511 - protein, 31 aa, Artificial Sequence
  Description of Artificial Sequence: Synthetic polypeptide
DEEEIRCTNPVATEQYGSVATNLQRDAPNPV

SEQ ID NO: 33512 - protein, 30 aa, Artificial Sequence
  Description of Artificial Sequence: Synthetic polypeptide
MEEEIATTNPVATEQYGNVSVTLLQGDGNR

SEQ ID NO: 33513 - protein, 30 aa, Artificial Sequence
  Description of Artificial Sequence: Synthetic polypeptide
DEEEIRCTNPVATEQYGSVATNLQNNNNGH

SEQ ID NO: 33514 - protein, 32 aa, Artificial Sequence
  Description of Artificial Sequence: Synthetic polypeptide
FEEEIRTTNPVATEQYGSVSTTNLQNGGNGGE

SEQ ID NO: 33515 - protein, 33 aa, Artificial Sequence
  Description of Artificial Sequence: Synthetic polypeptide
FEEEIRTTNPVATEQYGSVSDTPNGLQRGNNPQ

SEQ ID NO: 33516 - protein, 31 aa, Artificial Sequence
  Description of Artificial Sequence: Synthetic polypeptide
FEEEIRTTNPVATEQYGSVSEPNLQIGEIRT

SEQ ID NO: 33517 - protein, 29 aa, Artificial Sequence
  Description of Artificial Sequence: Synthetic peptide
DEEEIRTTNPVATEQYGSAVSSNDQMNEQ

SEQ ID NO: 33518 - protein, 33 aa, Artificial Sequence
  Description of Artificial Sequence: Synthetic polypeptide
DEEEIRTTNPVATEQYGSAVSNTENHQNFGSNR

SEQ ID NO: 33519 - protein, 32 aa, Artificial Sequence
  Description of Artificial Sequence: Synthetic polypeptide
DEEEIRTTNPVATEQYGSAVSDTELQRFGSDQ

SEQ ID NO: 33520 - protein, 31 aa, Artificial Sequence
  Description of Artificial Sequence: Synthetic polypeptide
FEEEIRTTNPVATEQYGSVSGTNGQGGTNTI

SEQ ID NO: 33521 - protein, 31 aa, Artificial Sequence
  Description of Artificial Sequence: Synthetic polypeptide
AEEEISTTNPVATEQYGCVCSTNLQRLGSNQ

SEQ ID NO: 33522 - protein, 30 aa, Artificial Sequence
  Description of Artificial Sequence: Synthetic polypeptide
FEEEIRTTNPVATEQYGSVSIEELQRGLQS

SEQ ID NO: 33523 - protein, 30 aa, Artificial Sequence
  Description of Artificial Sequence: Synthetic polypeptide
FEEEIRTTNPVATEQYGSVSATNLNANFNI

SEQ ID NO: 33524 - protein, 32 aa, Artificial Sequence
  Description of Artificial Sequence: Synthetic polypeptide
FEEEIRTTNPVATEQYGSVSITNLQQGGNGNE

SEQ ID NO: 33525 - protein, 31 aa, Artificial Sequence
  Description of Artificial Sequence: Synthetic polypeptide
FEEEIRTTNPVATEQYGSVSPTALQQGNVVN

SEQ ID NO: 33526 - protein, 32 aa, Artificial Sequence
  Description of Artificial Sequence: Synthetic polypeptide
FEEEIRTTNPVATEQYGSVSPTNNLQETGNDN

SEQ ID NO: 33527 - protein, 32 aa, Artificial Sequence
  Description of Artificial Sequence: Synthetic polypeptide
FEEEIRTTNPVATEQYGSVSPTNNQQLGNERE

SEQ ID NO: 33528 - protein, 31 aa, Artificial Sequence
  Description of Artificial Sequence: Synthetic polypeptide
FEEEIRTTNPVATEQYGSVSPTNNQQLGNVQ

SEQ ID NO: 33529 - protein, 32 aa, Artificial Sequence
  Description of Artificial Sequence: Synthetic polypeptide
DEEEIRTTNPVATEQYGSAVCSTELQGFMSNR

SEQ ID NO: 33530 - protein, 30 aa, Artificial Sequence
  Description of Artificial Sequence: Synthetic polypeptide
FEEEIRTTNPVATEQYGSVSSNLQPEMNLS

SEQ ID NO: 33531 - protein, 33 aa, Artificial Sequence
  Description of Artificial Sequence: Synthetic polypeptide
DEEEIRTTNPVATEQYGSASTTNGLQRNGNVEQ

SEQ ID NO: 33532 - protein, 32 aa, Artificial Sequence
  Description of Artificial Sequence: Synthetic polypeptide
FEEEIRTTNPVATEQYGSVSSTNLQNEEGNNN

SEQ ID NO: 33533 - protein, 30 aa, Artificial Sequence
  Description of Artificial Sequence: Synthetic polypeptide
AEEEISTTNPVATEQYGCVCSTELQRGNDP

SEQ ID NO: 33534 - protein, 31 aa, Artificial Sequence
  Description of Artificial Sequence: Synthetic polypeptide
FEEEIRTTNPVATEQYGSVSTDNGQGEGNVI

SEQ ID NO: 33535 - protein, 33 aa, Artificial Sequence
  Description of Artificial Sequence: Synthetic polypeptide
DEEEIRTTNPVATEQYGSAVSTEELQNFGSNNR

SEQ ID NO: 33536 - protein, 32 aa, Artificial Sequence
  Description of Artificial Sequence: Synthetic polypeptide
FEEEIRTTNPVATEQYGSVNTSNMTQRGENTR

SEQ ID NO: 33537 - protein, 32 aa, Artificial Sequence
  Description of Artificial Sequence: Synthetic polypeptide
FEEEIRTTNPVATEQYGCVSTGNLNQYGSNNR

SEQ ID NO: 33538 - protein, 31 aa, Artificial Sequence
  Description of Artificial Sequence: Synthetic polypeptide
FEEEIRTTNPVATEQYGDVSTNLQQGGGNGE

SEQ ID NO: 33539 - protein, 32 aa, Artificial Sequence
  Description of Artificial Sequence: Synthetic polypeptide
DEEEIRTTNPVATEQYGSCIITNDIQRGNDRS

SEQ ID NO: 33540 - protein, 29 aa, Artificial Sequence
  Description of Artificial Sequence: Synthetic peptide
FEEEIRTTNPVATEQYGSCSTGLQREQGD

SEQ ID NO: 33541 - protein, 31 aa, Artificial Sequence
  Description of Artificial Sequence: Synthetic polypeptide
FEEEIRTTNPVATEQYGSVASTPNDQEGTNI

SEQ ID NO: 33542 - protein, 31 aa, Artificial Sequence
  Description of Artificial Sequence: Synthetic polypeptide
FEEEIRTTNPVATEQYGSVDSTNLQHPDNQG

SEQ ID NO: 33543 - protein, 31 aa, Artificial Sequence
  Description of Artificial Sequence: Synthetic polypeptide
DEEEIRTTNPVATEQYGSCATGNDEQRSGND

SEQ ID NO: 33544 - protein, 31 aa, Artificial Sequence
  Description of Artificial Sequence: Synthetic polypeptide
DEEEIRTTNPVATEQYGSCAGLINMLQRDNR

SEQ ID NO: 33545 - protein, 31 aa, Artificial Sequence
  Description of Artificial Sequence: Synthetic polypeptide
FEEEIRTTNPVATEQYGSVSANLQQSGTNVP

SEQ ID NO: 33546 - protein, 31 aa, Artificial Sequence
  Description of Artificial Sequence: Synthetic polypeptide
DEEEIRTTNPVATEQYGSCAAGNNLQREANR

SEQ ID NO: 33547 - protein, 30 aa, Artificial Sequence
  Description of Artificial Sequence: Synthetic polypeptide
DEEEIRTTNPVATEQYGSCAAGNMLQRDNM

SEQ ID NO: 33548 - protein, 30 aa, Artificial Sequence
  Description of Artificial Sequence: Synthetic polypeptide
DEEEIRTTNPVATEQYGSAVTNDQRNNIEQ

SEQ ID NO: 33549 - protein, 32 aa, Artificial Sequence
  Description of Artificial Sequence: Synthetic polypeptide
DEEEIRTTNPVATEQYGSAVSTNLQGFQSNDS

SEQ ID NO: 33550 - protein, 33 aa, Artificial Sequence
  Description of Artificial Sequence: Synthetic polypeptide
FEEEIRTTNPVATEQYGSVLVTSNLVQRGENYR

SEQ ID NO: 33551 - protein, 30 aa, Artificial Sequence
  Description of Artificial Sequence: Synthetic polypeptide
AEEEISTTNPVATEQYGNVSVTMNLQGGNN

SEQ ID NO: 33552 - protein, 29 aa, Artificial Sequence
  Description of Artificial Sequence: Synthetic peptide
FEEEIRTTNPVATEQYGSVNSTELSTGVV

SEQ ID NO: 33553 - protein, 30 aa, Artificial Sequence
  Description of Artificial Sequence: Synthetic polypeptide
AEEEISTTNPVATEQYGCVSVTALNQGGNR

SEQ ID NO: 33554 - protein, 32 aa, Artificial Sequence
  Description of Artificial Sequence: Synthetic polypeptide
FEEEIRTTNPVATEQYGSVNTSNLEQNGENYR

SEQ ID NO: 33555 - protein, 32 aa, Artificial Sequence
  Description of Artificial Sequence: Synthetic polypeptide
FEEEIRTTNPVATEQYGSVGSTNLQQGGGNGT

SEQ ID NO: 33556 - protein, 31 aa, Artificial Sequence
  Description of Artificial Sequence: Synthetic polypeptide
FEEEIRTTNPVATEQYGSVSTGLQRNANEQE

SEQ ID NO: 33557 - protein, 31 aa, Artificial Sequence
  Description of Artificial Sequence: Synthetic polypeptide
FEEEIRTTNPVATEQYGSVSTGNGQGGNNTI

SEQ ID NO: 33558 - protein, 32 aa, Artificial Sequence
  Description of Artificial Sequence: Synthetic polypeptide
FEEEIRTTNPVATEQYGSVSTGNLQQGGNEGE

SEQ ID NO: 33559 - protein, 30 aa, Artificial Sequence
  Description of Artificial Sequence: Synthetic polypeptide
FEEEIRTTNPVATEQYGSVSTNVNVGVNLQ

SEQ ID NO: 33560 - protein, 33 aa, Artificial Sequence
  Description of Artificial Sequence: Synthetic polypeptide
DEEEIRTTNPVATEQYGSASPTNLIQMRLGELR

SEQ ID NO: 33561 - protein, 33 aa, Artificial Sequence
  Description of Artificial Sequence: Synthetic polypeptide
FEEEIRTTNPVATEQYGSVSTPNGLMQRGVNNP

SEQ ID NO: 33562 - protein, 31 aa, Artificial Sequence
  Description of Artificial Sequence: Synthetic polypeptide
FEEEIRTTNPVATEQYGSVSTPNLQTGEVDG

SEQ ID NO: 33563 - protein, 33 aa, Artificial Sequence
  Description of Artificial Sequence: Synthetic polypeptide
DEEEIRTTNPVATEQYGSASPTENHQLREGPNR

SEQ ID NO: 33564 - protein, 29 aa, Artificial Sequence
  Description of Artificial Sequence: Synthetic peptide
DEEEIRTTNPVATEQYGSASPEDLQGGEN

SEQ ID NO: 33565 - protein, 31 aa, Artificial Sequence
  Description of Artificial Sequence: Synthetic polypeptide
DEEEIRTTNPVATEQYGSASPANLQTGLENL

SEQ ID NO: 33566 - protein, 33 aa, Artificial Sequence
  Description of Artificial Sequence: Synthetic polypeptide
DEEEIRTTNPVATEQYGSASMTENLSQRISNQR

SEQ ID NO: 33567 - protein, 32 aa, Artificial Sequence
  Description of Artificial Sequence: Synthetic polypeptide
FEEEIRTTNPVATEQYGSVSTNNLQTEMGTNE

SEQ ID NO: 33568 - protein, 32 aa, Artificial Sequence
  Description of Artificial Sequence: Synthetic polypeptide
FEEEIRTTNPVATEQYGSVSTSNEGQRGDNDG

SEQ ID NO: 33569 - protein, 30 aa, Artificial Sequence
  Description of Artificial Sequence: Synthetic polypeptide
DEEEIRCTNPVATEQYGSVATNLQENGDDT

SEQ ID NO: 33570 - protein, 32 aa, Artificial Sequence
  Description of Artificial Sequence: Synthetic polypeptide
FEEEIRTTNPVATEQYGSVSTTNLQEGGGNDD

SEQ ID NO: 33571 - protein, 32 aa, Artificial Sequence
  Description of Artificial Sequence: Synthetic polypeptide
FEEEIRTTNPVATEQYGSVSTTNLQEGGNDGD

SEQ ID NO: 33572 - protein, 32 aa, Artificial Sequence
  Description of Artificial Sequence: Synthetic polypeptide
FEEEIRTTNPVATEQYGSVSTTNLQEGGNGNN

SEQ ID NO: 33573 - protein, 30 aa, Artificial Sequence
  Description of Artificial Sequence: Synthetic polypeptide
DEEEIRTTNPVATEQYGSYSPPNLQIGLVN

SEQ ID NO: 33574 - protein, 32 aa, Artificial Sequence
  Description of Artificial Sequence: Synthetic polypeptide
FEEEIRTTNPVATEQYGSVSTTNLQGTGNEQI

SEQ ID NO: 33575 - protein, 32 aa, Artificial Sequence
  Description of Artificial Sequence: Synthetic polypeptide
FEEEIRTTNPVATEQYGSVSTTNLQMGGNEGG

SEQ ID NO: 33576 - protein, 32 aa, Artificial Sequence
  Description of Artificial Sequence: Synthetic polypeptide
FEEEIRTTNPVATEQYGSVSTTNLQMTGNGNE

SEQ ID NO: 33577 - protein, 32 aa, Artificial Sequence
  Description of Artificial Sequence: Synthetic polypeptide
FEEEIRTTNPVATEQYGSVSTSNLIERMENYR

SEQ ID NO: 33578 - protein, 30 aa, Artificial Sequence
  Description of Artificial Sequence: Synthetic polypeptide
FEEEIRTTNPVATEQYGSVSTNLVVMENVD

SEQ ID NO: 33579 - protein, 32 aa, Artificial Sequence
  Description of Artificial Sequence: Synthetic polypeptide
FEEEIRTTNPVATEQYGSVSTNLTQGGGNIQQ

SEQ ID NO: 33580 - protein, 32 aa, Artificial Sequence
  Description of Artificial Sequence: Synthetic polypeptide
FEEEIRTTNPVATEQYGSVSTNLQQNNGNEQG

SEQ ID NO: 33581 - protein, 31 aa, Artificial Sequence
  Description of Artificial Sequence: Synthetic polypeptide
FEEEIRTTNPVATEQYGSVSTGNTGQGGGNI

SEQ ID NO: 33582 - protein, 31 aa, Artificial Sequence
  Description of Artificial Sequence: Synthetic polypeptide
DEEEIRCTNPVATEQYGCVSMTNLFQGMGNV

SEQ ID NO: 33583 - protein, 32 aa, Artificial Sequence
  Description of Artificial Sequence: Synthetic polypeptide
DEEEIRCTNPVATEQYGCVSMTNLFQGSGNRG

SEQ ID NO: 33584 - protein, 30 aa, Artificial Sequence
  Description of Artificial Sequence: Synthetic polypeptide
DEEEIRCTNPVATEQYGCVSSNEDRGSNSR

SEQ ID NO: 33585 - protein, 31 aa, Artificial Sequence
  Description of Artificial Sequence: Synthetic polypeptide
DEEEIRCTNPVATEQYGCVSTNLQRFGSELT

SEQ ID NO: 33586 - protein, 31 aa, Artificial Sequence
  Description of Artificial Sequence: Synthetic polypeptide
DEEEIRTTNPVATEQYGSASTNLNQRILDED

SEQ ID NO: 33587 - protein, 31 aa, Artificial Sequence
  Description of Artificial Sequence: Synthetic polypeptide
DEEEIRTTNPVATEQYGSASTNLEVQGNSLL

SEQ ID NO: 33588 - protein, 30 aa, Artificial Sequence
  Description of Artificial Sequence: Synthetic polypeptide
DEEEIRCTNPVATEQYGDVSENLMNRAENR

SEQ ID NO: 33589 - protein, 32 aa, Artificial Sequence
  Description of Artificial Sequence: Synthetic polypeptide
FEEEIRTTNPVATEQYGSVSTMNLEQNGENEF

SEQ ID NO: 33590 - protein, 31 aa, Artificial Sequence
  Description of Artificial Sequence: Synthetic polypeptide
FEEEIRTTNPVATEQYGSVSTMNLINRSMNV

SEQ ID NO: 33591 - protein, 32 aa, Artificial Sequence
  Description of Artificial Sequence: Synthetic polypeptide
FEEEIRTTNPVATEQYGSVSTMNLNQGGSNTQ

SEQ ID NO: 33592 - protein, 31 aa, Artificial Sequence
  Description of Artificial Sequence: Synthetic polypeptide
FEEEIRTTNPVATEQYGSVSTMNQGQNGGNE

SEQ ID NO: 33593 - protein, 32 aa, Artificial Sequence
  Description of Artificial Sequence: Synthetic polypeptide
FEEEIRTTNPVATEQYGSVSTMNQLNQNGGNV

SEQ ID NO: 33594 - protein, 30 aa, Artificial Sequence
  Description of Artificial Sequence: Synthetic polypeptide
DEEEIRCTNPVATEQYGFVSVNQDRGSNSR

SEQ ID NO: 33595 - protein, 31 aa, Artificial Sequence
  Description of Artificial Sequence: Synthetic polypeptide
FEEEIRTTNPVATEQYGSVSTNGQDRPGFVE

SEQ ID NO: 33596 - protein, 31 aa, Artificial Sequence
  Description of Artificial Sequence: Synthetic polypeptide
FEEEIRTTNPVATEQYGSVSTNGQGGNGNTI

SEQ ID NO: 33597 - protein, 32 aa, Artificial Sequence
  Description of Artificial Sequence: Synthetic polypeptide
FEEEIRTTNPVATEQYGSVSTNLNEQVGNNID

SEQ ID NO: 33598 - protein, 32 aa, Artificial Sequence
  Description of Artificial Sequence: Synthetic polypeptide
FEEEIRTTNPVATEQYGSVSTNLQDGGNQNIG

SEQ ID NO: 33599 - protein, 31 aa, Artificial Sequence
  Description of Artificial Sequence: Synthetic polypeptide
DEEEIRTTNPVATEQYGSASPTTNLERINWN

SEQ ID NO: 33600 - protein, 32 aa, Artificial Sequence
  Description of Artificial Sequence: Synthetic polypeptide
FEEEIRTTNPVATEQYGSVSTTNLQQIGQNGG

SEQ ID NO: 33601 - protein, 31 aa, Artificial Sequence
  Description of Artificial Sequence: Synthetic polypeptide
DEEEIRGTNPVATEQYGSVSVLNQDRGANSR

SEQ ID NO: 33602 - protein, 31 aa, Artificial Sequence
  Description of Artificial Sequence: Synthetic polypeptide
DEEEIRCTNPVATEQYGSVSVYNQDRGSNSR

SEQ ID NO: 33603 - protein, 29 aa, Artificial Sequence
  Description of Artificial Sequence: Synthetic peptide
MEEEICTTNPVATEQYGNVSVTVLQGGER

SEQ ID NO: 33604 - protein, 33 aa, Artificial Sequence
  Description of Artificial Sequence: Synthetic polypeptide
DEEEIRTTNPVATEQYGQSVCSTNDLTRGSNQL

SEQ ID NO: 33605 - protein, 31 aa, Artificial Sequence
  Description of Artificial Sequence: Synthetic polypeptide
NEAEIRTTNPVATEQYGSVSTNLQAGDGQNQ

SEQ ID NO: 33606 - protein, 31 aa, Artificial Sequence
  Description of Artificial Sequence: Synthetic polypeptide
NEAEIRTTNPVATEQYGSVSTNLQGDGDNEG

SEQ ID NO: 33607 - protein, 30 aa, Artificial Sequence
  Description of Artificial Sequence: Synthetic polypeptide
NEAEIRTTNPVATEQYGSVSTNLQGDGQQQ

SEQ ID NO: 33608 - protein, 31 aa, Artificial Sequence
  Description of Artificial Sequence: Synthetic polypeptide
NEAEIRTTNPVATEQYGSVSTNLQNSGDNNM

SEQ ID NO: 33609 - protein, 31 aa, Artificial Sequence
  Description of Artificial Sequence: Synthetic polypeptide
NEAEIRTTNPVATEQYGSVSTNLQQGDGNDQ

SEQ ID NO: 33610 - protein, 30 aa, Artificial Sequence
  Description of Artificial Sequence: Synthetic polypeptide
NEAEIRTTNPVATEQYGSVWCTNLQIPGSR

SEQ ID NO: 33611 - protein, 30 aa, Artificial Sequence
  Description of Artificial Sequence: Synthetic polypeptide
NEAEIRTTNPVATEQYGSVWTDNLQGIGSR

SEQ ID NO: 33612 - protein, 32 aa, Artificial Sequence
  Description of Artificial Sequence: Synthetic polypeptide
DEEEIRTTNPVATEQYGQSVCSTNEQHFGSNQ

SEQ ID NO: 33613 - protein, 29 aa, Artificial Sequence
  Description of Artificial Sequence: Synthetic peptide
NEAEIRTTNPVATEQYGSVWTNHQEIGSR

SEQ ID NO: 33614 - protein, 31 aa, Artificial Sequence
  Description of Artificial Sequence: Synthetic polypeptide
AEEEIRTTNPVATEQYGVVSTTNLQTGGNAE

SEQ ID NO: 33615 - protein, 31 aa, Artificial Sequence
  Description of Artificial Sequence: Synthetic polypeptide
AEEEIRTTNPVATEQYGVVSTTNLQQNGTNA

SEQ ID NO: 33616 - protein, 33 aa, Artificial Sequence
  Description of Artificial Sequence: Synthetic polypeptide
DEEEIRTTNPVATEQYGQSVCSTETQRGSNFRT

SEQ ID NO: 33617 - protein, 31 aa, Artificial Sequence
  Description of Artificial Sequence: Synthetic polypeptide
AEEEIRTTNPVATEQYGVVSTTNLQQGVNVD

SEQ ID NO: 33618 - protein, 31 aa, Artificial Sequence
  Description of Artificial Sequence: Synthetic polypeptide
AEEEIRTTNPVATEQYGVVSTTNLQMGGNGE

SEQ ID NO: 33619 - protein, 33 aa, Artificial Sequence
  Description of Artificial Sequence: Synthetic polypeptide
DEEEIRTTNPVATEQYGQSVCSTELQRFGSNFP

SEQ ID NO: 33620 - protein, 32 aa, Artificial Sequence
  Description of Artificial Sequence: Synthetic polypeptide
DEEEIRTTNPVATEQYGQSVCSTELQFSSNRV

SEQ ID NO: 33621 - protein, 31 aa, Artificial Sequence
  Description of Artificial Sequence: Synthetic polypeptide
AEEEIRTTNPVATEQYGVVSTTNLQDEGNNE

SEQ ID NO: 33622 - protein, 30 aa, Artificial Sequence
  Description of Artificial Sequence: Synthetic polypeptide
NEAEIRTTNPVATEQYGVVSTNLQHNGGNA

SEQ ID NO: 33623 - protein, 31 aa, Artificial Sequence
  Description of Artificial Sequence: Synthetic polypeptide
AEEEIRTTNPVATEQYGVVSTTNLQAGGNVE

SEQ ID NO: 33624 - protein, 31 aa, Artificial Sequence
  Description of Artificial Sequence: Synthetic polypeptide
NEAEIRTTNPVATEPYGSVSTNLQEGGENHR

SEQ ID NO: 33625 - protein, 30 aa, Artificial Sequence
  Description of Artificial Sequence: Synthetic polypeptide
NEAEIRTTNPVATEHYGSVSTNLQANGDND

SEQ ID NO: 33626 - protein, 29 aa, Artificial Sequence
  Description of Artificial Sequence: Synthetic peptide
NAGEIATTNPVATEQYGVVSTNLQDGPNR

SEQ ID NO: 33627 - protein, 29 aa, Artificial Sequence
  Description of Artificial Sequence: Synthetic peptide
NAGEIRTTNPVATEQYGSVSTVPLQLGER

SEQ ID NO: 33628 - protein, 33 aa, Artificial Sequence
  Description of Artificial Sequence: Synthetic polypeptide
DEEEIRTTNPVATEQYGQSVCSTNLQHNSNTRL

SEQ ID NO: 33629 - protein, 30 aa, Artificial Sequence
  Description of Artificial Sequence: Synthetic polypeptide
NDEEIRTTNPVATEQYGVVCSWNLQSGSNR

SEQ ID NO: 33630 - protein, 32 aa, Artificial Sequence
  Description of Artificial Sequence: Synthetic polypeptide
DEEEIRTTNPVATEQYGQSVCSTNLQGISNNQ

SEQ ID NO: 33631 - protein, 32 aa, Artificial Sequence
  Description of Artificial Sequence: Synthetic polypeptide
DEEEIRTTNPVATEQYGQSVCSTNLISFGSDR

SEQ ID NO: 33632 - protein, 31 aa, Artificial Sequence
  Description of Artificial Sequence: Synthetic polypeptide
DEEEIRGTNPVATEQYGAVWSTINTLQRENN

SEQ ID NO: 33633 - protein, 31 aa, Artificial Sequence
  Description of Artificial Sequence: Synthetic polypeptide
NDEEIRTTNPVATEQYGVVSTNLQNIGSNRF

SEQ ID NO: 33634 - protein, 31 aa, Artificial Sequence
  Description of Artificial Sequence: Synthetic polypeptide
DEEEIRTTNPVATEQYGQSVCSTNHERGSDD

SEQ ID NO: 33635 - protein, 30 aa, Artificial Sequence
  Description of Artificial Sequence: Synthetic polypeptide
NDEEIRTTNPVATEQYGVVSTNLQNMGSNQ

SEQ ID NO: 33636 - protein, 28 aa, Artificial Sequence
  Description of Artificial Sequence: Synthetic peptide
NDESIRTTNPVATEQYGHVSTNHQRDNL

SEQ ID NO: 33637 - protein, 30 aa, Artificial Sequence
  Description of Artificial Sequence: Synthetic polypeptide
NEAEIATTNPVATEPYGSVSTNLQGEGNTR

SEQ ID NO: 33638 - protein, 31 aa, Artificial Sequence
  Description of Artificial Sequence: Synthetic polypeptide
DEEEIRGTNPVATEQYGCVSMTNLFQEGGNQ

SEQ ID NO: 33639 - protein, 30 aa, Artificial Sequence
  Description of Artificial Sequence: Synthetic polypeptide
NEAEIATTNPVATEQYGSVSTNLQGDGNQE

SEQ ID NO: 33640 - protein, 30 aa, Artificial Sequence
  Description of Artificial Sequence: Synthetic polypeptide
NEAEIATTNPVATEQYGSVSTNLQHDGNHQ

SEQ ID NO: 33641 - protein, 31 aa, Artificial Sequence
  Description of Artificial Sequence: Synthetic polypeptide
DEEEIRTTNPVATEQYGQSVCSTNHQSFGDQ

SEQ ID NO: 33642 - protein, 32 aa, Artificial Sequence
  Description of Artificial Sequence: Synthetic polypeptide
DEEEIRTTNPVATEQYGQSVCSTNHQNGNFQS

SEQ ID NO: 33643 - protein, 30 aa, Artificial Sequence
  Description of Artificial Sequence: Synthetic polypeptide
NEAEIRTTNPCATEQYGSVSTNLQHDGNNQ

SEQ ID NO: 33644 - protein, 30 aa, Artificial Sequence
  Description of Artificial Sequence: Synthetic polypeptide
NDEEIRTTNPVATEQYGVVSWNLQHGSNRA

SEQ ID NO: 33645 - protein, 32 aa, Artificial Sequence
  Description of Artificial Sequence: Synthetic polypeptide
DEEEIRTTNPVATEQYGQSVCSSNLQRGSEAQ

SEQ ID NO: 33646 - protein, 29 aa, Artificial Sequence
  Description of Artificial Sequence: Synthetic peptide
NEDEIRTTNPVATEQYGSVDITNLQIGQA

SEQ ID NO: 33647 - protein, 29 aa, Artificial Sequence
  Description of Artificial Sequence: Synthetic peptide
NEDEIRTTNPVATEQYGSVDNTNLQIGSG

SEQ ID NO: 33648 - protein, 31 aa, Artificial Sequence
  Description of Artificial Sequence: Synthetic polypeptide
DEEEIRTTNPVATEQYGQCVSTNHQFSNSDR

SEQ ID NO: 33649 - protein, 32 aa, Artificial Sequence
  Description of Artificial Sequence: Synthetic polypeptide
DEEEIRTTNPVATEQYGQCVSTNDQERGSNQG

SEQ ID NO: 33650 - protein, 33 aa, Artificial Sequence
  Description of Artificial Sequence: Synthetic polypeptide
DEEEIRTTNPVATEQYGQCVSTNDLQRFGSNQG

SEQ ID NO: 33651 - protein, 32 aa, Artificial Sequence
  Description of Artificial Sequence: Synthetic polypeptide
DEEEIRTTNPVATEQYGQCVSTNDLQFSNSNR

SEQ ID NO: 33652 - protein, 31 aa, Artificial Sequence
  Description of Artificial Sequence: Synthetic polypeptide
AEEEIRTTNPVATEQYGVVSSTTNLQNGNET

SEQ ID NO: 33653 - protein, 31 aa, Artificial Sequence
  Description of Artificial Sequence: Synthetic polypeptide
AEEEIRTTNPVATEQYGVVSSTTNLQENGNE

SEQ ID NO: 33654 - protein, 30 aa, Artificial Sequence
  Description of Artificial Sequence: Synthetic polypeptide
AEEEIRTTNPVATEQYGVVSSTTNLNNGNS

SEQ ID NO: 33655 - protein, 31 aa, Artificial Sequence
  Description of Artificial Sequence: Synthetic polypeptide
AEEEIRTTNPVATEQYGVVSSTNLQMGENGT

SEQ ID NO: 33656 - protein, 31 aa, Artificial Sequence
  Description of Artificial Sequence: Synthetic polypeptide
DEEEIRTTNPVATEQYGQCVSTNHQGFGGNQ

SEQ ID NO: 33657 - protein, 32 aa, Artificial Sequence
  Description of Artificial Sequence: Synthetic polypeptide
DEEEIRTTNPVATEQYGQCVSTMNLQRGSEQG

SEQ ID NO: 33658 - protein, 32 aa, Artificial Sequence
  Description of Artificial Sequence: Synthetic polypeptide
AEEEIRTTNPVATEQYGVVCSTGNLQRGSNDP

SEQ ID NO: 33659 - protein, 31 aa, Artificial Sequence
  Description of Artificial Sequence: Synthetic polypeptide
NEEEIACTNPVATEQYGSVATNLQRDGNDRN

SEQ ID NO: 33660 - protein, 32 aa, Artificial Sequence
  Description of Artificial Sequence: Synthetic polypeptide
DEEEIRTTNPVATEQYGQCVSTENLQFGSNQG

SEQ ID NO: 33661 - protein, 29 aa, Artificial Sequence
  Description of Artificial Sequence: Synthetic peptide
NEEEIACTNPVATEQYGSVATNLQSGDND

SEQ ID NO: 33662 - protein, 30 aa, Artificial Sequence
  Description of Artificial Sequence: Synthetic polypeptide
DEEEIRGTNPVATEQYGSVSSVVDRGSNSR

SEQ ID NO: 33663 - protein, 30 aa, Artificial Sequence
  Description of Artificial Sequence: Synthetic polypeptide
NEEEIATTNPVATEHYGSVSTNLQQGNEQM

SEQ ID NO: 33664 - protein, 30 aa, Artificial Sequence
  Description of Artificial Sequence: Synthetic polypeptide
NEEEIATTNPVATEIYGSVSTNLQRNANED

SEQ ID NO: 33665 - protein, 29 aa, Artificial Sequence
  Description of Artificial Sequence: Synthetic peptide
NEEEIATTNPVATEMWGSVSTNLQGGNDA

SEQ ID NO: 33666 - protein, 31 aa, Artificial Sequence
  Description of Artificial Sequence: Synthetic polypeptide
AEEEIRTTNPVATEQYGVVCSTNLQNFGNQP

SEQ ID NO: 33667 - protein, 30 aa, Artificial Sequence
  Description of Artificial Sequence: Synthetic polypeptide
AEEEIRTTNPVATEQYGVVSTNLQDGEQEQ

SEQ ID NO: 33668 - protein, 31 aa, Artificial Sequence
  Description of Artificial Sequence: Synthetic polypeptide
AEEEIRTTNPVATEQYGVVSTNLQMGGNNNS

SEQ ID NO: 33669 - protein, 29 aa, Artificial Sequence
  Description of Artificial Sequence: Synthetic peptide
AEEEIRTTNPVATEQYGVVSTNNLIGGEE

SEQ ID NO: 33670 - protein, 31 aa, Artificial Sequence
  Description of Artificial Sequence: Synthetic polypeptide
DEEEIRTTNPVATEQYGQSVCSSNHQHFGND

SEQ ID NO: 33671 - protein, 32 aa, Artificial Sequence
  Description of Artificial Sequence: Synthetic polypeptide
DEEEIRTTNPVATEQYGQSVCSSELQRGSNAS

SEQ ID NO: 33672 - protein, 29 aa, Artificial Sequence
  Description of Artificial Sequence: Synthetic peptide
NEDEIRTTNPVATEQYGSVDTNLQAEGSN

SEQ ID NO: 33673 - protein, 30 aa, Artificial Sequence
  Description of Artificial Sequence: Synthetic polypeptide
NEDEIRTTNPVATEQYGSVDTNLQIEGGNI

SEQ ID NO: 33674 - protein, 29 aa, Artificial Sequence
  Description of Artificial Sequence: Synthetic peptide
NEDEIRTTNPVATEQYGSVDTNLQIGGIT

SEQ ID NO: 33675 - protein, 33 aa, Artificial Sequence
  Description of Artificial Sequence: Synthetic polypeptide
DEEEIRTTNPVATEQYGQSVCSLDNLQRGSNGS

SEQ ID NO: 33676 - protein, 29 aa, Artificial Sequence
  Description of Artificial Sequence: Synthetic peptide
NEDEIRTTNPVATEQYGSVITNLQIGQSN

SEQ ID NO: 33677 - protein, 29 aa, Artificial Sequence
  Description of Artificial Sequence: Synthetic peptide
NEEEIACTNPVATEHYGVVSTNLQRGNQY

SEQ ID NO: 33678 - protein, 32 aa, Artificial Sequence
  Description of Artificial Sequence: Synthetic polypeptide
DEEEIRTTNPVATEQYGQCVSTTELQHGSNRS

SEQ ID NO: 33679 - protein, 31 aa, Artificial Sequence
  Description of Artificial Sequence: Synthetic polypeptide
DEEEIRTTNPVATEQYGQCVSTSMLQENENR

SEQ ID NO: 33680 - protein, 33 aa, Artificial Sequence
  Description of Artificial Sequence: Synthetic polypeptide
DEEEIRTTNPVATEQYGQCVSTNLQRFMSNNRS

SEQ ID NO: 33681 - protein, 31 aa, Artificial Sequence
  Description of Artificial Sequence: Synthetic polypeptide
DEEEIRTTNPVATEQYGQCVSTNLQNNSNQG

SEQ ID NO: 33682 - protein, 30 aa, Artificial Sequence
  Description of Artificial Sequence: Synthetic polypeptide
DEEEIRGTNPVATEQYGSVSDNQDRGSNSD

SEQ ID NO: 33683 - protein, 29 aa, Artificial Sequence
  Description of Artificial Sequence: Synthetic peptide
NEEEIACTNPVATEQYGSVATNLQAGNEN

SEQ ID NO: 33684 - protein, 31 aa, Artificial Sequence
  Description of Artificial Sequence: Synthetic polypeptide
DEEEIRTTNPVATEQYGQCVSTNLERGSQDG

SEQ ID NO: 33685 - protein, 31 aa, Artificial Sequence
  Description of Artificial Sequence: Synthetic polypeptide
DEEEIRTTNPVATEQYGQCVSTNLERGSDQM

SEQ ID NO: 33686 - protein, 31 aa, Artificial Sequence
  Description of Artificial Sequence: Synthetic polypeptide
DEEEIRTTNPVATEQYGQCVSTNHTRGSNQG

SEQ ID NO: 33687 - protein, 32 aa, Artificial Sequence
  Description of Artificial Sequence: Synthetic polypeptide
DEEEIRTTNPVATEQYGQCVSTNHQRGGSERF

SEQ ID NO: 33688 - protein, 30 aa, Artificial Sequence
  Description of Artificial Sequence: Synthetic polypeptide
AEEEIRTTNPVATEQYGVVSTNNNQFGNSA

SEQ ID NO: 33689 - protein, 32 aa, Artificial Sequence
  Description of Artificial Sequence: Synthetic polypeptide
DEEEIRTTNPVATEQYGQSVCSWNHQNGSNNR

SEQ ID NO: 33690 - protein, 29 aa, Artificial Sequence
  Description of Artificial Sequence: Synthetic peptide
MEEEIATTNPVATEQYGTVSVTELQGGNA

SEQ ID NO: 33691 - protein, 30 aa, Artificial Sequence
  Description of Artificial Sequence: Synthetic polypeptide
NAEEIATTNPVATEQYGVVSTNLQDGENDR

SEQ ID NO: 33692 - protein, 34 aa, Artificial Sequence
  Description of Artificial Sequence: Synthetic polypeptide
DEEEIRTTNPVATEQYGQSVPSENLSQRTGGNNR

SEQ ID NO: 33693 - protein, 28 aa, Artificial Sequence
  Description of Artificial Sequence: Synthetic peptide
MEEEIRATNPCATEQYGSVSENLMFGNI

SEQ ID NO: 33694 - protein, 29 aa, Artificial Sequence
  Description of Artificial Sequence: Synthetic peptide
MEEEIRATNPCATEQYGSVSENLMGGNQR

SEQ ID NO: 33695 - protein, 29 aa, Artificial Sequence
  Description of Artificial Sequence: Synthetic peptide
MEEEIRCTNPAATEQYGSVSENGMREGNR

SEQ ID NO: 33696 - protein, 28 aa, Artificial Sequence
  Description of Artificial Sequence: Synthetic peptide
MEEEIRTCNPVATEQYGSVSTALTRNQQ

SEQ ID NO: 33697 - protein, 31 aa, Artificial Sequence
  Description of Artificial Sequence: Synthetic polypeptide
MEEEIRTTNPVATECYGSVSTNLQDNEGNDM

SEQ ID NO: 33698 - protein, 32 aa, Artificial Sequence
  Description of Artificial Sequence: Synthetic polypeptide
MEEEIRTTNPVATEQYGCVCSTNLQRFGSEND

SEQ ID NO: 33699 - protein, 30 aa, Artificial Sequence
  Description of Artificial Sequence: Synthetic polypeptide
MEEEIRTTNPVATEQYGCVSMTENTERENR

SEQ ID NO: 33700 - protein, 31 aa, Artificial Sequence
  Description of Artificial Sequence: Synthetic polypeptide
MEEEIRTTNPVATEQYGCVSTNLNQRFGSEQ

SEQ ID NO: 33701 - protein, 28 aa, Artificial Sequence
  Description of Artificial Sequence: Synthetic peptide
MEEEIRATNPCATEQYGSVSENLIAGNM

SEQ ID NO: 33702 - protein, 30 aa, Artificial Sequence
  Description of Artificial Sequence: Synthetic polypeptide
MEEEIRTTNPVATEQYGCVSTPNLQNNTRA

SEQ ID NO: 33703 - protein, 29 aa, Artificial Sequence
  Description of Artificial Sequence: Synthetic peptide
MEEEIRTTNPVATEQYGSVATALQNGDFQ

SEQ ID NO: 33704 - protein, 29 aa, Artificial Sequence
  Description of Artificial Sequence: Synthetic peptide
MEEEIRTTNPVATEQYGSVATSALVNGFR

SEQ ID NO: 33705 - protein, 30 aa, Artificial Sequence
  Description of Artificial Sequence: Synthetic polypeptide
DEEEIRTTNPVATEQYGQVSTNLIHFSEFR

SEQ ID NO: 33706 - protein, 31 aa, Artificial Sequence
  Description of Artificial Sequence: Synthetic polypeptide
MEEEIRTTNPVATEQYGSVDSTSNLQPTANG

SEQ ID NO: 33707 - protein, 30 aa, Artificial Sequence
  Description of Artificial Sequence: Synthetic polypeptide
DEEEIRTTNPVATEQYGQVSTLDQIGINPF

SEQ ID NO: 33708 - protein, 33 aa, Artificial Sequence
  Description of Artificial Sequence: Synthetic polypeptide
MEEEIRTTNPVATEQYGSVNETSNLQQRGENYR

SEQ ID NO: 33709 - protein, 31 aa, Artificial Sequence
  Description of Artificial Sequence: Synthetic polypeptide
MEEEIRTTNPVATEQYGSVSCTLNTQEGGNN

SEQ ID NO: 33710 - protein, 33 aa, Artificial Sequence
  Description of Artificial Sequence: Synthetic polypeptide
MEEEIRTTNPVATEQYGSVSDTSNLQQRGENNQ

SEQ ID NO: 33711 - protein, 28 aa, Artificial Sequence
  Description of Artificial Sequence: Synthetic peptide
MEEEIRTTNPVATEQYGSGYTALENGFR

SEQ ID NO: 33712 - protein, 31 aa, Artificial Sequence
  Description of Artificial Sequence: Synthetic polypeptide
MEEEIRTTNPVATEQYGSVSDTWLEQNSQNR

SEQ ID NO: 33713 - protein, 32 aa, Artificial Sequence
  Description of Artificial Sequence: Synthetic polypeptide
DEEEIRTTNPVATEQYGQVSTSLSPRAGGNRC

SEQ ID NO: 33714 - protein, 32 aa, Artificial Sequence
  Description of Artificial Sequence: Synthetic polypeptide
DEEEIRTTNPVATEQYGQVSWTENDNRGMNER

SEQ ID NO: 33715 - protein, 30 aa, Artificial Sequence
  Description of Artificial Sequence: Synthetic polypeptide
DEEEIRCTNPVATEQYGSVSWNPDRGSNSI

SEQ ID NO: 33716 - protein, 29 aa, Artificial Sequence
  Description of Artificial Sequence: Synthetic peptide
MEEEICTTNPVATEQYGVVSVTVLQGGNS

SEQ ID NO: 33717 - protein, 29 aa, Artificial Sequence
  Description of Artificial Sequence: Synthetic peptide
MEEEIGTTNPVATEQYGNVSATMLQNGNG

SEQ ID NO: 33718 - protein, 29 aa, Artificial Sequence
  Description of Artificial Sequence: Synthetic peptide
MEEEIGTTNPVATEQYGNVSVTMLQNGQR

SEQ ID NO: 33719 - protein, 30 aa, Artificial Sequence
  Description of Artificial Sequence: Synthetic polypeptide
MEEEIKTTNPVATEQYGNVSVNMNLQGGNR

SEQ ID NO: 33720 - protein, 30 aa, Artificial Sequence
  Description of Artificial Sequence: Synthetic polypeptide
AEEEIRTTNPVATEQYGVVSVTNQQQLGNE

SEQ ID NO: 33721 - protein, 30 aa, Artificial Sequence
  Description of Artificial Sequence: Synthetic polypeptide
MEEEIKTTNPVATEQYGNVSVTMLQGTGNR

SEQ ID NO: 33722 - protein, 31 aa, Artificial Sequence
  Description of Artificial Sequence: Synthetic polypeptide
AEEEIRTTNPVATEQYGVVSVTNNLQEGENA

SEQ ID NO: 33723 - protein, 29 aa, Artificial Sequence
  Description of Artificial Sequence: Synthetic peptide
MEEEIMTTNPVATEQYGNVSVTMLQHGNQ

SEQ ID NO: 33724 - protein, 30 aa, Artificial Sequence
  Description of Artificial Sequence: Synthetic polypeptide
AEEEIRTTNPVATEQYGVVSVTNNLQDGQE

SEQ ID NO: 33725 - protein, 30 aa, Artificial Sequence
  Description of Artificial Sequence: Synthetic polypeptide
DEEEIRCTNPVATEQYGVVCSTELQGNSNR

SEQ ID NO: 33726 - protein, 31 aa, Artificial Sequence
  Description of Artificial Sequence: Synthetic polypeptide
AEEEIRTTNPVATEQYGVVSVTNLQQDEGNG

SEQ ID NO: 33727 - protein, 31 aa, Artificial Sequence
  Description of Artificial Sequence: Synthetic polypeptide
AEEEIRTTNPVATEQYGVVSVTNLQMGGNQT

SEQ ID NO: 33728 - protein, 31 aa, Artificial Sequence
  Description of Artificial Sequence: Synthetic polypeptide
AEEEIRTTNPVATEQYGVVSVTNLQMGGNGG

SEQ ID NO: 33729 - protein, 30 aa, Artificial Sequence
  Description of Artificial Sequence: Synthetic polypeptide
MEEEIMTTNPVATEQYGCVSVTELQGEGNR

SEQ ID NO: 33730 - protein, 30 aa, Artificial Sequence
  Description of Artificial Sequence: Synthetic polypeptide
MEEEIMTTNPVATEQYGNVSTTMLQGDGNR

SEQ ID NO: 33731 - protein, 31 aa, Artificial Sequence
  Description of Artificial Sequence: Synthetic polypeptide
DEEEIRCTNPVATEQYGVVSMTNLFQGGNQG

SEQ ID NO: 33732 - protein, 29 aa, Artificial Sequence
  Description of Artificial Sequence: Synthetic peptide
MEEEIMTTNPVATEQYGNVSVTMLLDGNR

SEQ ID NO: 33733 - protein, 31 aa, Artificial Sequence
  Description of Artificial Sequence: Synthetic polypeptide
AEEEIRTTNPVATEQYGVVSVTNLQQSGINQ

SEQ ID NO: 33734 - protein, 33 aa, Artificial Sequence
  Description of Artificial Sequence: Synthetic polypeptide
MEEEIRTTNPVATEQYGSVSPTSNLDQRGENDN

SEQ ID NO: 33735 - protein, 30 aa, Artificial Sequence
  Description of Artificial Sequence: Synthetic polypeptide
DEEEIRTTNPVATEQYGQVSCTNGGQKGKT

SEQ ID NO: 33736 - protein, 31 aa, Artificial Sequence
  Description of Artificial Sequence: Synthetic polypeptide
MEEEIRTTNPVATEQYGSVSTDDLSRGEDRN

SEQ ID NO: 33737 - protein, 29 aa, Artificial Sequence
  Description of Artificial Sequence: Synthetic peptide
MEGEIRTTNPVATEQYGSVQTALIERDNR

SEQ ID NO: 33738 - protein, 31 aa, Artificial Sequence
  Description of Artificial Sequence: Synthetic polypeptide
AEEEIRTTNPVATEQYGVVSTTTNLQQGNDN

SEQ ID NO: 33739 - protein, 31 aa, Artificial Sequence
  Description of Artificial Sequence: Synthetic polypeptide
AEEEIRTTNPVATEQYGVVSTTTNLQNNGNT

SEQ ID NO: 33740 - protein, 30 aa, Artificial Sequence
  Description of Artificial Sequence: Synthetic polypeptide
MEHEIRTTNPVATEQYGSVSQNLFRNMNRD

SEQ ID NO: 33741 - protein, 31 aa, Artificial Sequence
  Description of Artificial Sequence: Synthetic polypeptide
DEEEIRTTNPVATEQYGQSVSTNLEYGSDDS

SEQ ID NO: 33742 - protein, 30 aa, Artificial Sequence
  Description of Artificial Sequence: Synthetic polypeptide
DEEEIRGTNPVATEQFGVTSVSTDLTRGNG

SEQ ID NO: 33743 - protein, 29 aa, Artificial Sequence
  Description of Artificial Sequence: Synthetic peptide
AEEEIRTTNPVATEQYGVVSTTQQGGNVE

SEQ ID NO: 33744 - protein, 28 aa, Artificial Sequence
  Description of Artificial Sequence: Synthetic peptide
MENEIATTNPVATEQYGSVSEDLQQGNT

SEQ ID NO: 33745 - protein, 28 aa, Artificial Sequence
  Description of Artificial Sequence: Synthetic peptide
MEGEIRTTNPVATEQYGSVETALIRMDR

SEQ ID NO: 33746 - protein, 30 aa, Artificial Sequence
  Description of Artificial Sequence: Synthetic polypeptide
MENEIRTTNPVATEIYGSVSFNVLQRGNEQ

SEQ ID NO: 33747 - protein, 28 aa, Artificial Sequence
  Description of Artificial Sequence: Synthetic peptide
MENEIRTTNPVATEQYGSVHTALENGFR

SEQ ID NO: 33748 - protein, 32 aa, Artificial Sequence
  Description of Artificial Sequence: Synthetic polypeptide
MENEIRTTNPVATEQYGSVSTSNLFQEGENER

SEQ ID NO: 33749 - protein, 33 aa, Artificial Sequence
  Description of Artificial Sequence: Synthetic polypeptide
DEEEIRTTNPVATEQYGQSVSTMNHQRFGSNQT

SEQ ID NO: 33750 - protein, 32 aa, Artificial Sequence
  Description of Artificial Sequence: Synthetic polypeptide
DEEEIRTTNPVATEQYGQSVSTELTRSGSNQP

SEQ ID NO: 33751 - protein, 32 aa, Artificial Sequence
  Description of Artificial Sequence: Synthetic polypeptide
DEEEIRTTNPVATEQYGQSVSTELQNFGNNQL

SEQ ID NO: 33752 - protein, 31 aa, Artificial Sequence
  Description of Artificial Sequence: Synthetic polypeptide
DEEEIRTTNPVATEQYGQSVSTEHQNSGNQP

SEQ ID NO: 33753 - protein, 29 aa, Artificial Sequence
  Description of Artificial Sequence: Synthetic peptide
MTEEIRTTNPVATDQYGSVSTELQPGDNF

SEQ ID NO: 33754 - protein, 29 aa, Artificial Sequence
  Description of Artificial Sequence: Synthetic peptide
MTEEIRTTNPVATDQYGSVSTELQQMGNF

SEQ ID NO: 33755 - protein, 30 aa, Artificial Sequence
  Description of Artificial Sequence: Synthetic polypeptide
MENEIRTTNPVATEQYGCVCSTNHQRGSNQ

SEQ ID NO: 33756 - protein, 29 aa, Artificial Sequence
  Description of Artificial Sequence: Synthetic peptide
MEEQIRTTNPVATEQYGSVSTNLSMELNG

SEQ ID NO: 33757 - protein, 29 aa, Artificial Sequence
  Description of Artificial Sequence: Synthetic peptide
MEEGICTTNPVATEQYGSVSMNGSQRGNS

SEQ ID NO: 33758 - protein, 29 aa, Artificial Sequence
  Description of Artificial Sequence: Synthetic peptide
MEEEITTTNPVATEQYGVVSVTGLQGGNA

SEQ ID NO: 33759 - protein, 29 aa, Artificial Sequence
  Description of Artificial Sequence: Synthetic peptide
DEEEIRCTNPVSTEPYGTISMNLQQRGNR

SEQ ID NO: 33760 - protein, 31 aa, Artificial Sequence
  Description of Artificial Sequence: Synthetic polypeptide
MEEEIRTTNPVATEQYGSVSTNDLQENANFY

SEQ ID NO: 33761 - protein, 32 aa, Artificial Sequence
  Description of Artificial Sequence: Synthetic polypeptide
DEEEIRTTNPVATEQYGQVSCQNLSTRGGNNR

SEQ ID NO: 33762 - protein, 32 aa, Artificial Sequence
  Description of Artificial Sequence: Synthetic polypeptide
MEEEIRTTNPVATEQYGSVSTNHNQNFGSNRS

SEQ ID NO: 33763 - protein, 30 aa, Artificial Sequence
  Description of Artificial Sequence: Synthetic polypeptide
MEEEIRTTNPVATEQYGSVSTNHQNGSEAS

SEQ ID NO: 33764 - protein, 31 aa, Artificial Sequence
  Description of Artificial Sequence: Synthetic polypeptide
MEEEIRTTNPVATEQYGSVSTPNLQLSIINE

SEQ ID NO: 33765 - protein, 33 aa, Artificial Sequence
  Description of Artificial Sequence: Synthetic polypeptide
MEEEIRTTNPVATEQYGSVSTSNGEDQRGENQR

SEQ ID NO: 33766 - protein, 31 aa, Artificial Sequence
  Description of Artificial Sequence: Synthetic polypeptide
DEEEIRTTNPVATEQYGQVCSWNLQFFGSNQ

SEQ ID NO: 33767 - protein, 33 aa, Artificial Sequence
  Description of Artificial Sequence: Synthetic polypeptide
DEEEIRTTNPVATEQYGQTVVPSTWSLSQRGNR

SEQ ID NO: 33768 - protein, 30 aa, Artificial Sequence
  Description of Artificial Sequence: Synthetic polypeptide
MEEEIRTTNPVATEQYGSVSWNLQGNENFY

SEQ ID NO: 33769 - protein, 30 aa, Artificial Sequence
  Description of Artificial Sequence: Synthetic polypeptide
MEEEIRTTNPVATEQYGSVTSTNPLINGEQ

SEQ ID NO: 33770 - protein, 32 aa, Artificial Sequence
  Description of Artificial Sequence: Synthetic polypeptide
MEEEIRTTNPVATEQYGSVVSTNLLQTGANIY

SEQ ID NO: 33771 - protein, 29 aa, Artificial Sequence
  Description of Artificial Sequence: Synthetic peptide
MEEEIRTTNPVATEQYGSYVATTLENGFR

SEQ ID NO: 33772 - protein, 33 aa, Artificial Sequence
  Description of Artificial Sequence: Synthetic polypeptide
DEEEIRTTNPVATEQYGQSVTSTGNLQGFGSND

SEQ ID NO: 33773 - protein, 30 aa, Artificial Sequence
  Description of Artificial Sequence: Synthetic polypeptide
MEEEISTTNPVATEQYGCVSVTDLQGGSNR

SEQ ID NO: 33774 - protein, 30 aa, Artificial Sequence
  Description of Artificial Sequence: Synthetic polypeptide
MEEEISTTNPVATEQYGCVSVTMLQGGNER

SEQ ID NO: 33775 - protein, 28 aa, Artificial Sequence
  Description of Artificial Sequence: Synthetic peptide
MEEEISTTNPVATEQYGSVSDDLQNGEY

SEQ ID NO: 33776 - protein, 29 aa, Artificial Sequence
  Description of Artificial Sequence: Synthetic peptide
MEEEITTTNPVATEQYGNVSVTELQGDNR

SEQ ID NO: 33777 - protein, 30 aa, Artificial Sequence
  Description of Artificial Sequence: Synthetic polypeptide
MEEEITTTNPVATEQYGNVSVTMLQTQGNR

SEQ ID NO: 33778 - protein, 34 aa, Artificial Sequence
  Description of Artificial Sequence: Synthetic polypeptide
DEEEIRTTNPVATEQYGQSVPSCTNLAQTGGNNR

SEQ ID NO: 33779 - protein, 32 aa, Artificial Sequence
  Description of Artificial Sequence: Synthetic polypeptide
AEEEIRTTNPVATEQYGSVSTTSNLQQEGENE

SEQ ID NO: 33780 - protein, 32 aa, Artificial Sequence
  Description of Artificial Sequence: Synthetic polypeptide
DEEEIRTTNPVATEQYGCVSNTGNLQFFGSNA

SEQ ID NO: 33781 - protein, 29 aa, Artificial Sequence
  Description of Artificial Sequence: Synthetic peptide
SEEEIRCTNPIATEQYGSVSENLMGGNMR

SEQ ID NO: 33782 - protein, 32 aa, Artificial Sequence
  Description of Artificial Sequence: Synthetic polypeptide
TEEEIRTTNPVATEQYGISVSCTNQQRGGNNG

SEQ ID NO: 33783 - protein, 31 aa, Artificial Sequence
  Description of Artificial Sequence: Synthetic polypeptide
TEEEIRTTNPVATEQYGKTVSCTNFSQRGNS

SEQ ID NO: 33784 - protein, 32 aa, Artificial Sequence
  Description of Artificial Sequence: Synthetic polypeptide
TEEEIRTTNPVATEQYGKVPSCTNLSQRGNNH

SEQ ID NO: 33785 - protein, 33 aa, Artificial Sequence
  Description of Artificial Sequence: Synthetic polypeptide
TEEEIRTTNPVATEQYGKVPSTNLQDRTGGNNR

SEQ ID NO: 33786 - protein, 31 aa, Artificial Sequence
  Description of Artificial Sequence: Synthetic polypeptide
TEEEIRTTNPVATEQYGKVSCTNALDRVNNR

SEQ ID NO: 33787 - protein, 32 aa, Artificial Sequence
  Description of Artificial Sequence: Synthetic polypeptide
TEEEIRTTNPVATEQYGKVSCTNALQNVGNQR

SEQ ID NO: 33788 - protein, 31 aa, Artificial Sequence
  Description of Artificial Sequence: Synthetic polypeptide
TEEEIRTTNPVATEQYGKVSCTNLQKGGNNG

SEQ ID NO: 33789 - protein, 31 aa, Artificial Sequence
  Description of Artificial Sequence: Synthetic polypeptide
TEEEIRTTNPVATEQYGKVSINLSERGGNNR

SEQ ID NO: 33790 - protein, 32 aa, Artificial Sequence
  Description of Artificial Sequence: Synthetic polypeptide
TEEEIRTTNPVATEQYGISTVSTNLQTVGNNY

SEQ ID NO: 33791 - protein, 32 aa, Artificial Sequence
  Description of Artificial Sequence: Synthetic polypeptide
DEEEIRTTNPVATEQYGCAVSWNLQRFGSERA

SEQ ID NO: 33792 - protein, 32 aa, Artificial Sequence
  Description of Artificial Sequence: Synthetic polypeptide
DEEEIRTTNPVATEQYGCAVSTNLQRFQSNQS

SEQ ID NO: 33793 - protein, 32 aa, Artificial Sequence
  Description of Artificial Sequence: Synthetic polypeptide
TEEEIRTTNPVATEQYGKVVSCTGNLQQGNNR

SEQ ID NO: 33794 - protein, 32 aa, Artificial Sequence
  Description of Artificial Sequence: Synthetic polypeptide
DEEEIRTTNPVATEQYGCAVSTGNHQRFGSER

SEQ ID NO: 33795 - protein, 32 aa, Artificial Sequence
  Description of Artificial Sequence: Synthetic polypeptide
DEEEIRTTNPVATEQYGCAVSTELQRFGSETR

SEQ ID NO: 33796 - protein, 34 aa, Artificial Sequence
  Description of Artificial Sequence: Synthetic polypeptide
TEEEIRTTNPVATEQYGQSVSTGNLSQRTGGNYR

SEQ ID NO: 33797 - protein, 31 aa, Artificial Sequence
  Description of Artificial Sequence: Synthetic polypeptide
DEEEIRTTNPVATEQYGCAVCSTNLQGFGQQ

SEQ ID NO: 33798 - protein, 32 aa, Artificial Sequence
  Description of Artificial Sequence: Synthetic polypeptide
TEEEIRTTNPVATEQYGQTVCACTNLQRGNRN

SEQ ID NO: 33799 - protein, 30 aa, Artificial Sequence
  Description of Artificial Sequence: Synthetic polypeptide
AEEEIRGTNPIATEQYGSVSEMNLMRGNDR

SEQ ID NO: 33800 - protein, 31 aa, Artificial Sequence
  Description of Artificial Sequence: Synthetic polypeptide
DEEEIRTTNPVATEQYGCAVSTNLQSFGSEL

SEQ ID NO: 33801 - protein, 31 aa, Artificial Sequence
  Description of Artificial Sequence: Synthetic polypeptide
TEEEIRTTNPVATEQYGSISTHLSQSQGGNR

SEQ ID NO: 33802 - protein, 33 aa, Artificial Sequence
  Description of Artificial Sequence: Synthetic polypeptide
TEEEIRTTNPVATEQYGISTVSCTNALQRGNNA

SEQ ID NO: 33803 - protein, 32 aa, Artificial Sequence
  Description of Artificial Sequence: Synthetic polypeptide
TEEEIRTTNPVATEQYGEVPSTNEQSQRGGNR

SEQ ID NO: 33804 - protein, 32 aa, Artificial Sequence
  Description of Artificial Sequence: Synthetic polypeptide
TEEEIRTTNPVATEQWGSVSCTNWHQRGGNNR

SEQ ID NO: 33805 - protein, 31 aa, Artificial Sequence
  Description of Artificial Sequence: Synthetic polypeptide
AEEEIRTTNPVATEAYGSVSGTNLEQMTDNR

SEQ ID NO: 33806 - protein, 32 aa, Artificial Sequence
  Description of Artificial Sequence: Synthetic polypeptide
AEEEIRTTNPVATEAYGSVSCTNELSQAGGNR

SEQ ID NO: 33807 - protein, 31 aa, Artificial Sequence
  Description of Artificial Sequence: Synthetic polypeptide
AEEEIRTTNPVATEAYGSTVSCTNLSQSVNR

SEQ ID NO: 33808 - protein, 29 aa, Artificial Sequence
  Description of Artificial Sequence: Synthetic peptide
AEEEIRTTNPVATEAYGNVATNIQRGNEG

SEQ ID NO: 33809 - protein, 30 aa, Artificial Sequence
  Description of Artificial Sequence: Synthetic polypeptide
AEEEIRTTNPVATEAYGCISINELQRTGNR

SEQ ID NO: 33810 - protein, 30 aa, Artificial Sequence
  Description of Artificial Sequence: Synthetic polypeptide
AEEEIRTTNPVATEAYGCCSINELSQRGNR

SEQ ID NO: 33811 - protein, 31 aa, Artificial Sequence
  Description of Artificial Sequence: Synthetic polypeptide
TEEEIRTTNPVATEQWGSVSTNAPTRGGNNR

SEQ ID NO: 33812 - protein, 32 aa, Artificial Sequence
  Description of Artificial Sequence: Synthetic polypeptide
TEEEIRTTNPVATEQYGHTVSTGNLSQGGGNR

SEQ ID NO: 33813 - protein, 32 aa, Artificial Sequence
  Description of Artificial Sequence: Synthetic polypeptide
TEEEIRTTNPVATEQWGSVSTNLSQRNVGNPA

SEQ ID NO: 33814 - protein, 32 aa, Artificial Sequence
  Description of Artificial Sequence: Synthetic polypeptide
TEEEIRTTNPVATEQWGSVVSCTNLQGGGNRP

SEQ ID NO: 33815 - protein, 33 aa, Artificial Sequence
  Description of Artificial Sequence: Synthetic polypeptide
DEEEIRTTNPVATEQYGCIVSTENLQRFGSERN

SEQ ID NO: 33816 - protein, 33 aa, Artificial Sequence
  Description of Artificial Sequence: Synthetic polypeptide
TEEEIRTTNPVATEQWGSVVSTNLQDRTGGNNR

SEQ ID NO: 33817 - protein, 31 aa, Artificial Sequence
  Description of Artificial Sequence: Synthetic polypeptide
TEEEIRTTNPVATEQWGSVVSTNQQRTGGNE

SEQ ID NO: 33818 - protein, 32 aa, Artificial Sequence
  Description of Artificial Sequence: Synthetic polypeptide
TEEEIRTTNPVATEQWGVVPSTNALQRGGNNR

SEQ ID NO: 33819 - protein, 32 aa, Artificial Sequence
  Description of Artificial Sequence: Synthetic polypeptide
TEEEIRTTNPVATEQWGVVPSYTNLQRTGGNR

SEQ ID NO: 33820 - protein, 31 aa, Artificial Sequence
  Description of Artificial Sequence: Synthetic polypeptide
DEEEIRTTNPVATEQYGCISSPNMLQRDSNR

SEQ ID NO: 33821 - protein, 32 aa, Artificial Sequence
  Description of Artificial Sequence: Synthetic polypeptide
DEEEIRTTNPVATEQYGCISCTGNELQRVGNN

SEQ ID NO: 33822 - protein, 32 aa, Artificial Sequence
  Description of Artificial Sequence: Synthetic polypeptide
TEEEIRTTNPVATEQWGSVVSCTGNLSQQGNR

SEQ ID NO: 33823 - protein, 32 aa, Artificial Sequence
  Description of Artificial Sequence: Synthetic polypeptide
DEEEIRTTNPVATEQYGCIVSTNHQRFGSERF

SEQ ID NO: 33824 - protein, 32 aa, Artificial Sequence
  Description of Artificial Sequence: Synthetic polypeptide
TEEEIRTTNPVATEQYGSLSCTHLSQRVTGNR

SEQ ID NO: 33825 - protein, 32 aa, Artificial Sequence
  Description of Artificial Sequence: Synthetic polypeptide
TEEEIRTTNPVATEQYGSLVSCCNELQRDGNQ

SEQ ID NO: 33826 - protein, 32 aa, Artificial Sequence
  Description of Artificial Sequence: Synthetic polypeptide
TEEEIRTTNPVATEQYGSTVSCTNMLSHRGNE

SEQ ID NO: 33827 - protein, 30 aa, Artificial Sequence
  Description of Artificial Sequence: Synthetic polypeptide
AEEEIRATNPVATEQYGSVATNLDRGNPDF

SEQ ID NO: 33828 - protein, 32 aa, Artificial Sequence
  Description of Artificial Sequence: Synthetic polypeptide
TEEEIRTTNPVATEQYGSTVSCTVLSGRGNNR

SEQ ID NO: 33829 - protein, 32 aa, Artificial Sequence
  Description of Artificial Sequence: Synthetic polypeptide
TEEEIRTTNPVATEQYGSTVSTAMLSQRGGSR

SEQ ID NO: 33830 - protein, 34 aa, Artificial Sequence
  Description of Artificial Sequence: Synthetic polypeptide
TEEEIRTTNPVATEQYGSTVSTNALSQERGGNRD

SEQ ID NO: 33831 - protein, 29 aa, Artificial Sequence
  Description of Artificial Sequence: Synthetic peptide
AEEEIRATNPVATEQYGCVATNLQQGNLA

SEQ ID NO: 33832 - protein, 34 aa, Artificial Sequence
  Description of Artificial Sequence: Synthetic polypeptide
TEEEIRTTNPVATEQYGSTVSTNELSQRAGGNER

SEQ ID NO: 33833 - protein, 31 aa, Artificial Sequence
  Description of Artificial Sequence: Synthetic polypeptide
TEEEIRTTNPVATEQYGSTVSTNHSQIGGNE

SEQ ID NO: 33834 - protein, 33 aa, Artificial Sequence
  Description of Artificial Sequence: Synthetic polypeptide
TEEEIRTTNPVATEQYGSTVSCTNLQGTGGNRP

SEQ ID NO: 33835 - protein, 32 aa, Artificial Sequence
  Description of Artificial Sequence: Synthetic polypeptide
TEEEIRTTNPVATEQYGSTVSTNLSQRVADND

SEQ ID NO: 33836 - protein, 30 aa, Artificial Sequence
  Description of Artificial Sequence: Synthetic polypeptide
AEEEIRATNPVATEGYGSVSTNLQNGNEAD

SEQ ID NO: 33837 - protein, 31 aa, Artificial Sequence
  Description of Artificial Sequence: Synthetic polypeptide
DEEEIRTTNPVATEQYGAVSTYNLQRQVEIE

SEQ ID NO: 33838 - protein, 33 aa, Artificial Sequence
  Description of Artificial Sequence: Synthetic polypeptide
TEEEIRTTNPVATEQYGSTVSYTGLSQRGGNRG

SEQ ID NO: 33839 - protein, 33 aa, Artificial Sequence
  Description of Artificial Sequence: Synthetic polypeptide
DEEEIRTTNPVATEQYGAVSTVNLQRNGNNGGD

SEQ ID NO: 33840 - protein, 33 aa, Artificial Sequence
  Description of Artificial Sequence: Synthetic polypeptide
TEEEIRTTNPVATEQYGSVACTNLSQERGGNRD

SEQ ID NO: 33841 - protein, 31 aa, Artificial Sequence
  Description of Artificial Sequence: Synthetic polypeptide
DEEEIRTTNPVATEQYGAVSTVNLPIEGGNF

SEQ ID NO: 33842 - protein, 31 aa, Artificial Sequence
  Description of Artificial Sequence: Synthetic polypeptide
DEEEIRTTNPVATEQYGAVSTVNLPGEGTNF

SEQ ID NO: 33843 - protein, 31 aa, Artificial Sequence
  Description of Artificial Sequence: Synthetic polypeptide
DEEEIRTTNPVATEQYGAVSTVNLPEEGNEF

SEQ ID NO: 33844 - protein, 31 aa, Artificial Sequence
  Description of Artificial Sequence: Synthetic polypeptide
AEEEIRATNPVATEQWGSVSTNLQRGENTEE

SEQ ID NO: 33845 - protein, 31 aa, Artificial Sequence
  Description of Artificial Sequence: Synthetic polypeptide
AEEEIRCTNPVATEQYGSVATNLQMRGNDWS

SEQ ID NO: 33846 - protein, 29 aa, Artificial Sequence
  Description of Artificial Sequence: Synthetic peptide
AEEEIRATNPVATEQYGSVATNLQQPDRN

SEQ ID NO: 33847 - protein, 32 aa, Artificial Sequence
  Description of Artificial Sequence: Synthetic polypeptide
DEEEIRTTNPVATEQYGAVWESTNNDLQRENN

SEQ ID NO: 33848 - protein, 32 aa, Artificial Sequence
  Description of Artificial Sequence: Synthetic polypeptide
TEEEIRTTNPVATEQYGSLVSCTNHQRGGSNE

SEQ ID NO: 33849 - protein, 33 aa, Artificial Sequence
  Description of Artificial Sequence: Synthetic polypeptide
TEEEIRTTNPVATEQYGSTVNTGNLSQRGGNRE

SEQ ID NO: 33850 - protein, 30 aa, Artificial Sequence
  Description of Artificial Sequence: Synthetic polypeptide
TEEEIRTTNPVATEQYGSTVPATALQNGER

SEQ ID NO: 33851 - protein, 34 aa, Artificial Sequence
  Description of Artificial Sequence: Synthetic polypeptide
TEEEIRTTNPVATEQYGSTVQSCTPNLSQRGTNR

SEQ ID NO: 33852 - protein, 28 aa, Artificial Sequence
  Description of Artificial Sequence: Synthetic peptide
AEEEIRCTNPIATEQYGEASENLQRGGR

SEQ ID NO: 33853 - protein, 33 aa, Artificial Sequence
  Description of Artificial Sequence: Synthetic polypeptide
TEEEIRTTNPVATEQYGSTVQSTPNLSQPGGNR

SEQ ID NO: 33854 - protein, 31 aa, Artificial Sequence
  Description of Artificial Sequence: Synthetic polypeptide
TEEEIRTTNPVATEQYGSTVSAGNLDEMGNR

SEQ ID NO: 33855 - protein, 30 aa, Artificial Sequence
  Description of Artificial Sequence: Synthetic polypeptide
AEEEIRATNPVATEQYGSVSTNLQHGEPTA

SEQ ID NO: 33856 - protein, 32 aa, Artificial Sequence
  Description of Artificial Sequence: Synthetic polypeptide
TEEEIRTTNPVATEQYGSTVSCTNHQSTGNNR

SEQ ID NO: 33857 - protein, 31 aa, Artificial Sequence
  Description of Artificial Sequence: Synthetic polypeptide
AEEEIRATNPVATEQYGSVSTNLQHGENDNN

SEQ ID NO: 33858 - protein, 30 aa, Artificial Sequence
  Description of Artificial Sequence: Synthetic polypeptide
AEEEIRATNPVATEQYGSVSTNLERPDNQD

SEQ ID NO: 33859 - protein, 31 aa, Artificial Sequence
  Description of Artificial Sequence: Synthetic polypeptide
DEEEIRTTNPVATEQYGAVWSTINELQREDN

SEQ ID NO: 33860 - protein, 33 aa, Artificial Sequence
  Description of Artificial Sequence: Synthetic polypeptide
TEEEIRTTNPVATEQYGSTVSCENLSQRGNNRT

SEQ ID NO: 33861 - protein, 33 aa, Artificial Sequence
  Description of Artificial Sequence: Synthetic polypeptide
AEEEIRATNPVATEQYGSVSTGNLGQRGENGRE

SEQ ID NO: 33862 - protein, 32 aa, Artificial Sequence
  Description of Artificial Sequence: Synthetic polypeptide
TEEEIRTTNPVATEQYGSTVSCINELSTRGNR

SEQ ID NO: 33863 - protein, 33 aa, Artificial Sequence
  Description of Artificial Sequence: Synthetic polypeptide
TEEEIRTTNPVATEQYGSTVSCQGNLQRPGGNR

SEQ ID NO: 33864 - protein, 32 aa, Artificial Sequence
  Description of Artificial Sequence: Synthetic polypeptide
TEEEIRTTNPVATEQYGSTVSCSGNLQSGGNR

SEQ ID NO: 33865 - protein, 33 aa, Artificial Sequence
  Description of Artificial Sequence: Synthetic polypeptide
TEEEIRTTNPVATEQYGSTVSCTNELDQIGGNR

SEQ ID NO: 33866 - protein, 31 aa, Artificial Sequence
  Description of Artificial Sequence: Synthetic polypeptide
AEEEIRATNPVATEQYGSVSTNLQHGENAEE

SEQ ID NO: 33867 - protein, 31 aa, Artificial Sequence
  Description of Artificial Sequence: Synthetic polypeptide
AEEEIRTTNPVATEAYGSVSTNLDQEGQNTL

SEQ ID NO: 33868 - protein, 32 aa, Artificial Sequence
  Description of Artificial Sequence: Synthetic polypeptide
DEEEIRTTNPVATEQYGCIVSTNLQNFGSERS

SEQ ID NO: 33869 - protein, 32 aa, Artificial Sequence
  Description of Artificial Sequence: Synthetic polypeptide
TEEEIRTTNPVATEQWGSVNYTNLSQRGTNNR

SEQ ID NO: 33870 - protein, 31 aa, Artificial Sequence
  Description of Artificial Sequence: Synthetic polypeptide
TEEEIRTTNPVATEAWGSVVSTNMLSQRGDR

SEQ ID NO: 33871 - protein, 32 aa, Artificial Sequence
  Description of Artificial Sequence: Synthetic polypeptide
TEEEIRTTNPVATEAYGCVVSTNMLSQRGGNR

SEQ ID NO: 33872 - protein, 30 aa, Artificial Sequence
  Description of Artificial Sequence: Synthetic polypeptide
TEEEIRTTNPVATEAYGSIPSTHLQRQGGR

SEQ ID NO: 33873 - protein, 32 aa, Artificial Sequence
  Description of Artificial Sequence: Synthetic polypeptide
TEEEIRTTNPVATEAYGSVCSCTNLSIQGGNR

SEQ ID NO: 33874 - protein, 31 aa, Artificial Sequence
  Description of Artificial Sequence: Synthetic polypeptide
TEEEIRTTNPVATEAYGSVPATNAGQRGGNR

SEQ ID NO: 33875 - protein, 31 aa, Artificial Sequence
  Description of Artificial Sequence: Synthetic polypeptide
TEEEIRTTNPVATEAYGSVPATNQQRTGGNR

SEQ ID NO: 33876 - protein, 30 aa, Artificial Sequence
  Description of Artificial Sequence: Synthetic polypeptide
DEEEIRTTNPVATEQYGCVATNDLVDGNED

SEQ ID NO: 33877 - protein, 30 aa, Artificial Sequence
  Description of Artificial Sequence: Synthetic polypeptide
DEEEIRTTNPVATEQYGCVATDLERIEGNQ

SEQ ID NO: 33878 - protein, 31 aa, Artificial Sequence
  Description of Artificial Sequence: Synthetic polypeptide
TEEEIRTTNPVATEAWGSVSLNELSQRGGNR

SEQ ID NO: 33879 - protein, 31 aa, Artificial Sequence
  Description of Artificial Sequence: Synthetic polypeptide
TEEEIRTTNPVATEAYGSVSCTNLQMGGNNG

SEQ ID NO: 33880 - protein, 32 aa, Artificial Sequence
  Description of Artificial Sequence: Synthetic polypeptide
DEEEIRTTNPVATEQYGCVAMTNLNRGGENDR

SEQ ID NO: 33881 - protein, 31 aa, Artificial Sequence
  Description of Artificial Sequence: Synthetic polypeptide
DEEEIRTTNPVATEQYGCVAMTNLNRGDEDR

SEQ ID NO: 33882 - protein, 31 aa, Artificial Sequence
  Description of Artificial Sequence: Synthetic polypeptide
TEEEIRTTNPVATEAYGSVSTGNMLSQRVNS

SEQ ID NO: 33883 - protein, 32 aa, Artificial Sequence
  Description of Artificial Sequence: Synthetic polypeptide
DEEEIRTTNPVATEQYGCVAMTNLGARGMNDR

SEQ ID NO: 33884 - protein, 30 aa, Artificial Sequence
  Description of Artificial Sequence: Synthetic polypeptide
TEEEIRTTNPVATEAYGSVSTNLSQAGGSP

SEQ ID NO: 33885 - protein, 33 aa, Artificial Sequence
  Description of Artificial Sequence: Synthetic polypeptide
TEEEIRTTNPVATEAYGSVSTNLSQDRTGGNQR

SEQ ID NO: 33886 - protein, 31 aa, Artificial Sequence
  Description of Artificial Sequence: Synthetic polypeptide
TEEEIRTTNPVATEAYGSVSTNLSQFVGNNA

SEQ ID NO: 33887 - protein, 32 aa, Artificial Sequence
  Description of Artificial Sequence: Synthetic polypeptide
TEEEIRTTNPVATEAYGSVSTNLSQRVGNQPA

SEQ ID NO: 33888 - protein, 31 aa, Artificial Sequence
  Description of Artificial Sequence: Synthetic polypeptide
DEEEIRTTNPVATEQYGCVAMTNLNRPMNDR

SEQ ID NO: 33889 - protein, 33 aa, Artificial Sequence
  Description of Artificial Sequence: Synthetic polypeptide
TEEEIRTTNPVATEAYGSVSTNMLQDRTGGNNR

SEQ ID NO: 33890 - protein, 32 aa, Artificial Sequence
  Description of Artificial Sequence: Synthetic polypeptide
TEEEIRTTNPVATEAWGSVSCTNLAQRTGNNR

SEQ ID NO: 33891 - protein, 29 aa, Artificial Sequence
  Description of Artificial Sequence: Synthetic peptide
DEEEIRTTNPVATEQYGCVATNLERETDD

SEQ ID NO: 33892 - protein, 30 aa, Artificial Sequence
  Description of Artificial Sequence: Synthetic polypeptide
TEEEIRCTNPIATEQYGSVPSENLMRGNNR

SEQ ID NO: 33893 - protein, 29 aa, Artificial Sequence
  Description of Artificial Sequence: Synthetic peptide
DEEEIRTTNPVATEQYGCVCGTELQNGDD

SEQ ID NO: 33894 - protein, 29 aa, Artificial Sequence
  Description of Artificial Sequence: Synthetic peptide
TEEEIRCTNPIATEQYGSVSENEHMRGNR

SEQ ID NO: 33895 - protein, 29 aa, Artificial Sequence
  Description of Artificial Sequence: Synthetic peptide
TEEEIRCTNPIATEQYGSVSENLMRGGSR

SEQ ID NO: 33896 - protein, 31 aa, Artificial Sequence
  Description of Artificial Sequence: Synthetic polypeptide
DEEEIRTTNPVATEQYGCVAWTNLGRGMNDT

SEQ ID NO: 33897 - protein, 29 aa, Artificial Sequence
  Description of Artificial Sequence: Synthetic peptide
TEEEIRCTNPIATEQYGSVSENLSMSGNR

SEQ ID NO: 33898 - protein, 30 aa, Artificial Sequence
  Description of Artificial Sequence: Synthetic polypeptide
TEEEIRCTNPIATEQYGSVSENLSTRGGNR

SEQ ID NO: 33899 - protein, 30 aa, Artificial Sequence
  Description of Artificial Sequence: Synthetic polypeptide
TEEEIRCTNPIATEQYGSVSENMLMRVGNR

SEQ ID NO: 33900 - protein, 32 aa, Artificial Sequence
  Description of Artificial Sequence: Synthetic polypeptide
TEEEIRTTNPVATEAWGSVPSTNALQRGGNTR

SEQ ID NO: 33901 - protein, 29 aa, Artificial Sequence
  Description of Artificial Sequence: Synthetic peptide
TEEEIRCTNPIAYEQYGSVSENALMRGNR

SEQ ID NO: 33902 - protein, 31 aa, Artificial Sequence
  Description of Artificial Sequence: Synthetic polypeptide
TEEEIRTTNPCATEAYGSVSYTNDSQRVGNR

SEQ ID NO: 33903 - protein, 32 aa, Artificial Sequence
  Description of Artificial Sequence: Synthetic polypeptide
TEEEIRTTNPCATEQYGSTVSYTNLSQRVGDR

SEQ ID NO: 33904 - protein, 30 aa, Artificial Sequence
  Description of Artificial Sequence: Synthetic polypeptide
TEEEIRTTNPCATEQYGSVSTNLQGNAGEY

SEQ ID NO: 33905 - protein, 31 aa, Artificial Sequence
  Description of Artificial Sequence: Synthetic polypeptide
DEEEIRTTNPVATEQYGCVATNLQQRGDTEQ

SEQ ID NO: 33906 - protein, 28 aa, Artificial Sequence
  Description of Artificial Sequence: Synthetic peptide
TEEEIRTTNPLATEQYGSVPTRLARGKE

SEQ ID NO: 33907 - protein, 29 aa, Artificial Sequence
  Description of Artificial Sequence: Synthetic peptide
DEEEIRTTNPVATEQYGCVATNLQAPEDN

SEQ ID NO: 33908 - protein, 32 aa, Artificial Sequence
  Description of Artificial Sequence: Synthetic polypeptide
DEEEIRTTNPVATEQYGCVATNLERPGENARM

SEQ ID NO: 33909 - protein, 30 aa, Artificial Sequence
  Description of Artificial Sequence: Synthetic polypeptide
DEEEIRTTNPVATEQYGCVATNLERNHNDE

SEQ ID NO: 33910 - protein, 30 aa, Artificial Sequence
  Description of Artificial Sequence: Synthetic polypeptide
DEEEIRTTNPVATEQYGCVATNLQREDEDA

SEQ ID NO: 33911 - protein, 32 aa, Artificial Sequence
  Description of Artificial Sequence: Synthetic polypeptide
TEEEIRTTNPVATEAYGSVSTNMLQRPGGNNE

SEQ ID NO: 33912 - protein, 31 aa, Artificial Sequence
  Description of Artificial Sequence: Synthetic polypeptide
DEEEIRTTNPVATEQYGCVADTWLDQREQNR

SEQ ID NO: 33913 - protein, 31 aa, Artificial Sequence
  Description of Artificial Sequence: Synthetic polypeptide
TEEEIRTTNPVATEAYGSVVSCTNHQTGNNR

SEQ ID NO: 33914 - protein, 32 aa, Artificial Sequence
  Description of Artificial Sequence: Synthetic polypeptide
TEEEIRTTNPVATEPYGSVPSCTNLSQRGNNW

SEQ ID NO: 33915 - protein, 32 aa, Artificial Sequence
  Description of Artificial Sequence: Synthetic polypeptide
TEEEIRTTNPVATEPYGSVPSTNAFSQRGNNR

SEQ ID NO: 33916 - protein, 33 aa, Artificial Sequence
  Description of Artificial Sequence: Synthetic polypeptide
TEEEIRTTNPVATEPYGSVSCTNLQRPGGNNRV

SEQ ID NO: 33917 - protein, 31 aa, Artificial Sequence
  Description of Artificial Sequence: Synthetic polypeptide
TEEEIRTTNPVATEPYGSVSCTNLSPSGGNR

SEQ ID NO: 33918 - protein, 33 aa, Artificial Sequence
  Description of Artificial Sequence: Synthetic polypeptide
TEEEIRTTNPVATEPYGSVSCTNLSQTRGGNRD

SEQ ID NO: 33919 - protein, 34 aa, Artificial Sequence
  Description of Artificial Sequence: Synthetic polypeptide
DEEEIRTTNPVATEQYGCSTVPSCTNLSQGTGNR

SEQ ID NO: 33920 - protein, 32 aa, Artificial Sequence
  Description of Artificial Sequence: Synthetic polypeptide
TEEEIRTTNPVATEPYGSVSCTNSLSQRGNNS

SEQ ID NO: 33921 - protein, 32 aa, Artificial Sequence
  Description of Artificial Sequence: Synthetic polypeptide
DEEEIRTTNPVATEQYGCSCSTNELQRFGSQQ

SEQ ID NO: 33922 - protein, 31 aa, Artificial Sequence
  Description of Artificial Sequence: Synthetic polypeptide
TEEEIRTTNPVATEPYGSVCFTNLTRIGNRN

SEQ ID NO: 33923 - protein, 31 aa, Artificial Sequence
  Description of Artificial Sequence: Synthetic polypeptide
TEEEIRTTNPVATEPYGSVSNTNALHRGDQR

SEQ ID NO: 33924 - protein, 33 aa, Artificial Sequence
  Description of Artificial Sequence: Synthetic polypeptide
TEEEIRTTNPVATEPYGSVSTNLSQDRGGNNRD

SEQ ID NO: 33925 - protein, 32 aa, Artificial Sequence
  Description of Artificial Sequence: Synthetic polypeptide
DEEEIRTTNPVATEQYGCQVSTNLIRFGSNQA

SEQ ID NO: 33926 - protein, 31 aa, Artificial Sequence
  Description of Artificial Sequence: Synthetic polypeptide
DEEEIRTTNPVATEQYGCQVSTNHQRFGSEL

SEQ ID NO: 33927 - protein, 31 aa, Artificial Sequence
  Description of Artificial Sequence: Synthetic polypeptide
DEEEIRTTNPVATEQYGCQVSTELQNGSNQQ

SEQ ID NO: 33928 - protein, 33 aa, Artificial Sequence
  Description of Artificial Sequence: Synthetic polypeptide
TEEEIRTTNPVATEPYGSVVSCTNMLSQRGNPR

SEQ ID NO: 33929 - protein, 32 aa, Artificial Sequence
  Description of Artificial Sequence: Synthetic polypeptide
DEEEIRTTNPVATEQYGCQVCSTNLTRGSNQM

SEQ ID NO: 33930 - protein, 31 aa, Artificial Sequence
  Description of Artificial Sequence: Synthetic polypeptide
DEEEIRTTNPVATEQYGCNSTINPLQREENN

SEQ ID NO: 33931 - protein, 31 aa, Artificial Sequence
  Description of Artificial Sequence: Synthetic polypeptide
TEEEIRTTNPVATEQWGSVATNELSQEGGNR

SEQ ID NO: 33932 - protein, 31 aa, Artificial Sequence
  Description of Artificial Sequence: Synthetic polypeptide
TEEEIRTTNPVATEPYGSVSTNLSPRGGNNT

SEQ ID NO: 33933 - protein, 31 aa, Artificial Sequence
  Description of Artificial Sequence: Synthetic polypeptide
TEEEIRTTNPVATEPYGSVCFTNLTERTGNR

SEQ ID NO: 33934 - protein, 31 aa, Artificial Sequence
  Description of Artificial Sequence: Synthetic polypeptide
TEEEIRTTNPVATEPYGSTVSTNLSPEGGNR

SEQ ID NO: 33935 - protein, 31 aa, Artificial Sequence
  Description of Artificial Sequence: Synthetic polypeptide
TEEEIRTTNPVATEPYGSTVPSTNLSQAGNQ

SEQ ID NO: 33936 - protein, 32 aa, Artificial Sequence
  Description of Artificial Sequence: Synthetic polypeptide
TEEEIRTTNPVATEAYGSVVSCTNLQKNGGNR

SEQ ID NO: 33937 - protein, 33 aa, Artificial Sequence
  Description of Artificial Sequence: Synthetic polypeptide
TEEEIRTTNPVATEAYGSVVSCTNMLSQRGNQR

SEQ ID NO: 33938 - protein, 32 aa, Artificial Sequence
  Description of Artificial Sequence: Synthetic polypeptide
TEEEIRTTNPVATEAYGSVVSTGNMSSQRGNR

SEQ ID NO: 33939 - protein, 33 aa, Artificial Sequence
  Description of Artificial Sequence: Synthetic polypeptide
TEEEIRTTNPVATEAYGSVVSTLNMLSQRTGNR

SEQ ID NO: 33940 - protein, 32 aa, Artificial Sequence
  Description of Artificial Sequence: Synthetic polypeptide
TEEEIRTTNPVATEAYGSVVSTNALSTRGNNR

SEQ ID NO: 33941 - protein, 31 aa, Artificial Sequence
  Description of Artificial Sequence: Synthetic polypeptide
TEEEIRTTNPVATEAYGSVVSTNMLSQPVNR

SEQ ID NO: 33942 - protein, 34 aa, Artificial Sequence
  Description of Artificial Sequence: Synthetic polypeptide
DEEEIRTTNPVATEQYGCTVSCTENLSQRGTNNR

SEQ ID NO: 33943 - protein, 32 aa, Artificial Sequence
  Description of Artificial Sequence: Synthetic polypeptide
TEEEIRTTNPVATECYGCVSVTNLSQRGGDNR

SEQ ID NO: 33944 - protein, 32 aa, Artificial Sequence
  Description of Artificial Sequence: Synthetic polypeptide
DEEEIRTTNPVATEQYGCTVFCTNLSQRVSNR

SEQ ID NO: 33945 - protein, 31 aa, Artificial Sequence
  Description of Artificial Sequence: Synthetic polypeptide
DEEEIRTTNPVATEQYGCTSQTNDQRGDNDQ

SEQ ID NO: 33946 - protein, 32 aa, Artificial Sequence
  Description of Artificial Sequence: Synthetic polypeptide
TEEEIRTTNPVATEEYGSVVSTGLSQRGGNNR

SEQ ID NO: 33947 - protein, 33 aa, Artificial Sequence
  Description of Artificial Sequence: Synthetic polypeptide
TEEEIRTTNPVATEHYGSTVSTNLSQNRGGNPR

SEQ ID NO: 33948 - protein, 30 aa, Artificial Sequence
  Description of Artificial Sequence: Synthetic polypeptide
DEEEIRTTNPVATEQYGCTIATGELQQGNR

SEQ ID NO: 33949 - protein, 33 aa, Artificial Sequence
  Description of Artificial Sequence: Synthetic polypeptide
DEEEIRTTNPVATEQYGCTCSTNELQRGSNNRN

SEQ ID NO: 33950 - protein, 31 aa, Artificial Sequence
  Description of Artificial Sequence: Synthetic polypeptide
DEEEIRTTNPVATEQYGCTCSTNEHQERGNQ

SEQ ID NO: 33951 - protein, 33 aa, Artificial Sequence
  Description of Artificial Sequence: Synthetic polypeptide
TEEEIRTTNPVATEHYGSVSCTNLSQRGGNYRV

SEQ ID NO: 33952 - protein, 31 aa, Artificial Sequence
  Description of Artificial Sequence: Synthetic polypeptide
TEEEIRTTNPVATEPWGSVSCTNLSARGNNR

SEQ ID NO: 33953 - protein, 33 aa, Artificial Sequence
  Description of Artificial Sequence: Synthetic polypeptide
TEEEIRTTNPVATEPYGISTVSYTNMLSQRGNR

SEQ ID NO: 33954 - protein, 29 aa, Artificial Sequence
  Description of Artificial Sequence: Synthetic peptide
TEEEIRTTNPVATEPYGSTLSTHLQRVGR

SEQ ID NO: 33955 - protein, 31 aa, Artificial Sequence
  Description of Artificial Sequence: Synthetic polypeptide
TEEEIRTTNPVATEQYGSVATNLSQGGGNND

SEQ ID NO: 33956 - protein, 32 aa, Artificial Sequence
  Description of Artificial Sequence: Synthetic polypeptide
DEEEIRTTNPVATEQYGAVSTVNLIQGPGNNE

SEQ ID NO: 33957 - protein, 31 aa, Artificial Sequence
  Description of Artificial Sequence: Synthetic polypeptide
DEEEIRTTNPVATEQYGAVSTTNLQTIMNIE

SEQ ID NO: 33958 - protein, 30 aa, Artificial Sequence
  Description of Artificial Sequence: Synthetic polypeptide
DEEEIRTTNPVATEQYGAVSTSNLLFGGQI

SEQ ID NO: 33959 - protein, 30 aa, Artificial Sequence
  Description of Artificial Sequence: Synthetic polypeptide
TEEEIRTTNPVAYEAYGVVSTNLSQRGNNE

SEQ ID NO: 33960 - protein, 32 aa, Artificial Sequence
  Description of Artificial Sequence: Synthetic polypeptide
TEEEIRTTNPVAYECYGSTVSCTNLSQRGNRV

SEQ ID NO: 33961 - protein, 29 aa, Artificial Sequence
  Description of Artificial Sequence: Synthetic peptide
DEEEIRTTNPVATEQWGTVVSTELLGGNQ

SEQ ID NO: 33962 - protein, 31 aa, Artificial Sequence
  Description of Artificial Sequence: Synthetic polypeptide
TEEEIRTTNPVAYEEYGSVASTNHSQRVGNR

SEQ ID NO: 33963 - protein, 30 aa, Artificial Sequence
  Description of Artificial Sequence: Synthetic polypeptide
TEEEIRTTNPVAYEHYGSLVSTNHQRVGNE

SEQ ID NO: 33964 - protein, 30 aa, Artificial Sequence
  Description of Artificial Sequence: Synthetic polypeptide
DEEEIRTTNPVATEQWGTTSTVNPLQRENN

SEQ ID NO: 33965 - protein, 31 aa, Artificial Sequence
  Description of Artificial Sequence: Synthetic polypeptide
TEEEIRTTNPVAYEHYGSVSTNLQRTGGNNK

SEQ ID NO: 33966 - protein, 30 aa, Artificial Sequence
  Description of Artificial Sequence: Synthetic polypeptide
DEEEIRTTNPVATEQWGTSVVTGLLREGNS

SEQ ID NO: 33967 - protein, 30 aa, Artificial Sequence
  Description of Artificial Sequence: Synthetic polypeptide
TEEEIRTTNPVAYEAYGVVSTGNGSQRGNR

SEQ ID NO: 33968 - protein, 29 aa, Artificial Sequence
  Description of Artificial Sequence: Synthetic peptide
TEEEIRTTNPVAYEPWGSVSTNLSTPGNR

SEQ ID NO: 33969 - protein, 31 aa, Artificial Sequence
  Description of Artificial Sequence: Synthetic polypeptide
DEEEIRTTNPVATEQWGTSVSTPLLRDGDNS

SEQ ID NO: 33970 - protein, 31 aa, Artificial Sequence
  Description of Artificial Sequence: Synthetic polypeptide
TEEEIRTTNPVAYEPYGSLVSTNLSPRGGNR

SEQ ID NO: 33971 - protein, 31 aa, Artificial Sequence
  Description of Artificial Sequence: Synthetic polypeptide
TEEEIRTTNPVAYEPYGSTVSCTNAQRGNNR

SEQ ID NO: 33972 - protein, 30 aa, Artificial Sequence
  Description of Artificial Sequence: Synthetic polypeptide
TEEEIRTTNPVAYEPYGSTVSTNLSQRGPQ

SEQ ID NO: 33973 - protein, 31 aa, Artificial Sequence
  Description of Artificial Sequence: Synthetic polypeptide
TEEEIRTTNPVAYEPYGSVPSCTNGQRPGNR

SEQ ID NO: 33974 - protein, 31 aa, Artificial Sequence
  Description of Artificial Sequence: Synthetic polypeptide
TEEEIRTTNPVAYEPYGSVPSTNLSQRGNEV

SEQ ID NO: 33975 - protein, 30 aa, Artificial Sequence
  Description of Artificial Sequence: Synthetic polypeptide
DEEEIRTTNPVATEQWGTSVSTELNREQNS

SEQ ID NO: 33976 - protein, 31 aa, Artificial Sequence
  Description of Artificial Sequence: Synthetic polypeptide
TEEEIRTTNPVAYEPYGSVSTGNLSQRGNNW

SEQ ID NO: 33977 - protein, 30 aa, Artificial Sequence
  Description of Artificial Sequence: Synthetic polypeptide
TEEEIRTTNPVAYEPYGCVSTNALQEGGNR

SEQ ID NO: 33978 - protein, 30 aa, Artificial Sequence
  Description of Artificial Sequence: Synthetic polypeptide
TEEEIRTTNPVAYEPYGSVSTNLSQSGNNA

SEQ ID NO: 33979 - protein, 29 aa, Artificial Sequence
  Description of Artificial Sequence: Synthetic peptide
DEEEIRTTNPVATEQWGTVVSTELLRTNS

SEQ ID NO: 33980 - protein, 31 aa, Artificial Sequence
  Description of Artificial Sequence: Synthetic polypeptide
TEEEIRTTNPVAYEAYGSVVSTNLQRGGNQL

SEQ ID NO: 33981 - protein, 29 aa, Artificial Sequence
  Description of Artificial Sequence: Synthetic peptide
TEEEIRTTNPVATEWYGSVATALQNGDFR

SEQ ID NO: 33982 - protein, 30 aa, Artificial Sequence
  Description of Artificial Sequence: Synthetic polypeptide
DEEEIRTTNPVATEQWGYTISTNELQQGNM

SEQ ID NO: 33983 - protein, 31 aa, Artificial Sequence
  Description of Artificial Sequence: Synthetic polypeptide
TEEEIRTTNPVATLQYGSVSATSNLQRTNDV

SEQ ID NO: 33984 - protein, 31 aa, Artificial Sequence
  Description of Artificial Sequence: Synthetic polypeptide
DEEEIRTTNPVATEQWGYTAYTNELQRDGNR

SEQ ID NO: 33985 - protein, 29 aa, Artificial Sequence
  Description of Artificial Sequence: Synthetic peptide
DEEEIRTTNPVATEQWGVVVSTVLLQGNS

SEQ ID NO: 33986 - protein, 29 aa, Artificial Sequence
  Description of Artificial Sequence: Synthetic peptide
TEEEIRTTNPVAYEAYGCVVSTNLQRNNH

SEQ ID NO: 33987 - protein, 29 aa, Artificial Sequence
  Description of Artificial Sequence: Synthetic peptide
DEEEIRTTNPVATEQWGTVVSTYLNQGNS

SEQ ID NO: 33988 - protein, 32 aa, Artificial Sequence
  Description of Artificial Sequence: Synthetic polypeptide
TEEEIRTTNPVAYEAYGISVSCTNLSQRGNRV

SEQ ID NO: 33989 - protein, 32 aa, Artificial Sequence
  Description of Artificial Sequence: Synthetic polypeptide
TEEEIRTTNPVAYEAYGSVVSTNMLSQRGNER

SEQ ID NO: 33990 - protein, 32 aa, Artificial Sequence
  Description of Artificial Sequence: Synthetic polypeptide
TEEEIRTTNPVAYEAYGSTVSTNLSQRGNYRV

SEQ ID NO: 33991 - protein, 30 aa, Artificial Sequence
  Description of Artificial Sequence: Synthetic polypeptide
DEEEIRTTNPVATEQWGTVVSTTNLLLGND

SEQ ID NO: 33992 - protein, 31 aa, Artificial Sequence
  Description of Artificial Sequence: Synthetic polypeptide
TEEEIRTTNPVAYEAYGSVSTNALQSRGGNE

SEQ ID NO: 33993 - protein, 29 aa, Artificial Sequence
  Description of Artificial Sequence: Synthetic peptide
DEEEIRTTNPVATEQWGTVVSTQLLAGNS

SEQ ID NO: 33994 - protein, 29 aa, Artificial Sequence
  Description of Artificial Sequence: Synthetic peptide
TEEEIRTTNPVAYEAYGSVSTNGSQRVNG

SEQ ID NO: 33995 - protein, 30 aa, Artificial Sequence
  Description of Artificial Sequence: Synthetic polypeptide
TEEEIRTTNPVAYEAYGSVSTNLSQRGGTF

SEQ ID NO: 33996 - protein, 31 aa, Artificial Sequence
  Description of Artificial Sequence: Synthetic polypeptide
DEEEIRTTNPVATEQWGTVVSTNLLLQQGNS

SEQ ID NO: 33997 - protein, 30 aa, Artificial Sequence
  Description of Artificial Sequence: Synthetic polypeptide
TEEEIRTTNPVAYEAYGSVSTNMHQRGGNQ

SEQ ID NO: 33998 - protein, 30 aa, Artificial Sequence
  Description of Artificial Sequence: Synthetic polypeptide
TEEEIRTTNPVAYEAYGSVVSCTNLQKGNS

SEQ ID NO: 33999 - protein, 29 aa, Artificial Sequence
  Description of Artificial Sequence: Synthetic peptide
DEEEIRTTNPVATEQWGTVVSTVNLLGNS

SEQ ID NO: 34000 - protein, 30 aa, Artificial Sequence
  Description of Artificial Sequence: Synthetic polypeptide
TEEEIRTTNPVAYEPYGSVSTNLSVRGGNS

SEQ ID NO: 34001 - protein, 30 aa, Artificial Sequence
  Description of Artificial Sequence: Synthetic polypeptide
DEEEIRTTNPVATEQWGTSVSTEALLDGNS

SEQ ID NO: 34002 - protein, 31 aa, Artificial Sequence
  Description of Artificial Sequence: Synthetic polypeptide
DEEEIRTTNPVATEQWGTSVSTEAGLMRGNS

SEQ ID NO: 34003 - protein, 33 aa, Artificial Sequence
  Description of Artificial Sequence: Synthetic polypeptide
TEEEIRTTNPVAYEQYGSVPSTGNLQRGGNTVR

SEQ ID NO: 34004 - protein, 29 aa, Artificial Sequence
  Description of Artificial Sequence: Synthetic peptide
AEEEIATTNPVAYEQYGSVSTGLQHGNDP

SEQ ID NO: 34005 - protein, 30 aa, Artificial Sequence
  Description of Artificial Sequence: Synthetic polypeptide
DEEEIRTTNPVATEQWGSVSVSDNDQRDNN

SEQ ID NO: 34006 - protein, 32 aa, Artificial Sequence
  Description of Artificial Sequence: Synthetic polypeptide
TEEEIRTTNPVAYEQYGSVPSTNALQQEGNER

SEQ ID NO: 34007 - protein, 33 aa, Artificial Sequence
  Description of Artificial Sequence: Synthetic polypeptide
TEEEIRTTNPVAYEQYGSVPSYTLNELQRGGNR

SEQ ID NO: 34008 - protein, 31 aa, Artificial Sequence
  Description of Artificial Sequence: Synthetic polypeptide
TEEEIRTTNPVAYEQYGSVPTNLSQRGGNYT

SEQ ID NO: 34009 - protein, 32 aa, Artificial Sequence
  Description of Artificial Sequence: Synthetic polypeptide
TEEEIRTTNPVAYEQYGSVSCIGNLQRGGNRG

SEQ ID NO: 34010 - protein, 32 aa, Artificial Sequence
  Description of Artificial Sequence: Synthetic polypeptide
TEEEIRTTNPVAYEQYGSVSCNGNLSQRGGNR

SEQ ID NO: 34011 - protein, 32 aa, Artificial Sequence
  Description of Artificial Sequence: Synthetic polypeptide
TEEEIRTTNPVAYEQYGSVPSTFALQRTGGNR

SEQ ID NO: 34012 - protein, 32 aa, Artificial Sequence
  Description of Artificial Sequence: Synthetic polypeptide
TEEEIRTTNPVAYEQYGSVSCTNALAQRGNNF

SEQ ID NO: 34013 - protein, 30 aa, Artificial Sequence
  Description of Artificial Sequence: Synthetic polypeptide
AEEEIATTNPVAYEQYGSASTNLQHGNDRM

SEQ ID NO: 34014 - protein, 31 aa, Artificial Sequence
  Description of Artificial Sequence: Synthetic polypeptide
TEEEIRTTNPVAYEQYGSVSCTNGQNTGGNR

SEQ ID NO: 34015 - protein, 31 aa, Artificial Sequence
  Description of Artificial Sequence: Synthetic polypeptide
TEEEIRTTNPVAYEQYGSVSCTNLQDGGNNG

SEQ ID NO: 34016 - protein, 31 aa, Artificial Sequence
  Description of Artificial Sequence: Synthetic polypeptide
TEEEIRTTNPVAYEQYGSVSCTNLSQFTGNS

SEQ ID NO: 34017 - protein, 32 aa, Artificial Sequence
  Description of Artificial Sequence: Synthetic polypeptide
TEEEIRTTNPVAYEQYGSVSCTNLSQHGNNRE

SEQ ID NO: 34018 - protein, 32 aa, Artificial Sequence
  Description of Artificial Sequence: Synthetic polypeptide
TEEEIRTTNPVAYEQYGSVSCTNMGSQRPGNR

SEQ ID NO: 34019 - protein, 32 aa, Artificial Sequence
  Description of Artificial Sequence: Synthetic polypeptide
TEEEIRTTNPVAYEQYGSVSCTNNGQRPGGNR

SEQ ID NO: 34020 - protein, 31 aa, Artificial Sequence
  Description of Artificial Sequence: Synthetic polypeptide
TEEEIRTTNPVAYEQYGSVSCTNQAQRGGNA

SEQ ID NO: 34021 - protein, 32 aa, Artificial Sequence
  Description of Artificial Sequence: Synthetic polypeptide
DEEEIRTTNPVATEQWGSVSTNLSTNGGNNRM

SEQ ID NO: 34022 - protein, 32 aa, Artificial Sequence
  Description of Artificial Sequence: Synthetic polypeptide
DEEEIRTTNPVATEQWGSVSVTNLQHGDNDQT

SEQ ID NO: 34023 - protein, 30 aa, Artificial Sequence
  Description of Artificial Sequence: Synthetic polypeptide
AEEEIATTNPVSTEQYGSVSTNEDRGQNER

SEQ ID NO: 34024 - protein, 32 aa, Artificial Sequence
  Description of Artificial Sequence: Synthetic polypeptide
TEEEIRTTNPVAYEQYGSVPSCTSMLSQRGNR

SEQ ID NO: 34025 - protein, 31 aa, Artificial Sequence
  Description of Artificial Sequence: Synthetic polypeptide
DEEEIRTTNPVATEQWGTSVSTDLLRDGNDS

SEQ ID NO: 34026 - protein, 29 aa, Artificial Sequence
  Description of Artificial Sequence: Synthetic peptide
DEEEIRTTNPVATEQWGTSVSIYGERGNS

SEQ ID NO: 34027 - protein, 30 aa, Artificial Sequence
  Description of Artificial Sequence: Synthetic polypeptide
TEEEIRTTNPVAYEQWGKVSTNLQVGGGNR

SEQ ID NO: 34028 - protein, 30 aa, Artificial Sequence
  Description of Artificial Sequence: Synthetic polypeptide
DEEEIRTTNPVATEQWGTSVATELLRGGNS

SEQ ID NO: 34029 - protein, 32 aa, Artificial Sequence
  Description of Artificial Sequence: Synthetic polypeptide
TEEEIRTTNPVAYEQYGCVASTNELSQRGDNR

SEQ ID NO: 34030 - protein, 30 aa, Artificial Sequence
  Description of Artificial Sequence: Synthetic polypeptide
TEEEIRTTNPVAYEQYGCVSTNLSQNGNNE

SEQ ID NO: 34031 - protein, 31 aa, Artificial Sequence
  Description of Artificial Sequence: Synthetic polypeptide
TEEEIRTTNPVAYEQYGHVSCANLAQRVGNR

SEQ ID NO: 34032 - protein, 32 aa, Artificial Sequence
  Description of Artificial Sequence: Synthetic polypeptide
TEEEIRTTNPVAYEQYGISVSTGNLSQSPGNR

SEQ ID NO: 34033 - protein, 32 aa, Artificial Sequence
  Description of Artificial Sequence: Synthetic polypeptide
TEEEIRTTNPVAYEQYGSIVSTNSLQRTGNVG

SEQ ID NO: 34034 - protein, 31 aa, Artificial Sequence
  Description of Artificial Sequence: Synthetic polypeptide
TEEEIRTTNPVAYEQYGSLVSCTNHQRGGNE

SEQ ID NO: 34035 - protein, 29 aa, Artificial Sequence
  Description of Artificial Sequence: Synthetic peptide
AEEEICTTNPVATEQYGTVSVTALQGGNL

SEQ ID NO: 34036 - protein, 33 aa, Artificial Sequence
  Description of Artificial Sequence: Synthetic polypeptide
DEEEIRTTNPVATEQWGSVVSCTNNGSQRGGNR

SEQ ID NO: 34037 - protein, 32 aa, Artificial Sequence
  Description of Artificial Sequence: Synthetic polypeptide
DEEEIRTTNPVATEQWGSVVSCTNLSDIVGNR

SEQ ID NO: 34038 - protein, 33 aa, Artificial Sequence
  Description of Artificial Sequence: Synthetic polypeptide
DEEEIRTTNPVATEQWGSVVSCTNAIQRTGNNR

SEQ ID NO: 34039 - protein, 30 aa, Artificial Sequence
  Description of Artificial Sequence: Synthetic polypeptide
TEEEIRTTNPVAYEQYGSVATNLSQGGNNL

SEQ ID NO: 34040 - protein, 32 aa, Artificial Sequence
  Description of Artificial Sequence: Synthetic polypeptide
DEEEIRTTNPVATEQWGSVVPSCTNLSQSGNL

SEQ ID NO: 34041 - protein, 30 aa, Artificial Sequence
  Description of Artificial Sequence: Synthetic polypeptide
AEEEICTTNPVATEQYGNVSVTMLQGGNQR

SEQ ID NO: 34042 - protein, 29 aa, Artificial Sequence
  Description of Artificial Sequence: Synthetic peptide
AEEEICTTNPVATEQYGNVSTTTLQGGNA

SEQ ID NO: 34043 - protein, 32 aa, Artificial Sequence
  Description of Artificial Sequence: Synthetic polypeptide
DEEEIRTTNPVATEQWGSVVACTPLQRTGGNR

SEQ ID NO: 34044 - protein, 33 aa, Artificial Sequence
  Description of Artificial Sequence: Synthetic polypeptide
TEEEIRTTNPVATESYGSVVPSCTNMLQRGNNR

SEQ ID NO: 34045 - protein, 32 aa, Artificial Sequence
  Description of Artificial Sequence: Synthetic polypeptide
DEEEIRTTNPVATEAYGTVVSCTNLQTRGNQV

SEQ ID NO: 34046 - protein, 31 aa, Artificial Sequence
  Description of Artificial Sequence: Synthetic polypeptide
TEEEIRTTNPVATESYGSVSVTNLHRTGDQR

SEQ ID NO: 34047 - protein, 32 aa, Artificial Sequence
  Description of Artificial Sequence: Synthetic polypeptide
TEEEIRTTNPVATESYGSVSNTNALHRGGDNR

SEQ ID NO: 34048 - protein, 32 aa, Artificial Sequence
  Description of Artificial Sequence: Synthetic polypeptide
TEEEIRTTNPVATEQYGSVSCLGNLSQHGGNR

SEQ ID NO: 34049 - protein, 33 aa, Artificial Sequence
  Description of Artificial Sequence: Synthetic polypeptide
TEEEIRTTNPVATEQYGSVSCTGLQDRTGGNNR

SEQ ID NO: 34050 - protein, 34 aa, Artificial Sequence
  Description of Artificial Sequence: Synthetic polypeptide
TEEEIRTTNPVATEQYGSVSCTGNALSQRGENYR

SEQ ID NO: 34051 - protein, 31 aa, Artificial Sequence
  Description of Artificial Sequence: Synthetic polypeptide
TEEEIRTTNPVATEQYGSVSCTNHGRGGNNG

SEQ ID NO: 34052 - protein, 32 aa, Artificial Sequence
  Description of Artificial Sequence: Synthetic polypeptide
TEEEIRTTNPVATEQYGSVSCTNHQGGGNNRP

SEQ ID NO: 34053 - protein, 32 aa, Artificial Sequence
  Description of Artificial Sequence: Synthetic polypeptide
TEEEIRTTNPVATEQYGSVSCTNLAQAGGNNG

SEQ ID NO: 34054 - protein, 32 aa, Artificial Sequence
  Description of Artificial Sequence: Synthetic polypeptide
TEEEIRTTNPVATEQYGSVSCTNLQRTVTNNY

SEQ ID NO: 34055 - protein, 33 aa, Artificial Sequence
  Description of Artificial Sequence: Synthetic polypeptide
TEEEIRTTNPVATEQYGSVSCTNLSQDTGNNRI

SEQ ID NO: 34056 - protein, 32 aa, Artificial Sequence
  Description of Artificial Sequence: Synthetic polypeptide
TEEEIRTTNPVATEQYGSVSCCGNLSQRGGMR

SEQ ID NO: 34057 - protein, 32 aa, Artificial Sequence
  Description of Artificial Sequence: Synthetic polypeptide
TEEEIRTTNPVATEQYGSVSCTNLSQRVANND

SEQ ID NO: 34058 - protein, 32 aa, Artificial Sequence
  Description of Artificial Sequence: Synthetic polypeptide
TEEEIRTTNPVATEQYGSVSCTNMLSQRVTNP

SEQ ID NO: 34059 - protein, 29 aa, Artificial Sequence
  Description of Artificial Sequence: Synthetic peptide
AEEEIRATNPCATEQYGSVSTENLMTGNQ

SEQ ID NO: 34060 - protein, 34 aa, Artificial Sequence
  Description of Artificial Sequence: Synthetic polypeptide
TEEEIRTTNPVATEQYGSVSCTPNLSQNRPGNNR

SEQ ID NO: 34061 - protein, 32 aa, Artificial Sequence
  Description of Artificial Sequence: Synthetic polypeptide
DEEEIRTTNPVATEQYGAVSTNDQIGENQQRI

SEQ ID NO: 34062 - protein, 32 aa, Artificial Sequence
  Description of Artificial Sequence: Synthetic polypeptide
TEEEIRTTNPVATEQYGSVSETANLQRNENEY

SEQ ID NO: 34063 - protein, 31 aa, Artificial Sequence
  Description of Artificial Sequence: Synthetic polypeptide
DEEEIRTTNPVATEQYGAVSTLNLQRDDSQG

SEQ ID NO: 34064 - protein, 32 aa, Artificial Sequence
  Description of Artificial Sequence: Synthetic polypeptide
TEEEIRTTNPVATEQYGSVSIPNALSQSGGNR

SEQ ID NO: 34065 - protein, 31 aa, Artificial Sequence
  Description of Artificial Sequence: Synthetic polypeptide
TEEEIRTTNPVATEQYGSVSPTNLQDREEQM

SEQ ID NO: 34066 - protein, 34 aa, Artificial Sequence
  Description of Artificial Sequence: Synthetic polypeptide
TEEEIRTTNPVATEQYGSVSCTNLSQTRGGNNRT

SEQ ID NO: 34067 - protein, 31 aa, Artificial Sequence
  Description of Artificial Sequence: Synthetic polypeptide
DEEEIRTTNPVATEQYGAVSSTNLQIQNLIP

SEQ ID NO: 34068 - protein, 32 aa, Artificial Sequence
  Description of Artificial Sequence: Synthetic polypeptide
TEEEIRTTNPVATEQYGSVSATNLSQPGGNNS

SEQ ID NO: 34069 - protein, 32 aa, Artificial Sequence
  Description of Artificial Sequence: Synthetic polypeptide
TEEEIRTTNPVATEQYGSVPSVTNLSQTGNNE

SEQ ID NO: 34070 - protein, 31 aa, Artificial Sequence
  Description of Artificial Sequence: Synthetic polypeptide
TEEEIRTTNPVATEQYGSVFCTNLSQQGGNS

SEQ ID NO: 34071 - protein, 28 aa, Artificial Sequence
  Description of Artificial Sequence: Synthetic peptide
TEEEIRTTNPVATEQYGSVGTAHQNGDQ

SEQ ID NO: 34072 - protein, 32 aa, Artificial Sequence
  Description of Artificial Sequence: Synthetic polypeptide
DEEEIRTTNPVATEQYGAVSTNNLQEDEGGNI

SEQ ID NO: 34073 - protein, 28 aa, Artificial Sequence
  Description of Artificial Sequence: Synthetic peptide
AEEEIRATNPCATEQYGSVSVNLMTGNM

SEQ ID NO: 34074 - protein, 32 aa, Artificial Sequence
  Description of Artificial Sequence: Synthetic polypeptide
TEEEIRTTNPVATEQYGSVNCTNALQRGGNNG

SEQ ID NO: 34075 - protein, 32 aa, Artificial Sequence
  Description of Artificial Sequence: Synthetic polypeptide
DEEEIRTTNPVATEQYGAVSTNLQTDEGENST

SEQ ID NO: 34076 - protein, 33 aa, Artificial Sequence
  Description of Artificial Sequence: Synthetic polypeptide
TEEEIRTTNPVATEQYGSVNTGNALSQRGGNYR

SEQ ID NO: 34077 - protein, 32 aa, Artificial Sequence
  Description of Artificial Sequence: Synthetic polypeptide
TEEEIRTTNPVATEQYGSVNTGNLNQHGSNPR

SEQ ID NO: 34078 - protein, 31 aa, Artificial Sequence
  Description of Artificial Sequence: Synthetic polypeptide
TEEEIRTTNPVATEQYGSVSAENLDEFVGNR

SEQ ID NO: 34079 - protein, 32 aa, Artificial Sequence
  Description of Artificial Sequence: Synthetic polypeptide
TEEEIRTTNPVATEQYGSVNTGNLNQRGSNNV

SEQ ID NO: 34080 - protein, 33 aa, Artificial Sequence
  Description of Artificial Sequence: Synthetic polypeptide
TEEEIRTTNPVATEQYGSVNTPNLSQRGGNYRW

SEQ ID NO: 34081 - protein, 32 aa, Artificial Sequence
  Description of Artificial Sequence: Synthetic polypeptide
TEEEIRTTNPVATEQYGSVPACTNDQRTGGNR

SEQ ID NO: 34082 - protein, 30 aa, Artificial Sequence
  Description of Artificial Sequence: Synthetic polypeptide
TEEEIRTTNPVATEQYGSVPATALQNGGAR

SEQ ID NO: 34083 - protein, 33 aa, Artificial Sequence
  Description of Artificial Sequence: Synthetic polypeptide
TEEEIRTTNPVATEQYGSVPSCCNLSQRGNNRT

SEQ ID NO: 34084 - protein, 33 aa, Artificial Sequence
  Description of Artificial Sequence: Synthetic polypeptide
TEEEIRTTNPVATEQYGSVPSCIGNLAQRGGNR

SEQ ID NO: 34085 - protein, 32 aa, Artificial Sequence
  Description of Artificial Sequence: Synthetic polypeptide
TEEEIRTTNPVATEQYGSVPSTNDSQGPGGNR

SEQ ID NO: 34086 - protein, 33 aa, Artificial Sequence
  Description of Artificial Sequence: Synthetic polypeptide
TEEEIRTTNPVATEQYGSVPSTNEFSQRGGNTR

SEQ ID NO: 34087 - protein, 33 aa, Artificial Sequence
  Description of Artificial Sequence: Synthetic polypeptide
TEEEIRTTNPVATEQYGSVPSTNMLSQPGGNTR

SEQ ID NO: 34088 - protein, 32 aa, Artificial Sequence
  Description of Artificial Sequence: Synthetic polypeptide
TEEEIRTTNPVATEQYGSVNTGNLSQRVENYR

SEQ ID NO: 34089 - protein, 33 aa, Artificial Sequence
  Description of Artificial Sequence: Synthetic polypeptide
TEEEIRTTNPVATEQYGSVSTGNELSQRGGSYR

SEQ ID NO: 34090 - protein, 32 aa, Artificial Sequence
  Description of Artificial Sequence: Synthetic polypeptide
DEEEIRTTNPVATEQYGAVSSTNLQFNEGNEF

SEQ ID NO: 34091 - protein, 32 aa, Artificial Sequence
  Description of Artificial Sequence: Synthetic polypeptide
TEEEIRTTNPVATEQYGSVSTGNLQSNGGTNI

SEQ ID NO: 34092 - protein, 34 aa, Artificial Sequence
  Description of Artificial Sequence: Synthetic polypeptide
TEEEIRTTNPVATEQYGSVTSYTENLSQRTGGNR

SEQ ID NO: 34093 - protein, 31 aa, Artificial Sequence
  Description of Artificial Sequence: Synthetic polypeptide
TEEEIRTTNPVATEQYGSVVACTHLQNGSNR

SEQ ID NO: 34094 - protein, 32 aa, Artificial Sequence
  Description of Artificial Sequence: Synthetic polypeptide
TEEEIRTTNPVATEQYGSVVACTPNLQRGGNE

SEQ ID NO: 34095 - protein, 33 aa, Artificial Sequence
  Description of Artificial Sequence: Synthetic polypeptide
TEEEIRTTNPVATEQYGSVVPSCTGNLQQTGNR

SEQ ID NO: 34096 - protein, 32 aa, Artificial Sequence
  Description of Artificial Sequence: Synthetic polypeptide
TEEEIRTTNPVATEQYGSVVSCCNLQRGGNNG

SEQ ID NO: 34097 - protein, 33 aa, Artificial Sequence
  Description of Artificial Sequence: Synthetic polypeptide
TEEEIRTTNPVATEQYGSVVSCEGNLQRGGNNR

SEQ ID NO: 34098 - protein, 34 aa, Artificial Sequence
  Description of Artificial Sequence: Synthetic polypeptide
TEEEIRTTNPVATEQYGSVVSTNALSQRPGGNQR

SEQ ID NO: 34099 - protein, 32 aa, Artificial Sequence
  Description of Artificial Sequence: Synthetic polypeptide
TEEEIRTTNPVATEQYGSVVSTNMLSGAGGNR

SEQ ID NO: 34100 - protein, 30 aa, Artificial Sequence
  Description of Artificial Sequence: Synthetic polypeptide
AEEEICTTNPVATEQYGVVSVTMQLQGGNR

SEQ ID NO: 34101 - protein, 33 aa, Artificial Sequence
  Description of Artificial Sequence: Synthetic polypeptide
TEEEIRTTNPVATEQYGSVWTDNGLEQRGENHR

SEQ ID NO: 34102 - protein, 33 aa, Artificial Sequence
  Description of Artificial Sequence: Synthetic polypeptide
TEEEIRTTNPVATEQYGTTVSCTNLSQRGNNRI

SEQ ID NO: 34103 - protein, 32 aa, Artificial Sequence
  Description of Artificial Sequence: Synthetic polypeptide
TEEEIRTTNPVATEQYGTVACTNLSQRTGTNR

SEQ ID NO: 34104 - protein, 32 aa, Artificial Sequence
  Description of Artificial Sequence: Synthetic polypeptide
TEEEIRTTNPVATEQYGTVQSCTNLSQRGNNE

SEQ ID NO: 34105 - protein, 33 aa, Artificial Sequence
  Description of Artificial Sequence: Synthetic polypeptide
TEEEIRTTNPVATEQYGTVSCTNLSQRTGNNRC

SEQ ID NO: 34106 - protein, 32 aa, Artificial Sequence
  Description of Artificial Sequence: Synthetic polypeptide
TEEEIRTTNPVATEQYGTVSCTNLSQTAGGNR

SEQ ID NO: 34107 - protein, 30 aa, Artificial Sequence
  Description of Artificial Sequence: Synthetic polypeptide
TEEEIRTTNPVATEQYGTVSTNDGQGGQAR

SEQ ID NO: 34108 - protein, 32 aa, Artificial Sequence
  Description of Artificial Sequence: Synthetic polypeptide
TEEEIRTTNPVATEQYGVVPSYTNLSQHGGNR

SEQ ID NO: 34109 - protein, 31 aa, Artificial Sequence
  Description of Artificial Sequence: Synthetic polypeptide
TEEEIRTTNPVATERYGKVSCTNLSQRGNND

SEQ ID NO: 34110 - protein, 30 aa, Artificial Sequence
  Description of Artificial Sequence: Synthetic polypeptide
DEEEIRTTNPVATEQYGAMSDDNPLQRENN

SEQ ID NO: 34111 - protein, 32 aa, Artificial Sequence
  Description of Artificial Sequence: Synthetic polypeptide
TEEEIRTTNPVATEQYGSVSVTNLSQGVGNQN

SEQ ID NO: 34112 - protein, 32 aa, Artificial Sequence
  Description of Artificial Sequence: Synthetic polypeptide
TEEEIRTTNPVATEQYGSVSTTNLQQEEGGNG

SEQ ID NO: 34113 - protein, 33 aa, Artificial Sequence
  Description of Artificial Sequence: Synthetic polypeptide
DEEEIRTTNPVATEQYGATSMTENLSQRIGNRV

SEQ ID NO: 34114 - protein, 34 aa, Artificial Sequence
  Description of Artificial Sequence: Synthetic polypeptide
TEEEIRTTNPVATEQYGSVSTGNLSQTRGGNNRD

SEQ ID NO: 34115 - protein, 32 aa, Artificial Sequence
  Description of Artificial Sequence: Synthetic polypeptide
DEEEIRTTNPVATEQYGAVSSTGNLQGEGGNT

SEQ ID NO: 34116 - protein, 31 aa, Artificial Sequence
  Description of Artificial Sequence: Synthetic polypeptide
TEEEIRTTNPVATEQYGSVSTNDSQEGGNNE

SEQ ID NO: 34117 - protein, 29 aa, Artificial Sequence
  Description of Artificial Sequence: Synthetic peptide
AEEEIRATNPCATEQYGSVSNNLMREGNM

SEQ ID NO: 34118 - protein, 29 aa, Artificial Sequence
  Description of Artificial Sequence: Synthetic peptide
AEEEIRATNPCATEQYGSVSETNLMLGNM

SEQ ID NO: 34119 - protein, 31 aa, Artificial Sequence
  Description of Artificial Sequence: Synthetic polypeptide
TEEEIRTTNPVATEQYGSVSTNLQNFGSEQA

SEQ ID NO: 34120 - protein, 29 aa, Artificial Sequence
  Description of Artificial Sequence: Synthetic peptide
AEEEIRATNPCATEQYGSVSENLSRGNEM

SEQ ID NO: 34121 - protein, 30 aa, Artificial Sequence
  Description of Artificial Sequence: Synthetic polypeptide
DEEEIRTTNPVATEQYGAVSGTTLQGAANN

SEQ ID NO: 34122 - protein, 29 aa, Artificial Sequence
  Description of Artificial Sequence: Synthetic peptide
AEEEIRATNPCATEQYGSVSENLNRNGNM

SEQ ID NO: 34123 - protein, 29 aa, Artificial Sequence
  Description of Artificial Sequence: Synthetic peptide
AEEEIRATNPCATEQYGSVSENLNQPGNV

SEQ ID NO: 34124 - protein, 28 aa, Artificial Sequence
  Description of Artificial Sequence: Synthetic peptide
AEEEIRATNPCATEQYGSVSENLMSGNG

SEQ ID NO: 34125 - protein, 32 aa, Artificial Sequence
  Description of Artificial Sequence: Synthetic polypeptide
DEEEIRTTNPVATEQYGAVSGTNLQMNGNGGV

SEQ ID NO: 34126 - protein, 29 aa, Artificial Sequence
  Description of Artificial Sequence: Synthetic peptide
AEEEIRATNPCATEQYGSVSENLMQGDNR

SEQ ID NO: 34127 - protein, 28 aa, Artificial Sequence
  Description of Artificial Sequence: Synthetic peptide
AEEEIRATNPCATEQYGSVSENLLMGNM

SEQ ID NO: 34128 - protein, 31 aa, Artificial Sequence
  Description of Artificial Sequence: Synthetic polypeptide
AEEEIGTTNPVATEQYGSVSTNQLQEQEGNL

SEQ ID NO: 34129 - protein, 32 aa, Artificial Sequence
  Description of Artificial Sequence: Synthetic polypeptide
DEEEIRTTNPVATEQYGAVISTNLQINEGGND

SEQ ID NO: 34130 - protein, 31 aa, Artificial Sequence
  Description of Artificial Sequence: Synthetic polypeptide
DEEEIRTTNPVATEQYGAVGSTDLQRDEQRQ

SEQ ID NO: 34131 - protein, 32 aa, Artificial Sequence
  Description of Artificial Sequence: Synthetic polypeptide
TEEEIRTTNPVATEQYGSVSTSNEGQRGENTF

SEQ ID NO: 34132 - protein, 30 aa, Artificial Sequence
  Description of Artificial Sequence: Synthetic polypeptide
AEEEICTTNPVATEQYGVVSVTTLQGGNER

SEQ ID NO: 34133 - protein, 31 aa, Artificial Sequence
  Description of Artificial Sequence: Synthetic polypeptide
DEEEIRTTNPVATEQWGYTISTNELQRDGNA

SEQ ID NO: 34134 - protein, 32 aa, Artificial Sequence
  Description of Artificial Sequence: Synthetic polypeptide
DEEEIRTTNPVATEQYGCVCGTNLQRFPSNRA

SEQ ID NO: 34135 - protein, 32 aa, Artificial Sequence
  Description of Artificial Sequence: Synthetic polypeptide
DEEEIRTTNPVATEQYGCVCSANLQRFGSNII

SEQ ID NO: 34136 - protein, 30 aa, Artificial Sequence
  Description of Artificial Sequence: Synthetic polypeptide
TEEEIMTTNPVATEQYGKVSVTGLSQGGNR

SEQ ID NO: 34137 - protein, 31 aa, Artificial Sequence
  Description of Artificial Sequence: Synthetic polypeptide
AEEEIRTTNPVATEQYGSVNSTNNNNQDGNG

SEQ ID NO: 34138 - protein, 34 aa, Artificial Sequence
  Description of Artificial Sequence: Synthetic polypeptide
DEEEIRTTNPVATEAYGSVPSYTNLSQRAGGNRG

SEQ ID NO: 34139 - protein, 28 aa, Artificial Sequence
  Description of Artificial Sequence: Synthetic peptide
SQEEICCTNPIATEQYGSVSENLMRGNR

SEQ ID NO: 34140 - protein, 30 aa, Artificial Sequence
  Description of Artificial Sequence: Synthetic polypeptide
AEEEIRTTNPVATEQYGSVGTALQNFGSDR

SEQ ID NO: 34141 - protein, 32 aa, Artificial Sequence
  Description of Artificial Sequence: Synthetic polypeptide
DEEEIRTTNPVATEQYGCVCSTENTQFGSNRV

SEQ ID NO: 34142 - protein, 29 aa, Artificial Sequence
  Description of Artificial Sequence: Synthetic peptide
SQEEIRCTNPIATEQYGSVSENLPMRGNR

SEQ ID NO: 34143 - protein, 31 aa, Artificial Sequence
  Description of Artificial Sequence: Synthetic polypeptide
AEEEIRTTNPVATEQYGSVCSTNLQFISNQY

SEQ ID NO: 34144 - protein, 32 aa, Artificial Sequence
  Description of Artificial Sequence: Synthetic polypeptide
AEEEIRTTNPVATEQYGSVCSTNHQRSGSDRP

SEQ ID NO: 34145 - protein, 31 aa, Artificial Sequence
  Description of Artificial Sequence: Synthetic polypeptide
AEEEIRTTNPVATEQYGSVNSTNNNQDGNNT

SEQ ID NO: 34146 - protein, 29 aa, Artificial Sequence
  Description of Artificial Sequence: Synthetic peptide
SQEEIRTTNPEATEQWGTVSTNLQGGNNR

SEQ ID NO: 34147 - protein, 31 aa, Artificial Sequence
  Description of Artificial Sequence: Synthetic polypeptide
AEEEIRTTNPVATEQYGSVCSTGELQGGSND

SEQ ID NO: 34148 - protein, 30 aa, Artificial Sequence
  Description of Artificial Sequence: Synthetic polypeptide
AEEEIRTTNPVATEQYGSVCSTELQNGDQP

SEQ ID NO: 34149 - protein, 33 aa, Artificial Sequence
  Description of Artificial Sequence: Synthetic polypeptide
AEEEIRTTNPVATEQYGSVCNTMNLDQRGSNTR

SEQ ID NO: 34150 - protein, 34 aa, Artificial Sequence
  Description of Artificial Sequence: Synthetic polypeptide
DEEEIRTTNPVATEAYGSVSCTANLSQRGGNNRP

SEQ ID NO: 34151 - protein, 33 aa, Artificial Sequence
  Description of Artificial Sequence: Synthetic polypeptide
DEEEIRTTNPVATEAYGSVSCTDNASQRGGNNR

SEQ ID NO: 34152 - protein, 31 aa, Artificial Sequence
  Description of Artificial Sequence: Synthetic polypeptide
DEEEIRTTNPVATEAYGSVSCTGGLSQGVNR

SEQ ID NO: 34153 - protein, 33 aa, Artificial Sequence
  Description of Artificial Sequence: Synthetic polypeptide
DEEEIRTTNPVATEAYGSVSCTGHLDQRGGNNR

SEQ ID NO: 34154 - protein, 30 aa, Artificial Sequence
  Description of Artificial Sequence: Synthetic polypeptide
SQEEIRTTNPVATEQWGKTVSTNLSQEGNR

SEQ ID NO: 34155 - protein, 32 aa, Artificial Sequence
  Description of Artificial Sequence: Synthetic polypeptide
DEEEIRTTNPVATEAYGSVSCNNELSQNGGNR

SEQ ID NO: 34156 - protein, 29 aa, Artificial Sequence
  Description of Artificial Sequence: Synthetic peptide
AEEEIRTTNPVATEQYGSVATVALQNGVQ

SEQ ID NO: 34157 - protein, 33 aa, Artificial Sequence
  Description of Artificial Sequence: Synthetic polypeptide
AEEEIRTTNPVATEQYGSVNTGNLDQRFGSNTR

SEQ ID NO: 34158 - protein, 32 aa, Artificial Sequence
  Description of Artificial Sequence: Synthetic polypeptide
DEEEIRTTNPVATEAYGSVPSTNLSQDTGGPR

SEQ ID NO: 34159 - protein, 32 aa, Artificial Sequence
  Description of Artificial Sequence: Synthetic polypeptide
AEEEIRTTNPVATEQYGSVSATNLQNQNENNR

SEQ ID NO: 34160 - protein, 32 aa, Artificial Sequence
  Description of Artificial Sequence: Synthetic polypeptide
AEEEIRTTNPVATEQYGSVSATNLQAGENNND

SEQ ID NO: 34161 - protein, 30 aa, Artificial Sequence
  Description of Artificial Sequence: Synthetic polypeptide
AEEEIRTTNPVATEQYGSVSAQNLDEGGNI

SEQ ID NO: 34162 - protein, 30 aa, Artificial Sequence
  Description of Artificial Sequence: Synthetic polypeptide
AEEEIRTTNPVATEQYGSVSANNNQETGNN

SEQ ID NO: 34163 - protein, 29 aa, Artificial Sequence
  Description of Artificial Sequence: Synthetic peptide
AEEEIRTTNPVATEQYGSVSALLQGQINA

SEQ ID NO: 34164 - protein, 32 aa, Artificial Sequence
  Description of Artificial Sequence: Synthetic polypeptide
DEEEIRTTNPVATEAYGSVPSCTFLSQAGGNR

SEQ ID NO: 34165 - protein, 29 aa, Artificial Sequence
  Description of Artificial Sequence: Synthetic peptide
AEEEIRTTNPVATEQYGSVQTALQENGDQ

SEQ ID NO: 34166 - protein, 30 aa, Artificial Sequence
  Description of Artificial Sequence: Synthetic polypeptide
SNEEIRTTNPVATEQYGVVSTNLQDGGPNF

SEQ ID NO: 34167 - protein, 33 aa, Artificial Sequence
  Description of Artificial Sequence: Synthetic polypeptide
DEEEIRTTNPVATEAYGSVPSTNLSQRGGNNMC

SEQ ID NO: 34168 - protein, 29 aa, Artificial Sequence
  Description of Artificial Sequence: Synthetic peptide
SQEEIATTNPVATEQWGTVSTNLNQEGNR

SEQ ID NO: 34169 - protein, 32 aa, Artificial Sequence
  Description of Artificial Sequence: Synthetic polypeptide
DEEEIRTTNPVATEAYGSVPSCTNLSQEGNNA

SEQ ID NO: 34170 - protein, 32 aa, Artificial Sequence
  Description of Artificial Sequence: Synthetic polypeptide
AEEEIRTTNPVATEQYGSVNTTNLAQQGENLR

SEQ ID NO: 34171 - protein, 33 aa, Artificial Sequence
  Description of Artificial Sequence: Synthetic polypeptide
DEEEIRTTNPVATEAYGSVPSCTNLSQHGGNMR

SEQ ID NO: 34172 - protein, 32 aa, Artificial Sequence
  Description of Artificial Sequence: Synthetic polypeptide
DEEEIRTTNPVATEAYGSVPSTNAISQNHGNR

SEQ ID NO: 34173 - protein, 32 aa, Artificial Sequence
  Description of Artificial Sequence: Synthetic polypeptide
AEEEIRTTNPVATEQYGSVNTSNLTQRGENPG

SEQ ID NO: 34174 - protein, 32 aa, Artificial Sequence
  Description of Artificial Sequence: Synthetic polypeptide
AEEEIRTTNPVATEQYGSVNTSNLTQEGENNR

SEQ ID NO: 34175 - protein, 32 aa, Artificial Sequence
  Description of Artificial Sequence: Synthetic polypeptide
AEEEIRTTNPVATEQYGSVNTSNLQQNGENIR

SEQ ID NO: 34176 - protein, 32 aa, Artificial Sequence
  Description of Artificial Sequence: Synthetic polypeptide
AEEEIRTTNPVATEQYGSVNTSNLDQQGENQR

SEQ ID NO: 34177 - protein, 30 aa, Artificial Sequence
  Description of Artificial Sequence: Synthetic polypeptide
AEEEIRTTNPVATEQYGSVPATALSQNGDR

SEQ ID NO: 34178 - protein, 33 aa, Artificial Sequence
  Description of Artificial Sequence: Synthetic polypeptide
DEEEIRTTNPVATEAYGSVSCTGNLSARGGNRY

SEQ ID NO: 34179 - protein, 28 aa, Artificial Sequence
  Description of Artificial Sequence: Synthetic peptide
SQEEIRTTNPVATEQWGTCSTNLQGGGR

SEQ ID NO: 34180 - protein, 33 aa, Artificial Sequence
  Description of Artificial Sequence: Synthetic polypeptide
DEEEIRTTNPVATEAYGSVSCTGNLSQRGQNNA

SEQ ID NO: 34181 - protein, 29 aa, Artificial Sequence
  Description of Artificial Sequence: Synthetic peptide
AEEEIRTTNPVATEQYGSTSTLLQGNQGG

SEQ ID NO: 34182 - protein, 30 aa, Artificial Sequence
  Description of Artificial Sequence: Synthetic polypeptide
SQEEIRTTNPVATEQWGTVSTNLQYGSNRI

SEQ ID NO: 34183 - protein, 28 aa, Artificial Sequence
  Description of Artificial Sequence: Synthetic peptide
SQEEIRTTNPVATEQWGTVSTNNQEGER

SEQ ID NO: 34184 - protein, 29 aa, Artificial Sequence
  Description of Artificial Sequence: Synthetic peptide
SQEEIRTTNPVATEQWGTVVTENLQGGNR

SEQ ID NO: 34185 - protein, 30 aa, Artificial Sequence
  Description of Artificial Sequence: Synthetic polypeptide
SQEEIRTTNPVATEQWGYTVYSTNLQGGNR

SEQ ID NO: 34186 - protein, 28 aa, Artificial Sequence
  Description of Artificial Sequence: Synthetic peptide
SQEEIRTTNPVAYEAWGTVSTNLQEGNR

SEQ ID NO: 34187 - protein, 32 aa, Artificial Sequence
  Description of Artificial Sequence: Synthetic polypeptide
DEEEIRTTNPVATEAYGSVSCTPLSQRGGNYA

SEQ ID NO: 34188 - protein, 33 aa, Artificial Sequence
  Description of Artificial Sequence: Synthetic polypeptide
DEEEIRTTNPVATEAYGSVSCTQNELSQRSNNR

SEQ ID NO: 34189 - protein, 29 aa, Artificial Sequence
  Description of Artificial Sequence: Synthetic peptide
AEEEIRTTNPVATEQYGSTSTLLQNQDER

SEQ ID NO: 34190 - protein, 29 aa, Artificial Sequence
  Description of Artificial Sequence: Synthetic peptide
SSEEIRCTNPIATEQYGSVSENLMRGNRL

SEQ ID NO: 34191 - protein, 29 aa, Artificial Sequence
  Description of Artificial Sequence: Synthetic peptide
SSEEIRTTNPVATCQYGCVSTELQRGNFG

SEQ ID NO: 34192 - protein, 32 aa, Artificial Sequence
  Description of Artificial Sequence: Synthetic polypeptide
DEEEIRTTNPVATEAYGSVSSTNLQIGGNNDT

SEQ ID NO: 34193 - protein, 31 aa, Artificial Sequence
  Description of Artificial Sequence: Synthetic polypeptide
DEEEIRTTNPVATEAYGSVSSVTGLQFGNLG

SEQ ID NO: 34194 - protein, 29 aa, Artificial Sequence
  Description of Artificial Sequence: Synthetic peptide
SSEEIRTTNPVATDQYGSVSTDLQDGNFQ

SEQ ID NO: 34195 - protein, 29 aa, Artificial Sequence
  Description of Artificial Sequence: Synthetic peptide
SSEEIRTTNPVATDQYGSVSTDLQNGGNF

SEQ ID NO: 34196 - protein, 30 aa, Artificial Sequence
  Description of Artificial Sequence: Synthetic polypeptide
SSEEIRTTNPVATDQYGSVSTDLQRDGENF

SEQ ID NO: 34197 - protein, 29 aa, Artificial Sequence
  Description of Artificial Sequence: Synthetic peptide
SSEEIRTTNPVATDQYGSVSTELQRVNFV

SEQ ID NO: 34198 - protein, 29 aa, Artificial Sequence
  Description of Artificial Sequence: Synthetic peptide
SSEEIRTTNPVATDQYGSVSTLLQDNGNF

SEQ ID NO: 34199 - protein, 28 aa, Artificial Sequence
  Description of Artificial Sequence: Synthetic peptide
SSEEIRCTNPIATEQYGSVSEWLMRGNR

SEQ ID NO: 34200 - protein, 28 aa, Artificial Sequence
  Description of Artificial Sequence: Synthetic peptide
AEEEIRTTNPVATEQYGSTSTQLQEQEQ

SEQ ID NO: 34201 - protein, 30 aa, Artificial Sequence
  Description of Artificial Sequence: Synthetic polypeptide
SQEEIRTTNPVATEQWGTVSTNLQYFGNRS

SEQ ID NO: 34202 - protein, 28 aa, Artificial Sequence
  Description of Artificial Sequence: Synthetic peptide
AEEEIRTTNPVATEQYGSTSTVLQIQGG

SEQ ID NO: 34203 - protein, 29 aa, Artificial Sequence
  Description of Artificial Sequence: Synthetic peptide
SQEEIRTTNPVATEQWGTVSDTNLQEGND

SEQ ID NO: 34204 - protein, 32 aa, Artificial Sequence
  Description of Artificial Sequence: Synthetic polypeptide
DEEEIRTTNPVATEAYGSVSCTLNLSQSGGNA

SEQ ID NO: 34205 - protein, 28 aa, Artificial Sequence
  Description of Artificial Sequence: Synthetic peptide
SQEEIRTTNPVATEQWGTVSTELQNGNV

SEQ ID NO: 34206 - protein, 28 aa, Artificial Sequence
  Description of Artificial Sequence: Synthetic peptide
SQEEIRTTNPVATEQWGTVSTNEQEGNF

SEQ ID NO: 34207 - protein, 32 aa, Artificial Sequence
  Description of Artificial Sequence: Synthetic polypeptide
DEEEIRTTNPVATEAYGSVSCTNALSQTGPNV

SEQ ID NO: 34208 - protein, 30 aa, Artificial Sequence
  Description of Artificial Sequence: Synthetic polypeptide
AEEEIRTTNPVATEQYGSVATTNALQNGVE

SEQ ID NO: 34209 - protein, 30 aa, Artificial Sequence
  Description of Artificial Sequence: Synthetic polypeptide
SQEEIRTTNPVATEQWGTVSTNLQEGMNRQ

SEQ ID NO: 34210 - protein, 30 aa, Artificial Sequence
  Description of Artificial Sequence: Synthetic polypeptide
AEEEIRTTNPVATEQYGSVATQALQNGNFE

SEQ ID NO: 34211 - protein, 29 aa, Artificial Sequence
  Description of Artificial Sequence: Synthetic peptide
SQEEIRTTNPVATEQWGTVSTNLQEQNRD

SEQ ID NO: 34212 - protein, 33 aa, Artificial Sequence
  Description of Artificial Sequence: Synthetic polypeptide
DEEEIRTTNPVATEAYGSVSCTNAQSQRPGNNR

SEQ ID NO: 34213 - protein, 29 aa, Artificial Sequence
  Description of Artificial Sequence: Synthetic peptide
SQEEIRTTNPVATEQWGTVSTNLQHGNQN

SEQ ID NO: 34214 - protein, 30 aa, Artificial Sequence
  Description of Artificial Sequence: Synthetic polypeptide
SQEEIRTTNPVATEQWGTVSTNLQHIGSNR

SEQ ID NO: 34215 - protein, 31 aa, Artificial Sequence
  Description of Artificial Sequence: Synthetic polypeptide
AEEEIRTTNPVATEQYGSVATNLQAEEGTRS

SEQ ID NO: 34216 - protein, 30 aa, Artificial Sequence
  Description of Artificial Sequence: Synthetic polypeptide
AEEEIRTTNPVATEQYGSVATAQLQNGNVE

SEQ ID NO: 34217 - protein, 29 aa, Artificial Sequence
  Description of Artificial Sequence: Synthetic peptide
AEEEIRTTNPVATEQYGSVATALQQNGFA

SEQ ID NO: 34218 - protein, 29 aa, Artificial Sequence
  Description of Artificial Sequence: Synthetic peptide
AEEEIRTTNPVATEQYGSVATALQNQGVE

SEQ ID NO: 34219 - protein, 29 aa, Artificial Sequence
  Description of Artificial Sequence: Synthetic peptide
AEEEIRTTNPVATEQYGSVATALQNGEFS

SEQ ID NO: 34220 - protein, 32 aa, Artificial Sequence
  Description of Artificial Sequence: Synthetic polypeptide
DEEEIRTTNPVATEAYGSVSCTNLSQIGTNNA

SEQ ID NO: 34221 - protein, 31 aa, Artificial Sequence
  Description of Artificial Sequence: Synthetic polypeptide
AEEEIRTTNPVATEQYGSVAATNLQDGNDGM

SEQ ID NO: 34222 - protein, 32 aa, Artificial Sequence
  Description of Artificial Sequence: Synthetic polypeptide
AEEEIRTTNPVATEQYGSVSATNLQQGENEEE

SEQ ID NO: 34223 - protein, 29 aa, Artificial Sequence
  Description of Artificial Sequence: Synthetic peptide
SSEEIRTTNPVATDQYGSVSTVLQRTGGF

SEQ ID NO: 34224 - protein, 32 aa, Artificial Sequence
  Description of Artificial Sequence: Synthetic polypeptide
AEEEIRTTNPVATEQYGSVSATNLQQGENGNQ

SEQ ID NO: 34225 - protein, 32 aa, Artificial Sequence
  Description of Artificial Sequence: Synthetic polypeptide
AEEEIRTTNPVATEQYGSVSATNLQQGNNNTN

SEQ ID NO: 34226 - protein, 31 aa, Artificial Sequence
  Description of Artificial Sequence: Synthetic polypeptide
AEEEIRTTNPVATEQYGSVSNTNLQQQGEDN

SEQ ID NO: 34227 - protein, 32 aa, Artificial Sequence
  Description of Artificial Sequence: Synthetic polypeptide
AEEEIRTTNPVATEQYGSVSNTNLQQNNGANI

SEQ ID NO: 34228 - protein, 28 aa, Artificial Sequence
  Description of Artificial Sequence: Synthetic peptide
SEYEIRATNPVATEQYGSVETSLQHGNQ

SEQ ID NO: 34229 - protein, 33 aa, Artificial Sequence
  Description of Artificial Sequence: Synthetic polypeptide
DEEEIRTTNPVATEAYGSTVSTGNLSQNGGNRC

SEQ ID NO: 34230 - protein, 32 aa, Artificial Sequence
  Description of Artificial Sequence: Synthetic polypeptide
AEEEIRTTNPVATEQYGSVSNTNLQNNNGIND

SEQ ID NO: 34231 - protein, 31 aa, Artificial Sequence
  Description of Artificial Sequence: Synthetic polypeptide
AEEEIRTTNPVATEQYGSVSNTNLQNNENAT

SEQ ID NO: 34232 - protein, 32 aa, Artificial Sequence
  Description of Artificial Sequence: Synthetic polypeptide
AEEEIRTTNPVATEQYGSVSNTNLQNGGGNDE

SEQ ID NO: 34233 - protein, 32 aa, Artificial Sequence
  Description of Artificial Sequence: Synthetic polypeptide
AEEEIRTTNPVATEQYGSVSNTNLQGNSGNEQ

SEQ ID NO: 34234 - protein, 32 aa, Artificial Sequence
  Description of Artificial Sequence: Synthetic polypeptide
AEEEIRTTNPVATEQYGSVSNTNLQQTGTTND

SEQ ID NO: 34235 - protein, 31 aa, Artificial Sequence
  Description of Artificial Sequence: Synthetic polypeptide
AEEEIRTTNPVATEQYGSVSNTNLQGENATG

SEQ ID NO: 34236 - protein, 28 aa, Artificial Sequence
  Description of Artificial Sequence: Synthetic peptide
SEYEIRATNPVAWEQYGSVETNLQHGNQ

SEQ ID NO: 34237 - protein, 31 aa, Artificial Sequence
  Description of Artificial Sequence: Synthetic polypeptide
AEEEIRTTNPVATEQYGSVSNTNLDEFGNNI

SEQ ID NO: 34238 - protein, 31 aa, Artificial Sequence
  Description of Artificial Sequence: Synthetic polypeptide
AEEEIRTTNPVATEQYGSVSNTNDQGNGTNI

SEQ ID NO: 34239 - protein, 31 aa, Artificial Sequence
  Description of Artificial Sequence: Synthetic polypeptide
AEEEIRTTNPVATEQYGSVSNTNDQGNGNQN

SEQ ID NO: 34240 - protein, 28 aa, Artificial Sequence
  Description of Artificial Sequence: Synthetic peptide
SEYEIRCTNPVATEQYGCVFTNLQHGNQ

SEQ ID NO: 34241 - protein, 28 aa, Artificial Sequence
  Description of Artificial Sequence: Synthetic peptide
AEEEIRTTNPVATEQYGSVSNSLDNGEQ

SEQ ID NO: 34242 - protein, 31 aa, Artificial Sequence
  Description of Artificial Sequence: Synthetic polypeptide
AEEEIRTTNPVATEQYGSVSNQNNLQVGNIN

SEQ ID NO: 34243 - protein, 31 aa, Artificial Sequence
  Description of Artificial Sequence: Synthetic polypeptide
AEEEIRTTNPVATEQYGSVSNNVLGIIQGNR

SEQ ID NO: 34244 - protein, 31 aa, Artificial Sequence
  Description of Artificial Sequence: Synthetic polypeptide
AEEEIRTTNPVATEQYGSVSNTNLNNVEGNS

SEQ ID NO: 34245 - protein, 30 aa, Artificial Sequence
  Description of Artificial Sequence: Synthetic polypeptide
AEEEIRTTNPVATEQYGSVSNNQLQGTNNQ

SEQ ID NO: 34246 - protein, 32 aa, Artificial Sequence
  Description of Artificial Sequence: Synthetic polypeptide
AEEEIRTTNPVATEQYGSVSNTNLQQTGTTNE

SEQ ID NO: 34247 - protein, 31 aa, Artificial Sequence
  Description of Artificial Sequence: Synthetic polypeptide
AEEEIRTTNPVATEQYGSVSNTNLQTGGGTT

SEQ ID NO: 34248 - protein, 33 aa, Artificial Sequence
  Description of Artificial Sequence: Synthetic polypeptide
DEEEIRTTNPVATEAYGSTTSYTENLSQRTGNR

SEQ ID NO: 34249 - protein, 30 aa, Artificial Sequence
  Description of Artificial Sequence: Synthetic polypeptide
SEVEIATTNPVATEQYGSVATNLQRDGNDF

SEQ ID NO: 34250 - protein, 29 aa, Artificial Sequence
  Description of Artificial Sequence: Synthetic peptide
SEVEIRCTNPIATEQYGSVSENLMRGGNR

SEQ ID NO: 34251 - protein, 32 aa, Artificial Sequence
  Description of Artificial Sequence: Synthetic polypeptide
AEEEIRTTNPVATEQYGSVSNTTNLQSGNDNG

SEQ ID NO: 34252 - protein, 32 aa, Artificial Sequence
  Description of Artificial Sequence: Synthetic polypeptide
DEEEIRTTNPVATEAYGSTVPSTDLSQRGGNE

SEQ ID NO: 34253 - protein, 32 aa, Artificial Sequence
  Description of Artificial Sequence: Synthetic polypeptide
AEEEIRTTNPVATEQYGSVSNTTNLQQIGNNS

SEQ ID NO: 34254 - protein, 31 aa, Artificial Sequence
  Description of Artificial Sequence: Synthetic polypeptide
AEEEIRTTNPVATEQYGSVSNTTNLQAGIDE

SEQ ID NO: 34255 - protein, 31 aa, Artificial Sequence
  Description of Artificial Sequence: Synthetic polypeptide
AEEEIRTTNPVATEQYGSVSNTNTDQGNGNT

SEQ ID NO: 34256 - protein, 32 aa, Artificial Sequence
  Description of Artificial Sequence: Synthetic polypeptide
AEEEIRTTNPVATEQYGSVSNTNLQQTTGTND

SEQ ID NO: 34257 - protein, 33 aa, Artificial Sequence
  Description of Artificial Sequence: Synthetic polypeptide
DEEEIRTTNPVATEAYGSTVSCTDNLSQRGNNS

SEQ ID NO: 34258 - protein, 31 aa, Artificial Sequence
  Description of Artificial Sequence: Synthetic polypeptide
AEEEIRTTNPVATEQYGSVSNTNQQIGENNA

SEQ ID NO: 34259 - protein, 32 aa, Artificial Sequence
  Description of Artificial Sequence: Synthetic polypeptide
AEEEIRTTNPVATEQYGSVSNTNQLQTGNSTT

SEQ ID NO: 34260 - protein, 33 aa, Artificial Sequence
  Description of Artificial Sequence: Synthetic polypeptide
DEEEIRTTNPVATEAYGSTVSCTGNAQQRGNNR

SEQ ID NO: 34261 - protein, 31 aa, Artificial Sequence
  Description of Artificial Sequence: Synthetic polypeptide
AEEEIRTTNPVATEQYGSVSNTNNNQEGEND

SEQ ID NO: 34262 - protein, 31 aa, Artificial Sequence
  Description of Artificial Sequence: Synthetic polypeptide
AEEEIRTTNPVATEQYGSVSNTNNLQQGIDT

SEQ ID NO: 34263 - protein, 33 aa, Artificial Sequence
  Description of Artificial Sequence: Synthetic polypeptide
DEEEIRTTNPVATEAYGSTVSCTNELQNGGNPR

SEQ ID NO: 34264 - protein, 32 aa, Artificial Sequence
  Description of Artificial Sequence: Synthetic polypeptide
AEEEIRTTNPVATEQYGSVSNTNNLQEGENVG

SEQ ID NO: 34265 - protein, 34 aa, Artificial Sequence
  Description of Artificial Sequence: Synthetic polypeptide
DEEEIRTTNPVATEAYGSTVSCTNLSQSRGTNYR

SEQ ID NO: 34266 - protein, 31 aa, Artificial Sequence
  Description of Artificial Sequence: Synthetic polypeptide
AEEEIRTTNPVATEQYGSVSNTNQQQIGNES

SEQ ID NO: 34267 - protein, 33 aa, Artificial Sequence
  Description of Artificial Sequence: Synthetic polypeptide
DEEEIRTTNPVATEAYGSVASCTNELSQRGNNA

SEQ ID NO: 34268 - protein, 33 aa, Artificial Sequence
  Description of Artificial Sequence: Synthetic polypeptide
DEEEIRTTNPVATEAYGSVATNMLSQRGGNNRM

SEQ ID NO: 34269 - protein, 29 aa, Artificial Sequence
  Description of Artificial Sequence: Synthetic peptide
SEYEIRMTNPVATEQYGSVETQNLQGGNQ

SEQ ID NO: 34270 - protein, 30 aa, Artificial Sequence
  Description of Artificial Sequence: Synthetic polypeptide
AEEEIRTTNPVATEQYGSVSGNQQRGIEAL

SEQ ID NO: 34271 - protein, 29 aa, Artificial Sequence
  Description of Artificial Sequence: Synthetic peptide
SMEEIRCTNPIATEQYGSVSENLMRGPNR

SEQ ID NO: 34272 - protein, 31 aa, Artificial Sequence
  Description of Artificial Sequence: Synthetic polypeptide
AEEEIRTTNPVATEQYGSVSENLDDRGEENQ

SEQ ID NO: 34273 - protein, 33 aa, Artificial Sequence
  Description of Artificial Sequence: Synthetic polypeptide
AEEEIRTTNPVATEQYGSVSCTNALSQRGGNNV

SEQ ID NO: 34274 - protein, 30 aa, Artificial Sequence
  Description of Artificial Sequence: Synthetic polypeptide
AEEEIRTTNPVATEQYGSVSAWNLDEFGNA

SEQ ID NO: 34275 - protein, 30 aa, Artificial Sequence
  Description of Artificial Sequence: Synthetic polypeptide
AEEEIRTTNPVATEQYGSVSAVNLDEQGNG

SEQ ID NO: 34276 - protein, 31 aa, Artificial Sequence
  Description of Artificial Sequence: Synthetic polypeptide
AEEEIRTTNPVATEQYGSVSATQNGEQGGNV

SEQ ID NO: 34277 - protein, 31 aa, Artificial Sequence
  Description of Artificial Sequence: Synthetic polypeptide
AEEEIRTTNPVATEQYGSVSATNQQQNGNET

SEQ ID NO: 34278 - protein, 30 aa, Artificial Sequence
  Description of Artificial Sequence: Synthetic polypeptide
AEEEIRTTNPVATEQYGSVSINDLEIGNST

SEQ ID NO: 34279 - protein, 31 aa, Artificial Sequence
  Description of Artificial Sequence: Synthetic polypeptide
AEEEIRTTNPVATEQYGSVSATNNQQGENNE

SEQ ID NO: 34280 - protein, 32 aa, Artificial Sequence
  Description of Artificial Sequence: Synthetic polypeptide
AEEEIRTTNPVATEQYGSVSATNNLQQGENNN

SEQ ID NO: 34281 - protein, 32 aa, Artificial Sequence
  Description of Artificial Sequence: Synthetic polypeptide
AEEEIRTTNPVATEQYGSVSATNNLQQGENNG

SEQ ID NO: 34282 - protein, 31 aa, Artificial Sequence
  Description of Artificial Sequence: Synthetic polypeptide
AEEEIRTTNPVATEQYGSVSATNNEQGGNVE

SEQ ID NO: 34283 - protein, 30 aa, Artificial Sequence
  Description of Artificial Sequence: Synthetic polypeptide
AEEEIRTTNPVATEQYGSVSATNNDEFGNE

SEQ ID NO: 34284 - protein, 32 aa, Artificial Sequence
  Description of Artificial Sequence: Synthetic polypeptide
AEEEIRTTNPVATEQYGSVSATNLQQQGTNNE

SEQ ID NO: 34285 - protein, 32 aa, Artificial Sequence
  Description of Artificial Sequence: Synthetic polypeptide
AEEEIRTTNPVATEQYGSVSATNLQQQGENNI

SEQ ID NO: 34286 - protein, 32 aa, Artificial Sequence
  Description of Artificial Sequence: Synthetic polypeptide
AEEEIRTTNPVATEQYGSVSATNLQQGVNNEI

SEQ ID NO: 34287 - protein, 32 aa, Artificial Sequence
  Description of Artificial Sequence: Synthetic polypeptide
AEEEIRTTNPVATEQYGSVSATNLQQGTNNGT

SEQ ID NO: 34288 - protein, 30 aa, Artificial Sequence
  Description of Artificial Sequence: Synthetic polypeptide
AEEEIRTTNPVATEQYGSVSATNNNLVGNV

SEQ ID NO: 34289 - protein, 30 aa, Artificial Sequence
  Description of Artificial Sequence: Synthetic polypeptide
AEEEIRTTNPVATEQYGSVSLNLGSTGANA

SEQ ID NO: 34290 - protein, 29 aa, Artificial Sequence
  Description of Artificial Sequence: Synthetic peptide
SMEEIRCTNPIATEQYGSVSENLMRDGNR

SEQ ID NO: 34291 - protein, 30 aa, Artificial Sequence
  Description of Artificial Sequence: Synthetic polypeptide
AEEEIRTTNPVATEQYGSVSNENLDEQGNT

SEQ ID NO: 34292 - protein, 32 aa, Artificial Sequence
  Description of Artificial Sequence: Synthetic polypeptide
DEEEIRTTNPVATEAYGSVAYTNASQRTGGNR

SEQ ID NO: 34293 - protein, 32 aa, Artificial Sequence
  Description of Artificial Sequence: Synthetic polypeptide
DEEEIRTTNPVATEAYGSVCCTNALSQRGNNA

SEQ ID NO: 34294 - protein, 31 aa, Artificial Sequence
  Description of Artificial Sequence: Synthetic polypeptide
DEEEIRTTNPVATEAYGSVCFTNLTRGGNNE

SEQ ID NO: 34295 - protein, 30 aa, Artificial Sequence
  Description of Artificial Sequence: Synthetic polypeptide
AEEEIRTTNPVATEQYGSVSNNNLNQGGGN

SEQ ID NO: 34296 - protein, 31 aa, Artificial Sequence
  Description of Artificial Sequence: Synthetic polypeptide
AEEEIRTTNPVATEQYGSVSNNNLGQEGGNS

SEQ ID NO: 34297 - protein, 29 aa, Artificial Sequence
  Description of Artificial Sequence: Synthetic peptide
SIEEIRCTNPIATEQYGSVPSENLMRGNR

SEQ ID NO: 34298 - protein, 31 aa, Artificial Sequence
  Description of Artificial Sequence: Synthetic polypeptide
AEEEIRTTNPVATEQYGSVSNNLQQGNENDE

SEQ ID NO: 34299 - protein, 31 aa, Artificial Sequence
  Description of Artificial Sequence: Synthetic polypeptide
AEEEIRTTNPVATEQYGSVSNNLQQGIENTT

SEQ ID NO: 34300 - protein, 31 aa, Artificial Sequence
  Description of Artificial Sequence: Synthetic polypeptide
AEEEIRTTNPVATEQYGSVSNNLQNGIENQE

SEQ ID NO: 34301 - protein, 31 aa, Artificial Sequence
  Description of Artificial Sequence: Synthetic polypeptide
AEEEIRTTNPVATEQYGSVSNNLQNGGGNND

SEQ ID NO: 34302 - protein, 30 aa, Artificial Sequence
  Description of Artificial Sequence: Synthetic polypeptide
AEEEIRTTNPVATEQYGSVSNNLQNDEINA

SEQ ID NO: 34303 - protein, 31 aa, Artificial Sequence
  Description of Artificial Sequence: Synthetic polypeptide
AEEEIRTTNPVATEQYGSVSNNLQLGGTNIS

SEQ ID NO: 34304 - protein, 29 aa, Artificial Sequence
  Description of Artificial Sequence: Synthetic peptide
SLEEIRCTNPIATEQYGSVSENLEMRGNR

SEQ ID NO: 34305 - protein, 28 aa, Artificial Sequence
  Description of Artificial Sequence: Synthetic peptide
SLEEIRCTNPIATEQYGSVSENLMRENR

SEQ ID NO: 34306 - protein, 31 aa, Artificial Sequence
  Description of Artificial Sequence: Synthetic polypeptide
AEEEIRTTNPVATEQYGSVSNNLGQQEGNNS

SEQ ID NO: 34307 - protein, 31 aa, Artificial Sequence
  Description of Artificial Sequence: Synthetic polypeptide
AEEEIRTTNPVATEQYGSVSNNLGQGENGNS

SEQ ID NO: 34308 - protein, 30 aa, Artificial Sequence
  Description of Artificial Sequence: Synthetic polypeptide
AEEEIRTTNPVATEQYGSVSNNLGGNEGNS

SEQ ID NO: 34309 - protein, 29 aa, Artificial Sequence
  Description of Artificial Sequence: Synthetic peptide
AEEEIRTTNPVATEQYGSVSNNEGNDGNE

SEQ ID NO: 34310 - protein, 30 aa, Artificial Sequence
  Description of Artificial Sequence: Synthetic polypeptide
AEEEIRTTNPVATEQYGSVSNLNLDEEGNV

SEQ ID NO: 34311 - protein, 32 aa, Artificial Sequence
  Description of Artificial Sequence: Synthetic polypeptide
AEEEIRTTNPVATEQYGSVSATNLQQGETNEN

SEQ ID NO: 34312 - protein, 31 aa, Artificial Sequence
  Description of Artificial Sequence: Synthetic polypeptide
TEEEIRTTNPVAYEQYGSVSCTNVQRPGGNQ

SEQ ID NO: 34313 - protein, 30 aa, Artificial Sequence
  Description of Artificial Sequence: Synthetic polypeptide
SSEEIRTTNPVATDQYGSVSTWDLDQRGNA

SEQ ID NO: 34314 - protein, 32 aa, Artificial Sequence
  Description of Artificial Sequence: Synthetic polypeptide
DEEEIRTTNPVATEAYGSVSTGNMLSHHGGNR

SEQ ID NO: 34315 - protein, 32 aa, Artificial Sequence
  Description of Artificial Sequence: Synthetic polypeptide
DEEEIRTTNPVATEQYGCVCSTALQRGSNNLS

SEQ ID NO: 34316 - protein, 28 aa, Artificial Sequence
  Description of Artificial Sequence: Synthetic peptide
AEEEIRTTNPVATEEYGCTSINGQAGNR

SEQ ID NO: 34317 - protein, 29 aa, Artificial Sequence
  Description of Artificial Sequence: Synthetic peptide
TEECIRTTNPVAYEQYGVVSTINVQRGNQ

SEQ ID NO: 34318 - protein, 30 aa, Artificial Sequence
  Description of Artificial Sequence: Synthetic polypeptide
DEEEIRTTNPVATEQYGCVCSTALQGGEQI

SEQ ID NO: 34319 - protein, 31 aa, Artificial Sequence
  Description of Artificial Sequence: Synthetic polypeptide
DEEEIRTTNPVATEQYGCVCSTAALQFGSNA

SEQ ID NO: 34320 - protein, 30 aa, Artificial Sequence
  Description of Artificial Sequence: Synthetic polypeptide
TEEEIACTNPVATEQYGSVSTNLQQGNDEQ

SEQ ID NO: 34321 - protein, 29 aa, Artificial Sequence
  Description of Artificial Sequence: Synthetic peptide
TEEEIACTNPVATEQYGVVSTNLERGNEA

SEQ ID NO: 34322 - protein, 29 aa, Artificial Sequence
  Description of Artificial Sequence: Synthetic peptide
TEEEIACTNPVATEQYGVVSTNLQQGNEF

SEQ ID NO: 34323 - protein, 30 aa, Artificial Sequence
  Description of Artificial Sequence: Synthetic polypeptide
AEEEIRTTNPVATEEYGCVFSINDLQDGNR

SEQ ID NO: 34324 - protein, 29 aa, Artificial Sequence
  Description of Artificial Sequence: Synthetic peptide
TEEEIACTNPVAYEQYGEVSTNLQRGNDQ

SEQ ID NO: 34325 - protein, 30 aa, Artificial Sequence
  Description of Artificial Sequence: Synthetic polypeptide
TEEEIATTNPVATEAYGSVSTNLSDGGGNR

SEQ ID NO: 34326 - protein, 31 aa, Artificial Sequence
  Description of Artificial Sequence: Synthetic polypeptide
TEEEIATTNPVATEAYGSVVSTNMLSQEGNR

SEQ ID NO: 34327 - protein, 30 aa, Artificial Sequence
  Description of Artificial Sequence: Synthetic polypeptide
DEEEIRTTNPVATEQYGCVCSSNHQGGNQA

SEQ ID NO: 34328 - protein, 31 aa, Artificial Sequence
  Description of Artificial Sequence: Synthetic polypeptide
TEEEIATTNPVATEQYGCSVSETNLSQGGNS

SEQ ID NO: 34329 - protein, 29 aa, Artificial Sequence
  Description of Artificial Sequence: Synthetic peptide
AEEEIRTTNPVATEEYGCKSINLQRGNGI

SEQ ID NO: 34330 - protein, 28 aa, Artificial Sequence
  Description of Artificial Sequence: Synthetic peptide
AEEEIRTTNPVATEEYGCKSINLQGGNI

SEQ ID NO: 34331 - protein, 32 aa, Artificial Sequence
  Description of Artificial Sequence: Synthetic polypeptide
TEEEIATTNPVATEQYGISVSCTNALSQRVNR

SEQ ID NO: 34332 - protein, 28 aa, Artificial Sequence
  Description of Artificial Sequence: Synthetic peptide
AEEEIRTTNPVATEEYGCISINHQNGNR

SEQ ID NO: 34333 - protein, 31 aa, Artificial Sequence
  Description of Artificial Sequence: Synthetic polypeptide
DEEEIRTTNPVATEQYGCVCSSNLLQFGSNA

SEQ ID NO: 34334 - protein, 30 aa, Artificial Sequence
  Description of Artificial Sequence: Synthetic polypeptide
AEEEIRTTNPVATEEYGCISIGNLQRFGNR

SEQ ID NO: 34335 - protein, 31 aa, Artificial Sequence
  Description of Artificial Sequence: Synthetic polypeptide
TEECIRTTNPVAYEQYGSVNCTNLAQRGGNR

SEQ ID NO: 34336 - protein, 28 aa, Artificial Sequence
  Description of Artificial Sequence: Synthetic peptide
AEEEIRTTNPVATEEYGCYSINLQGGND

SEQ ID NO: 34337 - protein, 33 aa, Artificial Sequence
  Description of Artificial Sequence: Synthetic polypeptide
DEEEIRTTNPVATEAYGSVVSTNALSQSPGNNR

SEQ ID NO: 34338 - protein, 31 aa, Artificial Sequence
  Description of Artificial Sequence: Synthetic polypeptide
DEEEIRTTNPVATEAYGSVVSTNDSQNGGNS

SEQ ID NO: 34339 - protein, 29 aa, Artificial Sequence
  Description of Artificial Sequence: Synthetic peptide
AEEEIRTTNPVATEGYGCTSNMNLQRGNA

SEQ ID NO: 34340 - protein, 33 aa, Artificial Sequence
  Description of Artificial Sequence: Synthetic polypeptide
DEEEIRTTNPVATEAYGSVVSTNMLSGRPGNNR

SEQ ID NO: 34341 - protein, 29 aa, Artificial Sequence
  Description of Artificial Sequence: Synthetic peptide
TEECIRTTNPVATEQYGSVSKNESNDGNR

SEQ ID NO: 34342 - protein, 28 aa, Artificial Sequence
  Description of Artificial Sequence: Synthetic peptide
TEECIRTTNPVATEQYGSVSSNLANLNQ

SEQ ID NO: 34343 - protein, 28 aa, Artificial Sequence
  Description of Artificial Sequence: Synthetic peptide
AEEEIRTTNPVATEGYGCKAINLQEGNR

SEQ ID NO: 34344 - protein, 28 aa, Artificial Sequence
  Description of Artificial Sequence: Synthetic peptide
TEECIRTTNPVATEQYGSVSTNDAYLNQ

SEQ ID NO: 34345 - protein, 31 aa, Artificial Sequence
  Description of Artificial Sequence: Synthetic polypeptide
DEEEIRTTNPVATEQYGCVCSTAPQRGSNQI

SEQ ID NO: 34346 - protein, 29 aa, Artificial Sequence
  Description of Artificial Sequence: Synthetic peptide
AEEEIRTTNPVATEEYGVVSSENLQLGNQ

SEQ ID NO: 34347 - protein, 30 aa, Artificial Sequence
  Description of Artificial Sequence: Synthetic polypeptide
TEECIRTTNPVATEQYGSVSTNELSMVGNE

SEQ ID NO: 34348 - protein, 29 aa, Artificial Sequence
  Description of Artificial Sequence: Synthetic peptide
AEEEIRTTNPVATEEYGTVTSNNLQGGNN

SEQ ID NO: 34349 - protein, 32 aa, Artificial Sequence
  Description of Artificial Sequence: Synthetic polypeptide
DEEEIRTTNPVATEQYGCVCSTEDNQRGSNRG

SEQ ID NO: 34350 - protein, 30 aa, Artificial Sequence
  Description of Artificial Sequence: Synthetic polypeptide
TEECIRTTNPVATEQYGSVSTNLAYSLSNR

SEQ ID NO: 34351 - protein, 31 aa, Artificial Sequence
  Description of Artificial Sequence: Synthetic polypeptide
DEEEIRTTNPVATEQYGCVCSTEDIQEYGNR

SEQ ID NO: 34352 - protein, 29 aa, Artificial Sequence
  Description of Artificial Sequence: Synthetic peptide
AEEEIRTTNPVATEEYGIISEVNLVRGNR

SEQ ID NO: 34353 - protein, 30 aa, Artificial Sequence
  Description of Artificial Sequence: Synthetic polypeptide
AEEEIRTTNPVATEEYGETSTSNEQRGNRQ

SEQ ID NO: 34354 - protein, 30 aa, Artificial Sequence
  Description of Artificial Sequence: Synthetic polypeptide
AEEEIRTTNPVATEEYGCYSSGNLQRGSNR

SEQ ID NO: 34355 - protein, 28 aa, Artificial Sequence
  Description of Artificial Sequence: Synthetic peptide
AEEEIRTTNPVATEEYGVTSENLQGGNT

SEQ ID NO: 34356 - protein, 30 aa, Artificial Sequence
  Description of Artificial Sequence: Synthetic polypeptide
TEEEIATTNPVATEQYGKVSCTMLQGGGNR

SEQ ID NO: 34357 - protein, 29 aa, Artificial Sequence
  Description of Artificial Sequence: Synthetic peptide
DEEEIRTTNPVATEAYGTVSSTNEQANND

SEQ ID NO: 34358 - protein, 31 aa, Artificial Sequence
  Description of Artificial Sequence: Synthetic polypeptide
DEEEIRTTNPVATEAYGTVSSTNLEQGGNNF

SEQ ID NO: 34359 - protein, 30 aa, Artificial Sequence
  Description of Artificial Sequence: Synthetic polypeptide
TEEEIATTNPVAYEQYGCVSCTNLSQAGNR

SEQ ID NO: 34360 - protein, 31 aa, Artificial Sequence
  Description of Artificial Sequence: Synthetic polypeptide
DEEEIRTTNPVATEQYGCVCSNTNHQSGERE

SEQ ID NO: 34361 - protein, 31 aa, Artificial Sequence
  Description of Artificial Sequence: Synthetic polypeptide
TEEEIATTNPVAYEQYGSVSCTNGQRPGNNR

SEQ ID NO: 34362 - protein, 31 aa, Artificial Sequence
  Description of Artificial Sequence: Synthetic polypeptide
DEEEIRTTNPVATEQYGCVCSNTELQSGDRD

SEQ ID NO: 34363 - protein, 31 aa, Artificial Sequence
  Description of Artificial Sequence: Synthetic polypeptide
TEEEIATTNPVAYEQYGSVVSTNELSQRGTR

SEQ ID NO: 34364 - protein, 31 aa, Artificial Sequence
  Description of Artificial Sequence: Synthetic polypeptide
TEEEIATTNPVAYEQYGVVSTNLSQRGGNRT

SEQ ID NO: 34365 - protein, 29 aa, Artificial Sequence
  Description of Artificial Sequence: Synthetic peptide
TEEEIATTNPVNTEQYGACSTNLQQDGNR

SEQ ID NO: 34366 - protein, 31 aa, Artificial Sequence
  Description of Artificial Sequence: Synthetic polypeptide
TEEEICTTNPCATEQYGSVPTNLQHRGGNNR

SEQ ID NO: 34367 - protein, 30 aa, Artificial Sequence
  Description of Artificial Sequence: Synthetic polypeptide
TEEEIATTNPVAYEAYGSVVSTNLSQRGVR

SEQ ID NO: 34368 - protein, 30 aa, Artificial Sequence
  Description of Artificial Sequence: Synthetic polypeptide
TEEEICTTNPVATEQYGNVSVTGLQGGTNR

SEQ ID NO: 34369 - protein, 30 aa, Artificial Sequence
  Description of Artificial Sequence: Synthetic polypeptide
TEEEICTTNPVATEQYGSVVSTGLQNGSRC

SEQ ID NO: 34370 - protein, 32 aa, Artificial Sequence
  Description of Artificial Sequence: Synthetic polypeptide
DEEEIRTTNPVATEQYGCVCSMTPELQYGSNR

SEQ ID NO: 34371 - protein, 30 aa, Artificial Sequence
  Description of Artificial Sequence: Synthetic polypeptide
TEEEICTTNPVAYEQYGSVSINLSQSGGNR

SEQ ID NO: 34372 - protein, 29 aa, Artificial Sequence
  Description of Artificial Sequence: Synthetic peptide
AEEEIRTTNPVATEAYGVVSSVNLQQGNQ

SEQ ID NO: 34373 - protein, 33 aa, Artificial Sequence
  Description of Artificial Sequence: Synthetic polypeptide
DEEEIRTTNPVATEQYGCVCSDTNLQRFGSNPQ

SEQ ID NO: 34374 - protein, 30 aa, Artificial Sequence
  Description of Artificial Sequence: Synthetic polypeptide
AEEEIRTTNPVATEAYGVVSSNNLQQGTNR

SEQ ID NO: 34375 - protein, 29 aa, Artificial Sequence
  Description of Artificial Sequence: Synthetic peptide
AEEEIRTTNPVATEAYGVVSSNNLQNGNI

SEQ ID NO: 34376 - protein, 29 aa, Artificial Sequence
  Description of Artificial Sequence: Synthetic peptide
AEEEIRTTNPVATEAYGVVSNVNLQGGNM

SEQ ID NO: 34377 - protein, 29 aa, Artificial Sequence
  Description of Artificial Sequence: Synthetic peptide
TEEEICTTNPVATEQYGNVSVTMLQGGNK

SEQ ID NO: 34378 - protein, 29 aa, Artificial Sequence
  Description of Artificial Sequence: Synthetic peptide
TEEEIATTNPVATKQYGSVATNDLQRGED

SEQ ID NO: 34379 - protein, 32 aa, Artificial Sequence
  Description of Artificial Sequence: Synthetic polypeptide
DEEEIRTTNPVATEQYGCVCSNTNLQGGSNQI

SEQ ID NO: 34380 - protein, 31 aa, Artificial Sequence
  Description of Artificial Sequence: Synthetic polypeptide
TEEEIATTNPVATERYGSTVSLNLSQRGNNR

SEQ ID NO: 34381 - protein, 29 aa, Artificial Sequence
  Description of Artificial Sequence: Synthetic peptide
DEEEIRTTNPVATEAYGTVSSTNQQGNNF

SEQ ID NO: 34382 - protein, 31 aa, Artificial Sequence
  Description of Artificial Sequence: Synthetic polypeptide
DEEEIRTTNPVATEQYGCVCSSEDLQFGSNR

SEQ ID NO: 34383 - protein, 29 aa, Artificial Sequence
  Description of Artificial Sequence: Synthetic peptide
AEEEIRTTNPVATEEYGCFCSSNLQSGNR

SEQ ID NO: 34384 - protein, 32 aa, Artificial Sequence
  Description of Artificial Sequence: Synthetic polypeptide
DEEEIRTTNPVATEAYGTVSTNELSTRGTNNR

SEQ ID NO: 34385 - protein, 31 aa, Artificial Sequence
  Description of Artificial Sequence: Synthetic polypeptide
DEEEIRTTNPVATEQYGCVCSNWELQNGNRS

SEQ ID NO: 34386 - protein, 29 aa, Artificial Sequence
  Description of Artificial Sequence: Synthetic peptide
AEEEIRTTNPVATEEYGCASINLQRSGNT

SEQ ID NO: 34387 - protein, 29 aa, Artificial Sequence
  Description of Artificial Sequence: Synthetic peptide
AEEEIRTTNPVATEEYGCASINLQMEGNR

SEQ ID NO: 34388 - protein, 28 aa, Artificial Sequence
  Description of Artificial Sequence: Synthetic peptide
AEEEIRTTNPVATEEYGCASINDQRGNV

SEQ ID NO: 34389 - protein, 28 aa, Artificial Sequence
  Description of Artificial Sequence: Synthetic peptide
AEEEIRTTNPVATEEWGCMSINLQEGNR

SEQ ID NO: 34390 - protein, 30 aa, Artificial Sequence
  Description of Artificial Sequence: Synthetic polypeptide
AEEEIRTTNPVATECYGCISINNLDQRGNR

SEQ ID NO: 34391 - protein, 33 aa, Artificial Sequence
  Description of Artificial Sequence: Synthetic polypeptide
DEEEIRTTNPVATEQYGCVCSNTPLDQRFGSNR

SEQ ID NO: 34392 - protein, 33 aa, Artificial Sequence
  Description of Artificial Sequence: Synthetic polypeptide
DEEEIRTTNPVATEQYGCVCSNTNNLQNGSNRV

SEQ ID NO: 34393 - protein, 32 aa, Artificial Sequence
  Description of Artificial Sequence: Synthetic polypeptide
TEEEIATTNPVATEQYGSVPSCCGNLQRGGNR

SEQ ID NO: 34394 - protein, 32 aa, Artificial Sequence
  Description of Artificial Sequence: Synthetic polypeptide
DEEEIRTTNPVATEQYGCVCSNTNLQHFNSQR

SEQ ID NO: 34395 - protein, 32 aa, Artificial Sequence
  Description of Artificial Sequence: Synthetic polypeptide
TEEEIATTNPVATEQYGSVPSCTNMLQDGNNR

SEQ ID NO: 34396 - protein, 33 aa, Artificial Sequence
  Description of Artificial Sequence: Synthetic polypeptide
TEEEIATTNPVATEQYGSVSTNLSQERGGNNRD

SEQ ID NO: 34397 - protein, 32 aa, Artificial Sequence
  Description of Artificial Sequence: Synthetic polypeptide
TEEEIATTNPVATEQYGSVVPSTNLSQRGSYR

SEQ ID NO: 34398 - protein, 31 aa, Artificial Sequence
  Description of Artificial Sequence: Synthetic polypeptide
TEEEIATTNPVATEQYGSVVSCTNQQRGGNS

SEQ ID NO: 34399 - protein, 30 aa, Artificial Sequence
  Description of Artificial Sequence: Synthetic polypeptide
TEEEIATTNPVATEQYGVVSVTYELQGGNR

SEQ ID NO: 34400 - protein, 29 aa, Artificial Sequence
  Description of Artificial Sequence: Synthetic peptide
TEECIRTTNPVATEQYGSVCSTELAYLNR

SEQ ID NO: 34401 - protein, 29 aa, Artificial Sequence
  Description of Artificial Sequence: Synthetic peptide
SSEEIRTTNPVATDQYGSVSTWLQDNGNF

SEQ ID NO: 34402 - protein, 31 aa, Artificial Sequence
  Description of Artificial Sequence: Synthetic polypeptide
TEECIRTTNPVATEQYGISVSTNLSSMLGNR

SEQ ID NO: 34403 - protein, 33 aa, Artificial Sequence
  Description of Artificial Sequence: Synthetic polypeptide
DEEEIRTTNPVATEAYGSVVPSTNLSQNEGGNR

SEQ ID NO: 34404 - protein, 32 aa, Artificial Sequence
  Description of Artificial Sequence: Synthetic polypeptide
DEEEIRTTNPVATEAYGSVSTNLVGQGEGGND

SEQ ID NO: 34405 - protein, 32 aa, Artificial Sequence
  Description of Artificial Sequence: Synthetic polypeptide
DEEEIRTTNPVATEAYGSVSTNSHQERDVGSR

SEQ ID NO: 34406 - protein, 29 aa, Artificial Sequence
  Description of Artificial Sequence: Synthetic peptide
SSEEIRTTNPVAYHQYGSVSTTLSQRGND

SEQ ID NO: 34407 - protein, 28 aa, Artificial Sequence
  Description of Artificial Sequence: Synthetic peptide
STEEIRCTNPIATEIYGSVSENLMRGNR

SEQ ID NO: 34408 - protein, 32 aa, Artificial Sequence
  Description of Artificial Sequence: Synthetic polypeptide
AEEEIRTTNPVATEQYGCVCSTELQRGGSNRV

SEQ ID NO: 34409 - protein, 29 aa, Artificial Sequence
  Description of Artificial Sequence: Synthetic peptide
STEEIRCTNPIATEQYGCSVSENLMRGNR

SEQ ID NO: 34410 - protein, 29 aa, Artificial Sequence
  Description of Artificial Sequence: Synthetic peptide
STEEIRCTNPIATEQYGSVSENLMRLGNR

SEQ ID NO: 34411 - protein, 28 aa, Artificial Sequence
  Description of Artificial Sequence: Synthetic peptide
STEEIRCTNPIATEQYGSVSENVMRGNR

SEQ ID NO: 34412 - protein, 29 aa, Artificial Sequence
  Description of Artificial Sequence: Synthetic peptide
SSEEIRTTNPVATHQYGSVSVTDLQRGEF

SEQ ID NO: 34413 - protein, 29 aa, Artificial Sequence
  Description of Artificial Sequence: Synthetic peptide
STEEIRTTNPVATDQYGSVSTELQQMGNF

SEQ ID NO: 34414 - protein, 30 aa, Artificial Sequence
  Description of Artificial Sequence: Synthetic polypeptide
STEEIRTTNPVATEQWGTVSATENLQEGNR

SEQ ID NO: 34415 - protein, 30 aa, Artificial Sequence
  Description of Artificial Sequence: Synthetic polypeptide
STEEIRTTNPVATEQWGTVSTNLQEGGNNR

SEQ ID NO: 34416 - protein, 29 aa, Artificial Sequence
  Description of Artificial Sequence: Synthetic peptide
STEEIRTTNPVATEQWGTVSTNLQEGNNL

SEQ ID NO: 34417 - protein, 29 aa, Artificial Sequence
  Description of Artificial Sequence: Synthetic peptide
STEEIRTTNPVATEQWGTVSTNLQEGNNN

SEQ ID NO: 34418 - protein, 28 aa, Artificial Sequence
  Description of Artificial Sequence: Synthetic peptide
STEEIRTTNPVATEQWGTVSTNLQEVNE

SEQ ID NO: 34419 - protein, 28 aa, Artificial Sequence
  Description of Artificial Sequence: Synthetic peptide
SVEEIRTTNPVATEQWGAVSTNEVEGNR

SEQ ID NO: 34420 - protein, 33 aa, Artificial Sequence
  Description of Artificial Sequence: Synthetic polypeptide
DEEEIRTTNPVATEAYGSVSTPNMLSQRGGNNG

SEQ ID NO: 34421 - protein, 31 aa, Artificial Sequence
  Description of Artificial Sequence: Synthetic polypeptide
TAEEIRSTNPVATEQYGSVSTNLQAGNGQQR

SEQ ID NO: 34422 - protein, 29 aa, Artificial Sequence
  Description of Artificial Sequence: Synthetic peptide
STEEIRTTNPVATDQYGSVSTTLQMGTNF

SEQ ID NO: 34423 - protein, 29 aa, Artificial Sequence
  Description of Artificial Sequence: Synthetic peptide
TDEEIRTTNPVATEQHGTVSTNLVENGNR

SEQ ID NO: 34424 - protein, 33 aa, Artificial Sequence
  Description of Artificial Sequence: Synthetic polypeptide
DEEEIRTTNPVATEAYGSVSTNLSQRAGGNNEN

SEQ ID NO: 34425 - protein, 29 aa, Artificial Sequence
  Description of Artificial Sequence: Synthetic peptide
SSEEIRTTNPVATHQYGSVSTWEDQRGNV

SEQ ID NO: 34426 - protein, 30 aa, Artificial Sequence
  Description of Artificial Sequence: Synthetic polypeptide
SSEEIRTTNPVATEQWGTVSTNLQEGMNER

SEQ ID NO: 34427 - protein, 30 aa, Artificial Sequence
  Description of Artificial Sequence: Synthetic polypeptide
AEEEIRTTNPVATEQYGCVSTNHQHNSNRT

SEQ ID NO: 34428 - protein, 30 aa, Artificial Sequence
  Description of Artificial Sequence: Synthetic polypeptide
DEEEIRTTNPVATEAYGSVSTNLNMDTNET

SEQ ID NO: 34429 - protein, 29 aa, Artificial Sequence
  Description of Artificial Sequence: Synthetic peptide
SSEEIRTTNPVATHQYGCVCSTYLQRGNQ

SEQ ID NO: 34430 - protein, 32 aa, Artificial Sequence
  Description of Artificial Sequence: Synthetic polypeptide
AEEEIRTTNPVATEQYGCVNTMNLDQRGSNYR

SEQ ID NO: 34431 - protein, 32 aa, Artificial Sequence
  Description of Artificial Sequence: Synthetic polypeptide
DEEEIRTTNPVATEAYGSVSTNLQFGQGNNDT

SEQ ID NO: 34432 - protein, 28 aa, Artificial Sequence
  Description of Artificial Sequence: Synthetic peptide
SSEEIRTTNPVATHQYGCVSTEDQRGNQ

SEQ ID NO: 34433 - protein, 32 aa, Artificial Sequence
  Description of Artificial Sequence: Synthetic polypeptide
DEEEIRTTNPVATEAYGSVSTNLQQGGNNNDT

SEQ ID NO: 34434 - protein, 29 aa, Artificial Sequence
  Description of Artificial Sequence: Synthetic peptide
SSEEIRTTNPVATHQYGSVSTWLNRGNNF

SEQ ID NO: 34435 - protein, 30 aa, Artificial Sequence
  Description of Artificial Sequence: Synthetic polypeptide
SSEEIRTTNPVATHQYGSVCSTYLQRGNFS

SEQ ID NO: 34436 - protein, 32 aa, Artificial Sequence
  Description of Artificial Sequence: Synthetic polypeptide
AEEEIRTTNPVATEQYGCVCSTYLQRFGSNTR

SEQ ID NO: 34437 - protein, 29 aa, Artificial Sequence
  Description of Artificial Sequence: Synthetic peptide
SSEEIRTTNPVATHQYGSVSTMDLQRGHF

SEQ ID NO: 34438 - protein, 30 aa, Artificial Sequence
  Description of Artificial Sequence: Synthetic polypeptide
SSEEIRTTNPVATHQYGSVSTPLQRFGNFS

SEQ ID NO: 34439 - protein, 32 aa, Artificial Sequence
  Description of Artificial Sequence: Synthetic polypeptide
AEEEIRTTNPVATEQYGCVCSTNLQGFGSENR

SEQ ID NO: 34440 - protein, 32 aa, Artificial Sequence
  Description of Artificial Sequence: Synthetic polypeptide
AEEEIRTTNPVATEQYGCVCSTNHQRGSNTRA

SEQ ID NO: 34441 - protein, 30 aa, Artificial Sequence
  Description of Artificial Sequence: Synthetic polypeptide
AEEEIRTTNPVATEQYGCVCSTNEQHGSNQ

SEQ ID NO: 34442 - protein, 29 aa, Artificial Sequence
  Description of Artificial Sequence: Synthetic peptide
SSEEIRTTNPVATHQYGSVSTWDLQQGNA

SEQ ID NO: 34443 - protein, 28 aa, Artificial Sequence
  Description of Artificial Sequence: Synthetic peptide
SSEEIRTTNPVATHQYGSVSTWDQGGNS

SEQ ID NO: 34444 - protein, 30 aa, Artificial Sequence
  Description of Artificial Sequence: Synthetic polypeptide
SSEEIRTTNPVATHQYGSVSCTVLQRGGNE

SEQ ID NO: 34445 - protein, 31 aa, Artificial Sequence
  Description of Artificial Sequence: Synthetic polypeptide
DEEEIRTTNPVATEQYGCVCSTENDQGGSND

SEQ ID NO: 34446 - protein, 33 aa, Artificial Sequence
  Description of Artificial Sequence: Synthetic polypeptide
DEEEIRTTNPVATEQYGCVCSTENDLQRGSNII

SEQ ID NO: 34447 - protein, 29 aa, Artificial Sequence
  Description of Artificial Sequence: Synthetic peptide
DEEEIRTTNPVATEQYGCVCSTELQSNEQ

SEQ ID NO: 34448 - protein, 31 aa, Artificial Sequence
  Description of Artificial Sequence: Synthetic polypeptide
DEEEIRTTNPVATEAYGSVSVTNLSTSVNNR

SEQ ID NO: 34449 - protein, 30 aa, Artificial Sequence
  Description of Artificial Sequence: Synthetic polypeptide
AEEEIRTTNPVATEPYGSVSTTNQQQGGNN

SEQ ID NO: 34450 - protein, 31 aa, Artificial Sequence
  Description of Artificial Sequence: Synthetic polypeptide
DEEEIRTTNPVATEQYGCVCSTEHNQGGSNR

SEQ ID NO: 34451 - protein, 30 aa, Artificial Sequence
  Description of Artificial Sequence: Synthetic polypeptide
AEEEIRTTNPVATEPYGCISINLSQRGNQR

SEQ ID NO: 34452 - protein, 33 aa, Artificial Sequence
  Description of Artificial Sequence: Synthetic polypeptide
DEEEIRTTNPVATEAYGSVSYTAMLSQRTGNNR

SEQ ID NO: 34453 - protein, 29 aa, Artificial Sequence
  Description of Artificial Sequence: Synthetic peptide
TEECICTTNPVATEQYGSVSANSSQRGNS

SEQ ID NO: 34454 - protein, 29 aa, Artificial Sequence
  Description of Artificial Sequence: Synthetic peptide
TEECICTTNPVATEQYGSVSMNSSQRGNS

SEQ ID NO: 34455 - protein, 28 aa, Artificial Sequence
  Description of Artificial Sequence: Synthetic peptide
TEECICTTNPVAYEQYGSVSENSQRGNS

SEQ ID NO: 34456 - protein, 31 aa, Artificial Sequence
  Description of Artificial Sequence: Synthetic polypeptide
DEEEIRTTNPVATEAYGSVSVSGNLSQRVNQ

SEQ ID NO: 34457 - protein, 33 aa, Artificial Sequence
  Description of Artificial Sequence: Synthetic polypeptide
DEEEIRTTNPVATEAYGSVSYTNAESQRGGNYR

SEQ ID NO: 34458 - protein, 31 aa, Artificial Sequence
  Description of Artificial Sequence: Synthetic polypeptide
DEEEIRTTNPVATEQYGCVCSTEELQNGNQE

SEQ ID NO: 34459 - protein, 31 aa, Artificial Sequence
  Description of Artificial Sequence: Synthetic polypeptide
AEEEIRTTNPVATEIYGSVSTTNNLQQGNGI

SEQ ID NO: 34460 - protein, 31 aa, Artificial Sequence
  Description of Artificial Sequence: Synthetic polypeptide
AEEEIRTTNPVATEIYGSVSTTNLQGGGNNQ

SEQ ID NO: 34461 - protein, 31 aa, Artificial Sequence
  Description of Artificial Sequence: Synthetic polypeptide
AEEEIRTTNPVATEIYGSVSTTNLQGGGNNN

SEQ ID NO: 34462 - protein, 31 aa, Artificial Sequence
  Description of Artificial Sequence: Synthetic polypeptide
AEEEIRTTNPVATEIYGSVSTNLGQGGGNNN

SEQ ID NO: 34463 - protein, 34 aa, Artificial Sequence
  Description of Artificial Sequence: Synthetic polypeptide
DEEEIRTTNPVATEAYGSVTSYTTNLSQRTGGNR

SEQ ID NO: 34464 - protein, 32 aa, Artificial Sequence
  Description of Artificial Sequence: Synthetic polypeptide
DEEEIRTTNPVATEAYGSVVACTNASQRTGNR

SEQ ID NO: 34465 - protein, 32 aa, Artificial Sequence
  Description of Artificial Sequence: Synthetic polypeptide
DEEEIRTTNPVATEAYGSVVPSCTNLSDRGMR

SEQ ID NO: 34466 - protein, 33 aa, Artificial Sequence
  Description of Artificial Sequence: Synthetic polypeptide
DEEEIRTTNPVATEAYGSVSYTNLSQNTGGNRG

SEQ ID NO: 34467 - protein, 30 aa, Artificial Sequence
  Description of Artificial Sequence: Synthetic polypeptide
DEEEIRTTNPVATEQYGCVCSTEHQHGNVN

SEQ ID NO: 34468 - protein, 30 aa, Artificial Sequence
  Description of Artificial Sequence: Synthetic polypeptide
DEEEIRTTNPVATEQYGCVCSTEHQIGNQS

SEQ ID NO: 34469 - protein, 31 aa, Artificial Sequence
  Description of Artificial Sequence: Synthetic polypeptide
TEDEIRTTNPVAYEAYGSVSITNLSQRSGNR

SEQ ID NO: 34470 - protein, 30 aa, Artificial Sequence
  Description of Artificial Sequence: Synthetic polypeptide
DEEEIRTTNPVATEQYGCVCSTELQRSEQA

SEQ ID NO: 34471 - protein, 30 aa, Artificial Sequence
  Description of Artificial Sequence: Synthetic polypeptide
TEAEIRTTNPVATEPYGTVSTNLSQRVGNY

SEQ ID NO: 34472 - protein, 31 aa, Artificial Sequence
  Description of Artificial Sequence: Synthetic polypeptide
DEEEIRTTNPVATEQYGCVCSTELQRPSNII

SEQ ID NO: 34473 - protein, 33 aa, Artificial Sequence
  Description of Artificial Sequence: Synthetic polypeptide
TEAEIRTTNPVATEQYGSLVSCTNMLSQRGGNR

SEQ ID NO: 34474 - protein, 31 aa, Artificial Sequence
  Description of Artificial Sequence: Synthetic polypeptide
DEEEIRTTNPVATEQYGCVCSTELQGNSNRG

SEQ ID NO: 34475 - protein, 32 aa, Artificial Sequence
  Description of Artificial Sequence: Synthetic polypeptide
TEAEIRTTNPVATEQYGSVVPSTNLSQGGTNR

SEQ ID NO: 34476 - protein, 32 aa, Artificial Sequence
  Description of Artificial Sequence: Synthetic polypeptide
DEEEIRTTNPVATEQYGCVCSTELQGGSNDRV

SEQ ID NO: 34477 - protein, 31 aa, Artificial Sequence
  Description of Artificial Sequence: Synthetic polypeptide
TEAEIRTTNPVATEQYGTVSCTNELQRVGNY

SEQ ID NO: 34478 - protein, 29 aa, Artificial Sequence
  Description of Artificial Sequence: Synthetic peptide
TEAEIRTTNPVATEQYGVVSTGLSQRPND

SEQ ID NO: 34479 - protein, 30 aa, Artificial Sequence
  Description of Artificial Sequence: Synthetic polypeptide
DEEEIRTTNPVATEQYGCVCSTELQEGGVQ

SEQ ID NO: 34480 - protein, 30 aa, Artificial Sequence
  Description of Artificial Sequence: Synthetic polypeptide
DEEEIRTTNPVATEQYGCVCSTELQAGDQM

SEQ ID NO: 34481 - protein, 33 aa, Artificial Sequence
  Description of Artificial Sequence: Synthetic polypeptide
DEEEIRTTNPVATEQYGCVCSTELNQRFGSNRN

SEQ ID NO: 34482 - protein, 33 aa, Artificial Sequence
  Description of Artificial Sequence: Synthetic polypeptide
DEEEIRTTNPVATEQYGCVCSTELNQERGSNRS

SEQ ID NO: 34483 - protein, 29 aa, Artificial Sequence
  Description of Artificial Sequence: Synthetic peptide
TEDEIRATNPVATEQYGSVFTNLSQHGNQ

SEQ ID NO: 34484 - protein, 32 aa, Artificial Sequence
  Description of Artificial Sequence: Synthetic polypeptide
TEDEIRTTNPVATEAYGSVCSCTNLSQRGNNR

SEQ ID NO: 34485 - protein, 31 aa, Artificial Sequence
  Description of Artificial Sequence: Synthetic polypeptide
DEEEIRTTNPVATEQYGCVCSTEIQRFGERA

SEQ ID NO: 34486 - protein, 32 aa, Artificial Sequence
  Description of Artificial Sequence: Synthetic polypeptide
TEDEIRTTNPVATEQYGTVPSTNELSQRGGNR

SEQ ID NO: 34487 - protein, 30 aa, Artificial Sequence
  Description of Artificial Sequence: Synthetic polypeptide
TEDEIRTTNPVATEQYGVVSTNLEQMGNEP

SEQ ID NO: 34488 - protein, 30 aa, Artificial Sequence
  Description of Artificial Sequence: Synthetic polypeptide
AEEEIRTTNPVATEQYGCVATNLQERGDQI

SEQ ID NO: 34489 - protein, 32 aa, Artificial Sequence
  Description of Artificial Sequence: Synthetic polypeptide
DEEEIRTTNPVATEAYGSVVSCANLAQRVGNA

SEQ ID NO: 34490 - protein, 33 aa, Artificial Sequence
  Description of Artificial Sequence: Synthetic polypeptide
TEEEIRTTNPVAYEQYGSVSCTSNLSQRGGNYR

SEQ ID NO: 34491 - protein, 31 aa, Artificial Sequence
  Description of Artificial Sequence: Synthetic polypeptide
TEEEIRTTNPVAYEQYGSVSLTNMNIRGGNR

SEQ ID NO: 34492 - protein, 31 aa, Artificial Sequence
  Description of Artificial Sequence: Synthetic polypeptide
TEEEIRTTNPVAYEQYGSVSTGNGSQRGNNG

SEQ ID NO: 34493 - protein, 31 aa, Artificial Sequence
  Description of Artificial Sequence: Synthetic polypeptide
DEEEIRTTNPVATEPYGSVCFTANDIRNGNR

SEQ ID NO: 34494 - protein, 31 aa, Artificial Sequence
  Description of Artificial Sequence: Synthetic polypeptide
DEEEIRTTNPVATEPYGSVCFNNLTRQGQNR

SEQ ID NO: 34495 - protein, 29 aa, Artificial Sequence
  Description of Artificial Sequence: Synthetic peptide
DEEEIRTTNPVATEGYGCSSTTNEQRNNQ

SEQ ID NO: 34496 - protein, 29 aa, Artificial Sequence
  Description of Artificial Sequence: Synthetic peptide
YEEEIRCTNPIATEQYGSVSENLMERGYR

SEQ ID NO: 34497 - protein, 28 aa, Artificial Sequence
  Description of Artificial Sequence: Synthetic peptide
YEEEIRCTNPIATEQYGSVSENLMSGNQ

SEQ ID NO: 34498 - protein, 28 aa, Artificial Sequence
  Description of Artificial Sequence: Synthetic peptide
YEEEIRCTNPIATEQYGVVSENLQSGNQ

SEQ ID NO: 34499 - protein, 32 aa, Artificial Sequence
  Description of Artificial Sequence: Synthetic polypeptide
DEEEIRTTNPVATEPYGSVCFETNLTQIGGNR

SEQ ID NO: 34500 - protein, 28 aa, Artificial Sequence
  Description of Artificial Sequence: Synthetic peptide
YEEEIRCTNPVCTEQYGVVSDNLQSGNQ

SEQ ID NO: 34501 - protein, 31 aa, Artificial Sequence
  Description of Artificial Sequence: Synthetic polypeptide
DEEEIRTTNPVATEPYGSVCFTANLIPGVNR

SEQ ID NO: 34502 - protein, 28 aa, Artificial Sequence
  Description of Artificial Sequence: Synthetic peptide
YEEEIRCTNPVCTEQYGVVSENLMSGNR

SEQ ID NO: 34503 - protein, 32 aa, Artificial Sequence
  Description of Artificial Sequence: Synthetic polypeptide
DEEEIRTTNPVATEPYGSVCCTNLTQRGGQAR

SEQ ID NO: 34504 - protein, 31 aa, Artificial Sequence
  Description of Artificial Sequence: Synthetic polypeptide
DEEEIRTTNPVATEPYGSVCATNLTIGGENR

SEQ ID NO: 34505 - protein, 32 aa, Artificial Sequence
  Description of Artificial Sequence: Synthetic polypeptide
DEEEIRTTNPVATEPYGSVCATNLTERGGNVR

SEQ ID NO: 34506 - protein, 28 aa, Artificial Sequence
  Description of Artificial Sequence: Synthetic peptide
YEEEIRSTNPVATEQYGVVSDNLQSENQ

SEQ ID NO: 34507 - protein, 29 aa, Artificial Sequence
  Description of Artificial Sequence: Synthetic peptide
YEEEIRSTNPVATSQYGSVATNDLQRGED

SEQ ID NO: 34508 - protein, 33 aa, Artificial Sequence
  Description of Artificial Sequence: Synthetic polypeptide
DEEEIRTTNPVATEPYGSTVSCTNMLQRGGSYR

SEQ ID NO: 34509 - protein, 28 aa, Artificial Sequence
  Description of Artificial Sequence: Synthetic peptide
YEEEIRSTNPVCTEQYGVVSDNLQSGNQ

SEQ ID NO: 34510 - protein, 33 aa, Artificial Sequence
  Description of Artificial Sequence: Synthetic polypeptide
DEEEIRTTNPVATEPYGSTVPSCTNEFSQRGNR

SEQ ID NO: 34511 - protein, 28 aa, Artificial Sequence
  Description of Artificial Sequence: Synthetic peptide
YEEEIRSTNPICTEQYGSVSENLQSGNQ

SEQ ID NO: 34512 - protein, 32 aa, Artificial Sequence
  Description of Artificial Sequence: Synthetic polypeptide
DEEEIRTTNPVATEPYGSTVCFTNLTDRTGNR

SEQ ID NO: 34513 - protein, 29 aa, Artificial Sequence
  Description of Artificial Sequence: Synthetic peptide
DEEEIRTTNPVATEGYGCSCSTNEQYPNQ

SEQ ID NO: 34514 - protein, 29 aa, Artificial Sequence
  Description of Artificial Sequence: Synthetic peptide
YEEEIITTNPVMTEQYGSASTNLQGNGER

SEQ ID NO: 34515 - protein, 28 aa, Artificial Sequence
  Description of Artificial Sequence: Synthetic peptide
YEEEIATVNPVATEQYGVVSDNLQHGNQ

SEQ ID NO: 34516 - protein, 32 aa, Artificial Sequence
  Description of Artificial Sequence: Synthetic polypeptide
DEEEIRTTNPVATEPYGSVCFVTANLEREGNR

SEQ ID NO: 34517 - protein, 28 aa, Artificial Sequence
  Description of Artificial Sequence: Synthetic peptide
YEEEIATVNPVATEQYGVVSDNLQSGNQ

SEQ ID NO: 34518 - protein, 32 aa, Artificial Sequence
  Description of Artificial Sequence: Synthetic polypeptide
DEEEIRTTNPVATEPYGSVCFTNPLTRQGNQR

SEQ ID NO: 34519 - protein, 32 aa, Artificial Sequence
  Description of Artificial Sequence: Synthetic polypeptide
DEEEIRTTNPVATEPYGSVCFTNLTVRMGLNR

SEQ ID NO: 34520 - protein, 29 aa, Artificial Sequence
  Description of Artificial Sequence: Synthetic peptide
AEDEICATNPVATEQYGSVASDNLQRGER

SEQ ID NO: 34521 - protein, 30 aa, Artificial Sequence
  Description of Artificial Sequence: Synthetic polypeptide
DEEEIRTTNPVATEPYGSVCFTNLTRMSNV

SEQ ID NO: 34522 - protein, 32 aa, Artificial Sequence
  Description of Artificial Sequence: Synthetic polypeptide
DEEEIRTTNPVATEPYGSVCFTNLTRGGNIRP

SEQ ID NO: 34523 - protein, 31 aa, Artificial Sequence
  Description of Artificial Sequence: Synthetic polypeptide
DEEEIRTTNPVATEPYGSVCFTANLTVAGNR

SEQ ID NO: 34524 - protein, 31 aa, Artificial Sequence
  Description of Artificial Sequence: Synthetic polypeptide
DEEEIRTTNPVATEPYGSVCFTNLTLGGNER

SEQ ID NO: 34525 - protein, 30 aa, Artificial Sequence
  Description of Artificial Sequence: Synthetic polypeptide
DEEEIRTTNPVATEPYGSVCFTNDTRGGND

SEQ ID NO: 34526 - protein, 29 aa, Artificial Sequence
  Description of Artificial Sequence: Synthetic peptide
YEEEICTTNPVMTEQYGSVSTNLQGALER

SEQ ID NO: 34527 - protein, 29 aa, Artificial Sequence
  Description of Artificial Sequence: Synthetic peptide
YEEEICTTNPVSTEQYGSVSNNLERVGNG

SEQ ID NO: 34528 - protein, 30 aa, Artificial Sequence
  Description of Artificial Sequence: Synthetic polypeptide
DEEEIRTTNPVATEPYGSVCFTNATRGGDR

SEQ ID NO: 34529 - protein, 29 aa, Artificial Sequence
  Description of Artificial Sequence: Synthetic peptide
YEEEIGTTNPVNTEQYGSVSNNLERGENG

SEQ ID NO: 34530 - protein, 31 aa, Artificial Sequence
  Description of Artificial Sequence: Synthetic polypeptide
AEDEIATTNPVATEQYGSVSTNLQRDGNEDQ

SEQ ID NO: 34531 - protein, 32 aa, Artificial Sequence
  Description of Artificial Sequence: Synthetic polypeptide
DEEEIRTTNPVATEPYGSVCFTGNLSTRGGNR

SEQ ID NO: 34532 - protein, 29 aa, Artificial Sequence
  Description of Artificial Sequence: Synthetic peptide
YEEEIHTTNPVITEMYGSVSEWNLQRGNV

SEQ ID NO: 34533 - protein, 31 aa, Artificial Sequence
  Description of Artificial Sequence: Synthetic polypeptide
DEEEIRTTNPVATEPYGSVCFTNELHEGGNR

SEQ ID NO: 34534 - protein, 31 aa, Artificial Sequence
  Description of Artificial Sequence: Synthetic polypeptide
DEEEIRTTNPVATEGYGCVCFTNLTRGGNRI

SEQ ID NO: 34535 - protein, 32 aa, Artificial Sequence
  Description of Artificial Sequence: Synthetic polypeptide
DEEEIRTTNPVATEPYGSSVSTVNLQDQIQNR

SEQ ID NO: 34536 - protein, 28 aa, Artificial Sequence
  Description of Artificial Sequence: Synthetic peptide
YEEEIRSVNPVATEQYGVVSDNLQSGNQ

SEQ ID NO: 34537 - protein, 32 aa, Artificial Sequence
  Description of Artificial Sequence: Synthetic polypeptide
DEEEIRTTNPVATEPYGISVSTVNDQDRIVNR

SEQ ID NO: 34538 - protein, 32 aa, Artificial Sequence
  Description of Artificial Sequence: Synthetic polypeptide
DEEEIRTTNPVATEPYGISVSTVELQDRIDNR

SEQ ID NO: 34539 - protein, 30 aa, Artificial Sequence
  Description of Artificial Sequence: Synthetic polypeptide
YEEEIRTTNPVATKQYGSVATNDLQRGELN

SEQ ID NO: 34540 - protein, 30 aa, Artificial Sequence
  Description of Artificial Sequence: Synthetic polypeptide
YEEEIRTTNPVATKQYGSVATNPLQRGEDQ

SEQ ID NO: 34541 - protein, 30 aa, Artificial Sequence
  Description of Artificial Sequence: Synthetic polypeptide
YEEEIRTTNPVATKQYGSVFTNDLQRVGED

SEQ ID NO: 34542 - protein, 29 aa, Artificial Sequence
  Description of Artificial Sequence: Synthetic peptide
YEEEIRTTNPVATKQYGSVWTNDLQKGED

SEQ ID NO: 34543 - protein, 30 aa, Artificial Sequence
  Description of Artificial Sequence: Synthetic polypeptide
YEEEIRTTNPVATLQYGSVATNDLQRGFED

SEQ ID NO: 34544 - protein, 32 aa, Artificial Sequence
  Description of Artificial Sequence: Synthetic polypeptide
YEEEIRTTNPVATLQYGSVCVWTWNLQRIGNR

SEQ ID NO: 34545 - protein, 33 aa, Artificial Sequence
  Description of Artificial Sequence: Synthetic polypeptide
DEEEIRTTNPVATEPYGISVSTVNILQDRIENR

SEQ ID NO: 34546 - protein, 32 aa, Artificial Sequence
  Description of Artificial Sequence: Synthetic polypeptide
YEEEIRTTNPVATLQYGSVRSTNSITQRGNDR

SEQ ID NO: 34547 - protein, 32 aa, Artificial Sequence
  Description of Artificial Sequence: Synthetic polypeptide
YEEEIRTTNPVATLQYGSVSTNPITQRQGNDR

SEQ ID NO: 34548 - protein, 31 aa, Artificial Sequence
  Description of Artificial Sequence: Synthetic polypeptide
YEEEIRTTNPVATLQYGSVSTNVGTQKGNDR

SEQ ID NO: 34549 - protein, 31 aa, Artificial Sequence
  Description of Artificial Sequence: Synthetic polypeptide
YEEEIRTTNPVATLQYGSVSTNVIPQVGNDR

SEQ ID NO: 34550 - protein, 32 aa, Artificial Sequence
  Description of Artificial Sequence: Synthetic polypeptide
YEEEIRTTNPVATLQYGSVSTNVITQRGSNDR

SEQ ID NO: 34551 - protein, 30 aa, Artificial Sequence
  Description of Artificial Sequence: Synthetic polypeptide
YEEEIRTTNPVATQQYGSVATNDLQRGAES

SEQ ID NO: 34552 - protein, 30 aa, Artificial Sequence
  Description of Artificial Sequence: Synthetic polypeptide
YEEEIRTTNPVATVQYGSVATNDLQRGEDG

SEQ ID NO: 34553 - protein, 29 aa, Artificial Sequence
  Description of Artificial Sequence: Synthetic peptide
YEEEIRTTNPVATYQYGSVACNDLQRGED

SEQ ID NO: 34554 - protein, 30 aa, Artificial Sequence
  Description of Artificial Sequence: Synthetic polypeptide
YEEEIRTTNPVCTEQYGSVSDPNLQSGMNQ

SEQ ID NO: 34555 - protein, 32 aa, Artificial Sequence
  Description of Artificial Sequence: Synthetic polypeptide
YEEEIRTTNPVATLQYGSVSATGNLQRTMNDR

SEQ ID NO: 34556 - protein, 32 aa, Artificial Sequence
  Description of Artificial Sequence: Synthetic polypeptide
DEEEIRTTNPVATEPYGISVSTVNLQDAIFNR

SEQ ID NO: 34557 - protein, 33 aa, Artificial Sequence
  Description of Artificial Sequence: Synthetic polypeptide
DEEEIRTTNPVATEPYGISVSTVNLQDRIHNDR

SEQ ID NO: 34558 - protein, 32 aa, Artificial Sequence
  Description of Artificial Sequence: Synthetic polypeptide
DEEEIRTTNPVATEPYGISVSTVNLQDRIIND

SEQ ID NO: 34559 - protein, 32 aa, Artificial Sequence
  Description of Artificial Sequence: Synthetic polypeptide
DEEEIRTTNPVATEPYGQVSTGNELSQRGGNE

SEQ ID NO: 34560 - protein, 32 aa, Artificial Sequence
  Description of Artificial Sequence: Synthetic polypeptide
DEEEIRTTNPVATEPYGQSVSTVNLQPRIINE

SEQ ID NO: 34561 - protein, 32 aa, Artificial Sequence
  Description of Artificial Sequence: Synthetic polypeptide
DEEEIRTTNPVATEPYGMSVSTVNLQPRIVND

SEQ ID NO: 34562 - protein, 32 aa, Artificial Sequence
  Description of Artificial Sequence: Synthetic polypeptide
DEEEIRTTNPVATEPYGMSVSTVNLIDRISNR

SEQ ID NO: 34563 - protein, 32 aa, Artificial Sequence
  Description of Artificial Sequence: Synthetic polypeptide
DEEEIRTTNPVATEPYGKVVSCTNLSQHGNNR

SEQ ID NO: 34564 - protein, 28 aa, Artificial Sequence
  Description of Artificial Sequence: Synthetic peptide
YEEEIRSVNPVCTEQYGVVSDNLQSGNR

SEQ ID NO: 34565 - protein, 31 aa, Artificial Sequence
  Description of Artificial Sequence: Synthetic polypeptide
DEEEIRTTNPVATEPYGKVSVTNQSQRGNTP

SEQ ID NO: 34566 - protein, 29 aa, Artificial Sequence
  Description of Artificial Sequence: Synthetic peptide
YEEEIRSVNPVCTEQYGVVSTDNLQRGNQ

SEQ ID NO: 34567 - protein, 32 aa, Artificial Sequence
  Description of Artificial Sequence: Synthetic polypeptide
DEEEIRTTNPVATEPYGKVSCTNGLSQRVGDR

SEQ ID NO: 34568 - protein, 30 aa, Artificial Sequence
  Description of Artificial Sequence: Synthetic polypeptide
YEEEIRTTNPDITEQYGSVSTINLEEGSNR

SEQ ID NO: 34569 - protein, 28 aa, Artificial Sequence
  Description of Artificial Sequence: Synthetic peptide
YEEEIRTTNPENTEQYGSVSNNLEEGNG

SEQ ID NO: 34570 - protein, 32 aa, Artificial Sequence
  Description of Artificial Sequence: Synthetic polypeptide
DEEEIRTTNPVATEPYGIVVSTVNLQDGNKNR

SEQ ID NO: 34571 - protein, 30 aa, Artificial Sequence
  Description of Artificial Sequence: Synthetic polypeptide
YEEEIRTTNPSMTEQYGSVSYTNLQGAGER

SEQ ID NO: 34572 - protein, 29 aa, Artificial Sequence
  Description of Artificial Sequence: Synthetic peptide
YEEEIRTTNPVATAQFGAVSTGNLGRGNL

SEQ ID NO: 34573 - protein, 32 aa, Artificial Sequence
  Description of Artificial Sequence: Synthetic polypeptide
YEEEIRTTNPVATEQYGSVCSTALQNLVGNRF

SEQ ID NO: 34574 - protein, 33 aa, Artificial Sequence
  Description of Artificial Sequence: Synthetic polypeptide
DEEEIRTTNPVATEPYGISVSTVNLQGRIMNRD

SEQ ID NO: 34575 - protein, 33 aa, Artificial Sequence
  Description of Artificial Sequence: Synthetic polypeptide
DEEEIRTTNPVATEPYGISVSTVNLQERINNRA

SEQ ID NO: 34576 - protein, 31 aa, Artificial Sequence
  Description of Artificial Sequence: Synthetic polypeptide
YEEEIRTTNPVATEQYGSVSSTALNMRNGNQ

SEQ ID NO: 34577 - protein, 33 aa, Artificial Sequence
  Description of Artificial Sequence: Synthetic polypeptide
DEEEIRTTNPVATEPYGISVSTVNLQDRINNFR

SEQ ID NO: 34578 - protein, 28 aa, Artificial Sequence
  Description of Artificial Sequence: Synthetic peptide
YEEEIATVNPVATEQYGVVSDNLQHGNK

SEQ ID NO: 34579 - protein, 31 aa, Artificial Sequence
  Description of Artificial Sequence: Synthetic polypeptide
YEEEIRTTNPVCTEQYGSVSSDPNLQRGMNQ

SEQ ID NO: 34580 - protein, 28 aa, Artificial Sequence
  Description of Artificial Sequence: Synthetic peptide
YEEEIATVNPVATEQYGEVSDNLQSGNK

SEQ ID NO: 34581 - protein, 28 aa, Artificial Sequence
  Description of Artificial Sequence: Synthetic peptide
YEEEIATTNPVCTEQYGVVSDNLQSGNQ

SEQ ID NO: 34582 - protein, 31 aa, Artificial Sequence
  Description of Artificial Sequence: Synthetic polypeptide
AEDEIRTTNPVATEQYGSVSTTNLQIGNSTV

SEQ ID NO: 34583 - protein, 31 aa, Artificial Sequence
  Description of Artificial Sequence: Synthetic polypeptide
AEDEIRTTNPVATEQYGSVSTTNLLQIGSNV

SEQ ID NO: 34584 - protein, 28 aa, Artificial Sequence
  Description of Artificial Sequence: Synthetic peptide
YEEEIACVNPVATEQYGSVSDNLMRGNQ

SEQ ID NO: 34585 - protein, 28 aa, Artificial Sequence
  Description of Artificial Sequence: Synthetic peptide
YEEEIACVNPVATEQYGVVSENLQSGNR

SEQ ID NO: 34586 - protein, 31 aa, Artificial Sequence
  Description of Artificial Sequence: Synthetic polypeptide
DEEEIRTTNPVATEFYGSVISGNLVRGNTQM

SEQ ID NO: 34587 - protein, 28 aa, Artificial Sequence
  Description of Artificial Sequence: Synthetic peptide
YEEEIASTNPVATEQYGEVSENLQSGGR

SEQ ID NO: 34588 - protein, 28 aa, Artificial Sequence
  Description of Artificial Sequence: Synthetic peptide
YEEEIASTNPVCTEQYGSVSDNLQSGNQ

SEQ ID NO: 34589 - protein, 31 aa, Artificial Sequence
  Description of Artificial Sequence: Synthetic polypeptide
DEEEIRTTNPVATEQFGQSVSCTHLSTRGNS

SEQ ID NO: 34590 - protein, 28 aa, Artificial Sequence
  Description of Artificial Sequence: Synthetic peptide
YEEEIACTNPVCTEQYGVVSDNLQSGNR

SEQ ID NO: 34591 - protein, 31 aa, Artificial Sequence
  Description of Artificial Sequence: Synthetic polypeptide
DEEEIRTTNPVATEQFGQSVPSTYLSERGNS

SEQ ID NO: 34592 - protein, 28 aa, Artificial Sequence
  Description of Artificial Sequence: Synthetic peptide
YEEEIASTNPVCTEQYGVVSDNLQRGNQ

SEQ ID NO: 34593 - protein, 31 aa, Artificial Sequence
  Description of Artificial Sequence: Synthetic polypeptide
DEEEIRTTNPVATEQFGEVSTTLSTRGGNRQ

SEQ ID NO: 34594 - protein, 31 aa, Artificial Sequence
  Description of Artificial Sequence: Synthetic polypeptide
DEEEIRTTNPVATEQFGDTSVSTVLGRGNSN

SEQ ID NO: 34595 - protein, 28 aa, Artificial Sequence
  Description of Artificial Sequence: Synthetic peptide
YEEEIASTNPVCTEQYGVVSDNLQSGNR

SEQ ID NO: 34596 - protein, 31 aa, Artificial Sequence
  Description of Artificial Sequence: Synthetic polypeptide
DEEEIRTTNPVATEFYGSVNTNVQQRGNNGQ

SEQ ID NO: 34597 - protein, 31 aa, Artificial Sequence
  Description of Artificial Sequence: Synthetic polypeptide
DEEEIRTTNPVATEFYGSVSCTNGGQRGKFP

SEQ ID NO: 34598 - protein, 31 aa, Artificial Sequence
  Description of Artificial Sequence: Synthetic polypeptide
DEEEIRTTNPVATEPYGVVCATNLTDRGGNR

SEQ ID NO: 34599 - protein, 28 aa, Artificial Sequence
  Description of Artificial Sequence: Synthetic peptide
YEEEIASVNPVATEQYGSVSDNLMRGNQ

SEQ ID NO: 34600 - protein, 30 aa, Artificial Sequence
  Description of Artificial Sequence: Synthetic polypeptide
DEEEIRTTNPVATEQFGNSVVSTYLIRENS

SEQ ID NO: 34601 - protein, 28 aa, Artificial Sequence
  Description of Artificial Sequence: Synthetic peptide
YEEEIASVNPVATEQYGSVSDNLQSGNL

SEQ ID NO: 34602 - protein, 30 aa, Artificial Sequence
  Description of Artificial Sequence: Synthetic polypeptide
DEEEIRTTNPVATEQFGTSVSTMYLTSGNQ

SEQ ID NO: 34603 - protein, 31 aa, Artificial Sequence
  Description of Artificial Sequence: Synthetic polypeptide
DEEEIRTTNPVATEQFGTSVSTNYLLRGGIS

SEQ ID NO: 34604 - protein, 32 aa, Artificial Sequence
  Description of Artificial Sequence: Synthetic polypeptide
WEEEIRTTNPVATEQYGSVSTSTLQEKGENYR

SEQ ID NO: 34605 - protein, 30 aa, Artificial Sequence
  Description of Artificial Sequence: Synthetic polypeptide
DEEEIRTTNPVATEQFGTVVSTDLLRGNDS

SEQ ID NO: 34606 - protein, 33 aa, Artificial Sequence
  Description of Artificial Sequence: Synthetic polypeptide
WEEEIRTTNPVATEQYGTVSTSNGLDQRGENQR

SEQ ID NO: 34607 - protein, 30 aa, Artificial Sequence
  Description of Artificial Sequence: Synthetic polypeptide
WEEEIRTTNPVGTEQYGSVSTMNLEQEENI

SEQ ID NO: 34608 - protein, 31 aa, Artificial Sequence
  Description of Artificial Sequence: Synthetic polypeptide
WEEEIRTTNPVGTEQYGSVSTMNLQRFDQNI

SEQ ID NO: 34609 - protein, 29 aa, Artificial Sequence
  Description of Artificial Sequence: Synthetic peptide
DEEEIRTTNPVATEQFGTSVSTYTARGDQ

SEQ ID NO: 34610 - protein, 30 aa, Artificial Sequence
  Description of Artificial Sequence: Synthetic polypeptide
DEEEIRTTNPVATEQFGTSVSTYLLRGVES

SEQ ID NO: 34611 - protein, 29 aa, Artificial Sequence
  Description of Artificial Sequence: Synthetic peptide
YAEEIRTTNPVSTEQYGSVSYNNLERGNG

SEQ ID NO: 34612 - protein, 28 aa, Artificial Sequence
  Description of Artificial Sequence: Synthetic peptide
YEEEIACTNPICTEQYGSVSENLQSGNR

SEQ ID NO: 34613 - protein, 31 aa, Artificial Sequence
  Description of Artificial Sequence: Synthetic polypeptide
DEEEIRTTNPVATEQFGTSVSTYLLRGGNSD

SEQ ID NO: 34614 - protein, 30 aa, Artificial Sequence
  Description of Artificial Sequence: Synthetic polypeptide
AEDEIRTTNPVATEQYGSVTTNNLQIGSNV

SEQ ID NO: 34615 - protein, 30 aa, Artificial Sequence
  Description of Artificial Sequence: Synthetic polypeptide
AEDEIRTTNPVATEQYGSVTTNLQIGSTNE

SEQ ID NO: 34616 - protein, 30 aa, Artificial Sequence
  Description of Artificial Sequence: Synthetic polypeptide
DEEEIRTTNPVATEQFGTSVSTYGLLGGNS

SEQ ID NO: 34617 - protein, 29 aa, Artificial Sequence
  Description of Artificial Sequence: Synthetic peptide
YEEAIRTTNPVHTEQYGSVVTNLQGAGER

SEQ ID NO: 34618 - protein, 31 aa, Artificial Sequence
  Description of Artificial Sequence: Synthetic polypeptide
YEEAIRTTNPVITEQYGSVSTYNLEERGSNR

SEQ ID NO: 34619 - protein, 31 aa, Artificial Sequence
  Description of Artificial Sequence: Synthetic polypeptide
DEEEIRTTNPVATEQFGTSVSTNYLLWGNDQ

SEQ ID NO: 34620 - protein, 31 aa, Artificial Sequence
  Description of Artificial Sequence: Synthetic polypeptide
DEEEIRTTNPVATEQFGTSVSTNYLLSPGNQ

SEQ ID NO: 34621 - protein, 28 aa, Artificial Sequence
  Description of Artificial Sequence: Synthetic peptide
YEEEIACTNPIATEQYGVVSENLMRGNR

SEQ ID NO: 34622 - protein, 30 aa, Artificial Sequence
  Description of Artificial Sequence: Synthetic polypeptide
DEEEIRTTNPVATEQFGTSVSTYLLRGETD

SEQ ID NO: 34623 - protein, 28 aa, Artificial Sequence
  Description of Artificial Sequence: Synthetic peptide
YEEEIASVNPVATEQYGSVSDNLQSGNQ

SEQ ID NO: 34624 - protein, 32 aa, Artificial Sequence
  Description of Artificial Sequence: Synthetic polypeptide
DEEEIRTTNPVATEPYGVSVSTVNLQDVILNR

SEQ ID NO: 34625 - protein, 28 aa, Artificial Sequence
  Description of Artificial Sequence: Synthetic peptide
YEEEIASVNPVATEQYGVVSDNLQRGNQ

SEQ ID NO: 34626 - protein, 31 aa, Artificial Sequence
  Description of Artificial Sequence: Synthetic polypeptide
DEEEIRTTNPVATEPYGSVSTTNLTNGGNNM

SEQ ID NO: 34627 - protein, 31 aa, Artificial Sequence
  Description of Artificial Sequence: Synthetic polypeptide
DEEEIRTTNPVATEPYGSVSTTNLTLGGNVT

SEQ ID NO: 34628 - protein, 31 aa, Artificial Sequence
  Description of Artificial Sequence: Synthetic polypeptide
DEEEIRTTNPVATEPYGSVSTTNLTLGGNVN

SEQ ID NO: 34629 - protein, 32 aa, Artificial Sequence
  Description of Artificial Sequence: Synthetic polypeptide
DEEEIRTTNPVATEPYGSVSTTNLQTGNGGNN

SEQ ID NO: 34630 - protein, 32 aa, Artificial Sequence
  Description of Artificial Sequence: Synthetic polypeptide
DEEEIRTTNPVATEPYGSVSTTNLNTQGGNVV

SEQ ID NO: 34631 - protein, 32 aa, Artificial Sequence
  Description of Artificial Sequence: Synthetic polypeptide
DEEEIRTTNPVATEPYGSVSTTNLNTQGGNGE

SEQ ID NO: 34632 - protein, 32 aa, Artificial Sequence
  Description of Artificial Sequence: Synthetic polypeptide
DEEEIRTTNPVATEPYGSVSTTNLGTEQGGNV

SEQ ID NO: 34633 - protein, 31 aa, Artificial Sequence
  Description of Artificial Sequence: Synthetic polypeptide
DEEEIRTTNPVATEFYGSVVFTNLIRGGNNT

SEQ ID NO: 34634 - protein, 32 aa, Artificial Sequence
  Description of Artificial Sequence: Synthetic polypeptide
DEEEIRTTNPVATEPYGSVSTTTNLTQGGNNG

SEQ ID NO: 34635 - protein, 33 aa, Artificial Sequence
  Description of Artificial Sequence: Synthetic polypeptide
DEEEIRTTNPVATEPYGSVSTGNLSQRTVNNRP

SEQ ID NO: 34636 - protein, 31 aa, Artificial Sequence
  Description of Artificial Sequence: Synthetic polypeptide
DEEEIRTTNPVATEPYGSVSCTNDSQGGGNS

SEQ ID NO: 34637 - protein, 32 aa, Artificial Sequence
  Description of Artificial Sequence: Synthetic polypeptide
DEEEIRTTNPVATEPYGSVSCSQNLSQRVGNI

SEQ ID NO: 34638 - protein, 32 aa, Artificial Sequence
  Description of Artificial Sequence: Synthetic polypeptide
DEEEIRTTNPVATEPYGSVPSCTFHSQRGGNR

SEQ ID NO: 34639 - protein, 28 aa, Artificial Sequence
  Description of Artificial Sequence: Synthetic peptide
YEEEIATTNPVATEQYGEVPDNLQSGNK

SEQ ID NO: 34640 - protein, 28 aa, Artificial Sequence
  Description of Artificial Sequence: Synthetic peptide
YEEEIATTNPVCTEQYGDVSDNLQSGNQ

SEQ ID NO: 34641 - protein, 29 aa, Artificial Sequence
  Description of Artificial Sequence: Synthetic peptide
YEEEIATTNPVCTEQYGSVSADNLQSGNQ

SEQ ID NO: 34642 - protein, 31 aa, Artificial Sequence
  Description of Artificial Sequence: Synthetic polypeptide
DEEEIRTTNPVATEPYGSVDNTNLTRGGNGG

SEQ ID NO: 34643 - protein, 31 aa, Artificial Sequence
  Description of Artificial Sequence: Synthetic polypeptide
DEEEIRTTNPVATEPYGSVCYTNDTGRGGNR

SEQ ID NO: 34644 - protein, 32 aa, Artificial Sequence
  Description of Artificial Sequence: Synthetic polypeptide
DEEEIRTTNPVATEPYGSVSSTNLQQGGNNQD

SEQ ID NO: 34645 - protein, 32 aa, Artificial Sequence
  Description of Artificial Sequence: Synthetic polypeptide
DEEEIRTTNPVATEFYGSVSTSNLQFETGNND

SEQ ID NO: 34646 - protein, 31 aa, Artificial Sequence
  Description of Artificial Sequence: Synthetic polypeptide
DEEEIRTTNPVATEPYGSVSVSLNLSQRVNI

SEQ ID NO: 34647 - protein, 33 aa, Artificial Sequence
  Description of Artificial Sequence: Synthetic polypeptide
DEEEIRTTNPVATEPYGSVSYTNLSQHGGNNRH

SEQ ID NO: 34648 - protein, 32 aa, Artificial Sequence
  Description of Artificial Sequence: Synthetic polypeptide
DEEEIRTTNPVATEPYGTVSYTNALQRTVGNP

SEQ ID NO: 34649 - protein, 32 aa, Artificial Sequence
  Description of Artificial Sequence: Synthetic polypeptide
DEEEIRTTNPVATEPYGTVPSCTNAHQRGGNR

SEQ ID NO: 34650 - protein, 28 aa, Artificial Sequence
  Description of Artificial Sequence: Synthetic peptide
YEEEIASVNPVATEQYGVVSENLQSGNR

SEQ ID NO: 34651 - protein, 32 aa, Artificial Sequence
  Description of Artificial Sequence: Synthetic polypeptide
DEEEIRTTNPVATEPYGTSVSTVNNQPRIVNR

SEQ ID NO: 34652 - protein, 32 aa, Artificial Sequence
  Description of Artificial Sequence: Synthetic polypeptide
DEEEIRTTNPVATEPYGTSVSTVNLQDLINNR

SEQ ID NO: 34653 - protein, 28 aa, Artificial Sequence
  Description of Artificial Sequence: Synthetic peptide
YEEEIASVNPVATEQYGVVSTNLQSGNQ

SEQ ID NO: 34654 - protein, 32 aa, Artificial Sequence
  Description of Artificial Sequence: Synthetic polypeptide
DEEEIRTTNPVATEPYGTSVSTENLQDEIPNR

SEQ ID NO: 34655 - protein, 30 aa, Artificial Sequence
  Description of Artificial Sequence: Synthetic polypeptide
DEEEIRTTNPVATEPYGSVVTTNLTLGGNP

SEQ ID NO: 34656 - protein, 32 aa, Artificial Sequence
  Description of Artificial Sequence: Synthetic polypeptide
DEEEIRTTNPVATEPYGSVVSTVNLQLAIDNR

SEQ ID NO: 34657 - protein, 32 aa, Artificial Sequence
  Description of Artificial Sequence: Synthetic polypeptide
DEEEIRTTNPVATEFYGSVSTLNLGQNGGNEP

SEQ ID NO: 34658 - protein, 32 aa, Artificial Sequence
  Description of Artificial Sequence: Synthetic polypeptide
DEEEIRTTNPVATEFYGSVSTLNLVQNGGNVP

SEQ ID NO: 34659 - protein, 32 aa, Artificial Sequence
  Description of Artificial Sequence: Synthetic polypeptide
DEEEIRTTNPVATEPYGSVVSTVNLQDESVNR

SEQ ID NO: 34660 - protein, 31 aa, Artificial Sequence
  Description of Artificial Sequence: Synthetic polypeptide
DEEEIRTTNPVATEFYGSVSTMNDQGTGNND

SEQ ID NO: 34661 - protein, 32 aa, Artificial Sequence
  Description of Artificial Sequence: Synthetic polypeptide
DEEEIRTTNPVATEFYGSVSTMNLGQEDGEND

SEQ ID NO: 34662 - protein, 28 aa, Artificial Sequence
  Description of Artificial Sequence: Synthetic peptide
YEEEIASVNPVCTEQYGSVSDNLQRGNQ

SEQ ID NO: 34663 - protein, 32 aa, Artificial Sequence
  Description of Artificial Sequence: Synthetic polypeptide
DEEEIRTTNPVATEPYGSVVPSCTNLSTFGNR

SEQ ID NO: 34664 - protein, 30 aa, Artificial Sequence
  Description of Artificial Sequence: Synthetic polypeptide
DEEEIRTTNPVATEPYGSVTNTNLTLGGNE

SEQ ID NO: 34665 - protein, 32 aa, Artificial Sequence
  Description of Artificial Sequence: Synthetic polypeptide
DEEEIRTTNPVATEFYGSVSTPNLQEDGGENQ

SEQ ID NO: 34666 - protein, 32 aa, Artificial Sequence
  Description of Artificial Sequence: Synthetic polypeptide
DEEEIRTTNPVATEFYGSVSTPNLQFNFGNQE

SEQ ID NO: 34667 - protein, 29 aa, Artificial Sequence
  Description of Artificial Sequence: Synthetic peptide
YEEEIATTNPVCTEQYGVVSTNLQSEGNQ

SEQ ID NO: 34668 - protein, 33 aa, Artificial Sequence
  Description of Artificial Sequence: Synthetic polypeptide
WEEEIRTTNPVATEQYGSVSLTSNLSQRGVNYN

SEQ ID NO: 34669 - protein, 31 aa, Artificial Sequence
  Description of Artificial Sequence: Synthetic polypeptide
YEEEIRTTNPVCTEQYGSVSSDPNLQRGMNV

SEQ ID NO: 34670 - protein, 28 aa, Artificial Sequence
  Description of Artificial Sequence: Synthetic peptide
YEEEIRTTNPVCTEQYGVVSDNLQSENA

SEQ ID NO: 34671 - protein, 28 aa, Artificial Sequence
  Description of Artificial Sequence: Synthetic peptide
YEEGICTTNPVATEQYGSVSMNSQDGNH

SEQ ID NO: 34672 - protein, 28 aa, Artificial Sequence
  Description of Artificial Sequence: Synthetic peptide
YEEGICTTNPVATEQYGSVSMNSQEGNE

SEQ ID NO: 34673 - protein, 29 aa, Artificial Sequence
  Description of Artificial Sequence: Synthetic peptide
YEEGICTTNPVATEQYGSVSMNSQRGNMV

SEQ ID NO: 34674 - protein, 28 aa, Artificial Sequence
  Description of Artificial Sequence: Synthetic peptide
YEEGICTTNPVATEQYGSVSVNSQEGNS

SEQ ID NO: 34675 - protein, 29 aa, Artificial Sequence
  Description of Artificial Sequence: Synthetic peptide
YEEGICTTNPVATEQYGSVSWNSQRGSNS

SEQ ID NO: 34676 - protein, 29 aa, Artificial Sequence
  Description of Artificial Sequence: Synthetic peptide
YEEGIKTTNPVATEQYGSVSMNQQRGNVS

SEQ ID NO: 34677 - protein, 29 aa, Artificial Sequence
  Description of Artificial Sequence: Synthetic peptide
YEEGITTTNPVATEQYGSVSMNQQRGNES

SEQ ID NO: 34678 - protein, 32 aa, Artificial Sequence
  Description of Artificial Sequence: Synthetic polypeptide
DEEEIRTTNPVATEHWGSVSCTNLSQRPGGNT

SEQ ID NO: 34679 - protein, 29 aa, Artificial Sequence
  Description of Artificial Sequence: Synthetic peptide
YEEGICTTNPVATEQYGSVSMNNSQRGNF

SEQ ID NO: 34680 - protein, 29 aa, Artificial Sequence
  Description of Artificial Sequence: Synthetic peptide
YEELIRTTNPVSTEQYGSVSCNNLERGNG

SEQ ID NO: 34681 - protein, 31 aa, Artificial Sequence
  Description of Artificial Sequence: Synthetic polypeptide
YEEPISTTNPVATEQYGSVNSTNLEQNGNIR

SEQ ID NO: 34682 - protein, 30 aa, Artificial Sequence
  Description of Artificial Sequence: Synthetic polypeptide
DEEEIRTTNPVATEGYGVVSNTNHQRSSNP

SEQ ID NO: 34683 - protein, 31 aa, Artificial Sequence
  Description of Artificial Sequence: Synthetic polypeptide
DEEEIRTTNPVATEGYGVVCSNTNLQSGSNQ

SEQ ID NO: 34684 - protein, 29 aa, Artificial Sequence
  Description of Artificial Sequence: Synthetic peptide
YEESICTTNPVATEQYGSVSMNDQSRGNS

SEQ ID NO: 34685 - protein, 31 aa, Artificial Sequence
  Description of Artificial Sequence: Synthetic polypeptide
DEEEIRTTNPVATEGYGSVCSTGNDQGGSND

SEQ ID NO: 34686 - protein, 28 aa, Artificial Sequence
  Description of Artificial Sequence: Synthetic peptide
YEETICTTNPVATEQYGSVSDNGIRGNS

SEQ ID NO: 34687 - protein, 31 aa, Artificial Sequence
  Description of Artificial Sequence: Synthetic polypeptide
DEEEIRTTNPVATEGYGSVCSTGNHQNFGND

SEQ ID NO: 34688 - protein, 33 aa, Artificial Sequence
  Description of Artificial Sequence: Synthetic polypeptide
DEEEIRTTNPVATEGYGSVCSTNDLQNFGSNRS

SEQ ID NO: 34689 - protein, 30 aa, Artificial Sequence
  Description of Artificial Sequence: Synthetic polypeptide
DEEEIRTTNPVATEGYGSVCFTNLTHFGNQ

SEQ ID NO: 34690 - protein, 29 aa, Artificial Sequence
  Description of Artificial Sequence: Synthetic peptide
YEETICTTNPVATEQYGSVSNNVQDRGNS

SEQ ID NO: 34691 - protein, 28 aa, Artificial Sequence
  Description of Artificial Sequence: Synthetic peptide
YEEGICTTNPVATEQYGSVSMNNQQGNS

SEQ ID NO: 34692 - protein, 29 aa, Artificial Sequence
  Description of Artificial Sequence: Synthetic peptide
YEEGICTTNPVATEQYGSVSINDQQRGNS

SEQ ID NO: 34693 - protein, 33 aa, Artificial Sequence
  Description of Artificial Sequence: Synthetic polypeptide
DEEEIRTTNPVATEHYGSVVPSTPLSQRGGNNR

SEQ ID NO: 34694 - protein, 30 aa, Artificial Sequence
  Description of Artificial Sequence: Synthetic polypeptide
DEEEIRTTNPVATEHYGSVSTNLEPAINED

SEQ ID NO: 34695 - protein, 31 aa, Artificial Sequence
  Description of Artificial Sequence: Synthetic polypeptide
DEEEIRTTNPVATEHYGSVSTELQRSGSEDS

SEQ ID NO: 34696 - protein, 33 aa, Artificial Sequence
  Description of Artificial Sequence: Synthetic polypeptide
DEEEIRTTNPVATEHYGSVSCTNAQSQRGTNNR

SEQ ID NO: 34697 - protein, 33 aa, Artificial Sequence
  Description of Artificial Sequence: Synthetic polypeptide
DEEEIRTTNPVATEHYGSVPSYTNPSQRGGNNR

SEQ ID NO: 34698 - protein, 31 aa, Artificial Sequence
  Description of Artificial Sequence: Synthetic polypeptide
YEEEISTTNPVCTEQYGSVNSTNLEQFGNIR

SEQ ID NO: 34699 - protein, 34 aa, Artificial Sequence
  Description of Artificial Sequence: Synthetic polypeptide
DEEEIRTTNPVATEHYGSVASTNALSQRPGGNNR

SEQ ID NO: 34700 - protein, 32 aa, Artificial Sequence
  Description of Artificial Sequence: Synthetic polypeptide
DEEEIRTTNPVATEHYGSVAQNALSQRGGNNR

SEQ ID NO: 34701 - protein, 29 aa, Artificial Sequence
  Description of Artificial Sequence: Synthetic peptide
YEEGICTTNPVATEQYGSVSMNEQRNGNS

SEQ ID NO: 34702 - protein, 28 aa, Artificial Sequence
  Description of Artificial Sequence: Synthetic peptide
YEEEIVTTNPVGTEQYGSVSNNMERGNV

SEQ ID NO: 34703 - protein, 28 aa, Artificial Sequence
  Description of Artificial Sequence: Synthetic peptide
YEEELSTTNPVSTEQYGSVSNNLERGNG

SEQ ID NO: 34704 - protein, 33 aa, Artificial Sequence
  Description of Artificial Sequence: Synthetic polypeptide
DEEEIRTTNPVATEHYGSTVSCTLLSQRGGNNR

SEQ ID NO: 34705 - protein, 33 aa, Artificial Sequence
  Description of Artificial Sequence: Synthetic polypeptide
YEEETIRTTNPVGTEQYGSIVSTINLQMRGNER

SEQ ID NO: 34706 - protein, 34 aa, Artificial Sequence
  Description of Artificial Sequence: Synthetic polypeptide
DEEEIRTTNPVATEHYGSTVQSCTPNLSQRGGNR

SEQ ID NO: 34707 - protein, 34 aa, Artificial Sequence
  Description of Artificial Sequence: Synthetic polypeptide
DEEEIRTTNPVATEHYGSTVPSCTNELSQRGNRD

SEQ ID NO: 34708 - protein, 29 aa, Artificial Sequence
  Description of Artificial Sequence: Synthetic peptide
YEEGICTTNPVATEQYGSVNSWNFQRGNS

SEQ ID NO: 34709 - protein, 29 aa, Artificial Sequence
  Description of Artificial Sequence: Synthetic peptide
YEEGICTTNPVATEQYGSVSENQQWRGNS

SEQ ID NO: 34710 - protein, 29 aa, Artificial Sequence
  Description of Artificial Sequence: Synthetic peptide
YEEGICTTNPVATEQYGSVSGNSQERGNS

SEQ ID NO: 34711 - protein, 32 aa, Artificial Sequence
  Description of Artificial Sequence: Synthetic polypeptide
DEEEIRTTNPVATEHYGSTVSCTNLSMGGGNR

SEQ ID NO: 34712 - protein, 28 aa, Artificial Sequence
  Description of Artificial Sequence: Synthetic peptide
YEGEIRTTNPVCTEQYGSVSNNMERGNC

SEQ ID NO: 34713 - protein, 28 aa, Artificial Sequence
  Description of Artificial Sequence: Synthetic peptide
YEGEIRTTNPVNTEQYGSVSNGLERGNG

SEQ ID NO: 34714 - protein, 29 aa, Artificial Sequence
  Description of Artificial Sequence: Synthetic peptide
YELEIGTTNPVMTEQYGSVSTNLQGAGER

SEQ ID NO: 34715 - protein, 31 aa, Artificial Sequence
  Description of Artificial Sequence: Synthetic polypeptide
YESEIRTTNPVATEQYGAVCSANLQRGDNRP

SEQ ID NO: 34716 - protein, 29 aa, Artificial Sequence
  Description of Artificial Sequence: Synthetic peptide
YESEIRTTNPVATEQYGSFSTMNNQQGNV

SEQ ID NO: 34717 - protein, 29 aa, Artificial Sequence
  Description of Artificial Sequence: Synthetic peptide
YESEIRTTNPVATEQYGSVSCNEPQSGNG

SEQ ID NO: 34718 - protein, 29 aa, Artificial Sequence
  Description of Artificial Sequence: Synthetic peptide
YESEIRTTNPVATEQYGSVSDNEPQSGNG

SEQ ID NO: 34719 - protein, 30 aa, Artificial Sequence
  Description of Artificial Sequence: Synthetic polypeptide
YESEIRTTNPVATEQYGSVSTNNQRFSMAR

SEQ ID NO: 34720 - protein, 31 aa, Artificial Sequence
  Description of Artificial Sequence: Synthetic polypeptide
YESEIRTTNPVATESYGSIVNSTNLQRGNYA

SEQ ID NO: 34721 - protein, 30 aa, Artificial Sequence
  Description of Artificial Sequence: Synthetic polypeptide
YESEIRTVNPVATEQYGQVSTMNLQERGNH

SEQ ID NO: 34722 - protein, 30 aa, Artificial Sequence
  Description of Artificial Sequence: Synthetic polypeptide
YETEIRTTNPVATEQYGSRSITPNLQANNR

SEQ ID NO: 34723 - protein, 31 aa, Artificial Sequence
  Description of Artificial Sequence: Synthetic polypeptide
DEEEIRTTNPVATEGYGSVNFTNLIRGGNNG

SEQ ID NO: 34724 - protein, 28 aa, Artificial Sequence
  Description of Artificial Sequence: Synthetic peptide
YEVEIGTTNPVATEQYGSVWTNETRGTR

SEQ ID NO: 34725 - protein, 30 aa, Artificial Sequence
  Description of Artificial Sequence: Synthetic polypeptide
YEYEIRTTNPVATEQYGSSVSTNIQRVANQ

SEQ ID NO: 34726 - protein, 28 aa, Artificial Sequence
  Description of Artificial Sequence: Synthetic peptide
DEEEIRTTNPVATEGYGSVSENLVNDDP

SEQ ID NO: 34727 - protein, 29 aa, Artificial Sequence
  Description of Artificial Sequence: Synthetic peptide
YNEEIRTTNPVGTEQYGSVSTMYLQRDNI

SEQ ID NO: 34728 - protein, 29 aa, Artificial Sequence
  Description of Artificial Sequence: Synthetic peptide
YNEEIRTTNPVSTEQYGSVSNNLERGNGD

SEQ ID NO: 34729 - protein, 30 aa, Artificial Sequence
  Description of Artificial Sequence: Synthetic polypeptide
YQEEIYTTNPVATEQYGEVSTNLQRNNARQ

SEQ ID NO: 34730 - protein, 30 aa, Artificial Sequence
  Description of Artificial Sequence: Synthetic polypeptide
YTEEIRTTNPVATGQYGSVSTNDEQGHGNR

SEQ ID NO: 34731 - protein, 29 aa, Artificial Sequence
  Description of Artificial Sequence: Synthetic peptide
YTEEIRTTNPVGTEQYGSVSTMNTQRDNS

SEQ ID NO: 34732 - protein, 29 aa, Artificial Sequence
  Description of Artificial Sequence: Synthetic peptide
AAEEEIATTNPVATEPYGSVATNLQQGNL

SEQ ID NO: 34733 - protein, 30 aa, Artificial Sequence
  Description of Artificial Sequence: Synthetic polypeptide
YEYEIATTNPVATEQYGSVYTNLGRGLNAR

SEQ ID NO: 34734 - protein, 28 aa, Artificial Sequence
  Description of Artificial Sequence: Synthetic peptide
YESEIRTTNPVATEGYGSASTAHQNGNR

SEQ ID NO: 34735 - protein, 32 aa, Artificial Sequence
  Description of Artificial Sequence: Synthetic polypeptide
DEEEIRTTNPVATEGYGSVSTMNLDQGGQNDG

SEQ ID NO: 34736 - protein, 32 aa, Artificial Sequence
  Description of Artificial Sequence: Synthetic polypeptide
DEEEIRTTNPVATEGYGSVSTMNLDQNGENIV

SEQ ID NO: 34737 - protein, 31 aa, Artificial Sequence
  Description of Artificial Sequence: Synthetic polypeptide
DEEEIRTTNPVATEGYGSVVFTNLIRGGNEE

SEQ ID NO: 34738 - protein, 32 aa, Artificial Sequence
  Description of Artificial Sequence: Synthetic polypeptide
DEEEIRTTNPVATEGYGSVSTYNLQGGGNNEQ

SEQ ID NO: 34739 - protein, 28 aa, Artificial Sequence
  Description of Artificial Sequence: Synthetic peptide
YENEIACTNPVATEQYGEVSENLQRGGR

SEQ ID NO: 34740 - protein, 28 aa, Artificial Sequence
  Description of Artificial Sequence: Synthetic peptide
YENEIACVNPVATEQYGEVSDNLQRGNR

SEQ ID NO: 34741 - protein, 28 aa, Artificial Sequence
  Description of Artificial Sequence: Synthetic peptide
YENEIASVNPVATEQYGVVSDNLQRGNR

SEQ ID NO: 34742 - protein, 32 aa, Artificial Sequence
  Description of Artificial Sequence: Synthetic polypeptide
YENEIRTTNPVHTEQYGSFVSTNNDLQRGVNR

SEQ ID NO: 34743 - protein, 31 aa, Artificial Sequence
  Description of Artificial Sequence: Synthetic polypeptide
DEEEIRTTNPVATEGYGSVSTNDLQNGSEQA

SEQ ID NO: 34744 - protein, 29 aa, Artificial Sequence
  Description of Artificial Sequence: Synthetic peptide
YEPEIATTNPVATEQYGSVSTAQSRGMNR

SEQ ID NO: 34745 - protein, 31 aa, Artificial Sequence
  Description of Artificial Sequence: Synthetic polypeptide
YEPEIRTTNPVATEQYGSVSDTNGQPRGNVL

SEQ ID NO: 34746 - protein, 32 aa, Artificial Sequence
  Description of Artificial Sequence: Synthetic polypeptide
DEEEIRTTNPVATEGYGSVSTMNLTQNAGNDG

SEQ ID NO: 34747 - protein, 32 aa, Artificial Sequence
  Description of Artificial Sequence: Synthetic polypeptide
DEEEIRTTNPVATEGYGSVSTMNLQSGGNGDG

SEQ ID NO: 34748 - protein, 32 aa, Artificial Sequence
  Description of Artificial Sequence: Synthetic polypeptide
DEEEIRTTNPVATEGYGSVSTMNLQGAEGNQG

SEQ ID NO: 34749 - protein, 31 aa, Artificial Sequence
  Description of Artificial Sequence: Synthetic polypeptide
YEQEIRTTNPVATEQYGSVSTNLQDQGAEER

SEQ ID NO: 34750 - protein, 29 aa, Artificial Sequence
  Description of Artificial Sequence: Synthetic peptide
YEREIRTTNPDATEEYGSVSTHLQAGGNR

SEQ ID NO: 34751 - protein, 30 aa, Artificial Sequence
  Description of Artificial Sequence: Synthetic polypeptide
YEREIRTTNPVATDQYGSVSETNLQRQNDL

SEQ ID NO: 34752 - protein, 32 aa, Artificial Sequence
  Description of Artificial Sequence: Synthetic polypeptide
DEEEIRTTNPVATEGYGSVSTMNLQAFGNIDG

SEQ ID NO: 34753 - protein, 32 aa, Artificial Sequence
  Description of Artificial Sequence: Synthetic polypeptide
DEEEIRTTNPVATEGYGSVSTMNLDQSEGNDG

SEQ ID NO: 34754 - protein, 32 aa, Artificial Sequence
  Description of Artificial Sequence: Synthetic polypeptide
DEEEIRTTNPVATEGYGSVSTMNLDQNGNNGT

SEQ ID NO: 34755 - protein, 29 aa, Artificial Sequence
  Description of Artificial Sequence: Synthetic peptide
YESEIATTNPVATEQYGSVSDNEQREGNQ

SEQ ID NO: 34756 - protein, 32 aa, Artificial Sequence
  Description of Artificial Sequence: Synthetic polypeptide
YEEEISTTNPVATEQYGSVYNETNPLNQRGNR

SEQ ID NO: 34757 - protein, 32 aa, Artificial Sequence
  Description of Artificial Sequence: Synthetic polypeptide
DEEEIRTTNPVATEPYGISVSTQNLQDTVTNR

SEQ ID NO: 34758 - protein, 31 aa, Artificial Sequence
  Description of Artificial Sequence: Synthetic polypeptide
YEEEISTTNPVATEQYGSVYCTNPLIARGNR

SEQ ID NO: 34759 - protein, 31 aa, Artificial Sequence
  Description of Artificial Sequence: Synthetic polypeptide
YEEEISTTNPVATEQYGSVSYTNSLQWGPNT

SEQ ID NO: 34760 - protein, 29 aa, Artificial Sequence
  Description of Artificial Sequence: Synthetic peptide
YEEEIRTTNPVGTEQYGSVSNHCLERGNG

SEQ ID NO: 34761 - protein, 29 aa, Artificial Sequence
  Description of Artificial Sequence: Synthetic peptide
YEEEIRTTNPVGTEQYGSVSNNFERAGNG

SEQ ID NO: 34762 - protein, 28 aa, Artificial Sequence
  Description of Artificial Sequence: Synthetic peptide
YEEEIRTTNPVGTEQYGSVSNNPEIGNG

SEQ ID NO: 34763 - protein, 29 aa, Artificial Sequence
  Description of Artificial Sequence: Synthetic peptide
YEEEIRTTNPVGTEQYGSVSNNQERIGNC

SEQ ID NO: 34764 - protein, 29 aa, Artificial Sequence
  Description of Artificial Sequence: Synthetic peptide
YEEEIRTTNPVGTEQYGSVSNNSERGDNG

SEQ ID NO: 34765 - protein, 28 aa, Artificial Sequence
  Description of Artificial Sequence: Synthetic peptide
YEEEIRTTNPVGTEQYGSVSNNYEDGNC

SEQ ID NO: 34766 - protein, 30 aa, Artificial Sequence
  Description of Artificial Sequence: Synthetic polypeptide
YEEEIRTTNPVGTEQYGSVSTMKLQRDNIN

SEQ ID NO: 34767 - protein, 30 aa, Artificial Sequence
  Description of Artificial Sequence: Synthetic polypeptide
YEEEIRTTNPVGTEQYGSVSTMNGLQPDNI

SEQ ID NO: 34768 - protein, 29 aa, Artificial Sequence
  Description of Artificial Sequence: Synthetic peptide
YEEEIRTTNPVGTEQYGSVSNGNSERGNC

SEQ ID NO: 34769 - protein, 30 aa, Artificial Sequence
  Description of Artificial Sequence: Synthetic polypeptide
YEEEIRTTNPVGTEQYGSVSTMNLCRDNIS

SEQ ID NO: 34770 - protein, 31 aa, Artificial Sequence
  Description of Artificial Sequence: Synthetic polypeptide
YEEEIRTTNPVGTEQYGSVSTMNLQCRDHNI

SEQ ID NO: 34771 - protein, 30 aa, Artificial Sequence
  Description of Artificial Sequence: Synthetic polypeptide
YEEEIRTTNPVGTEQYGSVSTMNLQRDDKI

SEQ ID NO: 34772 - protein, 31 aa, Artificial Sequence
  Description of Artificial Sequence: Synthetic polypeptide
YEEEIRTTNPVGTEQYGSVSTMNLQRDVNIM

SEQ ID NO: 34773 - protein, 30 aa, Artificial Sequence
  Description of Artificial Sequence: Synthetic polypeptide
YEEEIRTTNPVGTEQYGSVSTMNLQRWDEI

SEQ ID NO: 34774 - protein, 30 aa, Artificial Sequence
  Description of Artificial Sequence: Synthetic polypeptide
YEEEIRTTNPVGTEQYGSVSTMNNCQRFNI

SEQ ID NO: 34775 - protein, 29 aa, Artificial Sequence
  Description of Artificial Sequence: Synthetic peptide
YEEEIRTTNPVGTEQYGSVSTMSSQRDNI

SEQ ID NO: 34776 - protein, 29 aa, Artificial Sequence
  Description of Artificial Sequence: Synthetic peptide
YEEEIRTTNPVGTEQYGSVSWNNMERGNT

SEQ ID NO: 34777 - protein, 31 aa, Artificial Sequence
  Description of Artificial Sequence: Synthetic polypeptide
YEEEIRTTNPVGTETYGPFVSTNLQRHGNRT

SEQ ID NO: 34778 - protein, 30 aa, Artificial Sequence
  Description of Artificial Sequence: Synthetic polypeptide
YEEEIRTTNPVGTEQYGSVSTMNLLRDYNI

SEQ ID NO: 34779 - protein, 30 aa, Artificial Sequence
  Description of Artificial Sequence: Synthetic polypeptide
YEEEIRTTNPVGTFQYNGSVSTMNLQRFNI

SEQ ID NO: 34780 - protein, 29 aa, Artificial Sequence
  Description of Artificial Sequence: Synthetic peptide
YEEEIRTTNPVGTEQYGSVSMNMERGANC

SEQ ID NO: 34781 - protein, 28 aa, Artificial Sequence
  Description of Artificial Sequence: Synthetic peptide
YEEEIRTTNPVGTEQYGSVSHTMERGNC

SEQ ID NO: 34782 - protein, 28 aa, Artificial Sequence
  Description of Artificial Sequence: Synthetic peptide
YEEEIRTTNPVCTEQYGVVSENLQSENA

SEQ ID NO: 34783 - protein, 28 aa, Artificial Sequence
  Description of Artificial Sequence: Synthetic peptide
YEEEIRTTNPVGTECYGSVSNNVERGNC

SEQ ID NO: 34784 - protein, 32 aa, Artificial Sequence
  Description of Artificial Sequence: Synthetic polypeptide
YEEEIRTTNPVGTEEYGSIVSTINDLQMRGNR

SEQ ID NO: 34785 - protein, 31 aa, Artificial Sequence
  Description of Artificial Sequence: Synthetic polypeptide
YEEEIRTTNPVGTEGYGSIVSTILLQMRGNR

SEQ ID NO: 34786 - protein, 30 aa, Artificial Sequence
  Description of Artificial Sequence: Synthetic polypeptide
YEEEIRTTNPVGTEQYGGSVSWDNQRGNRE

SEQ ID NO: 34787 - protein, 30 aa, Artificial Sequence
  Description of Artificial Sequence: Synthetic polypeptide
YEEEIRTTNPVGTEQYGPFVSTNGQRGNDT

SEQ ID NO: 34788 - protein, 28 aa, Artificial Sequence
  Description of Artificial Sequence: Synthetic peptide
YEEEIRTTNPVGTEQYGQVSANMERGNC

SEQ ID NO: 34789 - protein, 31 aa, Artificial Sequence
  Description of Artificial Sequence: Synthetic polypeptide
YEEEIRTTNPVGTEQYGSICSAINLQNRGNR

SEQ ID NO: 34790 - protein, 28 aa, Artificial Sequence
  Description of Artificial Sequence: Synthetic peptide
YEEEIRTTNPVGTEQYGSVSLNMEIGNC

SEQ ID NO: 34791 - protein, 32 aa, Artificial Sequence
  Description of Artificial Sequence: Synthetic polypeptide
YEEEIRTTNPVGTEQYGSICSTINLQPRGNNR

SEQ ID NO: 34792 - protein, 33 aa, Artificial Sequence
  Description of Artificial Sequence: Synthetic polypeptide
YEEEIRTTNPVGTEQYGSIVGSTINLQMRGNNR

SEQ ID NO: 34793 - protein, 32 aa, Artificial Sequence
  Description of Artificial Sequence: Synthetic polypeptide
YEEEIRTTNPVGTEQYGSIVPSTINLPMRGNR

SEQ ID NO: 34794 - protein, 32 aa, Artificial Sequence
  Description of Artificial Sequence: Synthetic polypeptide
YEEEIRTTNPVGTEQYGSIVSTINLQMPGNDR

SEQ ID NO: 34795 - protein, 29 aa, Artificial Sequence
  Description of Artificial Sequence: Synthetic peptide
YEEEIRTTNPVGTEQYGSVNSNNPERGNC

SEQ ID NO: 34796 - protein, 29 aa, Artificial Sequence
  Description of Artificial Sequence: Synthetic peptide
YEEEIRTTNPVGTEQYGSVPSVNMERGNC

SEQ ID NO: 34797 - protein, 30 aa, Artificial Sequence
  Description of Artificial Sequence: Synthetic polypeptide
YEEEIRTTNPVGTEQYGSVRSNNLERGHNG

SEQ ID NO: 34798 - protein, 30 aa, Artificial Sequence
  Description of Artificial Sequence: Synthetic polypeptide
YEEEIRTTNPVGTEQYGSVSCMNLQRDNIT

SEQ ID NO: 34799 - protein, 29 aa, Artificial Sequence
  Description of Artificial Sequence: Synthetic peptide
YEEEIRTTNPVGTEQYGSVSENNMARGNC

SEQ ID NO: 34800 - protein, 32 aa, Artificial Sequence
  Description of Artificial Sequence: Synthetic polypeptide
YEEEIRTTNPVGTEQYGSICSTINLSQMRGNR

SEQ ID NO: 34801 - protein, 29 aa, Artificial Sequence
  Description of Artificial Sequence: Synthetic peptide
YEEEIRTTNPVGTGQYGVVSTMNLQRDNI

SEQ ID NO: 34802 - protein, 30 aa, Artificial Sequence
  Description of Artificial Sequence: Synthetic polypeptide
YEEEIRTTNPVHTEHYGSVSTVNIQNRGNT

SEQ ID NO: 34803 - protein, 31 aa, Artificial Sequence
  Description of Artificial Sequence: Synthetic polypeptide
YEEEIRTTNPVITEQYGSASTYNLERGSNRA

SEQ ID NO: 34804 - protein, 30 aa, Artificial Sequence
  Description of Artificial Sequence: Synthetic polypeptide
DEEEIRTTNPVATEGYGCVCSTNTQSGSNQ

SEQ ID NO: 34805 - protein, 33 aa, Artificial Sequence
  Description of Artificial Sequence: Synthetic polypeptide
DEEEIRTTNPVATEPYGCSVSTNNLQDRIENGR

SEQ ID NO: 34806 - protein, 33 aa, Artificial Sequence
  Description of Artificial Sequence: Synthetic polypeptide
DEEEIRTTNPVATEPYGASVSTENLQPRIVNGR

SEQ ID NO: 34807 - protein, 30 aa, Artificial Sequence
  Description of Artificial Sequence: Synthetic polypeptide
DEEEIRTTNPVATEPWGSVCFTNLTRTGNS

SEQ ID NO: 34808 - protein, 31 aa, Artificial Sequence
  Description of Artificial Sequence: Synthetic polypeptide
DEEEIRTTNPVATEGYGCVSNTELQYFGSNR

SEQ ID NO: 34809 - protein, 32 aa, Artificial Sequence
  Description of Artificial Sequence: Synthetic polypeptide
DEEEIRTTNPVATEPWGISVSTVNLQDGAKNR

SEQ ID NO: 34810 - protein, 30 aa, Artificial Sequence
  Description of Artificial Sequence: Synthetic polypeptide
DEEEIRTTNPVATEGYGCVSTNHQGGSNFQ

SEQ ID NO: 34811 - protein, 32 aa, Artificial Sequence
  Description of Artificial Sequence: Synthetic polypeptide
DEEEIRTTNPVATEPWGISVSTLNLQDGIDNR

SEQ ID NO: 34812 - protein, 33 aa, Artificial Sequence
  Description of Artificial Sequence: Synthetic polypeptide
DEEEIRTTNPVATEGYGCVCSTNLQRFGSNFRS

SEQ ID NO: 34813 - protein, 30 aa, Artificial Sequence
  Description of Artificial Sequence: Synthetic polypeptide
DEEEIRTTNPVATEGYGCVSTNTQNFGSNQ

SEQ ID NO: 34814 - protein, 30 aa, Artificial Sequence
  Description of Artificial Sequence: Synthetic polypeptide
DEEEIRTTNPVATEGYGEVSTELQGFGSND

SEQ ID NO: 34815 - protein, 32 aa, Artificial Sequence
  Description of Artificial Sequence: Synthetic polypeptide
DEEEIRTTNPVATEMYGSVSTNLQSGGGNNEQ

SEQ ID NO: 34816 - protein, 33 aa, Artificial Sequence
  Description of Artificial Sequence: Synthetic polypeptide
DEEEIRTTNPVATEGYGISVSTVNLDQDRISNR

SEQ ID NO: 34817 - protein, 32 aa, Artificial Sequence
  Description of Artificial Sequence: Synthetic polypeptide
DEEEIRTTNPVATEGYGIVVSTVNLQGRISNR

SEQ ID NO: 34818 - protein, 31 aa, Artificial Sequence
  Description of Artificial Sequence: Synthetic polypeptide
DEEEIRTTNPVATELYGSVSVTNLTYGINGD

SEQ ID NO: 34819 - protein, 31 aa, Artificial Sequence
  Description of Artificial Sequence: Synthetic polypeptide
DEEEIRTTNPVATEIYGSVSTNLQTESGTAT

SEQ ID NO: 34820 - protein, 31 aa, Artificial Sequence
  Description of Artificial Sequence: Synthetic polypeptide
YEEEISTTNPVATEQYGSVQSTNIQRNGNPM

SEQ ID NO: 34821 - protein, 33 aa, Artificial Sequence
  Description of Artificial Sequence: Synthetic polypeptide
DEEEIRTTNPVATEIYGSVCSTNLQNFGSNFRS

SEQ ID NO: 34822 - protein, 31 aa, Artificial Sequence
  Description of Artificial Sequence: Synthetic polypeptide
DEEEIRTTNPVATEPWGIKVATNGLPQRGNR

SEQ ID NO: 34823 - protein, 31 aa, Artificial Sequence
  Description of Artificial Sequence: Synthetic polypeptide
DEEEIRTTNPVATEPYGCVCFTNLTRFGNRS

SEQ ID NO: 34824 - protein, 33 aa, Artificial Sequence
  Description of Artificial Sequence: Synthetic polypeptide
DEEEIRTTNPVATEPYGESVSTVNRLQDRIENR

SEQ ID NO: 34825 - protein, 32 aa, Artificial Sequence
  Description of Artificial Sequence: Synthetic polypeptide
DEEEIRTTNPVATEPYGHVSCITNLSNRGGNR

SEQ ID NO: 34826 - protein, 31 aa, Artificial Sequence
  Description of Artificial Sequence: Synthetic polypeptide
YEEEIRTTNPVIYEQYGSVSTYNLEARGSNR

SEQ ID NO: 34827 - protein, 30 aa, Artificial Sequence
  Description of Artificial Sequence: Synthetic polypeptide
YEEEIRTTNPVNTEQYGACITMNLQQRGNR

SEQ ID NO: 34828 - protein, 31 aa, Artificial Sequence
  Description of Artificial Sequence: Synthetic polypeptide
YEEEIRTTNPVNTEQYGACSTNLQQRGSNRD

SEQ ID NO: 34829 - protein, 29 aa, Artificial Sequence
  Description of Artificial Sequence: Synthetic peptide
YEEEIRTTNPVNTEQYGSVSNNNERGNGM

SEQ ID NO: 34830 - protein, 28 aa, Artificial Sequence
  Description of Artificial Sequence: Synthetic peptide
YEEEIRTTNPVSTEAYGSVSNNMERGNC

SEQ ID NO: 34831 - protein, 29 aa, Artificial Sequence
  Description of Artificial Sequence: Synthetic peptide
YEEEIRTTNPVSTEQYGSVHNNLERGNGG

SEQ ID NO: 34832 - protein, 30 aa, Artificial Sequence
  Description of Artificial Sequence: Synthetic polypeptide
YEEEIRTTNPVSTEQYGSVSANNLERGNGY

SEQ ID NO: 34833 - protein, 31 aa, Artificial Sequence
  Description of Artificial Sequence: Synthetic polypeptide
YEEEIRTTNPVSTEQYGSVSATNIQNRGFNT

SEQ ID NO: 34834 - protein, 29 aa, Artificial Sequence
  Description of Artificial Sequence: Synthetic peptide
YEEEIRTTNPVSTEQYGSVSNNLERHDNG

SEQ ID NO: 34835 - protein, 29 aa, Artificial Sequence
  Description of Artificial Sequence: Synthetic peptide
YEEEIRTTNPVSTEQYGSVSNNWERGNGI

SEQ ID NO: 34836 - protein, 33 aa, Artificial Sequence
  Description of Artificial Sequence: Synthetic polypeptide
DEEEIRTTNPVATEPYGISVSTNLSQSPGGNNR

SEQ ID NO: 34837 - protein, 28 aa, Artificial Sequence
  Description of Artificial Sequence: Synthetic peptide
YEEEIRTVNPVCTEQYGVVSDNLQAGNQ

SEQ ID NO: 34838 - protein, 33 aa, Artificial Sequence
  Description of Artificial Sequence: Synthetic polypeptide
DEEEIRTTNPVATEPYGISVSTLNLPQDRVTNR

SEQ ID NO: 34839 - protein, 33 aa, Artificial Sequence
  Description of Artificial Sequence: Synthetic polypeptide
DEEEIRTTNPVATEPYGISVSTDNLQDRITNGR

SEQ ID NO: 34840 - protein, 33 aa, Artificial Sequence
  Description of Artificial Sequence: Synthetic polypeptide
DEEEIRTTNPVATEPYGISVSCTTNLQDRVTNR

SEQ ID NO: 34841 - protein, 31 aa, Artificial Sequence
  Description of Artificial Sequence: Synthetic polypeptide
YEEEISTTNPEATEQYGSVYCTNPLNQRGNR

SEQ ID NO: 34842 - protein, 32 aa, Artificial Sequence
  Description of Artificial Sequence: Synthetic polypeptide
DEEEIRTTNPVATEPYGISVACQNLSQRGGNR

SEQ ID NO: 34843 - protein, 33 aa, Artificial Sequence
  Description of Artificial Sequence: Synthetic polypeptide
DEEEIRTTNPVATEPYGISTVSTGNLQDRVDNR

SEQ ID NO: 34844 - protein, 32 aa, Artificial Sequence
  Description of Artificial Sequence: Synthetic polypeptide
DEEEIRTTNPVATEPYGICVSTVNLQDRIENR

SEQ ID NO: 34845 - protein, 32 aa, Artificial Sequence
  Description of Artificial Sequence: Synthetic polypeptide
DEEEIRTTNPVATEHYGYSISTTNELQRGEGR

SEQ ID NO: 34846 - protein, 29 aa, Artificial Sequence
  Description of Artificial Sequence: Synthetic peptide
SEVEIATTNPVATEQYGSVATNLQQGNPE

SEQ ID NO: 34847 - protein, 33 aa, Artificial Sequence
  Description of Artificial Sequence: Synthetic polypeptide
WEEEIRTTNPVATEQYGSVSLTSNLSQRGEEYR

SEQ ID NO: 34848 - protein, 28 aa, Artificial Sequence
  Description of Artificial Sequence: Synthetic peptide
AEEAIATTNPVATEQYGCVSSNPQRGNQ

SEQ ID NO: 34849 - protein, 29 aa, Artificial Sequence
  Description of Artificial Sequence: Synthetic peptide
TEENIRTTNPVATEQYGSVSTNDSGHNRS

SEQ ID NO: 34850 - protein, 29 aa, Artificial Sequence
  Description of Artificial Sequence: Synthetic peptide
TEENIRTTNPVATEQYGSVSTNDSGMNDR

SEQ ID NO: 34851 - protein, 33 aa, Artificial Sequence
  Description of Artificial Sequence: Synthetic polypeptide
DEEEIRTTNPVATEQWGSVSCTGNLSQRGTSQR

SEQ ID NO: 34852 - protein, 34 aa, Artificial Sequence
  Description of Artificial Sequence: Synthetic polypeptide
DEEEIRTTNPVATEQWGSVSCTGNLSQREGTNNR

SEQ ID NO: 34853 - protein, 31 aa, Artificial Sequence
  Description of Artificial Sequence: Synthetic polypeptide
DEEEIRTTNPVATECYGAVMSDTNEQRTGNF

SEQ ID NO: 34854 - protein, 30 aa, Artificial Sequence
  Description of Artificial Sequence: Synthetic polypeptide
DEEEIRTTNPVATECYGAVMSTNIEQRTNF

SEQ ID NO: 34855 - protein, 29 aa, Artificial Sequence
  Description of Artificial Sequence: Synthetic peptide
AEEEIATTNPVATEQYGCVATNLQDGNHE

SEQ ID NO: 34856 - protein, 28 aa, Artificial Sequence
  Description of Artificial Sequence: Synthetic peptide
TEEVIATTNPVATEQYGSVATNLNMANR

SEQ ID NO: 34857 - protein, 29 aa, Artificial Sequence
  Description of Artificial Sequence: Synthetic peptide
TEENIRTTNPVATEQYGSVSTLNDSMDNR

SEQ ID NO: 34858 - protein, 28 aa, Artificial Sequence
  Description of Artificial Sequence: Synthetic peptide
TEEVIATTNPVATEQYGSVSTNLTMMNN

SEQ ID NO: 34859 - protein, 29 aa, Artificial Sequence
  Description of Artificial Sequence: Synthetic peptide
TEEVICTTNPVATEQYGSVSMNSQRTGNS

SEQ ID NO: 34860 - protein, 29 aa, Artificial Sequence
  Description of Artificial Sequence: Synthetic peptide
DEEEIRTTNPVATECYGCHSATNEQRDNY

SEQ ID NO: 34861 - protein, 29 aa, Artificial Sequence
  Description of Artificial Sequence: Synthetic peptide
DEEEIRTTNPVATECYGCSSTNEQRENDF

SEQ ID NO: 34862 - protein, 30 aa, Artificial Sequence
  Description of Artificial Sequence: Synthetic polypeptide
DEEEIRTTNPVATECYGCVHSTNEDQRRNF

SEQ ID NO: 34863 - protein, 29 aa, Artificial Sequence
  Description of Artificial Sequence: Synthetic peptide
TEGVIRTTNPVATEQYGSISTNLSIIGNR

SEQ ID NO: 34864 - protein, 32 aa, Artificial Sequence
  Description of Artificial Sequence: Synthetic polypeptide
TEHEIRTTNPVATEQWGSVSCTNMLSQRGGNR

SEQ ID NO: 34865 - protein, 30 aa, Artificial Sequence
  Description of Artificial Sequence: Synthetic polypeptide
AEEEIATTNPVATEQWGSVSVNLQGGNDRQ

SEQ ID NO: 34866 - protein, 29 aa, Artificial Sequence
  Description of Artificial Sequence: Synthetic peptide
DEEEIRTTNPVATECYGEHSTNEQRINFT

SEQ ID NO: 34867 - protein, 32 aa, Artificial Sequence
  Description of Artificial Sequence: Synthetic polypeptide
DEEEIRTTNPVATEQWGSVSCNEPQDREGENR

SEQ ID NO: 34868 - protein, 32 aa, Artificial Sequence
  Description of Artificial Sequence: Synthetic polypeptide
TEHEIRTTNPVAYEQYGSVVSYTNLSQRGTNR

SEQ ID NO: 34869 - protein, 29 aa, Artificial Sequence
  Description of Artificial Sequence: Synthetic peptide
TEEGIRTTNPVAYEQYGSVSTNLSVMLNR

SEQ ID NO: 34870 - protein, 32 aa, Artificial Sequence
  Description of Artificial Sequence: Synthetic polypeptide
DEEEIRTTNPVATEQWGSVSCTNLSQRPGGTE

SEQ ID NO: 34871 - protein, 30 aa, Artificial Sequence
  Description of Artificial Sequence: Synthetic polypeptide
TEEGIRTTNPVATEQYGSVSTMNLSMLNRL

SEQ ID NO: 34872 - protein, 29 aa, Artificial Sequence
  Description of Artificial Sequence: Synthetic peptide
TEEGIRTTNPVATEQYGSVSTNDESMLNR

SEQ ID NO: 34873 - protein, 29 aa, Artificial Sequence
  Description of Artificial Sequence: Synthetic peptide
TEEGIRTTNPVATEQYGSVSTNDSGDQNR

SEQ ID NO: 34874 - protein, 31 aa, Artificial Sequence
  Description of Artificial Sequence: Synthetic polypeptide
TEEGIRTTNPVATEQYGSVSTNELSTMVGNR

SEQ ID NO: 34875 - protein, 29 aa, Artificial Sequence
  Description of Artificial Sequence: Synthetic peptide
TEEGIRTTNPVATEQYGSVSTNLEMLPIR

SEQ ID NO: 34876 - protein, 29 aa, Artificial Sequence
  Description of Artificial Sequence: Synthetic peptide
TEEGIRTTNPVATEQYGSVSTNLESELDR

SEQ ID NO: 34877 - protein, 33 aa, Artificial Sequence
  Description of Artificial Sequence: Synthetic polypeptide
DEEEIRTTNPVATEQWGSVSCTNNMDSQRGGNR

SEQ ID NO: 34878 - protein, 28 aa, Artificial Sequence
  Description of Artificial Sequence: Synthetic peptide
AEEEIATTNPVATEQYGEASENLQREER

SEQ ID NO: 34879 - protein, 29 aa, Artificial Sequence
  Description of Artificial Sequence: Synthetic peptide
TEEGIRTTNPVAYEQYGSVSTNLPSMVNR

SEQ ID NO: 34880 - protein, 28 aa, Artificial Sequence
  Description of Artificial Sequence: Synthetic peptide
AEEEIATTNPVATEQYGEASENLQHGGR

SEQ ID NO: 34881 - protein, 28 aa, Artificial Sequence
  Description of Artificial Sequence: Synthetic peptide
AEEEIATTNPVATEQYGEASENCQRGER

SEQ ID NO: 34882 - protein, 32 aa, Artificial Sequence
  Description of Artificial Sequence: Synthetic polypeptide
DEEEIRTTNPVATEQWGSVSCTNNHSQHGGNR

SEQ ID NO: 34883 - protein, 33 aa, Artificial Sequence
  Description of Artificial Sequence: Synthetic polypeptide
DEEEIRTTNPVATEQWGSVSCTNNESQRGGNNR

SEQ ID NO: 34884 - protein, 30 aa, Artificial Sequence
  Description of Artificial Sequence: Synthetic polypeptide
TEEGIRTTNPVATEQYGSVSTNLSEMSLNR

SEQ ID NO: 34885 - protein, 28 aa, Artificial Sequence
  Description of Artificial Sequence: Synthetic peptide
DEEEIRTTNPVATECYGAASTNEQGTNF

SEQ ID NO: 34886 - protein, 30 aa, Artificial Sequence
  Description of Artificial Sequence: Synthetic polypeptide
TEEGIRTTNPVATEQYGSVSTNLSSMVGNT

SEQ ID NO: 34887 - protein, 29 aa, Artificial Sequence
  Description of Artificial Sequence: Synthetic peptide
DEEEIRTTNPVATECYGAISTNEQREVNF

SEQ ID NO: 34888 - protein, 30 aa, Artificial Sequence
  Description of Artificial Sequence: Synthetic polypeptide
TEEGIRTTNPVATEQYGSVSTNQSMQLMNR

SEQ ID NO: 34889 - protein, 28 aa, Artificial Sequence
  Description of Artificial Sequence: Synthetic peptide
DEEEIRTTNPVATECWGTHSTNEQRDNT

SEQ ID NO: 34890 - protein, 29 aa, Artificial Sequence
  Description of Artificial Sequence: Synthetic peptide
AEEEIATTNPVATEQWGSVSTNLQAGPDM

SEQ ID NO: 34891 - protein, 29 aa, Artificial Sequence
  Description of Artificial Sequence: Synthetic peptide
DEEEIRTTNPVATECYGEHSTNEQRNVND

SEQ ID NO: 34892 - protein, 32 aa, Artificial Sequence
  Description of Artificial Sequence: Synthetic polypeptide
DEEEIRTTNPVATECYGESVSTVNLQDPIKNR

SEQ ID NO: 34893 - protein, 28 aa, Artificial Sequence
  Description of Artificial Sequence: Synthetic peptide
TESEIRTTNPVAYEQYGKVWTNLQIGSR

SEQ ID NO: 34894 - protein, 33 aa, Artificial Sequence
  Description of Artificial Sequence: Synthetic polypeptide
DEEEIRTTNPVATEQWGSVNCTGNLSQRGGNRT

SEQ ID NO: 34895 - protein, 29 aa, Artificial Sequence
  Description of Artificial Sequence: Synthetic peptide
DEEEIRTTNPVATECYGKISTNEFQRVNF

SEQ ID NO: 34896 - protein, 30 aa, Artificial Sequence
  Description of Artificial Sequence: Synthetic polypeptide
TESEIRTTNPVAYERYGSVSTNLQRGGNNA

SEQ ID NO: 34897 - protein, 28 aa, Artificial Sequence
  Description of Artificial Sequence: Synthetic peptide
TESSIRTTNPLATEQWGSVSFNLQSGNR

SEQ ID NO: 34898 - protein, 32 aa, Artificial Sequence
  Description of Artificial Sequence: Synthetic polypeptide
TETEIRTTNPVATEAYGSVSCTNLSQRNSGNR

SEQ ID NO: 34899 - protein, 28 aa, Artificial Sequence
  Description of Artificial Sequence: Synthetic peptide
TEVEIATTNPVAYDQYGTVSTALQRGNR

SEQ ID NO: 34900 - protein, 29 aa, Artificial Sequence
  Description of Artificial Sequence: Synthetic peptide
DEEEIRTTNPVATECYGKSSTNEQRVNFD

SEQ ID NO: 34901 - protein, 34 aa, Artificial Sequence
  Description of Artificial Sequence: Synthetic polypeptide
DEEEIRTTNPVATEQWGSVPSCTNNLSQRTGTNR

SEQ ID NO: 34902 - protein, 29 aa, Artificial Sequence
  Description of Artificial Sequence: Synthetic peptide
DEEEIRTTNPVATECYGKTSTNESQRVNE

SEQ ID NO: 34903 - protein, 29 aa, Artificial Sequence
  Description of Artificial Sequence: Synthetic peptide
DEEEIRTTNPVATEQWGSVDTNDMVGNDF

SEQ ID NO: 34904 - protein, 28 aa, Artificial Sequence
  Description of Artificial Sequence: Synthetic peptide
TNAEIRTTNPVATEQYGTTSTVLQHGNR

SEQ ID NO: 34905 - protein, 30 aa, Artificial Sequence
  Description of Artificial Sequence: Synthetic polypeptide
DEEEIRTTNPVATECYGKVCSTNHSQRVNF

SEQ ID NO: 34906 - protein, 30 aa, Artificial Sequence
  Description of Artificial Sequence: Synthetic polypeptide
TNEEIRTTNPVATECWGSVSTNLQTGGENR

SEQ ID NO: 34907 - protein, 30 aa, Artificial Sequence
  Description of Artificial Sequence: Synthetic polypeptide
DEEEIRTTNPVATEQWGSVATPDQRGNQMD

SEQ ID NO: 34908 - protein, 28 aa, Artificial Sequence
  Description of Artificial Sequence: Synthetic peptide
DEEEIRTTNPVATECYGMSSTNEQGQNF

SEQ ID NO: 34909 - protein, 32 aa, Artificial Sequence
  Description of Artificial Sequence: Synthetic polypeptide
TNEEIRTTNPVATEQYGSVSTNLNQGEGGENR

SEQ ID NO: 34910 - protein, 32 aa, Artificial Sequence
  Description of Artificial Sequence: Synthetic polypeptide
TNEEIRTTNPVATEQYGSVSTNLQGEGGDNQR

SEQ ID NO: 34911 - protein, 28 aa, Artificial Sequence
  Description of Artificial Sequence: Synthetic peptide
TEYEIRCTNPVATEQYGSVETNTQHGNQ

SEQ ID NO: 34912 - protein, 30 aa, Artificial Sequence
  Description of Artificial Sequence: Synthetic polypeptide
DEEEIRTTNPVATECYGKHSTNEQRGVENF

SEQ ID NO: 34913 - protein, 31 aa, Artificial Sequence
  Description of Artificial Sequence: Synthetic polypeptide
TESEIRTTNPVATEQYGSVSQNLSFRVGNNR

SEQ ID NO: 34914 - protein, 29 aa, Artificial Sequence
  Description of Artificial Sequence: Synthetic peptide
TESEIRTTNPVATEQYGSVATALQNGGPR

SEQ ID NO: 34915 - protein, 30 aa, Artificial Sequence
  Description of Artificial Sequence: Synthetic polypeptide
AEEEIATTNPVATEQWGSVATNLQDRGNES

SEQ ID NO: 34916 - protein, 31 aa, Artificial Sequence
  Description of Artificial Sequence: Synthetic polypeptide
DEEEIRTTNPVATEQWGSVPSTNQSGHGGNR

SEQ ID NO: 34917 - protein, 29 aa, Artificial Sequence
  Description of Artificial Sequence: Synthetic peptide
DEEEIRTTNPVATECYGETSTNEQRTGDQ

SEQ ID NO: 34918 - protein, 29 aa, Artificial Sequence
  Description of Artificial Sequence: Synthetic peptide
AEEEIATTNPVATEPYGSVATNLQQGNDV

SEQ ID NO: 34919 - protein, 30 aa, Artificial Sequence
  Description of Artificial Sequence: Synthetic polypeptide
AEEEIATTNPVATEMYGSVATNLQQGNSRE

SEQ ID NO: 34920 - protein, 28 aa, Artificial Sequence
  Description of Artificial Sequence: Synthetic peptide
AEEEIATTNPVATEHFGVVSTNLQNGNL

SEQ ID NO: 34921 - protein, 32 aa, Artificial Sequence
  Description of Artificial Sequence: Synthetic polypeptide
DEEEIRTTNPVATECYGGVVSTVNLQDRNVNR

SEQ ID NO: 34922 - protein, 29 aa, Artificial Sequence
  Description of Artificial Sequence: Synthetic peptide
DEEEIRTTNPVATECYGKACSTNEQRNNF

SEQ ID NO: 34923 - protein, 29 aa, Artificial Sequence
  Description of Artificial Sequence: Synthetic peptide
TEREIRTTNPVAYEQYGSVWTNLQIPGSR

SEQ ID NO: 34924 - protein, 29 aa, Artificial Sequence
  Description of Artificial Sequence: Synthetic peptide
TESEIATTNPVATEQYGSVSTNLSMTGNT

SEQ ID NO: 34925 - protein, 32 aa, Artificial Sequence
  Description of Artificial Sequence: Synthetic polypeptide
TESEICTTNPVATEQYGSVVSTNLSQRGGNNR

SEQ ID NO: 34926 - protein, 28 aa, Artificial Sequence
  Description of Artificial Sequence: Synthetic peptide
DEEEIRTTNPVATECYGKCSTNEQTVNF

SEQ ID NO: 34927 - protein, 29 aa, Artificial Sequence
  Description of Artificial Sequence: Synthetic peptide
DEEEIRTTNPVATECYGKHSTMNEQRENF

SEQ ID NO: 34928 - protein, 28 aa, Artificial Sequence
  Description of Artificial Sequence: Synthetic peptide
DEEEIRTTNPVATECYGKHSTNEERDNF

SEQ ID NO: 34929 - protein, 32 aa, Artificial Sequence
  Description of Artificial Sequence: Synthetic polypeptide
DEEEIRTTNPVATEQWGSVPSTNAISQSSGNR

SEQ ID NO: 34930 - protein, 28 aa, Artificial Sequence
  Description of Artificial Sequence: Synthetic peptide
DEEEIRTTNPVATECYGKHSTNEQGNLF

SEQ ID NO: 34931 - protein, 29 aa, Artificial Sequence
  Description of Artificial Sequence: Synthetic peptide
AEEEIATTNPVATEAYGCISINLQRGDNR

SEQ ID NO: 34932 - protein, 28 aa, Artificial Sequence
  Description of Artificial Sequence: Synthetic peptide
DEEEIRTTNPVATECYGKHSTNEQNSNF

SEQ ID NO: 34933 - protein, 31 aa, Artificial Sequence
  Description of Artificial Sequence: Synthetic polypeptide
TESEIRTTNPVATEQYGSTVSTNLQSVGNNY

SEQ ID NO: 34934 - protein, 33 aa, Artificial Sequence
  Description of Artificial Sequence: Synthetic polypeptide
DEEEIRTTNPVATECWGSVVSCTNLSQRGGNRQ

SEQ ID NO: 34935 - protein, 31 aa, Artificial Sequence
  Description of Artificial Sequence: Synthetic polypeptide
TNEEIRTTNPVATEQYGSVSTNLQGTGGEND

SEQ ID NO: 34936 - protein, 30 aa, Artificial Sequence
  Description of Artificial Sequence: Synthetic polypeptide
TEEGIRTTNPVATEQYGSVSTLNLFELNDR

SEQ ID NO: 34937 - protein, 30 aa, Artificial Sequence
  Description of Artificial Sequence: Synthetic polypeptide
AEEEIATTNPVATEQYGNVSVTMLQDGMNR

SEQ ID NO: 34938 - protein, 28 aa, Artificial Sequence
  Description of Artificial Sequence: Synthetic peptide
TEEEIRTTNPVGTEQYGNVSENLMRGDA

SEQ ID NO: 34939 - protein, 30 aa, Artificial Sequence
  Description of Artificial Sequence: Synthetic polypeptide
TEEEIRTTNPVGTEQYGSVSTNSLGRGGDP

SEQ ID NO: 34940 - protein, 30 aa, Artificial Sequence
  Description of Artificial Sequence: Synthetic polypeptide
TEEEIRTTNPVGTEQYGSVVSTNELGRGEP

SEQ ID NO: 34941 - protein, 31 aa, Artificial Sequence
  Description of Artificial Sequence: Synthetic polypeptide
TEEEIRTTNPVNTEQYGACSTENALQQRGNR

SEQ ID NO: 34942 - protein, 30 aa, Artificial Sequence
  Description of Artificial Sequence: Synthetic polypeptide
TEEEIRTTNPVSTEQYGACSTNLQQRTFNR

SEQ ID NO: 34943 - protein, 30 aa, Artificial Sequence
  Description of Artificial Sequence: Synthetic polypeptide
TEEEISTTNPVATEQYGNVSCTMLQGGNNR

SEQ ID NO: 34944 - protein, 31 aa, Artificial Sequence
  Description of Artificial Sequence: Synthetic polypeptide
TEEEISTTNPVATEQYGSVSTNSLSQVRGEF

SEQ ID NO: 34945 - protein, 30 aa, Artificial Sequence
  Description of Artificial Sequence: Synthetic polypeptide
AEEEIATTNPVATEQYGSVSTPNLQDGPQD

SEQ ID NO: 34946 - protein, 29 aa, Artificial Sequence
  Description of Artificial Sequence: Synthetic peptide
TEEEIRTTNPVCTEQYGACSTNLQQRTNF

SEQ ID NO: 34947 - protein, 31 aa, Artificial Sequence
  Description of Artificial Sequence: Synthetic polypeptide
AEEEIATTNPVATEQYGSVSTNQLQETMGNL

SEQ ID NO: 34948 - protein, 30 aa, Artificial Sequence
  Description of Artificial Sequence: Synthetic polypeptide
AEEEIATTNPVATEQYGSVSTNLQQDGPDE

SEQ ID NO: 34949 - protein, 31 aa, Artificial Sequence
  Description of Artificial Sequence: Synthetic polypeptide
AEEEIATTNPVATEQYGSVSTNLQGNDNGNN

SEQ ID NO: 34950 - protein, 33 aa, Artificial Sequence
  Description of Artificial Sequence: Synthetic polypeptide
TEEEISTTNPVATEQYGSVVSCTNLSQNRGNNR

SEQ ID NO: 34951 - protein, 30 aa, Artificial Sequence
  Description of Artificial Sequence: Synthetic polypeptide
AEEEIATTNPVATEQYGSVSTNLQAGPDDE

SEQ ID NO: 34952 - protein, 31 aa, Artificial Sequence
  Description of Artificial Sequence: Synthetic polypeptide
AEEEIATTNPVATEQYGSVSTNLQAGENMNN

SEQ ID NO: 34953 - protein, 30 aa, Artificial Sequence
  Description of Artificial Sequence: Synthetic polypeptide
AEEEIATTNPVATEQYGSVSTGLQGDGMNP

SEQ ID NO: 34954 - protein, 28 aa, Artificial Sequence
  Description of Artificial Sequence: Synthetic peptide
DEEEIRTTNPVATECWGKHSTNEQREND

SEQ ID NO: 34955 - protein, 30 aa, Artificial Sequence
  Description of Artificial Sequence: Synthetic polypeptide
TEEEISTTNPVAYEQYGSVAYTNLSQRVNR

SEQ ID NO: 34956 - protein, 30 aa, Artificial Sequence
  Description of Artificial Sequence: Synthetic polypeptide
AEEEIATTNPVATEQYGSVSTNPQNNNGNQ

SEQ ID NO: 34957 - protein, 29 aa, Artificial Sequence
  Description of Artificial Sequence: Synthetic peptide
AEEEIATTNPVATEQYGSVSANLQDGPDM

SEQ ID NO: 34958 - protein, 30 aa, Artificial Sequence
  Description of Artificial Sequence: Synthetic polypeptide
TEEEIRTTNPVCTEHYGSVSMPNLSQRGNL

SEQ ID NO: 34959 - protein, 32 aa, Artificial Sequence
  Description of Artificial Sequence: Synthetic polypeptide
TEEEIRTTNPVAYESYGSVPSTNLSQRGNNRL

SEQ ID NO: 34960 - protein, 30 aa, Artificial Sequence
  Description of Artificial Sequence: Synthetic polypeptide
TEEEIRTTNPVAYEQYGSVSTNDSQIGGNS

SEQ ID NO: 34961 - protein, 31 aa, Artificial Sequence
  Description of Artificial Sequence: Synthetic polypeptide
TEEEIRTTNPVAYEQYGSVSTNLSQLVGNTQ

SEQ ID NO: 34962 - protein, 31 aa, Artificial Sequence
  Description of Artificial Sequence: Synthetic polypeptide
TEEEIRTTNPVAYEQYGSVSTNLSQSNGNQE

SEQ ID NO: 34963 - protein, 31 aa, Artificial Sequence
  Description of Artificial Sequence: Synthetic polypeptide
TEEEIRTTNPVAYEQYGSVSTNMLSQNNGNQ

SEQ ID NO: 34964 - protein, 33 aa, Artificial Sequence
  Description of Artificial Sequence: Synthetic polypeptide
TEEEIRTTNPVAYEQYGSVSYTNLSQNRVGNRQ

SEQ ID NO: 34965 - protein, 29 aa, Artificial Sequence
  Description of Artificial Sequence: Synthetic peptide
TEEEIRTTNPVAYEQYGSVVATGLQNGPR

SEQ ID NO: 34966 - protein, 33 aa, Artificial Sequence
  Description of Artificial Sequence: Synthetic polypeptide
TEEEIRTTNPVAYEQYGSVVSCTNELQRGGNRV

SEQ ID NO: 34967 - protein, 32 aa, Artificial Sequence
  Description of Artificial Sequence: Synthetic polypeptide
TEEEIRTTNPVAYEQYGSVVSCTTLQRTGGNR

SEQ ID NO: 34968 - protein, 32 aa, Artificial Sequence
  Description of Artificial Sequence: Synthetic polypeptide
TEEEIRTTNPVAYESYGSVVSTNLSQRGNNRV

SEQ ID NO: 34969 - protein, 33 aa, Artificial Sequence
  Description of Artificial Sequence: Synthetic polypeptide
TEEEIRTTNPVAYEQYGSVVSTNALSQQRPGNR

SEQ ID NO: 34970 - protein, 30 aa, Artificial Sequence
  Description of Artificial Sequence: Synthetic polypeptide
AEEEIATTNPVATESYGSVSTNLQDGPNED

SEQ ID NO: 34971 - protein, 29 aa, Artificial Sequence
  Description of Artificial Sequence: Synthetic peptide
AEEEIATTNPVATESYGSVATNLQRENIS

SEQ ID NO: 34972 - protein, 28 aa, Artificial Sequence
  Description of Artificial Sequence: Synthetic peptide
AEEEIATTNPVATESYGCISANLQRGNQ

SEQ ID NO: 34973 - protein, 30 aa, Artificial Sequence
  Description of Artificial Sequence: Synthetic polypeptide
TEEEIRTTNPVAYEQYGTVACTNLTRPGNR

SEQ ID NO: 34974 - protein, 28 aa, Artificial Sequence
  Description of Artificial Sequence: Synthetic peptide
DEEEIRTTNPVATECWGCGSTNEQRRNF

SEQ ID NO: 34975 - protein, 30 aa, Artificial Sequence
  Description of Artificial Sequence: Synthetic polypeptide
TEEEIRTTNPVAYEQYGTVSTNGSQRGGNG

SEQ ID NO: 34976 - protein, 31 aa, Artificial Sequence
  Description of Artificial Sequence: Synthetic polypeptide
TEEEIRTTNPVAYEQYGVVSYTNLQRTGGNP

SEQ ID NO: 34977 - protein, 31 aa, Artificial Sequence
  Description of Artificial Sequence: Synthetic polypeptide
TEEEIRTTNPVAYERYGSTVSTNLQAVGNER

SEQ ID NO: 34978 - protein, 30 aa, Artificial Sequence
  Description of Artificial Sequence: Synthetic polypeptide
AEEEIATTNPVATEVYGSVSTNLQDGNDIS

SEQ ID NO: 34979 - protein, 30 aa, Artificial Sequence
  Description of Artificial Sequence: Synthetic polypeptide
AEEEIATTNPVATEQYGSVPATNLQQGNPE

SEQ ID NO: 34980 - protein, 31 aa, Artificial Sequence
  Description of Artificial Sequence: Synthetic polypeptide
AEEEIATTNPVATEQYGSVLSTNLQVSGNVD

SEQ ID NO: 34981 - protein, 28 aa, Artificial Sequence
  Description of Artificial Sequence: Synthetic peptide
DEEEIRTTNPVATECWGKMSTNEQRANF

SEQ ID NO: 34982 - protein, 29 aa, Artificial Sequence
  Description of Artificial Sequence: Synthetic peptide
AEEEIATTNPVATEQYGSVATNLQDGEDH

SEQ ID NO: 34983 - protein, 29 aa, Artificial Sequence
  Description of Artificial Sequence: Synthetic peptide
AEEEIATTNPVATEQYGSVATNLQDGDGD

SEQ ID NO: 34984 - protein, 32 aa, Artificial Sequence
  Description of Artificial Sequence: Synthetic polypeptide
DEEEIRTTNPVATEQWGSVSFTNGSQRGGNQT

SEQ ID NO: 34985 - protein, 29 aa, Artificial Sequence
  Description of Artificial Sequence: Synthetic peptide
TEEGIATTNPVATEQYGSVSTNDSGNGNR

SEQ ID NO: 34986 - protein, 28 aa, Artificial Sequence
  Description of Artificial Sequence: Synthetic peptide
AEEEIATTNPVATEQYGSVATNLADGPD

SEQ ID NO: 34987 - protein, 30 aa, Artificial Sequence
  Description of Artificial Sequence: Synthetic polypeptide
TEEGIATTNPVATEQYGSVSTNLNMGENER

SEQ ID NO: 34988 - protein, 31 aa, Artificial Sequence
  Description of Artificial Sequence: Synthetic polypeptide
DEEEIRTTNPVATEQWGSVSENLQPGENPMS

SEQ ID NO: 34989 - protein, 30 aa, Artificial Sequence
  Description of Artificial Sequence: Synthetic polypeptide
AEEEIATTNPVATEQYGSVANNLQDQGGNR

SEQ ID NO: 34990 - protein, 33 aa, Artificial Sequence
  Description of Artificial Sequence: Synthetic polypeptide
DEEEIRTTNPVATEQWGSVSNTNLSQRTEGNNE

SEQ ID NO: 34991 - protein, 29 aa, Artificial Sequence
  Description of Artificial Sequence: Synthetic peptide
AEEEIATTNPVATEQYGSVAMNLQQGNPE

SEQ ID NO: 34992 - protein, 31 aa, Artificial Sequence
  Description of Artificial Sequence: Synthetic polypeptide
AEEEIATTNPVATEQYGSVAITNLQQGNSRV

SEQ ID NO: 34993 - protein, 31 aa, Artificial Sequence
  Description of Artificial Sequence: Synthetic polypeptide
TEEGIRTTNPVATEAYGSVSTNELSSQVGNR

SEQ ID NO: 34994 - protein, 28 aa, Artificial Sequence
  Description of Artificial Sequence: Synthetic peptide
TEEGIRTTNPVATEQYGCVSTNLEFEVR

SEQ ID NO: 34995 - protein, 29 aa, Artificial Sequence
  Description of Artificial Sequence: Synthetic peptide
TEEGIRTTNPVATEQYGCVSTNLEGMENR

SEQ ID NO: 34996 - protein, 29 aa, Artificial Sequence
  Description of Artificial Sequence: Synthetic peptide
TEEGIRTTNPVATEQYGCVSTNLEMEGNT

SEQ ID NO: 34997 - protein, 29 aa, Artificial Sequence
  Description of Artificial Sequence: Synthetic peptide
DEEEIRTTNPVATEQWGSVSENLMNAGDA

SEQ ID NO: 34998 - protein, 31 aa, Artificial Sequence
  Description of Artificial Sequence: Synthetic polypeptide
DEEEIRTTNPVATECWGSVSEINEQDRGENR

SEQ ID NO: 34999 - protein, 29 aa, Artificial Sequence
  Description of Artificial Sequence: Synthetic peptide
DEEEIRTTNPVATEQWGSVSENLMNAENA

SEQ ID NO: 35000 - protein, 29 aa, Artificial Sequence
  Description of Artificial Sequence: Synthetic peptide
TEEGICTTNPVATEQYGSVSANESQRGNS

SEQ ID NO: 35001 - protein, 31 aa, Artificial Sequence
  Description of Artificial Sequence: Synthetic polypeptide
AEEEIATTNPVATEQYGSVATNLQERGGNNS

SEQ ID NO: 35002 - protein, 30 aa, Artificial Sequence
  Description of Artificial Sequence: Synthetic polypeptide
AEEEIATTNPVATEQYGSVATNLQGAGEND

SEQ ID NO: 35003 - protein, 29 aa, Artificial Sequence
  Description of Artificial Sequence: Synthetic peptide
AEEEIATTNPVATEQYGSVATNLQGGEPD

SEQ ID NO: 35004 - protein, 32 aa, Artificial Sequence
  Description of Artificial Sequence: Synthetic polypeptide
TEEEVRTTNPVATEQWGSVSCTGNLDQRTGNR

SEQ ID NO: 35005 - protein, 31 aa, Artificial Sequence
  Description of Artificial Sequence: Synthetic polypeptide
TEEEVRTTNPVATEQYGCVSTGNHDQRIGNR

SEQ ID NO: 35006 - protein, 33 aa, Artificial Sequence
  Description of Artificial Sequence: Synthetic polypeptide
TEEEVRTTNPVATEQYGSTVSTGNELSQRTGNR

SEQ ID NO: 35007 - protein, 32 aa, Artificial Sequence
  Description of Artificial Sequence: Synthetic polypeptide
TEEEVRTTNPVATEQYGSTVSTGNLDQRTVNR

SEQ ID NO: 35008 - protein, 30 aa, Artificial Sequence
  Description of Artificial Sequence: Synthetic polypeptide
AEEEIATTNPVATEQYGSVATNLQTEGPND

SEQ ID NO: 35009 - protein, 32 aa, Artificial Sequence
  Description of Artificial Sequence: Synthetic polypeptide
AEEEIATTNPVATEQYGSVATNLQRNGDNTRP

SEQ ID NO: 35010 - protein, 31 aa, Artificial Sequence
  Description of Artificial Sequence: Synthetic polypeptide
AEEEIATTNPVATEQYGSVATNLQRNGDNSM

SEQ ID NO: 35011 - protein, 30 aa, Artificial Sequence
  Description of Artificial Sequence: Synthetic polypeptide
AEEEIATTNPVATEQYGSVATNLQQGPNDD

SEQ ID NO: 35012 - protein, 30 aa, Artificial Sequence
  Description of Artificial Sequence: Synthetic polypeptide
AEEEIATTNPVATEQYGSVATNLQQGNSDD

SEQ ID NO: 35013 - protein, 31 aa, Artificial Sequence
  Description of Artificial Sequence: Synthetic polypeptide
AEEEIATTNPVATEQYGSVATNLQQGNNNRE

SEQ ID NO: 35014 - protein, 30 aa, Artificial Sequence
  Description of Artificial Sequence: Synthetic polypeptide
AEEEIATTNPVATEQYGSVATNLQQGNIQE

SEQ ID NO: 35015 - protein, 29 aa, Artificial Sequence
  Description of Artificial Sequence: Synthetic peptide
AEEEIATTNPVATEQYGSVATNLQQGMHE

SEQ ID NO: 35016 - protein, 31 aa, Artificial Sequence
  Description of Artificial Sequence: Synthetic polypeptide
AEEEIATTNPVATEQYGSVATNLQPVGDNRY

SEQ ID NO: 35017 - protein, 30 aa, Artificial Sequence
  Description of Artificial Sequence: Synthetic polypeptide
DEEEIRTTNPVATEQWGSVSTELQNPGEDA

SEQ ID NO: 35018 - protein, 30 aa, Artificial Sequence
  Description of Artificial Sequence: Synthetic polypeptide
AEEEIATTNPVATEQYGSVATNLQNQGNEE

SEQ ID NO: 35019 - protein, 30 aa, Artificial Sequence
  Description of Artificial Sequence: Synthetic polypeptide
AEEEIATTNPVATEQYGSVATNLQNPGERH

SEQ ID NO: 35020 - protein, 30 aa, Artificial Sequence
  Description of Artificial Sequence: Synthetic polypeptide
AEEEIATTNPVATEQYGSVATNLQNNNGNN

SEQ ID NO: 35021 - protein, 30 aa, Artificial Sequence
  Description of Artificial Sequence: Synthetic polypeptide
AEEEIATTNPVATEQYGSVATNLQITGPNQ

SEQ ID NO: 35022 - protein, 28 aa, Artificial Sequence
  Description of Artificial Sequence: Synthetic peptide
TEEGIATTNPVATEQYGSVATNLDMNNR

SEQ ID NO: 35023 - protein, 29 aa, Artificial Sequence
  Description of Artificial Sequence: Synthetic peptide
TEEGIRTTNPVATEQYGSVCSTNLANLNA

SEQ ID NO: 35024 - protein, 32 aa, Artificial Sequence
  Description of Artificial Sequence: Synthetic polypeptide
WEEEIRTTNPVATEQYGSVSESNQGQRGENYR

SEQ ID NO: 35025 - protein, 31 aa, Artificial Sequence
  Description of Artificial Sequence: Synthetic polypeptide
TNEEIRTTNPVATEQYGSVSTNLQTGGENEQ

SEQ ID NO: 35026 - protein, 28 aa, Artificial Sequence
  Description of Artificial Sequence: Synthetic peptide
TNEEISTTNPVATTQYGSVSTNDMRGNQ

SEQ ID NO: 35027 - protein, 32 aa, Artificial Sequence
  Description of Artificial Sequence: Synthetic polypeptide
VEEEIRTTNPVATEQYGSVSSTNLQGGGNNGD

SEQ ID NO: 35028 - protein, 32 aa, Artificial Sequence
  Description of Artificial Sequence: Synthetic polypeptide
VEEEIRTTNPVATEQYGSVSSTNLQIGEGNNN

SEQ ID NO: 35029 - protein, 31 aa, Artificial Sequence
  Description of Artificial Sequence: Synthetic polypeptide
DEEEIRTTNPVATEQWGCVSTELQAFGSNRS

SEQ ID NO: 35030 - protein, 32 aa, Artificial Sequence
  Description of Artificial Sequence: Synthetic polypeptide
VEEEIRTTNPVATEQYGSVSSTNLQPGGGNTQ

SEQ ID NO: 35031 - protein, 32 aa, Artificial Sequence
  Description of Artificial Sequence: Synthetic polypeptide
DEEEIRTTNPVATEQWGCVCSTNLQRGSNNQA

SEQ ID NO: 35032 - protein, 31 aa, Artificial Sequence
  Description of Artificial Sequence: Synthetic polypeptide
DEEEIRTTNPVATEEYGCVCSTLLQRGSNQG

SEQ ID NO: 35033 - protein, 32 aa, Artificial Sequence
  Description of Artificial Sequence: Synthetic polypeptide
VEEEIRTTNPVATEQYGSVSTGNLQQGGGNEG

SEQ ID NO: 35034 - protein, 33 aa, Artificial Sequence
  Description of Artificial Sequence: Synthetic polypeptide
DEEEIRTTNPVATEEYGISVQSTVNLQDRISNR

SEQ ID NO: 35035 - protein, 32 aa, Artificial Sequence
  Description of Artificial Sequence: Synthetic polypeptide
VEEEIRTTNPVATEQYGSVSSTNLQFEGNNNI

SEQ ID NO: 35036 - protein, 32 aa, Artificial Sequence
  Description of Artificial Sequence: Synthetic polypeptide
VEEEIRTTNPVATEQYGSVSTMNLQVRNNELM

SEQ ID NO: 35037 - protein, 31 aa, Artificial Sequence
  Description of Artificial Sequence: Synthetic polypeptide
VEEEIRTTNPVATEQYGSVSTNLPGFVGGNV

SEQ ID NO: 35038 - protein, 32 aa, Artificial Sequence
  Description of Artificial Sequence: Synthetic polypeptide
VEEEIRTTNPVATEQYGSVSTNLQQGGGNEQG

SEQ ID NO: 35039 - protein, 32 aa, Artificial Sequence
  Description of Artificial Sequence: Synthetic polypeptide
VEEEIRTTNPVATEQYGSVSTPGTLPQRQGER

SEQ ID NO: 35040 - protein, 32 aa, Artificial Sequence
  Description of Artificial Sequence: Synthetic polypeptide
VEEEIRTTNPVATEQYGSVSTPNLQFNFGNQD

SEQ ID NO: 35041 - protein, 32 aa, Artificial Sequence
  Description of Artificial Sequence: Synthetic polypeptide
VEEEIRTTNPVATEQYGSVSTPNLQRVPENII

SEQ ID NO: 35042 - protein, 30 aa, Artificial Sequence
  Description of Artificial Sequence: Synthetic polypeptide
VEEEIRTTNPVATEQYGSVSTPVEQRPENI

SEQ ID NO: 35043 - protein, 32 aa, Artificial Sequence
  Description of Artificial Sequence: Synthetic polypeptide
VEEEIRTTNPVATEQYGSVSTQNLQSNGTGNE

SEQ ID NO: 35044 - protein, 31 aa, Artificial Sequence
  Description of Artificial Sequence: Synthetic polypeptide
VEEEIRTTNPVATEQYGSVSTTNLEVGLNAT

SEQ ID NO: 35045 - protein, 30 aa, Artificial Sequence
  Description of Artificial Sequence: Synthetic polypeptide
VEEEIRTTNPVATEQYGSVSTNGQRVMVFD

SEQ ID NO: 35046 - protein, 30 aa, Artificial Sequence
  Description of Artificial Sequence: Synthetic polypeptide
DEEEIRTTNPVATEEYGSVCFTELTRGGNQ

SEQ ID NO: 35047 - protein, 32 aa, Artificial Sequence
  Description of Artificial Sequence: Synthetic polypeptide
VEEEIRTTNPVATEQYGSVSSTNLQEEGNNQG

SEQ ID NO: 35048 - protein, 30 aa, Artificial Sequence
  Description of Artificial Sequence: Synthetic polypeptide
DEEEIRTTNPVATEQWGETISTNELQDGNA

SEQ ID NO: 35049 - protein, 30 aa, Artificial Sequence
  Description of Artificial Sequence: Synthetic polypeptide
VEEEIRTTNPVATEQYGSVATALQNGDFRQ

SEQ ID NO: 35050 - protein, 32 aa, Artificial Sequence
  Description of Artificial Sequence: Synthetic polypeptide
VEEEIRTTNPVATEQYGSVATDNLPQDGENGR

SEQ ID NO: 35051 - protein, 30 aa, Artificial Sequence
  Description of Artificial Sequence: Synthetic polypeptide
DEEEIRTTNPVATECYGVVSTNLQNPEDRD

SEQ ID NO: 35052 - protein, 33 aa, Artificial Sequence
  Description of Artificial Sequence: Synthetic polypeptide
VEEEIRTTNPVATEQYGSVIQSETNLQRGENAI

SEQ ID NO: 35053 - protein, 33 aa, Artificial Sequence
  Description of Artificial Sequence: Synthetic polypeptide
VEEEIRTTNPVATEQYGSVNCTGNLSQRGENNR

SEQ ID NO: 35054 - protein, 32 aa, Artificial Sequence
  Description of Artificial Sequence: Synthetic polypeptide
VEEEIRTTNPVATEQYGSVNSTNLQNIGGNII

SEQ ID NO: 35055 - protein, 32 aa, Artificial Sequence
  Description of Artificial Sequence: Synthetic polypeptide
VEEEIRTTNPVATEQYGSVNSTNLQQNIGNIF

SEQ ID NO: 35056 - protein, 32 aa, Artificial Sequence
  Description of Artificial Sequence: Synthetic polypeptide
VEEEIRTTNPVATEQYGSVNSTNLTQNNIGNI

SEQ ID NO: 35057 - protein, 29 aa, Artificial Sequence
  Description of Artificial Sequence: Synthetic peptide
AEECISTTNPVATEQYGSVSWNPQRSGNQ

SEQ ID NO: 35058 - protein, 32 aa, Artificial Sequence
  Description of Artificial Sequence: Synthetic polypeptide
VEEEIRTTNPVATEQYGSVNTQNLFQGGENQR

SEQ ID NO: 35059 - protein, 32 aa, Artificial Sequence
  Description of Artificial Sequence: Synthetic polypeptide
VEEEIRTTNPVATEQYGSVNTSNLTQIGENDR

SEQ ID NO: 35060 - protein, 30 aa, Artificial Sequence
  Description of Artificial Sequence: Synthetic polypeptide
VEEEIRTTNPVATEQYGSVSETNNESGNMG

SEQ ID NO: 35061 - protein, 31 aa, Artificial Sequence
  Description of Artificial Sequence: Synthetic polypeptide
VEEEIRTTNPVATEQYGSVSITNLQQQLNVA

SEQ ID NO: 35062 - protein, 31 aa, Artificial Sequence
  Description of Artificial Sequence: Synthetic polypeptide
VEEEIRTTNPVATEQYGSVSLTNGQIGMVRD

SEQ ID NO: 35063 - protein, 32 aa, Artificial Sequence
  Description of Artificial Sequence: Synthetic polypeptide
VEEEIRTTNPVATEQYGSVSLTNGQTGEENRE

SEQ ID NO: 35064 - protein, 31 aa, Artificial Sequence
  Description of Artificial Sequence: Synthetic polypeptide
VEEEIRTTNPVATEQYGSVSLTPNEQRPENE

SEQ ID NO: 35065 - protein, 28 aa, Artificial Sequence
  Description of Artificial Sequence: Synthetic peptide
DEEEIRTTNPVATEEYGCISTNEQRSDF

SEQ ID NO: 35066 - protein, 32 aa, Artificial Sequence
  Description of Artificial Sequence: Synthetic polypeptide
VEEEIRTTNPVATEQYGSVSNTNLQRTGMPID

SEQ ID NO: 35067 - protein, 32 aa, Artificial Sequence
  Description of Artificial Sequence: Synthetic polypeptide
VEEEIRTTNPVATEQYGSVNTSNLNQRGENNN

SEQ ID NO: 35068 - protein, 32 aa, Artificial Sequence
  Description of Artificial Sequence: Synthetic polypeptide
VEEEIRTTNPVATEQYGSVSTVNLQIEGGNIG

SEQ ID NO: 35069 - protein, 31 aa, Artificial Sequence
  Description of Artificial Sequence: Synthetic polypeptide
VEEEIRTTNPVATEQYGSVSVAPNLNEFGNR

SEQ ID NO: 35070 - protein, 29 aa, Artificial Sequence
  Description of Artificial Sequence: Synthetic peptide
VEEEIRTTNPVATEQYGSVSVNNTQVANI

SEQ ID NO: 35071 - protein, 32 aa, Artificial Sequence
  Description of Artificial Sequence: Synthetic polypeptide
VEEEVRTTNPVATEQYGSVSTWNNLDQNIGNR

SEQ ID NO: 35072 - protein, 29 aa, Artificial Sequence
  Description of Artificial Sequence: Synthetic peptide
VEEGICTTNPVATEQYGSVSMNSQRGENS

SEQ ID NO: 35073 - protein, 29 aa, Artificial Sequence
  Description of Artificial Sequence: Synthetic peptide
VTEEIRATNPVATEQYGSATSTNLQNGTR

SEQ ID NO: 35074 - protein, 31 aa, Artificial Sequence
  Description of Artificial Sequence: Synthetic polypeptide
VTEEIRATNPVATEQYGSVVSTNLQNSGNTR

SEQ ID NO: 35075 - protein, 31 aa, Artificial Sequence
  Description of Artificial Sequence: Synthetic polypeptide
DEEEIRTTNPVATEFYGCVSTNLEQVQTGDR

SEQ ID NO: 35076 - protein, 32 aa, Artificial Sequence
  Description of Artificial Sequence: Synthetic polypeptide
WEEEIATTNPVATEQYGSVNTGNLEQRGDNPR

SEQ ID NO: 35077 - protein, 32 aa, Artificial Sequence
  Description of Artificial Sequence: Synthetic polypeptide
WEEEIATTNPVATEQYGSVNTPNLDQRGENPR

SEQ ID NO: 35078 - protein, 32 aa, Artificial Sequence
  Description of Artificial Sequence: Synthetic polypeptide
WEEEIATTNPVATEQYGSVSTPNLAQNGENPR

SEQ ID NO: 35079 - protein, 32 aa, Artificial Sequence
  Description of Artificial Sequence: Synthetic polypeptide
VEEEVRTTNPVATEQYGSVSTWNLDQVRIGER

SEQ ID NO: 35080 - protein, 33 aa, Artificial Sequence
  Description of Artificial Sequence: Synthetic polypeptide
WEEEIRCTNPVATEQYGSVSFTSNLQERGENYR

SEQ ID NO: 35081 - protein, 33 aa, Artificial Sequence
  Description of Artificial Sequence: Synthetic polypeptide
WEEEIRTTNPVATEQYGSTVNTMNLYQRGENDR

SEQ ID NO: 35082 - protein, 32 aa, Artificial Sequence
  Description of Artificial Sequence: Synthetic polypeptide
WEEEIRTTNPVATEQYGSVNSMNLYQRGENYV

SEQ ID NO: 35083 - protein, 30 aa, Artificial Sequence
  Description of Artificial Sequence: Synthetic polypeptide
DEEEIRTTNPVATEQFGVTSVSTLGIRGNS

SEQ ID NO: 35084 - protein, 30 aa, Artificial Sequence
  Description of Artificial Sequence: Synthetic polypeptide
DEEEIRTTNPVATEQFGTVVSTYLEVRGNG

SEQ ID NO: 35085 - protein, 29 aa, Artificial Sequence
  Description of Artificial Sequence: Synthetic peptide
AEEAICTTNPVATEQYGSVSSNSQRGNNS

SEQ ID NO: 35086 - protein, 28 aa, Artificial Sequence
  Description of Artificial Sequence: Synthetic peptide
AEEAICTTNPVATEQYGSVSNNSQHGNS

SEQ ID NO: 35087 - protein, 29 aa, Artificial Sequence
  Description of Artificial Sequence: Synthetic peptide
DEEEIRTTNPVATEQFGTVVSTPLLDGNS

SEQ ID NO: 35088 - protein, 28 aa, Artificial Sequence
  Description of Artificial Sequence: Synthetic peptide
AEEAICTTNPVATEQYGSVSMNSQSGNS

SEQ ID NO: 35089 - protein, 29 aa, Artificial Sequence
  Description of Artificial Sequence: Synthetic peptide
WEEEIRTTNPLGTEQYGQVSTMNLQRDNI

SEQ ID NO: 35090 - protein, 32 aa, Artificial Sequence
  Description of Artificial Sequence: Synthetic polypeptide
VEEEVRTTNPVATEQYGSVSTWNLDQIRIGNE

SEQ ID NO: 35091 - protein, 32 aa, Artificial Sequence
  Description of Artificial Sequence: Synthetic polypeptide
VEEEVRTTNPVATEQYGSVSTWNLDERIGNRE

SEQ ID NO: 35092 - protein, 29 aa, Artificial Sequence
  Description of Artificial Sequence: Synthetic peptide
AEECIATTNPVATEQYGSVSSNHQERGNQ

SEQ ID NO: 35093 - protein, 31 aa, Artificial Sequence
  Description of Artificial Sequence: Synthetic polypeptide
VEEEIRTTNPVATEQYGSVSVTPGTLQRGEE

SEQ ID NO: 35094 - protein, 31 aa, Artificial Sequence
  Description of Artificial Sequence: Synthetic polypeptide
DEEEIRTTNPVATEEYGSVCFTNLTSGGSNR

SEQ ID NO: 35095 - protein, 33 aa, Artificial Sequence
  Description of Artificial Sequence: Synthetic polypeptide
DEEEIRTTNPVATEEYGSVCSTMNLQRFGSNQT

SEQ ID NO: 35096 - protein, 30 aa, Artificial Sequence
  Description of Artificial Sequence: Synthetic polypeptide
VEEEIRTTNPVATESYGSVSNTPLHRGMQR

SEQ ID NO: 35097 - protein, 31 aa, Artificial Sequence
  Description of Artificial Sequence: Synthetic polypeptide
VEEEIRTTNPVAYEAYGSVSTNELSQRGGNP

SEQ ID NO: 35098 - protein, 30 aa, Artificial Sequence
  Description of Artificial Sequence: Synthetic polypeptide
DEEEIRTTNPVATEEYGSVSTDLQDLGPEQ

SEQ ID NO: 35099 - protein, 32 aa, Artificial Sequence
  Description of Artificial Sequence: Synthetic polypeptide
VEEELRTTNPVATEQYGSVSTWNDQDQRDGNR

SEQ ID NO: 35100 - protein, 32 aa, Artificial Sequence
  Description of Artificial Sequence: Synthetic polypeptide
VEEELRTTNPVATEQYGSVSTWNGLDQQIGNR

SEQ ID NO: 35101 - protein, 33 aa, Artificial Sequence
  Description of Artificial Sequence: Synthetic polypeptide
VEEELRTTNPVATEQYGSVSTWNLDQERKGDNR

SEQ ID NO: 35102 - protein, 31 aa, Artificial Sequence
  Description of Artificial Sequence: Synthetic polypeptide
VEEEVATTNPVATEQYGSVATPNLDQRGGNR

SEQ ID NO: 35103 - protein, 31 aa, Artificial Sequence
  Description of Artificial Sequence: Synthetic polypeptide
VEEEVATTNPVATEQYGSVGTGNLDQRDGNR

SEQ ID NO: 35104 - protein, 32 aa, Artificial Sequence
  Description of Artificial Sequence: Synthetic polypeptide
VEEEVATTNPVATEQYGSVSTVNMLDQRDGNR

SEQ ID NO: 35105 - protein, 31 aa, Artificial Sequence
  Description of Artificial Sequence: Synthetic polypeptide
VEEEVATTNPVAYEQYGSVSTPNLDQREGNR

SEQ ID NO: 35106 - protein, 32 aa, Artificial Sequence
  Description of Artificial Sequence: Synthetic polypeptide
VEEEVRTTNPVATEQYGSVSTPNLDQQRIGNE

SEQ ID NO: 35107 - protein, 29 aa, Artificial Sequence
  Description of Artificial Sequence: Synthetic peptide
AEECICTTNPVATEQYGSVSSNHQRGSNA

SEQ ID NO: 35108 - protein, 28 aa, Artificial Sequence
  Description of Artificial Sequence: Synthetic peptide
AEECIATVNPVATEWYGSVSDNLLRGNR

SEQ ID NO: 35109 - protein, 31 aa, Artificial Sequence
  Description of Artificial Sequence: Synthetic polypeptide
VEEEVRTTNPVATEQYGSVSTWNGDQDKGNR

SEQ ID NO: 35110 - protein, 32 aa, Artificial Sequence
  Description of Artificial Sequence: Synthetic polypeptide
VEEEVRTTNPVATEQYGSVSTWNGDQDRMGNR

SEQ ID NO: 35111 - protein, 29 aa, Artificial Sequence
  Description of Artificial Sequence: Synthetic peptide
AEECIATTNPVATEQYGSVSSNSQRGSNQ

SEQ ID NO: 35112 - protein, 28 aa, Artificial Sequence
  Description of Artificial Sequence: Synthetic peptide
AEEEIACTNPIATEQYGEVSENLQRGGR

SEQ ID NO: 35113 - protein, 31 aa, Artificial Sequence
  Description of Artificial Sequence: Synthetic polypeptide
TNEEIRTTNPVATEQYGVVSTNLQTGGDNNR

SEQ ID NO: 35114 - protein, 32 aa, Artificial Sequence
  Description of Artificial Sequence: Synthetic polypeptide
VEEEIRTTNPVATEQYGCVSTDNLEQRGNDGE

SEQ ID NO: 35115 - protein, 28 aa, Artificial Sequence
  Description of Artificial Sequence: Synthetic peptide
AEEEIACTNPVATEMYGSVATNLERGNA

SEQ ID NO: 35116 - protein, 33 aa, Artificial Sequence
  Description of Artificial Sequence: Synthetic polypeptide
DEEEIRTTNPVATEQWGSTVSCTNWLSQRGGER

SEQ ID NO: 35117 - protein, 32 aa, Artificial Sequence
  Description of Artificial Sequence: Synthetic polypeptide
DEEEIRTTNPVATEQWGSTVSCTNLGKTGGNR

SEQ ID NO: 35118 - protein, 33 aa, Artificial Sequence
  Description of Artificial Sequence: Synthetic polypeptide
DEEEIRTTNPVATEQWGSTVSCTNALSQHGNNR

SEQ ID NO: 35119 - protein, 31 aa, Artificial Sequence
  Description of Artificial Sequence: Synthetic polypeptide
TSEEIRTTNPVATEQWGSTVSTNLSQRVNYR

SEQ ID NO: 35120 - protein, 30 aa, Artificial Sequence
  Description of Artificial Sequence: Synthetic polypeptide
TSEEIRTTNPVATEQWGSVPSTDELQRGTR

SEQ ID NO: 35121 - protein, 28 aa, Artificial Sequence
  Description of Artificial Sequence: Synthetic peptide
AEEEIACTNPVATEQYGVVSENLQSGGR

SEQ ID NO: 35122 - protein, 28 aa, Artificial Sequence
  Description of Artificial Sequence: Synthetic peptide
AEEEIACTNPVATEQYGVASENLQRGGR

SEQ ID NO: 35123 - protein, 29 aa, Artificial Sequence
  Description of Artificial Sequence: Synthetic peptide
AEEEIACTNPVATEQYGSVVTNLQQGNPE

SEQ ID NO: 35124 - protein, 34 aa, Artificial Sequence
  Description of Artificial Sequence: Synthetic polypeptide
DEEEIRTTNPVATEQWGSTVSTNALSQRGGNERG

SEQ ID NO: 35125 - protein, 33 aa, Artificial Sequence
  Description of Artificial Sequence: Synthetic polypeptide
DEEEIRTTNPVATEQWGSTVSCTGNLQRGGETR

SEQ ID NO: 35126 - protein, 30 aa, Artificial Sequence
  Description of Artificial Sequence: Synthetic polypeptide
AEEEIACTNPVATEQYGSVSTNLQSGPNED

SEQ ID NO: 35127 - protein, 30 aa, Artificial Sequence
  Description of Artificial Sequence: Synthetic polypeptide
AEEEIACTNPVATEQYGSVSTNLQGGTNDD

SEQ ID NO: 35128 - protein, 33 aa, Artificial Sequence
  Description of Artificial Sequence: Synthetic polypeptide
DEEEIRTTNPVATEQWGSTVPSCTNNLSQRGNE

SEQ ID NO: 35129 - protein, 31 aa, Artificial Sequence
  Description of Artificial Sequence: Synthetic polypeptide
TSEEIRTTNPVATEQYGVTVSTNLSQDGTNR

SEQ ID NO: 35130 - protein, 29 aa, Artificial Sequence
  Description of Artificial Sequence: Synthetic peptide
AEEEIACTNPVATEQYGSVATNLQRTNDL

SEQ ID NO: 35131 - protein, 29 aa, Artificial Sequence
  Description of Artificial Sequence: Synthetic peptide
AEEEIACTNPVATEQYGSVATNLQRQNEQ

SEQ ID NO: 35132 - protein, 31 aa, Artificial Sequence
  Description of Artificial Sequence: Synthetic polypeptide
AEEEIACTNPVATEQYGSVATNLQRGDNTRD

SEQ ID NO: 35133 - protein, 30 aa, Artificial Sequence
  Description of Artificial Sequence: Synthetic polypeptide
AEEEIACTNPVATEQYGSVATNLQREQNRM

SEQ ID NO: 35134 - protein, 32 aa, Artificial Sequence
  Description of Artificial Sequence: Synthetic polypeptide
DEEEIRTTNPVATEQWGSTVSCTALSQRGGGR

SEQ ID NO: 35135 - protein, 30 aa, Artificial Sequence
  Description of Artificial Sequence: Synthetic polypeptide
AEEEIACTNPVATEQYGSVATNLQRDGNTA

SEQ ID NO: 35136 - protein, 28 aa, Artificial Sequence
  Description of Artificial Sequence: Synthetic peptide
AEEEIACVNPVATEQYGEASENLQRGNR

SEQ ID NO: 35137 - protein, 33 aa, Artificial Sequence
  Description of Artificial Sequence: Synthetic polypeptide
DEEEIRTTNPVATEQWGSTVSVTNALSPRGSNR

SEQ ID NO: 35138 - protein, 30 aa, Artificial Sequence
  Description of Artificial Sequence: Synthetic polypeptide
TQEEIRTTNPVATEQWGTTVSTNALQEGNR

SEQ ID NO: 35139 - protein, 30 aa, Artificial Sequence
  Description of Artificial Sequence: Synthetic polypeptide
TQEEIRTTNPVATEQWGTVSCTNLSQSGNR

SEQ ID NO: 35140 - protein, 31 aa, Artificial Sequence
  Description of Artificial Sequence: Synthetic polypeptide
DEEEIRTTNPVATEQWGSVATNLTRGDNTDT

SEQ ID NO: 35141 - protein, 29 aa, Artificial Sequence
  Description of Artificial Sequence: Synthetic peptide
TQEEIRTTNPVATEQWGTVSTNLSQEGSR

SEQ ID NO: 35142 - protein, 30 aa, Artificial Sequence
  Description of Artificial Sequence: Synthetic polypeptide
TQEEIRTTNPVATEQWGYTVSTNLEQEGNR

SEQ ID NO: 35143 - protein, 31 aa, Artificial Sequence
  Description of Artificial Sequence: Synthetic polypeptide
DEEEIRTTNPVATEQWGSVATNLERPGDNIT

SEQ ID NO: 35144 - protein, 31 aa, Artificial Sequence
  Description of Artificial Sequence: Synthetic polypeptide
TQEEIRTTNPVATEQYGVVSCTNLQDTGGNR

SEQ ID NO: 35145 - protein, 30 aa, Artificial Sequence
  Description of Artificial Sequence: Synthetic polypeptide
DEEEIRTTNPVATEQWGSVATNLERDPNED

SEQ ID NO: 35146 - protein, 28 aa, Artificial Sequence
  Description of Artificial Sequence: Synthetic peptide
AEEEIACVNPVATEQYGVVSENLQSGNR

SEQ ID NO: 35147 - protein, 32 aa, Artificial Sequence
  Description of Artificial Sequence: Synthetic polypeptide
TSEEIATTNPVATEQYGSVSTTGNLSQRGGNR

SEQ ID NO: 35148 - protein, 30 aa, Artificial Sequence
  Description of Artificial Sequence: Synthetic polypeptide
DEEEIRTTNPVATECYGSVCSTHLQANNID

SEQ ID NO: 35149 - protein, 31 aa, Artificial Sequence
  Description of Artificial Sequence: Synthetic polypeptide
DEEEIRTTNPVATEQWGSVALNLSGRGGNNR

SEQ ID NO: 35150 - protein, 32 aa, Artificial Sequence
  Description of Artificial Sequence: Synthetic polypeptide
DEEEIRTTNPVATEQWGSVACTNLSQRGGSQR

SEQ ID NO: 35151 - protein, 31 aa, Artificial Sequence
  Description of Artificial Sequence: Synthetic polypeptide
DEEEIRTTNPVATEQWGSVAANLQREGPNDD

SEQ ID NO: 35152 - protein, 28 aa, Artificial Sequence
  Description of Artificial Sequence: Synthetic peptide
AEEEIASTNPVCTEQYGVVSENLQRGGR

SEQ ID NO: 35153 - protein, 32 aa, Artificial Sequence
  Description of Artificial Sequence: Synthetic polypeptide
TSEEIRTTNPVATEAYGSVVSTNMLSQRPGNR

SEQ ID NO: 35154 - protein, 28 aa, Artificial Sequence
  Description of Artificial Sequence: Synthetic peptide
AEEEIASTNPVATEQYGVVSDNLQSGGR

SEQ ID NO: 35155 - protein, 28 aa, Artificial Sequence
  Description of Artificial Sequence: Synthetic peptide
AEEEIASTNPVATEQYGEVSDNLQSGGR

SEQ ID NO: 35156 - protein, 31 aa, Artificial Sequence
  Description of Artificial Sequence: Synthetic polypeptide
TSEEICTTNPVATEQYGSVSCTNALQRVNNR

SEQ ID NO: 35157 - protein, 32 aa, Artificial Sequence
  Description of Artificial Sequence: Synthetic polypeptide
DEEEIRTTNPVATEQWGSTSMTENLDQDIGNR

SEQ ID NO: 35158 - protein, 30 aa, Artificial Sequence
  Description of Artificial Sequence: Synthetic polypeptide
TSEEIRTTNPVATHQYGSVSTPLQRGGNNF

SEQ ID NO: 35159 - protein, 30 aa, Artificial Sequence
  Description of Artificial Sequence: Synthetic polypeptide
TSEEIRTTNPVATHQYGSVSTWLSQRGNNQ

SEQ ID NO: 35160 - protein, 32 aa, Artificial Sequence
  Description of Artificial Sequence: Synthetic polypeptide
DEEEIRTTNPVATECYGSVSTNLVQQGGGNGE

SEQ ID NO: 35161 - protein, 31 aa, Artificial Sequence
  Description of Artificial Sequence: Synthetic polypeptide
DEEEIRTTNPVATECYGSVSTPNQTGNVGNR

SEQ ID NO: 35162 - protein, 32 aa, Artificial Sequence
  Description of Artificial Sequence: Synthetic polypeptide
DEEEIRTTNPVATEQWGKVSCTNLSQGTEGNR

SEQ ID NO: 35163 - protein, 32 aa, Artificial Sequence
  Description of Artificial Sequence: Synthetic polypeptide
DEEEIRTTNPVATEQWGISVSTNQSQGGGNNR

SEQ ID NO: 35164 - protein, 29 aa, Artificial Sequence
  Description of Artificial Sequence: Synthetic peptide
VEEEIATTNPVATEPYGSVSANLQQGNNQ

SEQ ID NO: 35165 - protein, 29 aa, Artificial Sequence
  Description of Artificial Sequence: Synthetic peptide
VEEEIATTNPVATEQWGSVSENLQQGNES

SEQ ID NO: 35166 - protein, 29 aa, Artificial Sequence
  Description of Artificial Sequence: Synthetic peptide
DEEEIRTTNPVATECYGTHSTNEQRDNED

SEQ ID NO: 35167 - protein, 29 aa, Artificial Sequence
  Description of Artificial Sequence: Synthetic peptide
DEEEIRTTNPVATECYGTHSTNEQRDRNF

SEQ ID NO: 35168 - protein, 28 aa, Artificial Sequence
  Description of Artificial Sequence: Synthetic peptide
AEEEIACTNPVATEQYGEASDNLQRGGR

SEQ ID NO: 35169 - protein, 30 aa, Artificial Sequence
  Description of Artificial Sequence: Synthetic polypeptide
VEEEIATTNPVATEQYGSVATNLQDNGNPE

SEQ ID NO: 35170 - protein, 29 aa, Artificial Sequence
  Description of Artificial Sequence: Synthetic peptide
VEEEIATTNPVATEQYGSVATNLQNNNNQ

SEQ ID NO: 35171 - protein, 32 aa, Artificial Sequence
  Description of Artificial Sequence: Synthetic polypeptide
VEEEIATTNPVATEQYGSVSTNPLQARMGDNL

SEQ ID NO: 35172 - protein, 29 aa, Artificial Sequence
  Description of Artificial Sequence: Synthetic peptide
VEEEIATTNPVAYEQYGSVATNLQQGNEE

SEQ ID NO: 35173 - protein, 28 aa, Artificial Sequence
  Description of Artificial Sequence: Synthetic peptide
DEEEIRTTNPVATECYGTTSCNEQRRNF

SEQ ID NO: 35174 - protein, 28 aa, Artificial Sequence
  Description of Artificial Sequence: Synthetic peptide
DEEEIRTTNPVATECYGTTSTNEQELNG

SEQ ID NO: 35175 - protein, 28 aa, Artificial Sequence
  Description of Artificial Sequence: Synthetic peptide
DEEEIRTTNPVATECYGTTSTNEQGNNF

SEQ ID NO: 35176 - protein, 28 aa, Artificial Sequence
  Description of Artificial Sequence: Synthetic peptide
DEEEIRTTNPVATECYGTTSTNEQLENT

SEQ ID NO: 35177 - protein, 29 aa, Artificial Sequence
  Description of Artificial Sequence: Synthetic peptide
DEEEIRTTNPVATECYGTVSSTNEQGNNQ

SEQ ID NO: 35178 - protein, 29 aa, Artificial Sequence
  Description of Artificial Sequence: Synthetic peptide
VEEEIATTNPVATEQYGSVATNLQEDGGQ

SEQ ID NO: 35179 - protein, 28 aa, Artificial Sequence
  Description of Artificial Sequence: Synthetic peptide
AEEEIACTNPVATEQYGEASENLQRGGR

SEQ ID NO: 35180 - protein, 28 aa, Artificial Sequence
  Description of Artificial Sequence: Synthetic peptide
AEEEIACTNPVATEQYGEASNNLQRGGR

SEQ ID NO: 35181 - protein, 28 aa, Artificial Sequence
  Description of Artificial Sequence: Synthetic peptide
AEEEIACTNPVATEQYGSASEALQRGGR

SEQ ID NO: 35182 - protein, 31 aa, Artificial Sequence
  Description of Artificial Sequence: Synthetic polypeptide
DEEEIRTTNPVATEQWGSSWSLENDLQRDNR

SEQ ID NO: 35183 - protein, 29 aa, Artificial Sequence
  Description of Artificial Sequence: Synthetic peptide
TSEEIRTTNPVAYEQYGVVSTNLQDVGNQ

SEQ ID NO: 35184 - protein, 30 aa, Artificial Sequence
  Description of Artificial Sequence: Synthetic polypeptide
DEEEIRTTNPVATEQWGSFSLPNMLQDDNR

SEQ ID NO: 35185 - protein, 31 aa, Artificial Sequence
  Description of Artificial Sequence: Synthetic polypeptide
DEEEIRTTNPVATEQWGSASLPNMLQREDNR

SEQ ID NO: 35186 - protein, 31 aa, Artificial Sequence
  Description of Artificial Sequence: Synthetic polypeptide
DEEEIRTTNPVATEQWGQSVVSTHLSLRGNS

SEQ ID NO: 35187 - protein, 29 aa, Artificial Sequence
  Description of Artificial Sequence: Synthetic peptide
TSEEIRTTNPVGTEQWGTVSTNLQRGGVR

SEQ ID NO: 35188 - protein, 31 aa, Artificial Sequence
  Description of Artificial Sequence: Synthetic polypeptide
DEEEIRTTNPVATEQWGQSVSTHLSTRGGNS

SEQ ID NO: 35189 - protein, 29 aa, Artificial Sequence
  Description of Artificial Sequence: Synthetic peptide
AEEEIACTNPVATEQYGSVATNLQAGSND

SEQ ID NO: 35190 - protein, 29 aa, Artificial Sequence
  Description of Artificial Sequence: Synthetic peptide
DEEEIRTTNPVATEQWGNVATNLQRNEDD

SEQ ID NO: 35191 - protein, 30 aa, Artificial Sequence
  Description of Artificial Sequence: Synthetic polypeptide
AEEEIACTNPVATEQYGSVATNLQADGNTR

SEQ ID NO: 35192 - protein, 32 aa, Artificial Sequence
  Description of Artificial Sequence: Synthetic polypeptide
DEEEIRTTNPVATEQWGNTTSTNELQGREGNR

SEQ ID NO: 35193 - protein, 30 aa, Artificial Sequence
  Description of Artificial Sequence: Synthetic polypeptide
TTCEIRTTNPVATEQYGSVSTENNLQLGQR

SEQ ID NO: 35194 - protein, 28 aa, Artificial Sequence
  Description of Artificial Sequence: Synthetic peptide
AEEEIACTNPVATEQYGSVATALQNGER

SEQ ID NO: 35195 - protein, 32 aa, Artificial Sequence
  Description of Artificial Sequence: Synthetic polypeptide
DEEEIRTTNPVATECYGSVSTGPLQDRDGNNM

SEQ ID NO: 35196 - protein, 29 aa, Artificial Sequence
  Description of Artificial Sequence: Synthetic peptide
TTEEIRTTNPVATEQWGEVSTNLQMEGNI

SEQ ID NO: 35197 - protein, 29 aa, Artificial Sequence
  Description of Artificial Sequence: Synthetic peptide
TTEEIRTTNPVATEQWGQVSTNDQQEGNR

SEQ ID NO: 35198 - protein, 28 aa, Artificial Sequence
  Description of Artificial Sequence: Synthetic peptide
TTEEIRTTNPVATEQWGQVSTNGQEGNG

SEQ ID NO: 35199 - protein, 28 aa, Artificial Sequence
  Description of Artificial Sequence: Synthetic peptide
TTEEIRTTNPVATEQWGTVSTNEQEGNQ

SEQ ID NO: 35200 - protein, 30 aa, Artificial Sequence
  Description of Artificial Sequence: Synthetic polypeptide
AEEEIACTNPVATEQYGSASTENGPQRGNR

SEQ ID NO: 35201 - protein, 29 aa, Artificial Sequence
  Description of Artificial Sequence: Synthetic peptide
DEEEIRTTNPVATECYGTVSSTNNQNNNF

SEQ ID NO: 35202 - protein, 30 aa, Artificial Sequence
  Description of Artificial Sequence: Synthetic polypeptide
DEVEIRTTNPVATEAYGSVSLQNDQEGNDR

SEQ ID NO: 35203 - protein, 31 aa, Artificial Sequence
  Description of Artificial Sequence: Synthetic polypeptide
AEEEIRTTNPVATEQYGSVSNVNLQQGENNN

SEQ ID NO: 35204 - protein, 30 aa, Artificial Sequence
  Description of Artificial Sequence: Synthetic polypeptide
AEEEIRTTNPVATEQYGSVSSNENQGNGNS

SEQ ID NO: 35205 - protein, 31 aa, Artificial Sequence
  Description of Artificial Sequence: Synthetic polypeptide
DEEEIRTTNPVATEQYGCVCSTYLINFGNRG

SEQ ID NO: 35206 - protein, 30 aa, Artificial Sequence
  Description of Artificial Sequence: Synthetic polypeptide
DEEEIRTTNPVATEQYGCVCSTYHQNFGNV

SEQ ID NO: 35207 - protein, 31 aa, Artificial Sequence
  Description of Artificial Sequence: Synthetic polypeptide
SEEEIRTTNPVATEEYGSVSNTNLDHRGDQR

SEQ ID NO: 35208 - protein, 30 aa, Artificial Sequence
  Description of Artificial Sequence: Synthetic polypeptide
SEEEIRTTNPVATEEYGSVSNTNLHNGDTR

SEQ ID NO: 35209 - protein, 32 aa, Artificial Sequence
  Description of Artificial Sequence: Synthetic polypeptide
AEEEIRTTNPVATEQYGSVSTTNLQQQIGNNE

SEQ ID NO: 35210 - protein, 32 aa, Artificial Sequence
  Description of Artificial Sequence: Synthetic polypeptide
AEEEIRTTNPVATEQYGSVSTTNLQQQGQNNL

SEQ ID NO: 35211 - protein, 32 aa, Artificial Sequence
  Description of Artificial Sequence: Synthetic polypeptide
AEEEIRTTNPVATEQYGSVSTTNLQQQGNQVA

SEQ ID NO: 35212 - protein, 31 aa, Artificial Sequence
  Description of Artificial Sequence: Synthetic polypeptide
AEEEIRTTNPVATEQYGSVSTTNLQQQGGTD

SEQ ID NO: 35213 - protein, 30 aa, Artificial Sequence
  Description of Artificial Sequence: Synthetic polypeptide
DEEEIRTTNPVATEQYGCVCSTYLTNFGER

SEQ ID NO: 35214 - protein, 32 aa, Artificial Sequence
  Description of Artificial Sequence: Synthetic polypeptide
AEEEIRTTNPVATEQYGSVSTTNLQQQGENSN

SEQ ID NO: 35215 - protein, 32 aa, Artificial Sequence
  Description of Artificial Sequence: Synthetic polypeptide
AEEEIRTTNPVATEQYGSVSTTNLQQQEGNSG

SEQ ID NO: 35216 - protein, 29 aa, Artificial Sequence
  Description of Artificial Sequence: Synthetic peptide
SEEEIRTTNPVATEGYGCTDIGNLQRGNR

SEQ ID NO: 35217 - protein, 32 aa, Artificial Sequence
  Description of Artificial Sequence: Synthetic polypeptide
AEEEIRTTNPVATEQYGSVSTTNLQQNQGNDT

SEQ ID NO: 35218 - protein, 28 aa, Artificial Sequence
  Description of Artificial Sequence: Synthetic peptide
SEEEIRTTNPVATEGYGCTSINDQRGNI

SEQ ID NO: 35219 - protein, 32 aa, Artificial Sequence
  Description of Artificial Sequence: Synthetic polypeptide
AEEEIRTTNPVATEQYGSVSTTNLQQNGVTNS

SEQ ID NO: 35220 - protein, 29 aa, Artificial Sequence
  Description of Artificial Sequence: Synthetic peptide
SEEEIRTTNPVATEGYGCTSINLQRGNEG

SEQ ID NO: 35221 - protein, 32 aa, Artificial Sequence
  Description of Artificial Sequence: Synthetic polypeptide
AEEEIRTTNPVATEQYGSVSTTNLQQLQGNVE

SEQ ID NO: 35222 - protein, 29 aa, Artificial Sequence
  Description of Artificial Sequence: Synthetic peptide
DEEEIRTTNPMATEEYGSVATNHGRGNAV

SEQ ID NO: 35223 - protein, 31 aa, Artificial Sequence
  Description of Artificial Sequence: Synthetic polypeptide
DEEEIRTTNPVATEQYGCVCSTTNGDQRGEF

SEQ ID NO: 35224 - protein, 29 aa, Artificial Sequence
  Description of Artificial Sequence: Synthetic peptide
DEEEIRTTNPMATEEYGSVATTNQGRGNA

SEQ ID NO: 35225 - protein, 32 aa, Artificial Sequence
  Description of Artificial Sequence: Synthetic polypeptide
AEEEIRTTNPVATEQYGSVSTTNLQQQQGNDQ

SEQ ID NO: 35226 - protein, 31 aa, Artificial Sequence
  Description of Artificial Sequence: Synthetic polypeptide
DEEEIRTTNPVATEQYGCVCSWELQRGSENA

SEQ ID NO: 35227 - protein, 32 aa, Artificial Sequence
  Description of Artificial Sequence: Synthetic polypeptide
AEEEIRTTNPVATEQYGSVSTTNLQYGNSNNN

SEQ ID NO: 35228 - protein, 32 aa, Artificial Sequence
  Description of Artificial Sequence: Synthetic polypeptide
AEEEIRTTNPVATEQYGSVSTTNLQVQGNQGN

SEQ ID NO: 35229 - protein, 32 aa, Artificial Sequence
  Description of Artificial Sequence: Synthetic polypeptide
AEEEIRTTNPVATEQYGSVSTTNLQVNGNTEI

SEQ ID NO: 35230 - protein, 32 aa, Artificial Sequence
  Description of Artificial Sequence: Synthetic polypeptide
AEEEIRTTNPVATEQYGSVSTTNLQVIGTTNI

SEQ ID NO: 35231 - protein, 31 aa, Artificial Sequence
  Description of Artificial Sequence: Synthetic polypeptide
AEEEIRTTNPVATEQYGSVSTTNLQVIGTIQ

SEQ ID NO: 35232 - protein, 32 aa, Artificial Sequence
  Description of Artificial Sequence: Synthetic polypeptide
AEEEIRTTNPVATEQYGSVSTTNLQVGNVNND

SEQ ID NO: 35233 - protein, 32 aa, Artificial Sequence
  Description of Artificial Sequence: Synthetic polypeptide
AEEEIRTTNPVATEQYGSVSTTNLQVDGENNE

SEQ ID NO: 35234 - protein, 32 aa, Artificial Sequence
  Description of Artificial Sequence: Synthetic polypeptide
AEEEIRTTNPVATEQYGSVSTTNLQVANGNNI

SEQ ID NO: 35235 - protein, 30 aa, Artificial Sequence
  Description of Artificial Sequence: Synthetic polypeptide
DEEEIRTTNPVATEQYGCVCSWEHQRGSER

SEQ ID NO: 35236 - protein, 31 aa, Artificial Sequence
  Description of Artificial Sequence: Synthetic polypeptide
AEEEIRTTNPVATEQYGSVSTTNLQTNGGVD

SEQ ID NO: 35237 - protein, 32 aa, Artificial Sequence
  Description of Artificial Sequence: Synthetic polypeptide
AEEEIRTTNPVATEQYGSVSTTNLQQSGNQTT

SEQ ID NO: 35238 - protein, 31 aa, Artificial Sequence
  Description of Artificial Sequence: Synthetic polypeptide
SEEEIRTTNPVATEAYGSVSNTNLTRFGDQR

SEQ ID NO: 35239 - protein, 32 aa, Artificial Sequence
  Description of Artificial Sequence: Synthetic polypeptide
DEEEIRTTNPVATEQYGCVCSWENLNRGSNRQ

SEQ ID NO: 35240 - protein, 32 aa, Artificial Sequence
  Description of Artificial Sequence: Synthetic polypeptide
DEEEIRTTNPVATEQYGCVCSWENHQRFGNRA

SEQ ID NO: 35241 - protein, 31 aa, Artificial Sequence
  Description of Artificial Sequence: Synthetic polypeptide
SEEEIRTTNPVATEAYGSVSVTNLHRGTDQR

SEQ ID NO: 35242 - protein, 33 aa, Artificial Sequence
  Description of Artificial Sequence: Synthetic polypeptide
SEEEIRTTNPVATEAYGSVVSCTGNMLSQRGNR

SEQ ID NO: 35243 - protein, 30 aa, Artificial Sequence
  Description of Artificial Sequence: Synthetic polypeptide
SEEEIRTTNPVATECWGSVSENEQDRGENR

SEQ ID NO: 35244 - protein, 32 aa, Artificial Sequence
  Description of Artificial Sequence: Synthetic polypeptide
AEEEIRTTNPVATEQYGSVSTTNLQQQQGTNA

SEQ ID NO: 35245 - protein, 31 aa, Artificial Sequence
  Description of Artificial Sequence: Synthetic polypeptide
AEEEIRTTNPVATEQYGSVSTTNLQQTGETN

SEQ ID NO: 35246 - protein, 30 aa, Artificial Sequence
  Description of Artificial Sequence: Synthetic polypeptide
DEEEIRTTNPLATEQYGSVSQNIGRGGNND

SEQ ID NO: 35247 - protein, 30 aa, Artificial Sequence
  Description of Artificial Sequence: Synthetic polypeptide
SEEEIRTTNPVATEGYGCVSNTNLIRGDTR

SEQ ID NO: 35248 - protein, 29 aa, Artificial Sequence
  Description of Artificial Sequence: Synthetic peptide
SEEEIRTTNPVATEGYGMTSINLQRAGNI

SEQ ID NO: 35249 - protein, 31 aa, Artificial Sequence
  Description of Artificial Sequence: Synthetic polypeptide
DEEEIRTTNPMATEQYGSVCGTNLQSGSNNA

SEQ ID NO: 35250 - protein, 32 aa, Artificial Sequence
  Description of Artificial Sequence: Synthetic polypeptide
AEEEIRTTNPVATEQYGSVSTTNLQNNGENEL

SEQ ID NO: 35251 - protein, 32 aa, Artificial Sequence
  Description of Artificial Sequence: Synthetic polypeptide
AEEEIRTTNPVATEQYGSVSTTNLQNIGENNV

SEQ ID NO: 35252 - protein, 30 aa, Artificial Sequence
  Description of Artificial Sequence: Synthetic polypeptide
DEEEIRTTNPMATEQYGSVIATGLERGNIQ

SEQ ID NO: 35253 - protein, 32 aa, Artificial Sequence
  Description of Artificial Sequence: Synthetic polypeptide
AEEEIRTTNPVATEQYGSVSTTNLQNGNGNIE

SEQ ID NO: 35254 - protein, 31 aa, Artificial Sequence
  Description of Artificial Sequence: Synthetic polypeptide
DEEEIRTTNPMATEQYGSVIATGNLQRMNHG

SEQ ID NO: 35255 - protein, 30 aa, Artificial Sequence
  Description of Artificial Sequence: Synthetic polypeptide
SEEEIRTTNPVATELYGSVSGTNLIQQGGS

SEQ ID NO: 35256 - protein, 31 aa, Artificial Sequence
  Description of Artificial Sequence: Synthetic polypeptide
DEEEIRTTNPMATEQYGSVIATGNLTRGNFA

SEQ ID NO: 35257 - protein, 32 aa, Artificial Sequence
  Description of Artificial Sequence: Synthetic polypeptide
AEEEIRTTNPVATEQYGSVSTTNLQNQEGNQD

SEQ ID NO: 35258 - protein, 32 aa, Artificial Sequence
  Description of Artificial Sequence: Synthetic polypeptide
AEEEIRTTNPVATEQYGSVSTTNLQNAGNIEN

SEQ ID NO: 35259 - protein, 31 aa, Artificial Sequence
  Description of Artificial Sequence: Synthetic polypeptide
AEEEIRTTNPVATEQYGSVSTTNLQINQNGD

SEQ ID NO: 35260 - protein, 31 aa, Artificial Sequence
  Description of Artificial Sequence: Synthetic polypeptide
AEEEIRTTNPVATEQYGSVSTTNLQINENAG

SEQ ID NO: 35261 - protein, 31 aa, Artificial Sequence
  Description of Artificial Sequence: Synthetic polypeptide
AEEEIRTTNPVATEQYGSVSTTNLQIGEEES

SEQ ID NO: 35262 - protein, 30 aa, Artificial Sequence
  Description of Artificial Sequence: Synthetic polypeptide
SEEEIRTTNPVATEMYGSVSNTNLARPDQR

SEQ ID NO: 35263 - protein, 30 aa, Artificial Sequence
  Description of Artificial Sequence: Synthetic polypeptide
AEEEIRTTNPVATEQYGSVSTTNLQGQQTE

SEQ ID NO: 35264 - protein, 31 aa, Artificial Sequence
  Description of Artificial Sequence: Synthetic polypeptide
AEEEIRTTNPVATEQYGSVSTTNLQGQGTVG

SEQ ID NO: 35265 - protein, 32 aa, Artificial Sequence
  Description of Artificial Sequence: Synthetic polypeptide
DEEEIRTTNPVATEQYGCVCSTSELQERGSNQ

SEQ ID NO: 35266 - protein, 30 aa, Artificial Sequence
  Description of Artificial Sequence: Synthetic polypeptide
DEEEIRTTNPVATEQYGCVCSTPTQRGSEQ

SEQ ID NO: 35267 - protein, 31 aa, Artificial Sequence
  Description of Artificial Sequence: Synthetic polypeptide
AEEEIRTTNPVATEQYGSVSTTNLQIQNENG

SEQ ID NO: 35268 - protein, 31 aa, Artificial Sequence
  Description of Artificial Sequence: Synthetic polypeptide
AEEEIRTTNPVATEQYGSVSTTNLQQINAND

SEQ ID NO: 35269 - protein, 31 aa, Artificial Sequence
  Description of Artificial Sequence: Synthetic polypeptide
AEEEIRTTNPVATEQYGSVSTTNLQNQNNDV

SEQ ID NO: 35270 - protein, 29 aa, Artificial Sequence
  Description of Artificial Sequence: Synthetic peptide
SEEEIRTTNPVATEHYGVVSTNLQSGEPM

SEQ ID NO: 35271 - protein, 32 aa, Artificial Sequence
  Description of Artificial Sequence: Synthetic polypeptide
AEEEIRTTNPVATEQYGSVSTTNLQQIGTNPV

SEQ ID NO: 35272 - protein, 32 aa, Artificial Sequence
  Description of Artificial Sequence: Synthetic polypeptide
AEEEIRTTNPVATEQYGSVSTTNLQQGSTNET

SEQ ID NO: 35273 - protein, 32 aa, Artificial Sequence
  Description of Artificial Sequence: Synthetic polypeptide
DEEEIRTTNPVATEQYGCVCSTTELNQRGSDR

SEQ ID NO: 35274 - protein, 31 aa, Artificial Sequence
  Description of Artificial Sequence: Synthetic polypeptide
DEEEIRTTNPMATEQYGCVCGTNLQRGSENA

SEQ ID NO: 35275 - protein, 31 aa, Artificial Sequence
  Description of Artificial Sequence: Synthetic polypeptide
DEEEIRTTNPMATEQYGCVIATNLQRIGNEQ

SEQ ID NO: 35276 - protein, 32 aa, Artificial Sequence
  Description of Artificial Sequence: Synthetic polypeptide
DEEEIRTTNPVATEQYGCVCSTTEEHQRGSNR

SEQ ID NO: 35277 - protein, 30 aa, Artificial Sequence
  Description of Artificial Sequence: Synthetic polypeptide
SEEEIRTTNPVATEGYGSVSNTNLISGDQR

SEQ ID NO: 35278 - protein, 31 aa, Artificial Sequence
  Description of Artificial Sequence: Synthetic polypeptide
DEEEIRTTNPMATEQYGSVAATDNDQRGNGA

SEQ ID NO: 35279 - protein, 31 aa, Artificial Sequence
  Description of Artificial Sequence: Synthetic polypeptide
SEEEIRTTNPVATEHYGYSISTNELQRGEPR

SEQ ID NO: 35280 - protein, 32 aa, Artificial Sequence
  Description of Artificial Sequence: Synthetic polypeptide
AEEEIRTTNPVATEQYGSVSTTNLQQGNGQND

SEQ ID NO: 35281 - protein, 32 aa, Artificial Sequence
  Description of Artificial Sequence: Synthetic polypeptide
AEEEIRTTNPVATEQYGSVSTTNLQQGENDEG

SEQ ID NO: 35282 - protein, 32 aa, Artificial Sequence
  Description of Artificial Sequence: Synthetic polypeptide
DEEEIRTTNPMATEQYGSVAATNLQRDGNNGA

SEQ ID NO: 35283 - protein, 31 aa, Artificial Sequence
  Description of Artificial Sequence: Synthetic polypeptide
AEEEIRTTNPVATEQYGSVSTTNLQQEQGSG

SEQ ID NO: 35284 - protein, 32 aa, Artificial Sequence
  Description of Artificial Sequence: Synthetic polypeptide
AEEEIRTTNPVATEQYGSVSTTNLQQEIGNEN

SEQ ID NO: 35285 - protein, 32 aa, Artificial Sequence
  Description of Artificial Sequence: Synthetic polypeptide
AEEEIRTTNPVATEQYGSVSTTNLQQDTGNGE

SEQ ID NO: 35286 - protein, 32 aa, Artificial Sequence
  Description of Artificial Sequence: Synthetic polypeptide
AEEEIRTTNPVATEQYGSVSTTNLQQAGNNNT

SEQ ID NO: 35287 - protein, 32 aa, Artificial Sequence
  Description of Artificial Sequence: Synthetic polypeptide
AEEEIRTTNPVATEQYGSVSTTNLQNVGNNEN

SEQ ID NO: 35288 - protein, 31 aa, Artificial Sequence
  Description of Artificial Sequence: Synthetic polypeptide
AEEEIRTTNPVATEQYGSVSTTNLQNQVNED

SEQ ID NO: 35289 - protein, 32 aa, Artificial Sequence
  Description of Artificial Sequence: Synthetic polypeptide
AEEEIRTTNPVATEQYGSVSTTNLQQGGNEIA

SEQ ID NO: 35290 - protein, 30 aa, Artificial Sequence
  Description of Artificial Sequence: Synthetic polypeptide
DEEEIRTTNPLATEQYGSVSINEISGRGND

SEQ ID NO: 35291 - protein, 31 aa, Artificial Sequence
  Description of Artificial Sequence: Synthetic polypeptide
AEEEIRTTNPVATEQYGSVSTTNLYGTSGNQ

SEQ ID NO: 35292 - protein, 28 aa, Artificial Sequence
  Description of Artificial Sequence: Synthetic peptide
SEEEIRTTNPTATEEYGSVATNHGRGNA

SEQ ID NO: 35293 - protein, 28 aa, Artificial Sequence
  Description of Artificial Sequence: Synthetic peptide
SEEEIRSTNPIATEQYGNVSNNIQRGQR

SEQ ID NO: 35294 - protein, 33 aa, Artificial Sequence
  Description of Artificial Sequence: Synthetic polypeptide
AEEEIRTTNPVATEQYGSVSTTNNLQQNGTNRE

SEQ ID NO: 35295 - protein, 32 aa, Artificial Sequence
  Description of Artificial Sequence: Synthetic polypeptide
AEEEIRTTNPVATEQYGSVSTTNNLQQNGTER

SEQ ID NO: 35296 - protein, 29 aa, Artificial Sequence
  Description of Artificial Sequence: Synthetic peptide
SEEEIRSTNPIATEQYGSVSENLMSRGQR

SEQ ID NO: 35297 - protein, 29 aa, Artificial Sequence
  Description of Artificial Sequence: Synthetic peptide
SEEEIRSTNPIATEQYGSVSETLMRVGNR

SEQ ID NO: 35298 - protein, 28 aa, Artificial Sequence
  Description of Artificial Sequence: Synthetic peptide
SEEEIRSTNPICTEQYGSVSENLMSGNR

SEQ ID NO: 35299 - protein, 28 aa, Artificial Sequence
  Description of Artificial Sequence: Synthetic peptide
SEEEIRSTNPICTEQYGSVSENLQSGNQ

SEQ ID NO: 35300 - protein, 32 aa, Artificial Sequence
  Description of Artificial Sequence: Synthetic polypeptide
DEEEIRTTNPIATEQYGSVSTTPALPMRNGNR

SEQ ID NO: 35301 - protein, 28 aa, Artificial Sequence
  Description of Artificial Sequence: Synthetic peptide
SEEEIRPTNPIATEQYGIVSCNLMRGTR

SEQ ID NO: 35302 - protein, 28 aa, Artificial Sequence
  Description of Artificial Sequence: Synthetic peptide
SEEEIRSTNPISTEQYGSVAENLMRGNR

SEQ ID NO: 35303 - protein, 32 aa, Artificial Sequence
  Description of Artificial Sequence: Synthetic polypeptide
AEEEIRTTNPVATEQYGSVSTTNNLQNTGGNL

SEQ ID NO: 35304 - protein, 31 aa, Artificial Sequence
  Description of Artificial Sequence: Synthetic polypeptide
AEEEIRTTNPVATEQYGSVSTTNNLQNQNAA

SEQ ID NO: 35305 - protein, 28 aa, Artificial Sequence
  Description of Artificial Sequence: Synthetic peptide
SEEEIRSTNPVATEQYGVVSETLMHGNR

SEQ ID NO: 35306 - protein, 28 aa, Artificial Sequence
  Description of Artificial Sequence: Synthetic peptide
SEEEIRSTNPVATEQYGVVSSTLMHGNR

SEQ ID NO: 35307 - protein, 28 aa, Artificial Sequence
  Description of Artificial Sequence: Synthetic peptide
SEEEIRSTNPVCTEQYGSVSENLMSGNQ

SEQ ID NO: 35308 - protein, 31 aa, Artificial Sequence
  Description of Artificial Sequence: Synthetic polypeptide
DEEEIRTTNPVATEQYGCVCSWNPLQNGSNQ

SEQ ID NO: 35309 - protein, 28 aa, Artificial Sequence
  Description of Artificial Sequence: Synthetic peptide
SEEEIRSVNPVCTEQYGSVSDNLMRGNQ

SEQ ID NO: 35310 - protein, 31 aa, Artificial Sequence
  Description of Artificial Sequence: Synthetic polypeptide
AEEEIRTTNPVATEQYGSVSTTNNLQGQANT

SEQ ID NO: 35311 - protein, 32 aa, Artificial Sequence
  Description of Artificial Sequence: Synthetic polypeptide
AEEEIRTTNPVATEQYGSVSTTNNLQQEGENF

SEQ ID NO: 35312 - protein, 29 aa, Artificial Sequence
  Description of Artificial Sequence: Synthetic peptide
SEEEIRTTNPCATEQYGSCSTNLQEGDQA

SEQ ID NO: 35313 - protein, 29 aa, Artificial Sequence
  Description of Artificial Sequence: Synthetic peptide
DEEEIRTTNPIATEQYGSVSTDLMDHGEL

SEQ ID NO: 35314 - protein, 29 aa, Artificial Sequence
  Description of Artificial Sequence: Synthetic peptide
SEEEIRCTNPVSTEPYGSISMNLQQRGNR

SEQ ID NO: 35315 - protein, 30 aa, Artificial Sequence
  Description of Artificial Sequence: Synthetic polypeptide
SEEEIRCTNPVATEQYGSVSCNEQDRGENG

SEQ ID NO: 35316 - protein, 32 aa, Artificial Sequence
  Description of Artificial Sequence: Synthetic polypeptide
AEEEIRTTNPVATEQYGSVSTTNNNLQDGNVE

SEQ ID NO: 35317 - protein, 30 aa, Artificial Sequence
  Description of Artificial Sequence: Synthetic polypeptide
SEEEIRCTNPVATEQYGSVSENIMSRVGNR

SEQ ID NO: 35318 - protein, 31 aa, Artificial Sequence
  Description of Artificial Sequence: Synthetic polypeptide
SEEEIRCTNPVATEQYGSVSENLPMMRNGNR

SEQ ID NO: 35319 - protein, 30 aa, Artificial Sequence
  Description of Artificial Sequence: Synthetic polypeptide
SEEEIRCTNPVATEQYGSVSENLPMRGENG

SEQ ID NO: 35320 - protein, 29 aa, Artificial Sequence
  Description of Artificial Sequence: Synthetic peptide
SEEEIRCTNPVATEQYGSVSGNIQPGNQL

SEQ ID NO: 35321 - protein, 30 aa, Artificial Sequence
  Description of Artificial Sequence: Synthetic polypeptide
SEEEIRCTNPVATEQYGSVSSTALMMRGNV

SEQ ID NO: 35322 - protein, 32 aa, Artificial Sequence
  Description of Artificial Sequence: Synthetic polypeptide
SEEEIRCTNPVATEQYGSVSSTENLMRNGMNR

SEQ ID NO: 35323 - protein, 31 aa, Artificial Sequence
  Description of Artificial Sequence: Synthetic polypeptide
AEEEIRTTNPVATEQYGSVSTTNNLQSGGDG

SEQ ID NO: 35324 - protein, 30 aa, Artificial Sequence
  Description of Artificial Sequence: Synthetic polypeptide
SEEEIRCTNPVATEQYGSVSTDLEDREGNL

SEQ ID NO: 35325 - protein, 29 aa, Artificial Sequence
  Description of Artificial Sequence: Synthetic peptide
SEEEIRCTNPVATEQYGTVSENLVEFGNR

SEQ ID NO: 35326 - protein, 29 aa, Artificial Sequence
  Description of Artificial Sequence: Synthetic peptide
SEEEIRCTNPVATEVYGSVATNLQGGNIQ

SEQ ID NO: 35327 - protein, 28 aa, Artificial Sequence
  Description of Artificial Sequence: Synthetic peptide
SEEEIRCTNPVCTEQYGSVSDNLMSGNQ

SEQ ID NO: 35328 - protein, 31 aa, Artificial Sequence
  Description of Artificial Sequence: Synthetic polypeptide
DEEEIRTTNPVATEQYGCVDSTNDHQRGSQQ

SEQ ID NO: 35329 - protein, 31 aa, Artificial Sequence
  Description of Artificial Sequence: Synthetic polypeptide
DEEEIRTTNPVATEQYGCVDSTENHQRISND

SEQ ID NO: 35330 - protein, 28 aa, Artificial Sequence
  Description of Artificial Sequence: Synthetic peptide
SEEEIRCTNPVGTEQYGVMASNLQRGNR

SEQ ID NO: 35331 - protein, 32 aa, Artificial Sequence
  Description of Artificial Sequence: Synthetic polypeptide
AEEEIRTTNPVATEQYGSVSTTNNLQTGGINV

SEQ ID NO: 35332 - protein, 32 aa, Artificial Sequence
  Description of Artificial Sequence: Synthetic polypeptide
DEEEIRTTNPVATEQYGCVDQTNLQRFGSERT

SEQ ID NO: 35333 - protein, 30 aa, Artificial Sequence
  Description of Artificial Sequence: Synthetic polypeptide
SEEEIRCTNPVATEQYGSVSTNLQHGDEIA

SEQ ID NO: 35334 - protein, 31 aa, Artificial Sequence
  Description of Artificial Sequence: Synthetic polypeptide
DEEEIRTTNPVATEQYGCVCSWNLQRSGSDQ

SEQ ID NO: 35335 - protein, 32 aa, Artificial Sequence
  Description of Artificial Sequence: Synthetic polypeptide
AEEEIRTTNPVATEQYGSVSTTNNLQGGNISG

SEQ ID NO: 35336 - protein, 30 aa, Artificial Sequence
  Description of Artificial Sequence: Synthetic polypeptide
DEEEIRTTNPIATEQYGTVSATDNPERGND

SEQ ID NO: 35337 - protein, 32 aa, Artificial Sequence
  Description of Artificial Sequence: Synthetic polypeptide
AEEEIRTTNPVATEQYGSVSTTNNLNQEGNNE

SEQ ID NO: 35338 - protein, 30 aa, Artificial Sequence
  Description of Artificial Sequence: Synthetic polypeptide
SEEEIRTTNPIATEQYGSVSAENLMRGEDR

SEQ ID NO: 35339 - protein, 31 aa, Artificial Sequence
  Description of Artificial Sequence: Synthetic polypeptide
SEEEIRTTNPIATEQYGSVSATNLEDRGNDL

SEQ ID NO: 35340 - protein, 31 aa, Artificial Sequence
  Description of Artificial Sequence: Synthetic polypeptide
DEEEIRTTNPLATEAYGCSVSLNELSDRGNR

SEQ ID NO: 35341 - protein, 28 aa, Artificial Sequence
  Description of Artificial Sequence: Synthetic peptide
SEEEIRTTNPIATEQYGSVSENLMHEER

SEQ ID NO: 35342 - protein, 28 aa, Artificial Sequence
  Description of Artificial Sequence: Synthetic peptide
SEEEIRTTNPIATEQYGSVSENLMHENL

SEQ ID NO: 35343 - protein, 29 aa, Artificial Sequence
  Description of Artificial Sequence: Synthetic peptide
SEEEIRTTNPIATEQYGSVSENLMNREDR

SEQ ID NO: 35344 - protein, 32 aa, Artificial Sequence
  Description of Artificial Sequence: Synthetic polypeptide
AEEEIRTTNPVATEQYGSVSTTNNLGQDGNNE

SEQ ID NO: 35345 - protein, 32 aa, Artificial Sequence
  Description of Artificial Sequence: Synthetic polypeptide
AEEEIRTTNPVATEQYGSVSTTNNLNQEGNQD

SEQ ID NO: 35346 - protein, 32 aa, Artificial Sequence
  Description of Artificial Sequence: Synthetic polypeptide
AEEEIRTTNPVATEQYGSVSTTNNLEQIGNES

SEQ ID NO: 35347 - protein, 31 aa, Artificial Sequence
  Description of Artificial Sequence: Synthetic polypeptide
AEEEIRTTNPVATEQYGSVSTTNNIQEVGNQ

SEQ ID NO: 35348 - protein, 30 aa, Artificial Sequence
  Description of Artificial Sequence: Synthetic polypeptide
SEEEIRTTNPIATEQYGSVSEPALPMRGNR

SEQ ID NO: 35349 - protein, 31 aa, Artificial Sequence
  Description of Artificial Sequence: Synthetic polypeptide
SEEEIRTTNPIATEQYGSVSEPNLNRNGMNR

SEQ ID NO: 35350 - protein, 29 aa, Artificial Sequence
  Description of Artificial Sequence: Synthetic peptide
DEEEIRTTNPLATEQYGSVATWELARGKE

SEQ ID NO: 35351 - protein, 31 aa, Artificial Sequence
  Description of Artificial Sequence: Synthetic polypeptide
AEEEIRTTNPVATEQYGSVSTTNNDQGNGNI

SEQ ID NO: 35352 - protein, 29 aa, Artificial Sequence
  Description of Artificial Sequence: Synthetic peptide
DEEEIRTTNPLATEQYGSVPCTWLARGSE

SEQ ID NO: 35353 - protein, 30 aa, Artificial Sequence
  Description of Artificial Sequence: Synthetic polypeptide
DEEEIRTTNPLATEQYGSVPSCNITRGGND

SEQ ID NO: 35354 - protein, 30 aa, Artificial Sequence
  Description of Artificial Sequence: Synthetic polypeptide
SEEEIRTTNPIATEQYGTVSENIMQRNGNR

SEQ ID NO: 35355 - protein, 32 aa, Artificial Sequence
  Description of Artificial Sequence: Synthetic polypeptide
DEEEIRTTNPVATEQYGCVCSWGNDLQFGSNR

SEQ ID NO: 35356 - protein, 28 aa, Artificial Sequence
  Description of Artificial Sequence: Synthetic peptide
SEEEIRTTNPIATEQYGSVPENLQREEK

SEQ ID NO: 35357 - protein, 28 aa, Artificial Sequence
  Description of Artificial Sequence: Synthetic peptide
SEEEIRTTNPIATEQYGSVPENLMRENK

SEQ ID NO: 35358 - protein, 28 aa, Artificial Sequence
  Description of Artificial Sequence: Synthetic peptide
SEEEIRTTNPIATEQYGSISENLMQGNH

SEQ ID NO: 35359 - protein, 30 aa, Artificial Sequence
  Description of Artificial Sequence: Synthetic polypeptide
DEEEIRTTNPIATEQYGTVSATDNPMRGND

SEQ ID NO: 35360 - protein, 28 aa, Artificial Sequence
  Description of Artificial Sequence: Synthetic peptide
SEEEIRTTNPIATEQWGDVSEILMRGNR

SEQ ID NO: 35361 - protein, 29 aa, Artificial Sequence
  Description of Artificial Sequence: Synthetic peptide
SEEEIRTTNPIATEQWGSVSCINLMRGNG

SEQ ID NO: 35362 - protein, 32 aa, Artificial Sequence
  Description of Artificial Sequence: Synthetic polypeptide
AEEEIRTTNPVATEQYGSVSTTNNLQEGNGNF

SEQ ID NO: 35363 - protein, 32 aa, Artificial Sequence
  Description of Artificial Sequence: Synthetic polypeptide
AEEEIRTTNPVATEQYGSVSTTNNLQEGGNIA

SEQ ID NO: 35364 - protein, 32 aa, Artificial Sequence
  Description of Artificial Sequence: Synthetic polypeptide
AEEEIRTTNPVATEQYGSVSTTNNLQEGENAN

SEQ ID NO: 35365 - protein, 29 aa, Artificial Sequence
  Description of Artificial Sequence: Synthetic peptide
SEEEIRTTNPIATEQWGSVSENEPMRGNR

SEQ ID NO: 35366 - protein, 30 aa, Artificial Sequence
  Description of Artificial Sequence: Synthetic polypeptide
SEEEIRTTNPIATEQWGSVSENEPQRGENR

SEQ ID NO: 35367 - protein, 32 aa, Artificial Sequence
  Description of Artificial Sequence: Synthetic polypeptide
AEEEIRTTNPVATEQYGSVSTTNNLQDGNAET

SEQ ID NO: 35368 - protein, 28 aa, Artificial Sequence
  Description of Artificial Sequence: Synthetic peptide
SEEEIRTTNPIATEQWGSVSENLMRGDA

SEQ ID NO: 35369 - protein, 32 aa, Artificial Sequence
  Description of Artificial Sequence: Synthetic polypeptide
AEEEIRTTNPVATEQYGSVSTTNNLQATGENT

SEQ ID NO: 35370 - protein, 28 aa, Artificial Sequence
  Description of Artificial Sequence: Synthetic peptide
SEEEIRTTNPIATEQYGDVSENLMHENR

SEQ ID NO: 35371 - protein, 32 aa, Artificial Sequence
  Description of Artificial Sequence: Synthetic polypeptide
DEEEIRTTNPVATEQYGCVCSWNLQENFGNRN

SEQ ID NO: 35372 - protein, 32 aa, Artificial Sequence
  Description of Artificial Sequence: Synthetic polypeptide
DEEEIRTTNPVATEQYGCVCSWNLQASGSNRG

SEQ ID NO: 35373 - protein, 32 aa, Artificial Sequence
  Description of Artificial Sequence: Synthetic polypeptide
AEEEIRTTNPVATEQYGSVSTTNNLNQSGNGV

SEQ ID NO: 35374 - protein, 33 aa, Artificial Sequence
  Description of Artificial Sequence: Synthetic polypeptide
DEEEIRTTNPVATEQYGCVCSWNLEQRSGSNRT

SEQ ID NO: 35375 - protein, 28 aa, Artificial Sequence
  Description of Artificial Sequence: Synthetic peptide
SEEEIRTTNPIATEQYGEVSENCMRGER

SEQ ID NO: 35376 - protein, 32 aa, Artificial Sequence
  Description of Artificial Sequence: Synthetic polypeptide
DEEEIRTTNPVATEQYGCVCSWNLDQERGSNQ

SEQ ID NO: 35377 - protein, 29 aa, Artificial Sequence
  Description of Artificial Sequence: Synthetic peptide
SEEEIRTTNPIATEQYGSISENIQQQGNR

SEQ ID NO: 35378 - protein, 32 aa, Artificial Sequence
  Description of Artificial Sequence: Synthetic polypeptide
DEEEIRTTNPMATEQYGSVPACTNLQRVGNQA

SEQ ID NO: 35379 - protein, 31 aa, Artificial Sequence
  Description of Artificial Sequence: Synthetic polypeptide
DEEEIRTTNPMATEQYGSVPATNLSQDGNYA

SEQ ID NO: 35380 - protein, 32 aa, Artificial Sequence
  Description of Artificial Sequence: Synthetic polypeptide
DEEEIRTTNPMATEQYGSVPATNLSQRTGNNA

SEQ ID NO: 35381 - protein, 32 aa, Artificial Sequence
  Description of Artificial Sequence: Synthetic polypeptide
AEEEIRTTNPVATEQYGSVSTTNLQGGQGTNN

SEQ ID NO: 35382 - protein, 30 aa, Artificial Sequence
  Description of Artificial Sequence: Synthetic polypeptide
SEEEIRTTNPVATEQYGSVATNLQRPEDHM

SEQ ID NO: 35383 - protein, 30 aa, Artificial Sequence
  Description of Artificial Sequence: Synthetic polypeptide
DEEEIRTTNPVATEQYGCVCSTNTQRFIEQ

SEQ ID NO: 35384 - protein, 32 aa, Artificial Sequence
  Description of Artificial Sequence: Synthetic polypeptide
SEEEIRTTNPVATEQYGSVATSNLEQRGENPN

SEQ ID NO: 35385 - protein, 32 aa, Artificial Sequence
  Description of Artificial Sequence: Synthetic polypeptide
SEEEIRTTNPVATEQYGSVCSTIPLQRGNEDM

SEQ ID NO: 35386 - protein, 31 aa, Artificial Sequence
  Description of Artificial Sequence: Synthetic polypeptide
SEEEIRTTNPVATEQYGSVCSTMLQIDNDRI

SEQ ID NO: 35387 - protein, 31 aa, Artificial Sequence
  Description of Artificial Sequence: Synthetic polypeptide
SEEEIRTTNPVATEQYGSVCSTNHQYGSERP

SEQ ID NO: 35388 - protein, 31 aa, Artificial Sequence
  Description of Artificial Sequence: Synthetic polypeptide
SEEEIRTTNPVATEQYGSVCSTNLQGGSIQS

SEQ ID NO: 35389 - protein, 32 aa, Artificial Sequence
  Description of Artificial Sequence: Synthetic polypeptide
SEEEIRTTNPVATEQYGSVCSTNLQRFISNQP

SEQ ID NO: 35390 - protein, 30 aa, Artificial Sequence
  Description of Artificial Sequence: Synthetic polypeptide
SEEEIRTTNPVATEQYGSVATNLQRNAEED

SEQ ID NO: 35391 - protein, 31 aa, Artificial Sequence
  Description of Artificial Sequence: Synthetic polypeptide
AEEEIRTTNPVATEQYGSVSTTNEQQQGNDG

SEQ ID NO: 35392 - protein, 31 aa, Artificial Sequence
  Description of Artificial Sequence: Synthetic polypeptide
AEEEIRTTNPVATEQYGSVSTTNEQEGNINT

SEQ ID NO: 35393 - protein, 32 aa, Artificial Sequence
  Description of Artificial Sequence: Synthetic polypeptide
AEEEIRTTNPVATEQYGSVSTTNELGQEIGNN

SEQ ID NO: 35394 - protein, 31 aa, Artificial Sequence
  Description of Artificial Sequence: Synthetic polypeptide
AEEEIRTTNPVATEQYGSVSTTNDQSGNNLG

SEQ ID NO: 35395 - protein, 32 aa, Artificial Sequence
  Description of Artificial Sequence: Synthetic polypeptide
SEEEIRTTNPVATEQYGSVESETNNLQTGNAA

SEQ ID NO: 35396 - protein, 32 aa, Artificial Sequence
  Description of Artificial Sequence: Synthetic polypeptide
DEEEIRTTNPVATEQYGCVCSTNPLQFGSDTR

SEQ ID NO: 35397 - protein, 31 aa, Artificial Sequence
  Description of Artificial Sequence: Synthetic polypeptide
AEEEIRTTNPVATEQYGSVSTTNDQIGNGND

SEQ ID NO: 35398 - protein, 30 aa, Artificial Sequence
  Description of Artificial Sequence: Synthetic polypeptide
AEEEIRTTNPVATEQYGSVSTTNDQGQGTA

SEQ ID NO: 35399 - protein, 30 aa, Artificial Sequence
  Description of Artificial Sequence: Synthetic polypeptide
SEEEIRTTNPVATEQYGSVGTALQNFGDRM

SEQ ID NO: 35400 - protein, 31 aa, Artificial Sequence
  Description of Artificial Sequence: Synthetic polypeptide
AEEEIRTTNPVATEQYGSVSTTNEQQLGNNQ

SEQ ID NO: 35401 - protein, 29 aa, Artificial Sequence
  Description of Artificial Sequence: Synthetic peptide
SEEEIRTTNPVATEQYGSVGTALQNGDQG

SEQ ID NO: 35402 - protein, 31 aa, Artificial Sequence
  Description of Artificial Sequence: Synthetic polypeptide
SEEEIRTTNPVATEQYGSVATNLQQDGNENA

SEQ ID NO: 35403 - protein, 29 aa, Artificial Sequence
  Description of Artificial Sequence: Synthetic peptide
DEEEIRTTNPSATEQYGSVCSYSIFRGND

SEQ ID NO: 35404 - protein, 32 aa, Artificial Sequence
  Description of Artificial Sequence: Synthetic polypeptide
SEEEIRTTNPVATEQYGSTSMTENLSQGNGNR

SEQ ID NO: 35405 - protein, 33 aa, Artificial Sequence
  Description of Artificial Sequence: Synthetic polypeptide
SEEEIRTTNPVATEQYGSTVSVTNLSQHVGNTR

SEQ ID NO: 35406 - protein, 29 aa, Artificial Sequence
  Description of Artificial Sequence: Synthetic peptide
SEEEIRTTNPVATEQYGSVAAAMLQQGNP

SEQ ID NO: 35407 - protein, 29 aa, Artificial Sequence
  Description of Artificial Sequence: Synthetic peptide
SEEEIRTTNPVATEQYGSVAFELQNGDFR

SEQ ID NO: 35408 - protein, 31 aa, Artificial Sequence
  Description of Artificial Sequence: Synthetic polypeptide
SEEEIRTTNPVATEQYGSVASNLQERGNSED

SEQ ID NO: 35409 - protein, 29 aa, Artificial Sequence
  Description of Artificial Sequence: Synthetic peptide
SEEEIRTTNPVATEQYGSVATADQHGGFR

SEQ ID NO: 35410 - protein, 28 aa, Artificial Sequence
  Description of Artificial Sequence: Synthetic peptide
SEEEIRTTNPVATEQYGSVATAGQNGFT

SEQ ID NO: 35411 - protein, 29 aa, Artificial Sequence
  Description of Artificial Sequence: Synthetic peptide
DEEEIRTTNPSATCQYGQVVTEDLQRGNF

SEQ ID NO: 35412 - protein, 31 aa, Artificial Sequence
  Description of Artificial Sequence: Synthetic polypeptide
SEEEIRTTNPVATEQYGSVATNLQDQGNEPA

SEQ ID NO: 35413 - protein, 30 aa, Artificial Sequence
  Description of Artificial Sequence: Synthetic polypeptide
SEEEIRTTNPVATEQYGSVATALQEGEFRG

SEQ ID NO: 35414 - protein, 29 aa, Artificial Sequence
  Description of Artificial Sequence: Synthetic peptide
DEEEIRTTNPSATEEYGSVCATNHGRGNA

SEQ ID NO: 35415 - protein, 31 aa, Artificial Sequence
  Description of Artificial Sequence: Synthetic polypeptide
SEEEIRTTNPVATEQYGSVATNLERADNNRM

SEQ ID NO: 35416 - protein, 30 aa, Artificial Sequence
  Description of Artificial Sequence: Synthetic polypeptide
SEEEIRTTNPVATEQYGSVATNLERDENDD

SEQ ID NO: 35417 - protein, 31 aa, Artificial Sequence
  Description of Artificial Sequence: Synthetic polypeptide
SEEEIRTTNPVATEQYGSVATNLERDENERM

SEQ ID NO: 35418 - protein, 31 aa, Artificial Sequence
  Description of Artificial Sequence: Synthetic polypeptide
SEEEIRTTNPVATEQYGSVATNLNRNGNEEN

SEQ ID NO: 35419 - protein, 31 aa, Artificial Sequence
  Description of Artificial Sequence: Synthetic polypeptide
SEEEIRTTNPVATEQYGSVATNLNRNQNERP

SEQ ID NO: 35420 - protein, 31 aa, Artificial Sequence
  Description of Artificial Sequence: Synthetic polypeptide
SEEEIRTTNPVATEQYGSVATNLQAGPNENL

SEQ ID NO: 35421 - protein, 32 aa, Artificial Sequence
  Description of Artificial Sequence: Synthetic polypeptide
AEEEIRTTNPVATEQYGSVSTTNGNLQQGNIQ

SEQ ID NO: 35422 - protein, 29 aa, Artificial Sequence
  Description of Artificial Sequence: Synthetic peptide
SEEEIRTTNPVATEQYGSVATALQEGQFF

SEQ ID NO: 35423 - protein, 29 aa, Artificial Sequence
  Description of Artificial Sequence: Synthetic peptide
DEEEIRTTNPTATECYGSCSTNLAGGENQ

SEQ ID NO: 35424 - protein, 33 aa, Artificial Sequence
  Description of Artificial Sequence: Synthetic polypeptide
SEEEIRTTNPVATEQYGSVNITSNLDQRGENIR

SEQ ID NO: 35425 - protein, 33 aa, Artificial Sequence
  Description of Artificial Sequence: Synthetic polypeptide
SEEEIRTTNPVATEQYGSVNNTSNLDQRGENVR

SEQ ID NO: 35426 - protein, 30 aa, Artificial Sequence
  Description of Artificial Sequence: Synthetic polypeptide
SEEEIRTTNPVATEQYGSVSEILMNRAGDR

SEQ ID NO: 35427 - protein, 31 aa, Artificial Sequence
  Description of Artificial Sequence: Synthetic polypeptide
AEEEIRTTNPVATEQYGSVSTTLNQIQGNEQ

SEQ ID NO: 35428 - protein, 31 aa, Artificial Sequence
  Description of Artificial Sequence: Synthetic polypeptide
AEEEIRTTNPVATEQYGSVSTTLNQIQGENT

SEQ ID NO: 35429 - protein, 31 aa, Artificial Sequence
  Description of Artificial Sequence: Synthetic polypeptide
AEEEIRTTNPVATEQYGSVSTTLNLQTGGGT

SEQ ID NO: 35430 - protein, 32 aa, Artificial Sequence
  Description of Artificial Sequence: Synthetic polypeptide
AEEEIRTTNPVATEQYGSVSTTLNLQNVNGNE

SEQ ID NO: 35431 - protein, 31 aa, Artificial Sequence
  Description of Artificial Sequence: Synthetic polypeptide
AEEEIRTTNPVATEQYGSVSTTLNLNEGGNE

SEQ ID NO: 35432 - protein, 31 aa, Artificial Sequence
  Description of Artificial Sequence: Synthetic polypeptide
AEEEIRTTNPVATEQYGSVSTTLGQIQGTNG

SEQ ID NO: 35433 - protein, 31 aa, Artificial Sequence
  Description of Artificial Sequence: Synthetic polypeptide
AEEEIRTTNPVATEQYGSVSTTLGQIQGNTE

SEQ ID NO: 35434 - protein, 30 aa, Artificial Sequence
  Description of Artificial Sequence: Synthetic polypeptide
SEEEIRTTNPVATEQYGSVSEDLMDHEGNR

SEQ ID NO: 35435 - protein, 32 aa, Artificial Sequence
  Description of Artificial Sequence: Synthetic polypeptide
SEEEIRTTNPVATEQYGSVSEPNLPNRNGMNR

SEQ ID NO: 35436 - protein, 33 aa, Artificial Sequence
  Description of Artificial Sequence: Synthetic polypeptide
SEEEIRTTNPVATEQYGSVSISNDLNQRGENGR

SEQ ID NO: 35437 - protein, 29 aa, Artificial Sequence
  Description of Artificial Sequence: Synthetic peptide
AEEEIRTTNPVATEQYGSVSTTGGTNGNN

SEQ ID NO: 35438 - protein, 30 aa, Artificial Sequence
  Description of Artificial Sequence: Synthetic polypeptide
SEEEIRTTNPVATEQYGSVSNTNQPLGNMF

SEQ ID NO: 35439 - protein, 30 aa, Artificial Sequence
  Description of Artificial Sequence: Synthetic polypeptide
SEEEIRTTNPVATEQYGSVSPNLQENENFY

SEQ ID NO: 35440 - protein, 30 aa, Artificial Sequence
  Description of Artificial Sequence: Synthetic polypeptide
AEEEIRTTNPVATEQYGSVSTTEQGIGNQE

SEQ ID NO: 35441 - protein, 31 aa, Artificial Sequence
  Description of Artificial Sequence: Synthetic polypeptide
AEEEIRTTNPVATEQYGSVSTTENNQQIGNS

SEQ ID NO: 35442 - protein, 30 aa, Artificial Sequence
  Description of Artificial Sequence: Synthetic polypeptide
SEEEIRTTNPVATEQYGSVSSENGNMRGNV

SEQ ID NO: 35443 - protein, 30 aa, Artificial Sequence
  Description of Artificial Sequence: Synthetic polypeptide
SEEEIRTTNPVATEQYGSVSSTAGNRGMNV

SEQ ID NO: 35444 - protein, 28 aa, Artificial Sequence
  Description of Artificial Sequence: Synthetic peptide
DEEEIRTTNPTATEQYGSVPTWDARGME

SEQ ID NO: 35445 - protein, 29 aa, Artificial Sequence
  Description of Artificial Sequence: Synthetic peptide
SEEEIRTTNPVATEQYGSVSEAGMRGMNV

SEQ ID NO: 35446 - protein, 32 aa, Artificial Sequence
  Description of Artificial Sequence: Synthetic polypeptide
DEEEIRTTNPTATEQYGSVISTMNEQERGDNG

SEQ ID NO: 35447 - protein, 29 aa, Artificial Sequence
  Description of Artificial Sequence: Synthetic peptide
DEEEIRTTNPTATEQYGSVATWLARGEKE

SEQ ID NO: 35448 - protein, 32 aa, Artificial Sequence
  Description of Artificial Sequence: Synthetic polypeptide
AEEEIRTTNPVATEQYGSVSTTNALGQTTGNN

SEQ ID NO: 35449 - protein, 31 aa, Artificial Sequence
  Description of Artificial Sequence: Synthetic polypeptide
AEEEIRTTNPVATEQYGSVSTTLVQNGNNIQ

SEQ ID NO: 35450 - protein, 33 aa, Artificial Sequence
  Description of Artificial Sequence: Synthetic polypeptide
SEEEIRTTNPVATEQYGSVNTGNLKQERGENGR

SEQ ID NO: 35451 - protein, 29 aa, Artificial Sequence
  Description of Artificial Sequence: Synthetic peptide
DEEEIRTTNPTATEEYGSVATNDGRGNEA

SEQ ID NO: 35452 - protein, 31 aa, Artificial Sequence
  Description of Artificial Sequence: Synthetic polypeptide
DEEEIRTTNPVATEQYGCVCSTNPEQNFGNA

SEQ ID NO: 35453 - protein, 32 aa, Artificial Sequence
  Description of Artificial Sequence: Synthetic polypeptide
SEEEIRTTNPVATEQYGSVNTSNLDQRPENNR

SEQ ID NO: 35454 - protein, 31 aa, Artificial Sequence
  Description of Artificial Sequence: Synthetic polypeptide
AEEEIRTTNPVATEQYGSVSTTLTQINGNND

SEQ ID NO: 35455 - protein, 32 aa, Artificial Sequence
  Description of Artificial Sequence: Synthetic polypeptide
SEEEIRTTNPVATEQYGSVNTSNLHQRGENNE

SEQ ID NO: 35456 - protein, 32 aa, Artificial Sequence
  Description of Artificial Sequence: Synthetic polypeptide
SEEEIRTTNPVATEQYGSVNTSNLTQRGENGT

SEQ ID NO: 35457 - protein, 31 aa, Artificial Sequence
  Description of Artificial Sequence: Synthetic polypeptide
AEEEIRTTNPVATEQYGSVSTTLQQLQGNEE

SEQ ID NO: 35458 - protein, 31 aa, Artificial Sequence
  Description of Artificial Sequence: Synthetic polypeptide
AEEEIRTTNPVATEQYGSVSTTLQQLNGTND

SEQ ID NO: 35459 - protein, 33 aa, Artificial Sequence
  Description of Artificial Sequence: Synthetic polypeptide
SEEEIRTTNPVATEQYGSVNTSNPLDQRGENYR

SEQ ID NO: 35460 - protein, 31 aa, Artificial Sequence
  Description of Artificial Sequence: Synthetic polypeptide
AEEEIRTTNPVATEQYGSVSTTLQQIQGNVT

SEQ ID NO: 35461 - protein, 31 aa, Artificial Sequence
  Description of Artificial Sequence: Synthetic polypeptide
AEEEIRTTNPVATEQYGSVSTTLQQGVNTTS

SEQ ID NO: 35462 - protein, 31 aa, Artificial Sequence
  Description of Artificial Sequence: Synthetic polypeptide
SEEEIRTTNPVATEQYGSVSAGNLDEAGNAR

SEQ ID NO: 35463 - protein, 29 aa, Artificial Sequence
  Description of Artificial Sequence: Synthetic peptide
SEEEIRTTNPVATEQYGSVSANLYSIGVG

SEQ ID NO: 35464 - protein, 33 aa, Artificial Sequence
  Description of Artificial Sequence: Synthetic polypeptide
DEEEIRTTNPVATEQYGCVCSTNNPQERGSNRA

SEQ ID NO: 35465 - protein, 32 aa, Artificial Sequence
  Description of Artificial Sequence: Synthetic polypeptide
DEEEIRTTNPVATEQYGCVCSTNNLQYGSNVV

SEQ ID NO: 35466 - protein, 33 aa, Artificial Sequence
  Description of Artificial Sequence: Synthetic polypeptide
SEEEIRTTNPVATEQYGSVSDPSNLEQRGENMR

SEQ ID NO: 35467 - protein, 30 aa, Artificial Sequence
  Description of Artificial Sequence: Synthetic polypeptide
SEEEIRTTNPVATEQYGSTSETVNQANGNR

SEQ ID NO: 35468 - protein, 29 aa, Artificial Sequence
  Description of Artificial Sequence: Synthetic peptide
DEEEIRTTNPIATEQYGSVSEDLEDRGEL

SEQ ID NO: 35469 - protein, 31 aa, Artificial Sequence
  Description of Artificial Sequence: Synthetic polypeptide
AEEEIRTTNPVATEQYGSVSTTNGQTGTNQQ

SEQ ID NO: 35470 - protein, 31 aa, Artificial Sequence
  Description of Artificial Sequence: Synthetic polypeptide
AEEEIRTTNPVATEQYGSVSTTNLDNIGNTT

SEQ ID NO: 35471 - protein, 32 aa, Artificial Sequence
  Description of Artificial Sequence: Synthetic polypeptide
AEEEIRTTNPVATEQYGSVSTTNLNQQTGNLV

SEQ ID NO: 35472 - protein, 30 aa, Artificial Sequence
  Description of Artificial Sequence: Synthetic polypeptide
SEEEIRTTNPVATEPYGSVSTELQQLGNTA

SEQ ID NO: 35473 - protein, 28 aa, Artificial Sequence
  Description of Artificial Sequence: Synthetic peptide
SEEEIRTTNPVATEQWGDVSEILMRGNA

SEQ ID NO: 35474 - protein, 32 aa, Artificial Sequence
  Description of Artificial Sequence: Synthetic polypeptide
AEEEIRTTNPVATEQYGSVSTTNLNQQEQGNM

SEQ ID NO: 35475 - protein, 31 aa, Artificial Sequence
  Description of Artificial Sequence: Synthetic polypeptide
AEEEIRTTNPVATEQYGSVSTTNLNQQEGGG

SEQ ID NO: 35476 - protein, 32 aa, Artificial Sequence
  Description of Artificial Sequence: Synthetic polypeptide
AEEEIRTTNPVATEQYGSVSTTNLNQIQGNTD

SEQ ID NO: 35477 - protein, 32 aa, Artificial Sequence
  Description of Artificial Sequence: Synthetic polypeptide
AEEEIRTTNPVATEQYGSVSTTNLNQIQGNEE

SEQ ID NO: 35478 - protein, 31 aa, Artificial Sequence
  Description of Artificial Sequence: Synthetic polypeptide
DEEEIRTTNPVATEQYGCVCSTPNHQGGSND

SEQ ID NO: 35479 - protein, 31 aa, Artificial Sequence
  Description of Artificial Sequence: Synthetic polypeptide
AEEEIRTTNPVATEQYGSVSTTNLNTGVGNI

SEQ ID NO: 35480 - protein, 32 aa, Artificial Sequence
  Description of Artificial Sequence: Synthetic polypeptide
AEEEIRTTNPVATEQYGSVSTTNLNQGIQGNQ

SEQ ID NO: 35481 - protein, 31 aa, Artificial Sequence
  Description of Artificial Sequence: Synthetic polypeptide
AEEEIRTTNPVATEQYGSVSTTNLNQESNNT

SEQ ID NO: 35482 - protein, 32 aa, Artificial Sequence
  Description of Artificial Sequence: Synthetic polypeptide
DEEEIRTTNPMATEQYGSVVPATNLQRGGNNA

SEQ ID NO: 35483 - protein, 32 aa, Artificial Sequence
  Description of Artificial Sequence: Synthetic polypeptide
AEEEIRTTNPVATEQYGSVSTTNLNQEQGTND

SEQ ID NO: 35484 - protein, 32 aa, Artificial Sequence
  Description of Artificial Sequence: Synthetic polypeptide
AEEEIRTTNPVATEQYGSVSTTNLNQEQGNNT

SEQ ID NO: 35485 - protein, 30 aa, Artificial Sequence
  Description of Artificial Sequence: Synthetic polypeptide
DEEEIRTTNPVATEQYGCVCSTPLQYGDQE

SEQ ID NO: 35486 - protein, 32 aa, Artificial Sequence
  Description of Artificial Sequence: Synthetic polypeptide
AEEEIRTTNPVATEQYGSVSTTNLNQDEGNEG

SEQ ID NO: 35487 - protein, 32 aa, Artificial Sequence
  Description of Artificial Sequence: Synthetic polypeptide
AEEEIRTTNPVATEQYGSVSTTNLNLQVGNGE

SEQ ID NO: 35488 - protein, 31 aa, Artificial Sequence
  Description of Artificial Sequence: Synthetic polypeptide
DEEEIRTTNPVATEQYGCVCSTPLQRGSEHP

SEQ ID NO: 35489 - protein, 32 aa, Artificial Sequence
  Description of Artificial Sequence: Synthetic polypeptide
AEEEIRTTNPVATEQYGSVSTTNLNQGGNNNN

SEQ ID NO: 35490 - protein, 31 aa, Artificial Sequence
  Description of Artificial Sequence: Synthetic polypeptide
AEEEIRTTNPVATEQYGSVSTTNLNLEQGNP

SEQ ID NO: 35491 - protein, 31 aa, Artificial Sequence
  Description of Artificial Sequence: Synthetic polypeptide
AEEEIRTTNPVATEQYGSVSTTNLNTVGNTT

SEQ ID NO: 35492 - protein, 31 aa, Artificial Sequence
  Description of Artificial Sequence: Synthetic polypeptide
AEEEIRTTNPVATEQYGSVSTTNLQAGQGTT

SEQ ID NO: 35493 - protein, 32 aa, Artificial Sequence
  Description of Artificial Sequence: Synthetic polypeptide
AEEEIRTTNPVATEQYGSVSTTNLQGEQGNVA

SEQ ID NO: 35494 - protein, 32 aa, Artificial Sequence
  Description of Artificial Sequence: Synthetic polypeptide
AEEEIRTTNPVATEQYGSVSTTNLQGDGNGET

SEQ ID NO: 35495 - protein, 32 aa, Artificial Sequence
  Description of Artificial Sequence: Synthetic polypeptide
AEEEIRTTNPVATEQYGSVSTTNLQEQIGENN

SEQ ID NO: 35496 - protein, 33 aa, Artificial Sequence
  Description of Artificial Sequence: Synthetic polypeptide
DEEEIRTTNPVATEQYGCVCSTPNLQFFGSNRE

SEQ ID NO: 35497 - protein, 31 aa, Artificial Sequence
  Description of Artificial Sequence: Synthetic polypeptide
AEEEIRTTNPVATEQYGSVSTTNLQENQNQA

SEQ ID NO: 35498 - protein, 31 aa, Artificial Sequence
  Description of Artificial Sequence: Synthetic polypeptide
AEEEIRTTNPVATEQYGSVSTTNLQENNTNS

SEQ ID NO: 35499 - protein, 30 aa, Artificial Sequence
  Description of Artificial Sequence: Synthetic polypeptide
SEEEIRTTNPVATEPYGSVATNLQEAGNHE

SEQ ID NO: 35500 - protein, 32 aa, Artificial Sequence
  Description of Artificial Sequence: Synthetic polypeptide
AEEEIRTTNPVATEQYGSVSTTNLQEIGTNAN

SEQ ID NO: 35501 - protein, 30 aa, Artificial Sequence
  Description of Artificial Sequence: Synthetic polypeptide
SEEEIRTTNPVATEPYGSVSNTNLHQGDQR

SEQ ID NO: 35502 - protein, 32 aa, Artificial Sequence
  Description of Artificial Sequence: Synthetic polypeptide
AEEEIRTTNPVATEQYGSVSTTNLQEIGNTND

SEQ ID NO: 35503 - protein, 32 aa, Artificial Sequence
  Description of Artificial Sequence: Synthetic polypeptide
AEEEIRTTNPVATEQYGSVSTTNLQEGNGIND

SEQ ID NO: 35504 - protein, 32 aa, Artificial Sequence
  Description of Artificial Sequence: Synthetic polypeptide
AEEEIRTTNPVATEQYGSVSTTNLQEGGTNIA

SEQ ID NO: 35505 - protein, 32 aa, Artificial Sequence
  Description of Artificial Sequence: Synthetic polypeptide
AEEEIRTTNPVATEQYGSVSTTNLQEAEGGNY

SEQ ID NO: 35506 - protein, 32 aa, Artificial Sequence
  Description of Artificial Sequence: Synthetic polypeptide
AEEEIRTTNPVATEQYGSVSTTNLQDNGENVE

SEQ ID NO: 35507 - protein, 32 aa, Artificial Sequence
  Description of Artificial Sequence: Synthetic polypeptide
AEEEIRTTNPVATEQYGSVSTTNLQDGNNNEY

SEQ ID NO: 35508 - protein, 32 aa, Artificial Sequence
  Description of Artificial Sequence: Synthetic polypeptide
AEEEIRTTNPVATEQYGSVSTTNLQDGENAEN

SEQ ID NO: 35509 - protein, 32 aa, Artificial Sequence
  Description of Artificial Sequence: Synthetic polypeptide
AEEEIRTTNPVATEQYGSVSTTNLQDEIGNNT

SEQ ID NO: 35510 - protein, 32 aa, Artificial Sequence
  Description of Artificial Sequence: Synthetic polypeptide
SEEEIRTTNPVATEPYGSVSCTNALHRGGDNR

SEQ ID NO: 35511 - protein, 32 aa, Artificial Sequence
  Description of Artificial Sequence: Synthetic polypeptide
AEEEIRTTNPVATEQYGSVSTTNLQEGQGTNE

SEQ ID NO: 35512 - protein, 32 aa, Artificial Sequence
  Description of Artificial Sequence: Synthetic polypeptide
AEEEIRTTNPVATEQYGSVSTTNLNEQQGNTN

SEQ ID NO: 35513 - protein, 30 aa, Artificial Sequence
  Description of Artificial Sequence: Synthetic polypeptide
SEEEIRTTNPVATEQYGCVATNLQREGGDP

SEQ ID NO: 35514 - protein, 31 aa, Artificial Sequence
  Description of Artificial Sequence: Synthetic polypeptide
DEEEIRTTNPVATEQYGCVCSTPLNQYGSNA

SEQ ID NO: 35515 - protein, 32 aa, Artificial Sequence
  Description of Artificial Sequence: Synthetic polypeptide
SEEEIRTTNPVATEQYGCVSTGNLNQRGSNTQ

SEQ ID NO: 35516 - protein, 30 aa, Artificial Sequence
  Description of Artificial Sequence: Synthetic polypeptide
SEEEIRTTNPVATEQYGCVSTNHQRFTSNQ

SEQ ID NO: 35517 - protein, 32 aa, Artificial Sequence
  Description of Artificial Sequence: Synthetic polypeptide
AEEEIRTTNPVATEQYGSVSTTNLLGQNGENS

SEQ ID NO: 35518 - protein, 31 aa, Artificial Sequence
  Description of Artificial Sequence: Synthetic polypeptide
SEEEIRTTNPVATEQYGCVSTNLQERSGSEQ

SEQ ID NO: 35519 - protein, 30 aa, Artificial Sequence
  Description of Artificial Sequence: Synthetic polypeptide
AEEEIRTTNPVATEQYGSVSTTNLINEQNG

SEQ ID NO: 35520 - protein, 30 aa, Artificial Sequence
  Description of Artificial Sequence: Synthetic polypeptide
AEEEIRTTNPVATEQYGSVSTTNLINENTG

SEQ ID NO: 35521 - protein, 32 aa, Artificial Sequence
  Description of Artificial Sequence: Synthetic polypeptide
AEEEIRTTNPVATEQYGSVSTTNLGQQIGNNF

SEQ ID NO: 35522 - protein, 32 aa, Artificial Sequence
  Description of Artificial Sequence: Synthetic polypeptide
AEEEIRTTNPVATEQYGSVSTTNLGQQGNNQT

SEQ ID NO: 35523 - protein, 32 aa, Artificial Sequence
  Description of Artificial Sequence: Synthetic polypeptide
SEEEIRTTNPVATEQYGCVSTGNLDQNGSNFR

SEQ ID NO: 35524 - protein, 30 aa, Artificial Sequence
  Description of Artificial Sequence: Synthetic polypeptide
SEEEIRTTNPVATEQYGCVSTNLQNNSNFQ

SEQ ID NO: 35525 - protein, 32 aa, Artificial Sequence
  Description of Artificial Sequence: Synthetic polypeptide
AEEEIRTTNPVATEQYGSVSTTNLGQEENGNM

SEQ ID NO: 35526 - protein, 31 aa, Artificial Sequence
  Description of Artificial Sequence: Synthetic polypeptide
AEEEIRTTNPVATEQYGSVSTTNLGAGNQQE

SEQ ID NO: 35527 - protein, 31 aa, Artificial Sequence
  Description of Artificial Sequence: Synthetic polypeptide
AEEEIRTTNPVATEQYGSVSTTNLEQGNLTN

SEQ ID NO: 35528 - protein, 32 aa, Artificial Sequence
  Description of Artificial Sequence: Synthetic polypeptide
AEEEIRTTNPVATEQYGSVSTTNLEQEGNQNN

SEQ ID NO: 35529 - protein, 31 aa, Artificial Sequence
  Description of Artificial Sequence: Synthetic polypeptide
AEEEIRTTNPVATEQYGSVSTTNLEDGGNTN

SEQ ID NO: 35530 - protein, 32 aa, Artificial Sequence
  Description of Artificial Sequence: Synthetic polypeptide
AEEEIRTTNPVATEQYGSVSTTNLDQGQGTNI

SEQ ID NO: 35531 - protein, 32 aa, Artificial Sequence
  Description of Artificial Sequence: Synthetic polypeptide
SEEEIRTTNPVATEQYGQSVSTGNLQRNSNFA

SEQ ID NO: 35532 - protein, 32 aa, Artificial Sequence
  Description of Artificial Sequence: Synthetic polypeptide
AEEEIRTTNPVATEQYGSVSTTNLDNQIGNET

SEQ ID NO: 35533 - protein, 32 aa, Artificial Sequence
  Description of Artificial Sequence: Synthetic polypeptide
AEEEIRTTNPVATEQYGSVSTTNLGQGIGNES

SEQ ID NO: 35534 - protein, 29 aa, Artificial Sequence
  Description of Artificial Sequence: Synthetic peptide
SEEEIRTTNPVATEQYGCVSTEHQYGSNQ

SEQ ID NO: 35535 - protein, 30 aa, Artificial Sequence
  Description of Artificial Sequence: Synthetic polypeptide
SEEEIRTTNPVATEQYGCVSAGNLDEFGNR

SEQ ID NO: 35536 - protein, 32 aa, Artificial Sequence
  Description of Artificial Sequence: Synthetic polypeptide
AEEEIRTTNPVATEQYGSVSTTNLLQGGGTND

SEQ ID NO: 35537 - protein, 31 aa, Artificial Sequence
  Description of Artificial Sequence: Synthetic polypeptide
DEEEIRTTNPVATEQYGCVCSTPLNQNGNQE

SEQ ID NO: 35538 - protein, 31 aa, Artificial Sequence
  Description of Artificial Sequence: Synthetic polypeptide
DEEEIRTTNPVATEQYGCVCSTPLERGSNQY

SEQ ID NO: 35539 - protein, 32 aa, Artificial Sequence
  Description of Artificial Sequence: Synthetic polypeptide
AEEEIRTTNPVATEQYGSVSTTNLLQTQGNND

SEQ ID NO: 35540 - protein, 31 aa, Artificial Sequence
  Description of Artificial Sequence: Synthetic polypeptide
AEEEIRTTNPVATEQYGSVSTTNLLQTGGTT

SEQ ID NO: 35541 - protein, 31 aa, Artificial Sequence
  Description of Artificial Sequence: Synthetic polypeptide
AEEEIRTTNPVATEQYGSVSTTNLLQQQNED

SEQ ID NO: 35542 - protein, 31 aa, Artificial Sequence
  Description of Artificial Sequence: Synthetic polypeptide
SEEEIRTTNPVATEQYGCVCSTEHQRGSNTR

SEQ ID NO: 35543 - protein, 30 aa, Artificial Sequence
  Description of Artificial Sequence: Synthetic polypeptide
DEEEIRTTNPVATEQYGCVCSTPHQHGSNV

SEQ ID NO: 35544 - protein, 28 aa, Artificial Sequence
  Description of Artificial Sequence: Synthetic peptide
DEEEIRTTNPNATEEYGSVATNGERGEA

SEQ ID NO: 35545 - protein, 30 aa, Artificial Sequence
  Description of Artificial Sequence: Synthetic polypeptide
SEEEIRTTNPVATEQYGCVCSTNDQFGSER

SEQ ID NO: 35546 - protein, 32 aa, Artificial Sequence
  Description of Artificial Sequence: Synthetic polypeptide
AEEEIRTTNPVATEQYGSVSTTNLLQQGNNNM

SEQ ID NO: 35547 - protein, 32 aa, Artificial Sequence
  Description of Artificial Sequence: Synthetic polypeptide
AEEEIRTTNPVATEQYGSVSTTNLLQQGNNND

SEQ ID NO: 35548 - protein, 29 aa, Artificial Sequence
  Description of Artificial Sequence: Synthetic peptide
DEEEIRTTNPNATEEYGSVATNHGRMGND

SEQ ID NO: 35549 - protein, 28 aa, Artificial Sequence
  Description of Artificial Sequence: Synthetic peptide
DEEEIRTTNPNATEEYGSVATNHGRNNE

SEQ ID NO: 35550 - protein, 32 aa, Artificial Sequence
  Description of Artificial Sequence: Synthetic polypeptide
AEEEIRTTNPVATEQYGSVSTTNLLQNNGNQD

SEQ ID NO: 35551 - protein, 32 aa, Artificial Sequence
  Description of Artificial Sequence: Synthetic polypeptide
AEEEIRTTNPVATEQYGSVSTTNLLQNNGNNG

SEQ ID NO: 35552 - protein, 32 aa, Artificial Sequence
  Description of Artificial Sequence: Synthetic polypeptide
AEEEIRTTNPVATEQYGSVSTTNLLQNGNMEG

SEQ ID NO: 35553 - protein, 32 aa, Artificial Sequence
  Description of Artificial Sequence: Synthetic polypeptide
AEEEIRTTNPVATEQYGSVSTTNLLQIGGING

SEQ ID NO: 35554 - protein, 30 aa, Artificial Sequence
  Description of Artificial Sequence: Synthetic polypeptide
SEEEIRTTNPVATEQYGCVCSTNLQFNSDR

SEQ ID NO: 35555 - protein, 28 aa, Artificial Sequence
  Description of Artificial Sequence: Synthetic peptide
DEEEIRTTNPNATEEYGSVNTNHGGGNA

SEQ ID NO: 35556 - protein, 31 aa, Artificial Sequence
  Description of Artificial Sequence: Synthetic polypeptide
AEEEIRTTNPVATEQYGSVSTTNLDEGGNNN

SEQ ID NO: 35557 - protein, 29 aa, Artificial Sequence
  Description of Artificial Sequence: Synthetic peptide
SEEEIRCTNPVATEQYGSVSCNEMDRGNG

SEQ ID NO: 35558 - protein, 31 aa, Artificial Sequence
  Description of Artificial Sequence: Synthetic polypeptide
DEEEIRTTNPIATEQYGSVSEALNMRNGNPR

SEQ ID NO: 35559 - protein, 31 aa, Artificial Sequence
  Description of Artificial Sequence: Synthetic polypeptide
SEEEIRCTNPVATEQYGSVATNLQRGENQVQ

SEQ ID NO: 35560 - protein, 29 aa, Artificial Sequence
  Description of Artificial Sequence: Synthetic peptide
SEEEIRCTNPIATEQYGSVSENPVERGNR

SEQ ID NO: 35561 - protein, 29 aa, Artificial Sequence
  Description of Artificial Sequence: Synthetic peptide
SEEEIRCTNPIATEQYGSVSENQMRGLNR

SEQ ID NO: 35562 - protein, 29 aa, Artificial Sequence
  Description of Artificial Sequence: Synthetic peptide
SEEEIRCTNPIATEQYGSVSENQMRGNIR

SEQ ID NO: 35563 - protein, 29 aa, Artificial Sequence
  Description of Artificial Sequence: Synthetic peptide
SEEEIRCTNPIATEQYGSVSENRLMRDNR

SEQ ID NO: 35564 - protein, 30 aa, Artificial Sequence
  Description of Artificial Sequence: Synthetic polypeptide
SEEEIRCTNPIATEQYGSVSENSLDMRGNR

SEQ ID NO: 35565 - protein, 28 aa, Artificial Sequence
  Description of Artificial Sequence: Synthetic peptide
SEEEIRCTNPIATEQYGSVSENTMRGNI

SEQ ID NO: 35566 - protein, 29 aa, Artificial Sequence
  Description of Artificial Sequence: Synthetic peptide
SEEEIRCTNPIATEQYGSVSENTMRPGNR

SEQ ID NO: 35567 - protein, 28 aa, Artificial Sequence
  Description of Artificial Sequence: Synthetic peptide
SEEEIRCTNPIATEQYGSVSENTMTGNR

SEQ ID NO: 35568 - protein, 29 aa, Artificial Sequence
  Description of Artificial Sequence: Synthetic peptide
SEEEIRCTNPIATEQYGSVSENPSRGNRW

SEQ ID NO: 35569 - protein, 30 aa, Artificial Sequence
  Description of Artificial Sequence: Synthetic polypeptide
SEEEIRCTNPIATEQYGSVSENVLMREGNR

SEQ ID NO: 35570 - protein, 28 aa, Artificial Sequence
  Description of Artificial Sequence: Synthetic peptide
SEEEIRCTNPIATEQYGSVSENVMGGNR

SEQ ID NO: 35571 - protein, 29 aa, Artificial Sequence
  Description of Artificial Sequence: Synthetic peptide
SEEEIRCTNPIATEQYGSVSENWLMTGNR

SEQ ID NO: 35572 - protein, 29 aa, Artificial Sequence
  Description of Artificial Sequence: Synthetic peptide
SEEEIRCTNPIATEQYGSVSENWMERGNR

SEQ ID NO: 35573 - protein, 28 aa, Artificial Sequence
  Description of Artificial Sequence: Synthetic peptide
SEEEIRCTNPIATEQYGSVSENWMRGNW

SEQ ID NO: 35574 - protein, 29 aa, Artificial Sequence
  Description of Artificial Sequence: Synthetic peptide
SEEEIRCTNPIATEQYGSVSENWMRQGNR

SEQ ID NO: 35575 - protein, 29 aa, Artificial Sequence
  Description of Artificial Sequence: Synthetic peptide
SEEEIRCTNPIATEQYGSVSEPALMRGNR

SEQ ID NO: 35576 - protein, 30 aa, Artificial Sequence
  Description of Artificial Sequence: Synthetic polypeptide
SEEEIRCTNPIATEQYGSVSEPNELMRGNR

SEQ ID NO: 35577 - protein, 30 aa, Artificial Sequence
  Description of Artificial Sequence: Synthetic polypeptide
SEEEIRCTNPIATEQYGSVSEPNLNRNGNR

SEQ ID NO: 35578 - protein, 31 aa, Artificial Sequence
  Description of Artificial Sequence: Synthetic polypeptide
AEEEIRTTNPVATEQYGSVSTTNQNQIEGNQ

SEQ ID NO: 35579 - protein, 30 aa, Artificial Sequence
  Description of Artificial Sequence: Synthetic polypeptide
SEEEIRCTNPIATEQYGSVSEQNFLMRGNR

SEQ ID NO: 35580 - protein, 28 aa, Artificial Sequence
  Description of Artificial Sequence: Synthetic peptide
SEEEIRCTNPIATEQYGSVSENPMRGNS

SEQ ID NO: 35581 - protein, 29 aa, Artificial Sequence
  Description of Artificial Sequence: Synthetic peptide
SEEEIRCTNPIATEQYGSVSENNMRGGNR

SEQ ID NO: 35582 - protein, 31 aa, Artificial Sequence
  Description of Artificial Sequence: Synthetic polypeptide
AEEEIRTTNPVATEQYGSVSTTNQQQLGNNE

SEQ ID NO: 35583 - protein, 29 aa, Artificial Sequence
  Description of Artificial Sequence: Synthetic peptide
SEEEIRCTNPIATEQYGSVSENLNRGNEA

SEQ ID NO: 35584 - protein, 31 aa, Artificial Sequence
  Description of Artificial Sequence: Synthetic polypeptide
AEEEIRTTNPVATEQYGSVSTTNQQQIGNQV

SEQ ID NO: 35585 - protein, 29 aa, Artificial Sequence
  Description of Artificial Sequence: Synthetic peptide
SEEEIRCTNPIATEQYGSVSENLPHGNAR

SEQ ID NO: 35586 - protein, 29 aa, Artificial Sequence
  Description of Artificial Sequence: Synthetic peptide
SEEEIRCTNPIATEQYGSVSENLQMAGNS

SEQ ID NO: 35587 - protein, 31 aa, Artificial Sequence
  Description of Artificial Sequence: Synthetic polypeptide
AEEEIRTTNPVATEQYGSVSTTNQQNGIENM

SEQ ID NO: 35588 - protein, 29 aa, Artificial Sequence
  Description of Artificial Sequence: Synthetic peptide
SEEEIRCTNPIATEQYGSVSENLSMRENR

SEQ ID NO: 35589 - protein, 29 aa, Artificial Sequence
  Description of Artificial Sequence: Synthetic peptide
SEEEIRCTNPIATEQYGSVSENLTMRGNH

SEQ ID NO: 35590 - protein, 29 aa, Artificial Sequence
  Description of Artificial Sequence: Synthetic peptide
SEEEIRCTNPIATEQYGSVSENPMRGNRA

SEQ ID NO: 35591 - protein, 30 aa, Artificial Sequence
  Description of Artificial Sequence: Synthetic polypeptide
SEEEIRCTNPIATEQYGSVSENLVEREGNR

SEQ ID NO: 35592 - protein, 29 aa, Artificial Sequence
  Description of Artificial Sequence: Synthetic peptide
SEEEIRCTNPIATEQYGSVSENLVMRGNY

SEQ ID NO: 35593 - protein, 30 aa, Artificial Sequence
  Description of Artificial Sequence: Synthetic polypeptide
SEEEIRCTNPIATEQYGSVSENLWMRGNRE

SEQ ID NO: 35594 - protein, 29 aa, Artificial Sequence
  Description of Artificial Sequence: Synthetic peptide
SEEEIRCTNPIATEQYGSVSENLYMPGNR

SEQ ID NO: 35595 - protein, 29 aa, Artificial Sequence
  Description of Artificial Sequence: Synthetic peptide
SEEEIRCTNPIATEQYGSVSENMLMRGNG

SEQ ID NO: 35596 - protein, 30 aa, Artificial Sequence
  Description of Artificial Sequence: Synthetic polypeptide
SEEEIRCTNPIATEQYGSVSENMLMRGNRV

SEQ ID NO: 35597 - protein, 29 aa, Artificial Sequence
  Description of Artificial Sequence: Synthetic peptide
SEEEIRCTNPIATEQYGSVSENMLMRGNW

SEQ ID NO: 35598 - protein, 29 aa, Artificial Sequence
  Description of Artificial Sequence: Synthetic peptide
SEEEIRCTNPIATEQYGSVSENMMRLGNR

SEQ ID NO: 35599 - protein, 30 aa, Artificial Sequence
  Description of Artificial Sequence: Synthetic polypeptide
AEEEIRTTNPVATEQYGSVSTTNQQGNNVD

SEQ ID NO: 35600 - protein, 29 aa, Artificial Sequence
  Description of Artificial Sequence: Synthetic peptide
SEEEIRCTNPIATEQYGSVSENLVIGNQR

SEQ ID NO: 35601 - protein, 29 aa, Artificial Sequence
  Description of Artificial Sequence: Synthetic peptide
SEEEIRCTNPIATEQYGSVSERLMERGNR

SEQ ID NO: 35602 - protein, 29 aa, Artificial Sequence
  Description of Artificial Sequence: Synthetic peptide
SEEEIRCTNPIATEQYGSVSERNLMRGNQ

SEQ ID NO: 35603 - protein, 29 aa, Artificial Sequence
  Description of Artificial Sequence: Synthetic peptide
SEEEIRCTNPIATEQYGSVSESLIMRGNR

SEQ ID NO: 35604 - protein, 29 aa, Artificial Sequence
  Description of Artificial Sequence: Synthetic peptide
SEEEIRCTNPIATEQYGSVSEYLMRTGNR

SEQ ID NO: 35605 - protein, 29 aa, Artificial Sequence
  Description of Artificial Sequence: Synthetic peptide
SEEEIRCTNPIATEQYGSVSEYLMVRGNR

SEQ ID NO: 35606 - protein, 29 aa, Artificial Sequence
  Description of Artificial Sequence: Synthetic peptide
SEEEIRCTNPIATEQYGSVSEYNHMRGNR

SEQ ID NO: 35607 - protein, 30 aa, Artificial Sequence
  Description of Artificial Sequence: Synthetic polypeptide
AEEEIRTTNPVATEQYGSVSTTNQLEQQNN

SEQ ID NO: 35608 - protein, 31 aa, Artificial Sequence
  Description of Artificial Sequence: Synthetic polypeptide
DEEEIRTTNPVATEQYGCVSNTEEHQNGSNR

SEQ ID NO: 35609 - protein, 32 aa, Artificial Sequence
  Description of Artificial Sequence: Synthetic polypeptide
AEEEIRTTNPVATEQYGSVSTTNQLEQQGNQG

SEQ ID NO: 35610 - protein, 32 aa, Artificial Sequence
  Description of Artificial Sequence: Synthetic polypeptide
AEEEIRTTNPVATEQYGSVSTTNQLEQEQGNG

SEQ ID NO: 35611 - protein, 31 aa, Artificial Sequence
  Description of Artificial Sequence: Synthetic polypeptide
AEEEIRTTNPVATEQYGSVSTTNQDQGNGNN

SEQ ID NO: 35612 - protein, 28 aa, Artificial Sequence
  Description of Artificial Sequence: Synthetic peptide
SEEEIRCTNPIATEQYGSVSEYLMRPNR

SEQ ID NO: 35613 - protein, 30 aa, Artificial Sequence
  Description of Artificial Sequence: Synthetic polypeptide
SEEEIRCTNPIATEQYGSVSGENLMRGGNR

SEQ ID NO: 35614 - protein, 31 aa, Artificial Sequence
  Description of Artificial Sequence: Synthetic polypeptide
DEEEIRTTNPVATEQYGCVSMTNDQNFGNQS

SEQ ID NO: 35615 - protein, 30 aa, Artificial Sequence
  Description of Artificial Sequence: Synthetic polypeptide
SEEEIRCTNPIATEQYGSVSGENWLMRGNR

SEQ ID NO: 35616 - protein, 29 aa, Artificial Sequence
  Description of Artificial Sequence: Synthetic peptide
SEEEIRCTNPIATEQYGSVSGESLMRGNR

SEQ ID NO: 35617 - protein, 33 aa, Artificial Sequence
  Description of Artificial Sequence: Synthetic polypeptide
DEEEIRTTNPVATEQYGCVSMTGNLQYFGSNRS

SEQ ID NO: 35618 - protein, 32 aa, Artificial Sequence
  Description of Artificial Sequence: Synthetic polypeptide
DEEEIRTTNPVATEQYGCVSMTGNHQRGGSNA

SEQ ID NO: 35619 - protein, 30 aa, Artificial Sequence
  Description of Artificial Sequence: Synthetic polypeptide
SEEEIRCTNPIATEQYGSVSHENLMRGNRM

SEQ ID NO: 35620 - protein, 31 aa, Artificial Sequence
  Description of Artificial Sequence: Synthetic polypeptide
AEEEIRTTNPVATEQYGSVSTTNNQYGNQGE

SEQ ID NO: 35621 - protein, 31 aa, Artificial Sequence
  Description of Artificial Sequence: Synthetic polypeptide
AEEEIRTTNPVATEQYGSVSTTNNQQTGNTT

SEQ ID NO: 35622 - protein, 30 aa, Artificial Sequence
  Description of Artificial Sequence: Synthetic polypeptide
SEEEIRCTNPIATEQYGSVSGENLMRGNRL

SEQ ID NO: 35623 - protein, 29 aa, Artificial Sequence
  Description of Artificial Sequence: Synthetic peptide
SEEEIRCTNPIATEQYGSVSEWNLMRGGR

SEQ ID NO: 35624 - protein, 29 aa, Artificial Sequence
  Description of Artificial Sequence: Synthetic peptide
SEEEIRCTNPIATEQYGSVSEWGLMRGNR

SEQ ID NO: 35625 - protein, 28 aa, Artificial Sequence
  Description of Artificial Sequence: Synthetic peptide
SEEEIRCTNPIATEQYGSVSEWAMRGNR

SEQ ID NO: 35626 - protein, 32 aa, Artificial Sequence
  Description of Artificial Sequence: Synthetic polypeptide
AEEEIRTTNPVATEQYGSVSTTNQLVQQGNND

SEQ ID NO: 35627 - protein, 29 aa, Artificial Sequence
  Description of Artificial Sequence: Synthetic peptide
SEEEIRCTNPIATEQYGSVSESLMRAGNR

SEQ ID NO: 35628 - protein, 29 aa, Artificial Sequence
  Description of Artificial Sequence: Synthetic peptide
SEEEIRCTNPIATEQYGSVSESNLMRGNE

SEQ ID NO: 35629 - protein, 30 aa, Artificial Sequence
  Description of Artificial Sequence: Synthetic polypeptide
SEEEIRCTNPIATEQYGSVSESNLMRIGNR

SEQ ID NO: 35630 - protein, 28 aa, Artificial Sequence
  Description of Artificial Sequence: Synthetic peptide
SEEEIRCTNPIATEQYGSVSETLMHGNR

SEQ ID NO: 35631 - protein, 32 aa, Artificial Sequence
  Description of Artificial Sequence: Synthetic polypeptide
AEEEIRTTNPVATEQYGSVSTTNQLQNGNNGT

SEQ ID NO: 35632 - protein, 29 aa, Artificial Sequence
  Description of Artificial Sequence: Synthetic peptide
SEEEIRCTNPIATEQYGSVSETLMRGNRI

SEQ ID NO: 35633 - protein, 29 aa, Artificial Sequence
  Description of Artificial Sequence: Synthetic peptide
SEEEIRCTNPIATEQYGSVSETLMRVGNR

SEQ ID NO: 35634 - protein, 32 aa, Artificial Sequence
  Description of Artificial Sequence: Synthetic polypeptide
AEEEIRTTNPVATEQYGSVSTTNQLQGNGNNQ

SEQ ID NO: 35635 - protein, 32 aa, Artificial Sequence
  Description of Artificial Sequence: Synthetic polypeptide
AEEEIRTTNPVATEQYGSVSTTNQLQGGTANT

SEQ ID NO: 35636 - protein, 32 aa, Artificial Sequence
  Description of Artificial Sequence: Synthetic polypeptide
AEEEIRTTNPVATEQYGSVSTTNQLQGDGNIE

SEQ ID NO: 35637 - protein, 32 aa, Artificial Sequence
  Description of Artificial Sequence: Synthetic polypeptide
AEEEIRTTNPVATEQYGSVSTTNQLQEIGNNN

SEQ ID NO: 35638 - protein, 32 aa, Artificial Sequence
  Description of Artificial Sequence: Synthetic polypeptide
AEEEIRTTNPVATEQYGSVSTTNQLQEGGINS

SEQ ID NO: 35639 - protein, 32 aa, Artificial Sequence
  Description of Artificial Sequence: Synthetic polypeptide
AEEEIRTTNPVATEQYGSVSTTNQLQDGNNVG

SEQ ID NO: 35640 - protein, 29 aa, Artificial Sequence
  Description of Artificial Sequence: Synthetic peptide
SEEEIRCTNPIATEQYGSVSEVFLMRGNR

SEQ ID NO: 35641 - protein, 29 aa, Artificial Sequence
  Description of Artificial Sequence: Synthetic peptide
SEEEIRCTNPIATEQYGSVSEVGLMRGNR

SEQ ID NO: 35642 - protein, 28 aa, Artificial Sequence
  Description of Artificial Sequence: Synthetic peptide
SEEEIRCTNPIATEQYGSVSEVLMRGSR

SEQ ID NO: 35643 - protein, 29 aa, Artificial Sequence
  Description of Artificial Sequence: Synthetic peptide
SEEEIRCTNPIATEQYGSVSEVNLMRHNR

SEQ ID NO: 35644 - protein, 28 aa, Artificial Sequence
  Description of Artificial Sequence: Synthetic peptide
DEEEIRTTNPIATDQWGQVPTDLQRGNF

SEQ ID NO: 35645 - protein, 30 aa, Artificial Sequence
  Description of Artificial Sequence: Synthetic polypeptide
SEEEIRCTNPIATEQYGSVSENLNMRGHNR

SEQ ID NO: 35646 - protein, 30 aa, Artificial Sequence
  Description of Artificial Sequence: Synthetic polypeptide
SEEEIRCTNPIATEQYGSVSIENLIERGNR

SEQ ID NO: 35647 - protein, 31 aa, Artificial Sequence
  Description of Artificial Sequence: Synthetic polypeptide
AEEEIRTTNPVATEQYGSVSTTNQQQNGTNT

SEQ ID NO: 35648 - protein, 30 aa, Artificial Sequence
  Description of Artificial Sequence: Synthetic polypeptide
DEEEIRTTNPFATEQYGSVSYVNIEFRGND

SEQ ID NO: 35649 - protein, 29 aa, Artificial Sequence
  Description of Artificial Sequence: Synthetic peptide
SEEEIRCTNPIATEQYGSVSENLMREGNL

SEQ ID NO: 35650 - protein, 30 aa, Artificial Sequence
  Description of Artificial Sequence: Synthetic polypeptide
SEEEIRCTNPIATEQYGSVSENLMRGANTR

SEQ ID NO: 35651 - protein, 29 aa, Artificial Sequence
  Description of Artificial Sequence: Synthetic peptide
SEEEIRCTNPIATEQYGSVSENLMRGDMR

SEQ ID NO: 35652 - protein, 30 aa, Artificial Sequence
  Description of Artificial Sequence: Synthetic polypeptide
SEEEIRCTNPIATEQYGSVSENLMRGDNRF

SEQ ID NO: 35653 - protein, 29 aa, Artificial Sequence
  Description of Artificial Sequence: Synthetic peptide
AEEEIRTTNPVATEQYGSVSTTQQGTENN

SEQ ID NO: 35654 - protein, 29 aa, Artificial Sequence
  Description of Artificial Sequence: Synthetic peptide
SEEEIRCTNPIATEQYGSVSENLMRGFRG

SEQ ID NO: 35655 - protein, 29 aa, Artificial Sequence
  Description of Artificial Sequence: Synthetic peptide
SEEEIRCTNPIATEQYGSVSENLMRGGNH

SEQ ID NO: 35656 - protein, 29 aa, Artificial Sequence
  Description of Artificial Sequence: Synthetic peptide
SEEEIRCTNPIATEQYGSVSENLMRGGRQ

SEQ ID NO: 35657 - protein, 29 aa, Artificial Sequence
  Description of Artificial Sequence: Synthetic peptide
SEEEIRCTNPIATEQYGSVSENLMREGNG

SEQ ID NO: 35658 - protein, 30 aa, Artificial Sequence
  Description of Artificial Sequence: Synthetic polypeptide
SEEEIRCTNPIATEQYGSVSENLMRGHNRI

SEQ ID NO: 35659 - protein, 28 aa, Artificial Sequence
  Description of Artificial Sequence: Synthetic peptide
SEEEIRCTNPIATEQYGSVSENLMRGMC

SEQ ID NO: 35660 - protein, 29 aa, Artificial Sequence
  Description of Artificial Sequence: Synthetic peptide
SEEEIRCTNPIATEQYGSVSENLMRGMFR

SEQ ID NO: 35661 - protein, 29 aa, Artificial Sequence
  Description of Artificial Sequence: Synthetic peptide
SEEEIRCTNPIATEQYGSVSENLMRGMNV

SEQ ID NO: 35662 - protein, 29 aa, Artificial Sequence
  Description of Artificial Sequence: Synthetic peptide
SEEEIRCTNPIATEQYGSVSENLMRGNDK

SEQ ID NO: 35663 - protein, 31 aa, Artificial Sequence
  Description of Artificial Sequence: Synthetic polypeptide
AEEEIRTTNPVATEQYGSVSTTQNLNTVGNN

SEQ ID NO: 35664 - protein, 29 aa, Artificial Sequence
  Description of Artificial Sequence: Synthetic peptide
SEEEIRCTNPIATEQYGSVSENLMRGNFH

SEQ ID NO: 35665 - protein, 29 aa, Artificial Sequence
  Description of Artificial Sequence: Synthetic peptide
AEEEIRTTNPVATEQYGSVSTTQLQTICG

SEQ ID NO: 35666 - protein, 30 aa, Artificial Sequence
  Description of Artificial Sequence: Synthetic polypeptide
SEEEIRCTNPIATEQYGSVSENLMRGNGRE

SEQ ID NO: 35667 - protein, 31 aa, Artificial Sequence
  Description of Artificial Sequence: Synthetic polypeptide
AEEEIRTTNPVATEQYGSVSTTQNNQQEGNL

SEQ ID NO: 35668 - protein, 29 aa, Artificial Sequence
  Description of Artificial Sequence: Synthetic peptide
SEEEIRCTNPIATEQYGSVSENLMRGNHH

SEQ ID NO: 35669 - protein, 30 aa, Artificial Sequence
  Description of Artificial Sequence: Synthetic polypeptide
AEEEIRTTNPVATEQYGSVSTTQQQDGGNP

SEQ ID NO: 35670 - protein, 28 aa, Artificial Sequence
  Description of Artificial Sequence: Synthetic peptide
SEEEIRCTNPIATEQYGSVSENLMPRNR

SEQ ID NO: 35671 - protein, 32 aa, Artificial Sequence
  Description of Artificial Sequence: Synthetic polypeptide
AEEEIRTTNPVATEQYGSVSTTSNLQNNGTNS

SEQ ID NO: 35672 - protein, 32 aa, Artificial Sequence
  Description of Artificial Sequence: Synthetic polypeptide
AEEEIRTTNPVATEQYGSVSTTSNLQNNGNND

SEQ ID NO: 35673 - protein, 31 aa, Artificial Sequence
  Description of Artificial Sequence: Synthetic polypeptide
DEEEIRTTNPVATEQYGCVSNTGNHQNFGNA

SEQ ID NO: 35674 - protein, 30 aa, Artificial Sequence
  Description of Artificial Sequence: Synthetic polypeptide
SEEEIRCTNPIATEQYGSVSENLMGRGINR

SEQ ID NO: 35675 - protein, 31 aa, Artificial Sequence
  Description of Artificial Sequence: Synthetic polypeptide
AEEEIRTTNPVATEQYGSVSTTSNLNQEENM

SEQ ID NO: 35676 - protein, 28 aa, Artificial Sequence
  Description of Artificial Sequence: Synthetic peptide
SEEEIRCTNPIATEQYGSVSENLMHGDR

SEQ ID NO: 35677 - protein, 28 aa, Artificial Sequence
  Description of Artificial Sequence: Synthetic peptide
SEEEIRCTNPIATEQYGSVSENLMHGER

SEQ ID NO: 35678 - protein, 29 aa, Artificial Sequence
  Description of Artificial Sequence: Synthetic peptide
SEEEIRCTNPIATEQYGSVSENLMHGNRF

SEQ ID NO: 35679 - protein, 28 aa, Artificial Sequence
  Description of Artificial Sequence: Synthetic peptide
SEEEIRCTNPIATEQYGSVSENLMRAND

SEQ ID NO: 35680 - protein, 30 aa, Artificial Sequence
  Description of Artificial Sequence: Synthetic polypeptide
SEEEIRCTNPIATEQYGSVSENLMHRGNRG

SEQ ID NO: 35681 - protein, 29 aa, Artificial Sequence
  Description of Artificial Sequence: Synthetic peptide
SEEEIRCTNPIATEQYGSVSENLMKGNRT

SEQ ID NO: 35682 - protein, 29 aa, Artificial Sequence
  Description of Artificial Sequence: Synthetic peptide
SEEEIRCTNPIATEQYGSVSENLMLNGNR

SEQ ID NO: 35683 - protein, 29 aa, Artificial Sequence
  Description of Artificial Sequence: Synthetic peptide
SEEEIRCTNPIATEQYGSVSENLMLRGHR

SEQ ID NO: 35684 - protein, 31 aa, Artificial Sequence
  Description of Artificial Sequence: Synthetic polypeptide
AEEEIRTTNPVATEQYGSVSTTSNENQEGND

SEQ ID NO: 35685 - protein, 29 aa, Artificial Sequence
  Description of Artificial Sequence: Synthetic peptide
SEEEIRCTNPIATEQYGSVSENLMMGNRM

SEQ ID NO: 35686 - protein, 29 aa, Artificial Sequence
  Description of Artificial Sequence: Synthetic peptide
SEEEIRCTNPIATEQYGSVSENLMMHGNR

SEQ ID NO: 35687 - protein, 29 aa, Artificial Sequence
  Description of Artificial Sequence: Synthetic peptide
SEEEIRCTNPIATEQYGSVSENLMMRGNT

SEQ ID NO: 35688 - protein, 29 aa, Artificial Sequence
  Description of Artificial Sequence: Synthetic peptide
SEEEIRCTNPIATEQYGSVSENLMNRENR

SEQ ID NO: 35689 - protein, 30 aa, Artificial Sequence
  Description of Artificial Sequence: Synthetic polypeptide
SEEEIRCTNPIATEQYGSVSENLMIRGGNR

SEQ ID NO: 35690 - protein, 31 aa, Artificial Sequence
  Description of Artificial Sequence: Synthetic polypeptide
AEEEIRTTNPVATEQYGSVSTTQLQQISGNN

SEQ ID NO: 35691 - protein, 30 aa, Artificial Sequence
  Description of Artificial Sequence: Synthetic polypeptide
SEEEIRCTNPIATEQYGSVSENLMRGNHRI

SEQ ID NO: 35692 - protein, 31 aa, Artificial Sequence
  Description of Artificial Sequence: Synthetic polypeptide
AEEEIRTTNPVATEQYGSVSTTQLQIQGNNN

SEQ ID NO: 35693 - protein, 29 aa, Artificial Sequence
  Description of Artificial Sequence: Synthetic peptide
DEEEIRTTNPFATEQYGSVSYNIFSGIND

SEQ ID NO: 35694 - protein, 29 aa, Artificial Sequence
  Description of Artificial Sequence: Synthetic peptide
SEEEIRCTNPIATEQYGSVSENLMRMNRF

SEQ ID NO: 35695 - protein, 28 aa, Artificial Sequence
  Description of Artificial Sequence: Synthetic peptide
SEEEIRCTNPIATEQYGSVSENLMRNNF

SEQ ID NO: 35696 - protein, 29 aa, Artificial Sequence
  Description of Artificial Sequence: Synthetic peptide
SEEEIRCTNPIATEQYGSVSENLMRPGNA

SEQ ID NO: 35697 - protein, 28 aa, Artificial Sequence
  Description of Artificial Sequence: Synthetic peptide
SEEEIRCTNPIATEQYGSVSENLMRPNK

SEQ ID NO: 35698 - protein, 29 aa, Artificial Sequence
  Description of Artificial Sequence: Synthetic peptide
SEEEIRCTNPIATEQYGSVSENLMRQNWR

SEQ ID NO: 35699 - protein, 28 aa, Artificial Sequence
  Description of Artificial Sequence: Synthetic peptide
SEEEIRCTNPIATEQYGSVSENLMRRND

SEQ ID NO: 35700 - protein, 28 aa, Artificial Sequence
  Description of Artificial Sequence: Synthetic peptide
SEEEIRCTNPIATEQYGSVSENLMRSMR

SEQ ID NO: 35701 - protein, 29 aa, Artificial Sequence
  Description of Artificial Sequence: Synthetic peptide
DEEEIRTTNPFATEQYGSVSYNIFRTNVD

SEQ ID NO: 35702 - protein, 29 aa, Artificial Sequence
  Description of Artificial Sequence: Synthetic peptide
SEEEIRCTNPIATEQYGSVSENLMRTGFR

SEQ ID NO: 35703 - protein, 28 aa, Artificial Sequence
  Description of Artificial Sequence: Synthetic peptide
SEEEIRCTNPIATEQYGSVSENLMRYNN

SEQ ID NO: 35704 - protein, 28 aa, Artificial Sequence
  Description of Artificial Sequence: Synthetic peptide
SEEEIRCTNPIATEQYGSVSENLMSGNQ

SEQ ID NO: 35705 - protein, 28 aa, Artificial Sequence
  Description of Artificial Sequence: Synthetic peptide
SEEEIRCTNPIATEQYGSVSENLMSLNR

SEQ ID NO: 35706 - protein, 29 aa, Artificial Sequence
  Description of Artificial Sequence: Synthetic peptide
SEEEIRCTNPIATEQYGSVSENLMTGPNR

SEQ ID NO: 35707 - protein, 29 aa, Artificial Sequence
  Description of Artificial Sequence: Synthetic peptide
SEEEIRCTNPIATEQYGSVSENLMTRGYR

SEQ ID NO: 35708 - protein, 31 aa, Artificial Sequence
  Description of Artificial Sequence: Synthetic polypeptide
AEEEIRTTNPVATEQYGSVSTTNQQQQIGNV

SEQ ID NO: 35709 - protein, 30 aa, Artificial Sequence
  Description of Artificial Sequence: Synthetic polypeptide
SEEEIRCTNPIATEQYGSVSENLMVRGNRP

SEQ ID NO: 35710 - protein, 29 aa, Artificial Sequence
  Description of Artificial Sequence: Synthetic peptide
SEEEIRCTNPIATEQYGSVSENLMVRINR

SEQ ID NO: 35711 - protein, 30 aa, Artificial Sequence
  Description of Artificial Sequence: Synthetic polypeptide
SEEEIRCTNPIATEQYGSVSENLMRYGHNR

SEQ ID NO: 35712 - protein, 30 aa, Artificial Sequence
  Description of Artificial Sequence: Synthetic polypeptide
DEEEIRTTNPFATEQYGSVSYNIFRNGNDG

SEQ ID NO: 35713 - protein, 31 aa, Artificial Sequence
  Description of Artificial Sequence: Synthetic polypeptide
AEEEIRTTNPVATEQYGSVSTTNQQQTGGNE

SEQ ID NO: 35714 - protein, 29 aa, Artificial Sequence
  Description of Artificial Sequence: Synthetic peptide
DEEEIRTTNPFATEQYGSVSYNIFRGIDP

SEQ ID NO: 35715 - protein, 29 aa, Artificial Sequence
  Description of Artificial Sequence: Synthetic peptide
SEEEIRCTNPIATEQYGSVSENLMRGNMA

SEQ ID NO: 35716 - protein, 30 aa, Artificial Sequence
  Description of Artificial Sequence: Synthetic polypeptide
SEEEIRCTNPIATEQYGSVSENLMRGNPRE

SEQ ID NO: 35717 - protein, 28 aa, Artificial Sequence
  Description of Artificial Sequence: Synthetic peptide
DEEEIRTTNPFATEQYGSVSYGIFRGDD

SEQ ID NO: 35718 - protein, 29 aa, Artificial Sequence
  Description of Artificial Sequence: Synthetic peptide
SEEEIRCTNPIATEQYGSVSENLMRGNYW

SEQ ID NO: 35719 - protein, 28 aa, Artificial Sequence
  Description of Artificial Sequence: Synthetic peptide
SEEEIRCTNPIATEQYGSVSENLMRGQE

SEQ ID NO: 35720 - protein, 30 aa, Artificial Sequence
  Description of Artificial Sequence: Synthetic polypeptide
DEEEIRTTNPFATEQYGSVSYNIDERGDND

SEQ ID NO: 35721 - protein, 29 aa, Artificial Sequence
  Description of Artificial Sequence: Synthetic peptide
SEEEIRCTNPIATEQYGSVSENLMRGYNE

SEQ ID NO: 35722 - protein, 29 aa, Artificial Sequence
  Description of Artificial Sequence: Synthetic peptide
SEEEIRCTNPIATEQYGSVSENLMRGYNS

SEQ ID NO: 35723 - protein, 29 aa, Artificial Sequence
  Description of Artificial Sequence: Synthetic peptide
SEEEIRCTNPIATEQYGSVSENLMRGYNT

SEQ ID NO: 35724 - protein, 28 aa, Artificial Sequence
  Description of Artificial Sequence: Synthetic peptide
SEEEIRCTNPIATEQYGSVSENLMRGYT

SEQ ID NO: 35725 - protein, 29 aa, Artificial Sequence
  Description of Artificial Sequence: Synthetic peptide
SEEEIRCTNPIATEQYGSVSENLMRHNRI

SEQ ID NO: 35726 - protein, 29 aa, Artificial Sequence
  Description of Artificial Sequence: Synthetic peptide
SEEEIRCTNPIATEQYGSVSENLMRIGIR

SEQ ID NO: 35727 - protein, 30 aa, Artificial Sequence
  Description of Artificial Sequence: Synthetic polypeptide
SEEEIRCTNPIATEQYGSVSENLMRIGNRA

SEQ ID NO: 35728 - protein, 28 aa, Artificial Sequence
  Description of Artificial Sequence: Synthetic peptide
SEEEIRCTNPIATEQYGSVSENLMRIGR

SEQ ID NO: 35729 - protein, 28 aa, Artificial Sequence
  Description of Artificial Sequence: Synthetic peptide
SEEEIRCTNPIATEQYGSVSENLMRINE

SEQ ID NO: 35730 - protein, 30 aa, Artificial Sequence
  Description of Artificial Sequence: Synthetic polypeptide
SEEEIRCTNPIATEQYGSVSENLMRLGNRA

SEQ ID NO: 35731 - protein, 28 aa, Artificial Sequence
  Description of Artificial Sequence: Synthetic peptide
SEEEIRCTNPIATEQYGSVSENLMRLNP

SEQ ID NO: 35732 - protein, 29 aa, Artificial Sequence
  Description of Artificial Sequence: Synthetic peptide
DEEEIRTTNPFATEQYGSVSYNIDNGNED

SEQ ID NO: 35733 - protein, 30 aa, Artificial Sequence
  Description of Artificial Sequence: Synthetic polypeptide
SEEEIRCTNPIATEQYGSVSENLMRMGMNR

SEQ ID NO: 35734 - protein, 28 aa, Artificial Sequence
  Description of Artificial Sequence: Synthetic peptide
SEEEIRCTNPIATEQYGSVSENLMWGPR

SEQ ID NO: 35735 - protein, 30 aa, Artificial Sequence
  Description of Artificial Sequence: Synthetic polypeptide
AEEEIRTTNPVATEQYGSVSTTDTQTGNDE

SEQ ID NO: 35736 - protein, 32 aa, Artificial Sequence
  Description of Artificial Sequence: Synthetic polypeptide
DEEEIRTTNPVATEQYGCVSLTGNHQHFGSNR

SEQ ID NO: 35737 - protein, 30 aa, Artificial Sequence
  Description of Artificial Sequence: Synthetic polypeptide
SEEEIRCTNPIATEQYGSVSMENLMDRGNR

SEQ ID NO: 35738 - protein, 29 aa, Artificial Sequence
  Description of Artificial Sequence: Synthetic peptide
SEEEIRCTNPIATTQYGSVSENLMRPGNR

SEQ ID NO: 35739 - protein, 29 aa, Artificial Sequence
  Description of Artificial Sequence: Synthetic peptide
SEEEIRCTNPIATWQYGSVSEANLMRGNR

SEQ ID NO: 35740 - protein, 28 aa, Artificial Sequence
  Description of Artificial Sequence: Synthetic peptide
SEEEIRCTNPIATWQYGSVSENDMRGNR

SEQ ID NO: 35741 - protein, 28 aa, Artificial Sequence
  Description of Artificial Sequence: Synthetic peptide
SEEEIRCTNPIATWQYGSVSENLMRGNS

SEQ ID NO: 35742 - protein, 29 aa, Artificial Sequence
  Description of Artificial Sequence: Synthetic peptide
SEEEIRCTNPIATYQYGSVSENLMRGNPR

SEQ ID NO: 35743 - protein, 28 aa, Artificial Sequence
  Description of Artificial Sequence: Synthetic peptide
SEEEIRCTNPIAVEQYGAVSENLMRGNR

SEQ ID NO: 35744 - protein, 29 aa, Artificial Sequence
  Description of Artificial Sequence: Synthetic peptide
SEEEIRCTNPIAVEQYGSVSEDNLMRGNR

SEQ ID NO: 35745 - protein, 28 aa, Artificial Sequence
  Description of Artificial Sequence: Synthetic peptide
SEEEIRCTNPIAWEQYGSVHENLMRGNR

SEQ ID NO: 35746 - protein, 28 aa, Artificial Sequence
  Description of Artificial Sequence: Synthetic peptide
SEEEIRCTNPIATTQYGSVSENLMIGNR

SEQ ID NO: 35747 - protein, 28 aa, Artificial Sequence
  Description of Artificial Sequence: Synthetic peptide
SEEEIRCTNPIAWEQYGSVSENQMRGNR

SEQ ID NO: 35748 - protein, 29 aa, Artificial Sequence
  Description of Artificial Sequence: Synthetic peptide
SEEEIRCTNPIAYEQYGMSVSENLMRGNR

SEQ ID NO: 35749 - protein, 28 aa, Artificial Sequence
  Description of Artificial Sequence: Synthetic peptide
SEEEIRCTNPIAYEQYGSVSENLDRGNH

SEQ ID NO: 35750 - protein, 28 aa, Artificial Sequence
  Description of Artificial Sequence: Synthetic peptide
SEEEIRCTNPIAYEQYGSVSENLIRGND

SEQ ID NO: 35751 - protein, 28 aa, Artificial Sequence
  Description of Artificial Sequence: Synthetic peptide
SEEEIRCTNPIAYEQYGSVSENLMRGNP

SEQ ID NO: 35752 - protein, 31 aa, Artificial Sequence
  Description of Artificial Sequence: Synthetic polypeptide
AEEEIRTTNPVATEQYGSVSTTNNNQQQGNG

SEQ ID NO: 35753 - protein, 29 aa, Artificial Sequence
  Description of Artificial Sequence: Synthetic peptide
SEEEIRCTNPIAYEQYGSVSENNLMRGNR

SEQ ID NO: 35754 - protein, 29 aa, Artificial Sequence
  Description of Artificial Sequence: Synthetic peptide
SEEEIRCTNPIAYEQYGSVSGNLMRGNRM

SEQ ID NO: 35755 - protein, 29 aa, Artificial Sequence
  Description of Artificial Sequence: Synthetic peptide
SEEEIRCTNPIAYEQYGSVSINLMRGGNR

SEQ ID NO: 35756 - protein, 28 aa, Artificial Sequence
  Description of Artificial Sequence: Synthetic peptide
SEEEIRCTNPIAWEQYGSVSENTMRGNR

SEQ ID NO: 35757 - protein, 28 aa, Artificial Sequence
  Description of Artificial Sequence: Synthetic peptide
SEEEIRCTNPICTEQYGSVSENLMRGNL

SEQ ID NO: 35758 - protein, 31 aa, Artificial Sequence
  Description of Artificial Sequence: Synthetic polypeptide
DEEEIRTTNPVATEQYGCVQSTYDQFFGSNR

SEQ ID NO: 35759 - protein, 29 aa, Artificial Sequence
  Description of Artificial Sequence: Synthetic peptide
SEEEIRCTNPIATNQYGSVSEENLMRGNR

SEQ ID NO: 35760 - protein, 29 aa, Artificial Sequence
  Description of Artificial Sequence: Synthetic peptide
SEEEIRCTNPIATESYGSVSENLMRGNER

SEQ ID NO: 35761 - protein, 29 aa, Artificial Sequence
  Description of Artificial Sequence: Synthetic peptide
SEEEIRCTNPIATESYGSVSENLMRGNRG

SEQ ID NO: 35762 - protein, 29 aa, Artificial Sequence
  Description of Artificial Sequence: Synthetic peptide
SEEEIRCTNPIATESYGSVSENLMRIGNR

SEQ ID NO: 35763 - protein, 29 aa, Artificial Sequence
  Description of Artificial Sequence: Synthetic peptide
SEEEIRCTNPIATETYGSVSENDLMRGNR

SEQ ID NO: 35764 - protein, 28 aa, Artificial Sequence
  Description of Artificial Sequence: Synthetic peptide
SEEEIRCTNPIATEVYGSVSENLMRPNR

SEQ ID NO: 35765 - protein, 29 aa, Artificial Sequence
  Description of Artificial Sequence: Synthetic peptide
SEEEIRCTNPIATEVYGSVSENSLMRGNR

SEQ ID NO: 35766 - protein, 31 aa, Artificial Sequence
  Description of Artificial Sequence: Synthetic polypeptide
AEEEIRTTNPVATEQYGSVSTTNNQGGGANS

SEQ ID NO: 35767 - protein, 29 aa, Artificial Sequence
  Description of Artificial Sequence: Synthetic peptide
SEEEIRCTNPIATEVYGSVSLENLMRGNR

SEQ ID NO: 35768 - protein, 29 aa, Artificial Sequence
  Description of Artificial Sequence: Synthetic peptide
SEEEIRCTNPIATNQYGSVSEINLERGNR

SEQ ID NO: 35769 - protein, 28 aa, Artificial Sequence
  Description of Artificial Sequence: Synthetic peptide
SEEEIRCTNPIATEWYGSVSENLMMGNR

SEQ ID NO: 35770 - protein, 29 aa, Artificial Sequence
  Description of Artificial Sequence: Synthetic peptide
SEEEIRCTNPIATEWYGSVSENLMRGGNR

SEQ ID NO: 35771 - protein, 28 aa, Artificial Sequence
  Description of Artificial Sequence: Synthetic peptide
SEEEIRCTNPIATEWYGSVSENLMRGIR

SEQ ID NO: 35772 - protein, 28 aa, Artificial Sequence
  Description of Artificial Sequence: Synthetic peptide
SEEEIRCTNPIATEYYGSVSENLMQGNR

SEQ ID NO: 35773 - protein, 29 aa, Artificial Sequence
  Description of Artificial Sequence: Synthetic peptide
SEEEIRCTNPIATEYYGSVSENLMRGNQR

SEQ ID NO: 35774 - protein, 29 aa, Artificial Sequence
  Description of Artificial Sequence: Synthetic peptide
SEEEIRCTNPIATEYYGSVSENLMTRGNR

SEQ ID NO: 35775 - protein, 29 aa, Artificial Sequence
  Description of Artificial Sequence: Synthetic peptide
SEEEIRCTNPIATEYYGSVSPENLMRGNR

SEQ ID NO: 35776 - protein, 28 aa, Artificial Sequence
  Description of Artificial Sequence: Synthetic peptide
SEEEIRCTNPIATFQYGSVSENLMRNNR

SEQ ID NO: 35777 - protein, 29 aa, Artificial Sequence
  Description of Artificial Sequence: Synthetic peptide
SEEEIRCTNPIATHQYGSVSEGNLMRGNR

SEQ ID NO: 35778 - protein, 30 aa, Artificial Sequence
  Description of Artificial Sequence: Synthetic polypeptide
DEEEIRTTNPVATEQYGCVQTNHQRGSEAA

SEQ ID NO: 35779 - protein, 29 aa, Artificial Sequence
  Description of Artificial Sequence: Synthetic peptide
DEEEIRTTNPIATEQWGSTSEDLARGNYR

SEQ ID NO: 35780 - protein, 28 aa, Artificial Sequence
  Description of Artificial Sequence: Synthetic peptide
SEEEIRCTNPICTEQYGSVSENLMSGNR

SEQ ID NO: 35781 - protein, 29 aa, Artificial Sequence
  Description of Artificial Sequence: Synthetic peptide
SEEEIRCTNPICTEQYGSVSEPNLMRGNR

SEQ ID NO: 35782 - protein, 28 aa, Artificial Sequence
  Description of Artificial Sequence: Synthetic peptide
SEEEIRCTNPTATEQYGSVASNLMRGNE

SEQ ID NO: 35783 - protein, 29 aa, Artificial Sequence
  Description of Artificial Sequence: Synthetic peptide
SEEEIRCTNPTATEQYGSVSENLMDGNRM

SEQ ID NO: 35784 - protein, 29 aa, Artificial Sequence
  Description of Artificial Sequence: Synthetic peptide
SEEEIRCTNPTATEQYGSVSENLMRGNQV

SEQ ID NO: 35785 - protein, 28 aa, Artificial Sequence
  Description of Artificial Sequence: Synthetic peptide
SEEEIRCTNPTATEQYGSVSENLMRQNM

SEQ ID NO: 35786 - protein, 28 aa, Artificial Sequence
  Description of Artificial Sequence: Synthetic peptide
SEEEIRCTNPTATEQYGSVSENLMSGND

SEQ ID NO: 35787 - protein, 29 aa, Artificial Sequence
  Description of Artificial Sequence: Synthetic peptide
SEEEIRCTNPTATEQYGSVSVTLMRGNRD

SEQ ID NO: 35788 - protein, 32 aa, Artificial Sequence
  Description of Artificial Sequence: Synthetic polypeptide
DEEEIRTTNPVATEQYGCVDSTNTQYFGSNRY

SEQ ID NO: 35789 - protein, 29 aa, Artificial Sequence
  Description of Artificial Sequence: Synthetic peptide
SEEEIRCTNPVATECYGSVSENEMRGENR

SEQ ID NO: 35790 - protein, 28 aa, Artificial Sequence
  Description of Artificial Sequence: Synthetic peptide
SEEEIRCTNPTATEQYGSVAENLTAGNR

SEQ ID NO: 35791 - protein, 29 aa, Artificial Sequence
  Description of Artificial Sequence: Synthetic peptide
SEEEIRCTNPVATEPYGSVATNLQAGNEQ

SEQ ID NO: 35792 - protein, 28 aa, Artificial Sequence
  Description of Artificial Sequence: Synthetic peptide
SEEEIRCTNPVATEQWGSVSENEMRGDR

SEQ ID NO: 35793 - protein, 30 aa, Artificial Sequence
  Description of Artificial Sequence: Synthetic polypeptide
DEEEIRTTNPVATEQYGCVDSTNLQGISEQ

SEQ ID NO: 35794 - protein, 30 aa, Artificial Sequence
  Description of Artificial Sequence: Synthetic polypeptide
SEEEIRCTNPVATEQYGDVSENLMNRAGNR

SEQ ID NO: 35795 - protein, 30 aa, Artificial Sequence
  Description of Artificial Sequence: Synthetic polypeptide
DEEEIRTTNPIATEQYGSVSCLNIGRGGND

SEQ ID NO: 35796 - protein, 28 aa, Artificial Sequence
  Description of Artificial Sequence: Synthetic peptide
SEEEIRCTNPVATEQYGEASENLMRENR

SEQ ID NO: 35797 - protein, 28 aa, Artificial Sequence
  Description of Artificial Sequence: Synthetic peptide
SEEEIRCTNPVATEQYGEVSEVLMHGNR

SEQ ID NO: 35798 - protein, 30 aa, Artificial Sequence
  Description of Artificial Sequence: Synthetic polypeptide
DEEEIRTTNPIATEQYGSVSEAGPNRGNPR

SEQ ID NO: 35799 - protein, 30 aa, Artificial Sequence
  Description of Artificial Sequence: Synthetic polypeptide
SEEEIRCTNPVATEQYGSVATNLQRAENIE

SEQ ID NO: 35800 - protein, 28 aa, Artificial Sequence
  Description of Artificial Sequence: Synthetic peptide
DEEEIRTTNPIATEQYGSVPTMDARGKE

SEQ ID NO: 35801 - protein, 32 aa, Artificial Sequence
  Description of Artificial Sequence: Synthetic polypeptide
DEEEIRTTNPVATEQYGCVFCTNISQRGGSNR

SEQ ID NO: 35802 - protein, 29 aa, Artificial Sequence
  Description of Artificial Sequence: Synthetic peptide
SEEEIRCTNPTATEQYGSVAENLMRGGNR

SEQ ID NO: 35803 - protein, 29 aa, Artificial Sequence
  Description of Artificial Sequence: Synthetic peptide
SEEEIRCTNPLATEQYGSVSENLNMRGNF

SEQ ID NO: 35804 - protein, 28 aa, Artificial Sequence
  Description of Artificial Sequence: Synthetic peptide
SEEEIRCTNPICTEQYGVVSENLMRGNR

SEQ ID NO: 35805 - protein, 31 aa, Artificial Sequence
  Description of Artificial Sequence: Synthetic polypeptide
DEEEIRTTNPIATEQWGSVSCNEPQDRGENR

SEQ ID NO: 35806 - protein, 31 aa, Artificial Sequence
  Description of Artificial Sequence: Synthetic polypeptide
AEEEIRTTNPVATEQYGSVSTTNNNQQGNET

SEQ ID NO: 35807 - protein, 28 aa, Artificial Sequence
  Description of Artificial Sequence: Synthetic peptide
SEEEIRCTNPIGTEQYGSVAENLMRGNR

SEQ ID NO: 35808 - protein, 28 aa, Artificial Sequence
  Description of Artificial Sequence: Synthetic peptide
SEEEIRCTNPIGTEQYGSVSENLMRGAR

SEQ ID NO: 35809 - protein, 28 aa, Artificial Sequence
  Description of Artificial Sequence: Synthetic peptide
SEEEIRCTNPIGTEQYGVVSENLMRGNR

SEQ ID NO: 35810 - protein, 32 aa, Artificial Sequence
  Description of Artificial Sequence: Synthetic polypeptide
AEEEIRTTNPVATEQYGSVSTTNNNQLQQGNG

SEQ ID NO: 35811 - protein, 29 aa, Artificial Sequence
  Description of Artificial Sequence: Synthetic peptide
DEEEIRTTNPIATEQWGSVSEILMNRENR

SEQ ID NO: 35812 - protein, 29 aa, Artificial Sequence
  Description of Artificial Sequence: Synthetic peptide
DEEEIRTTNPIATEQWGSVSENLMNAGDR

SEQ ID NO: 35813 - protein, 28 aa, Artificial Sequence
  Description of Artificial Sequence: Synthetic peptide
SEEEIRCTNPISTEQYGEVSENLMRGNR

SEQ ID NO: 35814 - protein, 28 aa, Artificial Sequence
  Description of Artificial Sequence: Synthetic peptide
SEEEIRCTNPISTEQYGSVAENLMRGNR

SEQ ID NO: 35815 - protein, 29 aa, Artificial Sequence
  Description of Artificial Sequence: Synthetic peptide
DEEEIRTTNPIATEQWGSVSENLMNREDR

SEQ ID NO: 35816 - protein, 29 aa, Artificial Sequence
  Description of Artificial Sequence: Synthetic peptide
SEEEIRCTNPISTEQYGSVSEENLMRGNR

SEQ ID NO: 35817 - protein, 31 aa, Artificial Sequence
  Description of Artificial Sequence: Synthetic polypeptide
DEEEIRTTNPVATEQYGCVGTNTQNFGSNRT

SEQ ID NO: 35818 - protein, 29 aa, Artificial Sequence
  Description of Artificial Sequence: Synthetic peptide
SEEEIRCTNPISTEQYGSVSENLMIRGNR

SEQ ID NO: 35819 - protein, 28 aa, Artificial Sequence
  Description of Artificial Sequence: Synthetic peptide
SEEEIRCTNPISTEQYGSVSENLMRGTR

SEQ ID NO: 35820 - protein, 28 aa, Artificial Sequence
  Description of Artificial Sequence: Synthetic peptide
SEEEIRCTNPISTEQYGSVSENLMSGNR

SEQ ID NO: 35821 - protein, 29 aa, Artificial Sequence
  Description of Artificial Sequence: Synthetic peptide
SEEEIRCTNPISTEQYGSVSENLQQRGNH

SEQ ID NO: 35822 - protein, 30 aa, Artificial Sequence
  Description of Artificial Sequence: Synthetic polypeptide
SEEEIRCTNPLATEQYGSVSEGNLMRGGNR

SEQ ID NO: 35823 - protein, 29 aa, Artificial Sequence
  Description of Artificial Sequence: Synthetic peptide
SEEEIRCTNPIATERYGSVSENLPMRGNR

SEQ ID NO: 35824 - protein, 30 aa, Artificial Sequence
  Description of Artificial Sequence: Synthetic polypeptide
SEEEIRCTNPIATEQYGSVSLENLMRGVNR

SEQ ID NO: 35825 - protein, 29 aa, Artificial Sequence
  Description of Artificial Sequence: Synthetic peptide
SEEEIRCTNPIATEQYGYVSMENLMRGNR

SEQ ID NO: 35826 - protein, 28 aa, Artificial Sequence
  Description of Artificial Sequence: Synthetic peptide
SEEEIRCTNPIATEQYGYVSENLMRGPR

SEQ ID NO: 35827 - protein, 30 aa, Artificial Sequence
  Description of Artificial Sequence: Synthetic polypeptide
SEEEIRCTNPIATEQYGSVSSNLMRGSNNR

SEQ ID NO: 35828 - protein, 30 aa, Artificial Sequence
  Description of Artificial Sequence: Synthetic polypeptide
SEEEIRCTNPIATEQYGSVSSNLMRSGNRD

SEQ ID NO: 35829 - protein, 30 aa, Artificial Sequence
  Description of Artificial Sequence: Synthetic polypeptide
SEEEIRCTNPIATEQYGSVSSNLPMRGNRE

SEQ ID NO: 35830 - protein, 28 aa, Artificial Sequence
  Description of Artificial Sequence: Synthetic peptide
SEEEIRCTNPIATEQYGSVSSNPMNGNR

SEQ ID NO: 35831 - protein, 31 aa, Artificial Sequence
  Description of Artificial Sequence: Synthetic polypeptide
SEEEIRCTNPIATEQYGSVSSTENLMRGMNR

SEQ ID NO: 35832 - protein, 31 aa, Artificial Sequence
  Description of Artificial Sequence: Synthetic polypeptide
DEEEIRTTNPVATEQYGCVSDTELNQRSGDQ

SEQ ID NO: 35833 - protein, 29 aa, Artificial Sequence
  Description of Artificial Sequence: Synthetic peptide
SEEEIRCTNPIATEQYGSVSTENLMMGNM

SEQ ID NO: 35834 - protein, 31 aa, Artificial Sequence
  Description of Artificial Sequence: Synthetic polypeptide
SEEEIRCTNPIATEQYGSVSTENLSDRGGNR

SEQ ID NO: 35835 - protein, 29 aa, Artificial Sequence
  Description of Artificial Sequence: Synthetic peptide
SEEEIRCTNPIATEQYGSVSSNLMRGNLE

SEQ ID NO: 35836 - protein, 28 aa, Artificial Sequence
  Description of Artificial Sequence: Synthetic peptide
SEEEIRCTNPIATEQYGSVSTNLMHGEL

SEQ ID NO: 35837 - protein, 28 aa, Artificial Sequence
  Description of Artificial Sequence: Synthetic peptide
SEEEIRCTNPIATEQYGSVSWNLAAGNQ

SEQ ID NO: 35838 - protein, 29 aa, Artificial Sequence
  Description of Artificial Sequence: Synthetic peptide
SEEEIRCTNPIATEQYGSVSWNLIRGNQQ

SEQ ID NO: 35839 - protein, 29 aa, Artificial Sequence
  Description of Artificial Sequence: Synthetic peptide
SEEEIRCTNPIATEQYGSVSYENGMRGNR

SEQ ID NO: 35840 - protein, 30 aa, Artificial Sequence
  Description of Artificial Sequence: Synthetic polypeptide
SEEEIRCTNPIATEQYGSVSYENLMRVGNR

SEQ ID NO: 35841 - protein, 29 aa, Artificial Sequence
  Description of Artificial Sequence: Synthetic peptide
SEEEIRCTNPIATEQYGSVTAENLMRGNR

SEQ ID NO: 35842 - protein, 29 aa, Artificial Sequence
  Description of Artificial Sequence: Synthetic peptide
SEEEIRCTNPIATEQYGSVTENVLMRGNR

SEQ ID NO: 35843 - protein, 29 aa, Artificial Sequence
  Description of Artificial Sequence: Synthetic peptide
SEEEIRCTNPIATEQYGSVTSENHMRGNR

SEQ ID NO: 35844 - protein, 29 aa, Artificial Sequence
  Description of Artificial Sequence: Synthetic peptide
SEEEIRCTNPIATEQYGSVTVENLMRGNR

SEQ ID NO: 35845 - protein, 29 aa, Artificial Sequence
  Description of Artificial Sequence: Synthetic peptide
SEEEIRCTNPIATEQYGSVSVEMLMRGNR

SEQ ID NO: 35846 - protein, 29 aa, Artificial Sequence
  Description of Artificial Sequence: Synthetic peptide
SEEEIRCTNPIATEQYGSVVCENLERGNR

SEQ ID NO: 35847 - protein, 32 aa, Artificial Sequence
  Description of Artificial Sequence: Synthetic polypeptide
DEEEIRTTNPVATEQYGCVSDTNLQESSGSER

SEQ ID NO: 35848 - protein, 31 aa, Artificial Sequence
  Description of Artificial Sequence: Synthetic polypeptide
AEEEIRTTNPVATEQYGSVSTTNNQQQIGNG

SEQ ID NO: 35849 - protein, 29 aa, Artificial Sequence
  Description of Artificial Sequence: Synthetic peptide
SEEEIRCTNPIATEQYGSVSMENLMRGNV

SEQ ID NO: 35850 - protein, 30 aa, Artificial Sequence
  Description of Artificial Sequence: Synthetic polypeptide
SEEEIRCTNPIATEQYGSVSNENLIRGNQR

SEQ ID NO: 35851 - protein, 29 aa, Artificial Sequence
  Description of Artificial Sequence: Synthetic peptide
SEEEIRCTNPIATEQYGSVSNENLMYGNR

SEQ ID NO: 35852 - protein, 29 aa, Artificial Sequence
  Description of Artificial Sequence: Synthetic peptide
SEEEIRCTNPIATEQYGSVSNENQMRGNR

SEQ ID NO: 35853 - protein, 29 aa, Artificial Sequence
  Description of Artificial Sequence: Synthetic peptide
SEEEIRCTNPIATEQYGSVSNINLMRGNH

SEQ ID NO: 35854 - protein, 29 aa, Artificial Sequence
  Description of Artificial Sequence: Synthetic peptide
SEEEIRCTNPIATEQYGSVSNINLMRGQR

SEQ ID NO: 35855 - protein, 29 aa, Artificial Sequence
  Description of Artificial Sequence: Synthetic peptide
SEEEIRCTNPIATEQYGSVSNNDMRDGNR

SEQ ID NO: 35856 - protein, 29 aa, Artificial Sequence
  Description of Artificial Sequence: Synthetic peptide
SEEEIRCTNPIATEQYGSVSQENLMYGNR

SEQ ID NO: 35857 - protein, 31 aa, Artificial Sequence
  Description of Artificial Sequence: Synthetic polypeptide
DEEEIRTTNPVATEQYGCVSDTNLQSFGSDQ

SEQ ID NO: 35858 - protein, 30 aa, Artificial Sequence
  Description of Artificial Sequence: Synthetic polypeptide
DEEEIRTTNPVATEQYGCVSIELQYFGSNQ

SEQ ID NO: 35859 - protein, 30 aa, Artificial Sequence
  Description of Artificial Sequence: Synthetic polypeptide
SEEEIRCTNPIATEQYGSVSSENLMRGNHR

SEQ ID NO: 35860 - protein, 30 aa, Artificial Sequence
  Description of Artificial Sequence: Synthetic polypeptide
SEEEIRCTNPIATEQYGSVSSENLMRGNPR

SEQ ID NO: 35861 - protein, 29 aa, Artificial Sequence
  Description of Artificial Sequence: Synthetic peptide
SEEEIRCTNPIATEQYGSVSSENLMRLNR

SEQ ID NO: 35862 - protein, 30 aa, Artificial Sequence
  Description of Artificial Sequence: Synthetic polypeptide
SEEEIRCTNPIATEQYGSVSSENLNRGNPR

SEQ ID NO: 35863 - protein, 30 aa, Artificial Sequence
  Description of Artificial Sequence: Synthetic polypeptide
SEEEIRCTNPIATEQYGSVSSESNLMRGNR

SEQ ID NO: 35864 - protein, 29 aa, Artificial Sequence
  Description of Artificial Sequence: Synthetic peptide
SEEEIRCTNPIATEQYGSVSSGNLMHGNR

SEQ ID NO: 35865 - protein, 32 aa, Artificial Sequence
  Description of Artificial Sequence: Synthetic polypeptide
DEEEIRTTNPVATEQYGCVSDTYLNQRFSSNR

SEQ ID NO: 35866 - protein, 30 aa, Artificial Sequence
  Description of Artificial Sequence: Synthetic polypeptide
SEEEIRCTNPIATEQYGSVSSNLARGSNRA

SEQ ID NO: 35867 - protein, 29 aa, Artificial Sequence
  Description of Artificial Sequence: Synthetic peptide
SEEEIRCTNPIATEQYGSVSSENLMQGNR

SEQ ID NO: 35868 - protein, 29 aa, Artificial Sequence
  Description of Artificial Sequence: Synthetic peptide
SEEEIRCTNPIATEQYGSVVDENLMRGNR

SEQ ID NO: 35869 - protein, 30 aa, Artificial Sequence
  Description of Artificial Sequence: Synthetic polypeptide
DEEEIRTTNPVATEQYGCVSCTEDNQRGEF

SEQ ID NO: 35870 - protein, 28 aa, Artificial Sequence
  Description of Artificial Sequence: Synthetic peptide
SEEEIRCTNPIATEQYGSVVENLMRENR

SEQ ID NO: 35871 - protein, 29 aa, Artificial Sequence
  Description of Artificial Sequence: Synthetic peptide
SEEEIRCTNPIATEQYGTSVSENLMRANR

SEQ ID NO: 35872 - protein, 30 aa, Artificial Sequence
  Description of Artificial Sequence: Synthetic polypeptide
SEEEIRCTNPIATEQYGTSVSENLMRGQNR

SEQ ID NO: 35873 - protein, 29 aa, Artificial Sequence
  Description of Artificial Sequence: Synthetic peptide
SEEEIRCTNPIATEQYGTVGSENLMRGNR

SEQ ID NO: 35874 - protein, 29 aa, Artificial Sequence
  Description of Artificial Sequence: Synthetic peptide
DEEEIRTTNPIATEEYGSVATNGGRGPNA

SEQ ID NO: 35875 - protein, 29 aa, Artificial Sequence
  Description of Artificial Sequence: Synthetic peptide
SEEEIRCTNPIATEQYGTVSEDLQQRGNR

SEQ ID NO: 35876 - protein, 28 aa, Artificial Sequence
  Description of Artificial Sequence: Synthetic peptide
SEEEIRCTNPIATEQYGTVSEGLERGNR

SEQ ID NO: 35877 - protein, 30 aa, Artificial Sequence
  Description of Artificial Sequence: Synthetic polypeptide
DEEEIRTTNPIATEPYGSCSTNLSARGGNE

SEQ ID NO: 35878 - protein, 28 aa, Artificial Sequence
  Description of Artificial Sequence: Synthetic peptide
SEEEIRCTNPIATEQYGTVSENLERGND

SEQ ID NO: 35879 - protein, 30 aa, Artificial Sequence
  Description of Artificial Sequence: Synthetic polypeptide
SEEEIRCTNPIATEQYGTSVSDENLMRGNR

SEQ ID NO: 35880 - protein, 30 aa, Artificial Sequence
  Description of Artificial Sequence: Synthetic polypeptide
SEEEIRCTNPIATEQYGTVSENLQMRNGNR

SEQ ID NO: 35881 - protein, 28 aa, Artificial Sequence
  Description of Artificial Sequence: Synthetic peptide
SEEEIRCTNPIATEQYGTVSENNMRGNR

SEQ ID NO: 35882 - protein, 29 aa, Artificial Sequence
  Description of Artificial Sequence: Synthetic peptide
SEEEIRCTNPIATEQYGTVSENSLMRGNR

SEQ ID NO: 35883 - protein, 31 aa, Artificial Sequence
  Description of Artificial Sequence: Synthetic polypeptide
DEEEIRTTNPVATEQYGCVQTNLQRFGSEAM

SEQ ID NO: 35884 - protein, 29 aa, Artificial Sequence
  Description of Artificial Sequence: Synthetic peptide
SEEEIRCTNPIATEQYGTVSMNLMQNGNR

SEQ ID NO: 35885 - protein, 29 aa, Artificial Sequence
  Description of Artificial Sequence: Synthetic peptide
SEEEIRCTNPIATEQYGTVSMNLMRNGNR

SEQ ID NO: 35886 - protein, 28 aa, Artificial Sequence
  Description of Artificial Sequence: Synthetic peptide
SEEEIRCTNPIATEQYGVVSENLMHGNR

SEQ ID NO: 35887 - protein, 29 aa, Artificial Sequence
  Description of Artificial Sequence: Synthetic peptide
SEEEIRCTNPIATEQYGVVSNENLMRGNR

SEQ ID NO: 35888 - protein, 28 aa, Artificial Sequence
  Description of Artificial Sequence: Synthetic peptide
SEEEIRCTNPIATEQYGWVSENLMRGPR

SEQ ID NO: 35889 - protein, 29 aa, Artificial Sequence
  Description of Artificial Sequence: Synthetic peptide
SEEEIRCTNPIATEQYGTVSENLVERGNR

SEQ ID NO: 35890 - protein, 31 aa, Artificial Sequence
  Description of Artificial Sequence: Synthetic polypeptide
DEEEIRTTNPIATECYGSVCSKTNDDQRGNW

SEQ ID NO: 35891 - protein, 29 aa, Artificial Sequence
  Description of Artificial Sequence: Synthetic peptide
SEEEIRCTNPIATEQYGTSVDENLMRGNR

SEQ ID NO: 35892 - protein, 31 aa, Artificial Sequence
  Description of Artificial Sequence: Synthetic polypeptide
DEEEIRTTNPVATEQYGCVSAGNPLEYGNNR

SEQ ID NO: 35893 - protein, 29 aa, Artificial Sequence
  Description of Artificial Sequence: Synthetic peptide
SEEEIRCTNPIATEQYGSVVSENIMRGNR

SEQ ID NO: 35894 - protein, 30 aa, Artificial Sequence
  Description of Artificial Sequence: Synthetic polypeptide
SEEEIRCTNPIATEQYGSVVSENLMRGNGR

SEQ ID NO: 35895 - protein, 30 aa, Artificial Sequence
  Description of Artificial Sequence: Synthetic polypeptide
SEEEIRCTNPIATEQYGSVVSENLMRGNPR

SEQ ID NO: 35896 - protein, 29 aa, Artificial Sequence
  Description of Artificial Sequence: Synthetic peptide
SEEEIRCTNPIATEQYGSVVSENLMRQNR

SEQ ID NO: 35897 - protein, 29 aa, Artificial Sequence
  Description of Artificial Sequence: Synthetic peptide
SEEEIRCTNPIATEQYGSVVSENTMRGNR

SEQ ID NO: 35898 - protein, 29 aa, Artificial Sequence
  Description of Artificial Sequence: Synthetic peptide
SEEEIRCTNPIATEQYGSVWENLMRGNRT

SEQ ID NO: 35899 - protein, 28 aa, Artificial Sequence
  Description of Artificial Sequence: Synthetic peptide
SEEEIRCTNPIATEQYGSVWENLMRGSR

SEQ ID NO: 35900 - protein, 28 aa, Artificial Sequence
  Description of Artificial Sequence: Synthetic peptide
SEEEIRCTNPIATEQYGSVWENLMRTNR

SEQ ID NO: 35901 - protein, 29 aa, Artificial Sequence
  Description of Artificial Sequence: Synthetic peptide
SEEEIRCTNPIATEQYGSVWSENLARGPR

SEQ ID NO: 35902 - protein, 29 aa, Artificial Sequence
  Description of Artificial Sequence: Synthetic peptide
SEEEIRCTNPIATEQYGSVWSENLMLGNR

SEQ ID NO: 35903 - protein, 29 aa, Artificial Sequence
  Description of Artificial Sequence: Synthetic peptide
SEEEIRCTNPIATEQYGSVWSENLMRGNI

SEQ ID NO: 35904 - protein, 29 aa, Artificial Sequence
  Description of Artificial Sequence: Synthetic peptide
SEEEIRCTNPIATEQYGSVWSENWARGNR

SEQ ID NO: 35905 - protein, 29 aa, Artificial Sequence
  Description of Artificial Sequence: Synthetic peptide
SEEEIRCTNPIATEQYGSVWSENWMRGNR

SEQ ID NO: 35906 - protein, 29 aa, Artificial Sequence
  Description of Artificial Sequence: Synthetic peptide
SEEEIRCTNPIATEQYGSVWSETLMRGNR

SEQ ID NO: 35907 - protein, 28 aa, Artificial Sequence
  Description of Artificial Sequence: Synthetic peptide
SEEEIRCTNPIATEQYGSVYENLMRTNR

SEQ ID NO: 35908 - protein, 30 aa, Artificial Sequence
  Description of Artificial Sequence: Synthetic polypeptide
SEEEIRCTNPIATEQYGSVYSEENLMRGNR

SEQ ID NO: 35909 - protein, 31 aa, Artificial Sequence
  Description of Artificial Sequence: Synthetic polypeptide
DEEEIRTTNPVATEQYGCVSANLQRFGSEIY

SEQ ID NO: 35910 - protein, 29 aa, Artificial Sequence
  Description of Artificial Sequence: Synthetic peptide
SEEEIRCTNPIATEQYGSVYSENIMRGNR

SEQ ID NO: 35911 - protein, 29 aa, Artificial Sequence
  Description of Artificial Sequence: Synthetic peptide
SEEEIRCTNPIATEQYGSYSEQNLMRGNR

SEQ ID NO: 35912 - protein, 29 aa, Artificial Sequence
  Description of Artificial Sequence: Synthetic peptide
SEEEIRCTNPIATEQYGYVSEVNLMRGNR

SEQ ID NO: 35913 - protein, 32 aa, Artificial Sequence
  Description of Artificial Sequence: Synthetic polypeptide
DEEEIRTTNPVATEQYGCVCSTNNLQNSGSNQ

SEQ ID NO: 35914 - protein, 30 aa, Artificial Sequence
  Description of Artificial Sequence: Synthetic polypeptide
AEEEIRTTNPVATEQYGSVSTTDQQQSGNP

SEQ ID NO: 35915 - protein, 31 aa, Artificial Sequence
  Description of Artificial Sequence: Synthetic polypeptide
SEEEIRTTNPVATEQYGSVSSTENGNMRGNV

SEQ ID NO: 35916 - protein, 28 aa, Artificial Sequence
  Description of Artificial Sequence: Synthetic peptide
SENEIRTTNPIATEQYGSVSENLMREDR

SEQ ID NO: 35917 - protein, 31 aa, Artificial Sequence
  Description of Artificial Sequence: Synthetic polypeptide
AEEEIRTTNPVATEQYGSVSTGNQNQDGNEN

SEQ ID NO: 35918 - protein, 28 aa, Artificial Sequence
  Description of Artificial Sequence: Synthetic peptide
SENEIRTTNPIATEQYGSVSENLMRENL

SEQ ID NO: 35919 - protein, 28 aa, Artificial Sequence
  Description of Artificial Sequence: Synthetic peptide
SENEIRTTNPVATECYGSVSECLMRENR

SEQ ID NO: 35920 - protein, 31 aa, Artificial Sequence
  Description of Artificial Sequence: Synthetic polypeptide
AEEEIRTTNPVATEQYGSVSTGNNQQDGNTN

SEQ ID NO: 35921 - protein, 30 aa, Artificial Sequence
  Description of Artificial Sequence: Synthetic polypeptide
SENEIRTTNPVATEPYGSVSMEDLMQRGNR

SEQ ID NO: 35922 - protein, 30 aa, Artificial Sequence
  Description of Artificial Sequence: Synthetic polypeptide
AEEEIRTTNPVATEQYGSVSTGNNQGNPNE

SEQ ID NO: 35923 - protein, 30 aa, Artificial Sequence
  Description of Artificial Sequence: Synthetic polypeptide
SENEIRTTNPVATEPYGSVSMEDLQQRGNR

SEQ ID NO: 35924 - protein, 31 aa, Artificial Sequence
  Description of Artificial Sequence: Synthetic polypeptide
AEEEIRTTNPVATEQYGSVSTGNQQDEGTNE

SEQ ID NO: 35925 - protein, 31 aa, Artificial Sequence
  Description of Artificial Sequence: Synthetic polypeptide
AEEEIRTTNPVATEQYGSVSTGNLQQTNNNS

SEQ ID NO: 35926 - protein, 31 aa, Artificial Sequence
  Description of Artificial Sequence: Synthetic polypeptide
AEEEIRTTNPVATEQYGSVSTGNEQNEGNEN

SEQ ID NO: 35927 - protein, 31 aa, Artificial Sequence
  Description of Artificial Sequence: Synthetic polypeptide
DEEEIRTTNPVATEQYGCVCSTNDQNGSNAI

SEQ ID NO: 35928 - protein, 31 aa, Artificial Sequence
  Description of Artificial Sequence: Synthetic polypeptide
AEEEIRTTNPVATEQYGSVSTENQQQIGENV

SEQ ID NO: 35929 - protein, 30 aa, Artificial Sequence
  Description of Artificial Sequence: Synthetic polypeptide
DEEEIRTTNPVATCQYGCVSTEPQRFGSER

SEQ ID NO: 35930 - protein, 31 aa, Artificial Sequence
  Description of Artificial Sequence: Synthetic polypeptide
AEEEIRTTNPVATEQYGSVSTENQNQNIGNS

SEQ ID NO: 35931 - protein, 31 aa, Artificial Sequence
  Description of Artificial Sequence: Synthetic polypeptide
DEEEIRTTNPVATEQYGCVCSTNDPQNGSNQ

SEQ ID NO: 35932 - protein, 30 aa, Artificial Sequence
  Description of Artificial Sequence: Synthetic polypeptide
AEEEIRTTNPVATEQYGSVSTENNQQNDNS

SEQ ID NO: 35933 - protein, 31 aa, Artificial Sequence
  Description of Artificial Sequence: Synthetic polypeptide
DEEEIRTTNPVATCQYGSVCSTELQHGSERA

SEQ ID NO: 35934 - protein, 28 aa, Artificial Sequence
  Description of Artificial Sequence: Synthetic peptide
SENEIRTTNPVATEQYGSVSEILMAGDR

SEQ ID NO: 35935 - protein, 31 aa, Artificial Sequence
  Description of Artificial Sequence: Synthetic polypeptide
AEEEIRTTNPVATEQYGSVSTENNQLQGNVN

SEQ ID NO: 35936 - protein, 30 aa, Artificial Sequence
  Description of Artificial Sequence: Synthetic polypeptide
AEEEIRTTNPVATEQYGSVSTGNQQEENDG

SEQ ID NO: 35937 - protein, 30 aa, Artificial Sequence
  Description of Artificial Sequence: Synthetic polypeptide
SENEIRTTNPIATEPYGSVSMENLMQRGNR

SEQ ID NO: 35938 - protein, 31 aa, Artificial Sequence
  Description of Artificial Sequence: Synthetic polypeptide
DEEEIRTTNPVATEQYGCVCSTNELQFGSDL

SEQ ID NO: 35939 - protein, 28 aa, Artificial Sequence
  Description of Artificial Sequence: Synthetic peptide
SENEIRCTNPIATEQYGSVSENLMRENR

SEQ ID NO: 35940 - protein, 28 aa, Artificial Sequence
  Description of Artificial Sequence: Synthetic peptide
SENEIRCTNPIATEQYGSVSENLMRGGR

SEQ ID NO: 35941 - protein, 29 aa, Artificial Sequence
  Description of Artificial Sequence: Synthetic peptide
SENEIRCTNPIATEQYGSVSENLMRNGNR

SEQ ID NO: 35942 - protein, 29 aa, Artificial Sequence
  Description of Artificial Sequence: Synthetic peptide
SENEIRCTNPIATEQYGSVSMENLMRGNR

SEQ ID NO: 35943 - protein, 31 aa, Artificial Sequence
  Description of Artificial Sequence: Synthetic polypeptide
AEEEIRTTNPVATEQYGSVSTMNTNQQNGNQ

SEQ ID NO: 35944 - protein, 28 aa, Artificial Sequence
  Description of Artificial Sequence: Synthetic peptide
SENEIRCTNPVATEQYGDVSENLMRGNL

SEQ ID NO: 35945 - protein, 28 aa, Artificial Sequence
  Description of Artificial Sequence: Synthetic peptide
SENEIRCTNPVATEQYGEASENLQRGGR

SEQ ID NO: 35946 - protein, 31 aa, Artificial Sequence
  Description of Artificial Sequence: Synthetic polypeptide
AEEEIRTTNPVATEQYGSVSTGNQQNDGNNA

SEQ ID NO: 35947 - protein, 30 aa, Artificial Sequence
  Description of Artificial Sequence: Synthetic polypeptide
AEEEIRTTNPVATEQYGSVSTMNGTNDGNQ

SEQ ID NO: 35948 - protein, 30 aa, Artificial Sequence
  Description of Artificial Sequence: Synthetic polypeptide
AEEEIRTTNPVATEQYGSVSTLQQQANGNT

SEQ ID NO: 35949 - protein, 30 aa, Artificial Sequence
  Description of Artificial Sequence: Synthetic polypeptide
AEEEIRTTNPVATEQYGSVSTLQQLNGNNG

SEQ ID NO: 35950 - protein, 31 aa, Artificial Sequence
  Description of Artificial Sequence: Synthetic polypeptide
AEEEIRTTNPVATEQYGSVSTLNQQVGEINN

SEQ ID NO: 35951 - protein, 29 aa, Artificial Sequence
  Description of Artificial Sequence: Synthetic peptide
DEEEIRTTNPVATAQWGTSVSADLDRGND

SEQ ID NO: 35952 - protein, 31 aa, Artificial Sequence
  Description of Artificial Sequence: Synthetic polypeptide
DEEEIRTTNPVATAQYGQSVPTELQNRGSNQ

SEQ ID NO: 35953 - protein, 30 aa, Artificial Sequence
  Description of Artificial Sequence: Synthetic polypeptide
DEEEIRTTNPVATEQYGCVCSTNDQSGEQY

SEQ ID NO: 35954 - protein, 30 aa, Artificial Sequence
  Description of Artificial Sequence: Synthetic polypeptide
AEEEIRTTNPVATEQYGSVSTILQGTGTGG

SEQ ID NO: 35955 - protein, 30 aa, Artificial Sequence
  Description of Artificial Sequence: Synthetic polypeptide
AEEEIRTTNPVATEQYGSVSTGQQTNGNEV

SEQ ID NO: 35956 - protein, 31 aa, Artificial Sequence
  Description of Artificial Sequence: Synthetic polypeptide
AEEEIRTTNPVATEQYGSVSTMNGQNQGNNN

SEQ ID NO: 35957 - protein, 31 aa, Artificial Sequence
  Description of Artificial Sequence: Synthetic polypeptide
AEEEIRTTNPVATEQYGSVSTENNQIGTNES

SEQ ID NO: 35958 - protein, 31 aa, Artificial Sequence
  Description of Artificial Sequence: Synthetic polypeptide
AEEEIRTTNPVATEQYGSVSTENNQGTVGNI

SEQ ID NO: 35959 - protein, 31 aa, Artificial Sequence
  Description of Artificial Sequence: Synthetic polypeptide
AEEEIRTTNPVATEQYGSVSTENNNQLNGNS

SEQ ID NO: 35960 - protein, 29 aa, Artificial Sequence
  Description of Artificial Sequence: Synthetic peptide
SEQEIRTTNPIATEQYGSVSAEDLMRGNR

SEQ ID NO: 35961 - protein, 31 aa, Artificial Sequence
  Description of Artificial Sequence: Synthetic polypeptide
DEEEIRTTNPVATEQYGCVCSTNDHQGGNQV

SEQ ID NO: 35962 - protein, 28 aa, Artificial Sequence
  Description of Artificial Sequence: Synthetic peptide
SEREIRCTNPIATEQYGSVSENLMEGNR

SEQ ID NO: 35963 - protein, 28 aa, Artificial Sequence
  Description of Artificial Sequence: Synthetic peptide
SEREIRCTNPIATEQYGSVSENLMRGNG

SEQ ID NO: 35964 - protein, 33 aa, Artificial Sequence
  Description of Artificial Sequence: Synthetic polypeptide
DEEEIRTTNPVATDQYGSVSCTGNALSGRGGNR

SEQ ID NO: 35965 - protein, 28 aa, Artificial Sequence
  Description of Artificial Sequence: Synthetic peptide
SESEIACTNPIATEQYGSVSENLQRGQR

SEQ ID NO: 35966 - protein, 31 aa, Artificial Sequence
  Description of Artificial Sequence: Synthetic polypeptide
DEEEIRTTNPVATDQYGSVSDTENNERGTTR

SEQ ID NO: 35967 - protein, 31 aa, Artificial Sequence
  Description of Artificial Sequence: Synthetic polypeptide
DEEEIRTTNPVATDQYGSVSDTWQYQRSQNR

SEQ ID NO: 35968 - protein, 32 aa, Artificial Sequence
  Description of Artificial Sequence: Synthetic polypeptide
DEEEIRTTNPVATEQYGCVCSTNDIQEHGGNR

SEQ ID NO: 35969 - protein, 31 aa, Artificial Sequence
  Description of Artificial Sequence: Synthetic polypeptide
AEEEIRTTNPVATEQYGSVSTDLGQTTGNNN

SEQ ID NO: 35970 - protein, 33 aa, Artificial Sequence
  Description of Artificial Sequence: Synthetic polypeptide
AEEEIRTTNPVATEQYGSVSTDGNGQRGGNGRE

SEQ ID NO: 35971 - protein, 32 aa, Artificial Sequence
  Description of Artificial Sequence: Synthetic polypeptide
DEEEIRTTNPVATEQYGCVCSTNALQFGSDRA

SEQ ID NO: 35972 - protein, 29 aa, Artificial Sequence
  Description of Artificial Sequence: Synthetic peptide
AEEEIRTTNPVATEQYGSVSTAVNEGGNV

SEQ ID NO: 35973 - protein, 28 aa, Artificial Sequence
  Description of Artificial Sequence: Synthetic peptide
SESEIRATNPVATEQYGSVETNLQHGEQ

SEQ ID NO: 35974 - protein, 32 aa, Artificial Sequence
  Description of Artificial Sequence: Synthetic polypeptide
DEEEIRTTNPVATEQYGCVCSTNALDQHGSNQ

SEQ ID NO: 35975 - protein, 32 aa, Artificial Sequence
  Description of Artificial Sequence: Synthetic polypeptide
DEEEIRTTNPVATEQYGCVCSTNAIQEYFGNR

SEQ ID NO: 35976 - protein, 30 aa, Artificial Sequence
  Description of Artificial Sequence: Synthetic polypeptide
AEEEIRTTNPVATEQYGSVSTANVNEGGNM

SEQ ID NO: 35977 - protein, 32 aa, Artificial Sequence
  Description of Artificial Sequence: Synthetic polypeptide
DEEEIRTTNPVATEQYGCVCSTNAHQFGSNTR

SEQ ID NO: 35978 - protein, 30 aa, Artificial Sequence
  Description of Artificial Sequence: Synthetic polypeptide
AEEEIRTTNPVATEQYGSVSTDLGQINNAT

SEQ ID NO: 35979 - protein, 31 aa, Artificial Sequence
  Description of Artificial Sequence: Synthetic polypeptide
DEEEIRTTNPVATEQYGCVCSTNDLIFGSNA

SEQ ID NO: 35980 - protein, 29 aa, Artificial Sequence
  Description of Artificial Sequence: Synthetic peptide
SEQEIRCTNPVATEQYGSVSENLMRGEDR

SEQ ID NO: 35981 - protein, 31 aa, Artificial Sequence
  Description of Artificial Sequence: Synthetic polypeptide
AEEEIRTTNPVATEQYGSVSTDNQNQQTGNN

SEQ ID NO: 35982 - protein, 32 aa, Artificial Sequence
  Description of Artificial Sequence: Synthetic polypeptide
DEEEIRTTNPVATCQYGSVCSTNLTRFGSNQE

SEQ ID NO: 35983 - protein, 28 aa, Artificial Sequence
  Description of Artificial Sequence: Synthetic peptide
SENIIRCTNPIATEQYGSVSENLMRGNR

SEQ ID NO: 35984 - protein, 28 aa, Artificial Sequence
  Description of Artificial Sequence: Synthetic peptide
SENVIRCTNPIATEQYGSVSENLMRGNR

SEQ ID NO: 35985 - protein, 29 aa, Artificial Sequence
  Description of Artificial Sequence: Synthetic peptide
SEPEIRATNPVATEQYGSVETNNLQHGNQ

SEQ ID NO: 35986 - protein, 29 aa, Artificial Sequence
  Description of Artificial Sequence: Synthetic peptide
SEPEIRCTNPIATEQYGSVSENLMIRGNR

SEQ ID NO: 35987 - protein, 31 aa, Artificial Sequence
  Description of Artificial Sequence: Synthetic polypeptide
AEEEIRTTNPVATEQYGSVSTENNDQQGNSE

SEQ ID NO: 35988 - protein, 32 aa, Artificial Sequence
  Description of Artificial Sequence: Synthetic polypeptide
AEEEIRTTNPVATEQYGSVSTENLQTGNGGTT

SEQ ID NO: 35989 - protein, 29 aa, Artificial Sequence
  Description of Artificial Sequence: Synthetic peptide
SEPEIRCTNPIATEQYGSVSENLMRAGNR

SEQ ID NO: 35990 - protein, 31 aa, Artificial Sequence
  Description of Artificial Sequence: Synthetic polypeptide
AEEEIRTTNPVATEQYGSVSTENLQQEDTNG

SEQ ID NO: 35991 - protein, 29 aa, Artificial Sequence
  Description of Artificial Sequence: Synthetic peptide
SEPEIRCTNPIATEQYGSVWSENLMRGNR

SEQ ID NO: 35992 - protein, 31 aa, Artificial Sequence
  Description of Artificial Sequence: Synthetic polypeptide
AEEEIRTTNPVATEQYGSVSTENLGQTGGGT

SEQ ID NO: 35993 - protein, 31 aa, Artificial Sequence
  Description of Artificial Sequence: Synthetic polypeptide
DEEEIRTTNPVATEQYGCVCSTNDLQFSSDR

SEQ ID NO: 35994 - protein, 31 aa, Artificial Sequence
  Description of Artificial Sequence: Synthetic polypeptide
DEEEIRTTNPVATEQYGCVCSTNDLQFLSNQ

SEQ ID NO: 35995 - protein, 28 aa, Artificial Sequence
  Description of Artificial Sequence: Synthetic peptide
SEQEIRCTNPIATEQYGSVSEDLMRGNR

SEQ ID NO: 35996 - protein, 29 aa, Artificial Sequence
  Description of Artificial Sequence: Synthetic peptide
SEQEIRCTNPIATEQYGSVSEWNLMRGNR

SEQ ID NO: 35997 - protein, 30 aa, Artificial Sequence
  Description of Artificial Sequence: Synthetic polypeptide
AEEEIRTTNPVATEQYGSVSTEEQENGNIN

SEQ ID NO: 35998 - protein, 30 aa, Artificial Sequence
  Description of Artificial Sequence: Synthetic polypeptide
AEEEIRTTNPVATEQYGSVSTDVQAGNNDG

SEQ ID NO: 35999 - protein, 29 aa, Artificial Sequence
  Description of Artificial Sequence: Synthetic peptide
SEQEIRCTNPIATEQYGSVSYENLMRGNR

SEQ ID NO: 36000 - protein, 32 aa, Artificial Sequence
  Description of Artificial Sequence: Synthetic polypeptide
DEEEIRTTNPVATEQYGCVCSTNDLQFISNRS

SEQ ID NO: 36001 - protein, 29 aa, Artificial Sequence
  Description of Artificial Sequence: Synthetic peptide
SENEIRCTNPIATEQYGSVSENLMDRGNR

SEQ ID NO: 36002 - protein, 28 aa, Artificial Sequence
  Description of Artificial Sequence: Synthetic peptide
SESEIRCTNPIATECYGSVSCNEQRGNR

SEQ ID NO: 36003 - protein, 32 aa, Artificial Sequence
  Description of Artificial Sequence: Synthetic polypeptide
DEEEIRTTNPVATEQYGCVCSTNGHQEFGSNR

SEQ ID NO: 36004 - protein, 28 aa, Artificial Sequence
  Description of Artificial Sequence: Synthetic peptide
SENEIRCTNPIATEQYGEASENLQRGNR

SEQ ID NO: 36005 - protein, 29 aa, Artificial Sequence
  Description of Artificial Sequence: Synthetic peptide
SEHEIRCTNPIATEQYGSVSENLMRGQNR

SEQ ID NO: 36006 - protein, 32 aa, Artificial Sequence
  Description of Artificial Sequence: Synthetic polypeptide
AEEEIRTTNPVATEQYGSVSTNLNENQETGNE

SEQ ID NO: 36007 - protein, 31 aa, Artificial Sequence
  Description of Artificial Sequence: Synthetic polypeptide
AEEEIRTTNPVATEQYGSVSTNLNDNTGNTN

SEQ ID NO: 36008 - protein, 31 aa, Artificial Sequence
  Description of Artificial Sequence: Synthetic polypeptide
AEEEIRTTNPVATEQYGSVSTNLNDEGGNNM

SEQ ID NO: 36009 - protein, 30 aa, Artificial Sequence
  Description of Artificial Sequence: Synthetic polypeptide
AEEEIRTTNPVATEQYGSVSTNLLSNENEQ

SEQ ID NO: 36010 - protein, 29 aa, Artificial Sequence
  Description of Artificial Sequence: Synthetic peptide
SEHEIRCTNPIATEQYGSVSEPNLMRGNR

SEQ ID NO: 36011 - protein, 32 aa, Artificial Sequence
  Description of Artificial Sequence: Synthetic polypeptide
AEEEIRTTNPVATEQYGSVSTNLLQQNGNAEG

SEQ ID NO: 36012 - protein, 32 aa, Artificial Sequence
  Description of Artificial Sequence: Synthetic polypeptide
AEEEIRTTNPVATEQYGSVSTNLLQNNGNDEG

SEQ ID NO: 36013 - protein, 29 aa, Artificial Sequence
  Description of Artificial Sequence: Synthetic peptide
SEHEIRCTNPIATEQYGSVSENLMFRGNR

SEQ ID NO: 36014 - protein, 32 aa, Artificial Sequence
  Description of Artificial Sequence: Synthetic polypeptide
AEEEIRTTNPVATEQYGSVSTNLLQNGNNQEG

SEQ ID NO: 36015 - protein, 32 aa, Artificial Sequence
  Description of Artificial Sequence: Synthetic polypeptide
AEEEIRTTNPVATEQYGSVSTNLLQGNGGNPG

SEQ ID NO: 36016 - protein, 32 aa, Artificial Sequence
  Description of Artificial Sequence: Synthetic polypeptide
AEEEIRTTNPVATEQYGSVSTNLLQGNDGNEG

SEQ ID NO: 36017 - protein, 32 aa, Artificial Sequence
  Description of Artificial Sequence: Synthetic polypeptide
AEEEIRTTNPVATEQYGSVSTNLLQENEGNQG

SEQ ID NO: 36018 - protein, 31 aa, Artificial Sequence
  Description of Artificial Sequence: Synthetic polypeptide
AEEEIRTTNPVATEQYGSVSTNLLQEDTNQG

SEQ ID NO: 36019 - protein, 32 aa, Artificial Sequence
  Description of Artificial Sequence: Synthetic polypeptide
AEEEIRTTNPVATEQYGSVSTNLLNQNQGNQG

SEQ ID NO: 36020 - protein, 32 aa, Artificial Sequence
  Description of Artificial Sequence: Synthetic polypeptide
AEEEIRTTNPVATEQYGSVSTNLLNQNGNQNG

SEQ ID NO: 36021 - protein, 29 aa, Artificial Sequence
  Description of Artificial Sequence: Synthetic peptide
SEKEIRCTNPIATEQYGSIVSENLMRGNR

SEQ ID NO: 36022 - protein, 32 aa, Artificial Sequence
  Description of Artificial Sequence: Synthetic polypeptide
AEEEIRTTNPVATEQYGSVSTNLLGQQNGNNG

SEQ ID NO: 36023 - protein, 28 aa, Artificial Sequence
  Description of Artificial Sequence: Synthetic peptide
SEKEINCTNPIATEQYGSVSENLMRGNR

SEQ ID NO: 36024 - protein, 32 aa, Artificial Sequence
  Description of Artificial Sequence: Synthetic polypeptide
AEEEIRTTNPVATEQYGSVSTNLLEQNNGNEG

SEQ ID NO: 36025 - protein, 32 aa, Artificial Sequence
  Description of Artificial Sequence: Synthetic polypeptide
AEEEIRTTNPVATEQYGSVSTNLNEQVGTNID

SEQ ID NO: 36026 - protein, 28 aa, Artificial Sequence
  Description of Artificial Sequence: Synthetic peptide
SEGEIRPTNPIATEQYGSVSENLMRGTR

SEQ ID NO: 36027 - protein, 29 aa, Artificial Sequence
  Description of Artificial Sequence: Synthetic peptide
DEEEIRTTNPVAHEQYGSVWTGLQVFDTR

SEQ ID NO: 36028 - protein, 28 aa, Artificial Sequence
  Description of Artificial Sequence: Synthetic peptide
SEGEIACTNPVATEQYGSVATNLQNGNN

SEQ ID NO: 36029 - protein, 29 aa, Artificial Sequence
  Description of Artificial Sequence: Synthetic peptide
DEEEIRTTNPVAHEQYGSVWTNLQGFDSE

SEQ ID NO: 36030 - protein, 28 aa, Artificial Sequence
  Description of Artificial Sequence: Synthetic peptide
SEGEIAPTNPCATEQYGSVSENLMRGNR

SEQ ID NO: 36031 - protein, 29 aa, Artificial Sequence
  Description of Artificial Sequence: Synthetic peptide
DEEEIRTTNPVAHEQYGSVWTNLQVFESD

SEQ ID NO: 36032 - protein, 30 aa, Artificial Sequence
  Description of Artificial Sequence: Synthetic polypeptide
DEEEIRTTNPVAHEQYGSVWTNLQVNDVSR

SEQ ID NO: 36033 - protein, 28 aa, Artificial Sequence
  Description of Artificial Sequence: Synthetic peptide
SEGEIAPTNPIATEQYGSVSENLMRGNR

SEQ ID NO: 36034 - protein, 30 aa, Artificial Sequence
  Description of Artificial Sequence: Synthetic polypeptide
DEEEIRTTNPVAHEQYGSVWTSNLQVFDGR

SEQ ID NO: 36035 - protein, 28 aa, Artificial Sequence
  Description of Artificial Sequence: Synthetic peptide
SEGEIRPTNPVAYEQYGSVFTNLQHGNQ

SEQ ID NO: 36036 - protein, 28 aa, Artificial Sequence
  Description of Artificial Sequence: Synthetic peptide
SEGEIRCTNPCATEQYGIVSENLQRGTR

SEQ ID NO: 36037 - protein, 28 aa, Artificial Sequence
  Description of Artificial Sequence: Synthetic peptide
SEGEIRCTNPIAFEQYGSVSENLMRGNR

SEQ ID NO: 36038 - protein, 28 aa, Artificial Sequence
  Description of Artificial Sequence: Synthetic peptide
SEGEIRCTNPIASEQYGSVSENLMRGNR

SEQ ID NO: 36039 - protein, 32 aa, Artificial Sequence
  Description of Artificial Sequence: Synthetic polypeptide
AEEEIRTTNPVATEQYGSVSTNLNLQQQEGNQ

SEQ ID NO: 36040 - protein, 28 aa, Artificial Sequence
  Description of Artificial Sequence: Synthetic peptide
SEGEIRCTNPIATEQYGSVSENLMRGYR

SEQ ID NO: 36041 - protein, 29 aa, Artificial Sequence
  Description of Artificial Sequence: Synthetic peptide
SEGEIRCTNPIATEQYGSVSENSLMRGNR

SEQ ID NO: 36042 - protein, 29 aa, Artificial Sequence
  Description of Artificial Sequence: Synthetic peptide
SEGEIRCTNPIATEQYGSVSNENLMRGNR

SEQ ID NO: 36043 - protein, 29 aa, Artificial Sequence
  Description of Artificial Sequence: Synthetic peptide
SEGEIRCTNPIATEQYGSVVSENLMRGNR

SEQ ID NO: 36044 - protein, 29 aa, Artificial Sequence
  Description of Artificial Sequence: Synthetic peptide
SEGEIRCTNPVATEQYGSVATNLQHGNQD

SEQ ID NO: 36045 - protein, 30 aa, Artificial Sequence
  Description of Artificial Sequence: Synthetic polypeptide
DEEEIRTTNPVAHEQYGSVYTNLQVFDSPR

SEQ ID NO: 36046 - protein, 30 aa, Artificial Sequence
  Description of Artificial Sequence: Synthetic polypeptide
AEEEIRTTNPVATEQYGSVSTNLINNENGI

SEQ ID NO: 36047 - protein, 30 aa, Artificial Sequence
  Description of Artificial Sequence: Synthetic polypeptide
AEEEIRTTNPVATEQYGSVSTNLINENQGD

SEQ ID NO: 36048 - protein, 30 aa, Artificial Sequence
  Description of Artificial Sequence: Synthetic polypeptide
AEEEIRTTNPVATEQYGSVSTNLINDENGG

SEQ ID NO: 36049 - protein, 30 aa, Artificial Sequence
  Description of Artificial Sequence: Synthetic polypeptide
SEMEIRCTNPVATEQYGSVCSTDNLEFGNR

SEQ ID NO: 36050 - protein, 30 aa, Artificial Sequence
  Description of Artificial Sequence: Synthetic polypeptide
SEMEIRTTNPVATEQYGSVCSTDNPEFGNR

SEQ ID NO: 36051 - protein, 29 aa, Artificial Sequence
  Description of Artificial Sequence: Synthetic peptide
SEMEIRTTNPVATEQYGTVSTNPVERGND

SEQ ID NO: 36052 - protein, 30 aa, Artificial Sequence
  Description of Artificial Sequence: Synthetic polypeptide
AEEEIRTTNPVATEQYGSVSTNGNGTQGNV

SEQ ID NO: 36053 - protein, 30 aa, Artificial Sequence
  Description of Artificial Sequence: Synthetic polypeptide
AEEEIRTTNPVATEQYGSVSTNGGVAGNAG

SEQ ID NO: 36054 - protein, 28 aa, Artificial Sequence
  Description of Artificial Sequence: Synthetic peptide
SENEIACTNPIATEQYGEVSENLQRGNR

SEQ ID NO: 36055 - protein, 28 aa, Artificial Sequence
  Description of Artificial Sequence: Synthetic peptide
SENEIACTNPIATEQYGSVSENLMRGNR

SEQ ID NO: 36056 - protein, 31 aa, Artificial Sequence
  Description of Artificial Sequence: Synthetic polypeptide
AEEEIRTTNPVATEQYGSVSTNENQQDGNND

SEQ ID NO: 36057 - protein, 28 aa, Artificial Sequence
  Description of Artificial Sequence: Synthetic peptide
SEMEIRCTNPIATEQYGSVSENLMRANR

SEQ ID NO: 36058 - protein, 30 aa, Artificial Sequence
  Description of Artificial Sequence: Synthetic polypeptide
AEEEIRTTNPVATEQYGSVSTNDVQGTNVG

SEQ ID NO: 36059 - protein, 31 aa, Artificial Sequence
  Description of Artificial Sequence: Synthetic polypeptide
AEEEIRTTNPVATEQYGSVSTNDLGQQGEGG

SEQ ID NO: 36060 - protein, 28 aa, Artificial Sequence
  Description of Artificial Sequence: Synthetic peptide
SENEIACTNPVATECYGSVSENLMRGNR

SEQ ID NO: 36061 - protein, 28 aa, Artificial Sequence
  Description of Artificial Sequence: Synthetic peptide
SENEIACTNPVATECYGSVSENLQRGER

SEQ ID NO: 36062 - protein, 31 aa, Artificial Sequence
  Description of Artificial Sequence: Synthetic polypeptide
AEEEIRTTNPVATEQYGSVSTNANQQDGNGT

SEQ ID NO: 36063 - protein, 28 aa, Artificial Sequence
  Description of Artificial Sequence: Synthetic peptide
SENEIACTNPVATEQYGSVSENLMRGGR

SEQ ID NO: 36064 - protein, 29 aa, Artificial Sequence
  Description of Artificial Sequence: Synthetic peptide
DEEEIRTTNPVASEQYGCVATNLQVEDMR

SEQ ID NO: 36065 - protein, 29 aa, Artificial Sequence
  Description of Artificial Sequence: Synthetic peptide
SENEIRATNPVATEQYGSVETNLQHGNGQ

SEQ ID NO: 36066 - protein, 30 aa, Artificial Sequence
  Description of Artificial Sequence: Synthetic polypeptide
DEEEIRTTNPVASEQYGSVSCPALNMSGNR

SEQ ID NO: 36067 - protein, 30 aa, Artificial Sequence
  Description of Artificial Sequence: Synthetic polypeptide
AEEEIRTTNPVATEQYGSVSTNDQNGGQEE

SEQ ID NO: 36068 - protein, 28 aa, Artificial Sequence
  Description of Artificial Sequence: Synthetic peptide
SEMEIRCTNPIATEQYGSVSEGLMRGNR

SEQ ID NO: 36069 - protein, 30 aa, Artificial Sequence
  Description of Artificial Sequence: Synthetic polypeptide
SEMEIRCTNPIATEQYGSVCSTDNLERGNR

SEQ ID NO: 36070 - protein, 31 aa, Artificial Sequence
  Description of Artificial Sequence: Synthetic polypeptide
AEEEIRTTNPVATEQYGSVSTNGVEQNGGNT

SEQ ID NO: 36071 - protein, 30 aa, Artificial Sequence
  Description of Artificial Sequence: Synthetic polypeptide
AEEEIRTTNPVATEQYGSVSTNLIENTENG

SEQ ID NO: 36072 - protein, 31 aa, Artificial Sequence
  Description of Artificial Sequence: Synthetic polypeptide
AEEEIRTTNPVATEQYGSVSTNLGQVQGQGN

SEQ ID NO: 36073 - protein, 32 aa, Artificial Sequence
  Description of Artificial Sequence: Synthetic polypeptide
AEEEIRTTNPVATEQYGSVSTNLGQTGNGGTN

SEQ ID NO: 36074 - protein, 28 aa, Artificial Sequence
  Description of Artificial Sequence: Synthetic peptide
SELEIRCTNPIATEQYGSVSENDMRGNR

SEQ ID NO: 36075 - protein, 31 aa, Artificial Sequence
  Description of Artificial Sequence: Synthetic polypeptide
AEEEIRTTNPVATEQYGSVSTNLGNEAGNDG

SEQ ID NO: 36076 - protein, 30 aa, Artificial Sequence
  Description of Artificial Sequence: Synthetic polypeptide
AEEEIRTTNPVATEQYGSVSTNLGINENEG

SEQ ID NO: 36077 - protein, 31 aa, Artificial Sequence
  Description of Artificial Sequence: Synthetic polypeptide
AEEEIRTTNPVATEQYGSVSTNLGEAGENEG

SEQ ID NO: 36078 - protein, 28 aa, Artificial Sequence
  Description of Artificial Sequence: Synthetic peptide
SELEIRCTNPIATEQYGSVSENLMRHNR

SEQ ID NO: 36079 - protein, 32 aa, Artificial Sequence
  Description of Artificial Sequence: Synthetic polypeptide
AEEEIRTTNPVATEQYGSVSTNLDQTGGTTNT

SEQ ID NO: 36080 - protein, 33 aa, Artificial Sequence
  Description of Artificial Sequence: Synthetic polypeptide
DEEEIRTTNPVAMEQYGQSVSGTNDLEQRGIAR

SEQ ID NO: 36081 - protein, 32 aa, Artificial Sequence
  Description of Artificial Sequence: Synthetic polypeptide
AEEEIRTTNPVATEQYGSVSTNLDQQEGNNNE

SEQ ID NO: 36082 - protein, 31 aa, Artificial Sequence
  Description of Artificial Sequence: Synthetic polypeptide
AEEEIRTTNPVATEQYGSVSTNLDNTTGNTG

SEQ ID NO: 36083 - protein, 31 aa, Artificial Sequence
  Description of Artificial Sequence: Synthetic polypeptide
AEEEIRTTNPVATEQYGSVSTNLDNTEGGNT

SEQ ID NO: 36084 - protein, 30 aa, Artificial Sequence
  Description of Artificial Sequence: Synthetic polypeptide
AEEEIRTTNPVATEQYGSVSTNLDNQTNQT

SEQ ID NO: 36085 - protein, 32 aa, Artificial Sequence
  Description of Artificial Sequence: Synthetic polypeptide
AEEEIRTTNPVATEQYGSVSTNLDNQEGNQTN

SEQ ID NO: 36086 - protein, 31 aa, Artificial Sequence
  Description of Artificial Sequence: Synthetic polypeptide
AEEEIRTTNPVATEQYGSVSTNLDEGGTNNN

SEQ ID NO: 36087 - protein, 29 aa, Artificial Sequence
  Description of Artificial Sequence: Synthetic peptide
SEMEIRCTNPIATEQYGSVCSENLMRGNR

SEQ ID NO: 36088 - protein, 31 aa, Artificial Sequence
  Description of Artificial Sequence: Synthetic polypeptide
DEEEIRTTNPVATEQYGCVCSTNHEQRISER

SEQ ID NO: 36089 - protein, 31 aa, Artificial Sequence
  Description of Artificial Sequence: Synthetic polypeptide
AEEEIRTTNPVATEQYGSVSTNHQNFGSNQS

SEQ ID NO: 36090 - protein, 28 aa, Artificial Sequence
  Description of Artificial Sequence: Synthetic peptide
SENEIRCTNPIATEQYGSASENLMRGNR

SEQ ID NO: 36091 - protein, 31 aa, Artificial Sequence
  Description of Artificial Sequence: Synthetic polypeptide
AEEEIRTTNPVATEQYGSVSTNLNQESGGDG

SEQ ID NO: 36092 - protein, 30 aa, Artificial Sequence
  Description of Artificial Sequence: Synthetic polypeptide
AEEEIRTTNPVATEQYGSVSTANQNEAGNN

SEQ ID NO: 36093 - protein, 28 aa, Artificial Sequence
  Description of Artificial Sequence: Synthetic peptide
SESEIRCTNPIATEGYGSVSETLQRGNR

SEQ ID NO: 36094 - protein, 31 aa, Artificial Sequence
  Description of Artificial Sequence: Synthetic polypeptide
AEEEIRTTNPVATEQYGSVSSTNLQQGAEMG

SEQ ID NO: 36095 - protein, 31 aa, Artificial Sequence
  Description of Artificial Sequence: Synthetic polypeptide
AEEEIRTTNPVATEQYGSVSSTNLQNVENNI

SEQ ID NO: 36096 - protein, 31 aa, Artificial Sequence
  Description of Artificial Sequence: Synthetic polypeptide
AEEEIRTTNPVATEQYGSVSSTNLQNSTNQE

SEQ ID NO: 36097 - protein, 31 aa, Artificial Sequence
  Description of Artificial Sequence: Synthetic polypeptide
AEEEIRTTNPVATEQYGSVSSTNLQNEDENE

SEQ ID NO: 36098 - protein, 32 aa, Artificial Sequence
  Description of Artificial Sequence: Synthetic polypeptide
AEEEIRTTNPVATEQYGSVSSTNLQLQQGNQS

SEQ ID NO: 36099 - protein, 31 aa, Artificial Sequence
  Description of Artificial Sequence: Synthetic polypeptide
AEEEIRTTNPVATEQYGSVSSTNLQGVTNNS

SEQ ID NO: 36100 - protein, 32 aa, Artificial Sequence
  Description of Artificial Sequence: Synthetic polypeptide
AEEEIRTTNPVATEQYGSVSSTNLQEQNGNIG

SEQ ID NO: 36101 - protein, 32 aa, Artificial Sequence
  Description of Artificial Sequence: Synthetic polypeptide
AEEEIRTTNPVATEQYGSVSSTNLQEQIGNNQ

SEQ ID NO: 36102 - protein, 32 aa, Artificial Sequence
  Description of Artificial Sequence: Synthetic polypeptide
AEEEIRTTNPVATEQYGSVSSTNLQQGENNEQ

SEQ ID NO: 36103 - protein, 32 aa, Artificial Sequence
  Description of Artificial Sequence: Synthetic polypeptide
AEEEIRTTNPVATEQYGSVSSTNLQEQGNNQQ

SEQ ID NO: 36104 - protein, 31 aa, Artificial Sequence
  Description of Artificial Sequence: Synthetic polypeptide
AEEEIRTTNPVATEQYGSVSSTNLQENEIND

SEQ ID NO: 36105 - protein, 32 aa, Artificial Sequence
  Description of Artificial Sequence: Synthetic polypeptide
AEEEIRTTNPVATEQYGSVSSTNLQEGGNNLG

SEQ ID NO: 36106 - protein, 32 aa, Artificial Sequence
  Description of Artificial Sequence: Synthetic polypeptide
AEEEIRTTNPVATEQYGSVSSTNLQEGEENTE

SEQ ID NO: 36107 - protein, 33 aa, Artificial Sequence
  Description of Artificial Sequence: Synthetic polypeptide
DEEEIRTTNPVATEAYGISTVSCTNLQRPGGNQ

SEQ ID NO: 36108 - protein, 31 aa, Artificial Sequence
  Description of Artificial Sequence: Synthetic polypeptide
AEEEIRTTNPVATEQYGSVSSTNLQEDTNNG

SEQ ID NO: 36109 - protein, 31 aa, Artificial Sequence
  Description of Artificial Sequence: Synthetic polypeptide
DEEEIRTTNPVATEQYGCVCSTGNHQGGSNT

SEQ ID NO: 36110 - protein, 32 aa, Artificial Sequence
  Description of Artificial Sequence: Synthetic polypeptide
AEEEIRTTNPVATEQYGSVSSTNLNQQGNGND

SEQ ID NO: 36111 - protein, 32 aa, Artificial Sequence
  Description of Artificial Sequence: Synthetic polypeptide
AEEEIRTTNPVATEQYGSVSSTNLNQQGGNTN

SEQ ID NO: 36112 - protein, 32 aa, Artificial Sequence
  Description of Artificial Sequence: Synthetic polypeptide
AEEEIRTTNPVATEQYGSVSSTNLQEQGNNIA

SEQ ID NO: 36113 - protein, 29 aa, Artificial Sequence
  Description of Artificial Sequence: Synthetic peptide
SETEIRCTNPIATEQYGSVSIENLMRGNR

SEQ ID NO: 36114 - protein, 33 aa, Artificial Sequence
  Description of Artificial Sequence: Synthetic polypeptide
DEEEIRTTNPVATEQYGCVCSTGNLNARFGSNR

SEQ ID NO: 36115 - protein, 32 aa, Artificial Sequence
  Description of Artificial Sequence: Synthetic polypeptide
DEEEIRTTNPVATEAYGETVSCTGNLSQGGNR

SEQ ID NO: 36116 - protein, 32 aa, Artificial Sequence
  Description of Artificial Sequence: Synthetic polypeptide
AEEEIRTTNPVATEQYGSVSSTNNLQEGGNLL

SEQ ID NO: 36117 - protein, 32 aa, Artificial Sequence
  Description of Artificial Sequence: Synthetic polypeptide
AEEEIRTTNPVATEQYGSVSSTNNLQDGGNLN

SEQ ID NO: 36118 - protein, 32 aa, Artificial Sequence
  Description of Artificial Sequence: Synthetic polypeptide
AEEEIRTTNPVATEQYGSVSSTNNLNQGNGNN

SEQ ID NO: 36119 - protein, 28 aa, Artificial Sequence
  Description of Artificial Sequence: Synthetic peptide
SETEIRCTNPIATEQYGSVSENLMPGNR

SEQ ID NO: 36120 - protein, 32 aa, Artificial Sequence
  Description of Artificial Sequence: Synthetic polypeptide
AEEEIRTTNPVATEQYGSVSSTNNLNQGGNTM

SEQ ID NO: 36121 - protein, 32 aa, Artificial Sequence
  Description of Artificial Sequence: Synthetic polypeptide
AEEEIRTTNPVATEQYGSVSSTNNLNQGGNNN

SEQ ID NO: 36122 - protein, 32 aa, Artificial Sequence
  Description of Artificial Sequence: Synthetic polypeptide
AEEEIRTTNPVATEQYGSVSSTNNLNQGGNAA

SEQ ID NO: 36123 - protein, 31 aa, Artificial Sequence
  Description of Artificial Sequence: Synthetic polypeptide
AEEEIRTTNPVATEQYGSVSSTNNLGAGNEQ

SEQ ID NO: 36124 - protein, 32 aa, Artificial Sequence
  Description of Artificial Sequence: Synthetic polypeptide
AEEEIRTTNPVATEQYGSVSSTNLQQQGENNA

SEQ ID NO: 36125 - protein, 30 aa, Artificial Sequence
  Description of Artificial Sequence: Synthetic polypeptide
AEEEIRTTNPVATEQYGSVSSTNNGAGNST

SEQ ID NO: 36126 - protein, 31 aa, Artificial Sequence
  Description of Artificial Sequence: Synthetic polypeptide
AEEEIRTTNPVATEQYGSVSSTNNEQLGENT

SEQ ID NO: 36127 - protein, 31 aa, Artificial Sequence
  Description of Artificial Sequence: Synthetic polypeptide
AEEEIRTTNPVATEQYGSVSSTNNDQGNGNP

SEQ ID NO: 36128 - protein, 31 aa, Artificial Sequence
  Description of Artificial Sequence: Synthetic polypeptide
AEEEIRTTNPVATEQYGSVSSTNNANQDGNV

SEQ ID NO: 36129 - protein, 29 aa, Artificial Sequence
  Description of Artificial Sequence: Synthetic peptide
SETEIRCTNPIATEQYGSVSENLMRGGNR

SEQ ID NO: 36130 - protein, 31 aa, Artificial Sequence
  Description of Artificial Sequence: Synthetic polypeptide
AEEEIRTTNPVATEQYGSVSSTNLQVQGTTI

SEQ ID NO: 36131 - protein, 31 aa, Artificial Sequence
  Description of Artificial Sequence: Synthetic polypeptide
AEEEIRTTNPVATEQYGSVSSTNLQTNTNND

SEQ ID NO: 36132 - protein, 31 aa, Artificial Sequence
  Description of Artificial Sequence: Synthetic polypeptide
AEEEIRTTNPVATEQYGSVSSTNLQQQSNQE

SEQ ID NO: 36133 - protein, 32 aa, Artificial Sequence
  Description of Artificial Sequence: Synthetic polypeptide
AEEEIRTTNPVATEQYGSVSSTNLQQQNGIND

SEQ ID NO: 36134 - protein, 31 aa, Artificial Sequence
  Description of Artificial Sequence: Synthetic polypeptide
AEEEIRTTNPVATEQYGSVSSTNNEQQGVNI

SEQ ID NO: 36135 - protein, 32 aa, Artificial Sequence
  Description of Artificial Sequence: Synthetic polypeptide
DEEEIRTTNPVATEAYGIVVSTTNLQDRNVNR

SEQ ID NO: 36136 - protein, 32 aa, Artificial Sequence
  Description of Artificial Sequence: Synthetic polypeptide
AEEEIRTTNPVATEQYGSVSSTNLNQGQGNNN

SEQ ID NO: 36137 - protein, 32 aa, Artificial Sequence
  Description of Artificial Sequence: Synthetic polypeptide
AEEEIRTTNPVATEQYGSVSSTNLNQGQGENA

SEQ ID NO: 36138 - protein, 31 aa, Artificial Sequence
  Description of Artificial Sequence: Synthetic polypeptide
AEEEIRTTNPVATEQYGSVSSTNDEQLGNNI

SEQ ID NO: 36139 - protein, 31 aa, Artificial Sequence
  Description of Artificial Sequence: Synthetic polypeptide
AEEEIRTTNPVATEQYGSVSSTNDEQGNGNI

SEQ ID NO: 36140 - protein, 31 aa, Artificial Sequence
  Description of Artificial Sequence: Synthetic polypeptide
AEEEIRTTNPVATEQYGSVSSTNANQAGENQ

SEQ ID NO: 36141 - protein, 32 aa, Artificial Sequence
  Description of Artificial Sequence: Synthetic polypeptide
DEEEIRTTNPVATEQYGCVCSTGELNQRGSQR

SEQ ID NO: 36142 - protein, 32 aa, Artificial Sequence
  Description of Artificial Sequence: Synthetic polypeptide
AEEEIRTTNPVATEQYGSVSSTENTNQEGGNR

SEQ ID NO: 36143 - protein, 31 aa, Artificial Sequence
  Description of Artificial Sequence: Synthetic polypeptide
AEEEIRTTNPVATEQYGSVSSTENNQNGNNS

SEQ ID NO: 36144 - protein, 32 aa, Artificial Sequence
  Description of Artificial Sequence: Synthetic polypeptide
AEEEIRTTNPVATEQYGSVSSTENLQLGNETE

SEQ ID NO: 36145 - protein, 32 aa, Artificial Sequence
  Description of Artificial Sequence: Synthetic polypeptide
AEEEIRTTNPVATEQYGSVSSTENLGQQGNND

SEQ ID NO: 36146 - protein, 30 aa, Artificial Sequence
  Description of Artificial Sequence: Synthetic polypeptide
AEEEIRTTNPVATEQYGSVSSTNDNQGENE

SEQ ID NO: 36147 - protein, 31 aa, Artificial Sequence
  Description of Artificial Sequence: Synthetic polypeptide
AEEEIRTTNPVATEQYGSVSSTELQQNGNTT

SEQ ID NO: 36148 - protein, 31 aa, Artificial Sequence
  Description of Artificial Sequence: Synthetic polypeptide
DEEEIRTTNPVATEQYGCVCSTGELERGNQY

SEQ ID NO: 36149 - protein, 32 aa, Artificial Sequence
  Description of Artificial Sequence: Synthetic polypeptide
AEEEIRTTNPVATEQYGSVSSSTNQLQQGNNG

SEQ ID NO: 36150 - protein, 32 aa, Artificial Sequence
  Description of Artificial Sequence: Synthetic polypeptide
AEEEIRTTNPVATEQYGSVSSSTNNLQTGNVA

SEQ ID NO: 36151 - protein, 31 aa, Artificial Sequence
  Description of Artificial Sequence: Synthetic polypeptide
AEEEIRTTNPVATEQYGSVSSSTNLNENGNG

SEQ ID NO: 36152 - protein, 32 aa, Artificial Sequence
  Description of Artificial Sequence: Synthetic polypeptide
DEEEIRTTNPVATEQYGCVCSTGELDQRGSNQ

SEQ ID NO: 36153 - protein, 32 aa, Artificial Sequence
  Description of Artificial Sequence: Synthetic polypeptide
DEEEIRTTNPVATEAYGQVSCTGNELQRGGNE

SEQ ID NO: 36154 - protein, 33 aa, Artificial Sequence
  Description of Artificial Sequence: Synthetic polypeptide
DEEEIRTTNPVATEAYGSISCTQNLSQRGGNNR

SEQ ID NO: 36155 - protein, 30 aa, Artificial Sequence
  Description of Artificial Sequence: Synthetic polypeptide
AEEEIRTTNPVATEQYGSVSSNLGQQEGEG

SEQ ID NO: 36156 - protein, 31 aa, Artificial Sequence
  Description of Artificial Sequence: Synthetic polypeptide
AEEEIRTTNPVATEQYGSVSSTELQGNGNVT

SEQ ID NO: 36157 - protein, 31 aa, Artificial Sequence
  Description of Artificial Sequence: Synthetic polypeptide
AEEEIRTTNPVATEQYGSVSSTNDQQGNGNG

SEQ ID NO: 36158 - protein, 31 aa, Artificial Sequence
  Description of Artificial Sequence: Synthetic polypeptide
AEEEIRTTNPVATEQYGSVSSTNGQQNGGNT

SEQ ID NO: 36159 - protein, 31 aa, Artificial Sequence
  Description of Artificial Sequence: Synthetic polypeptide
DEEEIRTTNPVATEQYGCVCSTGNELQNGEQ

SEQ ID NO: 36160 - protein, 32 aa, Artificial Sequence
  Description of Artificial Sequence: Synthetic polypeptide
AEEEIRTTNPVATEQYGSVSSTNLNQGNGNAE

SEQ ID NO: 36161 - protein, 32 aa, Artificial Sequence
  Description of Artificial Sequence: Synthetic polypeptide
AEEEIRTTNPVATEQYGSVSSTNLNQGIGTNN

SEQ ID NO: 36162 - protein, 32 aa, Artificial Sequence
  Description of Artificial Sequence: Synthetic polypeptide
AEEEIRTTNPVATEQYGSVSSTNLNQGGTNAV

SEQ ID NO: 36163 - protein, 32 aa, Artificial Sequence
  Description of Artificial Sequence: Synthetic polypeptide
AEEEIRTTNPVATEQYGSVSSTNLNQGGNEAG

SEQ ID NO: 36164 - protein, 32 aa, Artificial Sequence
  Description of Artificial Sequence: Synthetic polypeptide
AEEEIRTTNPVATEQYGSVSSTNLNQGGGNDG

SEQ ID NO: 36165 - protein, 32 aa, Artificial Sequence
  Description of Artificial Sequence: Synthetic polypeptide
AEEEIRTTNPVATEQYGSVSSTNLNQGGGINN

SEQ ID NO: 36166 - protein, 30 aa, Artificial Sequence
  Description of Artificial Sequence: Synthetic polypeptide
DEEEIRTTNPVATEAYGKHSTNESQRVGNL

SEQ ID NO: 36167 - protein, 32 aa, Artificial Sequence
  Description of Artificial Sequence: Synthetic polypeptide
AEEEIRTTNPVATEQYGSVSSTNLNQEQGNQD

SEQ ID NO: 36168 - protein, 32 aa, Artificial Sequence
  Description of Artificial Sequence: Synthetic polypeptide
AEEEIRTTNPVATEQYGSVSSTNLNQAGGNIA

SEQ ID NO: 36169 - protein, 31 aa, Artificial Sequence
  Description of Artificial Sequence: Synthetic polypeptide
DEEEIRTTNPVATEAYGKTVSTGNLSQGGSR

SEQ ID NO: 36170 - protein, 32 aa, Artificial Sequence
  Description of Artificial Sequence: Synthetic polypeptide
AEEEIRTTNPVATEQYGSVSSTNLGQQGENND

SEQ ID NO: 36171 - protein, 33 aa, Artificial Sequence
  Description of Artificial Sequence: Synthetic polypeptide
DEEEIRTTNPVATEQYGCVCSTGNGLQFGSNRF

SEQ ID NO: 36172 - protein, 32 aa, Artificial Sequence
  Description of Artificial Sequence: Synthetic polypeptide
DEEEIRTTNPVATEAYGKVNCTGNELSQRGNR

SEQ ID NO: 36173 - protein, 31 aa, Artificial Sequence
  Description of Artificial Sequence: Synthetic polypeptide
AEEEIRTTNPVATEQYGSVSSTNLGLGGNSN

SEQ ID NO: 36174 - protein, 31 aa, Artificial Sequence
  Description of Artificial Sequence: Synthetic polypeptide
AEEEIRTTNPVATEQYGSVSSTNLGANGNEA

SEQ ID NO: 36175 - protein, 31 aa, Artificial Sequence
  Description of Artificial Sequence: Synthetic polypeptide
AEEEIRTTNPVATEQYGSVSSTNLGAGTNIN

SEQ ID NO: 36176 - protein, 31 aa, Artificial Sequence
  Description of Artificial Sequence: Synthetic polypeptide
AEEEIRTTNPVATEQYGSVSSTNLGAGNQVT

SEQ ID NO: 36177 - protein, 30 aa, Artificial Sequence
  Description of Artificial Sequence: Synthetic polypeptide
AEEEIRTTNPVATEQYGSVSSTNLGAGESG

SEQ ID NO: 36178 - protein, 31 aa, Artificial Sequence
  Description of Artificial Sequence: Synthetic polypeptide
AEEEIRTTNPVATEQYGSVSSTNLEQGTENI

SEQ ID NO: 36179 - protein, 32 aa, Artificial Sequence
  Description of Artificial Sequence: Synthetic polypeptide
AEEEIRTTNPVATEQYGSVSSTNNLQEQGNSE

SEQ ID NO: 36180 - protein, 30 aa, Artificial Sequence
  Description of Artificial Sequence: Synthetic polypeptide
AEEEIRTTNPVATEQYGSVSTANQEGGNQQ

SEQ ID NO: 36181 - protein, 32 aa, Artificial Sequence
  Description of Artificial Sequence: Synthetic polypeptide
AEEEIRTTNPVATEQYGSVSSTNNLQLGNEQV

SEQ ID NO: 36182 - protein, 32 aa, Artificial Sequence
  Description of Artificial Sequence: Synthetic polypeptide
AEEEIRTTNPVATEQYGSVSSTNNLQQQGNPE

SEQ ID NO: 36183 - protein, 28 aa, Artificial Sequence
  Description of Artificial Sequence: Synthetic peptide
SESEIRCTNPVATEAYGSVFTNLQHGNQ

SEQ ID NO: 36184 - protein, 33 aa, Artificial Sequence
  Description of Artificial Sequence: Synthetic polypeptide
DEEEIRTTNPVATEQYGCVCSTINLQFFGSNNR

SEQ ID NO: 36185 - protein, 31 aa, Artificial Sequence
  Description of Artificial Sequence: Synthetic polypeptide
AEEEIRTTNPVATEQYGSVSSVTNDQGNGNE

SEQ ID NO: 36186 - protein, 32 aa, Artificial Sequence
  Description of Artificial Sequence: Synthetic polypeptide
DEEEIRTTNPVATEAWGKVVSCTNLSQRTGNR

SEQ ID NO: 36187 - protein, 29 aa, Artificial Sequence
  Description of Artificial Sequence: Synthetic peptide
SESEIRGTNPVATEQYGSVITNLQHGENQ

SEQ ID NO: 36188 - protein, 28 aa, Artificial Sequence
  Description of Artificial Sequence: Synthetic peptide
SESEIRMTNPVATEQYGSVETNLQHNNQ

SEQ ID NO: 36189 - protein, 29 aa, Artificial Sequence
  Description of Artificial Sequence: Synthetic peptide
SESEIRPTNPVATEQYGSVVFTNLQHGNQ

SEQ ID NO: 36190 - protein, 31 aa, Artificial Sequence
  Description of Artificial Sequence: Synthetic polypeptide
DEEEIRTTNPVATEQYGCVCSTGNTQGGSNV

SEQ ID NO: 36191 - protein, 32 aa, Artificial Sequence
  Description of Artificial Sequence: Synthetic polypeptide
AEEEIRTTNPVATEQYGSVSSVTNLQQGNNNE

SEQ ID NO: 36192 - protein, 32 aa, Artificial Sequence
  Description of Artificial Sequence: Synthetic polypeptide
DEEEIRTTNPVATEAWGSTVSCTGLSQRGNQR

SEQ ID NO: 36193 - protein, 32 aa, Artificial Sequence
  Description of Artificial Sequence: Synthetic polypeptide
DEEEIRTTNPVATEAWGSTVSTNALSQERVNR

SEQ ID NO: 36194 - protein, 31 aa, Artificial Sequence
  Description of Artificial Sequence: Synthetic polypeptide
DEEEIRTTNPVATEAWGSVAVTNLSQRGGSR

SEQ ID NO: 36195 - protein, 32 aa, Artificial Sequence
  Description of Artificial Sequence: Synthetic polypeptide
DEEEIRTTNPVATEAWGSVSCTANLSQNGNNR

SEQ ID NO: 36196 - protein, 30 aa, Artificial Sequence
  Description of Artificial Sequence: Synthetic polypeptide
SESEIRTTNPIATEQYGSVSENLPMDRGNR

SEQ ID NO: 36197 - protein, 31 aa, Artificial Sequence
  Description of Artificial Sequence: Synthetic polypeptide
AEEEIRTTNPVATEQYGSVSSTTNTQEGNNS

SEQ ID NO: 36198 - protein, 31 aa, Artificial Sequence
  Description of Artificial Sequence: Synthetic polypeptide
AEEEIRTTNPVATEQYGSVSSTTNTQEGNND

SEQ ID NO: 36199 - protein, 33 aa, Artificial Sequence
  Description of Artificial Sequence: Synthetic polypeptide
DEEEIRTTNPVATEAWGSVSCTDNLSQRTGNNR

SEQ ID NO: 36200 - protein, 32 aa, Artificial Sequence
  Description of Artificial Sequence: Synthetic polypeptide
DEEEIRTTNPVATEAWGSVSCTGLSQRNGNNR

SEQ ID NO: 36201 - protein, 30 aa, Artificial Sequence
  Description of Artificial Sequence: Synthetic polypeptide
AEEEIRTTNPVATEQYGSVSSTVNSEQGNV

SEQ ID NO: 36202 - protein, 31 aa, Artificial Sequence
  Description of Artificial Sequence: Synthetic polypeptide
DEEEIRTTNPVATEAWGSVSCTGNLQGTVNR

SEQ ID NO: 36203 - protein, 32 aa, Artificial Sequence
  Description of Artificial Sequence: Synthetic polypeptide
DEEEIRTTNPVATEQYGCVCSTMELLQFGSNR

SEQ ID NO: 36204 - protein, 29 aa, Artificial Sequence
  Description of Artificial Sequence: Synthetic peptide
SESEIRCTNPISTEQYGSVSAENLQRGNR

SEQ ID NO: 36205 - protein, 30 aa, Artificial Sequence
  Description of Artificial Sequence: Synthetic polypeptide
AEEEIRTTNPVATEQYGSVSTANNGEGGNT

SEQ ID NO: 36206 - protein, 31 aa, Artificial Sequence
  Description of Artificial Sequence: Synthetic polypeptide
AEEEIRTTNPVATEQYGSVSTANNEQGGNNS

SEQ ID NO: 36207 - protein, 31 aa, Artificial Sequence
  Description of Artificial Sequence: Synthetic polypeptide
AEEEIRTTNPVATEQYGSVSTANNEQGGNAI

SEQ ID NO: 36208 - protein, 30 aa, Artificial Sequence
  Description of Artificial Sequence: Synthetic polypeptide
AEEEIRTTNPVATEQYGSVSTANNEGGNSN

SEQ ID NO: 36209 - protein, 28 aa, Artificial Sequence
  Description of Artificial Sequence: Synthetic peptide
SESEIRCTNPIATEQYGSMSENLMRGNR

SEQ ID NO: 36210 - protein, 32 aa, Artificial Sequence
  Description of Artificial Sequence: Synthetic polypeptide
DEEEIRTTNPVATEQYGCVCSTNADQFGSNRS

SEQ ID NO: 36211 - protein, 30 aa, Artificial Sequence
  Description of Artificial Sequence: Synthetic polypeptide
AEEEIRTTNPVATEQYGSVSTANLMEFNIY

SEQ ID NO: 36212 - protein, 28 aa, Artificial Sequence
  Description of Artificial Sequence: Synthetic peptide
SESEIRCTNPIATEQYGSVSENDMRGNR

SEQ ID NO: 36213 - protein, 28 aa, Artificial Sequence
  Description of Artificial Sequence: Synthetic peptide
SESEIRCTNPISTEQYGSVSENLMRGNR

SEQ ID NO: 36214 - protein, 31 aa, Artificial Sequence
  Description of Artificial Sequence: Synthetic polypeptide
AEEEIRTTNPVATEQYGSVSTANENQTTGNN

SEQ ID NO: 36215 - protein, 30 aa, Artificial Sequence
  Description of Artificial Sequence: Synthetic polypeptide
AEEEIRTTNPVATEQYGSVSTALGGGTNNA

SEQ ID NO: 36216 - protein, 28 aa, Artificial Sequence
  Description of Artificial Sequence: Synthetic peptide
SESEIRCTNPIATEQYGSVSENEMRGNR

SEQ ID NO: 36217 - protein, 32 aa, Artificial Sequence
  Description of Artificial Sequence: Synthetic polypeptide
DEEEIRTTNPVATEQYGCVCSTMNDIQENGNR

SEQ ID NO: 36218 - protein, 29 aa, Artificial Sequence
  Description of Artificial Sequence: Synthetic peptide
SESEIRCTNPIATEQYGSVSENLMMRGNR

SEQ ID NO: 36219 - protein, 28 aa, Artificial Sequence
  Description of Artificial Sequence: Synthetic peptide
SESEIRCTNPIATEQYGSVSENLMRGNP

SEQ ID NO: 36220 - protein, 29 aa, Artificial Sequence
  Description of Artificial Sequence: Synthetic peptide
SESEIRCTNPIATEQYGSVSENLMRGVNR

SEQ ID NO: 36221 - protein, 31 aa, Artificial Sequence
  Description of Artificial Sequence: Synthetic polypeptide
DEEEIRTTNPVATDQYGYVSTNNLQRGVEDN

SEQ ID NO: 36222 - protein, 29 aa, Artificial Sequence
  Description of Artificial Sequence: Synthetic peptide
SESEIRCTNPIATEQYGSVSENLPMRGNR

SEQ ID NO: 36223 - protein, 32 aa, Artificial Sequence
  Description of Artificial Sequence: Synthetic polypeptide
DEEEIRTTNPVATEQYGCVCSTMNLDQNGSNQ

SEQ ID NO: 36224 - protein, 32 aa, Artificial Sequence
  Description of Artificial Sequence: Synthetic polypeptide
DEEEIRTTNPVATEAWGSVSCTNLAQRTGGND

SEQ ID NO: 36225 - protein, 31 aa, Artificial Sequence
  Description of Artificial Sequence: Synthetic polypeptide
DEEEIRTTNPVATEAWGSVSCTNLSQFGNNA

SEQ ID NO: 36226 - protein, 32 aa, Artificial Sequence
  Description of Artificial Sequence: Synthetic polypeptide
DEEEIRTTNPVATEAWGSVSCTNLSQLTGTNR

SEQ ID NO: 36227 - protein, 32 aa, Artificial Sequence
  Description of Artificial Sequence: Synthetic polypeptide
DEEEIRTTNPVATEQYGCVCSTGNPQRGSNIA

SEQ ID NO: 36228 - protein, 29 aa, Artificial Sequence
  Description of Artificial Sequence: Synthetic peptide
DEEEIRTTNPVATEAYGCFSTNEQRNNQA

SEQ ID NO: 36229 - protein, 31 aa, Artificial Sequence
  Description of Artificial Sequence: Synthetic polypeptide
AEEEIRTTNPVATEQYGSVSSTNNQTGGNLD

SEQ ID NO: 36230 - protein, 31 aa, Artificial Sequence
  Description of Artificial Sequence: Synthetic polypeptide
AEEEIRTTNPVATEQYGSVSSTNNQQIGNTS

SEQ ID NO: 36231 - protein, 30 aa, Artificial Sequence
  Description of Artificial Sequence: Synthetic polypeptide
AEEEIRTTNPVATEQYGSVSSTNNQQEENE

SEQ ID NO: 36232 - protein, 31 aa, Artificial Sequence
  Description of Artificial Sequence: Synthetic polypeptide
AEEEIRTTNPVATEQYGSVSSTNNQLQGNQN

SEQ ID NO: 36233 - protein, 32 aa, Artificial Sequence
  Description of Artificial Sequence: Synthetic polypeptide
DEEEIRTTNPVATEQYGCVCSTGNLQRGSVII

SEQ ID NO: 36234 - protein, 31 aa, Artificial Sequence
  Description of Artificial Sequence: Synthetic polypeptide
AEEEIRTTNPVATEQYGSVSSTNNQEQGNLQ

SEQ ID NO: 36235 - protein, 30 aa, Artificial Sequence
  Description of Artificial Sequence: Synthetic polypeptide
AEEEIRTTNPVATEQYGSVSSTNQQQQGDQ

SEQ ID NO: 36236 - protein, 31 aa, Artificial Sequence
  Description of Artificial Sequence: Synthetic polypeptide
AEEEIRTTNPVATEQYGSVSSTNNNQQIGNG

SEQ ID NO: 36237 - protein, 31 aa, Artificial Sequence
  Description of Artificial Sequence: Synthetic polypeptide
DEEEIRTTNPVATEQYGCVCSTGNLQGNSQD

SEQ ID NO: 36238 - protein, 31 aa, Artificial Sequence
  Description of Artificial Sequence: Synthetic polypeptide
AEEEIRTTNPVATEQYGSVSSTNNNQFGNQV

SEQ ID NO: 36239 - protein, 32 aa, Artificial Sequence
  Description of Artificial Sequence: Synthetic polypeptide
DEEEIRTTNPVATEQYGCVCSTGNLQFGSQRV

SEQ ID NO: 36240 - protein, 31 aa, Artificial Sequence
  Description of Artificial Sequence: Synthetic polypeptide
AEEEIRTTNPVATEQYGSVSSTNNNQDGNVD

SEQ ID NO: 36241 - protein, 29 aa, Artificial Sequence
  Description of Artificial Sequence: Synthetic peptide
SETEIRATNPVATEQYGSVATNLQHGNTQ

SEQ ID NO: 36242 - protein, 33 aa, Artificial Sequence
  Description of Artificial Sequence: Synthetic polypeptide
DEEEIRTTNPVATEAYGCSVVSTNALSQREGNP

SEQ ID NO: 36243 - protein, 32 aa, Artificial Sequence
  Description of Artificial Sequence: Synthetic polypeptide
AEEEIRTTNPVATEQYGSVSSTNNNLQIGNTQ

SEQ ID NO: 36244 - protein, 32 aa, Artificial Sequence
  Description of Artificial Sequence: Synthetic polypeptide
AEEEIRTTNPVATEQYGSVSSTNNNLGQEGNS

SEQ ID NO: 36245 - protein, 28 aa, Artificial Sequence
  Description of Artificial Sequence: Synthetic peptide
SESEVACTNPIATEQYGSVSENLQRGNR

SEQ ID NO: 36246 - protein, 31 aa, Artificial Sequence
  Description of Artificial Sequence: Synthetic polypeptide
AEEEIRTTNPVATEQYGSVSSTNQQQQTGNE

SEQ ID NO: 36247 - protein, 30 aa, Artificial Sequence
  Description of Artificial Sequence: Synthetic polypeptide
AEEEIRTTNPVATEQYGSVSSTNSEQGNND

SEQ ID NO: 36248 - protein, 30 aa, Artificial Sequence
  Description of Artificial Sequence: Synthetic polypeptide
AEEEIRTTNPVATEQYGSVSSTNSEQGNQG

SEQ ID NO: 36249 - protein, 31 aa, Artificial Sequence
  Description of Artificial Sequence: Synthetic polypeptide
DEEEIRTTNPVATEAWGSVSCTNLSQRVNYA

SEQ ID NO: 36250 - protein, 32 aa, Artificial Sequence
  Description of Artificial Sequence: Synthetic polypeptide
AEEEIRTTNPVATEQYGSVSSTTNLQQGSNNQ

SEQ ID NO: 36251 - protein, 32 aa, Artificial Sequence
  Description of Artificial Sequence: Synthetic polypeptide
AEEEIRTTNPVATEQYGSVSSTTNLQENIGNI

SEQ ID NO: 36252 - protein, 33 aa, Artificial Sequence
  Description of Artificial Sequence: Synthetic polypeptide
DEEEIRTTNPVATEAWGSVSCTPNLSQRGNNRF

SEQ ID NO: 36253 - protein, 31 aa, Artificial Sequence
  Description of Artificial Sequence: Synthetic polypeptide
AEEEIRTTNPVATEQYGSVSSTTNLNQVENS

SEQ ID NO: 36254 - protein, 32 aa, Artificial Sequence
  Description of Artificial Sequence: Synthetic polypeptide
AEEEIRTTNPVATEQYGSVSSTTNLNQQGINA

SEQ ID NO: 36255 - protein, 32 aa, Artificial Sequence
  Description of Artificial Sequence: Synthetic polypeptide
AEEEIRTTNPVATEQYGSVSSTTNLNQNGGNM

SEQ ID NO: 36256 - protein, 32 aa, Artificial Sequence
  Description of Artificial Sequence: Synthetic polypeptide
AEEEIRTTNPVATEQYGSVSSTTNLNQGGTND

SEQ ID NO: 36257 - protein, 32 aa, Artificial Sequence
  Description of Artificial Sequence: Synthetic polypeptide
AEEEIRTTNPVATEQYGSVSSTTNLNQGGNNY

SEQ ID NO: 36258 - protein, 32 aa, Artificial Sequence
  Description of Artificial Sequence: Synthetic polypeptide
DEEEIRTTNPVATEAWGSVSCTQNLSQGGGNR

SEQ ID NO: 36259 - protein, 31 aa, Artificial Sequence
  Description of Artificial Sequence: Synthetic polypeptide
AEEEIRTTNPVATEQYGSVSSTTNLEAGNQT

SEQ ID NO: 36260 - protein, 31 aa, Artificial Sequence
  Description of Artificial Sequence: Synthetic polypeptide
AEEEIRTTNPVATEQYGSVSSTTNIQIGNTE

SEQ ID NO: 36261 - protein, 31 aa, Artificial Sequence
  Description of Artificial Sequence: Synthetic polypeptide
AEEEIRTTNPVATEQYGSVSSTTNAQNGNGD

SEQ ID NO: 36262 - protein, 31 aa, Artificial Sequence
  Description of Artificial Sequence: Synthetic polypeptide
AEEEIRTTNPVATEQYGSVSSTSNQQIGTND

SEQ ID NO: 36263 - protein, 31 aa, Artificial Sequence
  Description of Artificial Sequence: Synthetic polypeptide
AEEEIRTTNPVATEQYGSVSSTSNNQNVGNV

SEQ ID NO: 36264 - protein, 31 aa, Artificial Sequence
  Description of Artificial Sequence: Synthetic polypeptide
AEEEIRTTNPVATEQYGSVSSTSNNQNGNDD

SEQ ID NO: 36265 - protein, 32 aa, Artificial Sequence
  Description of Artificial Sequence: Synthetic polypeptide
AEEEIRTTNPVATEQYGSVSSTSNLQQNVGNE

SEQ ID NO: 36266 - protein, 30 aa, Artificial Sequence
  Description of Artificial Sequence: Synthetic polypeptide
SESEIRTTNPVATEQYGSVSCNLPMDRGNG

SEQ ID NO: 36267 - protein, 30 aa, Artificial Sequence
  Description of Artificial Sequence: Synthetic polypeptide
AEEEIRTTNPVATEQYGSVSSTNSSTSGNY

SEQ ID NO: 36268 - protein, 31 aa, Artificial Sequence
  Description of Artificial Sequence: Synthetic polypeptide
DEEEIRTTNPVATEAYGCVCSTNLQRFISNQ

SEQ ID NO: 36269 - protein, 28 aa, Artificial Sequence
  Description of Artificial Sequence: Synthetic peptide
SETEIRSTNPVATEQYGSVATNDQHGNQ

SEQ ID NO: 36270 - protein, 28 aa, Artificial Sequence
  Description of Artificial Sequence: Synthetic peptide
SEGEIACTNPISTEQYGSVSENLQRGNR

SEQ ID NO: 36271 - protein, 28 aa, Artificial Sequence
  Description of Artificial Sequence: Synthetic peptide
SEGEIACTNPIATEQYGSVSENLMRGNR

SEQ ID NO: 36272 - protein, 31 aa, Artificial Sequence
  Description of Artificial Sequence: Synthetic polypeptide
DEEEIRTTNPVATEQYGCVCSTNLQHNSNFM

SEQ ID NO: 36273 - protein, 32 aa, Artificial Sequence
  Description of Artificial Sequence: Synthetic polypeptide
DEEEIRTTNPVATEQYGCVCSTNLQHMGSERI

SEQ ID NO: 36274 - protein, 31 aa, Artificial Sequence
  Description of Artificial Sequence: Synthetic polypeptide
AEEEIRTTNPVATEQYGSVSTNQQVGVNTNS

SEQ ID NO: 36275 - protein, 30 aa, Artificial Sequence
  Description of Artificial Sequence: Synthetic polypeptide
AEEEIRTTNPVATEQYGSVSTNQQQQNGTD

SEQ ID NO: 36276 - protein, 32 aa, Artificial Sequence
  Description of Artificial Sequence: Synthetic polypeptide
DEEEIRTTNPVATEQYGCVCSTNLQGSGGERG

SEQ ID NO: 36277 - protein, 31 aa, Artificial Sequence
  Description of Artificial Sequence: Synthetic polypeptide
AEEEIRTTNPVATEQYGSVSTNQQQIGTNDV

SEQ ID NO: 36278 - protein, 31 aa, Artificial Sequence
  Description of Artificial Sequence: Synthetic polypeptide
AEEEIRTTNPVATEQYGSVSTNQQQIGNNVE

SEQ ID NO: 36279 - protein, 31 aa, Artificial Sequence
  Description of Artificial Sequence: Synthetic polypeptide
AEEEIRTTNPVATEQYGSVSTNQQGGVNNVD

SEQ ID NO: 36280 - protein, 31 aa, Artificial Sequence
  Description of Artificial Sequence: Synthetic polypeptide
DEEEIRTTNPVATEQYGCVCSTNLQNFFNNA

SEQ ID NO: 36281 - protein, 30 aa, Artificial Sequence
  Description of Artificial Sequence: Synthetic polypeptide
AEEEIRTTNPVATEQYGSVSTNQQGEGGGG

SEQ ID NO: 36282 - protein, 31 aa, Artificial Sequence
  Description of Artificial Sequence: Synthetic polypeptide
AEEEIRTTNPVATEQYGSVSTNQQEQIGNGV

SEQ ID NO: 36283 - protein, 31 aa, Artificial Sequence
  Description of Artificial Sequence: Synthetic polypeptide
AEEEIRTTNPVATEQYGSVSTNQNQQIGNEV

SEQ ID NO: 36284 - protein, 31 aa, Artificial Sequence
  Description of Artificial Sequence: Synthetic polypeptide
SEEEIRTTNPVATESYGSVSVTNLANRGDQR

SEQ ID NO: 36285 - protein, 31 aa, Artificial Sequence
  Description of Artificial Sequence: Synthetic polypeptide
SEEEIRTTNPVATESYGSVSVTNLHREGDQR

SEQ ID NO: 36286 - protein, 32 aa, Artificial Sequence
  Description of Artificial Sequence: Synthetic polypeptide
DEEEIRTTNPVATEQYGCVCSTNLQFGGSERQ

SEQ ID NO: 36287 - protein, 30 aa, Artificial Sequence
  Description of Artificial Sequence: Synthetic polypeptide
SEEEIRTTNPVATESYGVVSNTNLDRGDQR

SEQ ID NO: 36288 - protein, 33 aa, Artificial Sequence
  Description of Artificial Sequence: Synthetic polypeptide
DEEEIRTTNPVAFEQYGQSGVSTNDLLQRGIRG

SEQ ID NO: 36289 - protein, 30 aa, Artificial Sequence
  Description of Artificial Sequence: Synthetic polypeptide
SEEEIRTTNPVATESYGVVSTNLDQSNVNR

SEQ ID NO: 36290 - protein, 31 aa, Artificial Sequence
  Description of Artificial Sequence: Synthetic polypeptide
AEEEIRTTNPVATEQYGSVSTNQQEQNQGNG

SEQ ID NO: 36291 - protein, 31 aa, Artificial Sequence
  Description of Artificial Sequence: Synthetic polypeptide
AEEEIRTTNPVATEQYGSVSTNQLYNGGNSY

SEQ ID NO: 36292 - protein, 31 aa, Artificial Sequence
  Description of Artificial Sequence: Synthetic polypeptide
AEEEIRTTNPVATEQYGSVSTNTIQEGGNDG

SEQ ID NO: 36293 - protein, 30 aa, Artificial Sequence
  Description of Artificial Sequence: Synthetic polypeptide
SEEEIRTTNPVATESYGSVSNTNWDRGDQR

SEQ ID NO: 36294 - protein, 31 aa, Artificial Sequence
  Description of Artificial Sequence: Synthetic polypeptide
SEEEIRTTNPVATESYGSVSNTNLARGVDQR

SEQ ID NO: 36295 - protein, 30 aa, Artificial Sequence
  Description of Artificial Sequence: Synthetic polypeptide
SEEEIRTTNPVATESYGSVSNTNLERDDQR

SEQ ID NO: 36296 - protein, 30 aa, Artificial Sequence
  Description of Artificial Sequence: Synthetic polypeptide
AEEEIRTTNPVATEQYGSVSTNVNELGNDG

SEQ ID NO: 36297 - protein, 31 aa, Artificial Sequence
  Description of Artificial Sequence: Synthetic polypeptide
AEEEIRTTNPVATEQYGSVSTNTQQQIGNNV

SEQ ID NO: 36298 - protein, 31 aa, Artificial Sequence
  Description of Artificial Sequence: Synthetic polypeptide
SEEEIRTTNPVATESYGSVSNTNLERGDQRG

SEQ ID NO: 36299 - protein, 31 aa, Artificial Sequence
  Description of Artificial Sequence: Synthetic polypeptide
SEEEIRTTNPVATESYGSVSNTNLGRGDQRA

SEQ ID NO: 36300 - protein, 30 aa, Artificial Sequence
  Description of Artificial Sequence: Synthetic polypeptide
SEEEIRTTNPVATESYGSVSNTNLHRPDDR

SEQ ID NO: 36301 - protein, 30 aa, Artificial Sequence
  Description of Artificial Sequence: Synthetic polypeptide
SEEEIRTTNPVATESYGSVSNTNLIRGDDV

SEQ ID NO: 36302 - protein, 31 aa, Artificial Sequence
  Description of Artificial Sequence: Synthetic polypeptide
AEEEIRTTNPVATEQYGSVSTNTLGTNQGNG

SEQ ID NO: 36303 - protein, 31 aa, Artificial Sequence
  Description of Artificial Sequence: Synthetic polypeptide
AEEEIRTTNPVATEQYGSVSTNTNQAIGNIG

SEQ ID NO: 36304 - protein, 30 aa, Artificial Sequence
  Description of Artificial Sequence: Synthetic polypeptide
SEEEIRTTNPVATESYGSVSNTNLNQGTQR

SEQ ID NO: 36305 - protein, 31 aa, Artificial Sequence
  Description of Artificial Sequence: Synthetic polypeptide
AEEEIRTTNPVATEQYGSVSTNTNQAGGNNI

SEQ ID NO: 36306 - protein, 30 aa, Artificial Sequence
  Description of Artificial Sequence: Synthetic polypeptide
SEEEIRTTNPVATESYGSVSNTNLTVGEQR

SEQ ID NO: 36307 - protein, 30 aa, Artificial Sequence
  Description of Artificial Sequence: Synthetic polypeptide
AEEEIRTTNPVATEQYGSVSTNTNMQGNGT

SEQ ID NO: 36308 - protein, 30 aa, Artificial Sequence
  Description of Artificial Sequence: Synthetic polypeptide
SEEEIRTTNPVATESYGSVSNTNTHRGTQR

SEQ ID NO: 36309 - protein, 31 aa, Artificial Sequence
  Description of Artificial Sequence: Synthetic polypeptide
AEEEIRTTNPVATEQYGSVSTNTNLQETNVE

SEQ ID NO: 36310 - protein, 30 aa, Artificial Sequence
  Description of Artificial Sequence: Synthetic polypeptide
AEEEIRTTNPVATEQYGSVSTNTNLGNEEQ

SEQ ID NO: 36311 - protein, 30 aa, Artificial Sequence
  Description of Artificial Sequence: Synthetic polypeptide
SEEEIRTTNPVATESYGSVSNTNVERGDQR

SEQ ID NO: 36312 - protein, 30 aa, Artificial Sequence
  Description of Artificial Sequence: Synthetic polypeptide
SEEEIRTTNPVATESYGSVSNTNLNDGDQR

SEQ ID NO: 36313 - protein, 30 aa, Artificial Sequence
  Description of Artificial Sequence: Synthetic polypeptide
AEEEIRTTNPVATEQYGSVSTNQGVVGNDG

SEQ ID NO: 36314 - protein, 31 aa, Artificial Sequence
  Description of Artificial Sequence: Synthetic polypeptide
AEEEIRTTNPVATEQYGSVSTNQEQEGENIN

SEQ ID NO: 36315 - protein, 30 aa, Artificial Sequence
  Description of Artificial Sequence: Synthetic polypeptide
AEEEIRTTNPVATEQYGSVSTNPQENNNNN

SEQ ID NO: 36316 - protein, 31 aa, Artificial Sequence
  Description of Artificial Sequence: Synthetic polypeptide
AEEEIRTTNPVATEQYGSVSTNNQGTVGNQV

SEQ ID NO: 36317 - protein, 32 aa, Artificial Sequence
  Description of Artificial Sequence: Synthetic polypeptide
DEEEIRTTNPVATEQYGCVCSTNLQEHGSVRF

SEQ ID NO: 36318 - protein, 31 aa, Artificial Sequence
  Description of Artificial Sequence: Synthetic polypeptide
AEEEIRTTNPVATEQYGSVSTNNNQTIGNGI

SEQ ID NO: 36319 - protein, 31 aa, Artificial Sequence
  Description of Artificial Sequence: Synthetic polypeptide
AEEEIRTTNPVATEQYGSVSTNNNQSIGNNQ

SEQ ID NO: 36320 - protein, 31 aa, Artificial Sequence
  Description of Artificial Sequence: Synthetic polypeptide
AEEEIRTTNPVATEQYGSVSTNNNQQSIGNS

SEQ ID NO: 36321 - protein, 30 aa, Artificial Sequence
  Description of Artificial Sequence: Synthetic polypeptide
AEEEIRTTNPVATEQYGSVSTNNNQQSANI

SEQ ID NO: 36322 - protein, 30 aa, Artificial Sequence
  Description of Artificial Sequence: Synthetic polypeptide
SEEEIRTTNPVSTEQYGSVSMNLQQQNGNH

SEQ ID NO: 36323 - protein, 28 aa, Artificial Sequence
  Description of Artificial Sequence: Synthetic peptide
SEEEISCTNPIATEQYGSVSENHMRGNR

SEQ ID NO: 36324 - protein, 31 aa, Artificial Sequence
  Description of Artificial Sequence: Synthetic polypeptide
DEEEIRTTNPVATEQYGCVCSTNLQERMSEQ

SEQ ID NO: 36325 - protein, 31 aa, Artificial Sequence
  Description of Artificial Sequence: Synthetic polypeptide
AEEEIRTTNPVATEQYGSVSTNNNQQIGVNE

SEQ ID NO: 36326 - protein, 31 aa, Artificial Sequence
  Description of Artificial Sequence: Synthetic polypeptide
DEEEIRTTNPVATEQYGCVCSTNLERGSEQQ

SEQ ID NO: 36327 - protein, 33 aa, Artificial Sequence
  Description of Artificial Sequence: Synthetic polypeptide
DEEEIRTTNPVATEQYGCVCSTNLEQYSGSNRA

SEQ ID NO: 36328 - protein, 29 aa, Artificial Sequence
  Description of Artificial Sequence: Synthetic peptide
DEEEIRTTNPVAFEQYGSVGTNLQIFDSN

SEQ ID NO: 36329 - protein, 31 aa, Artificial Sequence
  Description of Artificial Sequence: Synthetic polypeptide
AEEEIRTTNPVATEQYGSVSTNNNQQGNPED

SEQ ID NO: 36330 - protein, 30 aa, Artificial Sequence
  Description of Artificial Sequence: Synthetic polypeptide
SEEEISTTNPVATEQYGNVSVTMLQGGNDR

SEQ ID NO: 36331 - protein, 29 aa, Artificial Sequence
  Description of Artificial Sequence: Synthetic peptide
DEEEIRTTNPVAFEQYGSVGTNLQVFDDQ

SEQ ID NO: 36332 - protein, 31 aa, Artificial Sequence
  Description of Artificial Sequence: Synthetic polypeptide
AEEEIRTTNPVATEQYGSVSTNNNQNNIGNY

SEQ ID NO: 36333 - protein, 31 aa, Artificial Sequence
  Description of Artificial Sequence: Synthetic polypeptide
AEEEIRTTNPVATEQYGSVSTNNNQNIGNVG

SEQ ID NO: 36334 - protein, 32 aa, Artificial Sequence
  Description of Artificial Sequence: Synthetic polypeptide
DEEEIRTTNPVATEQYGCVCSTNLERGSNNDN

SEQ ID NO: 36335 - protein, 32 aa, Artificial Sequence
  Description of Artificial Sequence: Synthetic polypeptide
DEEEIRTTNPVAFEQYGQVISTNDLLQRGIRG

SEQ ID NO: 36336 - protein, 30 aa, Artificial Sequence
  Description of Artificial Sequence: Synthetic polypeptide
SEEEIRTTNPVAYESYGKVSCTNLHRGDNR

SEQ ID NO: 36337 - protein, 30 aa, Artificial Sequence
  Description of Artificial Sequence: Synthetic polypeptide
SEEEIRTTNPVAYEQYGSVYATTNLQQGNA

SEQ ID NO: 36338 - protein, 30 aa, Artificial Sequence
  Description of Artificial Sequence: Synthetic polypeptide
AEEEIRTTNPVATEQYGSVSTNNTNQVGQT

SEQ ID NO: 36339 - protein, 30 aa, Artificial Sequence
  Description of Artificial Sequence: Synthetic polypeptide
SEEEIRTTNPVATEYYGSVSAQNLSGGGNR

SEQ ID NO: 36340 - protein, 29 aa, Artificial Sequence
  Description of Artificial Sequence: Synthetic peptide
SEEEIRTTNPVATEYYGSVSTNLNFTPNI

SEQ ID NO: 36341 - protein, 31 aa, Artificial Sequence
  Description of Artificial Sequence: Synthetic polypeptide
AEEEIRTTNPVATEQYGSVSTNNQVGTNEGD

SEQ ID NO: 36342 - protein, 30 aa, Artificial Sequence
  Description of Artificial Sequence: Synthetic polypeptide
AEEEIRTTNPVATEQYGSVSTNNQTNNENF

SEQ ID NO: 36343 - protein, 30 aa, Artificial Sequence
  Description of Artificial Sequence: Synthetic polypeptide
AEEEIRTTNPVATEQYGSVSTNNQQTENLT

SEQ ID NO: 36344 - protein, 31 aa, Artificial Sequence
  Description of Artificial Sequence: Synthetic polypeptide
AEEEIRTTNPVATEQYGSVSTNNQQTEGENL

SEQ ID NO: 36345 - protein, 30 aa, Artificial Sequence
  Description of Artificial Sequence: Synthetic polypeptide
AEEEIRTTNPVATEQYGSVSTNNQQQSANN

SEQ ID NO: 36346 - protein, 33 aa, Artificial Sequence
  Description of Artificial Sequence: Synthetic polypeptide
DEEEIRTTNPVAFEQYGQSVSTMNDLDQRGIRG

SEQ ID NO: 36347 - protein, 32 aa, Artificial Sequence
  Description of Artificial Sequence: Synthetic polypeptide
DEEEIRTTNPVAFEQYGQSVSTNDDLQRGIQG

SEQ ID NO: 36348 - protein, 33 aa, Artificial Sequence
  Description of Artificial Sequence: Synthetic polypeptide
DEEEIRTTNPVAFEQYGQSVSTNDELQTRGIRG

SEQ ID NO: 36349 - protein, 32 aa, Artificial Sequence
  Description of Artificial Sequence: Synthetic polypeptide
DEEEIRTTNPVAFEQYGQSVSTNDLLQAGIGR

SEQ ID NO: 36350 - protein, 33 aa, Artificial Sequence
  Description of Artificial Sequence: Synthetic polypeptide
DEEEIRTTNPVAFEQYGQSVSTNDNLQRGIRGG

SEQ ID NO: 36351 - protein, 30 aa, Artificial Sequence
  Description of Artificial Sequence: Synthetic polypeptide
SEEEIRTTNPVAYEQYGQVSTNMQAVGGNR

SEQ ID NO: 36352 - protein, 31 aa, Artificial Sequence
  Description of Artificial Sequence: Synthetic polypeptide
AEEEIRTTNPVATEQYGSVSTNNQNLGNEEV

SEQ ID NO: 36353 - protein, 30 aa, Artificial Sequence
  Description of Artificial Sequence: Synthetic polypeptide
AEEEIRTTNPVATEQYGSVSTNNQLQQNDN

SEQ ID NO: 36354 - protein, 30 aa, Artificial Sequence
  Description of Artificial Sequence: Synthetic polypeptide
SEEEIRTTNPVAYEQYGSVSAPNLDEFGNR

SEQ ID NO: 36355 - protein, 32 aa, Artificial Sequence
  Description of Artificial Sequence: Synthetic polypeptide
AEEEIRTTNPVATEQYGSVSTNNQLQNGNVSG

SEQ ID NO: 36356 - protein, 32 aa, Artificial Sequence
  Description of Artificial Sequence: Synthetic polypeptide
DEEEIRTTNPVATEQYGCVCSTNLQEYFGNQG

SEQ ID NO: 36357 - protein, 31 aa, Artificial Sequence
  Description of Artificial Sequence: Synthetic polypeptide
SEEEIRTTNPVATESYGSVSNTNLARFGDTR

SEQ ID NO: 36358 - protein, 31 aa, Artificial Sequence
  Description of Artificial Sequence: Synthetic polypeptide
AEEEIRTTNPVATEQYGSVSTNNNQNIGNIG

SEQ ID NO: 36359 - protein, 30 aa, Artificial Sequence
  Description of Artificial Sequence: Synthetic polypeptide
AEEEIRTTNPVATEQYGSVSTQLQNSENNE

SEQ ID NO: 36360 - protein, 31 aa, Artificial Sequence
  Description of Artificial Sequence: Synthetic polypeptide
AEEEIRTTNPVATEQYGSVSTQLQQIQGNNE

SEQ ID NO: 36361 - protein, 33 aa, Artificial Sequence
  Description of Artificial Sequence: Synthetic polypeptide
SEEEIRTTNPVATEQYGSVSTSNNGMQRGENDR

SEQ ID NO: 36362 - protein, 30 aa, Artificial Sequence
  Description of Artificial Sequence: Synthetic polypeptide
SEEEIRTTNPVATEQYGSVSTTIQQDSGNP

SEQ ID NO: 36363 - protein, 31 aa, Artificial Sequence
  Description of Artificial Sequence: Synthetic polypeptide
AEEEIRTTNPVATEQYGSVSTSNNQQTGNSG

SEQ ID NO: 36364 - protein, 31 aa, Artificial Sequence
  Description of Artificial Sequence: Synthetic polypeptide
AEEEIRTTNPVATEQYGSVSTSNNQQDGNNF

SEQ ID NO: 36365 - protein, 31 aa, Artificial Sequence
  Description of Artificial Sequence: Synthetic polypeptide
SEEEIRTTNPVATEQYGSVSVTNGGQRGDEF

SEQ ID NO: 36366 - protein, 31 aa, Artificial Sequence
  Description of Artificial Sequence: Synthetic polypeptide
AEEEIRTTNPVATEQYGSVSTSNNQGTGNSE

SEQ ID NO: 36367 - protein, 31 aa, Artificial Sequence
  Description of Artificial Sequence: Synthetic polypeptide
SEEEIRTTNPVATEQYGSVSVTNLQGNENFY

SEQ ID NO: 36368 - protein, 32 aa, Artificial Sequence
  Description of Artificial Sequence: Synthetic polypeptide
DEEEIRTTNPVATEQYGCVCSTNNLAFGSNRM

SEQ ID NO: 36369 - protein, 32 aa, Artificial Sequence
  Description of Artificial Sequence: Synthetic polypeptide
SEEEIRTTNPVATEQYGSVSTSNLNQNGENYI

SEQ ID NO: 36370 - protein, 33 aa, Artificial Sequence
  Description of Artificial Sequence: Synthetic polypeptide
SEEEIRTTNPVATEQYGSVSWTSNLEIRGENER

SEQ ID NO: 36371 - protein, 32 aa, Artificial Sequence
  Description of Artificial Sequence: Synthetic polypeptide
DEEEIRTTNPVACEQYGQVVSTNDLLQRGDAR

SEQ ID NO: 36372 - protein, 31 aa, Artificial Sequence
  Description of Artificial Sequence: Synthetic polypeptide
AEEEIRTTNPVATEQYGSVSTSNNLQTGGGT

SEQ ID NO: 36373 - protein, 30 aa, Artificial Sequence
  Description of Artificial Sequence: Synthetic polypeptide
SEEEIRTTNPVATEQYGSVTTDLQRGEEDM

SEQ ID NO: 36374 - protein, 32 aa, Artificial Sequence
  Description of Artificial Sequence: Synthetic polypeptide
DEEEIRTTNPVACEQYGQVVSTNQLLQRGTTR

SEQ ID NO: 36375 - protein, 30 aa, Artificial Sequence
  Description of Artificial Sequence: Synthetic polypeptide
SEEEIRTTNPVATEQYGSVVSTNNQNGYVG

SEQ ID NO: 36376 - protein, 31 aa, Artificial Sequence
  Description of Artificial Sequence: Synthetic polypeptide
SEEEIRTTNPVATEQYGSVVTLMDNGQSGNR

SEQ ID NO: 36377 - protein, 30 aa, Artificial Sequence
  Description of Artificial Sequence: Synthetic polypeptide
SEEEIRTTNPVATEQYGTVCSENPVERGNR

SEQ ID NO: 36378 - protein, 31 aa, Artificial Sequence
  Description of Artificial Sequence: Synthetic polypeptide
SEEEIRTTNPVATEQYGTVCSTDNPVERGNR

SEQ ID NO: 36379 - protein, 32 aa, Artificial Sequence
  Description of Artificial Sequence: Synthetic polypeptide
AEEEIRTTNPVATEQYGSVSTSNNNLQEIGNQ

SEQ ID NO: 36380 - protein, 32 aa, Artificial Sequence
  Description of Artificial Sequence: Synthetic polypeptide
AEEEIRTTNPVATEQYGSVSTSNLTQQGENAE

SEQ ID NO: 36381 - protein, 32 aa, Artificial Sequence
  Description of Artificial Sequence: Synthetic polypeptide
DEEEIRTTNPVATEQYGCVCSTNNLQFGSNLG

SEQ ID NO: 36382 - protein, 29 aa, Artificial Sequence
  Description of Artificial Sequence: Synthetic peptide
DEEEIRTTNPTATEYYGSVIATNQGRGNA

SEQ ID NO: 36383 - protein, 32 aa, Artificial Sequence
  Description of Artificial Sequence: Synthetic polypeptide
SEEEIRTTNPVATEQYGSVSSTENLMRNGMNV

SEQ ID NO: 36384 - protein, 32 aa, Artificial Sequence
  Description of Artificial Sequence: Synthetic polypeptide
DEEEIRTTNPVATEQYGCVCSTNNLQFSSNRA

SEQ ID NO: 36385 - protein, 31 aa, Artificial Sequence
  Description of Artificial Sequence: Synthetic polypeptide
SEEEIRTTNPVATEQYGSVSSTNLENAGGNE

SEQ ID NO: 36386 - protein, 30 aa, Artificial Sequence
  Description of Artificial Sequence: Synthetic polypeptide
SEEEIRTTNPVATEQYGSVSTDLEDREGEL

SEQ ID NO: 36387 - protein, 32 aa, Artificial Sequence
  Description of Artificial Sequence: Synthetic polypeptide
SEEEIRTTNPVATEQYGSVSTDNLSGVSGSNR

SEQ ID NO: 36388 - protein, 31 aa, Artificial Sequence
  Description of Artificial Sequence: Synthetic polypeptide
AEEEIRTTNPVATEQYGSVSTTANEQGEGNV

SEQ ID NO: 36389 - protein, 30 aa, Artificial Sequence
  Description of Artificial Sequence: Synthetic polypeptide
AEEEIRTTNPVATEQYGSVSTSVQSEGNEE

SEQ ID NO: 36390 - protein, 31 aa, Artificial Sequence
  Description of Artificial Sequence: Synthetic polypeptide
SEEEIRTTNPVATEQYGSVSTNGPGGDGSNR

SEQ ID NO: 36391 - protein, 32 aa, Artificial Sequence
  Description of Artificial Sequence: Synthetic polypeptide
SEEEIRTTNPVATEQYGSVSTSNGGQHGENYR

SEQ ID NO: 36392 - protein, 30 aa, Artificial Sequence
  Description of Artificial Sequence: Synthetic polypeptide
SEEEIRTTNPVATEQYGSVSTNGQTPGQYT

SEQ ID NO: 36393 - protein, 32 aa, Artificial Sequence
  Description of Artificial Sequence: Synthetic polypeptide
AEEEIRTTNPVATEQYGSVSTSTTNLQQGNSE

SEQ ID NO: 36394 - protein, 32 aa, Artificial Sequence
  Description of Artificial Sequence: Synthetic polypeptide
AEEEIRTTNPVATEQYGSVSTSTTNLQQGNQL

SEQ ID NO: 36395 - protein, 30 aa, Artificial Sequence
  Description of Artificial Sequence: Synthetic polypeptide
AEEEIRTTNPVATEQYGSVSTSTNQQGNEI

SEQ ID NO: 36396 - protein, 30 aa, Artificial Sequence
  Description of Artificial Sequence: Synthetic polypeptide
SEEEIRTTNPVATEQYGSVSTNLQNDTTDT

SEQ ID NO: 36397 - protein, 32 aa, Artificial Sequence
  Description of Artificial Sequence: Synthetic polypeptide
AEEEIRTTNPVATEQYGSVSTSTNLQQSGNQE

SEQ ID NO: 36398 - protein, 30 aa, Artificial Sequence
  Description of Artificial Sequence: Synthetic polypeptide
SEEEIRTTNPVATEQYGSVSTNPPQEVNDS

SEQ ID NO: 36399 - protein, 31 aa, Artificial Sequence
  Description of Artificial Sequence: Synthetic polypeptide
AEEEIRTTNPVATEQYGSVSTSNQQQIGNVD

SEQ ID NO: 36400 - protein, 33 aa, Artificial Sequence
  Description of Artificial Sequence: Synthetic polypeptide
SEEEIRTTNPVATEQYGSVSTPNLPNMRNGMNR

SEQ ID NO: 36401 - protein, 31 aa, Artificial Sequence
  Description of Artificial Sequence: Synthetic polypeptide
SEEEIRTTNPVATEQYGSVSTNLDGEDSGNI

SEQ ID NO: 36402 - protein, 32 aa, Artificial Sequence
  Description of Artificial Sequence: Synthetic polypeptide
AEEEIRTTNPVATEQYGSVSTSNLTQPGENTQ

SEQ ID NO: 36403 - protein, 32 aa, Artificial Sequence
  Description of Artificial Sequence: Synthetic polypeptide
AEEEIRTTNPVATEQYGSVSTSNLTQNGENQL

SEQ ID NO: 36404 - protein, 32 aa, Artificial Sequence
  Description of Artificial Sequence: Synthetic polypeptide
AEEEIRTTNPVATEQYGSVSTSNLTQAGENST

SEQ ID NO: 36405 - protein, 31 aa, Artificial Sequence
  Description of Artificial Sequence: Synthetic polypeptide
AEEEIRTTNPVATEQYGSVSTQNQQNGTNLE

SEQ ID NO: 36406 - protein, 33 aa, Artificial Sequence
  Description of Artificial Sequence: Synthetic polypeptide
DEEEIRTTNPVATEQYGCVCSTNLQSMGSNNRS

SEQ ID NO: 36407 - protein, 31 aa, Artificial Sequence
  Description of Artificial Sequence: Synthetic polypeptide
AEEEIRTTNPVATEQYGSVSTQNNQQTGNDN

SEQ ID NO: 36408 - protein, 32 aa, Artificial Sequence
  Description of Artificial Sequence: Synthetic polypeptide
DEEEIRTTNPVATEQYGCVCSTNLQSIGSDRS

SEQ ID NO: 36409 - protein, 30 aa, Artificial Sequence
  Description of Artificial Sequence: Synthetic polypeptide
SEEEIRTTNPVATESYGSVSNDNLTRGDQR

SEQ ID NO: 36410 - protein, 31 aa, Artificial Sequence
  Description of Artificial Sequence: Synthetic polypeptide
AEEEIRTTNPVATEQYGSVSTQNNNQQTGNM

SEQ ID NO: 36411 - protein, 31 aa, Artificial Sequence
  Description of Artificial Sequence: Synthetic polypeptide
DEEEIRTTNPVATEQYGCVCSTNLQRVSEQT

SEQ ID NO: 36412 - protein, 31 aa, Artificial Sequence
  Description of Artificial Sequence: Synthetic polypeptide
SEEEIRTTNPVATESYGSVSNTNDHRGNDQR

SEQ ID NO: 36413 - protein, 31 aa, Artificial Sequence
  Description of Artificial Sequence: Synthetic polypeptide
AEEEIRTTNPVATEQYGSVSTQNTNQAGNGI

SEQ ID NO: 36414 - protein, 32 aa, Artificial Sequence
  Description of Artificial Sequence: Synthetic polypeptide
SEEEIRTTNPVATESYGSVSNTNDLQTRGDQR

SEQ ID NO: 36415 - protein, 30 aa, Artificial Sequence
  Description of Artificial Sequence: Synthetic polypeptide
SEEEIRTTNPVATESYGSVSNTNEHRGEQR

SEQ ID NO: 36416 - protein, 32 aa, Artificial Sequence
  Description of Artificial Sequence: Synthetic polypeptide
AEEEIRTTNPVATEQYGSVSTQNLQNNGNITE

SEQ ID NO: 36417 - protein, 31 aa, Artificial Sequence
  Description of Artificial Sequence: Synthetic polypeptide
AEEEIRTTNPVATEQYGSVSTQNLQNNDGEE

SEQ ID NO: 36418 - protein, 31 aa, Artificial Sequence
  Description of Artificial Sequence: Synthetic polypeptide
AEEEIRTTNPVATEQYGSVSTQNLQINEQNG

SEQ ID NO: 36419 - protein, 31 aa, Artificial Sequence
  Description of Artificial Sequence: Synthetic polypeptide
AEEEIRTTNPVATEQYGSVSTQNLQGNANFE

SEQ ID NO: 36420 - protein, 31 aa, Artificial Sequence
  Description of Artificial Sequence: Synthetic polypeptide
AEEEIRTTNPVATEQYGSVSTQNLQEDTNNG

SEQ ID NO: 36421 - protein, 31 aa, Artificial Sequence
  Description of Artificial Sequence: Synthetic polypeptide
AEEEIRTTNPVATEQYGSVSTQNDEQGGNDT

SEQ ID NO: 36422 - protein, 31 aa, Artificial Sequence
  Description of Artificial Sequence: Synthetic polypeptide
AEEEIRTTNPVATEQYGSVSTQLQQSGTNEN

SEQ ID NO: 36423 - protein, 30 aa, Artificial Sequence
  Description of Artificial Sequence: Synthetic polypeptide
SEEEIRTTNPVATESYGSVSNTNEHRDGQR

SEQ ID NO: 36424 - protein, 31 aa, Artificial Sequence
  Description of Artificial Sequence: Synthetic polypeptide
AEEEIRTTNPVATEQYGSVSTQNTQGDTGNQ

SEQ ID NO: 36425 - protein, 30 aa, Artificial Sequence
  Description of Artificial Sequence: Synthetic polypeptide
AEEEIRTTNPVATEQYGSVSTQQVQNGNEQ

SEQ ID NO: 36426 - protein, 30 aa, Artificial Sequence
  Description of Artificial Sequence: Synthetic polypeptide
AEEEIRTTNPVATEQYGSVSTSGEQEGNIN

SEQ ID NO: 36427 - protein, 31 aa, Artificial Sequence
  Description of Artificial Sequence: Synthetic polypeptide
SEEEIRTTNPVATEQYGVVSTNLYQIGNNSA

SEQ ID NO: 36428 - protein, 31 aa, Artificial Sequence
  Description of Artificial Sequence: Synthetic polypeptide
AEEEIRTTNPVATEQYGSVSTSNLQQININN

SEQ ID NO: 36429 - protein, 31 aa, Artificial Sequence
  Description of Artificial Sequence: Synthetic polypeptide
AEEEIRTTNPVATEQYGSVSTSNLQQEGGAN

SEQ ID NO: 36430 - protein, 31 aa, Artificial Sequence
  Description of Artificial Sequence: Synthetic polypeptide
AEEEIRTTNPVATEQYGSVSTSNLQNNEGIL

SEQ ID NO: 36431 - protein, 32 aa, Artificial Sequence
  Description of Artificial Sequence: Synthetic polypeptide
AEEEIRTTNPVATEQYGSVSTSNLQETGGNNI

SEQ ID NO: 36432 - protein, 31 aa, Artificial Sequence
  Description of Artificial Sequence: Synthetic polypeptide
AEEEIRTTNPVATEQYGSVSTSNLNSGNNGN

SEQ ID NO: 36433 - protein, 33 aa, Artificial Sequence
  Description of Artificial Sequence: Synthetic polypeptide
DEEEIRTTNPVATEQYGCVCSTNLSQHSGSNRT

SEQ ID NO: 36434 - protein, 32 aa, Artificial Sequence
  Description of Artificial Sequence: Synthetic polypeptide
AEEEIRTTNPVATEQYGSVSTSNLLQTNGNNG

SEQ ID NO: 36435 - protein, 29 aa, Artificial Sequence
  Description of Artificial Sequence: Synthetic peptide
DEEEIRTTNPVACEQYGSVVTNLQVSDSA

SEQ ID NO: 36436 - protein, 32 aa, Artificial Sequence
  Description of Artificial Sequence: Synthetic polypeptide
DEEEIRTTNPVACEQYGSVVTQNDLLQRGEIR

SEQ ID NO: 36437 - protein, 32 aa, Artificial Sequence
  Description of Artificial Sequence: Synthetic polypeptide
DEEEIRTTNPVACEQYGSVVTTNDGLQRGTTR

SEQ ID NO: 36438 - protein, 31 aa, Artificial Sequence
  Description of Artificial Sequence: Synthetic polypeptide
AEEEIRTTNPVATEQYGSVSTSNENQVTGND

SEQ ID NO: 36439 - protein, 32 aa, Artificial Sequence
  Description of Artificial Sequence: Synthetic polypeptide
DEEEIRTTNPVATEQYGCVCSTNLQYIGSNFE

SEQ ID NO: 36440 - protein, 30 aa, Artificial Sequence
  Description of Artificial Sequence: Synthetic polypeptide
AEEEIRTTNPVATEQYGSVSTSNDEENGNQ

SEQ ID NO: 36441 - protein, 31 aa, Artificial Sequence
  Description of Artificial Sequence: Synthetic polypeptide
DEEEIRTTNPVATEQYGCVCSTNLQYFNNQE

SEQ ID NO: 36442 - protein, 31 aa, Artificial Sequence
  Description of Artificial Sequence: Synthetic polypeptide
AEEEIRTTNPVATEQYGSVSTSLQQQNGNTE

SEQ ID NO: 36443 - protein, 30 aa, Artificial Sequence
  Description of Artificial Sequence: Synthetic polypeptide
AEEEIRTTNPVATEQYGSVSTSLQQEQGET

SEQ ID NO: 36444 - protein, 32 aa, Artificial Sequence
  Description of Artificial Sequence: Synthetic polypeptide
DEEEIRTTNPVACEQYGVVVSTNDLLQRGERE

SEQ ID NO: 36445 - protein, 32 aa, Artificial Sequence
  Description of Artificial Sequence: Synthetic polypeptide
DEEEIRTTNPVATEQYGCVCSTNLQYEGSNII

SEQ ID NO: 36446 - protein, 31 aa, Artificial Sequence
  Description of Artificial Sequence: Synthetic polypeptide
AEEEIRTTNPVATEQYGSVSTQLQQEQGNLG

SEQ ID NO: 36447 - protein, 31 aa, Artificial Sequence
  Description of Artificial Sequence: Synthetic polypeptide
AEEEIRTTNPVATEQYGSVSTNLNQGTEENN

SEQ ID NO: 36448 - protein, 31 aa, Artificial Sequence
  Description of Artificial Sequence: Synthetic polypeptide
AEEEIRTTNPVATEQYGSVSTNNNQLSIGNI

SEQ ID NO: 36449 - protein, 32 aa, Artificial Sequence
  Description of Artificial Sequence: Synthetic polypeptide
AEEEIRTTNPVATEQYGSVSTNNNQLQQGNEN

SEQ ID NO: 36450 - protein, 29 aa, Artificial Sequence
  Description of Artificial Sequence: Synthetic peptide
SEEPIRCTNPCATEQYGSVSENLHRGNRD

SEQ ID NO: 36451 - protein, 31 aa, Artificial Sequence
  Description of Artificial Sequence: Synthetic polypeptide
AEEEIRTTNPVATEQYGSVSTNLQQNNQNFE

SEQ ID NO: 36452 - protein, 32 aa, Artificial Sequence
  Description of Artificial Sequence: Synthetic polypeptide
AEEEIRTTNPVATEQYGSVSTNLQQNIGINET

SEQ ID NO: 36453 - protein, 32 aa, Artificial Sequence
  Description of Artificial Sequence: Synthetic polypeptide
AEEEIRTTNPVATEQYGSVSTNLQQNEGGNIA

SEQ ID NO: 36454 - protein, 28 aa, Artificial Sequence
  Description of Artificial Sequence: Synthetic peptide
SEEPIRCTNPIANEQYGSVSENLMRGNR

SEQ ID NO: 36455 - protein, 31 aa, Artificial Sequence
  Description of Artificial Sequence: Synthetic polypeptide
AEEEIRTTNPVATEQYGSVSTNLQQLQQNAE

SEQ ID NO: 36456 - protein, 29 aa, Artificial Sequence
  Description of Artificial Sequence: Synthetic peptide
SEEPIRCTNPIATEQYGSVSEINLMRGNR

SEQ ID NO: 36457 - protein, 31 aa, Artificial Sequence
  Description of Artificial Sequence: Synthetic polypeptide
AEEEIRTTNPVATEQYGSVSTNLQQLNQNDE

SEQ ID NO: 36458 - protein, 31 aa, Artificial Sequence
  Description of Artificial Sequence: Synthetic polypeptide
AEEEIRTTNPVATEQYGSVSTNLQQNTDGET

SEQ ID NO: 36459 - protein, 32 aa, Artificial Sequence
  Description of Artificial Sequence: Synthetic polypeptide
AEEEIRTTNPVATEQYGSVSTNLQQLGQNGEV

SEQ ID NO: 36460 - protein, 32 aa, Artificial Sequence
  Description of Artificial Sequence: Synthetic polypeptide
AEEEIRTTNPVATEQYGSVSTNLQQIGGINEI

SEQ ID NO: 36461 - protein, 29 aa, Artificial Sequence
  Description of Artificial Sequence: Synthetic peptide
SEEPIRCTNPIATEQYGSVSENLMRGHNR

SEQ ID NO: 36462 - protein, 32 aa, Artificial Sequence
  Description of Artificial Sequence: Synthetic polypeptide
AEEEIRTTNPVATEQYGSVSTNLQQGGINEDT

SEQ ID NO: 36463 - protein, 32 aa, Artificial Sequence
  Description of Artificial Sequence: Synthetic polypeptide
AEEEIRTTNPVATEQYGSVSTNLQQETGGNGI

SEQ ID NO: 36464 - protein, 31 aa, Artificial Sequence
  Description of Artificial Sequence: Synthetic polypeptide
AEEEIRTTNPVATEQYGSVSTNLQQENDNDT

SEQ ID NO: 36465 - protein, 32 aa, Artificial Sequence
  Description of Artificial Sequence: Synthetic polypeptide
AEEEIRTTNPVATEQYGSVSTNLQQEGNLNGG

SEQ ID NO: 36466 - protein, 31 aa, Artificial Sequence
  Description of Artificial Sequence: Synthetic polypeptide
AEEEIRTTNPVATEQYGSVSTNLQQEGEVGN

SEQ ID NO: 36467 - protein, 31 aa, Artificial Sequence
  Description of Artificial Sequence: Synthetic polypeptide
AEEEIRTTNPVATEQYGSVSTNLQPNENDGE

SEQ ID NO: 36468 - protein, 31 aa, Artificial Sequence
  Description of Artificial Sequence: Synthetic polypeptide
AEEEIRTTNPVATEQYGSVSTNLQQININNQ

SEQ ID NO: 36469 - protein, 29 aa, Artificial Sequence
  Description of Artificial Sequence: Synthetic peptide
SEEQIRCTNPIATEQYGSVSENLMRHGNR

SEQ ID NO: 36470 - protein, 31 aa, Artificial Sequence
  Description of Artificial Sequence: Synthetic polypeptide
AEEEIRTTNPVATEQYGSVSTNLQQQDTINT

SEQ ID NO: 36471 - protein, 32 aa, Artificial Sequence
  Description of Artificial Sequence: Synthetic polypeptide
AEEEIRTTNPVATEQYGSVSTNLQQQENGNGG

SEQ ID NO: 36472 - protein, 31 aa, Artificial Sequence
  Description of Artificial Sequence: Synthetic polypeptide
AEEEIRTTNPVATEQYGSVSTNLQTNNDGEE

SEQ ID NO: 36473 - protein, 31 aa, Artificial Sequence
  Description of Artificial Sequence: Synthetic polypeptide
AEEEIRTTNPVATEQYGSVSTNLQTGVGTTG

SEQ ID NO: 36474 - protein, 32 aa, Artificial Sequence
  Description of Artificial Sequence: Synthetic polypeptide
AEEEIRTTNPVATEQYGSVSTNLQTGTNANFE

SEQ ID NO: 36475 - protein, 31 aa, Artificial Sequence
  Description of Artificial Sequence: Synthetic polypeptide
AEEEIRTTNPVATEQYGSVSTNLQTGSGGIT

SEQ ID NO: 36476 - protein, 32 aa, Artificial Sequence
  Description of Artificial Sequence: Synthetic polypeptide
AEEEIRTTNPVATEQYGSVSTNLQTGNGGNTT

SEQ ID NO: 36477 - protein, 31 aa, Artificial Sequence
  Description of Artificial Sequence: Synthetic polypeptide
AEEEIRTTNPVATEQYGSVSTNLQTGGVTTQ

SEQ ID NO: 36478 - protein, 31 aa, Artificial Sequence
  Description of Artificial Sequence: Synthetic polypeptide
AEEEIRTTNPVATEQYGSVSTNLQTGGTTTD

SEQ ID NO: 36479 - protein, 32 aa, Artificial Sequence
  Description of Artificial Sequence: Synthetic polypeptide
AEEEIRTTNPVATEQYGSVSTNLQQTGNSNNE

SEQ ID NO: 36480 - protein, 31 aa, Artificial Sequence
  Description of Artificial Sequence: Synthetic polypeptide
AEEEIRTTNPVATEQYGSVSTNLQQQEGVGD

SEQ ID NO: 36481 - protein, 32 aa, Artificial Sequence
  Description of Artificial Sequence: Synthetic polypeptide
AEEEIRTTNPVATEQYGSVSTNLQQSGTNEIA

SEQ ID NO: 36482 - protein, 32 aa, Artificial Sequence
  Description of Artificial Sequence: Synthetic polypeptide
AEEEIRTTNPVATEQYGSVSTNLQQQTGGNGI

SEQ ID NO: 36483 - protein, 32 aa, Artificial Sequence
  Description of Artificial Sequence: Synthetic polypeptide
AEEEIRTTNPVATEQYGSVSTNLQQQTAGNGD

SEQ ID NO: 36484 - protein, 30 aa, Artificial Sequence
  Description of Artificial Sequence: Synthetic polypeptide
DEEEIRTTNPVAHEQYGSVCTNLQEVDDSR

SEQ ID NO: 36485 - protein, 28 aa, Artificial Sequence
  Description of Artificial Sequence: Synthetic peptide
SEENIRCTNPIATEQYGSVSENLMRPNR

SEQ ID NO: 36486 - protein, 32 aa, Artificial Sequence
  Description of Artificial Sequence: Synthetic polypeptide
AEEEIRTTNPVATEQYGSVSTNLQQQQGNEIA

SEQ ID NO: 36487 - protein, 31 aa, Artificial Sequence
  Description of Artificial Sequence: Synthetic polypeptide
AEEEIRTTNPVATEQYGSVSTNLQQQNSNAA

SEQ ID NO: 36488 - protein, 29 aa, Artificial Sequence
  Description of Artificial Sequence: Synthetic peptide
SEEPICTTNPVATEQYGSVSMNEQRPGNS

SEQ ID NO: 36489 - protein, 32 aa, Artificial Sequence
  Description of Artificial Sequence: Synthetic polypeptide
AEEEIRTTNPVATEQYGSVSTNLQQQNGNEIA

SEQ ID NO: 36490 - protein, 32 aa, Artificial Sequence
  Description of Artificial Sequence: Synthetic polypeptide
AEEEIRTTNPVATEQYGSVSTNLQQQVQGNGE

SEQ ID NO: 36491 - protein, 32 aa, Artificial Sequence
  Description of Artificial Sequence: Synthetic polypeptide
AEEEIRTTNPVATEQYGSVSTNLQNSIGTNQQ

SEQ ID NO: 36492 - protein, 29 aa, Artificial Sequence
  Description of Artificial Sequence: Synthetic peptide
DEEEIRTTNPVAHEQYGSVPTNLQVNDSI

SEQ ID NO: 36493 - protein, 32 aa, Artificial Sequence
  Description of Artificial Sequence: Synthetic polypeptide
AEEEIRTTNPVATEQYGSVSTNLQNQGTNIEG

SEQ ID NO: 36494 - protein, 31 aa, Artificial Sequence
  Description of Artificial Sequence: Synthetic polypeptide
AEEEIRTTNPVATEQYGSVSTNLQESNANQY

SEQ ID NO: 36495 - protein, 33 aa, Artificial Sequence
  Description of Artificial Sequence: Synthetic polypeptide
AEEEIRTTNPVATEQYGSVSTNLQERFGSNNQG

SEQ ID NO: 36496 - protein, 32 aa, Artificial Sequence
  Description of Artificial Sequence: Synthetic polypeptide
AEEEIRTTNPVATEQYGSVSTNLQEQVEGNID

SEQ ID NO: 36497 - protein, 31 aa, Artificial Sequence
  Description of Artificial Sequence: Synthetic polypeptide
AEEEIRTTNPVATEQYGSVSTNLQEEDENEG

SEQ ID NO: 36498 - protein, 31 aa, Artificial Sequence
  Description of Artificial Sequence: Synthetic polypeptide
AEEEIRTTNPVATEQYGSVSTNLQDSTNNIL

SEQ ID NO: 36499 - protein, 31 aa, Artificial Sequence
  Description of Artificial Sequence: Synthetic polypeptide
AEEEIRTTNPVATEQYGSVSTNLQDSNANDQ

SEQ ID NO: 36500 - protein, 32 aa, Artificial Sequence
  Description of Artificial Sequence: Synthetic polypeptide
AEEEIRTTNPVATEQYGSVSTNLQDNTQGNNT

SEQ ID NO: 36501 - protein, 31 aa, Artificial Sequence
  Description of Artificial Sequence: Synthetic polypeptide
AEEEIRTTNPVATEQYGSVSTNLQAGGGGGE

SEQ ID NO: 36502 - protein, 32 aa, Artificial Sequence
  Description of Artificial Sequence: Synthetic polypeptide
AEEEIRTTNPVATEQYGSVSTNLQGNVGGNVE

SEQ ID NO: 36503 - protein, 28 aa, Artificial Sequence
  Description of Artificial Sequence: Synthetic peptide
SEETICTTNPVATEQYGSVSMNSQGGNS

SEQ ID NO: 36504 - protein, 29 aa, Artificial Sequence
  Description of Artificial Sequence: Synthetic peptide
SEETIRCTNPIATEQYGSVSENELMRGNR

SEQ ID NO: 36505 - protein, 29 aa, Artificial Sequence
  Description of Artificial Sequence: Synthetic peptide
SEETIRCTNPIATEQYGSVSENLMRGNWR

SEQ ID NO: 36506 - protein, 29 aa, Artificial Sequence
  Description of Artificial Sequence: Synthetic peptide
SEEVIRCTNPIATEQYGSVKSENLMRGNR

SEQ ID NO: 36507 - protein, 29 aa, Artificial Sequence
  Description of Artificial Sequence: Synthetic peptide
SEEVIRCTNPIATEQYGSVSENLMRAGNR

SEQ ID NO: 36508 - protein, 29 aa, Artificial Sequence
  Description of Artificial Sequence: Synthetic peptide
SEEVIRCTNPIATEQYGSVSIENLMRGNR

SEQ ID NO: 36509 - protein, 29 aa, Artificial Sequence
  Description of Artificial Sequence: Synthetic peptide
SEFEIRCTNPIATEQYGSVSENLMREGNR

SEQ ID NO: 36510 - protein, 33 aa, Artificial Sequence
  Description of Artificial Sequence: Synthetic polypeptide
DEEEIRTTNPVATEQYGCVCSTNHQERFGNPRT

SEQ ID NO: 36511 - protein, 28 aa, Artificial Sequence
  Description of Artificial Sequence: Synthetic peptide
SEGEIACTNPIATEQYGSVSCNLMRGNR

SEQ ID NO: 36512 - protein, 28 aa, Artificial Sequence
  Description of Artificial Sequence: Synthetic peptide
SEETIRCTNPIATEMYGSVSENLMRGNR

SEQ ID NO: 36513 - protein, 32 aa, Artificial Sequence
  Description of Artificial Sequence: Synthetic polypeptide
AEEEIRTTNPVATEQYGSVSTNLQGNVGNEEN

SEQ ID NO: 36514 - protein, 32 aa, Artificial Sequence
  Description of Artificial Sequence: Synthetic polypeptide
AEEEIRTTNPVATEQYGSVSTNLQGNVGNNSE

SEQ ID NO: 36515 - protein, 32 aa, Artificial Sequence
  Description of Artificial Sequence: Synthetic polypeptide
AEEEIRTTNPVATEQYGSVSTNLQGNVGTNEV

SEQ ID NO: 36516 - protein, 32 aa, Artificial Sequence
  Description of Artificial Sequence: Synthetic polypeptide
AEEEIRTTNPVATEQYGSVSTNLQNNVGNNED

SEQ ID NO: 36517 - protein, 32 aa, Artificial Sequence
  Description of Artificial Sequence: Synthetic polypeptide
AEEEIRTTNPVATEQYGSVSTNLQNNVGNDTN

SEQ ID NO: 36518 - protein, 31 aa, Artificial Sequence
  Description of Artificial Sequence: Synthetic polypeptide
AEEEIRTTNPVATEQYGSVSTNLQNNTANDN

SEQ ID NO: 36519 - protein, 32 aa, Artificial Sequence
  Description of Artificial Sequence: Synthetic polypeptide
AEEEIRTTNPVATEQYGSVSTNLQNNQGINTV

SEQ ID NO: 36520 - protein, 31 aa, Artificial Sequence
  Description of Artificial Sequence: Synthetic polypeptide
AEEEIRTTNPVATEQYGSVSTNLQNNNNNSE

SEQ ID NO: 36521 - protein, 31 aa, Artificial Sequence
  Description of Artificial Sequence: Synthetic polypeptide
AEEEIRTTNPVATEQYGSVSTNLQNNLGQEA

SEQ ID NO: 36522 - protein, 31 aa, Artificial Sequence
  Description of Artificial Sequence: Synthetic polypeptide
AEEEIRTTNPVATEQYGSVSTNLQNNGQGEQ

SEQ ID NO: 36523 - protein, 31 aa, Artificial Sequence
  Description of Artificial Sequence: Synthetic polypeptide
AEEEIRTTNPVATEQYGSVSTNLQNNGGDEI

SEQ ID NO: 36524 - protein, 32 aa, Artificial Sequence
  Description of Artificial Sequence: Synthetic polypeptide
AEEEIRTTNPVATEQYGSVSTNLQNNEGNIAT

SEQ ID NO: 36525 - protein, 28 aa, Artificial Sequence
  Description of Artificial Sequence: Synthetic peptide
SEEQIRCTNPIATEQYGSVYENLMRGNR

SEQ ID NO: 36526 - protein, 32 aa, Artificial Sequence
  Description of Artificial Sequence: Synthetic polypeptide
AEEEIRTTNPVATEQYGSVSTNLQNENGNQQG

SEQ ID NO: 36527 - protein, 31 aa, Artificial Sequence
  Description of Artificial Sequence: Synthetic polypeptide
AEEEIRTTNPVATEQYGSVSTNLQNEDTNSG

SEQ ID NO: 36528 - protein, 28 aa, Artificial Sequence
  Description of Artificial Sequence: Synthetic peptide
SEERIRCTNPIATEQYGSVSENLMRGNH

SEQ ID NO: 36529 - protein, 32 aa, Artificial Sequence
  Description of Artificial Sequence: Synthetic polypeptide
AEEEIRTTNPVATEQYGSVSTNLQLQIGTNPE

SEQ ID NO: 36530 - protein, 29 aa, Artificial Sequence
  Description of Artificial Sequence: Synthetic peptide
SEESIRCTNPIATEQYGSVSEDNLMRGNR

SEQ ID NO: 36531 - protein, 29 aa, Artificial Sequence
  Description of Artificial Sequence: Synthetic peptide
SEESIRCTNPIATEQYGSVSENLMRVGNR

SEQ ID NO: 36532 - protein, 31 aa, Artificial Sequence
  Description of Artificial Sequence: Synthetic polypeptide
AEEEIRTTNPVATEQYGSVSTNLQLGGQEEG

SEQ ID NO: 36533 - protein, 31 aa, Artificial Sequence
  Description of Artificial Sequence: Synthetic polypeptide
AEEEIRTTNPVATEQYGSVSTNLQINTENGE

SEQ ID NO: 36534 - protein, 28 aa, Artificial Sequence
  Description of Artificial Sequence: Synthetic peptide
SEETICCTNPIATEQYGSVSENLMRGNR

SEQ ID NO: 36535 - protein, 32 aa, Artificial Sequence
  Description of Artificial Sequence: Synthetic polypeptide
AEEEIRTTNPVATEQYGSVSTNLQVQNGNNID

SEQ ID NO: 36536 - protein, 32 aa, Artificial Sequence
  Description of Artificial Sequence: Synthetic polypeptide
AEEEIRTTNPVATEQYGSVSTNNNQLQSNGNS

SEQ ID NO: 36537 - protein, 32 aa, Artificial Sequence
  Description of Artificial Sequence: Synthetic polypeptide
AEEEIRTTNPVATEQYGSVSTNLQYGNINNTN

SEQ ID NO: 36538 - protein, 32 aa, Artificial Sequence
  Description of Artificial Sequence: Synthetic polypeptide
AEEEIRTTNPVATEQYGSVSTNLSGNQVGNID

SEQ ID NO: 36539 - protein, 34 aa, Artificial Sequence
  Description of Artificial Sequence: Synthetic polypeptide
DEEEIRTTNPVATEQYGCVCSTNLDQERSGSNRT

SEQ ID NO: 36540 - protein, 32 aa, Artificial Sequence
  Description of Artificial Sequence: Synthetic polypeptide
AEEEIRTTNPVATEQYGSVSTNNNLQYGNNLE

SEQ ID NO: 36541 - protein, 31 aa, Artificial Sequence
  Description of Artificial Sequence: Synthetic polypeptide
AEEEIRTTNPVATEQYGSVSTNNNLQTGIPG

SEQ ID NO: 36542 - protein, 32 aa, Artificial Sequence
  Description of Artificial Sequence: Synthetic polypeptide
DEEEIRTTNPVATEQYGCVCSTNLDARFGSNQ

SEQ ID NO: 36543 - protein, 32 aa, Artificial Sequence
  Description of Artificial Sequence: Synthetic polypeptide
DEEEIRTTNPVATEQYGCVCSTNLARGSETRA

SEQ ID NO: 36544 - protein, 29 aa, Artificial Sequence
  Description of Artificial Sequence: Synthetic peptide
SEEEVRCTNPVATEQYGSVSAETIQRGNR

SEQ ID NO: 36545 - protein, 32 aa, Artificial Sequence
  Description of Artificial Sequence: Synthetic polypeptide
DEEEIRTTNPVATEQYGCVCSTNHQRFGSNVQ

SEQ ID NO: 36546 - protein, 32 aa, Artificial Sequence
  Description of Artificial Sequence: Synthetic polypeptide
AEEEIRTTNPVATEQYGSVSTNNNLQLGNEQG

SEQ ID NO: 36547 - protein, 31 aa, Artificial Sequence
  Description of Artificial Sequence: Synthetic polypeptide
DEEEIRTTNPVATEQYGCVCSTNLDQGNNQG

SEQ ID NO: 36548 - protein, 32 aa, Artificial Sequence
  Description of Artificial Sequence: Synthetic polypeptide
AEEEIRTTNPVATEQYGSVSTNNNLQFGENET

SEQ ID NO: 36549 - protein, 30 aa, Artificial Sequence
  Description of Artificial Sequence: Synthetic polypeptide
AEEEIRTTNPVATEQYGSVSTNNNGEVGNV

SEQ ID NO: 36550 - protein, 31 aa, Artificial Sequence
  Description of Artificial Sequence: Synthetic polypeptide
AEEEIRTTNPVATEQYGSVSTNNNEQTGNSD

SEQ ID NO: 36551 - protein, 31 aa, Artificial Sequence
  Description of Artificial Sequence: Synthetic polypeptide
AEEEIRTTNPVATEQYGSVSTNNNEQAIGNG

SEQ ID NO: 36552 - protein, 32 aa, Artificial Sequence
  Description of Artificial Sequence: Synthetic polypeptide
SEEEVRTTNPVATEQYGSVSTMNHDQRIGSNR

SEQ ID NO: 36553 - protein, 29 aa, Artificial Sequence
  Description of Artificial Sequence: Synthetic peptide
SEEGIRCTNPIATEQYGSVSENLMERGNR

SEQ ID NO: 36554 - protein, 29 aa, Artificial Sequence
  Description of Artificial Sequence: Synthetic peptide
SEEHIRCTNPIATEQYGSVSENLMRGENR

SEQ ID NO: 36555 - protein, 29 aa, Artificial Sequence
  Description of Artificial Sequence: Synthetic peptide
SEEHIRCTNPIATEQYGSVSENLMTRGNR

SEQ ID NO: 36556 - protein, 28 aa, Artificial Sequence
  Description of Artificial Sequence: Synthetic peptide
SEEIIRCTNPIATEQWGSVSENLMRGNR

SEQ ID NO: 36557 - protein, 31 aa, Artificial Sequence
  Description of Artificial Sequence: Synthetic polypeptide
SEEEVRTTNPVATEQYGSVSTGELDQRIGNA

SEQ ID NO: 36558 - protein, 31 aa, Artificial Sequence
  Description of Artificial Sequence: Synthetic polypeptide
AEEEIRTTNPVATEQYGSVSTNNLRTVGNDD

SEQ ID NO: 36559 - protein, 29 aa, Artificial Sequence
  Description of Artificial Sequence: Synthetic peptide
SEEEIYCTNPIATEQYGSVSEANLMRGNR

SEQ ID NO: 36560 - protein, 33 aa, Artificial Sequence
  Description of Artificial Sequence: Synthetic polypeptide
DEEEIRTTNPVATEQYGCVCSTNLDQRGSNTQG

SEQ ID NO: 36561 - protein, 32 aa, Artificial Sequence
  Description of Artificial Sequence: Synthetic polypeptide
AEEEIRTTNPVATEQYGSVSTNNNQLQAGNTN

SEQ ID NO: 36562 - protein, 30 aa, Artificial Sequence
  Description of Artificial Sequence: Synthetic polypeptide
SEEEISTTNPVATEVYGSVSTNLQEVGGND

SEQ ID NO: 36563 - protein, 29 aa, Artificial Sequence
  Description of Artificial Sequence: Synthetic peptide
SEEEIVCTNPIATEQYGSVCSENLMRGNR

SEQ ID NO: 36564 - protein, 30 aa, Artificial Sequence
  Description of Artificial Sequence: Synthetic polypeptide
SEEEIVCTNPIATEQYGSVCSTNLMREGNR

SEQ ID NO: 36565 - protein, 29 aa, Artificial Sequence
  Description of Artificial Sequence: Synthetic peptide
SEEEIVCTNPIATEQYGSVSEDNLMRGNR

SEQ ID NO: 36566 - protein, 29 aa, Artificial Sequence
  Description of Artificial Sequence: Synthetic peptide
SEEEIVCTNPIATEQYGSVSENLHMRGNR

SEQ ID NO: 36567 - protein, 29 aa, Artificial Sequence
  Description of Artificial Sequence: Synthetic peptide
SEEEIVCTNPIATEQYGSVSENLMRGGNR

SEQ ID NO: 36568 - protein, 29 aa, Artificial Sequence
  Description of Artificial Sequence: Synthetic peptide
SEEEIVCTNPIATEQYGSVSENLMRGNQR

SEQ ID NO: 36569 - protein, 31 aa, Artificial Sequence
  Description of Artificial Sequence: Synthetic polypeptide
AEEEIRTTNPVATEQYGSVSTNNNNQGIGNQ

SEQ ID NO: 36570 - protein, 28 aa, Artificial Sequence
  Description of Artificial Sequence: Synthetic peptide
SEEEIVCTNPIATEQYGSVSENPMRGNR

SEQ ID NO: 36571 - protein, 29 aa, Artificial Sequence
  Description of Artificial Sequence: Synthetic peptide
SEEEIVTTNPIATEQYGSVSAEGLMRGNR

SEQ ID NO: 36572 - protein, 30 aa, Artificial Sequence
  Description of Artificial Sequence: Synthetic polypeptide
AEEEIRTTNPVATEQYGSVSTNNNQEANED

SEQ ID NO: 36573 - protein, 30 aa, Artificial Sequence
  Description of Artificial Sequence: Synthetic polypeptide
SEEEIVTTNPIATEQYGSVSATGLVMRGNR

SEQ ID NO: 36574 - protein, 30 aa, Artificial Sequence
  Description of Artificial Sequence: Synthetic polypeptide
SEEEIVTTNPVATEIYGSVATNLQERGNPA

SEQ ID NO: 36575 - protein, 30 aa, Artificial Sequence
  Description of Artificial Sequence: Synthetic polypeptide
DEEEIRTTNPVAFEQYGSVTGTNLQVEDDR

SEQ ID NO: 36576 - protein, 29 aa, Artificial Sequence
  Description of Artificial Sequence: Synthetic peptide
SEEEIWCTNPIATEQYGSVSENLMRGENR

SEQ ID NO: 36577 - protein, 32 aa, Artificial Sequence
  Description of Artificial Sequence: Synthetic polypeptide
DEEEIRTTNPVATEQYGCVCSTNLDQYSGSNQ

SEQ ID NO: 36578 - protein, 28 aa, Artificial Sequence
  Description of Artificial Sequence: Synthetic peptide
SEEEIWCTNPIATEQYGSVSENLMRGNC

SEQ ID NO: 36579 - protein, 31 aa, Artificial Sequence
  Description of Artificial Sequence: Synthetic polypeptide
AEEEIRTTNPVATEQYGSVSTNNNQGTVGNA

SEQ ID NO: 36580 - protein, 32 aa, Artificial Sequence
  Description of Artificial Sequence: Synthetic polypeptide
AEEEIRTTNPVATEQYGSVSTNNLQVGTVNNT

SEQ ID NO: 36581 - protein, 32 aa, Artificial Sequence
  Description of Artificial Sequence: Synthetic polypeptide
AEEEIRTTNPVATEQYGSVSTNNLQVENGNNL

SEQ ID NO: 36582 - protein, 31 aa, Artificial Sequence
  Description of Artificial Sequence: Synthetic polypeptide
AEEEIRTTNPVATEQYGSVSTNNLQTGTISG

SEQ ID NO: 36583 - protein, 31 aa, Artificial Sequence
  Description of Artificial Sequence: Synthetic polypeptide
AEEEIRTTNPVATEQYGSVSTNNENQEGNGN

SEQ ID NO: 36584 - protein, 32 aa, Artificial Sequence
  Description of Artificial Sequence: Synthetic polypeptide
AEEEIRTTNPVATEQYGSVSTNNELGQEGGNS

SEQ ID NO: 36585 - protein, 29 aa, Artificial Sequence
  Description of Artificial Sequence: Synthetic peptide
SEEMIRCTNPIATEQYGSVGSENLMRGNR

SEQ ID NO: 36586 - protein, 28 aa, Artificial Sequence
  Description of Artificial Sequence: Synthetic peptide
SEEMIRCTNPIATEQYGSVSENLMDGNR

SEQ ID NO: 36587 - protein, 28 aa, Artificial Sequence
  Description of Artificial Sequence: Synthetic peptide
SEEMIRCTNPIATEQYGSVSENLMRGND

SEQ ID NO: 36588 - protein, 31 aa, Artificial Sequence
  Description of Artificial Sequence: Synthetic polypeptide
AEEEIRTTNPVATEQYGSVSTNNDQIGTGNT

SEQ ID NO: 36589 - protein, 29 aa, Artificial Sequence
  Description of Artificial Sequence: Synthetic peptide
SEEMIRCTNPIATEQYGSVSENPLMRGNR

SEQ ID NO: 36590 - protein, 28 aa, Artificial Sequence
  Description of Artificial Sequence: Synthetic peptide
SEENIHCTNPIATEQYGSVSENLMRGNR

SEQ ID NO: 36591 - protein, 31 aa, Artificial Sequence
  Description of Artificial Sequence: Synthetic polypeptide
AEEEIRTTNPVATEQYGSVSTNNEQGEGNNN

SEQ ID NO: 36592 - protein, 28 aa, Artificial Sequence
  Description of Artificial Sequence: Synthetic peptide
SEENIRCTNPIATEQYGSVSENLAGGNR

SEQ ID NO: 36593 - protein, 33 aa, Artificial Sequence
  Description of Artificial Sequence: Synthetic polypeptide
DEEEIRTTNPVAHEQYGQSVSNTNDLDQRGIAR

SEQ ID NO: 36594 - protein, 30 aa, Artificial Sequence
  Description of Artificial Sequence: Synthetic polypeptide
AEEEIRTTNPVATEQYGSVSTNMNQDNGGG

SEQ ID NO: 36595 - protein, 30 aa, Artificial Sequence
  Description of Artificial Sequence: Synthetic polypeptide
AEEEIRTTNPVATEQYGSVSTNLVVTNSNN

SEQ ID NO: 36596 - protein, 32 aa, Artificial Sequence
  Description of Artificial Sequence: Synthetic polypeptide
AEEEIRTTNPVATEQYGSVSTNLVQTLMGANA

SEQ ID NO: 36597 - protein, 32 aa, Artificial Sequence
  Description of Artificial Sequence: Synthetic polypeptide
AEEEIRTTNPVATEQYGSVSTNLVQTGNNNND

SEQ ID NO: 36598 - protein, 31 aa, Artificial Sequence
  Description of Artificial Sequence: Synthetic polypeptide
AEEEIRTTNPVATEQYGSVSTNLTQSNANDE

SEQ ID NO: 36599 - protein, 31 aa, Artificial Sequence
  Description of Artificial Sequence: Synthetic polypeptide
AEEEIRTTNPVATEQYGSVSTNLTFGGNNTT

SEQ ID NO: 36600 - protein, 31 aa, Artificial Sequence
  Description of Artificial Sequence: Synthetic polypeptide
AEEEIRTTNPVATEQYGSVSTNLSQNPNLIF

SEQ ID NO: 36601 - protein, 31 aa, Artificial Sequence
  Description of Artificial Sequence: Synthetic polypeptide
AEEEIRTTNPVATEQYGSVSTNNAEQGGNET

SEQ ID NO: 36602 - protein, 28 aa, Artificial Sequence
  Description of Artificial Sequence: Synthetic peptide
SEEKIRCTNPIATEQYGSVSENLMRGLR

SEQ ID NO: 36603 - protein, 31 aa, Artificial Sequence
  Description of Artificial Sequence: Synthetic polypeptide
AEEEIRTTNPVATEQYGSVSTNNEQQGAGNG

SEQ ID NO: 36604 - protein, 30 aa, Artificial Sequence
  Description of Artificial Sequence: Synthetic polypeptide
AEEEIRTTNPVATEQYGSVSTNNGTVGNFG

SEQ ID NO: 36605 - protein, 32 aa, Artificial Sequence
  Description of Artificial Sequence: Synthetic polypeptide
AEEEIRTTNPVATEQYGSVSTNNLQQQIGNQT

SEQ ID NO: 36606 - protein, 32 aa, Artificial Sequence
  Description of Artificial Sequence: Synthetic polypeptide
AEEEIRTTNPVATEQYGSVSTNNLQQQDGNET

SEQ ID NO: 36607 - protein, 28 aa, Artificial Sequence
  Description of Artificial Sequence: Synthetic peptide
SEEIIRCTNPIATEQYGSVSENFMRGNR

SEQ ID NO: 36608 - protein, 32 aa, Artificial Sequence
  Description of Artificial Sequence: Synthetic polypeptide
AEEEIRTTNPVATEQYGSVSTNNLQQDEGNIF

SEQ ID NO: 36609 - protein, 32 aa, Artificial Sequence
  Description of Artificial Sequence: Synthetic polypeptide
AEEEIRTTNPVATEQYGSVSTNNLQNNTEGNQ

SEQ ID NO: 36610 - protein, 32 aa, Artificial Sequence
  Description of Artificial Sequence: Synthetic polypeptide
AEEEIRTTNPVATEQYGSVSTNNLQNLGGGND

SEQ ID NO: 36611 - protein, 32 aa, Artificial Sequence
  Description of Artificial Sequence: Synthetic polypeptide
AEEEIRTTNPVATEQYGSVSTNNLQLGGNNIS

SEQ ID NO: 36612 - protein, 31 aa, Artificial Sequence
  Description of Artificial Sequence: Synthetic polypeptide
AEEEIRTTNPVATEQYGSVSTNNLQGIENET

SEQ ID NO: 36613 - protein, 31 aa, Artificial Sequence
  Description of Artificial Sequence: Synthetic polypeptide
AEEEIRTTNPVATEQYGSVSTNNLQEDTNVG

SEQ ID NO: 36614 - protein, 32 aa, Artificial Sequence
  Description of Artificial Sequence: Synthetic polypeptide
AEEEIRTTNPVATEQYGSVSTNNLQDGGNESG

SEQ ID NO: 36615 - protein, 30 aa, Artificial Sequence
  Description of Artificial Sequence: Synthetic polypeptide
AEEEIRTTNPVATEQYGSVSTNNLNQGQGE

SEQ ID NO: 36616 - protein, 32 aa, Artificial Sequence
  Description of Artificial Sequence: Synthetic polypeptide
AEEEIRTTNPVATEQYGSVSTNNLNQAGNNSG

SEQ ID NO: 36617 - protein, 31 aa, Artificial Sequence
  Description of Artificial Sequence: Synthetic polypeptide
AEEEIRTTNPVATEQYGSVSTNNLNLGNNQV

SEQ ID NO: 36618 - protein, 29 aa, Artificial Sequence
  Description of Artificial Sequence: Synthetic peptide
SEEIIRCTNPIATEQYGSVSENLMRGNLR

SEQ ID NO: 36619 - protein, 32 aa, Artificial Sequence
  Description of Artificial Sequence: Synthetic polypeptide
AEEEIRTTNPVATEQYGSVSTNNLGQQEGNNS

SEQ ID NO: 36620 - protein, 31 aa, Artificial Sequence
  Description of Artificial Sequence: Synthetic polypeptide
AEEEIRTTNPVATEQYGSVSTNNLEQQGEDN

SEQ ID NO: 36621 - protein, 32 aa, Artificial Sequence
  Description of Artificial Sequence: Synthetic polypeptide
AEEEIRTTNPVATEQYGSVSTNNLDQQGNGNG

SEQ ID NO: 36622 - protein, 31 aa, Artificial Sequence
  Description of Artificial Sequence: Synthetic polypeptide
AEEEIRTTNPVATEQYGSVSTNNLDNQGNTD

SEQ ID NO: 36623 - protein, 30 aa, Artificial Sequence
  Description of Artificial Sequence: Synthetic polypeptide
AEEEIRTTNPVATEQYGSVSTNNGVTVGNA

SEQ ID NO: 36624 - protein, 32 aa, Artificial Sequence
  Description of Artificial Sequence: Synthetic polypeptide
AEEEIRTTNPVATEQYGSVSTNLQYGTSGNNT

SEQ ID NO: 36625 - protein, 31 aa, Artificial Sequence
  Description of Artificial Sequence: Synthetic polypeptide
DEEEIRTTNPVATEQYGSISTTNLVQEMNFD

SEQ ID NO: 36626 - protein, 30 aa, Artificial Sequence
  Description of Artificial Sequence: Synthetic polypeptide
DEMEIRTTNPVATQQYGCVSTNLERSGSNF

SEQ ID NO: 36627 - protein, 30 aa, Artificial Sequence
  Description of Artificial Sequence: Synthetic polypeptide
DEGEIRTTNPVATEAYGSVQTALSHRVGNR

SEQ ID NO: 36628 - protein, 31 aa, Artificial Sequence
  Description of Artificial Sequence: Synthetic polypeptide
DEHEIRTTNPVATEQYGSVSTNAQQDGNNES

SEQ ID NO: 36629 - protein, 31 aa, Artificial Sequence
  Description of Artificial Sequence: Synthetic polypeptide
DEHEIRTTNPVATEQYGSVSTNAQQNGGNEP

SEQ ID NO: 36630 - protein, 31 aa, Artificial Sequence
  Description of Artificial Sequence: Synthetic polypeptide
DEEEIATTNPVATEQYGSVSTNLNGNMGNDS

SEQ ID NO: 36631 - protein, 29 aa, Artificial Sequence
  Description of Artificial Sequence: Synthetic peptide
DDAEIRTTNPVATEQYGCCSTVLQHFGNR

SEQ ID NO: 36632 - protein, 31 aa, Artificial Sequence
  Description of Artificial Sequence: Synthetic polypeptide
DEHEIRTTNPVATEQYGSVSTNGHQERDMIR

SEQ ID NO: 36633 - protein, 30 aa, Artificial Sequence
  Description of Artificial Sequence: Synthetic polypeptide
DEHEIRTTNPVATEQYGSVSTNHGEGGQND

SEQ ID NO: 36634 - protein, 31 aa, Artificial Sequence
  Description of Artificial Sequence: Synthetic polypeptide
DEHEIRTTNPVATEQYGSVSTNAQPDGDNGE

SEQ ID NO: 36635 - protein, 31 aa, Artificial Sequence
  Description of Artificial Sequence: Synthetic polypeptide
DEEEIATTNPVATEQYGSVSTNLNQGDSQDR

SEQ ID NO: 36636 - protein, 31 aa, Artificial Sequence
  Description of Artificial Sequence: Synthetic polypeptide
DEHEIRTTNPVATEQYGSVSTNLNDGHNDGQ

SEQ ID NO: 36637 - protein, 31 aa, Artificial Sequence
  Description of Artificial Sequence: Synthetic polypeptide
DEHEIRTTNPVATEQYGSVSTNLNGDGNLGQ

SEQ ID NO: 36638 - protein, 32 aa, Artificial Sequence
  Description of Artificial Sequence: Synthetic polypeptide
DEHEIRTTNPVATEQYGSVSTNLNGEEGDNGR

SEQ ID NO: 36639 - protein, 31 aa, Artificial Sequence
  Description of Artificial Sequence: Synthetic polypeptide
DEHEIRTTNPVATEQYGSVSTNLNGGPNNGQ

SEQ ID NO: 36640 - protein, 32 aa, Artificial Sequence
  Description of Artificial Sequence: Synthetic polypeptide
DEHEIRTTNPVATEQYGSVSTNLNGQDGMNGQ

SEQ ID NO: 36641 - protein, 32 aa, Artificial Sequence
  Description of Artificial Sequence: Synthetic polypeptide
DEEEIRTTNPVAYEQYGKVSCTNALSQERVNR

SEQ ID NO: 36642 - protein, 30 aa, Artificial Sequence
  Description of Artificial Sequence: Synthetic polypeptide
DEHEIRTTNPVATEQYGSVSTNLNAGDGGQ

SEQ ID NO: 36643 - protein, 32 aa, Artificial Sequence
  Description of Artificial Sequence: Synthetic polypeptide
DEEEIRTTNPVAYEQYGKVSCTGNLQDTGGNR

SEQ ID NO: 36644 - protein, 31 aa, Artificial Sequence
  Description of Artificial Sequence: Synthetic polypeptide
DEHEIRTTNPVATEQYGSVSTNAGGQDGNEP

SEQ ID NO: 36645 - protein, 30 aa, Artificial Sequence
  Description of Artificial Sequence: Synthetic polypeptide
DEAAEICTTNPVATECYGSVSTNLQDGNEN

SEQ ID NO: 36646 - protein, 29 aa, Artificial Sequence
  Description of Artificial Sequence: Synthetic peptide
DEHEIRTTNPVATEQYGSVSSNLERIEID

SEQ ID NO: 36647 - protein, 32 aa, Artificial Sequence
  Description of Artificial Sequence: Synthetic polypeptide
DEEEIATTNPVATEQYGSVSTNLNGEMNGNGR

SEQ ID NO: 36648 - protein, 32 aa, Artificial Sequence
  Description of Artificial Sequence: Synthetic polypeptide
DEEEIATTNPVATEQYGSVSTNLNGNDMGNSR

SEQ ID NO: 36649 - protein, 30 aa, Artificial Sequence
  Description of Artificial Sequence: Synthetic polypeptide
DDAEIRTTNPVATEQYGCVSTNLQSFGSNQ

SEQ ID NO: 36650 - protein, 32 aa, Artificial Sequence
  Description of Artificial Sequence: Synthetic polypeptide
DEEEIATTNPVATEQYGSVSTNLNGNEMGENR

SEQ ID NO: 36651 - protein, 30 aa, Artificial Sequence
  Description of Artificial Sequence: Synthetic polypeptide
DEHEIRTTNPVATEQYGSVSTAGGQQGNEE

SEQ ID NO: 36652 - protein, 31 aa, Artificial Sequence
  Description of Artificial Sequence: Synthetic polypeptide
DEEEIRTTNPVAYEQYGKVSTGNLSQNGGTR

SEQ ID NO: 36653 - protein, 32 aa, Artificial Sequence
  Description of Artificial Sequence: Synthetic polypeptide
DEHEIRTTNPVATEQYGSVSTDGLQDRGGEQR

SEQ ID NO: 36654 - protein, 32 aa, Artificial Sequence
  Description of Artificial Sequence: Synthetic polypeptide
DEHEIRTTNPVATEQYGSVSTDNAQGDMGNSR

SEQ ID NO: 36655 - protein, 30 aa, Artificial Sequence
  Description of Artificial Sequence: Synthetic polypeptide
DEHEIRTTNPVATEQYGSVSTGGDDRQGNE

SEQ ID NO: 36656 - protein, 33 aa, Artificial Sequence
  Description of Artificial Sequence: Synthetic polypeptide
DEEEIRTTNPVAYEQYGNSVISTNDLLQRGIER

SEQ ID NO: 36657 - protein, 31 aa, Artificial Sequence
  Description of Artificial Sequence: Synthetic polypeptide
DEEEIATTNPVATEQYGSVSTNLNGNMGGNM

SEQ ID NO: 36658 - protein, 32 aa, Artificial Sequence
  Description of Artificial Sequence: Synthetic polypeptide
DEHEIRTTNPVATEQYGSVSTGNPQAGGGNDR

SEQ ID NO: 36659 - protein, 29 aa, Artificial Sequence
  Description of Artificial Sequence: Synthetic peptide
DEHEIRTTNPVATEQYGSVSTMDDGMGNQ

SEQ ID NO: 36660 - protein, 31 aa, Artificial Sequence
  Description of Artificial Sequence: Synthetic polypeptide
DEHEIRTTNPVATEQYGSVSTDNADGDGNSR

SEQ ID NO: 36661 - protein, 31 aa, Artificial Sequence
  Description of Artificial Sequence: Synthetic polypeptide
DEEEIATTNPVATEQYGSVSTNLNGEMGDSR

SEQ ID NO: 36662 - protein, 31 aa, Artificial Sequence
  Description of Artificial Sequence: Synthetic polypeptide
DEHEIRTTNPVATEQYGSVSTNLNHDGNGGQ

SEQ ID NO: 36663 - protein, 31 aa, Artificial Sequence
  Description of Artificial Sequence: Synthetic polypeptide
DEHEIRTTNPVATEQYGSVSTNLNNGGMNGQ

SEQ ID NO: 36664 - protein, 32 aa, Artificial Sequence
  Description of Artificial Sequence: Synthetic polypeptide
DEHEIRTTNPVATEQYGSVSTNLQNQGQNDNG

SEQ ID NO: 36665 - protein, 32 aa, Artificial Sequence
  Description of Artificial Sequence: Synthetic polypeptide
DEEEIRTTNPVATEQYGSVISTNLQPVGAQDE

SEQ ID NO: 36666 - protein, 31 aa, Artificial Sequence
  Description of Artificial Sequence: Synthetic polypeptide
DEHEIRTTNPVATEQYGSVSTNLQQAGGDDP

SEQ ID NO: 36667 - protein, 32 aa, Artificial Sequence
  Description of Artificial Sequence: Synthetic polypeptide
DEHEIRTTNPVATEQYGSVSTNLQQGDPNDDN

SEQ ID NO: 36668 - protein, 32 aa, Artificial Sequence
  Description of Artificial Sequence: Synthetic polypeptide
DEHEIRTTNPVATEQYGSVSTNLQQMGDNDED

SEQ ID NO: 36669 - protein, 32 aa, Artificial Sequence
  Description of Artificial Sequence: Synthetic polypeptide
DEEEIATTNPVATEQYGSVSTNLQAQGGNDDT

SEQ ID NO: 36670 - protein, 32 aa, Artificial Sequence
  Description of Artificial Sequence: Synthetic polypeptide
DEEEIRTTNPVAYEQYGKVPSTGNEDSQRGNR

SEQ ID NO: 36671 - protein, 32 aa, Artificial Sequence
  Description of Artificial Sequence: Synthetic polypeptide
DEHEIRTTNPVATEQYGSVSTNLQVNGNNDMG

SEQ ID NO: 36672 - protein, 32 aa, Artificial Sequence
  Description of Artificial Sequence: Synthetic polypeptide
DEHEIRTTNPVATEQYGSVSTNNGLQTGDNNE

SEQ ID NO: 36673 - protein, 30 aa, Artificial Sequence
  Description of Artificial Sequence: Synthetic polypeptide
DCGEIRTTNPVATEQYGSVSTNNLLELGMR

SEQ ID NO: 36674 - protein, 30 aa, Artificial Sequence
  Description of Artificial Sequence: Synthetic polypeptide
DCGEIRTTNPVATEQYGSVSTNLLQLGMQF

SEQ ID NO: 36675 - protein, 30 aa, Artificial Sequence
  Description of Artificial Sequence: Synthetic polypeptide
DCGEIRTTNPVATEQYGSVSTNLLQLGGME

SEQ ID NO: 36676 - protein, 31 aa, Artificial Sequence
  Description of Artificial Sequence: Synthetic polypeptide
DEHEIRTTNPVATEQYGSVSTNNQGADGNTN

SEQ ID NO: 36677 - protein, 32 aa, Artificial Sequence
  Description of Artificial Sequence: Synthetic polypeptide
DEHEIRTTNPVATEQYGSVSTNNQNRMDNIRE

SEQ ID NO: 36678 - protein, 32 aa, Artificial Sequence
  Description of Artificial Sequence: Synthetic polypeptide
DEHEIRTTNPVATEQYGSVSTNNGLQGSGNNE

SEQ ID NO: 36679 - protein, 31 aa, Artificial Sequence
  Description of Artificial Sequence: Synthetic polypeptide
DEHEIRTTNPVATEQYGSVSTNLNMGDNGNQ

SEQ ID NO: 36680 - protein, 32 aa, Artificial Sequence
  Description of Artificial Sequence: Synthetic polypeptide
DEHEIRTTNPVATEQYGSVSTNLQNNGQNEDS

SEQ ID NO: 36681 - protein, 31 aa, Artificial Sequence
  Description of Artificial Sequence: Synthetic polypeptide
DEHEIRTTNPVATEQYGSVSTNLQNGDMGGG

SEQ ID NO: 36682 - protein, 32 aa, Artificial Sequence
  Description of Artificial Sequence: Synthetic polypeptide
DEHEIRTTNPVATEQYGSVSTNLNQGEGGSDR

SEQ ID NO: 36683 - protein, 32 aa, Artificial Sequence
  Description of Artificial Sequence: Synthetic polypeptide
DEHEIRTTNPVATEQYGSVSTNLNQGNMGDGR

SEQ ID NO: 36684 - protein, 31 aa, Artificial Sequence
  Description of Artificial Sequence: Synthetic polypeptide
DEHEIRTTNPVATEQYGSVSTNLQAGGDGPD

SEQ ID NO: 36685 - protein, 32 aa, Artificial Sequence
  Description of Artificial Sequence: Synthetic polypeptide
DEHEIRTTNPVATEQYGSVSTNLQDNGDDRRG

SEQ ID NO: 36686 - protein, 31 aa, Artificial Sequence
  Description of Artificial Sequence: Synthetic polypeptide
DEHEIRTTNPVATEQYGSVSTNLQDNGDGSG

SEQ ID NO: 36687 - protein, 32 aa, Artificial Sequence
  Description of Artificial Sequence: Synthetic polypeptide
DEHEIRTTNPVATEQYGSVSTNLQGAGGGNPP

SEQ ID NO: 36688 - protein, 32 aa, Artificial Sequence
  Description of Artificial Sequence: Synthetic polypeptide
DEHEIRTTNPVATEQYGSVSTNLQNGGQDENG

SEQ ID NO: 36689 - protein, 31 aa, Artificial Sequence
  Description of Artificial Sequence: Synthetic polypeptide
DEHEIRTTNPVATEQYGSVSTNLQGDGDAGK

SEQ ID NO: 36690 - protein, 32 aa, Artificial Sequence
  Description of Artificial Sequence: Synthetic polypeptide
DEEEIRTTNPVATEQYGSVISTNLQEVVENVL

SEQ ID NO: 36691 - protein, 32 aa, Artificial Sequence
  Description of Artificial Sequence: Synthetic polypeptide
DEHEIRTTNPVATEQYGSVSTNLQGEHGQGND

SEQ ID NO: 36692 - protein, 32 aa, Artificial Sequence
  Description of Artificial Sequence: Synthetic polypeptide
DEHEIRTTNPVATEQYGSVSTNLQGNEGGDLR

SEQ ID NO: 36693 - protein, 32 aa, Artificial Sequence
  Description of Artificial Sequence: Synthetic polypeptide
DEHEIRTTNPVATEQYGSVSTNLQGNGGNNAQ

SEQ ID NO: 36694 - protein, 32 aa, Artificial Sequence
  Description of Artificial Sequence: Synthetic polypeptide
DEHEIRTTNPVATEQYGSVSTNLQGNMGDDRN

SEQ ID NO: 36695 - protein, 32 aa, Artificial Sequence
  Description of Artificial Sequence: Synthetic polypeptide
DEHEIRTTNPVATEQYGSVSTNLQGPDGGNAQ

SEQ ID NO: 36696 - protein, 32 aa, Artificial Sequence
  Description of Artificial Sequence: Synthetic polypeptide
DEHEIRTTNPVATEQYGSVSTNLQGDVGNNEQ

SEQ ID NO: 36697 - protein, 31 aa, Artificial Sequence
  Description of Artificial Sequence: Synthetic polypeptide
DEHEIRTTNPVATEQYGSVSTNQQHNGNDGS

SEQ ID NO: 36698 - protein, 31 aa, Artificial Sequence
  Description of Artificial Sequence: Synthetic polypeptide
DEHEIRTTNPVATEQYGSVSQSNLGEQNMNR

SEQ ID NO: 36699 - protein, 32 aa, Artificial Sequence
  Description of Artificial Sequence: Synthetic polypeptide
DEHEIRTTNPVATEQYGSVSQNLSFRTVGSNR

SEQ ID NO: 36700 - protein, 30 aa, Artificial Sequence
  Description of Artificial Sequence: Synthetic polypeptide
DEHEIRTTNPVATEQYGEVSTDNLAGGVSR

SEQ ID NO: 36701 - protein, 32 aa, Artificial Sequence
  Description of Artificial Sequence: Synthetic polypeptide
DEEEIRTTNPVATEQYGSVISTNDIQRGDQVL

SEQ ID NO: 36702 - protein, 31 aa, Artificial Sequence
  Description of Artificial Sequence: Synthetic polypeptide
DEHEIRTTNPVATEQYGEVSTNLQGDGDNDM

SEQ ID NO: 36703 - protein, 32 aa, Artificial Sequence
  Description of Artificial Sequence: Synthetic polypeptide
DEEEIRTTNPVATEQYGSVISTNDLVDGSQRL

SEQ ID NO: 36704 - protein, 31 aa, Artificial Sequence
  Description of Artificial Sequence: Synthetic polypeptide
DEHEIRTTNPVATEQYGEVSTNLQGEGQNDM

SEQ ID NO: 36705 - protein, 31 aa, Artificial Sequence
  Description of Artificial Sequence: Synthetic polypeptide
DEHEIRTTNPVATEQYGEVSTNLQPGDNNAQ

SEQ ID NO: 36706 - protein, 29 aa, Artificial Sequence
  Description of Artificial Sequence: Synthetic peptide
DEHEIRTTNPVATEQYGEISTNIQGEGLR

SEQ ID NO: 36707 - protein, 31 aa, Artificial Sequence
  Description of Artificial Sequence: Synthetic polypeptide
DEHEIRTTNPVATEQYGMVSTTNQDQRGPNT

SEQ ID NO: 36708 - protein, 31 aa, Artificial Sequence
  Description of Artificial Sequence: Synthetic polypeptide
DEHEIRTTNPVATEQYGNVSTNLQGEGGNNA

SEQ ID NO: 36709 - protein, 31 aa, Artificial Sequence
  Description of Artificial Sequence: Synthetic polypeptide
DEHEIRTTNPVATEQYGSCSMTDNHQREGLR

SEQ ID NO: 36710 - protein, 30 aa, Artificial Sequence
  Description of Artificial Sequence: Synthetic polypeptide
DEHEIRTTNPVATEQYGSCSTGNTQGEGLR

SEQ ID NO: 36711 - protein, 30 aa, Artificial Sequence
  Description of Artificial Sequence: Synthetic polypeptide
DEHEIRTTNPVATEQYGSCSTNTQGEGDSR

SEQ ID NO: 36712 - protein, 31 aa, Artificial Sequence
  Description of Artificial Sequence: Synthetic polypeptide
DEHEIRTTNPVATEQYGSISCTNATQRTGSR

SEQ ID NO: 36713 - protein, 29 aa, Artificial Sequence
  Description of Artificial Sequence: Synthetic peptide
DEHEIRTTNPVATEQYGSISTLTQREGLF

SEQ ID NO: 36714 - protein, 31 aa, Artificial Sequence
  Description of Artificial Sequence: Synthetic polypeptide
DEHEIRTTNPVATEQYGNVSTNLQAQGGNDT

SEQ ID NO: 36715 - protein, 30 aa, Artificial Sequence
  Description of Artificial Sequence: Synthetic polypeptide
DEHEIRTTNPVATEQYGSISTNGTQGEGSR

SEQ ID NO: 36716 - protein, 33 aa, Artificial Sequence
  Description of Artificial Sequence: Synthetic polypeptide
DEEEIATTNPVATEQYGSVSTNELSQERNGTNL

SEQ ID NO: 36717 - protein, 30 aa, Artificial Sequence
  Description of Artificial Sequence: Synthetic polypeptide
DEHEIRTTNPVATEQYGCVSTNNLFGGDER

SEQ ID NO: 36718 - protein, 32 aa, Artificial Sequence
  Description of Artificial Sequence: Synthetic polypeptide
DEEEIRTTNPVAYEQYGQSVSFNDLLQRGIHR

SEQ ID NO: 36719 - protein, 30 aa, Artificial Sequence
  Description of Artificial Sequence: Synthetic polypeptide
DDEAIRTTNPVATEQYGCVSTNHQRGVNLS

SEQ ID NO: 36720 - protein, 30 aa, Artificial Sequence
  Description of Artificial Sequence: Synthetic polypeptide
DEEEIATTNPVATEQYGSVSTGPLQDGDGE

SEQ ID NO: 36721 - protein, 32 aa, Artificial Sequence
  Description of Artificial Sequence: Synthetic polypeptide
DEEEIRTTNPVATEQYGSVCSTNLEHGEPDRE

SEQ ID NO: 36722 - protein, 33 aa, Artificial Sequence
  Description of Artificial Sequence: Synthetic polypeptide
DEEEIATTNPVATEQYGSVSTINELSQSGGNNR

SEQ ID NO: 36723 - protein, 28 aa, Artificial Sequence
  Description of Artificial Sequence: Synthetic peptide
DDEAIATTNPVATEQYGEVSTNHQRNNL

SEQ ID NO: 36724 - protein, 32 aa, Artificial Sequence
  Description of Artificial Sequence: Synthetic polypeptide
DEEEIRTTNPVAYEQYGQSVPTNDLLQRGIAR

SEQ ID NO: 36725 - protein, 33 aa, Artificial Sequence
  Description of Artificial Sequence: Synthetic polypeptide
DEEEIRTTNPVAYEQYGQSVSETNDACQRGNER

SEQ ID NO: 36726 - protein, 31 aa, Artificial Sequence
  Description of Artificial Sequence: Synthetic polypeptide
DEHEIRTTNPVATEQYGAVSTNLQIGGDNDD

SEQ ID NO: 36727 - protein, 33 aa, Artificial Sequence
  Description of Artificial Sequence: Synthetic polypeptide
DEEEIATTNPVATEQYGSVSTNALSQERAGGNL

SEQ ID NO: 36728 - protein, 33 aa, Artificial Sequence
  Description of Artificial Sequence: Synthetic polypeptide
DEEEIATTNPVATEQYGSVSTNAPSQRPGNNRE

SEQ ID NO: 36729 - protein, 30 aa, Artificial Sequence
  Description of Artificial Sequence: Synthetic polypeptide
DEHEIRTTNPVATEQYGCVSTNLQAGGDMP

SEQ ID NO: 36730 - protein, 31 aa, Artificial Sequence
  Description of Artificial Sequence: Synthetic polypeptide
DEHEIRTTNPVATEQYGCVSTNLQGGPNDAN

SEQ ID NO: 36731 - protein, 31 aa, Artificial Sequence
  Description of Artificial Sequence: Synthetic polypeptide
DEHEIRTTNPVATEQYGCVSTNLQHQNGDER

SEQ ID NO: 36732 - protein, 31 aa, Artificial Sequence
  Description of Artificial Sequence: Synthetic polypeptide
DEHEIRTTNPVATEQYGAVSTNLGQGNDNNR

SEQ ID NO: 36733 - protein, 31 aa, Artificial Sequence
  Description of Artificial Sequence: Synthetic polypeptide
DEHEIRTTNPVATEQYGSVSQQNLGDGNMNR

SEQ ID NO: 36734 - protein, 30 aa, Artificial Sequence
  Description of Artificial Sequence: Synthetic polypeptide
DEEEIATTNPVATEQYGSVSTNHGNTGNNV

SEQ ID NO: 36735 - protein, 30 aa, Artificial Sequence
  Description of Artificial Sequence: Synthetic polypeptide
DEHEIRTTNPVATEQYGSISTNTQREGLDL

SEQ ID NO: 36736 - protein, 31 aa, Artificial Sequence
  Description of Artificial Sequence: Synthetic polypeptide
DEHEIRTTNPVATEQYGSVSGQNLGDRNMNR

SEQ ID NO: 36737 - protein, 31 aa, Artificial Sequence
  Description of Artificial Sequence: Synthetic polypeptide
DEHEIRTTNPVATEQYGSVSNNDGHRGNNQR

SEQ ID NO: 36738 - protein, 32 aa, Artificial Sequence
  Description of Artificial Sequence: Synthetic polypeptide
DEEEIATTNPVATEQYGSVSTNLNGDAGGNRQ

SEQ ID NO: 36739 - protein, 30 aa, Artificial Sequence
  Description of Artificial Sequence: Synthetic polypeptide
DEHEIRTTNPVATEQYGSVSQNLFDFNMNR

SEQ ID NO: 36740 - protein, 32 aa, Artificial Sequence
  Description of Artificial Sequence: Synthetic polypeptide
DEEEIRTTNPVAYEQYGQSTSTNDLLQRGIDR

SEQ ID NO: 36741 - protein, 29 aa, Artificial Sequence
  Description of Artificial Sequence: Synthetic peptide
DEHEIRTTNPVATEQYGSVSQNLFGNQFE

SEQ ID NO: 36742 - protein, 31 aa, Artificial Sequence
  Description of Artificial Sequence: Synthetic polypeptide
DEHEIRTTNPVATEQYGSVSGQNLGDGNMNR

SEQ ID NO: 36743 - protein, 29 aa, Artificial Sequence
  Description of Artificial Sequence: Synthetic peptide
DEHEIRTTNPVATEQYGSVSQNLFNNMNV

SEQ ID NO: 36744 - protein, 31 aa, Artificial Sequence
  Description of Artificial Sequence: Synthetic polypeptide
DDAEIRTTNPVATEQYGSVSTNELQHFGSDR

SEQ ID NO: 36745 - protein, 32 aa, Artificial Sequence
  Description of Artificial Sequence: Synthetic polypeptide
DEEEIATTNPVATEQYGSVSTNLNGDGMGTNR

SEQ ID NO: 36746 - protein, 32 aa, Artificial Sequence
  Description of Artificial Sequence: Synthetic polypeptide
DEEEIRTTNPVATEQYGSVISTNLEVELGNGE

SEQ ID NO: 36747 - protein, 31 aa, Artificial Sequence
  Description of Artificial Sequence: Synthetic polypeptide
DEHEIRTTNPVATEQYGSVSQNLGEDQNMNR

SEQ ID NO: 36748 - protein, 31 aa, Artificial Sequence
  Description of Artificial Sequence: Synthetic polypeptide
DEEEIRTTNPVATEQYGSVISTNLGSNGVEV

SEQ ID NO: 36749 - protein, 32 aa, Artificial Sequence
  Description of Artificial Sequence: Synthetic polypeptide
DEEEIRTTNPVAYEQYGNVSCTNLSQNGGSNR

SEQ ID NO: 36750 - protein, 32 aa, Artificial Sequence
  Description of Artificial Sequence: Synthetic polypeptide
DEEEIATTNPVATEQYGSVSTNLNGDAQGNDR

SEQ ID NO: 36751 - protein, 30 aa, Artificial Sequence
  Description of Artificial Sequence: Synthetic polypeptide
DEHEIRTTNPVATEQYGSISTNTQREGETQ

SEQ ID NO: 36752 - protein, 32 aa, Artificial Sequence
  Description of Artificial Sequence: Synthetic polypeptide
DEEEIRTTNPVATEQYGSVISTNLEQGTMTRV

SEQ ID NO: 36753 - protein, 33 aa, Artificial Sequence
  Description of Artificial Sequence: Synthetic polypeptide
DEEEIRTTNPVAYEQYGQSVASTNWLSQRVGDR

SEQ ID NO: 36754 - protein, 30 aa, Artificial Sequence
  Description of Artificial Sequence: Synthetic polypeptide
DEHEIRTTNPVATEQYGSISTNTQREGSED

SEQ ID NO: 36755 - protein, 30 aa, Artificial Sequence
  Description of Artificial Sequence: Synthetic polypeptide
DEHEIRTTNPVATEQYGSISTSNTQGEGLR

SEQ ID NO: 36756 - protein, 30 aa, Artificial Sequence
  Description of Artificial Sequence: Synthetic polypeptide
DEHEIRTTNPVATEQYGSIWSTNEQEGGER

SEQ ID NO: 36757 - protein, 29 aa, Artificial Sequence
  Description of Artificial Sequence: Synthetic peptide
DEHEIRTTNPVATEQYGSSSTNTQEEGLQ

SEQ ID NO: 36758 - protein, 32 aa, Artificial Sequence
  Description of Artificial Sequence: Synthetic polypeptide
DEHEIRTTNPVATEQYGSTSPTENDSQRDGNR

SEQ ID NO: 36759 - protein, 32 aa, Artificial Sequence
  Description of Artificial Sequence: Synthetic polypeptide
DEEEIRTTNPVATEQYGSVISTNDMQEGNNDQ

SEQ ID NO: 36760 - protein, 31 aa, Artificial Sequence
  Description of Artificial Sequence: Synthetic polypeptide
DEHEIRTTNPVATEQYGSVSDTNYQLNGMNQ

SEQ ID NO: 36761 - protein, 30 aa, Artificial Sequence
  Description of Artificial Sequence: Synthetic polypeptide
DEHEIRTTNPVATEQYGSVATNNQGEDNDR

SEQ ID NO: 36762 - protein, 33 aa, Artificial Sequence
  Description of Artificial Sequence: Synthetic polypeptide
DEHEIRTTNPVATEQYGSVCSTGNNLMQRDGNN

SEQ ID NO: 36763 - protein, 32 aa, Artificial Sequence
  Description of Artificial Sequence: Synthetic polypeptide
DEHEIRTTNPVATEQYGSVCSTNDTGQREGLR

SEQ ID NO: 36764 - protein, 29 aa, Artificial Sequence
  Description of Artificial Sequence: Synthetic peptide
DEHEIRTTNPVATEQYGSVSANLFGNNNH

SEQ ID NO: 36765 - protein, 30 aa, Artificial Sequence
  Description of Artificial Sequence: Synthetic polypeptide
DEHEIRTTNPVATEQYGSVSANNEQGGVND

SEQ ID NO: 36766 - protein, 30 aa, Artificial Sequence
  Description of Artificial Sequence: Synthetic polypeptide
DEHEIRTTNPVATEQYGSVSCTNLTASGDD

SEQ ID NO: 36767 - protein, 31 aa, Artificial Sequence
  Description of Artificial Sequence: Synthetic polypeptide
DEEEIATTNPVATEQYGSVSTNLGQNDGGPK

SEQ ID NO: 36768 - protein, 30 aa, Artificial Sequence
  Description of Artificial Sequence: Synthetic polypeptide
DEHEIRTTNPVATEQYGSVATNNQGEHNDR

SEQ ID NO: 36769 - protein, 31 aa, Artificial Sequence
  Description of Artificial Sequence: Synthetic polypeptide
DEHEIRTTNPVATEQYGSVSTNTGNGDGNPR

SEQ ID NO: 36770 - protein, 29 aa, Artificial Sequence
  Description of Artificial Sequence: Synthetic peptide
DCEEISTTNPVATTQYGSVSTNPMRENQR

SEQ ID NO: 36771 - protein, 29 aa, Artificial Sequence
  Description of Artificial Sequence: Synthetic peptide
DCEEISTTNPVATTQYGSVSTNPMNGNAR

SEQ ID NO: 36772 - protein, 31 aa, Artificial Sequence
  Description of Artificial Sequence: Synthetic polypeptide
DEEEIRTTNPVAYEQYGCVSTNESDRGGNNR

SEQ ID NO: 36773 - protein, 32 aa, Artificial Sequence
  Description of Artificial Sequence: Synthetic polypeptide
DEHEIRTTNPVATEVYGSVSTNLQGDHGNNGR

SEQ ID NO: 36774 - protein, 30 aa, Artificial Sequence
  Description of Artificial Sequence: Synthetic polypeptide
DEHEIRTTNPVATEWYGCVSTNLQGGGDNE

SEQ ID NO: 36775 - protein, 30 aa, Artificial Sequence
  Description of Artificial Sequence: Synthetic polypeptide
DEHEIRTTNPVATEWYGSVSCTGMDRDGNR

SEQ ID NO: 36776 - protein, 30 aa, Artificial Sequence
  Description of Artificial Sequence: Synthetic polypeptide
DEHEIRTTNPVATEWYGVVSTNLQGGDNGG

SEQ ID NO: 36777 - protein, 31 aa, Artificial Sequence
  Description of Artificial Sequence: Synthetic polypeptide
DEHEIRTTNPVATEYYGSVSTNGDQGNGNRG

SEQ ID NO: 36778 - protein, 31 aa, Artificial Sequence
  Description of Artificial Sequence: Synthetic polypeptide
DEHEIRTTNPVATETYGSVSTNLQTGGGDTR

SEQ ID NO: 36779 - protein, 31 aa, Artificial Sequence
  Description of Artificial Sequence: Synthetic polypeptide
DEEEIRTTNPVAYEQYGCVSTGGLSQNGGNR

SEQ ID NO: 36780 - protein, 30 aa, Artificial Sequence
  Description of Artificial Sequence: Synthetic polypeptide
DEHEIRTTNPVAYECYGSVSTGNLQNDGDR

SEQ ID NO: 36781 - protein, 30 aa, Artificial Sequence
  Description of Artificial Sequence: Synthetic polypeptide
DEEEIRTTNPVAYEQYGCVSTEPQRGSERA

SEQ ID NO: 36782 - protein, 31 aa, Artificial Sequence
  Description of Artificial Sequence: Synthetic polypeptide
DEEEIATTNPVATEQWGSVSVAGNLQRGVNQ

SEQ ID NO: 36783 - protein, 30 aa, Artificial Sequence
  Description of Artificial Sequence: Synthetic polypeptide
DEHEIRTTNPVAYECYGSVSTNLNQGGNNQ

SEQ ID NO: 36784 - protein, 30 aa, Artificial Sequence
  Description of Artificial Sequence: Synthetic polypeptide
DEHEIRTTNPVAYECYGSVSTNLQDGNNDE

SEQ ID NO: 36785 - protein, 30 aa, Artificial Sequence
  Description of Artificial Sequence: Synthetic polypeptide
DEHEIRTTNPVAYECYGSVSTNLQDGNNDM

SEQ ID NO: 36786 - protein, 32 aa, Artificial Sequence
  Description of Artificial Sequence: Synthetic polypeptide
DEEEIRTTNPVATEQYGSVISTNSLEVERMNE

SEQ ID NO: 36787 - protein, 29 aa, Artificial Sequence
  Description of Artificial Sequence: Synthetic peptide
DAGEISTTNPVATEQYGSVSTNDLELGMR

SEQ ID NO: 36788 - protein, 31 aa, Artificial Sequence
  Description of Artificial Sequence: Synthetic polypeptide
DEHEIRTTNPVATETYGSVSTNLQQGDGDNM

SEQ ID NO: 36789 - protein, 29 aa, Artificial Sequence
  Description of Artificial Sequence: Synthetic peptide
DEHEIRTTNPVATESYGSVSWNDLQDGTA

SEQ ID NO: 36790 - protein, 32 aa, Artificial Sequence
  Description of Artificial Sequence: Synthetic polypeptide
DEEEIRTTNPVAYEQYGETVSTGNLSQGGGNR

SEQ ID NO: 36791 - protein, 31 aa, Artificial Sequence
  Description of Artificial Sequence: Synthetic polypeptide
DEHEIRTTNPVATEQYGVVSTNLQHQGNGNQ

SEQ ID NO: 36792 - protein, 31 aa, Artificial Sequence
  Description of Artificial Sequence: Synthetic polypeptide
DEHEIRTTNPVATEQYGVVSTNLQNQGDNPN

SEQ ID NO: 36793 - protein, 31 aa, Artificial Sequence
  Description of Artificial Sequence: Synthetic polypeptide
DEEEIRTTNPVATEQYGSVISTNNQIDMNND

SEQ ID NO: 36794 - protein, 31 aa, Artificial Sequence
  Description of Artificial Sequence: Synthetic polypeptide
DEEEIRTTNPVATEQYGSVISTNNQIPTEND

SEQ ID NO: 36795 - protein, 32 aa, Artificial Sequence
  Description of Artificial Sequence: Synthetic polypeptide
DEHEIRTTNPVATEQYGVVSTPNLQGDGGQNR

SEQ ID NO: 36796 - protein, 30 aa, Artificial Sequence
  Description of Artificial Sequence: Synthetic polypeptide
DEHEIRTTNPVATETWGSVSTNLQPGGGNS

SEQ ID NO: 36797 - protein, 31 aa, Artificial Sequence
  Description of Artificial Sequence: Synthetic polypeptide
DEEEIRTTNPVAYEQYGCVSTNTQYFGSNRG

SEQ ID NO: 36798 - protein, 32 aa, Artificial Sequence
  Description of Artificial Sequence: Synthetic polypeptide
DEHEIRTTNPVATERYGSVSTNLQQGEGGNTR

SEQ ID NO: 36799 - protein, 31 aa, Artificial Sequence
  Description of Artificial Sequence: Synthetic polypeptide
DEHEIRTTNPVATESYGSVSTNLQLGGDNEQ

SEQ ID NO: 36800 - protein, 31 aa, Artificial Sequence
  Description of Artificial Sequence: Synthetic polypeptide
DEHEIRTTNPVATESYGSVSTNNGGQDAGNR

SEQ ID NO: 36801 - protein, 31 aa, Artificial Sequence
  Description of Artificial Sequence: Synthetic polypeptide
DEHEIRTTNPVATESYGSVSTNNGGQDMGNR

SEQ ID NO: 36802 - protein, 32 aa, Artificial Sequence
  Description of Artificial Sequence: Synthetic polypeptide
DEEEIRTTNPVAYEQYGCVSTNLSQRGGNNAI

SEQ ID NO: 36803 - protein, 31 aa, Artificial Sequence
  Description of Artificial Sequence: Synthetic polypeptide
DEHEIRTTNPVATESYGSVSTNNGQGDEGNR

SEQ ID NO: 36804 - protein, 31 aa, Artificial Sequence
  Description of Artificial Sequence: Synthetic polypeptide
DEHEIRTTNPVATERYGSVSTGNLQGGGDLR

SEQ ID NO: 36805 - protein, 31 aa, Artificial Sequence
  Description of Artificial Sequence: Synthetic polypeptide
DEHEIRTTNPVATEQYGVVSTNLQHQGGNDN

SEQ ID NO: 36806 - protein, 30 aa, Artificial Sequence
  Description of Artificial Sequence: Synthetic polypeptide
DAGEIRTTNPVATEQYGSVSTPGNDQLGMR

SEQ ID NO: 36807 - protein, 30 aa, Artificial Sequence
  Description of Artificial Sequence: Synthetic polypeptide
DEEEIRTTNPVAYEQYGCVSTEHQRNSNRT

SEQ ID NO: 36808 - protein, 32 aa, Artificial Sequence
  Description of Artificial Sequence: Synthetic polypeptide
DEEEIRTTNPVAYEQYGCVSCLNLSQDRGSNR

SEQ ID NO: 36809 - protein, 32 aa, Artificial Sequence
  Description of Artificial Sequence: Synthetic polypeptide
DEEEIRTTNPVAYEQYGCVPSTGVLSQRGGNR

SEQ ID NO: 36810 - protein, 31 aa, Artificial Sequence
  Description of Artificial Sequence: Synthetic polypeptide
DEEEIATTNPVATEQYGSVSTNPDNRGNDAS

SEQ ID NO: 36811 - protein, 31 aa, Artificial Sequence
  Description of Artificial Sequence: Synthetic polypeptide
DEEEIATTNPVATEQYGSVSTNPGGQDGERV

SEQ ID NO: 36812 - protein, 29 aa, Artificial Sequence
  Description of Artificial Sequence: Synthetic peptide
DAGEIATTNPVATEQYGSVSTNQLQEMMR

SEQ ID NO: 36813 - protein, 30 aa, Artificial Sequence
  Description of Artificial Sequence: Synthetic polypeptide
DAGEIATTNPVATEQYGSVSTNPLQLGMPR

SEQ ID NO: 36814 - protein, 30 aa, Artificial Sequence
  Description of Artificial Sequence: Synthetic polypeptide
DEEEIATTNPVATEQYGSVSTNNQHNGEDG

SEQ ID NO: 36815 - protein, 31 aa, Artificial Sequence
  Description of Artificial Sequence: Synthetic polypeptide
DEEEIRTTNPVAYEQYGCVPSCTNLQPGGNL

SEQ ID NO: 36816 - protein, 31 aa, Artificial Sequence
  Description of Artificial Sequence: Synthetic polypeptide
DEEEIATTNPVATEQYGSVSTNSLFQSREEF

SEQ ID NO: 36817 - protein, 31 aa, Artificial Sequence
  Description of Artificial Sequence: Synthetic polypeptide
DEEEIATTNPVATEQYGSVSTNSLGQVTGEF

SEQ ID NO: 36818 - protein, 31 aa, Artificial Sequence
  Description of Artificial Sequence: Synthetic polypeptide
DEEEIATTNPVATEQYGSVSTNTNGGDGNQR

SEQ ID NO: 36819 - protein, 29 aa, Artificial Sequence
  Description of Artificial Sequence: Synthetic peptide
DAEEIRTTNPCAYEHYGSVSANLQRENDR

SEQ ID NO: 36820 - protein, 31 aa, Artificial Sequence
  Description of Artificial Sequence: Synthetic polypeptide
DEEEIRTTNPVAYEQYGCVCSTNLQNFGNQP

SEQ ID NO: 36821 - protein, 31 aa, Artificial Sequence
  Description of Artificial Sequence: Synthetic polypeptide
DAEEIRSTNPVATEQYGSVSTPNGQAGNGQR

SEQ ID NO: 36822 - protein, 30 aa, Artificial Sequence
  Description of Artificial Sequence: Synthetic polypeptide
DEHEIRTTNPVAYEQWGSVSTNLQGDGNSS

SEQ ID NO: 36823 - protein, 32 aa, Artificial Sequence
  Description of Artificial Sequence: Synthetic polypeptide
DEEEIATTNPVATEQYGSVSTNLSQHNGGNNQ

SEQ ID NO: 36824 - protein, 28 aa, Artificial Sequence
  Description of Artificial Sequence: Synthetic peptide
DEHEIRTTNPVAYEQWGSVSTNGQHGMQ

SEQ ID NO: 36825 - protein, 31 aa, Artificial Sequence
  Description of Artificial Sequence: Synthetic polypeptide
DEEEIRTTNPVAYEQYGCVSCQNLQSAVGNR

SEQ ID NO: 36826 - protein, 30 aa, Artificial Sequence
  Description of Artificial Sequence: Synthetic polypeptide
DAGEIRTTNPVATEQYGSVSTNDGDQQGMR

SEQ ID NO: 36827 - protein, 31 aa, Artificial Sequence
  Description of Artificial Sequence: Synthetic polypeptide
DAGEIRTTNPVATEQYGSVSTGNDLQNEGMR

SEQ ID NO: 36828 - protein, 30 aa, Artificial Sequence
  Description of Artificial Sequence: Synthetic polypeptide
DAGEIRTTNPVATEQYGSVSTGDLQDTGMR

SEQ ID NO: 36829 - protein, 30 aa, Artificial Sequence
  Description of Artificial Sequence: Synthetic polypeptide
DAGEIRTTNPVATEQYGSVATNDLQNGPRS

SEQ ID NO: 36830 - protein, 31 aa, Artificial Sequence
  Description of Artificial Sequence: Synthetic polypeptide
DEEEIRTTNPVAYEQYGCVSCTNLSANGGNR

SEQ ID NO: 36831 - protein, 29 aa, Artificial Sequence
  Description of Artificial Sequence: Synthetic peptide
DAGEIRTTNPVATEQWGSVSANALQQGMR

SEQ ID NO: 36832 - protein, 31 aa, Artificial Sequence
  Description of Artificial Sequence: Synthetic polypeptide
DEEEIATTNPVATEQYGSVSTNNLFQNEGEF

SEQ ID NO: 36833 - protein, 29 aa, Artificial Sequence
  Description of Artificial Sequence: Synthetic peptide
DAGEIRATNPVAYEQYGSVSTNPLQDGMR

SEQ ID NO: 36834 - protein, 32 aa, Artificial Sequence
  Description of Artificial Sequence: Synthetic polypeptide
DEEEIRTTNPVAYEQYGCVSCTNLQQRGGSND

SEQ ID NO: 36835 - protein, 33 aa, Artificial Sequence
  Description of Artificial Sequence: Synthetic polypeptide
DEEEIATTNPVATEQYGSVSTNLSQQTGGNNRK

SEQ ID NO: 36836 - protein, 30 aa, Artificial Sequence
  Description of Artificial Sequence: Synthetic polypeptide
DEHEIRTTNPVAYEHYGEVSTNLQDGNNDR

SEQ ID NO: 36837 - protein, 30 aa, Artificial Sequence
  Description of Artificial Sequence: Synthetic polypeptide
DEHEIRTTNPVAYEHYGSVSTNLQGNSGNM

SEQ ID NO: 36838 - protein, 31 aa, Artificial Sequence
  Description of Artificial Sequence: Synthetic polypeptide
DEEEIATTNPVATEQYGSVSTNMGQDGGERR

SEQ ID NO: 36839 - protein, 33 aa, Artificial Sequence
  Description of Artificial Sequence: Synthetic polypeptide
DEEEIRTTNPVATEQYGSVCSTNLDQGFGSNQL

SEQ ID NO: 36840 - protein, 29 aa, Artificial Sequence
  Description of Artificial Sequence: Synthetic peptide
DAGEIRATNPVATEQYGSVSTNGLQDGMV

SEQ ID NO: 36841 - protein, 32 aa, Artificial Sequence
  Description of Artificial Sequence: Synthetic polypeptide
DEEEIATTNPVATEQYGSVSTNLQNSGGNNGD

SEQ ID NO: 36842 - protein, 32 aa, Artificial Sequence
  Description of Artificial Sequence: Synthetic polypeptide
DEEEIRTTNPVATEQYGSVISTNMVIEDGNRD

SEQ ID NO: 36843 - protein, 32 aa, Artificial Sequence
  Description of Artificial Sequence: Synthetic polypeptide
DEEEIATTNPVATEQYGSVSTNLQNGGGDNGD

SEQ ID NO: 36844 - protein, 32 aa, Artificial Sequence
  Description of Artificial Sequence: Synthetic polypeptide
DEHEIRTTNPVATEQYGSVSTTLQRDGDNNQS

SEQ ID NO: 36845 - protein, 32 aa, Artificial Sequence
  Description of Artificial Sequence: Synthetic polypeptide
DEEEIATTNPVATEQYGSVSTNLQGDVGGNTE

SEQ ID NO: 36846 - protein, 32 aa, Artificial Sequence
  Description of Artificial Sequence: Synthetic polypeptide
DEHEIRTTNPVATEQYGSVSTTNAGQDTGNER

SEQ ID NO: 36847 - protein, 32 aa, Artificial Sequence
  Description of Artificial Sequence: Synthetic polypeptide
DEHEIRTTNPVATEQYGSVSTTNEDQNSNGNR

SEQ ID NO: 36848 - protein, 32 aa, Artificial Sequence
  Description of Artificial Sequence: Synthetic polypeptide
DEEEIATTNPVATEQYGSVSTNLQGEDGNNSE

SEQ ID NO: 36849 - protein, 32 aa, Artificial Sequence
  Description of Artificial Sequence: Synthetic polypeptide
DEHEIRTTNPVATEQYGSVSTTNGGDQRQGNM

SEQ ID NO: 36850 - protein, 31 aa, Artificial Sequence
  Description of Artificial Sequence: Synthetic polypeptide
DEHEIRTTNPVATEQYGSVSTTLQGDGNLQN

SEQ ID NO: 36851 - protein, 33 aa, Artificial Sequence
  Description of Artificial Sequence: Synthetic polypeptide
DEHEIRTTNPVATEQYGSVSTTNGLQSDGENDR

SEQ ID NO: 36852 - protein, 32 aa, Artificial Sequence
  Description of Artificial Sequence: Synthetic polypeptide
DEEEIATTNPVATEQYGSVSTNLQGNDAGNEE

SEQ ID NO: 36853 - protein, 32 aa, Artificial Sequence
  Description of Artificial Sequence: Synthetic polypeptide
DEEEIRTTNPVAYEQYGISVSTGNLSQSVTNR

SEQ ID NO: 36854 - protein, 31 aa, Artificial Sequence
  Description of Artificial Sequence: Synthetic polypeptide
DEEEIATTNPVATEQYGSVSTNLQGNMGGDS

SEQ ID NO: 36855 - protein, 31 aa, Artificial Sequence
  Description of Artificial Sequence: Synthetic polypeptide
DEHEIRTTNPVATEQYGSVSTTNLQGGGDLQ

SEQ ID NO: 36856 - protein, 32 aa, Artificial Sequence
  Description of Artificial Sequence: Synthetic polypeptide
DEHEIRTTNPVATEQYGSVSTTNNGQRGENDS

SEQ ID NO: 36857 - protein, 32 aa, Artificial Sequence
  Description of Artificial Sequence: Synthetic polypeptide
DEHEIRTTNPVATEQYGSVSTTNQAQNDGNER

SEQ ID NO: 36858 - protein, 31 aa, Artificial Sequence
  Description of Artificial Sequence: Synthetic polypeptide
DCEEIRTTNPVATDQYGSVSTNGGQDHGNHR

SEQ ID NO: 36859 - protein, 31 aa, Artificial Sequence
  Description of Artificial Sequence: Synthetic polypeptide
DEHEIRTTNPVATEQYGSVSTTPDQRGGNDL

SEQ ID NO: 36860 - protein, 31 aa, Artificial Sequence
  Description of Artificial Sequence: Synthetic polypeptide
DEHEIRTTNPVATEQYGSVSTTLQGDGGNLQ

SEQ ID NO: 36861 - protein, 32 aa, Artificial Sequence
  Description of Artificial Sequence: Synthetic polypeptide
DEHEIRTTNPVATEQYGSVSTTGQGDRGNGDR

SEQ ID NO: 36862 - protein, 31 aa, Artificial Sequence
  Description of Artificial Sequence: Synthetic polypeptide
DEHEIRTTNPVATEQYGSVSTPNGQDDGSNL

SEQ ID NO: 36863 - protein, 30 aa, Artificial Sequence
  Description of Artificial Sequence: Synthetic polypeptide
DCEEIRTTNPVGTEQWGMVSTNLQRDGEVR

SEQ ID NO: 36864 - protein, 32 aa, Artificial Sequence
  Description of Artificial Sequence: Synthetic polypeptide
DEEEIATTNPVATEQYGSVSTNLQEGNGNDEM

SEQ ID NO: 36865 - protein, 31 aa, Artificial Sequence
  Description of Artificial Sequence: Synthetic polypeptide
DEHEIRTTNPVATEQYGSVSTQLQGEGDNNH

SEQ ID NO: 36866 - protein, 31 aa, Artificial Sequence
  Description of Artificial Sequence: Synthetic polypeptide
DEEEIRTTNPVAYEQYGKVATNLSQRGGNSF

SEQ ID NO: 36867 - protein, 31 aa, Artificial Sequence
  Description of Artificial Sequence: Synthetic polypeptide
DCEEIRTTNPVATHQYGSVSTTNGDQGGNHR

SEQ ID NO: 36868 - protein, 32 aa, Artificial Sequence
  Description of Artificial Sequence: Synthetic polypeptide
DEEEIRTTNPVAYEQYGKTVSCTNLSQRGNSH

SEQ ID NO: 36869 - protein, 31 aa, Artificial Sequence
  Description of Artificial Sequence: Synthetic polypeptide
DCEEIRTTNPVATEQYGTSVSLNLQGGEMNK

SEQ ID NO: 36870 - protein, 32 aa, Artificial Sequence
  Description of Artificial Sequence: Synthetic polypeptide
DEHEIRTTNPVATEQYGSVSTTDGEQRGNNDR

SEQ ID NO: 36871 - protein, 31 aa, Artificial Sequence
  Description of Artificial Sequence: Synthetic polypeptide
DEEEIRTTNPVAYEQYGKTVSTGNLSQEVNR

SEQ ID NO: 36872 - protein, 30 aa, Artificial Sequence
  Description of Artificial Sequence: Synthetic polypeptide
DEHEIRTTNPVATEQYGSVSTTGDRGGNEL

SEQ ID NO: 36873 - protein, 31 aa, Artificial Sequence
  Description of Artificial Sequence: Synthetic polypeptide
DEEEIATTNPVATEQYGSVSTNLQGDGGGAI

SEQ ID NO: 36874 - protein, 32 aa, Artificial Sequence
  Description of Artificial Sequence: Synthetic polypeptide
DEEEIATTNPVATEQYGSVSTNLQGDHGNNTE

SEQ ID NO: 36875 - protein, 30 aa, Artificial Sequence
  Description of Artificial Sequence: Synthetic polypeptide
DEHEIRTTNPVATEQYGSVSTTGQGDGNAL

SEQ ID NO: 36876 - protein, 32 aa, Artificial Sequence
  Description of Artificial Sequence: Synthetic polypeptide
DEHEIRTTNPVATEQYGSVSTSNGDQRGGDVR

SEQ ID NO: 36877 - protein, 32 aa, Artificial Sequence
  Description of Artificial Sequence: Synthetic polypeptide
DEEEIATTNPVATEQYGSVSTNLQGPGGDDRR

SEQ ID NO: 36878 - protein, 32 aa, Artificial Sequence
  Description of Artificial Sequence: Synthetic polypeptide
DEEEIATTNPVATEQYGSVSTNLQGQDNGNTE

SEQ ID NO: 36879 - protein, 31 aa, Artificial Sequence
  Description of Artificial Sequence: Synthetic polypeptide
DEEEIATTNPVATEQYGSVSTNLQGQGGDAD

SEQ ID NO: 36880 - protein, 32 aa, Artificial Sequence
  Description of Artificial Sequence: Synthetic polypeptide
DEEEIRTTNPVAYEQYGISVSQNSLSQRGGER

SEQ ID NO: 36881 - protein, 32 aa, Artificial Sequence
  Description of Artificial Sequence: Synthetic polypeptide
DEEEIRTTNPVAYEQYGISVSPNDLLQRGIRR

SEQ ID NO: 36882 - protein, 32 aa, Artificial Sequence
  Description of Artificial Sequence: Synthetic polypeptide
DEEEIRTTNPVATEQYGSVISTNLVELGPNGG

SEQ ID NO: 36883 - protein, 31 aa, Artificial Sequence
  Description of Artificial Sequence: Synthetic polypeptide
DEEEIRTTNPVATEQYGSVISTNMGIEGVRP

SEQ ID NO: 36884 - protein, 30 aa, Artificial Sequence
  Description of Artificial Sequence: Synthetic polypeptide
DEHEIRTTNPVATEQYGTVSTALQGDNGNG

SEQ ID NO: 36885 - protein, 31 aa, Artificial Sequence
  Description of Artificial Sequence: Synthetic polypeptide
DEHEIRTTNPVATEQYGTVSTNLQGDGNNAS

SEQ ID NO: 36886 - protein, 30 aa, Artificial Sequence
  Description of Artificial Sequence: Synthetic polypeptide
DEHEIRTTNPVATEQYGSVVTNNDGNDGNR

SEQ ID NO: 36887 - protein, 30 aa, Artificial Sequence
  Description of Artificial Sequence: Synthetic polypeptide
DEHEIRTTNPVATEQYGTVSTNLQGGGMDM

SEQ ID NO: 36888 - protein, 31 aa, Artificial Sequence
  Description of Artificial Sequence: Synthetic polypeptide
DEHEIRTTNPVATEQYGTVSTNLQNGQNEEG

SEQ ID NO: 36889 - protein, 31 aa, Artificial Sequence
  Description of Artificial Sequence: Synthetic polypeptide
DEHEIRTTNPVATEQYGVVSTNGSQEQGGNR

SEQ ID NO: 36890 - protein, 29 aa, Artificial Sequence
  Description of Artificial Sequence: Synthetic peptide
DCEEIRATNPVATEQYGSCSTNMQSGNNE

SEQ ID NO: 36891 - protein, 31 aa, Artificial Sequence
  Description of Artificial Sequence: Synthetic polypeptide
DEHEIRTTNPVATEQYGVVSTNLQDGQGNPN

SEQ ID NO: 36892 - protein, 31 aa, Artificial Sequence
  Description of Artificial Sequence: Synthetic polypeptide
DEHEIRTTNPVATEQYGVVSTNLQGEQGNAN

SEQ ID NO: 36893 - protein, 31 aa, Artificial Sequence
  Description of Artificial Sequence: Synthetic polypeptide
DEHEIRTTNPVATEQYGVVSTNLQGNDGNPN

SEQ ID NO: 36894 - protein, 31 aa, Artificial Sequence
  Description of Artificial Sequence: Synthetic polypeptide
DEEEIRTTNPVAYEQYGGTVSTNWSSQRPNR

SEQ ID NO: 36895 - protein, 32 aa, Artificial Sequence
  Description of Artificial Sequence: Synthetic polypeptide
DEHEIRTTNPVATEQYGSVVSTNTDQGDGDNR

SEQ ID NO: 36896 - protein, 32 aa, Artificial Sequence
  Description of Artificial Sequence: Synthetic polypeptide
DEEEIATTNPVATEQYGSVSTNLQHNGGGDVR

SEQ ID NO: 36897 - protein, 32 aa, Artificial Sequence
  Description of Artificial Sequence: Synthetic polypeptide
DEHEIRTTNPVATEQYGSVVSTNLGDEGNNRD

SEQ ID NO: 36898 - protein, 30 aa, Artificial Sequence
  Description of Artificial Sequence: Synthetic polypeptide
DCEEIRSTNPVATEQYGSVSTNLVAENGQR

SEQ ID NO: 36899 - protein, 31 aa, Artificial Sequence
  Description of Artificial Sequence: Synthetic polypeptide
DCEEIRSTNPVATEQYGSVSTNLQAENGGQR

SEQ ID NO: 36900 - protein, 30 aa, Artificial Sequence
  Description of Artificial Sequence: Synthetic polypeptide
DCEEIRSTNPVATEQYGSVSSTNMQDGNNN

SEQ ID NO: 36901 - protein, 30 aa, Artificial Sequence
  Description of Artificial Sequence: Synthetic polypeptide
DCEEIRSTNPVATEQYGSISTNQSQRGGNN

SEQ ID NO: 36902 - protein, 31 aa, Artificial Sequence
  Description of Artificial Sequence: Synthetic polypeptide
DEHEIRTTNPVATEQYGSVSTTQQGDGNNDR

SEQ ID NO: 36903 - protein, 31 aa, Artificial Sequence
  Description of Artificial Sequence: Synthetic polypeptide
DEHEIRTTNPVATEQYGSVSTTQQRGGDNDQ

SEQ ID NO: 36904 - protein, 31 aa, Artificial Sequence
  Description of Artificial Sequence: Synthetic polypeptide
DEHEIRTTNPVATEQYGSVSTVLQGGGDNNQ

SEQ ID NO: 36905 - protein, 29 aa, Artificial Sequence
  Description of Artificial Sequence: Synthetic peptide
DEHEIRTTNPVATEQYGSVSWNDDHNMNR

SEQ ID NO: 36906 - protein, 30 aa, Artificial Sequence
  Description of Artificial Sequence: Synthetic polypeptide
DEHEIRTTNPVATEQYGSVSWNLDDMNMNR

SEQ ID NO: 36907 - protein, 29 aa, Artificial Sequence
  Description of Artificial Sequence: Synthetic peptide
DEHEIRTTNPVATEQYGSVSWYLFRNSNQ

SEQ ID NO: 36908 - protein, 32 aa, Artificial Sequence
  Description of Artificial Sequence: Synthetic polypeptide
DEHEIRTTNPVATEQYGSVVSQNLSDRVGNNR

SEQ ID NO: 36909 - protein, 30 aa, Artificial Sequence
  Description of Artificial Sequence: Synthetic polypeptide
DCEEIRCTNPVATEQYGSSSTMNQQRSGNN

SEQ ID NO: 36910 - protein, 32 aa, Artificial Sequence
  Description of Artificial Sequence: Synthetic polypeptide
DEHEIRTTNPVATEQYGSVVSTNGDGQTDGNR

SEQ ID NO: 36911 - protein, 33 aa, Artificial Sequence
  Description of Artificial Sequence: Synthetic polypeptide
DEEEIRTTNPVAYEQYGISVSTGNLSQSGGNRW

SEQ ID NO: 36912 - protein, 33 aa, Artificial Sequence
  Description of Artificial Sequence: Synthetic polypeptide
DEEEIRTTNPVAYEQYGISVSSTNDLLQRGIER

SEQ ID NO: 36913 - protein, 33 aa, Artificial Sequence
  Description of Artificial Sequence: Synthetic polypeptide
DEHEIRTTNPVATEPYGSVSTTNLGQGDRGNER

SEQ ID NO: 36914 - protein, 33 aa, Artificial Sequence
  Description of Artificial Sequence: Synthetic polypeptide
DEEEIRTTNPVAYEQYGQSVSITNDLLQRGIFR

SEQ ID NO: 36915 - protein, 31 aa, Artificial Sequence
  Description of Artificial Sequence: Synthetic polypeptide
DEEEIRTTNPVATEQYGSVISTDAQRGDQVL

SEQ ID NO: 36916 - protein, 33 aa, Artificial Sequence
  Description of Artificial Sequence: Synthetic polypeptide
DEEEIATTNPVATEQYGSVSTGNLSQAGGNNRK

SEQ ID NO: 36917 - protein, 30 aa, Artificial Sequence
  Description of Artificial Sequence: Synthetic polypeptide
DEGEIRTTNPVAYEQYGVVSTRLSQRPGND

SEQ ID NO: 36918 - protein, 28 aa, Artificial Sequence
  Description of Artificial Sequence: Synthetic peptide
DEGEISTTNPVAYEPYGSVATNLQVGND

SEQ ID NO: 36919 - protein, 29 aa, Artificial Sequence
  Description of Artificial Sequence: Synthetic peptide
DEGEIYTTNPVATEQYGSVSTDLNGGNET

SEQ ID NO: 36920 - protein, 29 aa, Artificial Sequence
  Description of Artificial Sequence: Synthetic peptide
DEGEIYTTNPVATEQYGSVSTDNGNGGNT

SEQ ID NO: 36921 - protein, 29 aa, Artificial Sequence
  Description of Artificial Sequence: Synthetic peptide
DEGEIYTTNPVATEQYGSVSTNDNGGGNT

SEQ ID NO: 36922 - protein, 29 aa, Artificial Sequence
  Description of Artificial Sequence: Synthetic peptide
DEGMIRTTNPVATEQYGSASTNLEINGNV

SEQ ID NO: 36923 - protein, 30 aa, Artificial Sequence
  Description of Artificial Sequence: Synthetic polypeptide
DEGEIRTTNPVAYEQYGSVPTALSTRVGNR

SEQ ID NO: 36924 - protein, 31 aa, Artificial Sequence
  Description of Artificial Sequence: Synthetic polypeptide
DEEEIRTTNPVATEQYGSVCSTNLQYLSEAS

SEQ ID NO: 36925 - protein, 32 aa, Artificial Sequence
  Description of Artificial Sequence: Synthetic polypeptide
DEEEIRTTNPVATEQYGSVCSTNLQYFNSNIM

SEQ ID NO: 36926 - protein, 29 aa, Artificial Sequence
  Description of Artificial Sequence: Synthetic peptide
DEGTIGTTNPVATEQYGSYSTNLDIGGNR

SEQ ID NO: 36927 - protein, 30 aa, Artificial Sequence
  Description of Artificial Sequence: Synthetic polypeptide
DEGTIRTTNPVATEQYGSTSETNLVIGTNR

SEQ ID NO: 36928 - protein, 31 aa, Artificial Sequence
  Description of Artificial Sequence: Synthetic polypeptide
DEEEIATTNPVATEQYGCVATNLQRGENESP

SEQ ID NO: 36929 - protein, 30 aa, Artificial Sequence
  Description of Artificial Sequence: Synthetic polypeptide
DEGTIRTTNPVATEQYGSVTSTNLIIGEDR

SEQ ID NO: 36930 - protein, 30 aa, Artificial Sequence
  Description of Artificial Sequence: Synthetic polypeptide
DEEEIATTNPVATEQYGCVATNLQNGENDS

SEQ ID NO: 36931 - protein, 31 aa, Artificial Sequence
  Description of Artificial Sequence: Synthetic polypeptide
DEEEIRTTNPVATEQYGSVCSTNLQYLSDQD

SEQ ID NO: 36932 - protein, 28 aa, Artificial Sequence
  Description of Artificial Sequence: Synthetic peptide
DEGTIRTTNPVATEQYGSYSGNLIGGNG

SEQ ID NO: 36933 - protein, 31 aa, Artificial Sequence
  Description of Artificial Sequence: Synthetic polypeptide
DDEEIRCTNPVATEQYGSVSTNLQARSGQQG

SEQ ID NO: 36934 - protein, 29 aa, Artificial Sequence
  Description of Artificial Sequence: Synthetic peptide
DEGEIRTTNPVAYEQYGSVATALSIRPNR

SEQ ID NO: 36935 - protein, 30 aa, Artificial Sequence
  Description of Artificial Sequence: Synthetic polypeptide
DDEEIRSTNPVATEQYGSSSTNAQQRGVNN

SEQ ID NO: 36936 - protein, 32 aa, Artificial Sequence
  Description of Artificial Sequence: Synthetic polypeptide
DEEEIRTTNPVAYEQYGQSVSQNDLLQRGMGR

SEQ ID NO: 36937 - protein, 32 aa, Artificial Sequence
  Description of Artificial Sequence: Synthetic polypeptide
DEEEIRTTNPVAYEQYGQSVSQNDLLQRGEKR

SEQ ID NO: 36938 - protein, 29 aa, Artificial Sequence
  Description of Artificial Sequence: Synthetic peptide
DDEEIRSTNPVATEQYGSSCSTNDQNGNN

SEQ ID NO: 36939 - protein, 33 aa, Artificial Sequence
  Description of Artificial Sequence: Synthetic polypeptide
DEGEIRTTNPVATEQYGSVVSCTNLSQDGGNER

SEQ ID NO: 36940 - protein, 31 aa, Artificial Sequence
  Description of Artificial Sequence: Synthetic polypeptide
DEEEIATTNPVATEQYGSVSCTNLSGPGGDR

SEQ ID NO: 36941 - protein, 32 aa, Artificial Sequence
  Description of Artificial Sequence: Synthetic polypeptide
DEGEIRTTNPVAYEQYGSVPSCTNLSQTGNER

SEQ ID NO: 36942 - protein, 32 aa, Artificial Sequence
  Description of Artificial Sequence: Synthetic polypeptide
DEEEIATTNPVATEQYGSVSCTNLSQDTGGND

SEQ ID NO: 36943 - protein, 31 aa, Artificial Sequence
  Description of Artificial Sequence: Synthetic polypeptide
DEGEIRTTNPVATEQYGVTVSTYLSQRPGND

SEQ ID NO: 36944 - protein, 31 aa, Artificial Sequence
  Description of Artificial Sequence: Synthetic polypeptide
DEGEIRTTNPVATEQYGYTISTNELQRGNDE

SEQ ID NO: 36945 - protein, 30 aa, Artificial Sequence
  Description of Artificial Sequence: Synthetic polypeptide
DEEEIATTNPVATEQYGSVSDNLQDSEGEL

SEQ ID NO: 36946 - protein, 32 aa, Artificial Sequence
  Description of Artificial Sequence: Synthetic polypeptide
DEEEIRTTNPVATEQYGSVCSTNNHQFGSNFV

SEQ ID NO: 36947 - protein, 29 aa, Artificial Sequence
  Description of Artificial Sequence: Synthetic peptide
DEEEIATTNPVATEQYGSVSENLEDHGEL

SEQ ID NO: 36948 - protein, 31 aa, Artificial Sequence
  Description of Artificial Sequence: Synthetic polypeptide
DEEEIRTTNPVATEQYGSVCSTNLVRMQVEE

SEQ ID NO: 36949 - protein, 32 aa, Artificial Sequence
  Description of Artificial Sequence: Synthetic polypeptide
DEEEIRTTNPVATEQYGSVISPTLDQRGNDVL

SEQ ID NO: 36950 - protein, 31 aa, Artificial Sequence
  Description of Artificial Sequence: Synthetic polypeptide
DDEEIRSTNPVATEQYGSVDTTNLQARNGQR

SEQ ID NO: 36951 - protein, 29 aa, Artificial Sequence
  Description of Artificial Sequence: Synthetic peptide
DEGTIRTTNPVATEQYGSYSTNLIGGNDD

SEQ ID NO: 36952 - protein, 29 aa, Artificial Sequence
  Description of Artificial Sequence: Synthetic peptide
DEGVIATTNPVATEQWGSVSTDGLQRGNQ

SEQ ID NO: 36953 - protein, 33 aa, Artificial Sequence
  Description of Artificial Sequence: Synthetic polypeptide
DEEEIRTTNPVATEQYGSVCSTNLQSMGSNNQT

SEQ ID NO: 36954 - protein, 30 aa, Artificial Sequence
  Description of Artificial Sequence: Synthetic polypeptide
DDEEIRATNPVATEQYGSVSSTNMDDRGNN

SEQ ID NO: 36955 - protein, 31 aa, Artificial Sequence
  Description of Artificial Sequence: Synthetic polypeptide
DDEEIRATNPVATEQYGSVSITNMQRGDNND

SEQ ID NO: 36956 - protein, 32 aa, Artificial Sequence
  Description of Artificial Sequence: Synthetic polypeptide
DDEEIRATNPVATEQYGSVSGTNLQARNGQGR

SEQ ID NO: 36957 - protein, 29 aa, Artificial Sequence
  Description of Artificial Sequence: Synthetic peptide
DEHEIATTNPTATEQYGSVSTNQNSGQNR

SEQ ID NO: 36958 - protein, 33 aa, Artificial Sequence
  Description of Artificial Sequence: Synthetic polypeptide
DEEEIRTTNPVATEQYGSVCSTNLQRVGETEHI

SEQ ID NO: 36959 - protein, 31 aa, Artificial Sequence
  Description of Artificial Sequence: Synthetic polypeptide
DDEEIRATNPVATEQYGSVSTNLQARNGQQT

SEQ ID NO: 36960 - protein, 33 aa, Artificial Sequence
  Description of Artificial Sequence: Synthetic polypeptide
DEEEIRTTNPVATEQYGSVISPTNDIQPRLNRD

SEQ ID NO: 36961 - protein, 29 aa, Artificial Sequence
  Description of Artificial Sequence: Synthetic peptide
DEHEIATTNPVATDQYGSVGTEGLQRGND

SEQ ID NO: 36962 - protein, 28 aa, Artificial Sequence
  Description of Artificial Sequence: Synthetic peptide
DEEEIATTNPVATEQYGCVATNLDRTTE

SEQ ID NO: 36963 - protein, 30 aa, Artificial Sequence
  Description of Artificial Sequence: Synthetic polypeptide
DEHEIATTNPVATECYGSVSTNLQGDGNSG

SEQ ID NO: 36964 - protein, 30 aa, Artificial Sequence
  Description of Artificial Sequence: Synthetic polypeptide
DEHEIATTNPVATEHYGSVSTNLQMDGNND

SEQ ID NO: 36965 - protein, 30 aa, Artificial Sequence
  Description of Artificial Sequence: Synthetic polypeptide
DEHEIATTNPVATEHYGSVSTNLQQGNEGM

SEQ ID NO: 36966 - protein, 30 aa, Artificial Sequence
  Description of Artificial Sequence: Synthetic polypeptide
DEHEIATTNPVATEHYGSVSTNLQQGNESM

SEQ ID NO: 36967 - protein, 29 aa, Artificial Sequence
  Description of Artificial Sequence: Synthetic peptide
DEHEIATTNPVATDQYGSVATALQRGDND

SEQ ID NO: 36968 - protein, 32 aa, Artificial Sequence
  Description of Artificial Sequence: Synthetic polypeptide
DEEEIRTTNPVATEQYGSVCSTNLQSSTSNQP

SEQ ID NO: 36969 - protein, 31 aa, Artificial Sequence
  Description of Artificial Sequence: Synthetic polypeptide
DEEEIATTNPVATEQYGSVSNTNGGQHGGNG

SEQ ID NO: 36970 - protein, 30 aa, Artificial Sequence
  Description of Artificial Sequence: Synthetic polypeptide
DEGVIRTTNPVATEQYGSISTNLIIGGNNR

SEQ ID NO: 36971 - protein, 32 aa, Artificial Sequence
  Description of Artificial Sequence: Synthetic polypeptide
DEEEIRTTNPVAYEQYGQSVSQNDLEQRGSVR

SEQ ID NO: 36972 - protein, 33 aa, Artificial Sequence
  Description of Artificial Sequence: Synthetic polypeptide
DEEEIATTNPVATEQYGSVSITNALSQEGGDNR

SEQ ID NO: 36973 - protein, 29 aa, Artificial Sequence
  Description of Artificial Sequence: Synthetic peptide
DEGVIATTNPVATEQYGSASTNLIHGNDR

SEQ ID NO: 36974 - protein, 29 aa, Artificial Sequence
  Description of Artificial Sequence: Synthetic peptide
DEGVIATTNPVATEQYGSCSTNGLIIGNR

SEQ ID NO: 36975 - protein, 29 aa, Artificial Sequence
  Description of Artificial Sequence: Synthetic peptide
DEGVIATTNPVATEQYGSCSTNLADEGNR

SEQ ID NO: 36976 - protein, 32 aa, Artificial Sequence
  Description of Artificial Sequence: Synthetic polypeptide
DEEEIRTTNPVAYEQYGQSVSQNDLDQRGMIR

SEQ ID NO: 36977 - protein, 30 aa, Artificial Sequence
  Description of Artificial Sequence: Synthetic polypeptide
DEGVIRTTNPVATEQYGSISTNLSTIGGNR

SEQ ID NO: 36978 - protein, 32 aa, Artificial Sequence
  Description of Artificial Sequence: Synthetic polypeptide
DEEEIRTTNPVAYEQYGQSVSQNDLDQRGERR

SEQ ID NO: 36979 - protein, 29 aa, Artificial Sequence
  Description of Artificial Sequence: Synthetic peptide
DEGVIATTNPVATEQYGSFSTNLIDQGNR

SEQ ID NO: 36980 - protein, 32 aa, Artificial Sequence
  Description of Artificial Sequence: Synthetic polypeptide
DEEEIRTTNPVAYEQYGQSVSQNDLDQRGDRR

SEQ ID NO: 36981 - protein, 31 aa, Artificial Sequence
  Description of Artificial Sequence: Synthetic polypeptide
DEEEIATTNPVATEQYGSVSNNLQGDGGTDR

SEQ ID NO: 36982 - protein, 29 aa, Artificial Sequence
  Description of Artificial Sequence: Synthetic peptide
DEGVIRTTNPVATEQYGCVATNPQRGDND

SEQ ID NO: 36983 - protein, 29 aa, Artificial Sequence
  Description of Artificial Sequence: Synthetic peptide
DEGVIRTTNPVATEQYGCVATNPQRGNEQ

SEQ ID NO: 36984 - protein, 29 aa, Artificial Sequence
  Description of Artificial Sequence: Synthetic peptide
DEGVIRTTNPVATEQYGSCSTNLIDIDNR

SEQ ID NO: 36985 - protein, 30 aa, Artificial Sequence
  Description of Artificial Sequence: Synthetic polypeptide
DEEEIATTNPVATEQYGSVSMMGQRGENTL

SEQ ID NO: 36986 - protein, 31 aa, Artificial Sequence
  Description of Artificial Sequence: Synthetic polypeptide
DEEEIRTTNPVATEQYGSVISPTELQREQEH

SEQ ID NO: 36987 - protein, 34 aa, Artificial Sequence
  Description of Artificial Sequence: Synthetic polypeptide
DEEEIRTTNPVATEQYGSVCSTNNLQEFFGSNRA

SEQ ID NO: 36988 - protein, 32 aa, Artificial Sequence
  Description of Artificial Sequence: Synthetic polypeptide
DEEEIRTTNPVAYEQYGQSVSQNDLTQRGIIR

SEQ ID NO: 36989 - protein, 30 aa, Artificial Sequence
  Description of Artificial Sequence: Synthetic polypeptide
DEEEIATTNPVATEQYGSVSADNLESEGNQ

SEQ ID NO: 36990 - protein, 31 aa, Artificial Sequence
  Description of Artificial Sequence: Synthetic polypeptide
DEEEIRTTNPVATEQYGSVCSTNTDGGSNQT

SEQ ID NO: 36991 - protein, 31 aa, Artificial Sequence
  Description of Artificial Sequence: Synthetic polypeptide
DEGEIRTTNPVATEQYGSVAATNLQRAEPRD

SEQ ID NO: 36992 - protein, 31 aa, Artificial Sequence
  Description of Artificial Sequence: Synthetic polypeptide
DEGEIRTTNPVATEQYGSVATAELSGRVGNR

SEQ ID NO: 36993 - protein, 28 aa, Artificial Sequence
  Description of Artificial Sequence: Synthetic peptide
DEGEIRTTNPVATEQYGSVATALAPMNM

SEQ ID NO: 36994 - protein, 29 aa, Artificial Sequence
  Description of Artificial Sequence: Synthetic peptide
DEGEIRTTNPVATEQYGSVATALMRMNDM

SEQ ID NO: 36995 - protein, 31 aa, Artificial Sequence
  Description of Artificial Sequence: Synthetic polypeptide
DEEEIRTTNPVATEQYGSVCSTNTTGNSNRL

SEQ ID NO: 36996 - protein, 30 aa, Artificial Sequence
  Description of Artificial Sequence: Synthetic polypeptide
DEGEIRTTNPVATEQYGSVATALSIRVTNR

SEQ ID NO: 36997 - protein, 30 aa, Artificial Sequence
  Description of Artificial Sequence: Synthetic polypeptide
DEGEIRTTNPVATEQYGSVATALSTRVNNR

SEQ ID NO: 36998 - protein, 30 aa, Artificial Sequence
  Description of Artificial Sequence: Synthetic polypeptide
DDEEIRTTNPVATDQYGSVSTNGVTNGNER

SEQ ID NO: 36999 - protein, 30 aa, Artificial Sequence
  Description of Artificial Sequence: Synthetic polypeptide
DEGEIRTTNPVATEQYGSVCQTDLIREMNR

SEQ ID NO: 37000 - protein, 33 aa, Artificial Sequence
  Description of Artificial Sequence: Synthetic polypeptide
DEEEIRTTNPVAYEQYGQSVSQTNDLEQRGGQR

SEQ ID NO: 37001 - protein, 33 aa, Artificial Sequence
  Description of Artificial Sequence: Synthetic polypeptide
DEEEIRTTNPVAYEQYGQSVSQTNDLDQRGMIR

SEQ ID NO: 37002 - protein, 32 aa, Artificial Sequence
  Description of Artificial Sequence: Synthetic polypeptide
DEEEIRTTNPVAYEQYGQSVSQTELSQRGGPR

SEQ ID NO: 37003 - protein, 30 aa, Artificial Sequence
  Description of Artificial Sequence: Synthetic polypeptide
DEGEIRTTNPVATEQYGSVATALSREMNRQ

SEQ ID NO: 37004 - protein, 30 aa, Artificial Sequence
  Description of Artificial Sequence: Synthetic polypeptide
DDEEIRTTNPVATDQYGSVSTNGTQNGNDT

SEQ ID NO: 37005 - protein, 33 aa, Artificial Sequence
  Description of Artificial Sequence: Synthetic polypeptide
DEEEIRTTNPVAYEQYGQSVSQTNDLLQRGHER

SEQ ID NO: 37006 - protein, 30 aa, Artificial Sequence
  Description of Artificial Sequence: Synthetic polypeptide
DEEEIATTNPVATEQYGSVPTNLQEDDNVQ

SEQ ID NO: 37007 - protein, 29 aa, Artificial Sequence
  Description of Artificial Sequence: Synthetic peptide
DEGEIRTTNGVAYCQYGSVCSTNLQGGGR

SEQ ID NO: 37008 - protein, 31 aa, Artificial Sequence
  Description of Artificial Sequence: Synthetic polypeptide
DEEEIATTNPVATEQYGSVMSTNDQQERGEA

SEQ ID NO: 37009 - protein, 33 aa, Artificial Sequence
  Description of Artificial Sequence: Synthetic polypeptide
DEEEIRTTNPVAYEQYGQSVSQTNDLNQRGIGR

SEQ ID NO: 37010 - protein, 31 aa, Artificial Sequence
  Description of Artificial Sequence: Synthetic polypeptide
DEEEIRTTNPVATEQYGSVCSTPLQNFGDQA

SEQ ID NO: 37011 - protein, 31 aa, Artificial Sequence
  Description of Artificial Sequence: Synthetic polypeptide
DEEEIRTTNPVATEQYGSVCSTPLQFFFNDP

SEQ ID NO: 37012 - protein, 30 aa, Artificial Sequence
  Description of Artificial Sequence: Synthetic polypeptide
DEGEIRTTNPVATDQYGSVNTQLQRGGNND

SEQ ID NO: 37013 - protein, 31 aa, Artificial Sequence
  Description of Artificial Sequence: Synthetic polypeptide
DEEEIATTNPVATEQYGSVPTPLQTRGGNSE

SEQ ID NO: 37014 - protein, 30 aa, Artificial Sequence
  Description of Artificial Sequence: Synthetic polypeptide
DEGEIRTTNPVATDQYGSVNTQLSQRVGND

SEQ ID NO: 37015 - protein, 30 aa, Artificial Sequence
  Description of Artificial Sequence: Synthetic polypeptide
DEEEIRTTNPVATEQYGSVCSTPLENFGDQ

SEQ ID NO: 37016 - protein, 32 aa, Artificial Sequence
  Description of Artificial Sequence: Synthetic polypeptide
DEEEIRTTNPVATEQYGSVCSTPLEERELNRF

SEQ ID NO: 37017 - protein, 33 aa, Artificial Sequence
  Description of Artificial Sequence: Synthetic polypeptide
DEEEIRTTNPVATEQYGSVCSTPELNQRFGSNA

SEQ ID NO: 37018 - protein, 30 aa, Artificial Sequence
  Description of Artificial Sequence: Synthetic polypeptide
DEGEIRTTNPVATEQWGYTISTNEGQRGNR

SEQ ID NO: 37019 - protein, 29 aa, Artificial Sequence
  Description of Artificial Sequence: Synthetic peptide
DEGEIRTTNPVATEQYGCTATNLQRGDSL

SEQ ID NO: 37020 - protein, 32 aa, Artificial Sequence
  Description of Artificial Sequence: Synthetic polypeptide
DEEEIATTNPVATEQYGSVPSCTGNLQRGGDE

SEQ ID NO: 37021 - protein, 31 aa, Artificial Sequence
  Description of Artificial Sequence: Synthetic polypeptide
DEVEICTTNPVATEQYGSVSTNNQRGGNDDM

SEQ ID NO: 37022 - protein, 30 aa, Artificial Sequence
  Description of Artificial Sequence: Synthetic polypeptide
DDEEIRTTNPVATDQYGSVSTNGQQGGNQG

SEQ ID NO: 37023 - protein, 30 aa, Artificial Sequence
  Description of Artificial Sequence: Synthetic polypeptide
DDEEIRTTNPVATDQYGSVSTNGNQNGNHG

SEQ ID NO: 37024 - protein, 31 aa, Artificial Sequence
  Description of Artificial Sequence: Synthetic polypeptide
DDEEIRTTNPVATDQYGSVSTNGNEQNGNTR

SEQ ID NO: 37025 - protein, 32 aa, Artificial Sequence
  Description of Artificial Sequence: Synthetic polypeptide
DEEEIRTTNPVAYEQYGQSVSQNGLDQRGGDR

SEQ ID NO: 37026 - protein, 31 aa, Artificial Sequence
  Description of Artificial Sequence: Synthetic polypeptide
DEGEIRTTNPVATEQYGSVSTNDEQNTGEDR

SEQ ID NO: 37027 - protein, 32 aa, Artificial Sequence
  Description of Artificial Sequence: Synthetic polypeptide
DEEEIRTTNPVATEQYGSVCSTNNLQYNSNQM

SEQ ID NO: 37028 - protein, 31 aa, Artificial Sequence
  Description of Artificial Sequence: Synthetic polypeptide
DDEEIRSTNPVATEQYGSVYSTELQERGNTD

SEQ ID NO: 37029 - protein, 32 aa, Artificial Sequence
  Description of Artificial Sequence: Synthetic polypeptide
DDEEIRSTNPVATEQYGSVSTTNLQARNGEQR

SEQ ID NO: 37030 - protein, 32 aa, Artificial Sequence
  Description of Artificial Sequence: Synthetic polypeptide
DEEEIRTTNPVAYEQYGQSVSQNDQLQRGIER

SEQ ID NO: 37031 - protein, 32 aa, Artificial Sequence
  Description of Artificial Sequence: Synthetic polypeptide
DEEEIRTTNPVAYEQYGQSVSQNMLPQRGGSR

SEQ ID NO: 37032 - protein, 31 aa, Artificial Sequence
  Description of Artificial Sequence: Synthetic polypeptide
DDEEIRSTNPVATEQYGSVSTNVQARNGLRI

SEQ ID NO: 37033 - protein, 31 aa, Artificial Sequence
  Description of Artificial Sequence: Synthetic polypeptide
DDEEIRSTNPVATEQYGSVSTNLQAQNGQRI

SEQ ID NO: 37034 - protein, 31 aa, Artificial Sequence
  Description of Artificial Sequence: Synthetic polypeptide
DDEEIRSTNPVATEQYGSVSTELQERSGQRG

SEQ ID NO: 37035 - protein, 30 aa, Artificial Sequence
  Description of Artificial Sequence: Synthetic polypeptide
DEGEIRTTNPVATEQYGSVSTNSLDEQANL

SEQ ID NO: 37036 - protein, 31 aa, Artificial Sequence
  Description of Artificial Sequence: Synthetic polypeptide
DDEEIRSTNPVATEQYGSVSSTNNMQDRGNN

SEQ ID NO: 37037 - protein, 30 aa, Artificial Sequence
  Description of Artificial Sequence: Synthetic polypeptide
DDEEIRSTNPVATEQYGSVSSTNMNRGNNG

SEQ ID NO: 37038 - protein, 30 aa, Artificial Sequence
  Description of Artificial Sequence: Synthetic polypeptide
DDEEIRSTNPVATEQYGSVSSTNMGQRGDN

SEQ ID NO: 37039 - protein, 32 aa, Artificial Sequence
  Description of Artificial Sequence: Synthetic polypeptide
DDEEIRSTNPVATEQYGSVSTNLQARNGEQNE

SEQ ID NO: 37040 - protein, 31 aa, Artificial Sequence
  Description of Artificial Sequence: Synthetic polypeptide
DEEEIRTTNPVATEQYGSVCSTNPANGSNTQ

SEQ ID NO: 37041 - protein, 31 aa, Artificial Sequence
  Description of Artificial Sequence: Synthetic polypeptide
DEEEIRTTNPVATEQYGSVCSTNPLINGEIQ

SEQ ID NO: 37042 - protein, 32 aa, Artificial Sequence
  Description of Artificial Sequence: Synthetic polypeptide
DEEEIRTTNPVATEQYGSVCSTNPLQDGPADE

SEQ ID NO: 37043 - protein, 29 aa, Artificial Sequence
  Description of Artificial Sequence: Synthetic peptide
DEGEIRTTNPVATEQYGSVETDLIRMQRD

SEQ ID NO: 37044 - protein, 32 aa, Artificial Sequence
  Description of Artificial Sequence: Synthetic polypeptide
DEEEIRTTNPVATEQYGSVCSTNPQNFGSQNQ

SEQ ID NO: 37045 - protein, 33 aa, Artificial Sequence
  Description of Artificial Sequence: Synthetic polypeptide
DEEEIRTTNPVATEQYGSVISPLHDLQREGENR

SEQ ID NO: 37046 - protein, 31 aa, Artificial Sequence
  Description of Artificial Sequence: Synthetic polypeptide
DEEEIATTNPVATEQYGSVSATDLEDHEGNR

SEQ ID NO: 37047 - protein, 30 aa, Artificial Sequence
  Description of Artificial Sequence: Synthetic polypeptide
DEGEIRTTNPVATEQYGSVPTALIREMENR

SEQ ID NO: 37048 - protein, 33 aa, Artificial Sequence
  Description of Artificial Sequence: Synthetic polypeptide
DEEEIRTTNPVATEQYGSVCSTNPQERLGSNQA

SEQ ID NO: 37049 - protein, 29 aa, Artificial Sequence
  Description of Artificial Sequence: Synthetic peptide
DEGEIRTTNPVATEQYGSVQTALEFFENR

SEQ ID NO: 37050 - protein, 31 aa, Artificial Sequence
  Description of Artificial Sequence: Synthetic polypeptide
DEEEIRTTNPVATEQYGSVCSTNPQENGSQQ

SEQ ID NO: 37051 - protein, 29 aa, Artificial Sequence
  Description of Artificial Sequence: Synthetic peptide
DEGEIRTTNPVATEQYGSVQTALIGENHR

SEQ ID NO: 37052 - protein, 29 aa, Artificial Sequence
  Description of Artificial Sequence: Synthetic peptide
DEGEIRTTNPVATEQYGSVQTALIHMNRY

SEQ ID NO: 37053 - protein, 28 aa, Artificial Sequence
  Description of Artificial Sequence: Synthetic peptide
DEGEIRTTNPVATEQYGSVQTALISENS

SEQ ID NO: 37054 - protein, 33 aa, Artificial Sequence
  Description of Artificial Sequence: Synthetic polypeptide
DEEEIATTNPVATEQYGSVSATNPLQARMGNEL

SEQ ID NO: 37055 - protein, 32 aa, Artificial Sequence
  Description of Artificial Sequence: Synthetic polypeptide
DEEEIRTTNPVAYEQYGQSVSQNNLSQRGETR

SEQ ID NO: 37056 - protein, 33 aa, Artificial Sequence
  Description of Artificial Sequence: Synthetic polypeptide
DEGEIRTTNPVATEQYGSVSCTNLTGIRTGGNR

SEQ ID NO: 37057 - protein, 32 aa, Artificial Sequence
  Description of Artificial Sequence: Synthetic polypeptide
DEGEIRTTNPVATEQYGSVSNTLNLQEGNNDE

SEQ ID NO: 37058 - protein, 30 aa, Artificial Sequence
  Description of Artificial Sequence: Synthetic polypeptide
DEEEIATTNPVATEQYGSVSSTDDYQEGNP

SEQ ID NO: 37059 - protein, 30 aa, Artificial Sequence
  Description of Artificial Sequence: Synthetic polypeptide
DEEEIATTNPVATEQWGSVSTEGLDRGNPE

SEQ ID NO: 37060 - protein, 30 aa, Artificial Sequence
  Description of Artificial Sequence: Synthetic polypeptide
DEHEIATTNPVATEQYGCVSTNLQPMGDER

SEQ ID NO: 37061 - protein, 30 aa, Artificial Sequence
  Description of Artificial Sequence: Synthetic polypeptide
DEHEIATTNPVATEQYGSVAATNLQRAEPR

SEQ ID NO: 37062 - protein, 30 aa, Artificial Sequence
  Description of Artificial Sequence: Synthetic polypeptide
DEHEIRTTNPVATEAWGSVSTNLQPGGNTS

SEQ ID NO: 37063 - protein, 33 aa, Artificial Sequence
  Description of Artificial Sequence: Synthetic polypeptide
DEHEIRTTNPVATEAYGSVCSCTNLSQRTGGNR

SEQ ID NO: 37064 - protein, 31 aa, Artificial Sequence
  Description of Artificial Sequence: Synthetic polypeptide
DEHEIRTTNPVATEAYGSVSTNLQDHDGGNM

SEQ ID NO: 37065 - protein, 30 aa, Artificial Sequence
  Description of Artificial Sequence: Synthetic polypeptide
DEEEIATTNPVATEQYGSVSTELQFNSNQS

SEQ ID NO: 37066 - protein, 31 aa, Artificial Sequence
  Description of Artificial Sequence: Synthetic polypeptide
DEHEIRTTNPVATEAYGSVSTNLQQGDGNMI

SEQ ID NO: 37067 - protein, 29 aa, Artificial Sequence
  Description of Artificial Sequence: Synthetic peptide
DDECIRTTNPVATEQYGKVSTNAHQRVNE

SEQ ID NO: 37068 - protein, 29 aa, Artificial Sequence
  Description of Artificial Sequence: Synthetic peptide
DDECIRTTNPVATEQYGTVSTNHQRNDNM

SEQ ID NO: 37069 - protein, 30 aa, Artificial Sequence
  Description of Artificial Sequence: Synthetic polypeptide
DEHEIRTTNPVATECYGSVSTNLQAGGDEP

SEQ ID NO: 37070 - protein, 31 aa, Artificial Sequence
  Description of Artificial Sequence: Synthetic polypeptide
DEHEIRTTNPVATECYGSVSTNLQGNMGDMR

SEQ ID NO: 37071 - protein, 31 aa, Artificial Sequence
  Description of Artificial Sequence: Synthetic polypeptide
DEHEIRTTNPVATECYGSVSTNLQHQGNNEQ

SEQ ID NO: 37072 - protein, 31 aa, Artificial Sequence
  Description of Artificial Sequence: Synthetic polypeptide
DEHEIRTTNPVATECYGSVSTNLQLGGDNGA

SEQ ID NO: 37073 - protein, 29 aa, Artificial Sequence
  Description of Artificial Sequence: Synthetic peptide
DDECIRTTNPVATEQYGEVSTNHQRDSNL

SEQ ID NO: 37074 - protein, 29 aa, Artificial Sequence
  Description of Artificial Sequence: Synthetic peptide
DDECIRTTNPVATEQYGEVSTGNNQRNNL

SEQ ID NO: 37075 - protein, 30 aa, Artificial Sequence
  Description of Artificial Sequence: Synthetic polypeptide
DEHEIRTTNPVATECYGSVSTNLQNGGDEK

SEQ ID NO: 37076 - protein, 31 aa, Artificial Sequence
  Description of Artificial Sequence: Synthetic polypeptide
DEHEIRTTNPVATECYGSVSTNLQGDGNNAQ

SEQ ID NO: 37077 - protein, 29 aa, Artificial Sequence
  Description of Artificial Sequence: Synthetic peptide
DDECIRTTNPVATEQYGCVSTNHNQRVNL

SEQ ID NO: 37078 - protein, 29 aa, Artificial Sequence
  Description of Artificial Sequence: Synthetic peptide
DDECIRTTNPVATEQYGVVSTNHQRSSNL

SEQ ID NO: 37079 - protein, 32 aa, Artificial Sequence
  Description of Artificial Sequence: Synthetic polypeptide
DEEEIATTNPVATEQYGSVSTDNPQGNEGNRD

SEQ ID NO: 37080 - protein, 28 aa, Artificial Sequence
  Description of Artificial Sequence: Synthetic peptide
DEHEIRTTNPVATDQYGSVNTEQQRVND

SEQ ID NO: 37081 - protein, 29 aa, Artificial Sequence
  Description of Artificial Sequence: Synthetic peptide
DEHEIRTTNPVATDQYGSVNTGDQRGNDM

SEQ ID NO: 37082 - protein, 29 aa, Artificial Sequence
  Description of Artificial Sequence: Synthetic peptide
DEEEIATTNPVATEQYGSVSTDLEHEGEK

SEQ ID NO: 37083 - protein, 29 aa, Artificial Sequence
  Description of Artificial Sequence: Synthetic peptide
DEEEIATTNPVATEQYGSVSTDLEHEGEL

SEQ ID NO: 37084 - protein, 29 aa, Artificial Sequence
  Description of Artificial Sequence: Synthetic peptide
DEHEIRTTNPVATDQYGSVNTQLEGRGND

SEQ ID NO: 37085 - protein, 29 aa, Artificial Sequence
  Description of Artificial Sequence: Synthetic peptide
DEHEIRTTNPVATDQYGSVNTQLQRGDFD

SEQ ID NO: 37086 - protein, 28 aa, Artificial Sequence
  Description of Artificial Sequence: Synthetic peptide
DDECIRTTNPVATEQYGVVSTNHTRVNL

SEQ ID NO: 37087 - protein, 29 aa, Artificial Sequence
  Description of Artificial Sequence: Synthetic peptide
DEHEIRTTNPVATDQYGSVNTQLQRGSID

SEQ ID NO: 37088 - protein, 29 aa, Artificial Sequence
  Description of Artificial Sequence: Synthetic peptide
DEHEIRTTNPVATDQYGSVNTQLQRSGGD

SEQ ID NO: 37089 - protein, 33 aa, Artificial Sequence
  Description of Artificial Sequence: Synthetic polypeptide
DEEEIRTTNPVAYEQYGQSVSNTNDLLQRGIER

SEQ ID NO: 37090 - protein, 29 aa, Artificial Sequence
  Description of Artificial Sequence: Synthetic peptide
DEHEIRTTNPVATDQYGSVNTQLQRTNQD

SEQ ID NO: 37091 - protein, 30 aa, Artificial Sequence
  Description of Artificial Sequence: Synthetic polypeptide
DEEEIATTNPVATEQYGSVSTDLPDGDNGI

SEQ ID NO: 37092 - protein, 29 aa, Artificial Sequence
  Description of Artificial Sequence: Synthetic peptide
DEHEIRTTNPVATDQYGSVNTVELQRTND

SEQ ID NO: 37093 - protein, 33 aa, Artificial Sequence
  Description of Artificial Sequence: Synthetic polypeptide
DEEEIRTTNPVATEQYGSVCSTNLEQAFGSNAV

SEQ ID NO: 37094 - protein, 29 aa, Artificial Sequence
  Description of Artificial Sequence: Synthetic peptide
DEEEIATTNPVATEQYGSVSTDLMDHGEL

SEQ ID NO: 37095 - protein, 29 aa, Artificial Sequence
  Description of Artificial Sequence: Synthetic peptide
DEHEIRTTNPVATDQYGSVNTDLQMGNDD

SEQ ID NO: 37096 - protein, 32 aa, Artificial Sequence
  Description of Artificial Sequence: Synthetic polypeptide
DEEEIATTNPVATEQYGSVSTENSLFQVRGEF

SEQ ID NO: 37097 - protein, 32 aa, Artificial Sequence
  Description of Artificial Sequence: Synthetic polypeptide
DEHEIRTTNPVATEEYGSVSTNLQRDGGNGDM

SEQ ID NO: 37098 - protein, 32 aa, Artificial Sequence
  Description of Artificial Sequence: Synthetic polypeptide
DEEEIRTTNPVAYEQYGQSVSLNDLLQRGFDR

SEQ ID NO: 37099 - protein, 29 aa, Artificial Sequence
  Description of Artificial Sequence: Synthetic peptide
DDECIRTTNPVATEQYGAVCSTNHQRVNL

SEQ ID NO: 37100 - protein, 30 aa, Artificial Sequence
  Description of Artificial Sequence: Synthetic polypeptide
DEHEIRTTNPVATEHYGTVSTNLQGDGNND

SEQ ID NO: 37101 - protein, 30 aa, Artificial Sequence
  Description of Artificial Sequence: Synthetic polypeptide
DEHEIRTTNPVATEIYGSVCSNNLQRDGTM

SEQ ID NO: 37102 - protein, 30 aa, Artificial Sequence
  Description of Artificial Sequence: Synthetic polypeptide
DEEEIATTNPVATEQYGSVSTGNGNQGNAD

SEQ ID NO: 37103 - protein, 32 aa, Artificial Sequence
  Description of Artificial Sequence: Synthetic polypeptide
DEEEIATTNPVATEQYGSVSTGNLDQGMGQNM

SEQ ID NO: 37104 - protein, 31 aa, Artificial Sequence
  Description of Artificial Sequence: Synthetic polypeptide
DEHEIRTTNPVATEHYGSVSTNLQNDGDNND

SEQ ID NO: 37105 - protein, 32 aa, Artificial Sequence
  Description of Artificial Sequence: Synthetic polypeptide
DEHEIRTTNPVATENYGSVSTNLQGEGGGNTR

SEQ ID NO: 37106 - protein, 30 aa, Artificial Sequence
  Description of Artificial Sequence: Synthetic polypeptide
DEHEIRTTNPVATEPYGSVCSTHMDRDGNR

SEQ ID NO: 37107 - protein, 33 aa, Artificial Sequence
  Description of Artificial Sequence: Synthetic polypeptide
DEEEIRTTNPVATEQYGSVISTCNGLQIGDNTV

SEQ ID NO: 37108 - protein, 32 aa, Artificial Sequence
  Description of Artificial Sequence: Synthetic polypeptide
DEHEIRTTNPVATEPYGSVFSTGNDLQNGNER

SEQ ID NO: 37109 - protein, 32 aa, Artificial Sequence
  Description of Artificial Sequence: Synthetic polypeptide
DEHEIRTTNPVATEPYGSVSTNLQGDLGNGGR

SEQ ID NO: 37110 - protein, 31 aa, Artificial Sequence
  Description of Artificial Sequence: Synthetic polypeptide
DEHEIRTTNPVATEPYGSVSTNLQPGGNNAQ

SEQ ID NO: 37111 - protein, 31 aa, Artificial Sequence
  Description of Artificial Sequence: Synthetic polypeptide
DEHEIRTTNPVATEPYGSVSTTNLGDDGNER

SEQ ID NO: 37112 - protein, 31 aa, Artificial Sequence
  Description of Artificial Sequence: Synthetic polypeptide
DEHEIRTTNPVATEPWGSVSTNLQLGEDNER

SEQ ID NO: 37113 - protein, 31 aa, Artificial Sequence
  Description of Artificial Sequence: Synthetic polypeptide
DEHEIRTTNPVATECYGSVTTNLQGNGNDER

SEQ ID NO: 37114 - protein, 31 aa, Artificial Sequence
  Description of Artificial Sequence: Synthetic polypeptide
DEHEIRTTNPVATEHYGSVSTNLQGNDGNNN

SEQ ID NO: 37115 - protein, 32 aa, Artificial Sequence
  Description of Artificial Sequence: Synthetic polypeptide
DEHEIRTTNPVATEHYGSVSTNLQGDRGGNND

SEQ ID NO: 37116 - protein, 33 aa, Artificial Sequence
  Description of Artificial Sequence: Synthetic polypeptide
DEEEIRTTNPVATEQYGSVISSTNLQIVGENNG

SEQ ID NO: 37117 - protein, 33 aa, Artificial Sequence
  Description of Artificial Sequence: Synthetic polypeptide
DEEEIRTTNPVAYEQYGQSVSLTNDLAQRGDQR

SEQ ID NO: 37118 - protein, 32 aa, Artificial Sequence
  Description of Artificial Sequence: Synthetic polypeptide
DEEEIATTNPVATEQYGSVSTGAQDQERGNER

SEQ ID NO: 37119 - protein, 29 aa, Artificial Sequence
  Description of Artificial Sequence: Synthetic peptide
DEHEIRTTNPVATEFYGSISTNTQREGLQ

SEQ ID NO: 37120 - protein, 33 aa, Artificial Sequence
  Description of Artificial Sequence: Synthetic polypeptide
DEEEIATTNPVATEQYGSVSTGNDLDQRGQNEM

SEQ ID NO: 37121 - protein, 29 aa, Artificial Sequence
  Description of Artificial Sequence: Synthetic peptide
DEHEIRTTNPVATEHYGSVSQNLGDNMNR

SEQ ID NO: 37122 - protein, 31 aa, Artificial Sequence
  Description of Artificial Sequence: Synthetic polypeptide
DEHEIRTTNPVATEHYGSVSTNLQGGGNNDH

SEQ ID NO: 37123 - protein, 31 aa, Artificial Sequence
  Description of Artificial Sequence: Synthetic polypeptide
DEHEIRTTNPVATEHYGSVSTNLQADGNNDK

SEQ ID NO: 37124 - protein, 31 aa, Artificial Sequence
  Description of Artificial Sequence: Synthetic polypeptide
DEHEIRTTNPVATEHYGSVSTNLQAGGDNND

SEQ ID NO: 37125 - protein, 31 aa, Artificial Sequence
  Description of Artificial Sequence: Synthetic polypeptide
DEHEIRTTNPVATEHYGSVSTNLQDEGNNDA

SEQ ID NO: 37126 - protein, 31 aa, Artificial Sequence
  Description of Artificial Sequence: Synthetic polypeptide
DEHEIRTTNPVATEHYGSVSTNLQGAGENND

SEQ ID NO: 37127 - protein, 32 aa, Artificial Sequence
  Description of Artificial Sequence: Synthetic polypeptide
DEEEIRTTNPVAYEQYGQSVSLNELLQRGIRR

SEQ ID NO: 37128 - protein, 31 aa, Artificial Sequence
  Description of Artificial Sequence: Synthetic polypeptide
DEHEIRTTNPVATEHYGSVSTNLQGDAGNDQ

SEQ ID NO: 37129 - protein, 31 aa, Artificial Sequence
  Description of Artificial Sequence: Synthetic polypeptide
DEHEIRTTNPVATEHYGSVSTNLQGDGNNDQ

SEQ ID NO: 37130 - protein, 31 aa, Artificial Sequence
  Description of Artificial Sequence: Synthetic polypeptide
DEHEIRTTNPVATEHYGSVSTNLQADHGNND

SEQ ID NO: 37131 - protein, 33 aa, Artificial Sequence
  Description of Artificial Sequence: Synthetic polypeptide
DEEEIRTTNPVATEQYGSVCSTNLEQHFNSNRL

SEQ ID NO: 37132 - protein, 30 aa, Artificial Sequence
  Description of Artificial Sequence: Synthetic polypeptide
DEHEIRTTNPVATDQYGSVNCTALQRVGND

SEQ ID NO: 37133 - protein, 32 aa, Artificial Sequence
  Description of Artificial Sequence: Synthetic polypeptide
DEEEIATTNPVATEQYGSVSTANSLFQVRGEF

SEQ ID NO: 37134 - protein, 33 aa, Artificial Sequence
  Description of Artificial Sequence: Synthetic polypeptide
DEEEIRTTNPVATEQYGSVCSTNLQNAFGSNQG

SEQ ID NO: 37135 - protein, 32 aa, Artificial Sequence
  Description of Artificial Sequence: Synthetic polypeptide
DEEEIRTTNPVATEQYGSVCSTNLQHSGSEVG

SEQ ID NO: 37136 - protein, 33 aa, Artificial Sequence
  Description of Artificial Sequence: Synthetic polypeptide
DEEEIRTTNPVATEQYGSVCSTNLQHIGSENQE

SEQ ID NO: 37137 - protein, 32 aa, Artificial Sequence
  Description of Artificial Sequence: Synthetic polypeptide
DEEEIRTTNPVATEQYGSVCSTNLQHIGSDAE

SEQ ID NO: 37138 - protein, 29 aa, Artificial Sequence
  Description of Artificial Sequence: Synthetic peptide
DEHEIATTNPVAYEQYGSCSTNTQRPGNP

SEQ ID NO: 37139 - protein, 28 aa, Artificial Sequence
  Description of Artificial Sequence: Synthetic peptide
DEHEIATTNPVAYEQYGSVAANLQDGDR

SEQ ID NO: 37140 - protein, 28 aa, Artificial Sequence
  Description of Artificial Sequence: Synthetic peptide
DEHEIATTNPVAYDHYGSVSTNLQRDNM

SEQ ID NO: 37141 - protein, 31 aa, Artificial Sequence
  Description of Artificial Sequence: Synthetic polypeptide
DEHEIATTNPVAYEQYGSVATNLQDRGDNAR

SEQ ID NO: 37142 - protein, 32 aa, Artificial Sequence
  Description of Artificial Sequence: Synthetic polypeptide
DEEEIRTTNPVATEQYGSVCSTNLQGSNSQQM

SEQ ID NO: 37143 - protein, 32 aa, Artificial Sequence
  Description of Artificial Sequence: Synthetic polypeptide
DEEEIRTTNPVATEQYGSVCSTNLQGSGSDAG

SEQ ID NO: 37144 - protein, 32 aa, Artificial Sequence
  Description of Artificial Sequence: Synthetic polypeptide
DEEEIRTTNPVATEQYGSVCSTNLQGIQSNAS

SEQ ID NO: 37145 - protein, 33 aa, Artificial Sequence
  Description of Artificial Sequence: Synthetic polypeptide
DEEEIRTTNPVATEQYGSVCSTNLQGIGSNTQE

SEQ ID NO: 37146 - protein, 29 aa, Artificial Sequence
  Description of Artificial Sequence: Synthetic peptide
DEHEICTTNPVATDQYGSVAGTGLQRGND

SEQ ID NO: 37147 - protein, 31 aa, Artificial Sequence
  Description of Artificial Sequence: Synthetic polypeptide
DEEEIRTTNPVATEQYGSVCSTNLQFMSEDA

SEQ ID NO: 37148 - protein, 32 aa, Artificial Sequence
  Description of Artificial Sequence: Synthetic polypeptide
DEEEIRTTNPVATEQYGSVCSTNLQHFNSVDY

SEQ ID NO: 37149 - protein, 32 aa, Artificial Sequence
  Description of Artificial Sequence: Synthetic polypeptide
DEEEIRTTNPVATEQYGSVCSTNLQFLFENIT

SEQ ID NO: 37150 - protein, 30 aa, Artificial Sequence
  Description of Artificial Sequence: Synthetic polypeptide
DEHEIATTNPVATEVYGSVSTNLQEGGNNH

SEQ ID NO: 37151 - protein, 29 aa, Artificial Sequence
  Description of Artificial Sequence: Synthetic peptide
DDEEICTTNPVATEQYGSVSTMNDHDGNY

SEQ ID NO: 37152 - protein, 32 aa, Artificial Sequence
  Description of Artificial Sequence: Synthetic polypeptide
DEHEIATTNPVATEQYGSVASATNLQENGNDR

SEQ ID NO: 37153 - protein, 31 aa, Artificial Sequence
  Description of Artificial Sequence: Synthetic polypeptide
DEHEIATTNPVATEQYGSVASTMTLQVDGNR

SEQ ID NO: 37154 - protein, 31 aa, Artificial Sequence
  Description of Artificial Sequence: Synthetic polypeptide
DEHEIATTNPVATEQYGSVATNLQREGDGNV

SEQ ID NO: 37155 - protein, 29 aa, Artificial Sequence
  Description of Artificial Sequence: Synthetic peptide
DEHEIATTNPVATEQYGSVATVLQRDNDP

SEQ ID NO: 37156 - protein, 32 aa, Artificial Sequence
  Description of Artificial Sequence: Synthetic polypeptide
DEEEIRTTNPVATEQYGSVCSTNLQPEVGEVS

SEQ ID NO: 37157 - protein, 29 aa, Artificial Sequence
  Description of Artificial Sequence: Synthetic peptide
DEHEIATTNPVATEQYGSVSANLDRPMDR

SEQ ID NO: 37158 - protein, 32 aa, Artificial Sequence
  Description of Artificial Sequence: Synthetic polypeptide
DEEEIRTTNPVATEQYGSVCSTNLQNFFNNQS

SEQ ID NO: 37159 - protein, 31 aa, Artificial Sequence
  Description of Artificial Sequence: Synthetic polypeptide
DEHEIATTNPVATEQYGSVSTNLNGMEGDNR

SEQ ID NO: 37160 - protein, 31 aa, Artificial Sequence
  Description of Artificial Sequence: Synthetic polypeptide
DEHEIATTNPVATEQYGSVSTNLQGEGQSDR

SEQ ID NO: 37161 - protein, 28 aa, Artificial Sequence
  Description of Artificial Sequence: Synthetic peptide
DDEEIKSTNPVATEQYGSSSTNMQGGNN

SEQ ID NO: 37162 - protein, 32 aa, Artificial Sequence
  Description of Artificial Sequence: Synthetic polypeptide
DEEEIRTTNPVATEQYGSVCSTNLQNGSEDDS

SEQ ID NO: 37163 - protein, 31 aa, Artificial Sequence
  Description of Artificial Sequence: Synthetic polypeptide
DEHEIATTNPVATEQYGSVSTNLQHQGNNDM

SEQ ID NO: 37164 - protein, 31 aa, Artificial Sequence
  Description of Artificial Sequence: Synthetic polypeptide
DEHEIATTNPVATEQYGSVSTNLQLGEGGSR

SEQ ID NO: 37165 - protein, 30 aa, Artificial Sequence
  Description of Artificial Sequence: Synthetic polypeptide
DEHEIATTNPVATEQYGSVSTNLQNGGDQK

SEQ ID NO: 37166 - protein, 30 aa, Artificial Sequence
  Description of Artificial Sequence: Synthetic polypeptide
DEHEIATTNPVATEQYGSVSTNLQAGGDPQ

SEQ ID NO: 37167 - protein, 33 aa, Artificial Sequence
  Description of Artificial Sequence: Synthetic polypeptide
DEEEIRTTNPVATEQYGSVCSTNLQEYFGSNQF

SEQ ID NO: 37168 - protein, 32 aa, Artificial Sequence
  Description of Artificial Sequence: Synthetic polypeptide
DEEEIRTTNPVATEQYGSVCSTNLQENNSEQA

SEQ ID NO: 37169 - protein, 33 aa, Artificial Sequence
  Description of Artificial Sequence: Synthetic polypeptide
DEEEIRTTNPVATEQYGSVISPTNLIQPIVNRI

SEQ ID NO: 37170 - protein, 32 aa, Artificial Sequence
  Description of Artificial Sequence: Synthetic polypeptide
DEEEIRTTNPVATEQYGSVCSTNLIENFGNQP

SEQ ID NO: 37171 - protein, 32 aa, Artificial Sequence
  Description of Artificial Sequence: Synthetic polypeptide
DEEEIRTTNPVATEQYGSVCSTNLIEGGSNAT

SEQ ID NO: 37172 - protein, 31 aa, Artificial Sequence
  Description of Artificial Sequence: Synthetic polypeptide
DEHEIRTTNPCATEQYGSVSTNLQGNGDERG

SEQ ID NO: 37173 - protein, 31 aa, Artificial Sequence
  Description of Artificial Sequence: Synthetic polypeptide
DEHEIRTTNPCATEQYGSVSTNLQGNMGDQR

SEQ ID NO: 37174 - protein, 31 aa, Artificial Sequence
  Description of Artificial Sequence: Synthetic polypeptide
DEHEIRTTNPCATEQYGSVSTNLQNDGGEMR

SEQ ID NO: 37175 - protein, 31 aa, Artificial Sequence
  Description of Artificial Sequence: Synthetic polypeptide
DEHEIRTTNPCATEQYGSVSTNLQSDGNNDM

SEQ ID NO: 37176 - protein, 30 aa, Artificial Sequence
  Description of Artificial Sequence: Synthetic polypeptide
DEHEIRTTNPCATEQYGSVSTNLQGDGGMV

SEQ ID NO: 37177 - protein, 32 aa, Artificial Sequence
  Description of Artificial Sequence: Synthetic polypeptide
DEEEIRTTNPVAYEQYGQSVSPNDLDQRGIER

SEQ ID NO: 37178 - protein, 29 aa, Artificial Sequence
  Description of Artificial Sequence: Synthetic peptide
DEEEIATTNPVATEQYGSVSTAGNSGMNV

SEQ ID NO: 37179 - protein, 29 aa, Artificial Sequence
  Description of Artificial Sequence: Synthetic peptide
DEHEIRTTNPVATDQWGSVTTQLQRGNDD

SEQ ID NO: 37180 - protein, 30 aa, Artificial Sequence
  Description of Artificial Sequence: Synthetic polypeptide
DEHEIRTTNPVATDQYGISVNTGLQRGGND

SEQ ID NO: 37181 - protein, 32 aa, Artificial Sequence
  Description of Artificial Sequence: Synthetic polypeptide
DEEEIATTNPVATEQYGSVSTANLPQDGNGNV

SEQ ID NO: 37182 - protein, 29 aa, Artificial Sequence
  Description of Artificial Sequence: Synthetic peptide
DEHEIRTTNPVATDQYGSVATQLQDGGND

SEQ ID NO: 37183 - protein, 29 aa, Artificial Sequence
  Description of Artificial Sequence: Synthetic peptide
DEHEIRTTNPVATDQYGSVATQLQDGNDN

SEQ ID NO: 37184 - protein, 33 aa, Artificial Sequence
  Description of Artificial Sequence: Synthetic polypeptide
DEEEIRTTNPVAYEQYGQSVSNTNGLLQRGAER

SEQ ID NO: 37185 - protein, 31 aa, Artificial Sequence
  Description of Artificial Sequence: Synthetic polypeptide
DEHEIRTTNPCATEQYGSVSTNLQGDGGMNH

SEQ ID NO: 37186 - protein, 31 aa, Artificial Sequence
  Description of Artificial Sequence: Synthetic polypeptide
DEEEIRTTNPVATEQYGSVCSTNLIGGSDFT

SEQ ID NO: 37187 - protein, 34 aa, Artificial Sequence
  Description of Artificial Sequence: Synthetic polypeptide
DEEEIRTTNPVATEQYGSVCSTNLLNQGFGSNRS

SEQ ID NO: 37188 - protein, 29 aa, Artificial Sequence
  Description of Artificial Sequence: Synthetic peptide
DDEEIACTNPVATEQYGNVSENLMSRGNR

SEQ ID NO: 37189 - protein, 29 aa, Artificial Sequence
  Description of Artificial Sequence: Synthetic peptide
DDEDIRTTNPVATEQYGTVSTNHQRNSNL

SEQ ID NO: 37190 - protein, 29 aa, Artificial Sequence
  Description of Artificial Sequence: Synthetic peptide
DDEDIRTTNPVATEQYGKVSTNHQRVNDG

SEQ ID NO: 37191 - protein, 29 aa, Artificial Sequence
  Description of Artificial Sequence: Synthetic peptide
DDEDIRTTNPVATEQYGKVSTNHQDRVND

SEQ ID NO: 37192 - protein, 29 aa, Artificial Sequence
  Description of Artificial Sequence: Synthetic peptide
DDEDIRTTNPVATEQYGAVSTNHQQRVNA

SEQ ID NO: 37193 - protein, 33 aa, Artificial Sequence
  Description of Artificial Sequence: Synthetic polypeptide
DEEEIRTTNPVATEQYGSVCSTNLQASGSNTQG

SEQ ID NO: 37194 - protein, 32 aa, Artificial Sequence
  Description of Artificial Sequence: Synthetic polypeptide
DEEEIRTTNPVATEQYGSVCSTNLQASGSDQD

SEQ ID NO: 37195 - protein, 32 aa, Artificial Sequence
  Description of Artificial Sequence: Synthetic polypeptide
DEEEIRTTNPVATEQYGSVCSTNLPQGFNSNQ

SEQ ID NO: 37196 - protein, 31 aa, Artificial Sequence
  Description of Artificial Sequence: Synthetic polypeptide
DEEEIRTTNPVATEQYGSVISPTNLQGLPDL

SEQ ID NO: 37197 - protein, 33 aa, Artificial Sequence
  Description of Artificial Sequence: Synthetic polypeptide
DEEEIRTTNPVATEQYGSVCSTNLNQNSGSNFG

SEQ ID NO: 37198 - protein, 33 aa, Artificial Sequence
  Description of Artificial Sequence: Synthetic polypeptide
DEEEIRTTNPVATEQYGSVISPTNLQLGLIDRE

SEQ ID NO: 37199 - protein, 32 aa, Artificial Sequence
  Description of Artificial Sequence: Synthetic polypeptide
DEEEIRTTNPVATEQYGSVISPTNNQRGVFVS

SEQ ID NO: 37200 - protein, 31 aa, Artificial Sequence
  Description of Artificial Sequence: Synthetic polypeptide
DEHEIRTTNPCATEQYGSVSTNGGQDAGNNR

SEQ ID NO: 37201 - protein, 31 aa, Artificial Sequence
  Description of Artificial Sequence: Synthetic polypeptide
DEHEIRTTNPCATEQYGSVSTNGQDMNGNGR

SEQ ID NO: 37202 - protein, 34 aa, Artificial Sequence
  Description of Artificial Sequence: Synthetic polypeptide
DEEEIRTTNPVATEQYGSVCSTNLLQERFGSERQ

SEQ ID NO: 37203 - protein, 30 aa, Artificial Sequence
  Description of Artificial Sequence: Synthetic polypeptide
DEHEIATTNPVATEQYGEVSTNLQGGPNDM

SEQ ID NO: 37204 - protein, 30 aa, Artificial Sequence
  Description of Artificial Sequence: Synthetic polypeptide
DAEEIRSTNPVATEQYGSVSTNQNARNGQR

SEQ ID NO: 37205 - protein, 31 aa, Artificial Sequence
  Description of Artificial Sequence: Synthetic polypeptide
DAEEIRSTNPVATEQYGSVSTNLTEARNGTR

SEQ ID NO: 37206 - protein, 31 aa, Artificial Sequence
  Description of Artificial Sequence: Synthetic polypeptide
DAEEIRSTNPVATEQYGSVSTNLQAGNGQPT

SEQ ID NO: 37207 - protein, 28 aa, Artificial Sequence
  Description of Artificial Sequence: Synthetic peptide
DEAEIAATNPVATEQYGCVATNLERGNE

SEQ ID NO: 37208 - protein, 32 aa, Artificial Sequence
  Description of Artificial Sequence: Synthetic polypeptide
DEEEIRTTNPVATEQYGSVCSTGNDLQGGSED

SEQ ID NO: 37209 - protein, 29 aa, Artificial Sequence
  Description of Artificial Sequence: Synthetic peptide
DEEEIRTTNPVAVEQYGSVVTNLQNNDQG

SEQ ID NO: 37210 - protein, 31 aa, Artificial Sequence
  Description of Artificial Sequence: Synthetic polypeptide
DEEEIRTTNPVATEQYGSVCSTGNDAGGSNQ

SEQ ID NO: 37211 - protein, 30 aa, Artificial Sequence
  Description of Artificial Sequence: Synthetic polypeptide
DEEEIRTTNPVAVEQYGSVVTNLQGNDETG

SEQ ID NO: 37212 - protein, 31 aa, Artificial Sequence
  Description of Artificial Sequence: Synthetic polypeptide
DEEEIRTTNPVATEQYGSVCSTGLQVQGLIQ

SEQ ID NO: 37213 - protein, 30 aa, Artificial Sequence
  Description of Artificial Sequence: Synthetic polypeptide
DEMEIRTTNPVATQQYGCVSATNLERPGNP

SEQ ID NO: 37214 - protein, 29 aa, Artificial Sequence
  Description of Artificial Sequence: Synthetic peptide
DEEEIRTTNPVAVEQYGSVTTNLQVNDSV

SEQ ID NO: 37215 - protein, 30 aa, Artificial Sequence
  Description of Artificial Sequence: Synthetic polypeptide
DEEEIRTTNPVATEQYGSVCSTGLQVIPDN

SEQ ID NO: 37216 - protein, 31 aa, Artificial Sequence
  Description of Artificial Sequence: Synthetic polypeptide
DEEEIATTNPVATEPYGTVSTNLQGNTGDNR

SEQ ID NO: 37217 - protein, 30 aa, Artificial Sequence
  Description of Artificial Sequence: Synthetic polypeptide
DEMEIRTTNPVATQQYGCVSTNLERGSNDM

SEQ ID NO: 37218 - protein, 30 aa, Artificial Sequence
  Description of Artificial Sequence: Synthetic polypeptide
DEEEIRTTNPVATEQYGSVCSTGLQQAPDQ

SEQ ID NO: 37219 - protein, 30 aa, Artificial Sequence
  Description of Artificial Sequence: Synthetic polypeptide
DEMEIRTTNPVATQQYGVVSTNELERQGNS

SEQ ID NO: 37220 - protein, 29 aa, Artificial Sequence
  Description of Artificial Sequence: Synthetic peptide
DEMEIRTTNPVATVQYGCVSTNLERGSDP

SEQ ID NO: 37221 - protein, 29 aa, Artificial Sequence
  Description of Artificial Sequence: Synthetic peptide
CEYEIRATNPVATEQYGSVDTNLQHNGNQ

SEQ ID NO: 37222 - protein, 29 aa, Artificial Sequence
  Description of Artificial Sequence: Synthetic peptide
DEMEIRTTNPVATWQYGEVSTNLERELNP

SEQ ID NO: 37223 - protein, 30 aa, Artificial Sequence
  Description of Artificial Sequence: Synthetic polypeptide
CQEEIRTTNPVATEQWGTVSTNLSQEGTNR

SEQ ID NO: 37224 - protein, 29 aa, Artificial Sequence
  Description of Artificial Sequence: Synthetic peptide
DEEEIRTTNPVAVEQYGSVVTNLQVEDSE

SEQ ID NO: 37225 - protein, 30 aa, Artificial Sequence
  Description of Artificial Sequence: Synthetic polypeptide
DEMEIRTTNPVATEQYGTVCSTGLMREGND

SEQ ID NO: 37226 - protein, 30 aa, Artificial Sequence
  Description of Artificial Sequence: Synthetic polypeptide
DEEEIRTTNPVAWEQYGSVWTNDQHHDGSR

SEQ ID NO: 37227 - protein, 32 aa, Artificial Sequence
  Description of Artificial Sequence: Synthetic polypeptide
DEEEIRTTNPVATEQYGSVLTNLQQREQLIRQ

SEQ ID NO: 37228 - protein, 30 aa, Artificial Sequence
  Description of Artificial Sequence: Synthetic polypeptide
DEEEIRTTNPVAWEQYGSVAWTNLQVPDSR

SEQ ID NO: 37229 - protein, 31 aa, Artificial Sequence
  Description of Artificial Sequence: Synthetic polypeptide
DEEEIRTTNPVAWEQYGQCVYSTELQRGIER

SEQ ID NO: 37230 - protein, 29 aa, Artificial Sequence
  Description of Artificial Sequence: Synthetic peptide
DEMEIRTTNPVATEQYGTVSTGPVERGND

SEQ ID NO: 37231 - protein, 30 aa, Artificial Sequence
  Description of Artificial Sequence: Synthetic polypeptide
DEEEIRTTNPVAVEQYGSVVTNLQQNDENN

SEQ ID NO: 37232 - protein, 32 aa, Artificial Sequence
  Description of Artificial Sequence: Synthetic polypeptide
DEEEIRTTNPVAWEQYGCVSCTNLSQRGGNNE

SEQ ID NO: 37233 - protein, 29 aa, Artificial Sequence
  Description of Artificial Sequence: Synthetic peptide
DEMEIRTTNPVATEQYGVVSTVLQQPEND

SEQ ID NO: 37234 - protein, 33 aa, Artificial Sequence
  Description of Artificial Sequence: Synthetic polypeptide
DEEEIRTTNPVATEQYGSVCSTGNLDENFGSNR

SEQ ID NO: 37235 - protein, 30 aa, Artificial Sequence
  Description of Artificial Sequence: Synthetic polypeptide
DEMEIRTTNPVATEQYGVVSVTELQRNEND

SEQ ID NO: 37236 - protein, 31 aa, Artificial Sequence
  Description of Artificial Sequence: Synthetic polypeptide
DEEEIRTTNPVAWEPYGSVSTNHSQNGQNRW

SEQ ID NO: 37237 - protein, 32 aa, Artificial Sequence
  Description of Artificial Sequence: Synthetic polypeptide
DEEEIRTTNPVATEQYGSVCSTGNLAGGSNDG

SEQ ID NO: 37238 - protein, 29 aa, Artificial Sequence
  Description of Artificial Sequence: Synthetic peptide
DEEEIRTTNPVAVEQYGSVVTNLQVNEDN

SEQ ID NO: 37239 - protein, 32 aa, Artificial Sequence
  Description of Artificial Sequence: Synthetic polypeptide
DEEEIRTTNPVATEQYGSVCSTGNLENGSNVP

SEQ ID NO: 37240 - protein, 29 aa, Artificial Sequence
  Description of Artificial Sequence: Synthetic peptide
DEEEIRTTNPVAWEQYGSVWTNDQVFDVR

SEQ ID NO: 37241 - protein, 30 aa, Artificial Sequence
  Description of Artificial Sequence: Synthetic polypeptide
DEEEIATTNPVATEPYGSVSTTNGNQNGNS

SEQ ID NO: 37242 - protein, 31 aa, Artificial Sequence
  Description of Artificial Sequence: Synthetic polypeptide
DEEEIATTNPVATEPYGSVSTNLQVGGNNNH

SEQ ID NO: 37243 - protein, 31 aa, Artificial Sequence
  Description of Artificial Sequence: Synthetic polypeptide
DEEEIRTTNPVAVEQYGSVSTTNLQVNDSND

SEQ ID NO: 37244 - protein, 31 aa, Artificial Sequence
  Description of Artificial Sequence: Synthetic polypeptide
DEEEIRTTNPVAVEQYGSVSTTNLQGNDNSD

SEQ ID NO: 37245 - protein, 31 aa, Artificial Sequence
  Description of Artificial Sequence: Synthetic polypeptide
DEEEIRTTNPVAVEQYGSVSTTNLQENNNSD

SEQ ID NO: 37246 - protein, 29 aa, Artificial Sequence
  Description of Artificial Sequence: Synthetic peptide
DEEEIATTNPVAYEPYGSVATNLQQDGND

SEQ ID NO: 37247 - protein, 30 aa, Artificial Sequence
  Description of Artificial Sequence: Synthetic polypeptide
DEMVIGTTNPVATEQWGSVSTTDDLQRGNR

SEQ ID NO: 37248 - protein, 29 aa, Artificial Sequence
  Description of Artificial Sequence: Synthetic peptide
DEMVIRTTNPVATEQYGCVETNPQGSGNR

SEQ ID NO: 37249 - protein, 30 aa, Artificial Sequence
  Description of Artificial Sequence: Synthetic polypeptide
DEEEIATTNPVATEPYGSVSTNGNGDNGNR

SEQ ID NO: 37250 - protein, 31 aa, Artificial Sequence
  Description of Artificial Sequence: Synthetic polypeptide
DEEEIATTNPVAYEPYGSVSTGNMLSQSGNR

SEQ ID NO: 37251 - protein, 33 aa, Artificial Sequence
  Description of Artificial Sequence: Synthetic polypeptide
DEEEIRTTNPVATEQYGSVCSTENPNQRGSNQQ

SEQ ID NO: 37252 - protein, 29 aa, Artificial Sequence
  Description of Artificial Sequence: Synthetic peptide
DENCISTTNPVATEQYGVVSDTNLQRGEA

SEQ ID NO: 37253 - protein, 32 aa, Artificial Sequence
  Description of Artificial Sequence: Synthetic polypeptide
DEEEIRTTNPVATEQYGSVCSTENLQYFNNQM

SEQ ID NO: 37254 - protein, 33 aa, Artificial Sequence
  Description of Artificial Sequence: Synthetic polypeptide
DEEEIRTTNPVATEQYGSVCSTENLQASGSNAF

SEQ ID NO: 37255 - protein, 29 aa, Artificial Sequence
  Description of Artificial Sequence: Synthetic peptide
DENEIACTNPVATECYGSVSCNEPQRGNR

SEQ ID NO: 37256 - protein, 33 aa, Artificial Sequence
  Description of Artificial Sequence: Synthetic polypeptide
DEEEIRTTNPVATEQYGSVCSTENLQAGNSNQL

SEQ ID NO: 37257 - protein, 33 aa, Artificial Sequence
  Description of Artificial Sequence: Synthetic polypeptide
DEEEIRTTNPVATEQYGSVCSTENPQEFGSNRE

SEQ ID NO: 37258 - protein, 31 aa, Artificial Sequence
  Description of Artificial Sequence: Synthetic polypeptide
DEEEIATTNPVATEPYGSVSTNPGNQNGENR

SEQ ID NO: 37259 - protein, 31 aa, Artificial Sequence
  Description of Artificial Sequence: Synthetic polypeptide
DEEEIATTNPVATEPYGSVSTNGNQGNMGNR

SEQ ID NO: 37260 - protein, 31 aa, Artificial Sequence
  Description of Artificial Sequence: Synthetic polypeptide
DEEEIRTTNPVATEQYGSVCSTEPQAFGSNL

SEQ ID NO: 37261 - protein, 32 aa, Artificial Sequence
  Description of Artificial Sequence: Synthetic polypeptide
DEEEIATTNPVATEPYGSVSTNLQGEHGGNDR

SEQ ID NO: 37262 - protein, 30 aa, Artificial Sequence
  Description of Artificial Sequence: Synthetic polypeptide
DEEEIRTTNPVATEQYGSVCSTGELANGEQ

SEQ ID NO: 37263 - protein, 31 aa, Artificial Sequence
  Description of Artificial Sequence: Synthetic polypeptide
DEEEIRTTNPVATEQYGSVMSGIFNLQEVNI

SEQ ID NO: 37264 - protein, 31 aa, Artificial Sequence
  Description of Artificial Sequence: Synthetic polypeptide
DEEEIATTNPVATEPYGSVSTNLQDHDGGER

SEQ ID NO: 37265 - protein, 30 aa, Artificial Sequence
  Description of Artificial Sequence: Synthetic polypeptide
DEEEIATTNPVATEPYGSVSTNLGVMGNNG

SEQ ID NO: 37266 - protein, 31 aa, Artificial Sequence
  Description of Artificial Sequence: Synthetic polypeptide
DEEEIRTTNPVATEQYGSVCSTGATQGGSND

SEQ ID NO: 37267 - protein, 33 aa, Artificial Sequence
  Description of Artificial Sequence: Synthetic polypeptide
DEEEIRTTNPVATEQYGSVCSTEPPLQNGSNRL

SEQ ID NO: 37268 - protein, 32 aa, Artificial Sequence
  Description of Artificial Sequence: Synthetic polypeptide
DEEEIRTTNPVATEQYGSVCSTGALQRTSNQS

SEQ ID NO: 37269 - protein, 30 aa, Artificial Sequence
  Description of Artificial Sequence: Synthetic polypeptide
DEEEIRTTNPVATEQYGSVCSTFTLQNTGI

SEQ ID NO: 37270 - protein, 32 aa, Artificial Sequence
  Description of Artificial Sequence: Synthetic polypeptide
DEEEIRTTNPVATEQYGSVCSTFDLHGNGNTR

SEQ ID NO: 37271 - protein, 31 aa, Artificial Sequence
  Description of Artificial Sequence: Synthetic polypeptide
DEEEIATTNPVATEPYGSVSTNLGQMGDNGQ

SEQ ID NO: 37272 - protein, 32 aa, Artificial Sequence
  Description of Artificial Sequence: Synthetic polypeptide
DEEEIRTTNPVATEQYGSVCSTEYEQRGSNDS

SEQ ID NO: 37273 - protein, 30 aa, Artificial Sequence
  Description of Artificial Sequence: Synthetic polypeptide
DEEEIRTTNPVATEQYGSVCSTETQNGEQI

SEQ ID NO: 37274 - protein, 31 aa, Artificial Sequence
  Description of Artificial Sequence: Synthetic polypeptide
DEEEIATTNPVATEPYGSVSTNGNQNGGNDR

SEQ ID NO: 37275 - protein, 31 aa, Artificial Sequence
  Description of Artificial Sequence: Synthetic polypeptide
DEEEIRTTNPVATEQYGSVCSTGAHQGFGNQ

SEQ ID NO: 37276 - protein, 32 aa, Artificial Sequence
  Description of Artificial Sequence: Synthetic polypeptide
DEEEIRTTNPVATEQYGSVCSTGNLIGLGSND

SEQ ID NO: 37277 - protein, 33 aa, Artificial Sequence
  Description of Artificial Sequence: Synthetic polypeptide
DEEEIRTTNPVATEQYGSVCSTGNLNQGIGSNQ

SEQ ID NO: 37278 - protein, 30 aa, Artificial Sequence
  Description of Artificial Sequence: Synthetic polypeptide
DEMEIRTTNPVATEQYGTVCSEGLMREGNR

SEQ ID NO: 37279 - protein, 30 aa, Artificial Sequence
  Description of Artificial Sequence: Synthetic polypeptide
DEMEIRTTNPVATEQYGSVSTPLNRGDDDE

SEQ ID NO: 37280 - protein, 29 aa, Artificial Sequence
  Description of Artificial Sequence: Synthetic peptide
DEMEIRTTNPVATEQYGSVSTPLNSRDDN

SEQ ID NO: 37281 - protein, 32 aa, Artificial Sequence
  Description of Artificial Sequence: Synthetic polypeptide
DEEEIRTTNPVAYEAYGSVPSCTGNLQRGNNH

SEQ ID NO: 37282 - protein, 30 aa, Artificial Sequence
  Description of Artificial Sequence: Synthetic polypeptide
DEMEIRTTNPVATEQYGSVSTPNDQEGEEM

SEQ ID NO: 37283 - protein, 31 aa, Artificial Sequence
  Description of Artificial Sequence: Synthetic polypeptide
DEEEIRTTNPVATEQYGSVLSFTNEQRQEEQ

SEQ ID NO: 37284 - protein, 32 aa, Artificial Sequence
  Description of Artificial Sequence: Synthetic polypeptide
DEEEIRTTNPVAYEAYGSVCSCTNLSTQTGNR

SEQ ID NO: 37285 - protein, 30 aa, Artificial Sequence
  Description of Artificial Sequence: Synthetic polypeptide
DEMEIRTTNPVATEQYGSVSTPLNRDNDQD

SEQ ID NO: 37286 - protein, 32 aa, Artificial Sequence
  Description of Artificial Sequence: Synthetic polypeptide
DEEEIRTTNPVAYEAYGSVATNLSQRGGNQRG

SEQ ID NO: 37287 - protein, 32 aa, Artificial Sequence
  Description of Artificial Sequence: Synthetic polypeptide
DEEEIRTTNPVAYEAYGSVATNLSQNRGGNRI

SEQ ID NO: 37288 - protein, 33 aa, Artificial Sequence
  Description of Artificial Sequence: Synthetic polypeptide
DEEEIRTTNPVAYEAYGSTVSYTGNLQRGGNRA

SEQ ID NO: 37289 - protein, 32 aa, Artificial Sequence
  Description of Artificial Sequence: Synthetic polypeptide
DEEEIRTTNPVAYEAYGSTVPVTNLSQRTGNR

SEQ ID NO: 37290 - protein, 32 aa, Artificial Sequence
  Description of Artificial Sequence: Synthetic polypeptide
DEEEIRTTNPVATEQYGSVLSPTNEQRQPEER

SEQ ID NO: 37291 - protein, 28 aa, Artificial Sequence
  Description of Artificial Sequence: Synthetic peptide
CTSEIRTTNPVATEQYGTTSTVLQHGNR

SEQ ID NO: 37292 - protein, 30 aa, Artificial Sequence
  Description of Artificial Sequence: Synthetic polypeptide
DEMEIRTTNPVATEQYGSVSTSLEQRDDDE

SEQ ID NO: 37293 - protein, 29 aa, Artificial Sequence
  Description of Artificial Sequence: Synthetic peptide
DEMEIRTTNPVATEQYGSVSTPPLNNNND

SEQ ID NO: 37294 - protein, 32 aa, Artificial Sequence
  Description of Artificial Sequence: Synthetic polypeptide
DEEEIRTTNPVATEQYGSVCSTMALQNGSNAA

SEQ ID NO: 37295 - protein, 30 aa, Artificial Sequence
  Description of Artificial Sequence: Synthetic polypeptide
DEMEIRTTNPVATEQYGSVSTPLNRDMDER

SEQ ID NO: 37296 - protein, 30 aa, Artificial Sequence
  Description of Artificial Sequence: Synthetic polypeptide
DEMEIRTTNPVATEQYGSVSTPLNRDDIRE

SEQ ID NO: 37297 - protein, 33 aa, Artificial Sequence
  Description of Artificial Sequence: Synthetic polypeptide
DEEEIRTTNPVATEQYGSVLCTPNLQRGVNEDD

SEQ ID NO: 37298 - protein, 30 aa, Artificial Sequence
  Description of Artificial Sequence: Synthetic polypeptide
DEEEIRTTNPVATEQYGSVLESELQRGDLL

SEQ ID NO: 37299 - protein, 32 aa, Artificial Sequence
  Description of Artificial Sequence: Synthetic polypeptide
DEEEIRTTNPVAYEAYGSVSCTNALQQTGNQR

SEQ ID NO: 37300 - protein, 32 aa, Artificial Sequence
  Description of Artificial Sequence: Synthetic polypeptide
DEEEIRTTNPVATEQYGSVCSTMNLERANEEI

SEQ ID NO: 37301 - protein, 32 aa, Artificial Sequence
  Description of Artificial Sequence: Synthetic polypeptide
DEEEIRTTNPVATEQYGSVLLTNNQRGLEVRV

SEQ ID NO: 37302 - protein, 30 aa, Artificial Sequence
  Description of Artificial Sequence: Synthetic polypeptide
DEMEIRTTNPVATEQYGSVSTNNQETNEKN

SEQ ID NO: 37303 - protein, 30 aa, Artificial Sequence
  Description of Artificial Sequence: Synthetic polypeptide
DEMEIRTTNPVATEQYGSVSTPLNRDDIRM

SEQ ID NO: 37304 - protein, 31 aa, Artificial Sequence
  Description of Artificial Sequence: Synthetic polypeptide
DEEEIRTTNPVAYEAYGSVSANELSQRGGNA

SEQ ID NO: 37305 - protein, 31 aa, Artificial Sequence
  Description of Artificial Sequence: Synthetic polypeptide
DEEEIRTTNPVATEQYGSVLPITNLQIGDLL

SEQ ID NO: 37306 - protein, 30 aa, Artificial Sequence
  Description of Artificial Sequence: Synthetic polypeptide
DEMEIRTTNPVATEQYGSVSTPLENRGDDQ

SEQ ID NO: 37307 - protein, 31 aa, Artificial Sequence
  Description of Artificial Sequence: Synthetic polypeptide
DEEEIRTTNPVAYEAYGSVPWTNLSQRGGNI

SEQ ID NO: 37308 - protein, 29 aa, Artificial Sequence
  Description of Artificial Sequence: Synthetic peptide
DEMEIRTTNPVATEQYGSVSTPLNETDRQ

SEQ ID NO: 37309 - protein, 33 aa, Artificial Sequence
  Description of Artificial Sequence: Synthetic polypeptide
DEEEIRTTNPVATEQYGSVCSTMNDQRFGSNQN

SEQ ID NO: 37310 - protein, 32 aa, Artificial Sequence
  Description of Artificial Sequence: Synthetic polypeptide
DEEEIRTTNPVAYEAYGSVPSCTNLSQRGPRY

SEQ ID NO: 37311 - protein, 30 aa, Artificial Sequence
  Description of Artificial Sequence: Synthetic polypeptide
DEMEIRTTNPVATEQYGSVSTNQQESTENN

SEQ ID NO: 37312 - protein, 30 aa, Artificial Sequence
  Description of Artificial Sequence: Synthetic polypeptide
DEEEIRTTNPVATEQYGSVCSTLLEFNSER

SEQ ID NO: 37313 - protein, 30 aa, Artificial Sequence
  Description of Artificial Sequence: Synthetic polypeptide
CTGEIRTTNPVATEQYGSVSTQNNLQGGER

SEQ ID NO: 37314 - protein, 31 aa, Artificial Sequence
  Description of Artificial Sequence: Synthetic polypeptide
DEMEIRTTNPVATEQYGSVSTVHEFRGGNDR

SEQ ID NO: 37315 - protein, 31 aa, Artificial Sequence
  Description of Artificial Sequence: Synthetic polypeptide
DEEEIRTTNPVAYEAYGCVSTNLSQQEGNER

SEQ ID NO: 37316 - protein, 29 aa, Artificial Sequence
  Description of Artificial Sequence: Synthetic peptide
CTEEIRTTNPVGTEQYGSVSTMGLQRDNI

SEQ ID NO: 37317 - protein, 30 aa, Artificial Sequence
  Description of Artificial Sequence: Synthetic polypeptide
DEMEIRTTNPVATEQYGSVTSQNLFNNSNR

SEQ ID NO: 37318 - protein, 33 aa, Artificial Sequence
  Description of Artificial Sequence: Synthetic polypeptide
DEEEIRTTNPVATEQYGSVCSTGNLQGGSNPDA

SEQ ID NO: 37319 - protein, 32 aa, Artificial Sequence
  Description of Artificial Sequence: Synthetic polypeptide
DEMEIRTTNPVATEQYGSVTSTVLQRGSDQRG

SEQ ID NO: 37320 - protein, 32 aa, Artificial Sequence
  Description of Artificial Sequence: Synthetic polypeptide
DEEEIRTTNPVAYEAWGSVSCTNMLAQRPGNR

SEQ ID NO: 37321 - protein, 32 aa, Artificial Sequence
  Description of Artificial Sequence: Synthetic polypeptide
DEEEIRTTNPVATEQYGSVCSTGNLQGGSVDQ

SEQ ID NO: 37322 - protein, 32 aa, Artificial Sequence
  Description of Artificial Sequence: Synthetic polypeptide
DEEEIRTTNPVATEQYGSVCSTGNLQGGSEQI

SEQ ID NO: 37323 - protein, 31 aa, Artificial Sequence
  Description of Artificial Sequence: Synthetic polypeptide
DEEEIRTTNPVAYEAWGSVSCTNLQQEGNER

SEQ ID NO: 37324 - protein, 32 aa, Artificial Sequence
  Description of Artificial Sequence: Synthetic polypeptide
DEEEIRTTNPVATEQYGSVLSWNIGQRIDNTR

SEQ ID NO: 37325 - protein, 32 aa, Artificial Sequence
  Description of Artificial Sequence: Synthetic polypeptide
DEEEIRTTNPVATEQYGSVCSTGNLQFFNNTQ

SEQ ID NO: 37326 - protein, 30 aa, Artificial Sequence
  Description of Artificial Sequence: Synthetic polypeptide
DEMEIRTTNPVATEQYGSVVTNHQRYSDER

SEQ ID NO: 37327 - protein, 30 aa, Artificial Sequence
  Description of Artificial Sequence: Synthetic polypeptide
DEEEIRTTNPVAWEQYGSVWTNTLQDFDSR

SEQ ID NO: 37328 - protein, 32 aa, Artificial Sequence
  Description of Artificial Sequence: Synthetic polypeptide
DEEEIRTTNPVATEQYGSVCSTGNLQENSGEQ

SEQ ID NO: 37329 - protein, 32 aa, Artificial Sequence
  Description of Artificial Sequence: Synthetic polypeptide
DEEEIRTTNPVATEQYGSVCSTGNLQGGGSDD

SEQ ID NO: 37330 - protein, 31 aa, Artificial Sequence
  Description of Artificial Sequence: Synthetic polypeptide
DEEEIRTTNPVAYEAYGICVSCTNLQEGGNR

SEQ ID NO: 37331 - protein, 30 aa, Artificial Sequence
  Description of Artificial Sequence: Synthetic polypeptide
DEMEIRTTNPVATEQYGSVSWNLQEDEDRQ

SEQ ID NO: 37332 - protein, 31 aa, Artificial Sequence
  Description of Artificial Sequence: Synthetic polypeptide
DEEEIRTTNPVAYEAYGKTVSYTNLQRGGNS

SEQ ID NO: 37333 - protein, 31 aa, Artificial Sequence
  Description of Artificial Sequence: Synthetic polypeptide
DEEEIRTTNPVATEQYGSVCSTINDQGGSEQ

SEQ ID NO: 37334 - protein, 32 aa, Artificial Sequence
  Description of Artificial Sequence: Synthetic polypeptide
DEEEIRTTNPVATEQYGSVCSTGPLQGFGSND

SEQ ID NO: 37335 - protein, 32 aa, Artificial Sequence
  Description of Artificial Sequence: Synthetic polypeptide
DEEEIRTTNPVATEQYGSVLSPTNLQRDPLQT

SEQ ID NO: 37336 - protein, 29 aa, Artificial Sequence
  Description of Artificial Sequence: Synthetic peptide
DEMEIRTTNPVATEQYGSVSVNDQMGEAD

SEQ ID NO: 37337 - protein, 31 aa, Artificial Sequence
  Description of Artificial Sequence: Synthetic polypeptide
DEMEIRTTNPVATEQYGSVSVNLERSGEERM

SEQ ID NO: 37338 - protein, 32 aa, Artificial Sequence
  Description of Artificial Sequence: Synthetic polypeptide
DEEEIRTTNPVATEQYGSVLSTNLDDRENSEL

SEQ ID NO: 37339 - protein, 31 aa, Artificial Sequence
  Description of Artificial Sequence: Synthetic polypeptide
DEEEIRTTNPVAYEAYGKVVSYTNLSQRGNF

SEQ ID NO: 37340 - protein, 29 aa, Artificial Sequence
  Description of Artificial Sequence: Synthetic peptide
DEEEIRTTNPVSTEQYGSVAINLQGGGST

SEQ ID NO: 37341 - protein, 31 aa, Artificial Sequence
  Description of Artificial Sequence: Synthetic polypeptide
DEEEIRTTNPVAYEAYGKVSTNLQSGGNNRP

SEQ ID NO: 37342 - protein, 30 aa, Artificial Sequence
  Description of Artificial Sequence: Synthetic polypeptide
DEEEIRTTNPVAYEAYGKVSCTGNLQGVNR

SEQ ID NO: 37343 - protein, 32 aa, Artificial Sequence
  Description of Artificial Sequence: Synthetic polypeptide
DEEEIRTTNPVATEQYGSVCSTGNLQNIGEQA

SEQ ID NO: 37344 - protein, 32 aa, Artificial Sequence
  Description of Artificial Sequence: Synthetic polypeptide
DEMEIRTTNPVATEQYGSVSVTNLDERGDNPQ

SEQ ID NO: 37345 - protein, 31 aa, Artificial Sequence
  Description of Artificial Sequence: Synthetic polypeptide
DEEEIATTNPVAYEAYGSVVSTNLQRVGNQL

SEQ ID NO: 37346 - protein, 33 aa, Artificial Sequence
  Description of Artificial Sequence: Synthetic polypeptide
DEEEIRTTNPVATEQYGSVCSTGNLQGSGSNDL

SEQ ID NO: 37347 - protein, 30 aa, Artificial Sequence
  Description of Artificial Sequence: Synthetic polypeptide
DEMEIRTTNPVATEQYGSVSWGNLFNNSNR

SEQ ID NO: 37348 - protein, 30 aa, Artificial Sequence
  Description of Artificial Sequence: Synthetic polypeptide
DEEEIATTNPVATEPYGSVSTGNGNDNGNR

SEQ ID NO: 37349 - protein, 30 aa, Artificial Sequence
  Description of Artificial Sequence: Synthetic polypeptide
DEMEIRTTNPVATEQYGSVSTNHQRFISEQ

SEQ ID NO: 37350 - protein, 29 aa, Artificial Sequence
  Description of Artificial Sequence: Synthetic peptide
DEEEIATTNPVATEPYGSVSANLQEQGDY

SEQ ID NO: 37351 - protein, 28 aa, Artificial Sequence
  Description of Artificial Sequence: Synthetic peptide
DENEIACTNPVATEQYGDASENLQRGGR

SEQ ID NO: 37352 - protein, 30 aa, Artificial Sequence
  Description of Artificial Sequence: Synthetic polypeptide
DENEIATTNPVATEQYGSVAATNDQRGDND

SEQ ID NO: 37353 - protein, 30 aa, Artificial Sequence
  Description of Artificial Sequence: Synthetic polypeptide
DENEIATTNPVATEQYGSVAGTNGQRGNDQ

SEQ ID NO: 37354 - protein, 29 aa, Artificial Sequence
  Description of Artificial Sequence: Synthetic peptide
DENEIATTNPVATEQYGSVAITNDQDGND

SEQ ID NO: 37355 - protein, 32 aa, Artificial Sequence
  Description of Artificial Sequence: Synthetic polypeptide
DEEEIRTTNPVATEVYGSVSTNLVQQGGGNDS

SEQ ID NO: 37356 - protein, 30 aa, Artificial Sequence
  Description of Artificial Sequence: Synthetic polypeptide
DEEEIATTNPVAYEQWGSVSTNLDGNGNTR

SEQ ID NO: 37357 - protein, 30 aa, Artificial Sequence
  Description of Artificial Sequence: Synthetic polypeptide
DEEEIRTTNPVATEVYGSVSTALQVVGGDI

SEQ ID NO: 37358 - protein, 32 aa, Artificial Sequence
  Description of Artificial Sequence: Synthetic polypeptide
DEEEIRTTNPVATEVYGSVSTNPDQMGGENRQ

SEQ ID NO: 37359 - protein, 32 aa, Artificial Sequence
  Description of Artificial Sequence: Synthetic polypeptide
DEEEIRTTNPVATEQYGSVCSSANLERGNQIE

SEQ ID NO: 37360 - protein, 33 aa, Artificial Sequence
  Description of Artificial Sequence: Synthetic polypeptide
DEEEIRTTNPVATEVYGSVCSTQNLQDDGDNRF

SEQ ID NO: 37361 - protein, 29 aa, Artificial Sequence
  Description of Artificial Sequence: Synthetic peptide
DEAEIATTNPVATDQYGSVPTQLDQRGND

SEQ ID NO: 37362 - protein, 29 aa, Artificial Sequence
  Description of Artificial Sequence: Synthetic peptide
DENEIATTNPVATEQYGSVAMNLQQVGNQ

SEQ ID NO: 37363 - protein, 32 aa, Artificial Sequence
  Description of Artificial Sequence: Synthetic polypeptide
DEEEIRTTNPVATETYGSVSTNLVQQGGGNGN

SEQ ID NO: 37364 - protein, 32 aa, Artificial Sequence
  Description of Artificial Sequence: Synthetic polypeptide
DEEEIRTTNPVATETYGSVSTNLVQGGGNGNT

SEQ ID NO: 37365 - protein, 32 aa, Artificial Sequence
  Description of Artificial Sequence: Synthetic polypeptide
DEEEIRTTNPVATETYGSVSTNLVQGGGGNTS

SEQ ID NO: 37366 - protein, 31 aa, Artificial Sequence
  Description of Artificial Sequence: Synthetic polypeptide
DEEEIRTTNPVATEVYGSVDNTNLTRGGNGQ

SEQ ID NO: 37367 - protein, 28 aa, Artificial Sequence
  Description of Artificial Sequence: Synthetic peptide
DENEIATTNPVATEQYGSVANNLQNGPE

SEQ ID NO: 37368 - protein, 32 aa, Artificial Sequence
  Description of Artificial Sequence: Synthetic polypeptide
DEEEIRTTNPVATEQYGSVCSSNDQRFGSNTQ

SEQ ID NO: 37369 - protein, 29 aa, Artificial Sequence
  Description of Artificial Sequence: Synthetic peptide
DEEEIRTTNPVATEVYGSVTTNNILAGNG

SEQ ID NO: 37370 - protein, 31 aa, Artificial Sequence
  Description of Artificial Sequence: Synthetic polypeptide
DEEEIRTTNPVATEQYGSVCSTDLQGGSEIP

SEQ ID NO: 37371 - protein, 32 aa, Artificial Sequence
  Description of Artificial Sequence: Synthetic polypeptide
DEEEIRTTNPVATEQYGSVCSTDGLVMFEGNR

SEQ ID NO: 37372 - protein, 29 aa, Artificial Sequence
  Description of Artificial Sequence: Synthetic peptide
DENEIATTNPVATEQWGSASEINEQRGNR

SEQ ID NO: 37373 - protein, 31 aa, Artificial Sequence
  Description of Artificial Sequence: Synthetic polypeptide
DEEEIRTTNPVATEQYGSVCSTDDLQDMNDP

SEQ ID NO: 37374 - protein, 31 aa, Artificial Sequence
  Description of Artificial Sequence: Synthetic polypeptide
DEEEIRTTNPVATEQYGSVCSTCLETGNNVS

SEQ ID NO: 37375 - protein, 32 aa, Artificial Sequence
  Description of Artificial Sequence: Synthetic polypeptide
DEEEIRTTNPVATEQYGSVCSTAPQRFGSDRP

SEQ ID NO: 37376 - protein, 31 aa, Artificial Sequence
  Description of Artificial Sequence: Synthetic polypeptide
DEEEIRTTNPVATEQYGSVCSSNHQGFGNQV

SEQ ID NO: 37377 - protein, 32 aa, Artificial Sequence
  Description of Artificial Sequence: Synthetic polypeptide
DEEEIRTTNPVATEQYGSVCSTALQERGSEQI

SEQ ID NO: 37378 - protein, 31 aa, Artificial Sequence
  Description of Artificial Sequence: Synthetic polypeptide
DEEEIRTTNPVATEQYGSVCSTAHQSGSNAA

SEQ ID NO: 37379 - protein, 29 aa, Artificial Sequence
  Description of Artificial Sequence: Synthetic peptide
DENEIATTNPVATEQYGDVSENLQNAGNA

SEQ ID NO: 37380 - protein, 29 aa, Artificial Sequence
  Description of Artificial Sequence: Synthetic peptide
DENEIATTNPVATEQYGDVSENLQNSGNA

SEQ ID NO: 37381 - protein, 33 aa, Artificial Sequence
  Description of Artificial Sequence: Synthetic polypeptide
DEEEIRTTNPVATEQYGSVCSSPELQRFGSNRT

SEQ ID NO: 37382 - protein, 31 aa, Artificial Sequence
  Description of Artificial Sequence: Synthetic polypeptide
DEEEIRTTNPVATEQYGSVCSSNLQYGSDAP

SEQ ID NO: 37383 - protein, 31 aa, Artificial Sequence
  Description of Artificial Sequence: Synthetic polypeptide
DEEEIRTTNPVATEQYGSVCSSNLQGQSNNQ

SEQ ID NO: 37384 - protein, 31 aa, Artificial Sequence
  Description of Artificial Sequence: Synthetic polypeptide
DEEEIRTTNPVATEQYGSVCSTAHQTGSNQS

SEQ ID NO: 37385 - protein, 32 aa, Artificial Sequence
  Description of Artificial Sequence: Synthetic polypeptide
DEEEIRTTNPVATEQYGSVCSTEAHQRGSNLS

SEQ ID NO: 37386 - protein, 29 aa, Artificial Sequence
  Description of Artificial Sequence: Synthetic peptide
DENEIATTNPVATEQYGSVATNDQNGNDN

SEQ ID NO: 37387 - protein, 31 aa, Artificial Sequence
  Description of Artificial Sequence: Synthetic polypeptide
DEEEIRTTNPVATEQYGSVCSPTNPMREERI

SEQ ID NO: 37388 - protein, 30 aa, Artificial Sequence
  Description of Artificial Sequence: Synthetic polypeptide
DEEEIATTNPVAYEQWGSVSTNLQDGGVDR

SEQ ID NO: 37389 - protein, 31 aa, Artificial Sequence
  Description of Artificial Sequence: Synthetic polypeptide
DENEIATTNPVATEQYGSVSENLIGNRGHNR

SEQ ID NO: 37390 - protein, 32 aa, Artificial Sequence
  Description of Artificial Sequence: Synthetic polypeptide
DEEEIATTNPVATEHYGSVSTNLQPQGDNERM

SEQ ID NO: 37391 - protein, 30 aa, Artificial Sequence
  Description of Artificial Sequence: Synthetic polypeptide
DEAEIATTNPVATEIYGSVSTNLQGGDTRM

SEQ ID NO: 37392 - protein, 28 aa, Artificial Sequence
  Description of Artificial Sequence: Synthetic peptide
DEAEIATTNPVATEMWGSVSTDLDNGNR

SEQ ID NO: 37393 - protein, 30 aa, Artificial Sequence
  Description of Artificial Sequence: Synthetic polypeptide
DEAEIATTNPVATENYGSVSTNLQQMGGNS

SEQ ID NO: 37394 - protein, 30 aa, Artificial Sequence
  Description of Artificial Sequence: Synthetic polypeptide
DEAEIATTNPVATEHYGTVSTNLQRDGNDI

SEQ ID NO: 37395 - protein, 30 aa, Artificial Sequence
  Description of Artificial Sequence: Synthetic polypeptide
DEAEIATTNPVATEPYGSVAATNEQRGNDR

SEQ ID NO: 37396 - protein, 32 aa, Artificial Sequence
  Description of Artificial Sequence: Synthetic polypeptide
DEEEIATTNPVATEHYGSVSTNLQGQDGNDRM

SEQ ID NO: 37397 - protein, 28 aa, Artificial Sequence
  Description of Artificial Sequence: Synthetic peptide
DENEIATTNPVATEQYGSVSTDLQHEEL

SEQ ID NO: 37398 - protein, 31 aa, Artificial Sequence
  Description of Artificial Sequence: Synthetic polypeptide
DEEEIATTNPVAYEQWGSVSTNLQHQGNDDR

SEQ ID NO: 37399 - protein, 29 aa, Artificial Sequence
  Description of Artificial Sequence: Synthetic peptide
DEAEIATTNPVATEPYGSVATNDQRGPNQ

SEQ ID NO: 37400 - protein, 32 aa, Artificial Sequence
  Description of Artificial Sequence: Synthetic polypeptide
DEEEIRTTNPVATEQYGSVCSPNLQTQGELRT

SEQ ID NO: 37401 - protein, 28 aa, Artificial Sequence
  Description of Artificial Sequence: Synthetic peptide
DENEIATTNPVATESYGSVSNNLQDGTQ

SEQ ID NO: 37402 - protein, 32 aa, Artificial Sequence
  Description of Artificial Sequence: Synthetic polypeptide
DEEEIRTTNPVATETYGQSVVCTNELQRGNNM

SEQ ID NO: 37403 - protein, 29 aa, Artificial Sequence
  Description of Artificial Sequence: Synthetic peptide
DEAEIATTNPVATECYGAVSTNLQNGDER

SEQ ID NO: 37404 - protein, 31 aa, Artificial Sequence
  Description of Artificial Sequence: Synthetic polypeptide
DEEEIATTNPVATEHYGSVSTNLQQGGDERN

SEQ ID NO: 37405 - protein, 31 aa, Artificial Sequence
  Description of Artificial Sequence: Synthetic polypeptide
DEAEIATTNPVATEHYGSVSTNLQRDGNNAG

SEQ ID NO: 37406 - protein, 33 aa, Artificial Sequence
  Description of Artificial Sequence: Synthetic polypeptide
DEEEIRTTNPVATEQYGSVCSPTNLPEREENRI

SEQ ID NO: 37407 - protein, 32 aa, Artificial Sequence
  Description of Artificial Sequence: Synthetic polypeptide
DEEEIRTTNPVATETYGSVSTNLVGQGEGNNN

SEQ ID NO: 37408 - protein, 29 aa, Artificial Sequence
  Description of Artificial Sequence: Synthetic peptide
DEEEIATTNPVATEIYGSVATNLQRTPEE

SEQ ID NO: 37409 - protein, 30 aa, Artificial Sequence
  Description of Artificial Sequence: Synthetic polypeptide
DENEIATTNPVATEQYGSVATNLQQGNNQM

SEQ ID NO: 37410 - protein, 29 aa, Artificial Sequence
  Description of Artificial Sequence: Synthetic peptide
CEGTIRTTNPVATEQYGSVTSTNLIIGNG

SEQ ID NO: 37411 - protein, 30 aa, Artificial Sequence
  Description of Artificial Sequence: Synthetic polypeptide
DEAEIATTNPVATEEYGSVSTNLQGDGNDA

SEQ ID NO: 37412 - protein, 28 aa, Artificial Sequence
  Description of Artificial Sequence: Synthetic peptide
DENEIATTNPVATEQYGSVSECLQHGEL

SEQ ID NO: 37413 - protein, 31 aa, Artificial Sequence
  Description of Artificial Sequence: Synthetic polypeptide
DEEEIATTNPVATEHYGVVSTNLQGDAGNNR

SEQ ID NO: 37414 - protein, 30 aa, Artificial Sequence
  Description of Artificial Sequence: Synthetic polypeptide
DEAEIATTNPVATEHYGSVSTNLQGDGDNT

SEQ ID NO: 37415 - protein, 31 aa, Artificial Sequence
  Description of Artificial Sequence: Synthetic polypeptide
DEEEIRTTNPVATEQYGSVCSPTNLERETEG

SEQ ID NO: 37416 - protein, 30 aa, Artificial Sequence
  Description of Artificial Sequence: Synthetic polypeptide
DEAEIATTNPVATEHYGSVSTNLQGDGNDK

SEQ ID NO: 37417 - protein, 32 aa, Artificial Sequence
  Description of Artificial Sequence: Synthetic polypeptide
DEEEIRTTNPVATEQYGSVCSPTNLEREQERN

SEQ ID NO: 37418 - protein, 31 aa, Artificial Sequence
  Description of Artificial Sequence: Synthetic polypeptide
DEAEIATTNPVATEHYGSVSTNLQRDGMNDE

SEQ ID NO: 37419 - protein, 31 aa, Artificial Sequence
  Description of Artificial Sequence: Synthetic polypeptide
DEAEIATTNPVATEHYGSVSTNLQRDGMNDL

SEQ ID NO: 37420 - protein, 29 aa, Artificial Sequence
  Description of Artificial Sequence: Synthetic peptide
DEAEIATTNPVATEGYGSVSTNDTRGNDQ

SEQ ID NO: 37421 - protein, 30 aa, Artificial Sequence
  Description of Artificial Sequence: Synthetic polypeptide
DENEIATTNPVATEIYGSVSNNLQRGNEDA

SEQ ID NO: 37422 - protein, 29 aa, Artificial Sequence
  Description of Artificial Sequence: Synthetic peptide
DEEEIRTTNPVATEYYGCISTNEQRSNFF

SEQ ID NO: 37423 - protein, 29 aa, Artificial Sequence
  Description of Artificial Sequence: Synthetic peptide
DEEEIRTTNPVATEYYGCSSTNEQRPNFA

SEQ ID NO: 37424 - protein, 31 aa, Artificial Sequence
  Description of Artificial Sequence: Synthetic polypeptide
DEEEIRTTNPVATEQYGSVCSTELQIGSELI

SEQ ID NO: 37425 - protein, 31 aa, Artificial Sequence
  Description of Artificial Sequence: Synthetic polypeptide
DEEEIRTTNPVATEQYGSVCSTELQGNSNAM

SEQ ID NO: 37426 - protein, 31 aa, Artificial Sequence
  Description of Artificial Sequence: Synthetic polypeptide
DEEEIRTTNPVATEQYGSVMSTLPLDQLEND

SEQ ID NO: 37427 - protein, 30 aa, Artificial Sequence
  Description of Artificial Sequence: Synthetic polypeptide
DEEEIRTTNPVATEQYGSVCSTELQFNQQM

SEQ ID NO: 37428 - protein, 30 aa, Artificial Sequence
  Description of Artificial Sequence: Synthetic polypeptide
DENEIACTNPVATEQYGSVSTNGPQRGGPR

SEQ ID NO: 37429 - protein, 31 aa, Artificial Sequence
  Description of Artificial Sequence: Synthetic polypeptide
DEEEIRTTNPVATEQYGSVCSTELQFGSVQP

SEQ ID NO: 37430 - protein, 30 aa, Artificial Sequence
  Description of Artificial Sequence: Synthetic polypeptide
DEEEIATTNPVATEPYGSVCANNLTRGGNR

SEQ ID NO: 37431 - protein, 29 aa, Artificial Sequence
  Description of Artificial Sequence: Synthetic peptide
DENEIACTNPVATEQYGSVSTNLEDHGER

SEQ ID NO: 37432 - protein, 32 aa, Artificial Sequence
  Description of Artificial Sequence: Synthetic polypeptide
DEEEIRTTNPVATEQYGSVCSTELNQNGSDNQ

SEQ ID NO: 37433 - protein, 29 aa, Artificial Sequence
  Description of Artificial Sequence: Synthetic peptide
DEEEIATTNPVATEPYGSVATNLQQENDT

SEQ ID NO: 37434 - protein, 33 aa, Artificial Sequence
  Description of Artificial Sequence: Synthetic polypeptide
DEEEIRTTNPVATEQYGSVCSTELNQHSGSNRG

SEQ ID NO: 37435 - protein, 31 aa, Artificial Sequence
  Description of Artificial Sequence: Synthetic polypeptide
DEEEIATTNPVATEPYGQSVSTNLGLGGNQR

SEQ ID NO: 37436 - protein, 29 aa, Artificial Sequence
  Description of Artificial Sequence: Synthetic peptide
DEEEIATTNPVATEPYGNVATNLQQGNDL

SEQ ID NO: 37437 - protein, 28 aa, Artificial Sequence
  Description of Artificial Sequence: Synthetic peptide
DENEIACTNPVATEQYGTISMNLQRGGR

SEQ ID NO: 37438 - protein, 29 aa, Artificial Sequence
  Description of Artificial Sequence: Synthetic peptide
DENEIACTNPVATEQYGSVSTNLEDHGGR

SEQ ID NO: 37439 - protein, 32 aa, Artificial Sequence
  Description of Artificial Sequence: Synthetic polypeptide
DEEEIATTNPVATEPYGKVISTNLSQREGGNR

SEQ ID NO: 37440 - protein, 30 aa, Artificial Sequence
  Description of Artificial Sequence: Synthetic polypeptide
DEEEIATTNPVATEPYGSVCATNLTQGGDR

SEQ ID NO: 37441 - protein, 32 aa, Artificial Sequence
  Description of Artificial Sequence: Synthetic polypeptide
DEEEIRTTNPVATEQYGSVCSTELQRSLSNDP

SEQ ID NO: 37442 - protein, 31 aa, Artificial Sequence
  Description of Artificial Sequence: Synthetic polypeptide
DEEEIRTTNPVATEQYGSVCSTENHQHNNQM

SEQ ID NO: 37443 - protein, 32 aa, Artificial Sequence
  Description of Artificial Sequence: Synthetic polypeptide
DEEEIRTTNPVAVEQYGSVSTTNGQLQNGQER

SEQ ID NO: 37444 - protein, 31 aa, Artificial Sequence
  Description of Artificial Sequence: Synthetic polypeptide
DEEEIRTTNPVATEQYGSVCSTENEQYNSND

SEQ ID NO: 37445 - protein, 32 aa, Artificial Sequence
  Description of Artificial Sequence: Synthetic polypeptide
DEEEIRTTNPVATEQYGSVCSTENEQNGSNQI

SEQ ID NO: 37446 - protein, 29 aa, Artificial Sequence
  Description of Artificial Sequence: Synthetic peptide
DENEIACTNPVATEQYGEASENLQREGNR

SEQ ID NO: 37447 - protein, 28 aa, Artificial Sequence
  Description of Artificial Sequence: Synthetic peptide
DENEIACTNPVATEQYGEASENLQRGGR

SEQ ID NO: 37448 - protein, 28 aa, Artificial Sequence
  Description of Artificial Sequence: Synthetic peptide
DENEIACTNPVATEQYGEVSENLQRGGV

SEQ ID NO: 37449 - protein, 32 aa, Artificial Sequence
  Description of Artificial Sequence: Synthetic polypeptide
DEEEIRTTNPVATEQYGSVCSTENEQFGSNDF

SEQ ID NO: 37450 - protein, 31 aa, Artificial Sequence
  Description of Artificial Sequence: Synthetic polypeptide
DEEEIRTTNPVATEQYGSVCSTENEINGSND

SEQ ID NO: 37451 - protein, 28 aa, Artificial Sequence
  Description of Artificial Sequence: Synthetic peptide
DENEIACTNPVATEQYGEISMNLQRGGR

SEQ ID NO: 37452 - protein, 34 aa, Artificial Sequence
  Description of Artificial Sequence: Synthetic polypeptide
DEEEIRTTNPVATEQYGSVCSTENDLQFGSNNRP

SEQ ID NO: 37453 - protein, 31 aa, Artificial Sequence
  Description of Artificial Sequence: Synthetic polypeptide
DEEEIRTTNPVATEQYGSVCSTELQYFGDIA

SEQ ID NO: 37454 - protein, 30 aa, Artificial Sequence
  Description of Artificial Sequence: Synthetic polypeptide
DENEIACTNPVATEQYGEVSENLPQREGNR

SEQ ID NO: 37455 - protein, 31 aa, Artificial Sequence
  Description of Artificial Sequence: Synthetic polypeptide
DEEEIRTTNPVATEQYGSVCSTELQRTSDTQ

SEQ ID NO: 37456 - protein, 28 aa, Artificial Sequence
  Description of Artificial Sequence: Synthetic peptide
DENEIACTNPVATEQYGEASMNLQRGGR

SEQ ID NO: 37457 - protein, 29 aa, Artificial Sequence
  Description of Artificial Sequence: Synthetic peptide
DENEIACTNPVATEQYGTVSAENLQFGNR

SEQ ID NO: 37458 - protein, 31 aa, Artificial Sequence
  Description of Artificial Sequence: Synthetic polypeptide
DEEEIRTTNPVATEQYGSVCSTELLEYGNIK

SEQ ID NO: 37459 - protein, 31 aa, Artificial Sequence
  Description of Artificial Sequence: Synthetic polypeptide
DEEEIRTTNPVATEQYGSVCSTELIHNSNRL

SEQ ID NO: 37460 - protein, 31 aa, Artificial Sequence
  Description of Artificial Sequence: Synthetic polypeptide
DEEEIRTTNPVATEQYGSVCSTEELQHGSVI

SEQ ID NO: 37461 - protein, 30 aa, Artificial Sequence
  Description of Artificial Sequence: Synthetic polypeptide
DEAEIASTNPVAYEQYGSVSTNLQRGPDRE

SEQ ID NO: 37462 - protein, 30 aa, Artificial Sequence
  Description of Artificial Sequence: Synthetic polypeptide
DEEEIRTTNPVATEYYGSVSTELQFGSEDS

SEQ ID NO: 37463 - protein, 32 aa, Artificial Sequence
  Description of Artificial Sequence: Synthetic polypeptide
DEEEIRTTNPVATEYYGSVSTDNNLADRGNQG

SEQ ID NO: 37464 - protein, 30 aa, Artificial Sequence
  Description of Artificial Sequence: Synthetic polypeptide
DENEIATTNPVATECYGSASEINLQREGNR

SEQ ID NO: 37465 - protein, 30 aa, Artificial Sequence
  Description of Artificial Sequence: Synthetic polypeptide
DENEIATTNPVATECYGSVSCNEPQRGENR

SEQ ID NO: 37466 - protein, 30 aa, Artificial Sequence
  Description of Artificial Sequence: Synthetic polypeptide
DEAEIASTNPVATEQYGVVSTNLQRGPERD

SEQ ID NO: 37467 - protein, 31 aa, Artificial Sequence
  Description of Artificial Sequence: Synthetic polypeptide
DEEEIRTTNPVATEQYGSVMTNEFQEEDNQR

SEQ ID NO: 37468 - protein, 31 aa, Artificial Sequence
  Description of Artificial Sequence: Synthetic polypeptide
DEEEIRTTNPVATEQYGSVCSTEEEQRGSED

SEQ ID NO: 37469 - protein, 29 aa, Artificial Sequence
  Description of Artificial Sequence: Synthetic peptide
DEAEIATTNGVAYCQYGSVSTGNLQRGDR

SEQ ID NO: 37470 - protein, 31 aa, Artificial Sequence
  Description of Artificial Sequence: Synthetic polypeptide
DEEEIRTTNPVATEYYGSAVSTALQHGENIP

SEQ ID NO: 37471 - protein, 30 aa, Artificial Sequence
  Description of Artificial Sequence: Synthetic polypeptide
DEEEIATTNPVATENYGSVSTNNQGNGNDG

SEQ ID NO: 37472 - protein, 32 aa, Artificial Sequence
  Description of Artificial Sequence: Synthetic polypeptide
DEEEIRTTNPVATEQYGSVCSTEDTQEHGSNR

SEQ ID NO: 37473 - protein, 33 aa, Artificial Sequence
  Description of Artificial Sequence: Synthetic polypeptide
DEEEIRTTNPVATEQYGSVCSTEDLQRFGSERQ

SEQ ID NO: 37474 - protein, 32 aa, Artificial Sequence
  Description of Artificial Sequence: Synthetic polypeptide
DEEEIRTTNPVATEQYGSVCSTEEHQNFGNRV

SEQ ID NO: 37475 - protein, 28 aa, Artificial Sequence
  Description of Artificial Sequence: Synthetic peptide
DEAEIAQTNPVATEMYGSTSCNLQRGNY

SEQ ID NO: 37476 - protein, 31 aa, Artificial Sequence
  Description of Artificial Sequence: Synthetic polypeptide
DEEEIRTTNPVATEQYGSVCSTEHQAGSNLF

SEQ ID NO: 37477 - protein, 28 aa, Artificial Sequence
  Description of Artificial Sequence: Synthetic peptide
DENEIATTNPVATECYGATSENLQRGGR

SEQ ID NO: 37478 - protein, 32 aa, Artificial Sequence
  Description of Artificial Sequence: Synthetic polypeptide
DEEEIRTTNPVAVEQYGQVVSTNDLLQRGEMR

SEQ ID NO: 37479 - protein, 28 aa, Artificial Sequence
  Description of Artificial Sequence: Synthetic peptide
DEAEIACTNPVATEQYGSVATNDDRGND

SEQ ID NO: 37480 - protein, 28 aa, Artificial Sequence
  Description of Artificial Sequence: Synthetic peptide
DENEIATTNCVAYYQYGSVATNLQRGDR

SEQ ID NO: 37481 - protein, 34 aa, Artificial Sequence
  Description of Artificial Sequence: Synthetic polypeptide
DEEEIRTTNPVATEQYGSVCSTELHQERFGSNRS

SEQ ID NO: 37482 - protein, 31 aa, Artificial Sequence
  Description of Artificial Sequence: Synthetic polypeptide
DEEEIRTTNPVATEQYGSVCSTELENGSNND

SEQ ID NO: 37483 - protein, 28 aa, Artificial Sequence
  Description of Artificial Sequence: Synthetic peptide
DEAEIACTNPVATEQYGSVATNLQSGSD

SEQ ID NO: 37484 - protein, 30 aa, Artificial Sequence
  Description of Artificial Sequence: Synthetic polypeptide
DEEEIRTTNPVATMQYGTVSYNLQEFFNNR

SEQ ID NO: 37485 - protein, 31 aa, Artificial Sequence
  Description of Artificial Sequence: Synthetic polypeptide
DEEEIRTTNPVATEQYGSVCSTEHQSGSNTA

SEQ ID NO: 37486 - protein, 29 aa, Artificial Sequence
  Description of Artificial Sequence: Synthetic peptide
DEAEIACTNPVATEQYGSVATNLTRDGND

SEQ ID NO: 37487 - protein, 29 aa, Artificial Sequence
  Description of Artificial Sequence: Synthetic peptide
DENEIATTNPVATDQYGVVSTALQRGNND

SEQ ID NO: 37488 - protein, 29 aa, Artificial Sequence
  Description of Artificial Sequence: Synthetic peptide
DENEIATTNPVATEAYGSVSANLQQRGTM

SEQ ID NO: 37489 - protein, 32 aa, Artificial Sequence
  Description of Artificial Sequence: Synthetic polypeptide
DEEEIRTTNPVATEQYGSVCSTEHQRGSNDAV

SEQ ID NO: 37490 - protein, 31 aa, Artificial Sequence
  Description of Artificial Sequence: Synthetic polypeptide
DEEEIRTTNPVATEQYGSVCSTEHQRFLNQA

SEQ ID NO: 37491 - protein, 31 aa, Artificial Sequence
  Description of Artificial Sequence: Synthetic polypeptide
DEAEIACTNPVATEQYGSVSTNLQREEGTRE

SEQ ID NO: 37492 - protein, 31 aa, Artificial Sequence
  Description of Artificial Sequence: Synthetic polypeptide
DEEEIRTTNPVATEQYGSVMTGLSQRGGEDN

SEQ ID NO: 37493 - protein, 32 aa, Artificial Sequence
  Description of Artificial Sequence: Synthetic polypeptide
DEEEIRTTNPVATEQYGSVCSTENHQSFGNVV

SEQ ID NO: 37494 - protein, 29 aa, Artificial Sequence
  Description of Artificial Sequence: Synthetic peptide
DEGEIRPTNPVATEQYGIVSCNLQNAGDR

SEQ ID NO: 37495 - protein, 33 aa, Artificial Sequence
  Description of Artificial Sequence: Synthetic polypeptide
DEEEIRTTNPVAYEAYGSVSCTQNLDQRGGNNR

SEQ ID NO: 37496 - protein, 32 aa, Artificial Sequence
  Description of Artificial Sequence: Synthetic polypeptide
DEEEIRTTNPVAYEAYGSVSQQNMLSQRGGNR

SEQ ID NO: 37497 - protein, 30 aa, Artificial Sequence
  Description of Artificial Sequence: Synthetic polypeptide
DEEEIRTTNPVAYEQWGKVSTNLSQEGGGR

SEQ ID NO: 37498 - protein, 31 aa, Artificial Sequence
  Description of Artificial Sequence: Synthetic polypeptide
DEEEIRTTNPVATEQYGSVITNLERAENSDE

SEQ ID NO: 37499 - protein, 31 aa, Artificial Sequence
  Description of Artificial Sequence: Synthetic polypeptide
DEMEIRCTNPVATEQYGSVCSTDNPVERGNR

SEQ ID NO: 37500 - protein, 30 aa, Artificial Sequence
  Description of Artificial Sequence: Synthetic polypeptide
DEEEIRTTNPVAYEQWGKVSCTNLQAGGTR

SEQ ID NO: 37501 - protein, 29 aa, Artificial Sequence
  Description of Artificial Sequence: Synthetic peptide
DEMEIRCTNPVATEQYGSVSEGPMREGNR

SEQ ID NO: 37502 - protein, 31 aa, Artificial Sequence
  Description of Artificial Sequence: Synthetic polypeptide
DEEEIATTNPVATEQYGSVVVTNLQHGGDNE

SEQ ID NO: 37503 - protein, 30 aa, Artificial Sequence
  Description of Artificial Sequence: Synthetic polypeptide
DEEEIRTTNPVATEQYGSVCSTNHESGSDQ

SEQ ID NO: 37504 - protein, 32 aa, Artificial Sequence
  Description of Artificial Sequence: Synthetic polypeptide
DEEEIATTNPVATEQYGSVYTANSLTDRGNDR

SEQ ID NO: 37505 - protein, 31 aa, Artificial Sequence
  Description of Artificial Sequence: Synthetic polypeptide
DEEEIRTTNPVAYEQWGKVPSTNELSQRGNS

SEQ ID NO: 37506 - protein, 29 aa, Artificial Sequence
  Description of Artificial Sequence: Synthetic peptide
DEMEIRTTNPVATAQYGCVSTNLERNNPY

SEQ ID NO: 37507 - protein, 30 aa, Artificial Sequence
  Description of Artificial Sequence: Synthetic polypeptide
DEMEIRTTNPVATCQYGCVCSTNLERGSNP

SEQ ID NO: 37508 - protein, 29 aa, Artificial Sequence
  Description of Artificial Sequence: Synthetic peptide
DEMEIRTTNPVATCQYGCVNNTELQRGNQ

SEQ ID NO: 37509 - protein, 29 aa, Artificial Sequence
  Description of Artificial Sequence: Synthetic peptide
DEMEIRTTNPVATCQYGCVNTALQRGNDS

SEQ ID NO: 37510 - protein, 32 aa, Artificial Sequence
  Description of Artificial Sequence: Synthetic polypeptide
DEEEIRTTNPVATEQYGSVITNLQMREDNDQD

SEQ ID NO: 37511 - protein, 29 aa, Artificial Sequence
  Description of Artificial Sequence: Synthetic peptide
DEMEIRTTNPVATAQYGCVSTNLERGQPP

SEQ ID NO: 37512 - protein, 28 aa, Artificial Sequence
  Description of Artificial Sequence: Synthetic peptide
DEMEIRTTNPVATCQYGCVNTPLQHGND

SEQ ID NO: 37513 - protein, 30 aa, Artificial Sequence
  Description of Artificial Sequence: Synthetic polypeptide
DEEEIRTTNPVAYEQWGKVSTNLSQRGGPS

SEQ ID NO: 37514 - protein, 32 aa, Artificial Sequence
  Description of Artificial Sequence: Synthetic polypeptide
DEEEIATTNPVATEQYGSVVSTTNDGQNNGNR

SEQ ID NO: 37515 - protein, 33 aa, Artificial Sequence
  Description of Artificial Sequence: Synthetic polypeptide
DEEEIRTTNPVAYEQWGSTVSTNALSQRGENNR

SEQ ID NO: 37516 - protein, 30 aa, Artificial Sequence
  Description of Artificial Sequence: Synthetic polypeptide
DELVISTTNPVATEQFGSVSTDTLQRQGNR

SEQ ID NO: 37517 - protein, 30 aa, Artificial Sequence
  Description of Artificial Sequence: Synthetic polypeptide
DEACIRTTNPVAFEQYGSISTNLQERPNFR

SEQ ID NO: 37518 - protein, 29 aa, Artificial Sequence
  Description of Artificial Sequence: Synthetic peptide
DEMCIRTTNPVATEQYGCVCETNPQRGNA

SEQ ID NO: 37519 - protein, 32 aa, Artificial Sequence
  Description of Artificial Sequence: Synthetic polypeptide
DEEEIATTNPVATEQYGSVVSTNGMQNGGDNR

SEQ ID NO: 37520 - protein, 28 aa, Artificial Sequence
  Description of Artificial Sequence: Synthetic peptide
DEMEIATTNPVATAQYGCVSTNLEQGNP

SEQ ID NO: 37521 - protein, 28 aa, Artificial Sequence
  Description of Artificial Sequence: Synthetic peptide
DEMEIATTNPVATQQYGCVSTALQNGNQ

SEQ ID NO: 37522 - protein, 29 aa, Artificial Sequence
  Description of Artificial Sequence: Synthetic peptide
DEMEIATTNPVATAQYGCVSTNLERGDND

SEQ ID NO: 37523 - protein, 31 aa, Artificial Sequence
  Description of Artificial Sequence: Synthetic polypeptide
DEEEIRTTNPVATEQYGSVITNEQPETGELR

SEQ ID NO: 37524 - protein, 33 aa, Artificial Sequence
  Description of Artificial Sequence: Synthetic polypeptide
DEEEIATTNPVATEQYGSVVSTNLSQNGGNNRK

SEQ ID NO: 37525 - protein, 31 aa, Artificial Sequence
  Description of Artificial Sequence: Synthetic polypeptide
DEEEIATTNPVATEQYGSVVSTNNIQTRGTD

SEQ ID NO: 37526 - protein, 30 aa, Artificial Sequence
  Description of Artificial Sequence: Synthetic polypeptide
DEMEIATTNPVATEQYGSVSANLGRNMNDR

SEQ ID NO: 37527 - protein, 32 aa, Artificial Sequence
  Description of Artificial Sequence: Synthetic polypeptide
DEEEIRTTNPVATEQYGSVCSTNHFERGSNAS

SEQ ID NO: 37528 - protein, 30 aa, Artificial Sequence
  Description of Artificial Sequence: Synthetic polypeptide
DEEEIRTTNPVATEQYGSVITNLDYMQQGQ

SEQ ID NO: 37529 - protein, 31 aa, Artificial Sequence
  Description of Artificial Sequence: Synthetic polypeptide
DEEEIRTTNPVAYEQWGQWVSCTNLQRGGNT

SEQ ID NO: 37530 - protein, 32 aa, Artificial Sequence
  Description of Artificial Sequence: Synthetic polypeptide
DEEEIRTTNPVAYEQWGSTVSYTNLSQRTENR

SEQ ID NO: 37531 - protein, 28 aa, Artificial Sequence
  Description of Artificial Sequence: Synthetic peptide
DEMEIRTTNPVATCQYGCVSTNHEQGNQ

SEQ ID NO: 37532 - protein, 29 aa, Artificial Sequence
  Description of Artificial Sequence: Synthetic peptide
DEMEIRTTNPVATCQYGCVSTNLERGQET

SEQ ID NO: 37533 - protein, 31 aa, Artificial Sequence
  Description of Artificial Sequence: Synthetic polypeptide
DEEEIRTTNPVATEQYGSVCSTNDQAGSDQS

SEQ ID NO: 37534 - protein, 29 aa, Artificial Sequence
  Description of Artificial Sequence: Synthetic peptide
DEMEIRTTNPVATEQYGCISTNTQYFGER

SEQ ID NO: 37535 - protein, 30 aa, Artificial Sequence
  Description of Artificial Sequence: Synthetic polypeptide
DAEEIATTNPVATEQWGSVTSTDLQRGTAR

SEQ ID NO: 37536 - protein, 32 aa, Artificial Sequence
  Description of Artificial Sequence: Synthetic polypeptide
DEEEIRTTNPVAYEPYGSVVSVTNLSQSGNNR

SEQ ID NO: 37537 - protein, 31 aa, Artificial Sequence
  Description of Artificial Sequence: Synthetic polypeptide
DEEEIATTNPVATEQYGVVACTNLTRVGNNR

SEQ ID NO: 37538 - protein, 32 aa, Artificial Sequence
  Description of Artificial Sequence: Synthetic polypeptide
DEEEIRTTNPVAYEPYGSVSVTNLSQHGGNPR

SEQ ID NO: 37539 - protein, 31 aa, Artificial Sequence
  Description of Artificial Sequence: Synthetic polypeptide
DEEEIRTTNPVAYEPYGTVSCTNLSNRGGNR

SEQ ID NO: 37540 - protein, 32 aa, Artificial Sequence
  Description of Artificial Sequence: Synthetic polypeptide
DEEEIRTTNPVAYEPYGSVSTWNELSQRTGNQ

SEQ ID NO: 37541 - protein, 29 aa, Artificial Sequence
  Description of Artificial Sequence: Synthetic peptide
DAEEIATTNPVATEQWGSVTSTALQQGQR

SEQ ID NO: 37542 - protein, 29 aa, Artificial Sequence
  Description of Artificial Sequence: Synthetic peptide
DEEEIATTNPVATEQYGVVSADNLQHGEQ

SEQ ID NO: 37543 - protein, 30 aa, Artificial Sequence
  Description of Artificial Sequence: Synthetic polypeptide
DEMEIRTTNPVATEQYGCTSTGNLQRGDQS

SEQ ID NO: 37544 - protein, 33 aa, Artificial Sequence
  Description of Artificial Sequence: Synthetic polypeptide
DEEEIRTTNPVAYEPYGSVSTNALSQRAGSNRY

SEQ ID NO: 37545 - protein, 29 aa, Artificial Sequence
  Description of Artificial Sequence: Synthetic peptide
DEMEIRTTNPVATEQYGCTSTNLQHSGDQ

SEQ ID NO: 37546 - protein, 30 aa, Artificial Sequence
  Description of Artificial Sequence: Synthetic polypeptide
DEEEIATTNPVATEQYGVVSATNLQDHGEQ

SEQ ID NO: 37547 - protein, 29 aa, Artificial Sequence
  Description of Artificial Sequence: Synthetic peptide
DAEEIATTNPVATEQWGSVTSTALQRDDR

SEQ ID NO: 37548 - protein, 30 aa, Artificial Sequence
  Description of Artificial Sequence: Synthetic polypeptide
DEEEIRTTNPVAYEQWGKVACTNLSQRGNS

SEQ ID NO: 37549 - protein, 30 aa, Artificial Sequence
  Description of Artificial Sequence: Synthetic polypeptide
DEEEIATTNPVATEQYGTVSTTNGDNGNER

SEQ ID NO: 37550 - protein, 31 aa, Artificial Sequence
  Description of Artificial Sequence: Synthetic polypeptide
DEEEIATTNPVATEQYGTVSTNLQHGGDGNA

SEQ ID NO: 37551 - protein, 30 aa, Artificial Sequence
  Description of Artificial Sequence: Synthetic polypeptide
DEMEIRTTNPVATCQYGCVSTNLERGSNTQ

SEQ ID NO: 37552 - protein, 30 aa, Artificial Sequence
  Description of Artificial Sequence: Synthetic polypeptide
DEEEIATTNPVATEQWGSVSENLQDGNEVD

SEQ ID NO: 37553 - protein, 28 aa, Artificial Sequence
  Description of Artificial Sequence: Synthetic peptide
DEMEIRTTNPVATCQYGQVSTVVERGNP

SEQ ID NO: 37554 - protein, 32 aa, Artificial Sequence
  Description of Artificial Sequence: Synthetic polypeptide
DEEEIRTTNPVATEQYGSVCSTNDQNSGSERG

SEQ ID NO: 37555 - protein, 30 aa, Artificial Sequence
  Description of Artificial Sequence: Synthetic polypeptide
DEMEIRTTNPVATCQYGSVNTQLQRSGSNQ

SEQ ID NO: 37556 - protein, 29 aa, Artificial Sequence
  Description of Artificial Sequence: Synthetic peptide
DEMEIRTTNPVATDQYGCVCGTPLQRGND

SEQ ID NO: 37557 - protein, 31 aa, Artificial Sequence
  Description of Artificial Sequence: Synthetic polypeptide
DEMEIRTTNPVATEQYGCAVCSTELQNGSNR

SEQ ID NO: 37558 - protein, 30 aa, Artificial Sequence
  Description of Artificial Sequence: Synthetic polypeptide
DEMEIRTTNPVATDQYGCVSTNELERQGNG

SEQ ID NO: 37559 - protein, 32 aa, Artificial Sequence
  Description of Artificial Sequence: Synthetic polypeptide
DEEEIRTTNPVATEQYGSVCSTNDQHMGSNAS

SEQ ID NO: 37560 - protein, 31 aa, Artificial Sequence
  Description of Artificial Sequence: Synthetic polypeptide
DEEEIRTTNPVATEQYGSVITNLQQNEETRE

SEQ ID NO: 37561 - protein, 32 aa, Artificial Sequence
  Description of Artificial Sequence: Synthetic polypeptide
DEEEIRTTNPVATEQYGSVCSTNDQGFGNFQS

SEQ ID NO: 37562 - protein, 32 aa, Artificial Sequence
  Description of Artificial Sequence: Synthetic polypeptide
DEEEIATTNPVATEQYGTVSCTNLSQRGGNQT

SEQ ID NO: 37563 - protein, 30 aa, Artificial Sequence
  Description of Artificial Sequence: Synthetic polypeptide
DEEEIRTTNPVAYEQDGSVSTGNLGMGNNG

SEQ ID NO: 37564 - protein, 32 aa, Artificial Sequence
  Description of Artificial Sequence: Synthetic polypeptide
DEACIRTTNPVATEQYGSVPSTNLSQRPGNNM

SEQ ID NO: 37565 - protein, 29 aa, Artificial Sequence
  Description of Artificial Sequence: Synthetic peptide
DEMEIRTTNPVATDQYGCVSTNLENGENP

SEQ ID NO: 37566 - protein, 31 aa, Artificial Sequence
  Description of Artificial Sequence: Synthetic polypeptide
DEEEIRTTNPVATEQYGSVCSTNHIGGSNIT

SEQ ID NO: 37567 - protein, 32 aa, Artificial Sequence
  Description of Artificial Sequence: Synthetic polypeptide
DEEEIATTNPVATEQYGSVVSTGNLGDGNNHR

SEQ ID NO: 37568 - protein, 31 aa, Artificial Sequence
  Description of Artificial Sequence: Synthetic polypeptide
DEEEIATTNPVATEQYGSVVSTGNDGAGNHR

SEQ ID NO: 37569 - protein, 32 aa, Artificial Sequence
  Description of Artificial Sequence: Synthetic polypeptide
DEEEIRTTNPVATEQYGSVISTTMLEQRENNI

SEQ ID NO: 37570 - protein, 31 aa, Artificial Sequence
  Description of Artificial Sequence: Synthetic polypeptide
DAEEICTTNPVATEQYGSVCATNLQQGVNER

SEQ ID NO: 37571 - protein, 30 aa, Artificial Sequence
  Description of Artificial Sequence: Synthetic polypeptide
DAEEICSTNPVATEQYGSVATNLQARGGDR

SEQ ID NO: 37572 - protein, 32 aa, Artificial Sequence
  Description of Artificial Sequence: Synthetic polypeptide
DEEEIATTNPVATEQYGSVSTTNGTQGDGNHR

SEQ ID NO: 37573 - protein, 33 aa, Artificial Sequence
  Description of Artificial Sequence: Synthetic polypeptide
DEEEIRTTNPVATEQYGSVISTTNLQGDGNDIE

SEQ ID NO: 37574 - protein, 31 aa, Artificial Sequence
  Description of Artificial Sequence: Synthetic polypeptide
DEHEIRTTNPVAYEQWGSVSTNLQRGGDNGQ

SEQ ID NO: 37575 - protein, 30 aa, Artificial Sequence
  Description of Artificial Sequence: Synthetic polypeptide
DAEEIGSTNPVATEQYGSVSTNLQAYNGER

SEQ ID NO: 37576 - protein, 32 aa, Artificial Sequence
  Description of Artificial Sequence: Synthetic polypeptide
DEEEIRTTNPVATEQYGSVCSTNHQRSGETQD

SEQ ID NO: 37577 - protein, 32 aa, Artificial Sequence
  Description of Artificial Sequence: Synthetic polypeptide
DEEEIRTTNPVAYEQYGATVSCTGNLSQGGNR

SEQ ID NO: 37578 - protein, 32 aa, Artificial Sequence
  Description of Artificial Sequence: Synthetic polypeptide
DEEEIRTTNPVATEQYGSVCSTNHQNMGSNLT

SEQ ID NO: 37579 - protein, 33 aa, Artificial Sequence
  Description of Artificial Sequence: Synthetic polypeptide
DEEEIRTTNPVAYEQWGVSVSATNDLDQRGNQR

SEQ ID NO: 37580 - protein, 30 aa, Artificial Sequence
  Description of Artificial Sequence: Synthetic polypeptide
DEEEIRTTNPVATEQYGSVCSTNHQNFDQT

SEQ ID NO: 37581 - protein, 30 aa, Artificial Sequence
  Description of Artificial Sequence: Synthetic polypeptide
DEHEIRTTNPVAYEQYGNVSTNLQDGNNQS

SEQ ID NO: 37582 - protein, 29 aa, Artificial Sequence
  Description of Artificial Sequence: Synthetic peptide
DEEEIATTNPVATEQWGSVSMNLQDQGTQ

SEQ ID NO: 37583 - protein, 31 aa, Artificial Sequence
  Description of Artificial Sequence: Synthetic polypeptide
DEEEIATTNPVATEQYGSVSTTNQQHGENGQ

SEQ ID NO: 37584 - protein, 33 aa, Artificial Sequence
  Description of Artificial Sequence: Synthetic polypeptide
DEEEIRTTNPVATEQYGSVISTWLQTPGENERF

SEQ ID NO: 37585 - protein, 33 aa, Artificial Sequence
  Description of Artificial Sequence: Synthetic polypeptide
DEEEIRTTNPVATEQYGSVISTSNLQRMIENDD

SEQ ID NO: 37586 - protein, 30 aa, Artificial Sequence
  Description of Artificial Sequence: Synthetic polypeptide
DEEEIATTNPVATEQWGSVSPNPQRGNDQL

SEQ ID NO: 37587 - protein, 31 aa, Artificial Sequence
  Description of Artificial Sequence: Synthetic polypeptide
DAEEIRSTNPVATEQYGSVSTNLNDAGNGQR

SEQ ID NO: 37588 - protein, 32 aa, Artificial Sequence
  Description of Artificial Sequence: Synthetic polypeptide
DAEEIRSTNPVATEQYGSVSTDNLGQAGNGQR

SEQ ID NO: 37589 - protein, 31 aa, Artificial Sequence
  Description of Artificial Sequence: Synthetic polypeptide
DEEEIRTTNPVATEQYGSVCSTNLAFPSNDY

SEQ ID NO: 37590 - protein, 32 aa, Artificial Sequence
  Description of Artificial Sequence: Synthetic polypeptide
DAEEIRSTNPVATEQYGSVSFTNLQARNGSER

SEQ ID NO: 37591 - protein, 33 aa, Artificial Sequence
  Description of Artificial Sequence: Synthetic polypeptide
DEEEIATTNPVATEQYGSVSTPNQLQERQGQNL

SEQ ID NO: 37592 - protein, 31 aa, Artificial Sequence
  Description of Artificial Sequence: Synthetic polypeptide
DAEEIRCTNPVATEQYGSVSITNLQAENGQR

SEQ ID NO: 37593 - protein, 30 aa, Artificial Sequence
  Description of Artificial Sequence: Synthetic polypeptide
DEEEIATTNPVATEQWGSVSPNPQERGNGD

SEQ ID NO: 37594 - protein, 31 aa, Artificial Sequence
  Description of Artificial Sequence: Synthetic polypeptide
DAEEIRATNPVATEQYGSVATNLQARPGQPR

SEQ ID NO: 37595 - protein, 30 aa, Artificial Sequence
  Description of Artificial Sequence: Synthetic polypeptide
DAEEIRATNPVATEQYGSCSTNHQRDGNNT

SEQ ID NO: 37596 - protein, 30 aa, Artificial Sequence
  Description of Artificial Sequence: Synthetic polypeptide
DEEEIATTNPVATEQWGSVSTDLQDGNPDM

SEQ ID NO: 37597 - protein, 31 aa, Artificial Sequence
  Description of Artificial Sequence: Synthetic polypeptide
DEEEIRTTNPVAYEQYGCVCSTEGHQRGSNR

SEQ ID NO: 37598 - protein, 32 aa, Artificial Sequence
  Description of Artificial Sequence: Synthetic polypeptide
DEEEIRTTNPVATEQYGSVCSTNHQYSGSNFG

SEQ ID NO: 37599 - protein, 29 aa, Artificial Sequence
  Description of Artificial Sequence: Synthetic peptide
DAEEIRATNPVATEQYGSCSTGNQQRDNN

SEQ ID NO: 37600 - protein, 30 aa, Artificial Sequence
  Description of Artificial Sequence: Synthetic polypeptide
DEEEIATTNPVATEQWGSVSPPNLQREGGE

SEQ ID NO: 37601 - protein, 29 aa, Artificial Sequence
  Description of Artificial Sequence: Synthetic peptide
DAEEIRATNPVATEQYGSCSTNHQRDSGN

SEQ ID NO: 37602 - protein, 32 aa, Artificial Sequence
  Description of Artificial Sequence: Synthetic polypeptide
DEEEIRTTNPVATEQYGSVCSTNHQHFGNFAS

SEQ ID NO: 37603 - protein, 32 aa, Artificial Sequence
  Description of Artificial Sequence: Synthetic polypeptide
DEEEIRTTNPVATEQYGSVISVTELQTENQRQ

SEQ ID NO: 37604 - protein, 31 aa, Artificial Sequence
  Description of Artificial Sequence: Synthetic polypeptide
DEHEIRTTNPVAYEQYGSVSINLSTRVGNNR

SEQ ID NO: 37605 - protein, 32 aa, Artificial Sequence
  Description of Artificial Sequence: Synthetic polypeptide
DEEEIRTTNPVATEQYGSVCSTNHQGGSNNFS

SEQ ID NO: 37606 - protein, 32 aa, Artificial Sequence
  Description of Artificial Sequence: Synthetic polypeptide
DEHEISTTNPVATEQYGSVSTTNLQDNHGNRD

SEQ ID NO: 37607 - protein, 31 aa, Artificial Sequence
  Description of Artificial Sequence: Synthetic polypeptide
DEEEIRTTNPVAYEQWGSVSCTGNSQRGGNL

SEQ ID NO: 37608 - protein, 32 aa, Artificial Sequence
  Description of Artificial Sequence: Synthetic polypeptide
DEEEIRTTNPVAYEQWGSVSCTGLSQRGNNRV

SEQ ID NO: 37609 - protein, 32 aa, Artificial Sequence
  Description of Artificial Sequence: Synthetic polypeptide
DEEEIATTNPVATEQYGSVSWTNDLEQERGEE

SEQ ID NO: 37610 - protein, 28 aa, Artificial Sequence
  Description of Artificial Sequence: Synthetic peptide
DEIEICTVNPVATEQYGSVSTLLFQGNE

SEQ ID NO: 37611 - protein, 29 aa, Artificial Sequence
  Description of Artificial Sequence: Synthetic peptide
DEHEISTTNPVATEQYGSVSTNLDYMDNT

SEQ ID NO: 37612 - protein, 30 aa, Artificial Sequence
  Description of Artificial Sequence: Synthetic polypeptide
DEEEIRTTNPVAYEQWGSVSCINLSQHGND

SEQ ID NO: 37613 - protein, 31 aa, Artificial Sequence
  Description of Artificial Sequence: Synthetic polypeptide
DEEEIRTTNPVATEQYGSVITGNGQERGEIV

SEQ ID NO: 37614 - protein, 32 aa, Artificial Sequence
  Description of Artificial Sequence: Synthetic polypeptide
DEEEIRTTNPVAYEQWGSVPFCTNNLSQRGNR

SEQ ID NO: 37615 - protein, 28 aa, Artificial Sequence
  Description of Artificial Sequence: Synthetic peptide
DEIEICTVNPVATEQYGSVSTNLFETNE

SEQ ID NO: 37616 - protein, 30 aa, Artificial Sequence
  Description of Artificial Sequence: Synthetic polypeptide
DEEEIATTNPVATEQYGSVVPANNLQGANR

SEQ ID NO: 37617 - protein, 32 aa, Artificial Sequence
  Description of Artificial Sequence: Synthetic polypeptide
DEEEIRTTNPVATEQYGSVITGNGQERVGNNV

SEQ ID NO: 37618 - protein, 33 aa, Artificial Sequence
  Description of Artificial Sequence: Synthetic polypeptide
DEEEIATTNPVATEQYGSVVSCTNLSHQNGGNR

SEQ ID NO: 37619 - protein, 31 aa, Artificial Sequence
  Description of Artificial Sequence: Synthetic polypeptide
DEEEIRTTNPVATEQYGSVCSTNHQENFSNA

SEQ ID NO: 37620 - protein, 28 aa, Artificial Sequence
  Description of Artificial Sequence: Synthetic peptide
DEHEIRTTNPVSTEQYGSVTCNLQGGTT

SEQ ID NO: 37621 - protein, 28 aa, Artificial Sequence
  Description of Artificial Sequence: Synthetic peptide
DEHEIRTTNPVAYQQYGCVSTNLETGNA

SEQ ID NO: 37622 - protein, 31 aa, Artificial Sequence
  Description of Artificial Sequence: Synthetic polypeptide
DEEEIRTTNPVAYEQWGSVSINLSQVTGGNR

SEQ ID NO: 37623 - protein, 30 aa, Artificial Sequence
  Description of Artificial Sequence: Synthetic polypeptide
DEEEIATTNPVATEQYGSVSTTQGGDGNSR

SEQ ID NO: 37624 - protein, 30 aa, Artificial Sequence
  Description of Artificial Sequence: Synthetic polypeptide
DEHEIRTTNPVAYEQYGSVSTNLNAGNDGQ

SEQ ID NO: 37625 - protein, 30 aa, Artificial Sequence
  Description of Artificial Sequence: Synthetic polypeptide
DEHEIRTTNPVAYEQYGSVSTNLQNGDVGG

SEQ ID NO: 37626 - protein, 31 aa, Artificial Sequence
  Description of Artificial Sequence: Synthetic polypeptide
DEHEIRTTNPVAYEQYGSVSTNLQSGGENDP

SEQ ID NO: 37627 - protein, 32 aa, Artificial Sequence
  Description of Artificial Sequence: Synthetic polypeptide
DEEEIRTTNPVAYEQWGSVVSTNLSQSGGNRS

SEQ ID NO: 37628 - protein, 32 aa, Artificial Sequence
  Description of Artificial Sequence: Synthetic polypeptide
DEEEIATTNPVATEQYGSVSTVNGQNNGDNSR

SEQ ID NO: 37629 - protein, 31 aa, Artificial Sequence
  Description of Artificial Sequence: Synthetic polypeptide
DEEEIATTNPVATEQYGSVSTWNHQRDSNSF

SEQ ID NO: 37630 - protein, 31 aa, Artificial Sequence
  Description of Artificial Sequence: Synthetic polypeptide
DEEEIRTTNPVAYEQWGSVSTYLSQQGGNNR

SEQ ID NO: 37631 - protein, 29 aa, Artificial Sequence
  Description of Artificial Sequence: Synthetic peptide
DEEEIRTTNPVATEQYGSVITDVLQETEQ

SEQ ID NO: 37632 - protein, 30 aa, Artificial Sequence
  Description of Artificial Sequence: Synthetic polypeptide
DEHEIRTTNPVAYERYGQVSTNMLQRGNTM

SEQ ID NO: 37633 - protein, 33 aa, Artificial Sequence
  Description of Artificial Sequence: Synthetic polypeptide
DEEEIRTTNPVAYEQWGSVSTNLSQRTGGNQRM

SEQ ID NO: 37634 - protein, 30 aa, Artificial Sequence
  Description of Artificial Sequence: Synthetic polypeptide
DEHEIRTTNPVAYERYGSVSTNLQDGNNGQ

SEQ ID NO: 37635 - protein, 31 aa, Artificial Sequence
  Description of Artificial Sequence: Synthetic polypeptide
DEEEIRTTNPVATEQYGSVITGLEVRLENRI

SEQ ID NO: 37636 - protein, 31 aa, Artificial Sequence
  Description of Artificial Sequence: Synthetic polypeptide
DEEEIRTTNPVATEQYGSVITGNEQRMQVAR

SEQ ID NO: 37637 - protein, 29 aa, Artificial Sequence
  Description of Artificial Sequence: Synthetic peptide
DEHEIRTTNPVAYQQYGCVSTNLERDGNQ

SEQ ID NO: 37638 - protein, 31 aa, Artificial Sequence
  Description of Artificial Sequence: Synthetic polypeptide
DEEEIRTTNPVAYEPYGSVSCTNGVRGGNNR

SEQ ID NO: 37639 - protein, 33 aa, Artificial Sequence
  Description of Artificial Sequence: Synthetic polypeptide
DEEEIRTTNPVATEQYGSVCSTMNLQAFGSNQS

SEQ ID NO: 37640 - protein, 31 aa, Artificial Sequence
  Description of Artificial Sequence: Synthetic polypeptide
DEMEIRTTNPVATEQYGCVCSTNDQNGSNRS

SEQ ID NO: 37641 - protein, 32 aa, Artificial Sequence
  Description of Artificial Sequence: Synthetic polypeptide
DEEEIRTTNPVAYEPYGSVPSTNLSQRGGNNK

SEQ ID NO: 37642 - protein, 28 aa, Artificial Sequence
  Description of Artificial Sequence: Synthetic peptide
DEEEIRTTNPVAYECYGKHSTNHQRVNV

SEQ ID NO: 37643 - protein, 32 aa, Artificial Sequence
  Description of Artificial Sequence: Synthetic polypeptide
DEEEIRTTNPVATEQYGSVITTNLQRAFNQDG

SEQ ID NO: 37644 - protein, 30 aa, Artificial Sequence
  Description of Artificial Sequence: Synthetic polypeptide
DEEEIATTNPVATESYGSVSTNLQMGGDQQ

SEQ ID NO: 37645 - protein, 33 aa, Artificial Sequence
  Description of Artificial Sequence: Synthetic polypeptide
DEEEIRTTNPVATEQYGSVITTNLQRENEITRE

SEQ ID NO: 37646 - protein, 31 aa, Artificial Sequence
  Description of Artificial Sequence: Synthetic polypeptide
DEEEIATTNPVATESYGSVSTNLQVGGENQS

SEQ ID NO: 37647 - protein, 31 aa, Artificial Sequence
  Description of Artificial Sequence: Synthetic polypeptide
DEEEIRTTNPVATEQYGSVITTNLQTLNNVM

SEQ ID NO: 37648 - protein, 31 aa, Artificial Sequence
  Description of Artificial Sequence: Synthetic polypeptide
DEMEIRTTNPVATEQYGSVCSTPLQNGSNQA

SEQ ID NO: 37649 - protein, 31 aa, Artificial Sequence
  Description of Artificial Sequence: Synthetic polypeptide
DEEEIATTNPVATESYGSVSTNLQVGGGDNQ

SEQ ID NO: 37650 - protein, 31 aa, Artificial Sequence
  Description of Artificial Sequence: Synthetic polypeptide
DEEEIATTNPVATESYGSVSTNLQVGGGNDA

SEQ ID NO: 37651 - protein, 32 aa, Artificial Sequence
  Description of Artificial Sequence: Synthetic polypeptide
DEEEIRTTNPVAYEAYGSVVSCTNLSQRGNLA

SEQ ID NO: 37652 - protein, 31 aa, Artificial Sequence
  Description of Artificial Sequence: Synthetic polypeptide
DEEEIRTTNPVAYEAYGSVVSCTNLSGGGNR

SEQ ID NO: 37653 - protein, 32 aa, Artificial Sequence
  Description of Artificial Sequence: Synthetic polypeptide
DEEEIRTTNPVATEQYGSVCSTNDDERGGEHR

SEQ ID NO: 37654 - protein, 32 aa, Artificial Sequence
  Description of Artificial Sequence: Synthetic polypeptide
DEEEIRTTNPVAYEAYGSVVSCQNLQRGGNRC

SEQ ID NO: 37655 - protein, 31 aa, Artificial Sequence
  Description of Artificial Sequence: Synthetic polypeptide
DEEEIRTTNPVATEQYGSVIVTGVDQRGNQI

SEQ ID NO: 37656 - protein, 31 aa, Artificial Sequence
  Description of Artificial Sequence: Synthetic polypeptide
DEEEIRTTNPVATEQYGSVITTNLVRAMNDM

SEQ ID NO: 37657 - protein, 33 aa, Artificial Sequence
  Description of Artificial Sequence: Synthetic polypeptide
DEEEIRTTNPVATEQYGSVCSTMPLQRFGSNQF

SEQ ID NO: 37658 - protein, 31 aa, Artificial Sequence
  Description of Artificial Sequence: Synthetic polypeptide
DEEEIATTNPVATESYGSVSTNLQMEGNMVG

SEQ ID NO: 37659 - protein, 31 aa, Artificial Sequence
  Description of Artificial Sequence: Synthetic polypeptide
DEMEIRTTNPVATEQYGSVCSTNLQHGSEAL

SEQ ID NO: 37660 - protein, 31 aa, Artificial Sequence
  Description of Artificial Sequence: Synthetic polypeptide
DEEEIRTTNPVAYECYGVVSTTNLQHGTNRD

SEQ ID NO: 37661 - protein, 31 aa, Artificial Sequence
  Description of Artificial Sequence: Synthetic polypeptide
DEEEIATTNPVATESYGSVSTNLQGEGNNMG

SEQ ID NO: 37662 - protein, 30 aa, Artificial Sequence
  Description of Artificial Sequence: Synthetic polypeptide
DEEEIATTNPVATESYGSVSTNLQGGGDMQ

SEQ ID NO: 37663 - protein, 31 aa, Artificial Sequence
  Description of Artificial Sequence: Synthetic polypeptide
DEEEIATTNPVATESYGSVSTNLQGGGTNGQ

SEQ ID NO: 37664 - protein, 31 aa, Artificial Sequence
  Description of Artificial Sequence: Synthetic polypeptide
DEEEIATTNPVATESYGSVSTNLQGPGDNQD

SEQ ID NO: 37665 - protein, 31 aa, Artificial Sequence
  Description of Artificial Sequence: Synthetic polypeptide
DEEEIATTNPVATESYGSVSTNLQGPGMNEQ

SEQ ID NO: 37666 - protein, 32 aa, Artificial Sequence
  Description of Artificial Sequence: Synthetic polypeptide
DEEEIRTTNPVATEQYGSVITTNEQDGQNVRP

SEQ ID NO: 37667 - protein, 30 aa, Artificial Sequence
  Description of Artificial Sequence: Synthetic polypeptide
DEEEIRTTNPVAYECYGKVISTNQQRVGNE

SEQ ID NO: 37668 - protein, 31 aa, Artificial Sequence
  Description of Artificial Sequence: Synthetic polypeptide
DEEEIATTNPVATESYGSVSTNLQHDQGNQM

SEQ ID NO: 37669 - protein, 32 aa, Artificial Sequence
  Description of Artificial Sequence: Synthetic polypeptide
DEEEIATTNPVATESYGSVSTNLQLGEGDNDR

SEQ ID NO: 37670 - protein, 30 aa, Artificial Sequence
  Description of Artificial Sequence: Synthetic polypeptide
DEMEIRTTNPVATEQYGSVCSTGLQVGDEQ

SEQ ID NO: 37671 - protein, 31 aa, Artificial Sequence
  Description of Artificial Sequence: Synthetic polypeptide
DEMEIRTTNPVATEQYGSVCSTNDQNGSNQA

SEQ ID NO: 37672 - protein, 32 aa, Artificial Sequence
  Description of Artificial Sequence: Synthetic polypeptide
DEMEIRTTNPVATEQYGSVCSTNLQGFGSERL

SEQ ID NO: 37673 - protein, 32 aa, Artificial Sequence
  Description of Artificial Sequence: Synthetic polypeptide
DEMEIRTTNPVATEQYGSVCSTNLQGFGSQRT

SEQ ID NO: 37674 - protein, 31 aa, Artificial Sequence
  Description of Artificial Sequence: Synthetic polypeptide
DEEEIRTTNPVATEQYGSVITTLQRELVAVR

SEQ ID NO: 37675 - protein, 29 aa, Artificial Sequence
  Description of Artificial Sequence: Synthetic peptide
DEEEIRTTNPVATEQYGSVITTLQFETEI

SEQ ID NO: 37676 - protein, 31 aa, Artificial Sequence
  Description of Artificial Sequence: Synthetic polypeptide
DEMEIRTTNPVATEQYGSVSNMDLQRGSENE

SEQ ID NO: 37677 - protein, 30 aa, Artificial Sequence
  Description of Artificial Sequence: Synthetic polypeptide
DEEEIATTNPVATETYGSVATNLQSGGNDA

SEQ ID NO: 37678 - protein, 31 aa, Artificial Sequence
  Description of Artificial Sequence: Synthetic polypeptide
DEEEIATTNPVATEVYGSVSTNLQGDGGNNM

SEQ ID NO: 37679 - protein, 30 aa, Artificial Sequence
  Description of Artificial Sequence: Synthetic polypeptide
DEEEIATTNPVATEVYGSVSTNLQGEDNNH

SEQ ID NO: 37680 - protein, 32 aa, Artificial Sequence
  Description of Artificial Sequence: Synthetic polypeptide
DEMEIRTTNPVATEQYGSVSTDNLDQIGNAQE

SEQ ID NO: 37681 - protein, 30 aa, Artificial Sequence
  Description of Artificial Sequence: Synthetic polypeptide
DEEEIRTTNPVATEQYGSVIYNLQSTDGMD

SEQ ID NO: 37682 - protein, 31 aa, Artificial Sequence
  Description of Artificial Sequence: Synthetic polypeptide
DEEEIATTNPVATEVYGSVSTNLQGQGGNEH

SEQ ID NO: 37683 - protein, 29 aa, Artificial Sequence
  Description of Artificial Sequence: Synthetic peptide
DEMEIRTTNPVATEQYGSVSTIDQMGEDA

SEQ ID NO: 37684 - protein, 32 aa, Artificial Sequence
  Description of Artificial Sequence: Synthetic polypeptide
DEMEIRTTNPVATEQYGSVSSTNLERGDNDQD

SEQ ID NO: 37685 - protein, 31 aa, Artificial Sequence
  Description of Artificial Sequence: Synthetic polypeptide
DEEEIATTNPVATEVYGSVSTNLQVGDGNNA

SEQ ID NO: 37686 - protein, 33 aa, Artificial Sequence
  Description of Artificial Sequence: Synthetic polypeptide
DEEEIRTTNPVATEQYGSVCSTMNLQRFGSDQA

SEQ ID NO: 37687 - protein, 34 aa, Artificial Sequence
  Description of Artificial Sequence: Synthetic polypeptide
DEEEIRTTNPVATEQYGSVCSTMNLQNSGSNNRG

SEQ ID NO: 37688 - protein, 30 aa, Artificial Sequence
  Description of Artificial Sequence: Synthetic polypeptide
DEEEIRTTNPVAYEAYGSVSTNASTHGGNR

SEQ ID NO: 37689 - protein, 30 aa, Artificial Sequence
  Description of Artificial Sequence: Synthetic polypeptide
DEMEIRTTNPVATEQYGSVSTNDQMGGEDK

SEQ ID NO: 37690 - protein, 32 aa, Artificial Sequence
  Description of Artificial Sequence: Synthetic polypeptide
DEEEIRTTNPVAYEAYGSVSTLNMLSQRGGPR

SEQ ID NO: 37691 - protein, 32 aa, Artificial Sequence
  Description of Artificial Sequence: Synthetic polypeptide
DEEEIRTTNPVAYEAYGSVSTGNLAQRGGNNG

SEQ ID NO: 37692 - protein, 31 aa, Artificial Sequence
  Description of Artificial Sequence: Synthetic polypeptide
DEMEIRTTNPVATEQYGSVSTNDHTGDNNRN

SEQ ID NO: 37693 - protein, 31 aa, Artificial Sequence
  Description of Artificial Sequence: Synthetic polypeptide
DEEEIRTTNPVATEQYGSVIYCTNGGQRGIF

SEQ ID NO: 37694 - protein, 32 aa, Artificial Sequence
  Description of Artificial Sequence: Synthetic polypeptide
DEEEIRTTNPVAYEAYGSVSTNELSQRNGNNS

SEQ ID NO: 37695 - protein, 34 aa, Artificial Sequence
  Description of Artificial Sequence: Synthetic polypeptide
DEEEIRTTNPVATEQYGSVCSTMNLQRFGSNTIP

SEQ ID NO: 37696 - protein, 32 aa, Artificial Sequence
  Description of Artificial Sequence: Synthetic polypeptide
DEMEIRTTNPVATEQYGSVSNTNDLQGFGSDR

SEQ ID NO: 37697 - protein, 31 aa, Artificial Sequence
  Description of Artificial Sequence: Synthetic polypeptide
DEEEIRTTNPVAYEAYGSVSTNWLSQSGGNA

SEQ ID NO: 37698 - protein, 32 aa, Artificial Sequence
  Description of Artificial Sequence: Synthetic polypeptide
DEEEIRTTNPVAYEAYGSVSTNNLSTRGGNRL

SEQ ID NO: 37699 - protein, 32 aa, Artificial Sequence
  Description of Artificial Sequence: Synthetic polypeptide
DEEEIRTTNPVATEQYGSVCSTMNNQFGSNQF

SEQ ID NO: 37700 - protein, 31 aa, Artificial Sequence
  Description of Artificial Sequence: Synthetic polypeptide
DEEEIATTNPVATETYGSVSTNLQGEGDNQP

SEQ ID NO: 37701 - protein, 31 aa, Artificial Sequence
  Description of Artificial Sequence: Synthetic polypeptide
DEEEIATTNPVATETYGSVSTNLQSGGDNGD

SEQ ID NO: 37702 - protein, 30 aa, Artificial Sequence
  Description of Artificial Sequence: Synthetic polypeptide
DEMEIRTTNPVATEQYGSVSQDNLFRNMNQ

SEQ ID NO: 37703 - protein, 31 aa, Artificial Sequence
  Description of Artificial Sequence: Synthetic polypeptide
DEEEIATTNPVATETYGTVSTNLQQGGGDNR

SEQ ID NO: 37704 - protein, 32 aa, Artificial Sequence
  Description of Artificial Sequence: Synthetic polypeptide
DEEEIRTTNPVAYEAYGSVSTNMLSQRNGGNA

SEQ ID NO: 37705 - protein, 31 aa, Artificial Sequence
  Description of Artificial Sequence: Synthetic polypeptide
DEEEIATTNPVATEVWGSVSTNLQGEHGNDR

SEQ ID NO: 37706 - protein, 30 aa, Artificial Sequence
  Description of Artificial Sequence: Synthetic polypeptide
DEEEIATTNPVATEVWGSVSTNLQQGGNNH

SEQ ID NO: 37707 - protein, 32 aa, Artificial Sequence
  Description of Artificial Sequence: Synthetic polypeptide
DEMEIRTTNPVATEQYGSVSPTNLQRGEEEID

SEQ ID NO: 37708 - protein, 32 aa, Artificial Sequence
  Description of Artificial Sequence: Synthetic polypeptide
DEEEIRTTNPVAYEAYGSVSTNMLSQNRGGNV

SEQ ID NO: 37709 - protein, 29 aa, Artificial Sequence
  Description of Artificial Sequence: Synthetic peptide
DEMEIRTTNPVATEQYGSVSPWLDMRGEQ

SEQ ID NO: 37710 - protein, 31 aa, Artificial Sequence
  Description of Artificial Sequence: Synthetic polypeptide
DEEEIRTTNPVAYEAYGSVSTNNLSQSTVNR

SEQ ID NO: 37711 - protein, 31 aa, Artificial Sequence
  Description of Artificial Sequence: Synthetic polypeptide
DEEEIRTTNPVAYEEYGSVSINLSQQGGNNR

SEQ ID NO: 37712 - protein, 31 aa, Artificial Sequence
  Description of Artificial Sequence: Synthetic polypeptide
DEEEIRTTNPVATEQYGSVITSWEDRGNDRM

SEQ ID NO: 37713 - protein, 29 aa, Artificial Sequence
  Description of Artificial Sequence: Synthetic peptide
DAAEIRTTNPVATEQYGCCSTVLQHQGNR

SEQ ID NO: 37714 - protein, 32 aa, Artificial Sequence
  Description of Artificial Sequence: Synthetic polypeptide
DEEEIRTTNPVAYEPYGSLVSTGNLSQRGGSR

SEQ ID NO: 37715 - protein, 30 aa, Artificial Sequence
  Description of Artificial Sequence: Synthetic polypeptide
DEEEIATTNPVATEQWGSVATNLERGDNDT

SEQ ID NO: 37716 - protein, 29 aa, Artificial Sequence
  Description of Artificial Sequence: Synthetic peptide
DEEEIATTNPVATEQWGSVASNDQRGNQM

SEQ ID NO: 37717 - protein, 30 aa, Artificial Sequence
  Description of Artificial Sequence: Synthetic polypeptide
DEMEIRTTNPVATEQYGCVSTNHQEFNGNE

SEQ ID NO: 37718 - protein, 32 aa, Artificial Sequence
  Description of Artificial Sequence: Synthetic polypeptide
DEEEIRTTNPVATEQYGSVITNLVRFGQANDP

SEQ ID NO: 37719 - protein, 28 aa, Artificial Sequence
  Description of Artificial Sequence: Synthetic peptide
DEEEIATTNPVATEQWGSVANNLQDGPQ

SEQ ID NO: 37720 - protein, 31 aa, Artificial Sequence
  Description of Artificial Sequence: Synthetic polypeptide
DEEEIATTNPVATEQYGVVSTNLQPDGDNAT

SEQ ID NO: 37721 - protein, 31 aa, Artificial Sequence
  Description of Artificial Sequence: Synthetic polypeptide
DEEEIATTNPVATEQYGVVSTTNGQDNGNER

SEQ ID NO: 37722 - protein, 32 aa, Artificial Sequence
  Description of Artificial Sequence: Synthetic polypeptide
DEEEIRTTNPVATEQYGSVCSTNDLNNDNGNV

SEQ ID NO: 37723 - protein, 32 aa, Artificial Sequence
  Description of Artificial Sequence: Synthetic polypeptide
DEEEIRTTNPVATEQYGSVCSTNDLERNNQDD

SEQ ID NO: 37724 - protein, 29 aa, Artificial Sequence
  Description of Artificial Sequence: Synthetic peptide
DAEEIATTNPVATAQYGSVSTNPDRGPNQ

SEQ ID NO: 37725 - protein, 30 aa, Artificial Sequence
  Description of Artificial Sequence: Synthetic polypeptide
DEEEIATTNPVATEQWGSVAMNLEQGGNDR

SEQ ID NO: 37726 - protein, 29 aa, Artificial Sequence
  Description of Artificial Sequence: Synthetic peptide
DAEEIATTNPVATAQWGSVSTNPPREGNR

SEQ ID NO: 37727 - protein, 31 aa, Artificial Sequence
  Description of Artificial Sequence: Synthetic polypeptide
DEEEIRTTNPVAYEPWGSVSCTNNGQRGGNR

SEQ ID NO: 37728 - protein, 32 aa, Artificial Sequence
  Description of Artificial Sequence: Synthetic polypeptide
DEEEIRTTNPVATEQYGSVCSTNDLNRNGPEV

SEQ ID NO: 37729 - protein, 33 aa, Artificial Sequence
  Description of Artificial Sequence: Synthetic polypeptide
DEEEIRTTNPVAYEMYGSLVSCTGNLSQRGGNR

SEQ ID NO: 37730 - protein, 33 aa, Artificial Sequence
  Description of Artificial Sequence: Synthetic polypeptide
DEEEIRTTNPVAYEPYGSTVSTGNMLAQRGGNR

SEQ ID NO: 37731 - protein, 31 aa, Artificial Sequence
  Description of Artificial Sequence: Synthetic polypeptide
DEEEIATTNPVATEQWGSVATNLERGDNTRQ

SEQ ID NO: 37732 - protein, 29 aa, Artificial Sequence
  Description of Artificial Sequence: Synthetic peptide
DAEEIATTNPVATEQWGSVTSAALQRGTR

SEQ ID NO: 37733 - protein, 32 aa, Artificial Sequence
  Description of Artificial Sequence: Synthetic polypeptide
DEEEIATTNPVATEQWGSVCCTNLSQRSGNQR

SEQ ID NO: 37734 - protein, 31 aa, Artificial Sequence
  Description of Artificial Sequence: Synthetic polypeptide
DEMEIRTTNPVATEQYGCVCSTNLQRGSQQI

SEQ ID NO: 37735 - protein, 31 aa, Artificial Sequence
  Description of Artificial Sequence: Synthetic polypeptide
DEEEIRTTNPVAYEPYGSVCTNLSTRPGGNR

SEQ ID NO: 37736 - protein, 29 aa, Artificial Sequence
  Description of Artificial Sequence: Synthetic peptide
DEMEIRTTNPVATEQYGCVSQNLANNSNR

SEQ ID NO: 37737 - protein, 31 aa, Artificial Sequence
  Description of Artificial Sequence: Synthetic polypeptide
DEMEIRTTNPVATEQYGCVSTALQNFGSNRA

SEQ ID NO: 37738 - protein, 29 aa, Artificial Sequence
  Description of Artificial Sequence: Synthetic peptide
DEMEIRTTNPVATEQYGCVSTELQRTEDS

SEQ ID NO: 37739 - protein, 31 aa, Artificial Sequence
  Description of Artificial Sequence: Synthetic polypeptide
DEMEIRTTNPVATEQYGCVSTALQRFGSNQS

SEQ ID NO: 37740 - protein, 29 aa, Artificial Sequence
  Description of Artificial Sequence: Synthetic peptide
DEMEIRTTNPVATEQYGCVSTELQNGSEV

SEQ ID NO: 37741 - protein, 30 aa, Artificial Sequence
  Description of Artificial Sequence: Synthetic polypeptide
DEEEIATTNPVATEQWGSVATNLQGDNDRQ

SEQ ID NO: 37742 - protein, 31 aa, Artificial Sequence
  Description of Artificial Sequence: Synthetic polypeptide
DEEEIATTNPVATEQWGSVATNLQEAGNDRE

SEQ ID NO: 37743 - protein, 29 aa, Artificial Sequence
  Description of Artificial Sequence: Synthetic peptide
DEEEIATTNPVATEQWGSVATNLPERENS

SEQ ID NO: 37744 - protein, 31 aa, Artificial Sequence
  Description of Artificial Sequence: Synthetic polypeptide
DEMEIRTTNPVATEQYGCVSTELQRFGSNPQ

SEQ ID NO: 37745 - protein, 31 aa, Artificial Sequence
  Description of Artificial Sequence: Synthetic polypeptide
DEEEIATTNPVATEQWGSVATNLERPGENRT

SEQ ID NO: 37746 - protein, 30 aa, Artificial Sequence
  Description of Artificial Sequence: Synthetic polypeptide
DEMEIRTTNPVATEQYGCVSTEHQNGSNRS

SEQ ID NO: 37747 - protein, 31 aa, Artificial Sequence
  Description of Artificial Sequence: Synthetic polypeptide
DEEEIRTTNPVATEQYGSVITPNLEVRFGDQ

SEQ ID NO: 37748 - protein, 30 aa, Artificial Sequence
  Description of Artificial Sequence: Synthetic polypeptide
DEEEIATTNPVATERYGSVSDTNPGDIGNR

SEQ ID NO: 37749 - protein, 33 aa, Artificial Sequence
  Description of Artificial Sequence: Synthetic polypeptide
DEEEIRTTNPVAYEHYGSVSVTNLSQRGGNNRQ

SEQ ID NO: 37750 - protein, 31 aa, Artificial Sequence
  Description of Artificial Sequence: Synthetic polypeptide
DEMEIRTTNPVATEQYGSCSTNNQRGSNQEM

SEQ ID NO: 37751 - protein, 32 aa, Artificial Sequence
  Description of Artificial Sequence: Synthetic polypeptide
DEEEIRTTNPVATEQYGSVCSTNDHQERDESR

SEQ ID NO: 37752 - protein, 32 aa, Artificial Sequence
  Description of Artificial Sequence: Synthetic polypeptide
DEEEIRTTNPVAYEGYGSVVSCTNLARTGGNR

SEQ ID NO: 37753 - protein, 32 aa, Artificial Sequence
  Description of Artificial Sequence: Synthetic polypeptide
DEEEIRTTNPVAYEGYGSVSCTNAQQRGGNNR

SEQ ID NO: 37754 - protein, 31 aa, Artificial Sequence
  Description of Artificial Sequence: Synthetic polypeptide
DEMEIRTTNPVATEQYGSCVSTNLQDTGDVN

SEQ ID NO: 37755 - protein, 29 aa, Artificial Sequence
  Description of Artificial Sequence: Synthetic peptide
DEMEIRTTNPVATEQYGSFSNELQRGEPQ

SEQ ID NO: 37756 - protein, 28 aa, Artificial Sequence
  Description of Artificial Sequence: Synthetic peptide
DAEEIASTNPVATEQYGSCSTNQQRDNN

SEQ ID NO: 37757 - protein, 31 aa, Artificial Sequence
  Description of Artificial Sequence: Synthetic polypeptide
DAEEIACTNPVATEQYGSVATNLQARGGENR

SEQ ID NO: 37758 - protein, 32 aa, Artificial Sequence
  Description of Artificial Sequence: Synthetic polypeptide
DEEEIRTTNPVAYEFYGQSVSTNDLQQRGILR

SEQ ID NO: 37759 - protein, 29 aa, Artificial Sequence
  Description of Artificial Sequence: Synthetic peptide
DEMEIRTTNPVATEQYGSISTNTQHFGDA

SEQ ID NO: 37760 - protein, 31 aa, Artificial Sequence
  Description of Artificial Sequence: Synthetic polypeptide
DEEEIATTNPVATESYGSVSTNLQAGGDNGH

SEQ ID NO: 37761 - protein, 30 aa, Artificial Sequence
  Description of Artificial Sequence: Synthetic polypeptide
DEMEIRTTNPVATEQYGSISTNTQRSGEQS

SEQ ID NO: 37762 - protein, 30 aa, Artificial Sequence
  Description of Artificial Sequence: Synthetic polypeptide
DADEIRTTNPVATEQYGSVSTNPLQLGMEQ

SEQ ID NO: 37763 - protein, 30 aa, Artificial Sequence
  Description of Artificial Sequence: Synthetic polypeptide
DADEIRSTNPVATEQYGSVSTNLEARFGQR

SEQ ID NO: 37764 - protein, 29 aa, Artificial Sequence
  Description of Artificial Sequence: Synthetic peptide
DEMEIRTTNPVATEQYGSISQNIQGFGLR

SEQ ID NO: 37765 - protein, 31 aa, Artificial Sequence
  Description of Artificial Sequence: Synthetic polypeptide
DEMEIRTTNPVATEQYGSCSTNLWPRFNDRN

SEQ ID NO: 37766 - protein, 30 aa, Artificial Sequence
  Description of Artificial Sequence: Synthetic polypeptide
DAEEIASTNPVATEQYGSVATNLQARAGGR

SEQ ID NO: 37767 - protein, 30 aa, Artificial Sequence
  Description of Artificial Sequence: Synthetic polypeptide
DEEEIATTNPVATEQWGSVAANLEDRGNDR

SEQ ID NO: 37768 - protein, 33 aa, Artificial Sequence
  Description of Artificial Sequence: Synthetic polypeptide
DEEEIRTTNPVATEQYGSVCSTNDLERNGNIDD

SEQ ID NO: 37769 - protein, 31 aa, Artificial Sequence
  Description of Artificial Sequence: Synthetic polypeptide
DEEEIRTTNPVATEQYGSVITPTNLQRNVTN

SEQ ID NO: 37770 - protein, 30 aa, Artificial Sequence
  Description of Artificial Sequence: Synthetic polypeptide
DEEEIATTNPVATESWGSVSTNLQGGDGNQ

SEQ ID NO: 37771 - protein, 32 aa, Artificial Sequence
  Description of Artificial Sequence: Synthetic polypeptide
DEEEIRTTNPVAYEHYGSVSCTNIDQRGGNNR

SEQ ID NO: 37772 - protein, 29 aa, Artificial Sequence
  Description of Artificial Sequence: Synthetic peptide
DEMEIRTTNPVATEQYGECSTNLQSGDSA

SEQ ID NO: 37773 - protein, 31 aa, Artificial Sequence
  Description of Artificial Sequence: Synthetic polypeptide
DEMEIRTTNPVATEQYGQCVCSTELQNGSNR

SEQ ID NO: 37774 - protein, 32 aa, Artificial Sequence
  Description of Artificial Sequence: Synthetic polypeptide
DEEEIRTTNPVATEQYGSVCSTNDIQDNGDNN

SEQ ID NO: 37775 - protein, 30 aa, Artificial Sequence
  Description of Artificial Sequence: Synthetic polypeptide
DEEEIRTTNPVAYEHYGSVAQNLSTRGGNR

SEQ ID NO: 37776 - protein, 32 aa, Artificial Sequence
  Description of Artificial Sequence: Synthetic polypeptide
DEEEIRTTNPVATEQYGSVCSTNDIPDDNGNR

SEQ ID NO: 37777 - protein, 30 aa, Artificial Sequence
  Description of Artificial Sequence: Synthetic polypeptide
DEMEIRTTNPVATEQYGSCSTDLQEGQNPQ

SEQ ID NO: 37778 - protein, 30 aa, Artificial Sequence
  Description of Artificial Sequence: Synthetic polypeptide
DEMEIRTTNPVATEQYGSCSTDLQNGENEQ

SEQ ID NO: 37779 - protein, 30 aa, Artificial Sequence
  Description of Artificial Sequence: Synthetic polypeptide
DAEEIASTNPVATEQYGSVSTNLQGENGQR

SEQ ID NO: 37780 - protein, 31 aa, Artificial Sequence
  Description of Artificial Sequence: Synthetic polypeptide
DAEEIASTNPVATEQYGSVSTNLQDRPGPQR

SEQ ID NO: 37781 - protein, 30 aa, Artificial Sequence
  Description of Artificial Sequence: Synthetic polypeptide
DEEEIATTNPVATEQWGSVAANNLQQGNDR

SEQ ID NO: 37782 - protein, 30 aa, Artificial Sequence
  Description of Artificial Sequence: Synthetic polypeptide
DEEEIATTNPVATEQWGSVAANLERGNNRD

SEQ ID NO: 37783 - protein, 32 aa, Artificial Sequence
  Description of Artificial Sequence: Synthetic polypeptide
DEEEIRTTNPVAYEPYGSVPVTNLSQRNGGNR

SEQ ID NO: 37784 - protein, 30 aa, Artificial Sequence
  Description of Artificial Sequence: Synthetic polypeptide
DEGEIRPTNPVATEQWGSVSCNEQDREGNR

SEQ ID NO: 37785 - protein, 32 aa, Artificial Sequence
  Description of Artificial Sequence: Synthetic polypeptide
DEEEIRTTNPVATEQYGSVCSTPLTQGFGSNQ

SEQ ID NO: 37786 - protein, 33 aa, Artificial Sequence
  Description of Artificial Sequence: Synthetic polypeptide
DEEEIRTTNPVATEQYGSVCSTPNDQRFGSNNA

SEQ ID NO: 37787 - protein, 30 aa, Artificial Sequence
  Description of Artificial Sequence: Synthetic polypeptide
DEEEITTTNPVATEQYGEVSTNLGEGDGNT

SEQ ID NO: 37788 - protein, 33 aa, Artificial Sequence
  Description of Artificial Sequence: Synthetic polypeptide
DEEEIRTTNPVATEQYGSVGSTVNLQQIIGNMP

SEQ ID NO: 37789 - protein, 33 aa, Artificial Sequence
  Description of Artificial Sequence: Synthetic polypeptide
DEEEIRTTNPVATEQYGSVGSTVNLQQNGINED

SEQ ID NO: 37790 - protein, 30 aa, Artificial Sequence
  Description of Artificial Sequence: Synthetic polypeptide
DEEEIATTNPVATEQYGSVATTDQGNGNNR

SEQ ID NO: 37791 - protein, 30 aa, Artificial Sequence
  Description of Artificial Sequence: Synthetic polypeptide
DEEEIATTNPVATEQYGSVATTGDQNGNNR

SEQ ID NO: 37792 - protein, 29 aa, Artificial Sequence
  Description of Artificial Sequence: Synthetic peptide
DDSEIACTNPVATEQYGNVSENLQSRGNR

SEQ ID NO: 37793 - protein, 33 aa, Artificial Sequence
  Description of Artificial Sequence: Synthetic polypeptide
DEEEIRTTNPVATEQYGSVGSTVNLQQEIGNNP

SEQ ID NO: 37794 - protein, 33 aa, Artificial Sequence
  Description of Artificial Sequence: Synthetic polypeptide
DEEEIRTTNPVAYEQYGVSVSTNDLLQDRGDRR

SEQ ID NO: 37795 - protein, 32 aa, Artificial Sequence
  Description of Artificial Sequence: Synthetic polypeptide
DEEEIRTTNPVAYEQYGVSVSTNDLHQEGDRR

SEQ ID NO: 37796 - protein, 31 aa, Artificial Sequence
  Description of Artificial Sequence: Synthetic polypeptide
DEEEITTTNPVAYEQYGSVSTNPSGRVGNNR

SEQ ID NO: 37797 - protein, 33 aa, Artificial Sequence
  Description of Artificial Sequence: Synthetic polypeptide
DEEEIRTTNPVATEQYGSVFSPTNLHEGNEERN

SEQ ID NO: 37798 - protein, 33 aa, Artificial Sequence
  Description of Artificial Sequence: Synthetic polypeptide
DEEEIRTTNPVAYEQYGVSVSQTNDLLQRGISR

SEQ ID NO: 37799 - protein, 30 aa, Artificial Sequence
  Description of Artificial Sequence: Synthetic polypeptide
DEEEIRTTNPVATEQYGSVFSPNLNDRDDD

SEQ ID NO: 37800 - protein, 28 aa, Artificial Sequence
  Description of Artificial Sequence: Synthetic peptide
DEEEIVTTNPDATEQYGSVSTVDQNGDF

SEQ ID NO: 37801 - protein, 33 aa, Artificial Sequence
  Description of Artificial Sequence: Synthetic polypeptide
DEEEIRTTNPVATEQYGSVGSTVNLQSFGFNED

SEQ ID NO: 37802 - protein, 31 aa, Artificial Sequence
  Description of Artificial Sequence: Synthetic polypeptide
DEEEIVTTNPIATEQYGSVSATGLVMREGNR

SEQ ID NO: 37803 - protein, 31 aa, Artificial Sequence
  Description of Artificial Sequence: Synthetic polypeptide
DEEEISTTNPVAYEQYGSVCCTNLSQRGNNE

SEQ ID NO: 37804 - protein, 33 aa, Artificial Sequence
  Description of Artificial Sequence: Synthetic polypeptide
DEEEIRTTNPVATEQYGSVGSTVNLQNVGINQE

SEQ ID NO: 37805 - protein, 31 aa, Artificial Sequence
  Description of Artificial Sequence: Synthetic polypeptide
DEEEISTTNPVATEQYGSVSTPELQCGQNIL

SEQ ID NO: 37806 - protein, 30 aa, Artificial Sequence
  Description of Artificial Sequence: Synthetic polypeptide
DEEEIRTTNPVATEQYGSVFTNLDQWVEEM

SEQ ID NO: 37807 - protein, 29 aa, Artificial Sequence
  Description of Artificial Sequence: Synthetic peptide
DEEEISTTNPVATEQYGSVSTPLTNNSER

SEQ ID NO: 37808 - protein, 31 aa, Artificial Sequence
  Description of Artificial Sequence: Synthetic polypeptide
DEEEISTTNPVATEQYGSVSTTNLQSGSEQP

SEQ ID NO: 37809 - protein, 31 aa, Artificial Sequence
  Description of Artificial Sequence: Synthetic polypeptide
DEEEISTTNPVATEQYGSVSWENLQYFGSNQ

SEQ ID NO: 37810 - protein, 31 aa, Artificial Sequence
  Description of Artificial Sequence: Synthetic polypeptide
DEEEISTTNPVATEQYGSVTSTEHQRFGSNA

SEQ ID NO: 37811 - protein, 32 aa, Artificial Sequence
  Description of Artificial Sequence: Synthetic polypeptide
DEEEIRTTNPVAYEQYGVVVSTNDLLQRGIIR

SEQ ID NO: 37812 - protein, 30 aa, Artificial Sequence
  Description of Artificial Sequence: Synthetic polypeptide
DEEEISTTNPVATEQYGTVSTVHQRFGSNQ

SEQ ID NO: 37813 - protein, 33 aa, Artificial Sequence
  Description of Artificial Sequence: Synthetic polypeptide
DEEEIRTTNPVATEQYGSVGSTVNLQNGGGNEE

SEQ ID NO: 37814 - protein, 31 aa, Artificial Sequence
  Description of Artificial Sequence: Synthetic polypeptide
DEEEIATTNPVATEQYGSVATPNLERGNDYD

SEQ ID NO: 37815 - protein, 30 aa, Artificial Sequence
  Description of Artificial Sequence: Synthetic polypeptide
DEEEISTTNPVATEQYGVVLSTNHNQANNR

SEQ ID NO: 37816 - protein, 33 aa, Artificial Sequence
  Description of Artificial Sequence: Synthetic polypeptide
DEEEIRTTNPVATEQYGSVGSTVNLQNSGINEG

SEQ ID NO: 37817 - protein, 30 aa, Artificial Sequence
  Description of Artificial Sequence: Synthetic polypeptide
DEEEISTTNPVATEQYGVVSTNHQRGSEQG

SEQ ID NO: 37818 - protein, 32 aa, Artificial Sequence
  Description of Artificial Sequence: Synthetic polypeptide
DEEEIATTNPVATEQYGSVATPNLQRDGNDEN

SEQ ID NO: 37819 - protein, 30 aa, Artificial Sequence
  Description of Artificial Sequence: Synthetic polypeptide
DEEEIATTNPVATEQYGSVATPNDQDGNEM

SEQ ID NO: 37820 - protein, 31 aa, Artificial Sequence
  Description of Artificial Sequence: Synthetic polypeptide
DEEEISTTNPVATEQYGSVSTNSLQQVRPEF

SEQ ID NO: 37821 - protein, 33 aa, Artificial Sequence
  Description of Artificial Sequence: Synthetic polypeptide
DEEEIRTTNPVATEQYGSVGSTVNLQTNGINDI

SEQ ID NO: 37822 - protein, 32 aa, Artificial Sequence
  Description of Artificial Sequence: Synthetic polypeptide
DEEEIRTTNPVAYEQYGVSVSQNDLLQRGVGR

SEQ ID NO: 37823 - protein, 30 aa, Artificial Sequence
  Description of Artificial Sequence: Synthetic polypeptide
DEEEIYTTNPVATESYGSVSTELQNISNRV

SEQ ID NO: 37824 - protein, 31 aa, Artificial Sequence
  Description of Artificial Sequence: Synthetic polypeptide
DEEETIRTTNPVATEQYGSVSTNHQGFGSDQ

SEQ ID NO: 37825 - protein, 31 aa, Artificial Sequence
  Description of Artificial Sequence: Synthetic polypeptide
DEEEIRTTNPVAYEQYGTVACTNLPTRSGNR

SEQ ID NO: 37826 - protein, 31 aa, Artificial Sequence
  Description of Artificial Sequence: Synthetic polypeptide
DEEEIRTTNPVATEQYGSVETYGLQRFGQMD

SEQ ID NO: 37827 - protein, 31 aa, Artificial Sequence
  Description of Artificial Sequence: Synthetic polypeptide
DEEEIRTTNPVATEQYGSVETYGLQQDMNRI

SEQ ID NO: 37828 - protein, 32 aa, Artificial Sequence
  Description of Artificial Sequence: Synthetic polypeptide
DEEEIRTTNPVAYEQYGTTISTNGLSQRGGNR

SEQ ID NO: 37829 - protein, 32 aa, Artificial Sequence
  Description of Artificial Sequence: Synthetic polypeptide
DEEEIYTTNPVATEQYGSVSTNSLQQVRDGEF

SEQ ID NO: 37830 - protein, 32 aa, Artificial Sequence
  Description of Artificial Sequence: Synthetic polypeptide
DEEEIRTTNPVAYEQYGTSVSVNDLLQRGISR

SEQ ID NO: 37831 - protein, 32 aa, Artificial Sequence
  Description of Artificial Sequence: Synthetic polypeptide
DEEEIRTTNPVATEQYGSVETTNLQRVQGIDE

SEQ ID NO: 37832 - protein, 31 aa, Artificial Sequence
  Description of Artificial Sequence: Synthetic polypeptide
DEEGIRTTNPVATEPYGGVTTNLQPRMGSNR

SEQ ID NO: 37833 - protein, 31 aa, Artificial Sequence
  Description of Artificial Sequence: Synthetic polypeptide
DEEGIRTTNPVATEPYGTVTTNLQRQGSNRE

SEQ ID NO: 37834 - protein, 30 aa, Artificial Sequence
  Description of Artificial Sequence: Synthetic polypeptide
DEEGIRTTNPVATEQWGAVATPNLQLGVNR

SEQ ID NO: 37835 - protein, 32 aa, Artificial Sequence
  Description of Artificial Sequence: Synthetic polypeptide
DEEEIRTTNPVAYEQYGTSVSTNDLLQGGIRR

SEQ ID NO: 37836 - protein, 31 aa, Artificial Sequence
  Description of Artificial Sequence: Synthetic polypeptide
DEEEIRTTNPVATEQYGSVGTNLQNFGSDQT

SEQ ID NO: 37837 - protein, 32 aa, Artificial Sequence
  Description of Artificial Sequence: Synthetic polypeptide
DEEEVRTTNPVATEQYGSVSPTNLQELGEEGR

SEQ ID NO: 37838 - protein, 32 aa, Artificial Sequence
  Description of Artificial Sequence: Synthetic polypeptide
DEEEIRTTNPVAYEQYGVSVSQNDLSQRGDRR

SEQ ID NO: 37839 - protein, 30 aa, Artificial Sequence
  Description of Artificial Sequence: Synthetic polypeptide
DEEEIYTTNPVATEQFGVVSTALQRGSNFQ

SEQ ID NO: 37840 - protein, 32 aa, Artificial Sequence
  Description of Artificial Sequence: Synthetic polypeptide
DEEEIRTTNPVAYEQYGTVATNALSQRTGTNR

SEQ ID NO: 37841 - protein, 31 aa, Artificial Sequence
  Description of Artificial Sequence: Synthetic polypeptide
DEEEIRTTNPVATEQYGSVGTGEHQNGSNRA

SEQ ID NO: 37842 - protein, 30 aa, Artificial Sequence
  Description of Artificial Sequence: Synthetic polypeptide
DEEEIRTTNPVATEQYGSVFGTLDQGFGNQ

SEQ ID NO: 37843 - protein, 31 aa, Artificial Sequence
  Description of Artificial Sequence: Synthetic polypeptide
DEEEIRTTNPVATEQYGSVFFTDLQREGQAE

SEQ ID NO: 37844 - protein, 32 aa, Artificial Sequence
  Description of Artificial Sequence: Synthetic polypeptide
DEEEIVTTNPVATEQYGSVSPTNSLFQVRGEF

SEQ ID NO: 37845 - protein, 32 aa, Artificial Sequence
  Description of Artificial Sequence: Synthetic polypeptide
DEEEIVTTNPVATEQYGSVSTGNQLQEEMGNL

SEQ ID NO: 37846 - protein, 31 aa, Artificial Sequence
  Description of Artificial Sequence: Synthetic polypeptide
DEEEIRTTNPVATEQYGSVGTINNQQGGGNE

SEQ ID NO: 37847 - protein, 29 aa, Artificial Sequence
  Description of Artificial Sequence: Synthetic peptide
DEEEIWTTNPVATEQYGVVSNCILQLGER

SEQ ID NO: 37848 - protein, 31 aa, Artificial Sequence
  Description of Artificial Sequence: Synthetic polypeptide
DEEEIRTTNPVATEQYGSVGTNLDQNIGEID

SEQ ID NO: 37849 - protein, 31 aa, Artificial Sequence
  Description of Artificial Sequence: Synthetic polypeptide
DEEEIRTTNPVATEQYGSVEYTENLQGGIDQ

SEQ ID NO: 37850 - protein, 29 aa, Artificial Sequence
  Description of Artificial Sequence: Synthetic peptide
DEEEIRTTNPVATEQYGSVEYDEQEGERV

SEQ ID NO: 37851 - protein, 30 aa, Artificial Sequence
  Description of Artificial Sequence: Synthetic polypeptide
DEEEIVTTNPVATEQYGTVCSTNLVESGNQ

SEQ ID NO: 37852 - protein, 30 aa, Artificial Sequence
  Description of Artificial Sequence: Synthetic polypeptide
DEEEIVTTNPVATEQYGVVCSDNLVQSGNQ

SEQ ID NO: 37853 - protein, 31 aa, Artificial Sequence
  Description of Artificial Sequence: Synthetic polypeptide
DEEEIRTTNPVATEQYGSVEVTNLQIVNNDQ

SEQ ID NO: 37854 - protein, 31 aa, Artificial Sequence
  Description of Artificial Sequence: Synthetic polypeptide
DEEEIRTTNPVAYEQYGTVPSCTNLDNGGNR

SEQ ID NO: 37855 - protein, 31 aa, Artificial Sequence
  Description of Artificial Sequence: Synthetic polypeptide
DEEEIVTTNPVATEQYGSVSTVGLFQVRGEF

SEQ ID NO: 37856 - protein, 31 aa, Artificial Sequence
  Description of Artificial Sequence: Synthetic polypeptide
DEEEISTTNPVATEQYGSVSTNSLFQVNGEQ

SEQ ID NO: 37857 - protein, 31 aa, Artificial Sequence
  Description of Artificial Sequence: Synthetic polypeptide
DEEEISTTNPVATEQYGSVSTNQLNQVLGEF

SEQ ID NO: 37858 - protein, 31 aa, Artificial Sequence
  Description of Artificial Sequence: Synthetic polypeptide
DEEEISTTNPVATEQYGSVSTNQLFQEQGEF

SEQ ID NO: 37859 - protein, 33 aa, Artificial Sequence
  Description of Artificial Sequence: Synthetic polypeptide
DEEEIRTTNPVAYESYGSVSCTNLSQRGLSNRY

SEQ ID NO: 37860 - protein, 32 aa, Artificial Sequence
  Description of Artificial Sequence: Synthetic polypeptide
DEEEISTTNPVATEQYGQVVCSTNPQRGSNRN

SEQ ID NO: 37861 - protein, 28 aa, Artificial Sequence
  Description of Artificial Sequence: Synthetic peptide
DDSEIRCTNPVSTEQYGSVSNTLQRGQR

SEQ ID NO: 37862 - protein, 33 aa, Artificial Sequence
  Description of Artificial Sequence: Synthetic polypeptide
DEEEISTTNPVATEQYGSVCSNTENLQGGSNRF

SEQ ID NO: 37863 - protein, 31 aa, Artificial Sequence
  Description of Artificial Sequence: Synthetic polypeptide
DEEEIATTNPVATEQYGSVATNLQRDENNEM

SEQ ID NO: 37864 - protein, 32 aa, Artificial Sequence
  Description of Artificial Sequence: Synthetic polypeptide
DEEEIATTNPVATEQYGSVATNLQRDGDNTGQ

SEQ ID NO: 37865 - protein, 32 aa, Artificial Sequence
  Description of Artificial Sequence: Synthetic polypeptide
DEEEISTTNPVATEQYGQSVSTNLQAFGSNAS

SEQ ID NO: 37866 - protein, 31 aa, Artificial Sequence
  Description of Artificial Sequence: Synthetic polypeptide
DEEEIATTNPVATEQYGSVATNLQRDQNTEE

SEQ ID NO: 37867 - protein, 33 aa, Artificial Sequence
  Description of Artificial Sequence: Synthetic polypeptide
DEEEIRTTNPVATEQYGSVGSTVNLQETGNNIT

SEQ ID NO: 37868 - protein, 31 aa, Artificial Sequence
  Description of Artificial Sequence: Synthetic polypeptide
DEEEIATTNPVATEQYGSVATNLQREGPGVV

SEQ ID NO: 37869 - protein, 31 aa, Artificial Sequence
  Description of Artificial Sequence: Synthetic polypeptide
DEEEIATTNPVATEQYGSVATNLQREGTEMV

SEQ ID NO: 37870 - protein, 31 aa, Artificial Sequence
  Description of Artificial Sequence: Synthetic polypeptide
DEEEIRTTNPVAYERYGSTVSTNALSQFVNR

SEQ ID NO: 37871 - protein, 30 aa, Artificial Sequence
  Description of Artificial Sequence: Synthetic polypeptide
DEEEIATTNPVATEQYGSVATNLQRESTAV

SEQ ID NO: 37872 - protein, 31 aa, Artificial Sequence
  Description of Artificial Sequence: Synthetic polypeptide
DEEEISTTNPVATEQYGSVCSTNHQGGSNQV

SEQ ID NO: 37873 - protein, 32 aa, Artificial Sequence
  Description of Artificial Sequence: Synthetic polypeptide
DEEEISTTNPVATEQYGSVCSTENEQRGSNDG

SEQ ID NO: 37874 - protein, 32 aa, Artificial Sequence
  Description of Artificial Sequence: Synthetic polypeptide
DEEEISTTNPVATEQYGSVCSTNHQRLGSNAS

SEQ ID NO: 37875 - protein, 32 aa, Artificial Sequence
  Description of Artificial Sequence: Synthetic polypeptide
DEEEISTTNPVATEQYGQSVSTELQNGSNNRF

SEQ ID NO: 37876 - protein, 33 aa, Artificial Sequence
  Description of Artificial Sequence: Synthetic polypeptide
DEEEISTTNPVATEQYGQSVCSTNLQSFGSNRF

SEQ ID NO: 37877 - protein, 30 aa, Artificial Sequence
  Description of Artificial Sequence: Synthetic polypeptide
DEEEIATTNPVATEQYGSVATNLQPDPNDI

SEQ ID NO: 37878 - protein, 32 aa, Artificial Sequence
  Description of Artificial Sequence: Synthetic polypeptide
DEEEIRTTNPVATEQYGSVFTTSNLQRLNSDQ

SEQ ID NO: 37879 - protein, 31 aa, Artificial Sequence
  Description of Artificial Sequence: Synthetic polypeptide
DEEEIATTNPVATEQYGSVATNLQQDGGDRA

SEQ ID NO: 37880 - protein, 34 aa, Artificial Sequence
  Description of Artificial Sequence: Synthetic polypeptide
DEEEIRTTNPVCAYEQYGQSVPSTNLSQRGGNNR

SEQ ID NO: 37881 - protein, 32 aa, Artificial Sequence
  Description of Artificial Sequence: Synthetic polypeptide
DEEEISTTNPVATEQYGCVVCSTELQRGSNRS

SEQ ID NO: 37882 - protein, 33 aa, Artificial Sequence
  Description of Artificial Sequence: Synthetic polypeptide
DEEEIRTTNPVAYEWYGSVSNTNLQQRGGNNRV

SEQ ID NO: 37883 - protein, 33 aa, Artificial Sequence
  Description of Artificial Sequence: Synthetic polypeptide
DEEEIRTTNPVATEQYGSVGSTVNLQEDEGENI

SEQ ID NO: 37884 - protein, 31 aa, Artificial Sequence
  Description of Artificial Sequence: Synthetic polypeptide
DEEEISTTNPVATEQYGICVCSTNLQNFGNQ

SEQ ID NO: 37885 - protein, 31 aa, Artificial Sequence
  Description of Artificial Sequence: Synthetic polypeptide
DEEEISTTNPVATEQYGQCVSTELQAGSNRS

SEQ ID NO: 37886 - protein, 31 aa, Artificial Sequence
  Description of Artificial Sequence: Synthetic polypeptide
DEEEIATTNPVATEQYGSVATNLQQGNNPEE

SEQ ID NO: 37887 - protein, 31 aa, Artificial Sequence
  Description of Artificial Sequence: Synthetic polypeptide
DEEEISTTNPVATEQYGQCVSTNLQSGSNQG

SEQ ID NO: 37888 - protein, 32 aa, Artificial Sequence
  Description of Artificial Sequence: Synthetic polypeptide
DEEEIATTNPVATEQYGSVATNLQQPGENPRE

SEQ ID NO: 37889 - protein, 30 aa, Artificial Sequence
  Description of Artificial Sequence: Synthetic polypeptide
DEEEIATTNPVATEQYGSVATNLQQPGEVA

SEQ ID NO: 37890 - protein, 32 aa, Artificial Sequence
  Description of Artificial Sequence: Synthetic polypeptide
DEEEISTTNPVATEQYGQSVCSTNLQAGSQRS

SEQ ID NO: 37891 - protein, 31 aa, Artificial Sequence
  Description of Artificial Sequence: Synthetic polypeptide
DEEEIATTNPVATEQYGSVATNLQQGENSDE

SEQ ID NO: 37892 - protein, 31 aa, Artificial Sequence
  Description of Artificial Sequence: Synthetic polypeptide
DEEEIATTNPVATEQYGSVATNLQRNPDGVA

SEQ ID NO: 37893 - protein, 33 aa, Artificial Sequence
  Description of Artificial Sequence: Synthetic polypeptide
DEEEISTTNPVATEQYGSVCSTNLQEGSGSNRE

SEQ ID NO: 37894 - protein, 32 aa, Artificial Sequence
  Description of Artificial Sequence: Synthetic polypeptide
DEEEIRTTNPVATEQYGSVFTTNLQRNFNTEV

SEQ ID NO: 37895 - protein, 32 aa, Artificial Sequence
  Description of Artificial Sequence: Synthetic polypeptide
DEEEISTTNPVATEQYGSVSTMNLQNFGSNQT

SEQ ID NO: 37896 - protein, 31 aa, Artificial Sequence
  Description of Artificial Sequence: Synthetic polypeptide
DEEEISTTNPVATEQYGSVSTNAHQERFMIR

SEQ ID NO: 37897 - protein, 31 aa, Artificial Sequence
  Description of Artificial Sequence: Synthetic polypeptide
DEEEISTTNPVATEQYGSVSTNDHQRGSQQG

SEQ ID NO: 37898 - protein, 33 aa, Artificial Sequence
  Description of Artificial Sequence: Synthetic polypeptide
DEEEIRTTNPVATEQYGSVGSTVNLQNDGINNT

SEQ ID NO: 37899 - protein, 31 aa, Artificial Sequence
  Description of Artificial Sequence: Synthetic polypeptide
DEEEISTTNPVATEQYGSVSTNGLFQVDGEF

SEQ ID NO: 37900 - protein, 30 aa, Artificial Sequence
  Description of Artificial Sequence: Synthetic polypeptide
DEEEISTTNPVATEQYGSVSTNHQNPSNDG

SEQ ID NO: 37901 - protein, 31 aa, Artificial Sequence
  Description of Artificial Sequence: Synthetic polypeptide
DEEEISTTNPVATEQYGSVSTGPHQRFGSNF

SEQ ID NO: 37902 - protein, 32 aa, Artificial Sequence
  Description of Artificial Sequence: Synthetic polypeptide
DEEEISTTNPVATEQYGSVSTNHQRFGSQNQG

SEQ ID NO: 37903 - protein, 31 aa, Artificial Sequence
  Description of Artificial Sequence: Synthetic polypeptide
DEEEISTTNPVATEQYGSVSTNLLGQVQGEF

SEQ ID NO: 37904 - protein, 32 aa, Artificial Sequence
  Description of Artificial Sequence: Synthetic polypeptide
DEEEISTTNPVATEQYGSVSTNLQENFGSNNQ

SEQ ID NO: 37905 - protein, 31 aa, Artificial Sequence
  Description of Artificial Sequence: Synthetic polypeptide
DEEEISTTNPVATEQYGSVSTNLQGFNSNTS

SEQ ID NO: 37906 - protein, 31 aa, Artificial Sequence
  Description of Artificial Sequence: Synthetic polypeptide
DEEEISTTNPVATEQYGSVSTNLQNFPSNAG

SEQ ID NO: 37907 - protein, 31 aa, Artificial Sequence
  Description of Artificial Sequence: Synthetic polypeptide
DEEEISTTNPVATEQYGSVSTNNLFQVTGEI

SEQ ID NO: 37908 - protein, 31 aa, Artificial Sequence
  Description of Artificial Sequence: Synthetic polypeptide
DEEEISTTNPVATEQYGSVSTNPQRFGSDLS

SEQ ID NO: 37909 - protein, 32 aa, Artificial Sequence
  Description of Artificial Sequence: Synthetic polypeptide
DEEEIRTTNPVAYEQYGYSVSQNDLYQRGIHR

SEQ ID NO: 37910 - protein, 30 aa, Artificial Sequence
  Description of Artificial Sequence: Synthetic polypeptide
DEEEISTTNPVATEQYGSVSTGNHQNGEQG

SEQ ID NO: 37911 - protein, 33 aa, Artificial Sequence
  Description of Artificial Sequence: Synthetic polypeptide
DEEEIRTTNPVATEQYGSVGSTVNLQNDGINDQ

SEQ ID NO: 37912 - protein, 32 aa, Artificial Sequence
  Description of Artificial Sequence: Synthetic polypeptide
DEEEISTTNPVATEQYGSVSTELQFSGSNNRT

SEQ ID NO: 37913 - protein, 32 aa, Artificial Sequence
  Description of Artificial Sequence: Synthetic polypeptide
DEEEISTTNPVATEQYGSVCSTPLQERFGSNQ

SEQ ID NO: 37914 - protein, 30 aa, Artificial Sequence
  Description of Artificial Sequence: Synthetic polypeptide
DEEEIATTNPVATEQYGSVATNLQVANPES

SEQ ID NO: 37915 - protein, 30 aa, Artificial Sequence
  Description of Artificial Sequence: Synthetic polypeptide
DEEEIATTNPVATEQYGSVATNLQVDDNGQ

SEQ ID NO: 37916 - protein, 30 aa, Artificial Sequence
  Description of Artificial Sequence: Synthetic polypeptide
DEEEIATTNPVATEQYGSVATNLTDGGNEN

SEQ ID NO: 37917 - protein, 31 aa, Artificial Sequence
  Description of Artificial Sequence: Synthetic polypeptide
DEEEISTTNPVATEQYGSVCSWNLQYFGSQR

SEQ ID NO: 37918 - protein, 33 aa, Artificial Sequence
  Description of Artificial Sequence: Synthetic polypeptide
DEEEIRTTNPVATEQYGSVGSTVNLQFTGENEI

SEQ ID NO: 37919 - protein, 31 aa, Artificial Sequence
  Description of Artificial Sequence: Synthetic polypeptide
DEEEIATTNPVATEQYGSVATNLTRPGENPE

SEQ ID NO: 37920 - protein, 29 aa, Artificial Sequence
  Description of Artificial Sequence: Synthetic peptide
DEEEISTTNPVATEQYGSVSANNHQYGEI

SEQ ID NO: 37921 - protein, 30 aa, Artificial Sequence
  Description of Artificial Sequence: Synthetic polypeptide
DEEEIRTTNPVAYERYGNVSTNLSQRVGSL

SEQ ID NO: 37922 - protein, 32 aa, Artificial Sequence
  Description of Artificial Sequence: Synthetic polypeptide
DEEEISTTNPVATEQYGSVSNTNLQNSGSERN

SEQ ID NO: 37923 - protein, 31 aa, Artificial Sequence
  Description of Artificial Sequence: Synthetic polypeptide
DEEEISTTNPVATEQYGSVSSPLQRFGSNQM

SEQ ID NO: 37924 - protein, 33 aa, Artificial Sequence
  Description of Artificial Sequence: Synthetic polypeptide
DEEEIRTTNPVATEQYGSVGSTVNLQINEGINT

SEQ ID NO: 37925 - protein, 31 aa, Artificial Sequence
  Description of Artificial Sequence: Synthetic polypeptide
DEEEISTTNPVATEQYGSVSTEEMQTGSNIR

SEQ ID NO: 37926 - protein, 31 aa, Artificial Sequence
  Description of Artificial Sequence: Synthetic polypeptide
DEEEISTTNPVATEQYGSVSTELNQNNSNRS

SEQ ID NO: 37927 - protein, 32 aa, Artificial Sequence
  Description of Artificial Sequence: Synthetic polypeptide
DEEEISTTNPVATEQYGSVSTELQEHSGSNRE

SEQ ID NO: 37928 - protein, 32 aa, Artificial Sequence
  Description of Artificial Sequence: Synthetic polypeptide
DEEEIRTTNPVAYEQYGTSVSENDLLQRGIRR

SEQ ID NO: 37929 - protein, 30 aa, Artificial Sequence
  Description of Artificial Sequence: Synthetic polypeptide
DEEEISTTNPVATEQYGCVSTNLQYFGSDQ

SEQ ID NO: 37930 - protein, 31 aa, Artificial Sequence
  Description of Artificial Sequence: Synthetic polypeptide
DEEGIRTTNPVATEQWGSVCTNNLQGLGVNR

SEQ ID NO: 37931 - protein, 30 aa, Artificial Sequence
  Description of Artificial Sequence: Synthetic polypeptide
DEEGIRTTNPVATEQYGDVSITNGQGGDNQ

SEQ ID NO: 37932 - protein, 30 aa, Artificial Sequence
  Description of Artificial Sequence: Synthetic polypeptide
DEEPIRTTNPVATEQYGCVSTNCQFGNEMP

SEQ ID NO: 37933 - protein, 30 aa, Artificial Sequence
  Description of Artificial Sequence: Synthetic polypeptide
DEEPIRTTNPVATEQYGSVSTGEGDRGNTS

SEQ ID NO: 37934 - protein, 31 aa, Artificial Sequence
  Description of Artificial Sequence: Synthetic polypeptide
DEEPIRTTNPVATEQYGYSISTNELQLVGER

SEQ ID NO: 37935 - protein, 31 aa, Artificial Sequence
  Description of Artificial Sequence: Synthetic polypeptide
DEEPIRTTNPVATEQYNSEVLSTNLGNGNDR

SEQ ID NO: 37936 - protein, 32 aa, Artificial Sequence
  Description of Artificial Sequence: Synthetic polypeptide
DEEEIRTTNPVAYEQYGSVVQSCTNLQSGGNT

SEQ ID NO: 37937 - protein, 30 aa, Artificial Sequence
  Description of Artificial Sequence: Synthetic polypeptide
DEEPIRTTNPVATEQYNSEVSTNLGGGNDY

SEQ ID NO: 37938 - protein, 33 aa, Artificial Sequence
  Description of Artificial Sequence: Synthetic polypeptide
DEEEIRTTNPVAYEQYGSVVSCTFELSQRGNYR

SEQ ID NO: 37939 - protein, 29 aa, Artificial Sequence
  Description of Artificial Sequence: Synthetic peptide
DEEPIRTTNPVATEQYSDEVSTNIEGGNR

SEQ ID NO: 37940 - protein, 30 aa, Artificial Sequence
  Description of Artificial Sequence: Synthetic polypeptide
DEEPIRTTNPVATEQYSEEVSTNLQIGNTT

SEQ ID NO: 37941 - protein, 29 aa, Artificial Sequence
  Description of Artificial Sequence: Synthetic peptide
DEEPIRTTNPVAYEQYAEEVTTNLQTGNR

SEQ ID NO: 37942 - protein, 33 aa, Artificial Sequence
  Description of Artificial Sequence: Synthetic polypeptide
DEEEIRTTNPVAYEQYGSVVNTGNLSQRGGNRT

SEQ ID NO: 37943 - protein, 31 aa, Artificial Sequence
  Description of Artificial Sequence: Synthetic polypeptide
DEEEIRTTNPVATEQYGSVETGLQPGQSERS

SEQ ID NO: 37944 - protein, 31 aa, Artificial Sequence
  Description of Artificial Sequence: Synthetic polypeptide
DEEEIRTTNPVATEQYGSVETGLQEMGNITD

SEQ ID NO: 37945 - protein, 30 aa, Artificial Sequence
  Description of Artificial Sequence: Synthetic polypeptide
DEEEIRTTNPVATEQYGSVETGLMTRVGDD

SEQ ID NO: 37946 - protein, 30 aa, Artificial Sequence
  Description of Artificial Sequence: Synthetic polypeptide
DEEPIRTTNPVATEQYSEEVSTNLQIGERD

SEQ ID NO: 37947 - protein, 31 aa, Artificial Sequence
  Description of Artificial Sequence: Synthetic polypeptide
DEEEIRTTNPVATEQYGSVETFTLQQGVNLS

SEQ ID NO: 37948 - protein, 30 aa, Artificial Sequence
  Description of Artificial Sequence: Synthetic polypeptide
DEEEIRTTNPVATEQYGSVETGLQTEVGMD

SEQ ID NO: 37949 - protein, 33 aa, Artificial Sequence
  Description of Artificial Sequence: Synthetic polypeptide
DEEEIRTTNPVAYEQYGSVVSCTGNGQRVGNRT

SEQ ID NO: 37950 - protein, 28 aa, Artificial Sequence
  Description of Artificial Sequence: Synthetic peptide
DDENIRTTNPVATEQYGAVSVNGQRINL

SEQ ID NO: 37951 - protein, 32 aa, Artificial Sequence
  Description of Artificial Sequence: Synthetic polypeptide
DEEEIRTTNPVAYEQYGSVVSCTNLQDPGGDR

SEQ ID NO: 37952 - protein, 29 aa, Artificial Sequence
  Description of Artificial Sequence: Synthetic peptide
DEEPIATTNPVATEGYSEEVSTNLQSGNR

SEQ ID NO: 37953 - protein, 31 aa, Artificial Sequence
  Description of Artificial Sequence: Synthetic polypeptide
DEEEIRTTNPVATEQYGSVETLLPQRNNLQD

SEQ ID NO: 37954 - protein, 29 aa, Artificial Sequence
  Description of Artificial Sequence: Synthetic peptide
DDENIRTTNPVATEQYGAVSTNGQRVNGM

SEQ ID NO: 37955 - protein, 30 aa, Artificial Sequence
  Description of Artificial Sequence: Synthetic polypeptide
DDENIRTTNPVATEQYGAVSTNGGQRGVNP

SEQ ID NO: 37956 - protein, 30 aa, Artificial Sequence
  Description of Artificial Sequence: Synthetic polypeptide
DEEPIRTTNPVATECYNSEVSTNLQIGNEG

SEQ ID NO: 37957 - protein, 29 aa, Artificial Sequence
  Description of Artificial Sequence: Synthetic peptide
DDENIRTTNPVATEQYGAVSTLNGQRENL

SEQ ID NO: 37958 - protein, 32 aa, Artificial Sequence
  Description of Artificial Sequence: Synthetic polypeptide
DEEEIRTTNPVATEQYGSVETGLSQTRVGEND

SEQ ID NO: 37959 - protein, 32 aa, Artificial Sequence
  Description of Artificial Sequence: Synthetic polypeptide
DEEEIRTTNPVAYEQYGSVVSCTNELSPRGNG

SEQ ID NO: 37960 - protein, 32 aa, Artificial Sequence
  Description of Artificial Sequence: Synthetic polypeptide
DEEEIRTTNPVATEQYGSVETGLQTRVGPNQD

SEQ ID NO: 37961 - protein, 29 aa, Artificial Sequence
  Description of Artificial Sequence: Synthetic peptide
DEEPIRCTNPVATEQYGCVSTNEQFGNEM

SEQ ID NO: 37962 - protein, 30 aa, Artificial Sequence
  Description of Artificial Sequence: Synthetic polypeptide
DEEPIRCTNPVATEQYGSVSVNADRGSNSR

SEQ ID NO: 37963 - protein, 30 aa, Artificial Sequence
  Description of Artificial Sequence: Synthetic polypeptide
DEEPIRTTNPVATEAYRWEVSTNLSQNGNR

SEQ ID NO: 37964 - protein, 30 aa, Artificial Sequence
  Description of Artificial Sequence: Synthetic polypeptide
DEEPIATTNPVATEQYSEEVSTNLQHGNRH

SEQ ID NO: 37965 - protein, 33 aa, Artificial Sequence
  Description of Artificial Sequence: Synthetic polypeptide
DEEEIRTTNPVAYEQYGSVVSGTNDLLQRGIRN

SEQ ID NO: 37966 - protein, 31 aa, Artificial Sequence
  Description of Artificial Sequence: Synthetic polypeptide
DEEEIRTTNPVATEQYGSVETFTLARGVNLD

SEQ ID NO: 37967 - protein, 31 aa, Artificial Sequence
  Description of Artificial Sequence: Synthetic polypeptide
DEEEIRTTNPVATEQYGSVETELQEIEGEER

SEQ ID NO: 37968 - protein, 30 aa, Artificial Sequence
  Description of Artificial Sequence: Synthetic polypeptide
DEEQIRTTNPVATEQYGAVSTNDQMFGVNC

SEQ ID NO: 37969 - protein, 28 aa, Artificial Sequence
  Description of Artificial Sequence: Synthetic peptide
DEEQIRTTNPVATEQYGAVSTNQQFLTC

SEQ ID NO: 37970 - protein, 32 aa, Artificial Sequence
  Description of Artificial Sequence: Synthetic polypeptide
DEEEIRTTNPVAYEQYGSVSYTNLQFTGGNNS

SEQ ID NO: 37971 - protein, 33 aa, Artificial Sequence
  Description of Artificial Sequence: Synthetic polypeptide
DEEEIRTTNPVAYEQYGSVSYTHLSQRGGNNRN

SEQ ID NO: 37972 - protein, 29 aa, Artificial Sequence
  Description of Artificial Sequence: Synthetic peptide
DEEQIRTTNPVATEQYGAVSTNQVVGNGC

SEQ ID NO: 37973 - protein, 32 aa, Artificial Sequence
  Description of Artificial Sequence: Synthetic polypeptide
DEEEIRTTNPVATEQYGSVHPTVVLQRGFNDD

SEQ ID NO: 37974 - protein, 30 aa, Artificial Sequence
  Description of Artificial Sequence: Synthetic polypeptide
DEEQIRTTNPVATEQWGSVSTHELNRGENT

SEQ ID NO: 37975 - protein, 28 aa, Artificial Sequence
  Description of Artificial Sequence: Synthetic peptide
DEEQIRTTNPVATEQYGCVSTEEINGNT

SEQ ID NO: 37976 - protein, 32 aa, Artificial Sequence
  Description of Artificial Sequence: Synthetic polypeptide
DEEEIRTTNPVAYEQYGSVSVTNQSQSTGGNR

SEQ ID NO: 37977 - protein, 33 aa, Artificial Sequence
  Description of Artificial Sequence: Synthetic polypeptide
DEEEIRTTNPVATEQYGSVESTNGLQQLEGNNA

SEQ ID NO: 37978 - protein, 30 aa, Artificial Sequence
  Description of Artificial Sequence: Synthetic polypeptide
DEEQIRTTNPVATEQYGSVCSTGEELRGNQ

SEQ ID NO: 37979 - protein, 30 aa, Artificial Sequence
  Description of Artificial Sequence: Synthetic polypeptide
DEEQIRTTNPVATEQYGSVCSTHELRGNDT

SEQ ID NO: 37980 - protein, 33 aa, Artificial Sequence
  Description of Artificial Sequence: Synthetic polypeptide
DEEEIRTTNPVAYEQYGSVSVTNELSQQEGNER

SEQ ID NO: 37981 - protein, 30 aa, Artificial Sequence
  Description of Artificial Sequence: Synthetic polypeptide
DEEQIRTTNPVATEQYGSVCSTYELRFGNQ

SEQ ID NO: 37982 - protein, 29 aa, Artificial Sequence
  Description of Artificial Sequence: Synthetic peptide
DEEQIRTTNPVATEQYGKVSTHHSTRGNT

SEQ ID NO: 37983 - protein, 28 aa, Artificial Sequence
  Description of Artificial Sequence: Synthetic peptide
DEEQIACTNPVATEQYGSVASNDQRGNL

SEQ ID NO: 37984 - protein, 31 aa, Artificial Sequence
  Description of Artificial Sequence: Synthetic polypeptide
DEEQIRTTNPVATEQWGSVATNNLQQGVNQR

SEQ ID NO: 37985 - protein, 29 aa, Artificial Sequence
  Description of Artificial Sequence: Synthetic peptide
DDEEISTTNPVATQQYGCVSTNPIRGSNR

SEQ ID NO: 37986 - protein, 29 aa, Artificial Sequence
  Description of Artificial Sequence: Synthetic peptide
DEEQIATTNPVATEIYGCVATNLQVGDNR

SEQ ID NO: 37987 - protein, 28 aa, Artificial Sequence
  Description of Artificial Sequence: Synthetic peptide
DEEQIATTNPVATEQWGSVSTHWNRGNT

SEQ ID NO: 37988 - protein, 30 aa, Artificial Sequence
  Description of Artificial Sequence: Synthetic polypeptide
DEEEIRTTNPVATEQYGSVETALQAGPPCN

SEQ ID NO: 37989 - protein, 29 aa, Artificial Sequence
  Description of Artificial Sequence: Synthetic peptide
DEEQIATTNPVATEQYGSVSATHGERGNT

SEQ ID NO: 37990 - protein, 33 aa, Artificial Sequence
  Description of Artificial Sequence: Synthetic polypeptide
DEEEIRTTNPVAYEQYGSVSYTPNELSQRGGPR

SEQ ID NO: 37991 - protein, 30 aa, Artificial Sequence
  Description of Artificial Sequence: Synthetic polypeptide
DEEEIRTTNPVATEQYGSVETALIEDENER

SEQ ID NO: 37992 - protein, 28 aa, Artificial Sequence
  Description of Artificial Sequence: Synthetic peptide
DDEEISTTNPVATFQYGSVSTNPIYGNQ

SEQ ID NO: 37993 - protein, 31 aa, Artificial Sequence
  Description of Artificial Sequence: Synthetic polypeptide
DEEEIRTTNPVAYEQYGSVSYTNLSQQAGSQ

SEQ ID NO: 37994 - protein, 30 aa, Artificial Sequence
  Description of Artificial Sequence: Synthetic polypeptide
DEEQICTVNPVATEQYGSVSTALQRGNQEN

SEQ ID NO: 37995 - protein, 28 aa, Artificial Sequence
  Description of Artificial Sequence: Synthetic peptide
DEEQIGTTNPVATEQYGSVSTGGLGGNT

SEQ ID NO: 37996 - protein, 29 aa, Artificial Sequence
  Description of Artificial Sequence: Synthetic peptide
DEEQIRATNPVATEQYGSVSENDQQGNNL

SEQ ID NO: 37997 - protein, 30 aa, Artificial Sequence
  Description of Artificial Sequence: Synthetic polypeptide
DEEQIRTTNPVATEGYGSVSTNHELRGNMT

SEQ ID NO: 37998 - protein, 29 aa, Artificial Sequence
  Description of Artificial Sequence: Synthetic peptide
DEEQIRTTNPVATEPYGTVTTNLQRASTR

SEQ ID NO: 37999 - protein, 31 aa, Artificial Sequence
  Description of Artificial Sequence: Synthetic polypeptide
DEEQIRTTNPVATEQWGSVAATNNLQQGVNR

SEQ ID NO: 38000 - protein, 28 aa, Artificial Sequence
  Description of Artificial Sequence: Synthetic peptide
DEEQIATTNPVAYEQYGSVSTHEERGNT

SEQ ID NO: 38001 - protein, 32 aa, Artificial Sequence
  Description of Artificial Sequence: Synthetic polypeptide
DEEEIRTTNPVATEQYGSVETLNLQRGEQEDV

SEQ ID NO: 38002 - protein, 32 aa, Artificial Sequence
  Description of Artificial Sequence: Synthetic polypeptide
DEEEIRTTNPVAYEQYGSVVSSNDLLQRGIGR

SEQ ID NO: 38003 - protein, 32 aa, Artificial Sequence
  Description of Artificial Sequence: Synthetic polypeptide
DEEEIRTTNPVAYEQYGSVVSTNAGSQRENNR

SEQ ID NO: 38004 - protein, 31 aa, Artificial Sequence
  Description of Artificial Sequence: Synthetic polypeptide
DEEEIRTTNPVATEQYGSVETTILEQRGVID

SEQ ID NO: 38005 - protein, 31 aa, Artificial Sequence
  Description of Artificial Sequence: Synthetic polypeptide
DEEEIRTTNPVAYEQYGSVWTNLQVTVGSRM

SEQ ID NO: 38006 - protein, 31 aa, Artificial Sequence
  Description of Artificial Sequence: Synthetic polypeptide
DDMEIRTTNPVATEQYGSVSTNDLQSGSDRM

SEQ ID NO: 38007 - protein, 30 aa, Artificial Sequence
  Description of Artificial Sequence: Synthetic polypeptide
DDMEIRTTNPVATEQYGSVCSTNPLQFGDQ

SEQ ID NO: 38008 - protein, 32 aa, Artificial Sequence
  Description of Artificial Sequence: Synthetic polypeptide
DEEEIRTTNPVATEQYGSVGTNTQNLQIEGNQ

SEQ ID NO: 38009 - protein, 30 aa, Artificial Sequence
  Description of Artificial Sequence: Synthetic polypeptide
DDMEIRTTNPVATEQYGSVCSTEDLQHGDR

SEQ ID NO: 38010 - protein, 30 aa, Artificial Sequence
  Description of Artificial Sequence: Synthetic polypeptide
DDMEIRTTNPVATEQYGSVSTNGLQQGMPN

SEQ ID NO: 38011 - protein, 31 aa, Artificial Sequence
  Description of Artificial Sequence: Synthetic polypeptide
DEEEIRTTNPVATEQYGSVETSGLEQRGGEL

SEQ ID NO: 38012 - protein, 30 aa, Artificial Sequence
  Description of Artificial Sequence: Synthetic polypeptide
DEEEIRTTNPVATEQYGSVETPSLIRNDNE

SEQ ID NO: 38013 - protein, 30 aa, Artificial Sequence
  Description of Artificial Sequence: Synthetic polypeptide
DEEGIRTTNPVATEQYGYSISTNECQVGER

SEQ ID NO: 38014 - protein, 30 aa, Artificial Sequence
  Description of Artificial Sequence: Synthetic polypeptide
DEEEIRTTNPVATEQYGSVGTPGLARGVEE

SEQ ID NO: 38015 - protein, 32 aa, Artificial Sequence
  Description of Artificial Sequence: Synthetic polypeptide
DEEEIRTTNPVATEQYGSVETNVVQRGLDIRV

SEQ ID NO: 38016 - protein, 31 aa, Artificial Sequence
  Description of Artificial Sequence: Synthetic polypeptide
DEEEIRTTNPVATEQYGSVETNQQVDVNERG

SEQ ID NO: 38017 - protein, 28 aa, Artificial Sequence
  Description of Artificial Sequence: Synthetic peptide
DEEHIRTTNPVATECYGKGSTNEQRVNF

SEQ ID NO: 38018 - protein, 32 aa, Artificial Sequence
  Description of Artificial Sequence: Synthetic polypeptide
DEEEIRTTNPVATEQYGSVGTNVGQEVFGNQR

SEQ ID NO: 38019 - protein, 30 aa, Artificial Sequence
  Description of Artificial Sequence: Synthetic polypeptide
DEEHIRTTNPVATEQWGSVITNNLQLGVHR

SEQ ID NO: 38020 - protein, 30 aa, Artificial Sequence
  Description of Artificial Sequence: Synthetic polypeptide
DEEGIRTTNPVATEQYGSVSTTQGDNGQNR

SEQ ID NO: 38021 - protein, 31 aa, Artificial Sequence
  Description of Artificial Sequence: Synthetic polypeptide
DEEGIRTTNPVATEQYGSVSTNLNDTNGQNT

SEQ ID NO: 38022 - protein, 29 aa, Artificial Sequence
  Description of Artificial Sequence: Synthetic peptide
DEEGIRTTNPVATEQYGDVSTNGGQGGEQ

SEQ ID NO: 38023 - protein, 30 aa, Artificial Sequence
  Description of Artificial Sequence: Synthetic polypeptide
DEEGIRTTNPVATEQYGDVSTNGQEGGGNQ

SEQ ID NO: 38024 - protein, 30 aa, Artificial Sequence
  Description of Artificial Sequence: Synthetic polypeptide
DEEGIRTTNPVATEQYGDVSTNGQGEGNGQ

SEQ ID NO: 38025 - protein, 30 aa, Artificial Sequence
  Description of Artificial Sequence: Synthetic polypeptide
DEEGIRTTNPVATEQYGDVSTNGQGGGNDQ

SEQ ID NO: 38026 - protein, 30 aa, Artificial Sequence
  Description of Artificial Sequence: Synthetic polypeptide
DEEEIRTTNPVAYEQYGTCSTNNPLQRENN

SEQ ID NO: 38027 - protein, 29 aa, Artificial Sequence
  Description of Artificial Sequence: Synthetic peptide
DEEEIRTTNPVAYEQYGSVWWNLQYFDDR

SEQ ID NO: 38028 - protein, 30 aa, Artificial Sequence
  Description of Artificial Sequence: Synthetic polypeptide
DEEGIRTTNPVATEQYGSVSTPHEARNGNT

SEQ ID NO: 38029 - protein, 28 aa, Artificial Sequence
  Description of Artificial Sequence: Synthetic peptide
DEEGIRTTNPVATEQYGSVETAEARGPT

SEQ ID NO: 38030 - protein, 29 aa, Artificial Sequence
  Description of Artificial Sequence: Synthetic peptide
DEEGIRTTNPVATEQYGSVSTGDDLGGNT

SEQ ID NO: 38031 - protein, 29 aa, Artificial Sequence
  Description of Artificial Sequence: Synthetic peptide
DEEGIRTTNPVATEQYGSVSTGDGGGENT

SEQ ID NO: 38032 - protein, 29 aa, Artificial Sequence
  Description of Artificial Sequence: Synthetic peptide
DEEGIRTTNPVATEQYGSVSTHEAVVGNT

SEQ ID NO: 38033 - protein, 30 aa, Artificial Sequence
  Description of Artificial Sequence: Synthetic polypeptide
DEEEIRTTNPVAYEQYGSVWTNLSQGPDSR

SEQ ID NO: 38034 - protein, 31 aa, Artificial Sequence
  Description of Artificial Sequence: Synthetic polypeptide
DEEGIRTTNPVATEQYGSVSTNLGDENGQNF

SEQ ID NO: 38035 - protein, 31 aa, Artificial Sequence
  Description of Artificial Sequence: Synthetic polypeptide
DEEGIRTTNPVATEQYGSVSTNLNDNGGQNN

SEQ ID NO: 38036 - protein, 32 aa, Artificial Sequence
  Description of Artificial Sequence: Synthetic polypeptide
DEEEIRTTNPVATEQYGSVETTNLIQTEGINP

SEQ ID NO: 38037 - protein, 31 aa, Artificial Sequence
  Description of Artificial Sequence: Synthetic polypeptide
DEEHIRTTNPVATEQWGSVMTNNLQHPGVNR

SEQ ID NO: 38038 - protein, 30 aa, Artificial Sequence
  Description of Artificial Sequence: Synthetic polypeptide
DEEEIRTTNPVAYEQYGSVWTNELQVHVSR

SEQ ID NO: 38039 - protein, 31 aa, Artificial Sequence
  Description of Artificial Sequence: Synthetic polypeptide
DEEEIRTTNPVATEQYGSVETNLTRNISEQR

SEQ ID NO: 38040 - protein, 29 aa, Artificial Sequence
  Description of Artificial Sequence: Synthetic peptide
DEENIRTTNPVATEIYGQVTTNLQRGSDG

SEQ ID NO: 38041 - protein, 30 aa, Artificial Sequence
  Description of Artificial Sequence: Synthetic polypeptide
DEENIRTTNPVATEIYGQVTTNNLQRGSNQ

SEQ ID NO: 38042 - protein, 29 aa, Artificial Sequence
  Description of Artificial Sequence: Synthetic peptide
DEENIRTTNPVATEIYGVVTTNLQQGSNQ

SEQ ID NO: 38043 - protein, 30 aa, Artificial Sequence
  Description of Artificial Sequence: Synthetic polypeptide
DEENIRTTNPVATEPYGQVATNLSQRGGSR

SEQ ID NO: 38044 - protein, 31 aa, Artificial Sequence
  Description of Artificial Sequence: Synthetic polypeptide
DEENIRTTNPVATEPYGTVITNLQRQAGNRE

SEQ ID NO: 38045 - protein, 29 aa, Artificial Sequence
  Description of Artificial Sequence: Synthetic peptide
DEEEIRTTNPVAYEQYGSVWKNLQVFDSR

SEQ ID NO: 38046 - protein, 29 aa, Artificial Sequence
  Description of Artificial Sequence: Synthetic peptide
DEENIRTTNPVATEIYGQVTTNLQQGTNV

SEQ ID NO: 38047 - protein, 32 aa, Artificial Sequence
  Description of Artificial Sequence: Synthetic polypeptide
DEEEIRTTNPVAYEQYGSVVSTNLSQQEGNET

SEQ ID NO: 38048 - protein, 31 aa, Artificial Sequence
  Description of Artificial Sequence: Synthetic polypeptide
DEEEIRTTNPVATEQYGSVETMTGLQTQNDR

SEQ ID NO: 38049 - protein, 34 aa, Artificial Sequence
  Description of Artificial Sequence: Synthetic polypeptide
DEEEIRTTNPVAYEQYGSVVSTNLSQERTGGNRE

SEQ ID NO: 38050 - protein, 33 aa, Artificial Sequence
  Description of Artificial Sequence: Synthetic polypeptide
DEEEIRTTNPVAYEQYGSVVSTNGSQRVGNMRT

SEQ ID NO: 38051 - protein, 32 aa, Artificial Sequence
  Description of Artificial Sequence: Synthetic polypeptide
DEENIRTTNPVATEQYGSVYSTNCQDQNWGNR

SEQ ID NO: 38052 - protein, 29 aa, Artificial Sequence
  Description of Artificial Sequence: Synthetic peptide
DEENIRTTNPVATESYGQVTTNLQAGSND

SEQ ID NO: 38053 - protein, 32 aa, Artificial Sequence
  Description of Artificial Sequence: Synthetic polypeptide
DEEEIRTTNPVAYEQYGSVVSTNDLLQTGILR

SEQ ID NO: 38054 - protein, 31 aa, Artificial Sequence
  Description of Artificial Sequence: Synthetic polypeptide
DEEEIRTTNPVATEQYGSVETNGLIETGNDE

SEQ ID NO: 38055 - protein, 32 aa, Artificial Sequence
  Description of Artificial Sequence: Synthetic polypeptide
DEEEIRTTNPVATEQYGSVETNLIRPDENPRT

SEQ ID NO: 38056 - protein, 31 aa, Artificial Sequence
  Description of Artificial Sequence: Synthetic polypeptide
DEEEIRTTNPVATEQYGSVETNLIRVGQVDN

SEQ ID NO: 38057 - protein, 28 aa, Artificial Sequence
  Description of Artificial Sequence: Synthetic peptide
DDETIRTTNPVATEQYGSVSTGDGGGNT

SEQ ID NO: 38058 - protein, 31 aa, Artificial Sequence
  Description of Artificial Sequence: Synthetic polypeptide
DEEEIRTTNPVAYEQYGSVWTNELQGFVGSR

SEQ ID NO: 38059 - protein, 29 aa, Artificial Sequence
  Description of Artificial Sequence: Synthetic peptide
DEEIIATTNPVATEQYGCVSTNNQFGGNE

SEQ ID NO: 38060 - protein, 29 aa, Artificial Sequence
  Description of Artificial Sequence: Synthetic peptide
DEEEIRTTNPVAYEQYGSVWTNDQSFDDR

SEQ ID NO: 38061 - protein, 30 aa, Artificial Sequence
  Description of Artificial Sequence: Synthetic polypeptide
DEEIIRTTNPVATEQYGAVSTNQQFQGQND

SEQ ID NO: 38062 - protein, 29 aa, Artificial Sequence
  Description of Artificial Sequence: Synthetic peptide
DEEIIRTTNPVATEQYGCVSTNAQFPENE

SEQ ID NO: 38063 - protein, 30 aa, Artificial Sequence
  Description of Artificial Sequence: Synthetic polypeptide
DEEIIRTTNPVATEQYGCVSTNCEQFGNEF

SEQ ID NO: 38064 - protein, 30 aa, Artificial Sequence
  Description of Artificial Sequence: Synthetic polypeptide
DEEIIRTTNPVATEQYGCVSTNNQFPGNQE

SEQ ID NO: 38065 - protein, 29 aa, Artificial Sequence
  Description of Artificial Sequence: Synthetic peptide
DEEIIRTTNPVATEQYGMVSTNCEFGNCQ

SEQ ID NO: 38066 - protein, 30 aa, Artificial Sequence
  Description of Artificial Sequence: Synthetic polypeptide
DDGEIRTTNPVATEQYGSVSTNWEQEGDRQ

SEQ ID NO: 38067 - protein, 31 aa, Artificial Sequence
  Description of Artificial Sequence: Synthetic polypeptide
DDGEIRTTNPVATEQYGSVSTNGLQQGMIRP

SEQ ID NO: 38068 - protein, 30 aa, Artificial Sequence
  Description of Artificial Sequence: Synthetic polypeptide
DDGEIRTTNPVATEQYGCVSTNPLQLGEMR

SEQ ID NO: 38069 - protein, 29 aa, Artificial Sequence
  Description of Artificial Sequence: Synthetic peptide
DEENIATTNPVATEIYGCVATNLQIGQNR

SEQ ID NO: 38070 - protein, 29 aa, Artificial Sequence
  Description of Artificial Sequence: Synthetic peptide
DDEVIRTTNPVATEQYGAVSTNEQMRVNL

SEQ ID NO: 38071 - protein, 29 aa, Artificial Sequence
  Description of Artificial Sequence: Synthetic peptide
DEENIRATNPVATEQYGSVSNNQGQLGNL

SEQ ID NO: 38072 - protein, 31 aa, Artificial Sequence
  Description of Artificial Sequence: Synthetic polypeptide
DEEEIRTTNPVAYEQYGSVWTNALQTADGSR

SEQ ID NO: 38073 - protein, 32 aa, Artificial Sequence
  Description of Artificial Sequence: Synthetic polypeptide
DEEEIRTTNPVATEQYGSVETTNLQRGMEIDD

SEQ ID NO: 38074 - protein, 29 aa, Artificial Sequence
  Description of Artificial Sequence: Synthetic peptide
DEEQIRTTNPVATEQYGSVETVELRSGNT

SEQ ID NO: 38075 - protein, 30 aa, Artificial Sequence
  Description of Artificial Sequence: Synthetic polypeptide
DEEEISTTNPVATEQYGCVSTNLQNNSQRG

SEQ ID NO: 38076 - protein, 32 aa, Artificial Sequence
  Description of Artificial Sequence: Synthetic polypeptide
DEEEISTTNPVATEQYGCVSTNLFQNFGSNRM

SEQ ID NO: 38077 - protein, 29 aa, Artificial Sequence
  Description of Artificial Sequence: Synthetic peptide
DEEEIRTTNPVGTEQYGSVSTNFEGEGGN

SEQ ID NO: 38078 - protein, 31 aa, Artificial Sequence
  Description of Artificial Sequence: Synthetic polypeptide
DEEEIRTTNPVATEQYGSVGNTNQQGGGNEQ

SEQ ID NO: 38079 - protein, 30 aa, Artificial Sequence
  Description of Artificial Sequence: Synthetic polypeptide
DEEEIATTNPVATEQYGSVAMNLQTDGNQV

SEQ ID NO: 38080 - protein, 29 aa, Artificial Sequence
  Description of Artificial Sequence: Synthetic peptide
DEEEIRTTNPVTTEIYGSVSTNLLGIGTD

SEQ ID NO: 38081 - protein, 31 aa, Artificial Sequence
  Description of Artificial Sequence: Synthetic polypeptide
DEEEIRTTNPVGTEQYGSVSTNELGRGSDQA

SEQ ID NO: 38082 - protein, 28 aa, Artificial Sequence
  Description of Artificial Sequence: Synthetic peptide
DEEEIRTTNPYATEQYGSVHEGEMRGNA

SEQ ID NO: 38083 - protein, 29 aa, Artificial Sequence
  Description of Artificial Sequence: Synthetic peptide
DEEEIRTTNPVGTEQYGSVSTNFEGGGMP

SEQ ID NO: 38084 - protein, 29 aa, Artificial Sequence
  Description of Artificial Sequence: Synthetic peptide
DEEEIATTNPVATEQYGSVAMNNQEQGNQ

SEQ ID NO: 38085 - protein, 29 aa, Artificial Sequence
  Description of Artificial Sequence: Synthetic peptide
DEEEIATTNPVATEQYGSVANNLQDGTEE

SEQ ID NO: 38086 - protein, 29 aa, Artificial Sequence
  Description of Artificial Sequence: Synthetic peptide
DEEEIATTNPVATEQYGSVANNLQDGTPQ

SEQ ID NO: 38087 - protein, 30 aa, Artificial Sequence
  Description of Artificial Sequence: Synthetic polypeptide
DEEEIRTTNPVGTEQYGSVSTNELGIGGDP

SEQ ID NO: 38088 - protein, 31 aa, Artificial Sequence
  Description of Artificial Sequence: Synthetic polypeptide
DEEEIATTNPVATEQYGSVANNLQEMGNDRE

SEQ ID NO: 38089 - protein, 31 aa, Artificial Sequence
  Description of Artificial Sequence: Synthetic polypeptide
DEEEIATTNPVATEQYGSVANNLQESGTNDR

SEQ ID NO: 38090 - protein, 29 aa, Artificial Sequence
  Description of Artificial Sequence: Synthetic peptide
DEEEIRTVNPVATEQYGSVATGLQRNQEH

SEQ ID NO: 38091 - protein, 30 aa, Artificial Sequence
  Description of Artificial Sequence: Synthetic polypeptide
DEEEIATTNPVATEQYGSVAMTNGGQRGPF

SEQ ID NO: 38092 - protein, 32 aa, Artificial Sequence
  Description of Artificial Sequence: Synthetic polypeptide
DEEEIRTTNPVGTEQYGSVSTNALSGRPGSNP

SEQ ID NO: 38093 - protein, 31 aa, Artificial Sequence
  Description of Artificial Sequence: Synthetic polypeptide
DEEEIRTTNPVGTEQYGSVSTNFLGMRGLPD

SEQ ID NO: 38094 - protein, 28 aa, Artificial Sequence
  Description of Artificial Sequence: Synthetic peptide
DEEEIRTTNPVSYEQYGSVAINLQGGQT

SEQ ID NO: 38095 - protein, 32 aa, Artificial Sequence
  Description of Artificial Sequence: Synthetic polypeptide
DEEEIRTTNPVATEQYGSVGSTDNDQNEMGNP

SEQ ID NO: 38096 - protein, 30 aa, Artificial Sequence
  Description of Artificial Sequence: Synthetic polypeptide
DEEEIRTTNPVGTEQYGSVSTNGQGEGFQF

SEQ ID NO: 38097 - protein, 28 aa, Artificial Sequence
  Description of Artificial Sequence: Synthetic peptide
DEEEIRTTNPVSTEQYGSVTSNQQGGQT

SEQ ID NO: 38098 - protein, 28 aa, Artificial Sequence
  Description of Artificial Sequence: Synthetic peptide
DEEEIRTTNPVSTEQYGSVTSNTQGGQQ

SEQ ID NO: 38099 - protein, 29 aa, Artificial Sequence
  Description of Artificial Sequence: Synthetic peptide
DEEEIATTNPVATEQYGSVAMNDNRGNQQ

SEQ ID NO: 38100 - protein, 28 aa, Artificial Sequence
  Description of Artificial Sequence: Synthetic peptide
DEEEIRTTNPVSTEQYGSVTWNLHGGQT

SEQ ID NO: 38101 - protein, 30 aa, Artificial Sequence
  Description of Artificial Sequence: Synthetic polypeptide
DEEEIRTTNPVGTEQYGSVSTNFLGVGFEP

SEQ ID NO: 38102 - protein, 29 aa, Artificial Sequence
  Description of Artificial Sequence: Synthetic peptide
DEEEIRTTNPVSTEQYGSVVGNLQGGGQT

SEQ ID NO: 38103 - protein, 31 aa, Artificial Sequence
  Description of Artificial Sequence: Synthetic polypeptide
DEEEIRTTNPVATEQYGSVGPTINEQRNNDQ

SEQ ID NO: 38104 - protein, 31 aa, Artificial Sequence
  Description of Artificial Sequence: Synthetic polypeptide
DEEEIRTTNPVATEQYGSVGPPNLQRLENMV

SEQ ID NO: 38105 - protein, 29 aa, Artificial Sequence
  Description of Artificial Sequence: Synthetic peptide
DEEEIRTTNPVSTEQYGVVSDDLQQSGNQ

SEQ ID NO: 38106 - protein, 29 aa, Artificial Sequence
  Description of Artificial Sequence: Synthetic peptide
DEEEIATTNPVATEQYGSVAMNLQDGTQH

SEQ ID NO: 38107 - protein, 30 aa, Artificial Sequence
  Description of Artificial Sequence: Synthetic polypeptide
DEEEIRTTNPVGTEQYGSVSTNGLGEGEQT

SEQ ID NO: 38108 - protein, 31 aa, Artificial Sequence
  Description of Artificial Sequence: Synthetic polypeptide
DEEEIRTTNPVGTEQYGSVSTNFLPGGGFNP

SEQ ID NO: 38109 - protein, 30 aa, Artificial Sequence
  Description of Artificial Sequence: Synthetic polypeptide
DEEEIRTTNPVGTEQYGSVSTNGLGEGQGP

SEQ ID NO: 38110 - protein, 29 aa, Artificial Sequence
  Description of Artificial Sequence: Synthetic peptide
DEEEIRTTNPVSTEQYGSVTSNLQVQGQT

SEQ ID NO: 38111 - protein, 30 aa, Artificial Sequence
  Description of Artificial Sequence: Synthetic polypeptide
DEEEIRTTNPVGTEQYGSVSTEDLGRGDQA

SEQ ID NO: 38112 - protein, 29 aa, Artificial Sequence
  Description of Artificial Sequence: Synthetic peptide
DEEEIATTNPVATEQYGSVANNLTSENRE

SEQ ID NO: 38113 - protein, 30 aa, Artificial Sequence
  Description of Artificial Sequence: Synthetic polypeptide
DEEEIRTVNPVATEQYGSVSTVLQRDDQEN

SEQ ID NO: 38114 - protein, 31 aa, Artificial Sequence
  Description of Artificial Sequence: Synthetic polypeptide
DEEEIRTTNPVGTEQYGSVCSTNELGRGDQS

SEQ ID NO: 38115 - protein, 29 aa, Artificial Sequence
  Description of Artificial Sequence: Synthetic peptide
DEEEIRTVNPVATEQYGSVSTVLQSDQPE

SEQ ID NO: 38116 - protein, 30 aa, Artificial Sequence
  Description of Artificial Sequence: Synthetic polypeptide
DEEEIRTVNPVATEQYGSVSVTDLQRNELE

SEQ ID NO: 38117 - protein, 29 aa, Artificial Sequence
  Description of Artificial Sequence: Synthetic peptide
DEEEIRTTNPVGTEQYGSVATNGLGGGFP

SEQ ID NO: 38118 - protein, 32 aa, Artificial Sequence
  Description of Artificial Sequence: Synthetic polypeptide
DEEEIRTTNPVATEQYGSVGGTNLVQGGGNGN

SEQ ID NO: 38119 - protein, 28 aa, Artificial Sequence
  Description of Artificial Sequence: Synthetic peptide
DEEEIRTTNPVGTEQYGSVDFNLIGGQT

SEQ ID NO: 38120 - protein, 30 aa, Artificial Sequence
  Description of Artificial Sequence: Synthetic polypeptide
DEEEIRTTNPVGTEQYGKVSTNMLSGRGEP

SEQ ID NO: 38121 - protein, 30 aa, Artificial Sequence
  Description of Artificial Sequence: Synthetic polypeptide
DEEEIRTTNPVGTEQYGCVSTNALGRGEQS

SEQ ID NO: 38122 - protein, 31 aa, Artificial Sequence
  Description of Artificial Sequence: Synthetic polypeptide
DEEEIRTTNPVATEQYGSVGSTMGQTDGPNT

SEQ ID NO: 38123 - protein, 30 aa, Artificial Sequence
  Description of Artificial Sequence: Synthetic polypeptide
DEEEIATTNPVATEQYGSVATNDERANMRM

SEQ ID NO: 38124 - protein, 30 aa, Artificial Sequence
  Description of Artificial Sequence: Synthetic polypeptide
DEEEIRTVNPVAYEQYGSVSTPELQRNGQE

SEQ ID NO: 38125 - protein, 29 aa, Artificial Sequence
  Description of Artificial Sequence: Synthetic peptide
DEEEIRTVNPVAYEQYGSVSTRELQRPSE

SEQ ID NO: 38126 - protein, 29 aa, Artificial Sequence
  Description of Artificial Sequence: Synthetic peptide
DEEEIRTVNPVAYEQYGSVSTRLQRTPQE

SEQ ID NO: 38127 - protein, 32 aa, Artificial Sequence
  Description of Artificial Sequence: Synthetic polypeptide
DEEEIRTTNPVATEQYGSVGGTNLIQNTGGNN

SEQ ID NO: 38128 - protein, 30 aa, Artificial Sequence
  Description of Artificial Sequence: Synthetic polypeptide
DEEEIRTTNPVGTEQYGSVSTDNFLGGGAP

SEQ ID NO: 38129 - protein, 29 aa, Artificial Sequence
  Description of Artificial Sequence: Synthetic peptide
DEEEIRTVNPVATEQYGSVSTVLEQNNQE

SEQ ID NO: 38130 - protein, 31 aa, Artificial Sequence
  Description of Artificial Sequence: Synthetic polypeptide
DEEEIATTNPVATEQYGSVASNLQEQGNDRS

SEQ ID NO: 38131 - protein, 30 aa, Artificial Sequence
  Description of Artificial Sequence: Synthetic polypeptide
DEEEIRTVNPVATEQYGSVSCTGLQRTVQE

SEQ ID NO: 38132 - protein, 31 aa, Artificial Sequence
  Description of Artificial Sequence: Synthetic polypeptide
DEEEIRTTNPVATEQYGSVGSTGNDGQNQNG

SEQ ID NO: 38133 - protein, 32 aa, Artificial Sequence
  Description of Artificial Sequence: Synthetic polypeptide
DEEEIRTTNPVGTEQYGSVSPTNYLTQRGQEP

SEQ ID NO: 38134 - protein, 30 aa, Artificial Sequence
  Description of Artificial Sequence: Synthetic polypeptide
DEEEIRTTNPVGTEQYGSVSPTNFLSVGFE

SEQ ID NO: 38135 - protein, 30 aa, Artificial Sequence
  Description of Artificial Sequence: Synthetic polypeptide
DEEEIRTTNPVGTEQYGSVSETNGLTRIFP

SEQ ID NO: 38136 - protein, 29 aa, Artificial Sequence
  Description of Artificial Sequence: Synthetic peptide
DEEEIRTVNPVATEQYGSVSTALSQENQE

SEQ ID NO: 38137 - protein, 30 aa, Artificial Sequence
  Description of Artificial Sequence: Synthetic polypeptide
DEEEIRTVNPVATEQYGSVSTSLLQRNVST

SEQ ID NO: 38138 - protein, 31 aa, Artificial Sequence
  Description of Artificial Sequence: Synthetic polypeptide
DEEEIRTVNPVATEQYGSVSTDLQRNDQNEQ

SEQ ID NO: 38139 - protein, 30 aa, Artificial Sequence
  Description of Artificial Sequence: Synthetic polypeptide
DEEEIATTNPVATEQYGSVASNDQRDENDR

SEQ ID NO: 38140 - protein, 30 aa, Artificial Sequence
  Description of Artificial Sequence: Synthetic polypeptide
DEEEIRTVNPVATEQYGSVSTMELQRNQQG

SEQ ID NO: 38141 - protein, 31 aa, Artificial Sequence
  Description of Artificial Sequence: Synthetic polypeptide
DEEEIRTVNPVATEQYGSVSTNQNQQDDGNK

SEQ ID NO: 38142 - protein, 29 aa, Artificial Sequence
  Description of Artificial Sequence: Synthetic peptide
DEEEIRTVNPVATEQYGSVSTPLQSNQQA

SEQ ID NO: 38143 - protein, 30 aa, Artificial Sequence
  Description of Artificial Sequence: Synthetic polypeptide
DEEEIRTVNPVATEQYGSVSTRELQRVQTE

SEQ ID NO: 38144 - protein, 30 aa, Artificial Sequence
  Description of Artificial Sequence: Synthetic polypeptide
DEEEIATTNPVATEQYGSVASNLQDPGNEH

SEQ ID NO: 38145 - protein, 30 aa, Artificial Sequence
  Description of Artificial Sequence: Synthetic polypeptide
DEEEIRTVNPVATEQYGSVSTEDQRFNQQG

SEQ ID NO: 38146 - protein, 29 aa, Artificial Sequence
  Description of Artificial Sequence: Synthetic peptide
DEEEIRTTNPVSTEQYGSVTSNLQGGQTN

SEQ ID NO: 38147 - protein, 30 aa, Artificial Sequence
  Description of Artificial Sequence: Synthetic polypeptide
DEEEIRTTNPVGTEQYGSVSTNNLGAGDFP

SEQ ID NO: 38148 - protein, 31 aa, Artificial Sequence
  Description of Artificial Sequence: Synthetic polypeptide
DEEEIATTNPVATEQYGSVAITNLQQGNNQL

SEQ ID NO: 38149 - protein, 29 aa, Artificial Sequence
  Description of Artificial Sequence: Synthetic peptide
DEEEIRTTNPVSTEQYGSVQVNLQIGGQT

SEQ ID NO: 38150 - protein, 29 aa, Artificial Sequence
  Description of Artificial Sequence: Synthetic peptide
DEEEIRTTNPVSTEQYGSVQWNLQGGQQS

SEQ ID NO: 38151 - protein, 31 aa, Artificial Sequence
  Description of Artificial Sequence: Synthetic polypeptide
DEEEIATTNPVATEQYGSVAATNLQAEGNGN

SEQ ID NO: 38152 - protein, 30 aa, Artificial Sequence
  Description of Artificial Sequence: Synthetic polypeptide
DEEEIRTTNPVSTEQYGSVSTDNLQGTDQT

SEQ ID NO: 38153 - protein, 33 aa, Artificial Sequence
  Description of Artificial Sequence: Synthetic polypeptide
DEEEIRTTNPVATEQYGSVGSNTNLIQGIGNGN

SEQ ID NO: 38154 - protein, 31 aa, Artificial Sequence
  Description of Artificial Sequence: Synthetic polypeptide
DEEEIATTNPVATEQYGSVAATNLQAPENNR

SEQ ID NO: 38155 - protein, 28 aa, Artificial Sequence
  Description of Artificial Sequence: Synthetic peptide
DEEEIRTTNPVSTEQYGSVQCNLLGGQT

SEQ ID NO: 38156 - protein, 29 aa, Artificial Sequence
  Description of Artificial Sequence: Synthetic peptide
DEEEIRTTNPVSTEQYGSVSTENLLGIQT

SEQ ID NO: 38157 - protein, 30 aa, Artificial Sequence
  Description of Artificial Sequence: Synthetic polypeptide
DEEEIRTTNPVSTEQYGSVSTNFLGPDGFP

SEQ ID NO: 38158 - protein, 31 aa, Artificial Sequence
  Description of Artificial Sequence: Synthetic polypeptide
DEEEIRTTNPVSTEQYGSVSTNFLGRGEFEP

SEQ ID NO: 38159 - protein, 31 aa, Artificial Sequence
  Description of Artificial Sequence: Synthetic polypeptide
DEEEIATTNPVATEQYGSVAATNLQDGNDNL

SEQ ID NO: 38160 - protein, 31 aa, Artificial Sequence
  Description of Artificial Sequence: Synthetic polypeptide
DEEEIRTTNPVSTEQYGSVSTNNNLQGTGQT

SEQ ID NO: 38161 - protein, 31 aa, Artificial Sequence
  Description of Artificial Sequence: Synthetic polypeptide
DEEEIATTNPVATEQYGSVAATNLQENDNER

SEQ ID NO: 38162 - protein, 32 aa, Artificial Sequence
  Description of Artificial Sequence: Synthetic polypeptide
DEEEIATTNPVATEQYGSVAATNLQREENPRE

SEQ ID NO: 38163 - protein, 30 aa, Artificial Sequence
  Description of Artificial Sequence: Synthetic polypeptide
DEEEIRTTNPVSTEQYGSVSTFNQQGTGQT

SEQ ID NO: 38164 - protein, 31 aa, Artificial Sequence
  Description of Artificial Sequence: Synthetic polypeptide
DEEEIRTTNPVSTEQYGSVSTVNFLGRVGFP

SEQ ID NO: 38165 - protein, 29 aa, Artificial Sequence
  Description of Artificial Sequence: Synthetic peptide
DEEEIRTTNPVSTEQYGSVPSNLQGGQTG

SEQ ID NO: 38166 - protein, 28 aa, Artificial Sequence
  Description of Artificial Sequence: Synthetic peptide
DEEEIRTTNPVSTEQYGCVGSNLQGNQT

SEQ ID NO: 38167 - protein, 29 aa, Artificial Sequence
  Description of Artificial Sequence: Synthetic peptide
DEEEIRTTNPVSTEQYGSVANNLQGNGPT

SEQ ID NO: 38168 - protein, 28 aa, Artificial Sequence
  Description of Artificial Sequence: Synthetic peptide
DEEEIRTTNPVSTEQYGSVAFNLQHDQT

SEQ ID NO: 38169 - protein, 29 aa, Artificial Sequence
  Description of Artificial Sequence: Synthetic peptide
DEEEIRTTNPVSTEQYGSVAQNALQGGQT

SEQ ID NO: 38170 - protein, 30 aa, Artificial Sequence
  Description of Artificial Sequence: Synthetic polypeptide
DEEEIRTTNPVSTEQYGSVAAVNLQGGNQT

SEQ ID NO: 38171 - protein, 29 aa, Artificial Sequence
  Description of Artificial Sequence: Synthetic peptide
DEEEIRTTNPVSTEQYGSVAANLQGGETP

SEQ ID NO: 38172 - protein, 30 aa, Artificial Sequence
  Description of Artificial Sequence: Synthetic polypeptide
DEEEIRTTNPVSTEQYGSVATNLQAPNNDD

SEQ ID NO: 38173 - protein, 33 aa, Artificial Sequence
  Description of Artificial Sequence: Synthetic polypeptide
DEEEIRTTNPVATEQYGSVGSNTNLFQGGGNEQ

SEQ ID NO: 38174 - protein, 29 aa, Artificial Sequence
  Description of Artificial Sequence: Synthetic peptide
DEEEIRTTNPVSTEQYGSVAVNLQGEGQT

SEQ ID NO: 38175 - protein, 30 aa, Artificial Sequence
  Description of Artificial Sequence: Synthetic polypeptide
DEEEIRTTNPVSTEQYGSCSTNFLERGGLP

SEQ ID NO: 38176 - protein, 29 aa, Artificial Sequence
  Description of Artificial Sequence: Synthetic peptide
DEEEIRTTNPVSTEQYGSVESNLQGNGQT

SEQ ID NO: 38177 - protein, 29 aa, Artificial Sequence
  Description of Artificial Sequence: Synthetic peptide
DEEEIRTTNPVSTEQYGSVGSNLQGGQQM

SEQ ID NO: 38178 - protein, 29 aa, Artificial Sequence
  Description of Artificial Sequence: Synthetic peptide
DEEEIRTTNPVSTEQYGSVNCNLSQGGQT

SEQ ID NO: 38179 - protein, 28 aa, Artificial Sequence
  Description of Artificial Sequence: Synthetic peptide
DEEEIRTTNPVSTEQYGSVNNNNQGGQT

SEQ ID NO: 38180 - protein, 29 aa, Artificial Sequence
  Description of Artificial Sequence: Synthetic peptide
DEEEIRTTNPVSTEQYGSVNVFNLQGGQT

SEQ ID NO: 38181 - protein, 29 aa, Artificial Sequence
  Description of Artificial Sequence: Synthetic peptide
DEEEIRTTNPVSTEQYGSVCFNELQGGST

SEQ ID NO: 38182 - protein, 29 aa, Artificial Sequence
  Description of Artificial Sequence: Synthetic peptide
DEEEIRTTNPVSTEQYGSVSTWDLGRVFP

SEQ ID NO: 38183 - protein, 32 aa, Artificial Sequence
  Description of Artificial Sequence: Synthetic polypeptide
DEEEIRTTNPVATEQYGSVGSNSDNLQSGNNV

SEQ ID NO: 38184 - protein, 29 aa, Artificial Sequence
  Description of Artificial Sequence: Synthetic peptide
DEEEIRTTNPVSTEQYGSVTANLQGGEQT

SEQ ID NO: 38185 - protein, 33 aa, Artificial Sequence
  Description of Artificial Sequence: Synthetic polypeptide
DEEEIRTTNPVATEQYGSVGSDTNLQTNGDNED

SEQ ID NO: 38186 - protein, 33 aa, Artificial Sequence
  Description of Artificial Sequence: Synthetic polypeptide
DEEEIRTTNPVATEQYGSVGSNTVNLQETGENI

SEQ ID NO: 38187 - protein, 33 aa, Artificial Sequence
  Description of Artificial Sequence: Synthetic polypeptide
DEEEIRTTNPVATEQYGSVGSDTNLQQNNGNEY

SEQ ID NO: 38188 - protein, 32 aa, Artificial Sequence
  Description of Artificial Sequence: Synthetic polypeptide
DEEEIRTTNPVATEQYGSVGSDTNLFESGNED

SEQ ID NO: 38189 - protein, 31 aa, Artificial Sequence
  Description of Artificial Sequence: Synthetic polypeptide
DEEEIATTNPVATEQYGSVAGTNPQEAGNRD

SEQ ID NO: 38190 - protein, 33 aa, Artificial Sequence
  Description of Artificial Sequence: Synthetic polypeptide
DEEEIRTTNPVATEQYGSVGSNTYNLQFTGNNQ

SEQ ID NO: 38191 - protein, 29 aa, Artificial Sequence
  Description of Artificial Sequence: Synthetic peptide
DEEEIRTTNPVSTEQYGSVTFNLTQGGQL

SEQ ID NO: 38192 - protein, 34 aa, Artificial Sequence
  Description of Artificial Sequence: Synthetic polypeptide
DEEEIRTTNPVATEQYGSVGSATPNGLQRGDFRQ

SEQ ID NO: 38193 - protein, 28 aa, Artificial Sequence
  Description of Artificial Sequence: Synthetic peptide
DEEEIRTTNPVSTEQYGSVTMGLQGGQT

SEQ ID NO: 38194 - protein, 29 aa, Artificial Sequence
  Description of Artificial Sequence: Synthetic peptide
DEEEIRTTNPVSTEQYGSVTNNLQGGVTT

SEQ ID NO: 38195 - protein, 28 aa, Artificial Sequence
  Description of Artificial Sequence: Synthetic peptide
DEEEIRTTNPVSTEQYGSVTNNVQGGQT

SEQ ID NO: 38196 - protein, 30 aa, Artificial Sequence
  Description of Artificial Sequence: Synthetic polypeptide
DEEEIRTTNPVGTEQYGSVSTTNNLGTGDP

SEQ ID NO: 38197 - protein, 31 aa, Artificial Sequence
  Description of Artificial Sequence: Synthetic polypeptide
DEEEIRTTNPVATEQYGSVGQPTNLQDNENQ

SEQ ID NO: 38198 - protein, 31 aa, Artificial Sequence
  Description of Artificial Sequence: Synthetic polypeptide
DEEEIRTTNPVGTEQYGSVSTTNFLGRSGFD

SEQ ID NO: 38199 - protein, 29 aa, Artificial Sequence
  Description of Artificial Sequence: Synthetic peptide
DEEEIRTTNPVSTEQYGSVTGMNLQGGQT

SEQ ID NO: 38200 - protein, 29 aa, Artificial Sequence
  Description of Artificial Sequence: Synthetic peptide
DEEEIRTTNPVSTEQYGSVTFNLQQGSQQ

SEQ ID NO: 38201 - protein, 29 aa, Artificial Sequence
  Description of Artificial Sequence: Synthetic peptide
DEEEIRTTNPVSTEQYGSVTFNLQGGQTI

SEQ ID NO: 38202 - protein, 29 aa, Artificial Sequence
  Description of Artificial Sequence: Synthetic peptide
DEEEIRTTNPVSTEQYGSVTFNLQGGQFN

SEQ ID NO: 38203 - protein, 29 aa, Artificial Sequence
  Description of Artificial Sequence: Synthetic peptide
DEEEIRTTNPVSTEQYGSVTANLQGMGQT

SEQ ID NO: 38204 - protein, 29 aa, Artificial Sequence
  Description of Artificial Sequence: Synthetic peptide
DEEEIRTTNPVSTEPYGTVSEDLQQQGNR

SEQ ID NO: 38205 - protein, 31 aa, Artificial Sequence
  Description of Artificial Sequence: Synthetic polypeptide
DEEEIATTNPVATEQYGSTVSNFNLQGGQER

SEQ ID NO: 38206 - protein, 31 aa, Artificial Sequence
  Description of Artificial Sequence: Synthetic polypeptide
DEEEIRTTNPVSTEHYGSVSMPNLSQRGGNL

SEQ ID NO: 38207 - protein, 31 aa, Artificial Sequence
  Description of Artificial Sequence: Synthetic polypeptide
DEEEIATTNPVATEQYGSVADTGLPQRSQNR

SEQ ID NO: 38208 - protein, 29 aa, Artificial Sequence
  Description of Artificial Sequence: Synthetic peptide
DEEEIRTTNPVSTEQYGSVTDNTLQGGQT

SEQ ID NO: 38209 - protein, 28 aa, Artificial Sequence
  Description of Artificial Sequence: Synthetic peptide
DEEEIRTTNPVSTEQYGSVTENNQGGQT

SEQ ID NO: 38210 - protein, 30 aa, Artificial Sequence
  Description of Artificial Sequence: Synthetic polypeptide
DEEEIRTTNPVSTEQYGSVTFNDLQGGNQM

SEQ ID NO: 38211 - protein, 33 aa, Artificial Sequence
  Description of Artificial Sequence: Synthetic polypeptide
DEEEIRTTNPVATEQYGSVGSNTNLQMNGGNEG

SEQ ID NO: 38212 - protein, 30 aa, Artificial Sequence
  Description of Artificial Sequence: Synthetic polypeptide
DEEEIRTTNPVGYEQYGSVVSTNELGRGDP

SEQ ID NO: 38213 - protein, 28 aa, Artificial Sequence
  Description of Artificial Sequence: Synthetic peptide
DEEEIRTTNPVSTEQYGSVTFNEQVGQD

SEQ ID NO: 38214 - protein, 33 aa, Artificial Sequence
  Description of Artificial Sequence: Synthetic polypeptide
DEEEIRTTNPVATEQYGSVGSNTNLQNIGNEGE

SEQ ID NO: 38215 - protein, 31 aa, Artificial Sequence
  Description of Artificial Sequence: Synthetic polypeptide
DEEEIATTNPVATEQYGSVAGTNDQNNGDNR

SEQ ID NO: 38216 - protein, 31 aa, Artificial Sequence
  Description of Artificial Sequence: Synthetic polypeptide
DEEEIATTNPVATEQYGSVAGTNLQEDGENT

SEQ ID NO: 38217 - protein, 29 aa, Artificial Sequence
  Description of Artificial Sequence: Synthetic peptide
DEEEIRTTNPVSTEQYGSVTFNLQGGQDM

SEQ ID NO: 38218 - protein, 30 aa, Artificial Sequence
  Description of Artificial Sequence: Synthetic polypeptide
DEEEIRTTNPVGTEQYGCVCSTNGLIRGFQ

SEQ ID NO: 38219 - protein, 30 aa, Artificial Sequence
  Description of Artificial Sequence: Synthetic polypeptide
DEEEISTTNPVATEQYGCVSTNLQANSNVS

SEQ ID NO: 38220 - protein, 29 aa, Artificial Sequence
  Description of Artificial Sequence: Synthetic peptide
DEEEIATTNPVATEQYGSVATNDQEGEDD

SEQ ID NO: 38221 - protein, 30 aa, Artificial Sequence
  Description of Artificial Sequence: Synthetic polypeptide
DEEEIATTNPVATEQYGSCSAGDNLDRDNR

SEQ ID NO: 38222 - protein, 30 aa, Artificial Sequence
  Description of Artificial Sequence: Synthetic polypeptide
DEEEIATTNPVATEQYGSVATNLQDDGGDD

SEQ ID NO: 38223 - protein, 32 aa, Artificial Sequence
  Description of Artificial Sequence: Synthetic polypeptide
DEEEIRTTNPVATEQYGSVGSTQLIQGQGNGQ

SEQ ID NO: 38224 - protein, 29 aa, Artificial Sequence
  Description of Artificial Sequence: Synthetic peptide
DEEEIRTTNPVCTEHYGCVSWGNHQRGNL

SEQ ID NO: 38225 - protein, 31 aa, Artificial Sequence
  Description of Artificial Sequence: Synthetic polypeptide
DEEEIATTNPVATEQYGSVATNLQDDPGNDN

SEQ ID NO: 38226 - protein, 31 aa, Artificial Sequence
  Description of Artificial Sequence: Synthetic polypeptide
DEEEISTTNPVATEQYGCVCSTNLQNFGNME

SEQ ID NO: 38227 - protein, 30 aa, Artificial Sequence
  Description of Artificial Sequence: Synthetic polypeptide
DEEEIATTNPVATEQYGSVATNLQDGEDAS

SEQ ID NO: 38228 - protein, 30 aa, Artificial Sequence
  Description of Artificial Sequence: Synthetic polypeptide
DEEEIATTNPVATEQYGSVATNLQDDGGAQ

SEQ ID NO: 38229 - protein, 31 aa, Artificial Sequence
  Description of Artificial Sequence: Synthetic polypeptide
DEEEIATTNPVATEQYGSVATNLQDGVEDNN

SEQ ID NO: 38230 - protein, 30 aa, Artificial Sequence
  Description of Artificial Sequence: Synthetic polypeptide
DEEEIRTTNPVCTEHYGCVSWENLQRGNLS

SEQ ID NO: 38231 - protein, 33 aa, Artificial Sequence
  Description of Artificial Sequence: Synthetic polypeptide
DEEEIRTTNPVATEQYGSVGSTQNLQGEMGNQI

SEQ ID NO: 38232 - protein, 31 aa, Artificial Sequence
  Description of Artificial Sequence: Synthetic polypeptide
DEEEIATTNPVATEQYGSVATNLQDPGEDRN

SEQ ID NO: 38233 - protein, 30 aa, Artificial Sequence
  Description of Artificial Sequence: Synthetic polypeptide
DEEEIATTNPVATEQYGSVATNLQDPGEMN

SEQ ID NO: 38234 - protein, 29 aa, Artificial Sequence
  Description of Artificial Sequence: Synthetic peptide
DEEEIRTTNPVCTEHWGSVSMPNLQGGNL

SEQ ID NO: 38235 - protein, 30 aa, Artificial Sequence
  Description of Artificial Sequence: Synthetic polypeptide
DEEEIATTNPVATEQYGSVATNLQDQEGMP

SEQ ID NO: 38236 - protein, 31 aa, Artificial Sequence
  Description of Artificial Sequence: Synthetic polypeptide
DEEEIATTNPVATEQYGSVATNLQDHTGNGQ

SEQ ID NO: 38237 - protein, 32 aa, Artificial Sequence
  Description of Artificial Sequence: Synthetic polypeptide
DEEEISTTNPVATEQYGCVCSTTNLQSSGSNR

SEQ ID NO: 38238 - protein, 30 aa, Artificial Sequence
  Description of Artificial Sequence: Synthetic polypeptide
DEEEIRTTNPVCTEHYGSVANPNLQRGNDL

SEQ ID NO: 38239 - protein, 30 aa, Artificial Sequence
  Description of Artificial Sequence: Synthetic polypeptide
DEEEIRTTNPVCTEHYGSVSEMPNLQRGTL

SEQ ID NO: 38240 - protein, 31 aa, Artificial Sequence
  Description of Artificial Sequence: Synthetic polypeptide
DEEEIATTNPVATEQYGSVATNLQADGPNEQ

SEQ ID NO: 38241 - protein, 30 aa, Artificial Sequence
  Description of Artificial Sequence: Synthetic polypeptide
DEEEIATTNPVATEQYGSVATNLQADNDEH

SEQ ID NO: 38242 - protein, 30 aa, Artificial Sequence
  Description of Artificial Sequence: Synthetic polypeptide
DEEEIATTNPVATEQYGSVATNLQADPNPE

SEQ ID NO: 38243 - protein, 33 aa, Artificial Sequence
  Description of Artificial Sequence: Synthetic polypeptide
DEEEIRTTNPVATEQYGSVGSTNLVQGGGNEDE

SEQ ID NO: 38244 - protein, 30 aa, Artificial Sequence
  Description of Artificial Sequence: Synthetic polypeptide
DEEEIRTTNPVCTEHYGSVSMPNDQRGDNL

SEQ ID NO: 38245 - protein, 32 aa, Artificial Sequence
  Description of Artificial Sequence: Synthetic polypeptide
DEEEISTTNPVATEQYGCVCSTMNLQRSGSDR

SEQ ID NO: 38246 - protein, 31 aa, Artificial Sequence
  Description of Artificial Sequence: Synthetic polypeptide
DEEEIRTTNPVCTEHYGSVCSIMPNLQRGNL

SEQ ID NO: 38247 - protein, 31 aa, Artificial Sequence
  Description of Artificial Sequence: Synthetic polypeptide
DEEEIRTTNPVCTEHYGSVSMPNDLQDRGNM

SEQ ID NO: 38248 - protein, 30 aa, Artificial Sequence
  Description of Artificial Sequence: Synthetic polypeptide
DEEEIATTNPVATEQYGSVATNLQAEDNNQ

SEQ ID NO: 38249 - protein, 30 aa, Artificial Sequence
  Description of Artificial Sequence: Synthetic polypeptide
DEEEIRTTNPVCTEHYGSVSLVNEQRGNLY

SEQ ID NO: 38250 - protein, 31 aa, Artificial Sequence
  Description of Artificial Sequence: Synthetic polypeptide
DEEEISTTNPVATEQYGCVCSTNHQRFGSNQ

SEQ ID NO: 38251 - protein, 30 aa, Artificial Sequence
  Description of Artificial Sequence: Synthetic polypeptide
DEEEIATTNPVATEQYGSVATNLQAGDEGD

SEQ ID NO: 38252 - protein, 30 aa, Artificial Sequence
  Description of Artificial Sequence: Synthetic polypeptide
DEEEIRTTNPVCTEHYGSVSGPNLQDGNLM

SEQ ID NO: 38253 - protein, 32 aa, Artificial Sequence
  Description of Artificial Sequence: Synthetic polypeptide
DEEEIRTTNPVATEQYGSVGSTNNLQNVGQEE

SEQ ID NO: 38254 - protein, 31 aa, Artificial Sequence
  Description of Artificial Sequence: Synthetic polypeptide
DEEEIRTTNPVCTEHYGSVSMGNLQDRDGNL

SEQ ID NO: 38255 - protein, 32 aa, Artificial Sequence
  Description of Artificial Sequence: Synthetic polypeptide
DEEEISTTNPVATEQYGCVCSTGNLQRFGNPD

SEQ ID NO: 38256 - protein, 31 aa, Artificial Sequence
  Description of Artificial Sequence: Synthetic polypeptide
DEEEIATTNPVATEQYGSVATNLQDQGNLQD

SEQ ID NO: 38257 - protein, 31 aa, Artificial Sequence
  Description of Artificial Sequence: Synthetic polypeptide
DEEEIATTNPVATEQYGSVATNLQDRPGEEY

SEQ ID NO: 38258 - protein, 29 aa, Artificial Sequence
  Description of Artificial Sequence: Synthetic peptide
DEEEISTTNPVATEQYGCVSTELQRSSEQ

SEQ ID NO: 38259 - protein, 30 aa, Artificial Sequence
  Description of Artificial Sequence: Synthetic polypeptide
DEEEIATTNPVATEQYGSVATNLQGEGGEV

SEQ ID NO: 38260 - protein, 31 aa, Artificial Sequence
  Description of Artificial Sequence: Synthetic polypeptide
DEEEIATTNPVATEQYGSVATNLQGEGMNVD

SEQ ID NO: 38261 - protein, 31 aa, Artificial Sequence
  Description of Artificial Sequence: Synthetic polypeptide
DEEEIATTNPVATEQYGSVATNLQGGEPDRE

SEQ ID NO: 38262 - protein, 31 aa, Artificial Sequence
  Description of Artificial Sequence: Synthetic polypeptide
DEEEIRTTNPVCTEAYGSVSDPNLQREGNNT

SEQ ID NO: 38263 - protein, 30 aa, Artificial Sequence
  Description of Artificial Sequence: Synthetic polypeptide
DEEEISTTNPVATEQYGCVSTEPQRGSERN

SEQ ID NO: 38264 - protein, 31 aa, Artificial Sequence
  Description of Artificial Sequence: Synthetic polypeptide
DEEEIATTNPVATEQYGSVATNLQGAGENND

SEQ ID NO: 38265 - protein, 31 aa, Artificial Sequence
  Description of Artificial Sequence: Synthetic polypeptide
DEEEISTTNPVATEQYGCVSTGELQRGSNND

SEQ ID NO: 38266 - protein, 30 aa, Artificial Sequence
  Description of Artificial Sequence: Synthetic polypeptide
DEEEIATTNPVATEQYGSVATNLQHAENDN

SEQ ID NO: 38267 - protein, 31 aa, Artificial Sequence
  Description of Artificial Sequence: Synthetic polypeptide
DEEEIRTTNPVCTEAYGSVSDPNLQREGNED

SEQ ID NO: 38268 - protein, 33 aa, Artificial Sequence
  Description of Artificial Sequence: Synthetic polypeptide
DEEEIRTTNPVATEQYGSVGSTVNLDQNGINDT

SEQ ID NO: 38269 - protein, 31 aa, Artificial Sequence
  Description of Artificial Sequence: Synthetic polypeptide
DEEEISTTNPVATEQYGCVSTMNLQNFGNQS

SEQ ID NO: 38270 - protein, 32 aa, Artificial Sequence
  Description of Artificial Sequence: Synthetic polypeptide
DEEEISTTNPVATEQYGCVSTMNLQRFGSDRM

SEQ ID NO: 38271 - protein, 30 aa, Artificial Sequence
  Description of Artificial Sequence: Synthetic polypeptide
DEEEIATTNPVATEQYGSVATNLQMENNVE

SEQ ID NO: 38272 - protein, 31 aa, Artificial Sequence
  Description of Artificial Sequence: Synthetic polypeptide
DEEEISTTNPVATEQYGCVSTGNDQRGSNTD

SEQ ID NO: 38273 - protein, 31 aa, Artificial Sequence
  Description of Artificial Sequence: Synthetic polypeptide
DEEEIATTNPVATEQYGSVATNLQDRGGDEI

SEQ ID NO: 38274 - protein, 31 aa, Artificial Sequence
  Description of Artificial Sequence: Synthetic polypeptide
DEEEIATTNPVATEQYGSVATNLQESNNDRA

SEQ ID NO: 38275 - protein, 32 aa, Artificial Sequence
  Description of Artificial Sequence: Synthetic polypeptide
DEEEIATTNPVATEQYGSVATNLQERPGEERN

SEQ ID NO: 38276 - protein, 32 aa, Artificial Sequence
  Description of Artificial Sequence: Synthetic polypeptide
DEEEIATTNPVATEQYGSVATNLQDRPGGNEI

SEQ ID NO: 38277 - protein, 32 aa, Artificial Sequence
  Description of Artificial Sequence: Synthetic polypeptide
DEEEIATTNPVATEQYGSVATNLQDRPGNMEM

SEQ ID NO: 38278 - protein, 29 aa, Artificial Sequence
  Description of Artificial Sequence: Synthetic peptide
DEEEIATTNPVATEQYGSVATNLQDVVED

SEQ ID NO: 38279 - protein, 31 aa, Artificial Sequence
  Description of Artificial Sequence: Synthetic polypeptide
DEEEISTTNPVATEQYGCVQTNLQRFGSERS

SEQ ID NO: 38280 - protein, 31 aa, Artificial Sequence
  Description of Artificial Sequence: Synthetic polypeptide
DEEEISTTNPVATEQYGCVSNTYLQRFGSNA

SEQ ID NO: 38281 - protein, 31 aa, Artificial Sequence
  Description of Artificial Sequence: Synthetic polypeptide
DEEEIATTNPVATEQYGSVATNLQEDGENQN

SEQ ID NO: 38282 - protein, 30 aa, Artificial Sequence
  Description of Artificial Sequence: Synthetic polypeptide
DEEEIRTTNPVCTEAYGSVSDPNLQRENGL

SEQ ID NO: 38283 - protein, 30 aa, Artificial Sequence
  Description of Artificial Sequence: Synthetic polypeptide
DEEEIRTTNPVCTECYGSVSMPNDQRGNLS

SEQ ID NO: 38284 - protein, 33 aa, Artificial Sequence
  Description of Artificial Sequence: Synthetic polypeptide
DEEEIRTTNPVATEQYGSVGSTSNLQMDGNNGV

SEQ ID NO: 38285 - protein, 31 aa, Artificial Sequence
  Description of Artificial Sequence: Synthetic polypeptide
DEEEIRTTNPVCTEAYGSVSDPNLQRGINGD

SEQ ID NO: 38286 - protein, 30 aa, Artificial Sequence
  Description of Artificial Sequence: Synthetic polypeptide
DEEEISTTNPVATEQYGCVSTEEQGSGSNR

SEQ ID NO: 38287 - protein, 31 aa, Artificial Sequence
  Description of Artificial Sequence: Synthetic polypeptide
DEEEIATTNPVATEQYGSVATNLQEGNPSVH

SEQ ID NO: 38288 - protein, 30 aa, Artificial Sequence
  Description of Artificial Sequence: Synthetic polypeptide
DEEEISTTNPVATEQYGCVSTELQAFGNQE

SEQ ID NO: 38289 - protein, 31 aa, Artificial Sequence
  Description of Artificial Sequence: Synthetic polypeptide
DEEEIATTNPVATEQYGSVATNLQERGEDGH

SEQ ID NO: 38290 - protein, 30 aa, Artificial Sequence
  Description of Artificial Sequence: Synthetic polypeptide
DEEEIATTNPVATEQYGSVATNLQEGGDVS

SEQ ID NO: 38291 - protein, 29 aa, Artificial Sequence
  Description of Artificial Sequence: Synthetic peptide
DEEEIRTTNPVCTEHYGSVSMPNGDRGNL

SEQ ID NO: 38292 - protein, 30 aa, Artificial Sequence
  Description of Artificial Sequence: Synthetic polypeptide
DEEEIATTNPVATEQYGSVATNLQADENEN

SEQ ID NO: 38293 - protein, 31 aa, Artificial Sequence
  Description of Artificial Sequence: Synthetic polypeptide
DEEEIATTNPVATEQYGSVATNLQADDNSRD

SEQ ID NO: 38294 - protein, 30 aa, Artificial Sequence
  Description of Artificial Sequence: Synthetic polypeptide
DEEEIRTTNPVGTEQWGSVSTNDLGRGIDP

SEQ ID NO: 38295 - protein, 30 aa, Artificial Sequence
  Description of Artificial Sequence: Synthetic polypeptide
DEEEIRYTNPVATEQYGSVSVNQTRGSNSD

SEQ ID NO: 38296 - protein, 30 aa, Artificial Sequence
  Description of Artificial Sequence: Synthetic polypeptide
DEEEIRYTNPVATEQYGSVTVNQDRGSNNR

SEQ ID NO: 38297 - protein, 30 aa, Artificial Sequence
  Description of Artificial Sequence: Synthetic polypeptide
DEEEIRTTNPVGTEQWGSVSTANELGRGPP

SEQ ID NO: 38298 - protein, 30 aa, Artificial Sequence
  Description of Artificial Sequence: Synthetic polypeptide
DEEEIATTNPVATEQYGSVATNLAQGNEPE

SEQ ID NO: 38299 - protein, 30 aa, Artificial Sequence
  Description of Artificial Sequence: Synthetic polypeptide
DEEEIRTTNPVGTEHYGSVSMVNTLQRGQD

SEQ ID NO: 38300 - protein, 29 aa, Artificial Sequence
  Description of Artificial Sequence: Synthetic peptide
DEEEIRTTNPVGTEQWGSVSTNELGGGPM

SEQ ID NO: 38301 - protein, 30 aa, Artificial Sequence
  Description of Artificial Sequence: Synthetic polypeptide
DEEEISTTNPCATEQYGSVETNLQHGNNGG

SEQ ID NO: 38302 - protein, 29 aa, Artificial Sequence
  Description of Artificial Sequence: Synthetic peptide
DEEEIATTNPVATEQYGSVATNLDPDNND

SEQ ID NO: 38303 - protein, 30 aa, Artificial Sequence
  Description of Artificial Sequence: Synthetic polypeptide
DEEEISTTNPCATEQYGSVVTNLQLSGNGG

SEQ ID NO: 38304 - protein, 30 aa, Artificial Sequence
  Description of Artificial Sequence: Synthetic polypeptide
DEEEIRTTNPVGTEFYGSVSVGNDQRGQNL

SEQ ID NO: 38305 - protein, 32 aa, Artificial Sequence
  Description of Artificial Sequence: Synthetic polypeptide
DEEEIRTTNPVATEQYGSVGSTNLNTDGGQNQ

SEQ ID NO: 38306 - protein, 30 aa, Artificial Sequence
  Description of Artificial Sequence: Synthetic polypeptide
DEEEISTTNPCATEQYGSVYTNLQLGGNGN

SEQ ID NO: 38307 - protein, 30 aa, Artificial Sequence
  Description of Artificial Sequence: Synthetic polypeptide
DEEEIATTNPVATEQYGSVATNLEAAENDR

SEQ ID NO: 38308 - protein, 30 aa, Artificial Sequence
  Description of Artificial Sequence: Synthetic polypeptide
DEEEISTTNPCATEQYGSVPTNLQQGVNGG

SEQ ID NO: 38309 - protein, 33 aa, Artificial Sequence
  Description of Artificial Sequence: Synthetic polypeptide
DEEEIRTTNPVATEQYGSVGSTNLPQTFGGNED

SEQ ID NO: 38310 - protein, 30 aa, Artificial Sequence
  Description of Artificial Sequence: Synthetic polypeptide
DEEEIRTTNPVGTEQWGSVSTNELGRDGPE

SEQ ID NO: 38311 - protein, 30 aa, Artificial Sequence
  Description of Artificial Sequence: Synthetic polypeptide
DEEEIRTTNPVGTEQWGSVSTNELGRGPSL

SEQ ID NO: 38312 - protein, 31 aa, Artificial Sequence
  Description of Artificial Sequence: Synthetic polypeptide
DEEEIATTNPVATEQYGSVATNDQNAGDNTR

SEQ ID NO: 38313 - protein, 29 aa, Artificial Sequence
  Description of Artificial Sequence: Synthetic peptide
DEEEIRTVNPVSTEQYGTVSDNLQSNGNQ

SEQ ID NO: 38314 - protein, 31 aa, Artificial Sequence
  Description of Artificial Sequence: Synthetic polypeptide
DEEEIRVTNPVATEQYGSVSVENQDRGENSR

SEQ ID NO: 38315 - protein, 30 aa, Artificial Sequence
  Description of Artificial Sequence: Synthetic polypeptide
DEEEIRYTNPVATEQYGAVSVNQERGSNSR

SEQ ID NO: 38316 - protein, 30 aa, Artificial Sequence
  Description of Artificial Sequence: Synthetic polypeptide
DEEEIRYTNPVATEQYGCVSWNDARGSNSR

SEQ ID NO: 38317 - protein, 30 aa, Artificial Sequence
  Description of Artificial Sequence: Synthetic polypeptide
DEEEIATTNPVATEQYGSVATNDQRDDNPE

SEQ ID NO: 38318 - protein, 31 aa, Artificial Sequence
  Description of Artificial Sequence: Synthetic polypeptide
DEEEIRYTNPVATEQYGSVSVNQDRGSNLRY

SEQ ID NO: 38319 - protein, 30 aa, Artificial Sequence
  Description of Artificial Sequence: Synthetic polypeptide
DEEEIRYTNPVATEQYGSVSSNEDRGSNNV

SEQ ID NO: 38320 - protein, 32 aa, Artificial Sequence
  Description of Artificial Sequence: Synthetic polypeptide
DEEEIRTTNPVATEQYGSVGSTNDQGTGNNVP

SEQ ID NO: 38321 - protein, 30 aa, Artificial Sequence
  Description of Artificial Sequence: Synthetic polypeptide
DEEEIRYTNPVATEQYGSVSSNQDVGSNSR

SEQ ID NO: 38322 - protein, 29 aa, Artificial Sequence
  Description of Artificial Sequence: Synthetic peptide
DEEEIATTNPVATEQYGSVATNGQNAENE

SEQ ID NO: 38323 - protein, 30 aa, Artificial Sequence
  Description of Artificial Sequence: Synthetic polypeptide
DEEEIRYTNPVATEQYGSVSVNQDPGSNMR

SEQ ID NO: 38324 - protein, 30 aa, Artificial Sequence
  Description of Artificial Sequence: Synthetic polypeptide
DEEEIRYTNPVATEQYGSVSVNQDRGSEGR

SEQ ID NO: 38325 - protein, 30 aa, Artificial Sequence
  Description of Artificial Sequence: Synthetic polypeptide
DEEEIRYTNPVATEQYGSVSVNQDRGSNAF

SEQ ID NO: 38326 - protein, 30 aa, Artificial Sequence
  Description of Artificial Sequence: Synthetic polypeptide
DEEEIATTNPVATEQYGSVATNDQVDNNRD

SEQ ID NO: 38327 - protein, 31 aa, Artificial Sequence
  Description of Artificial Sequence: Synthetic polypeptide
DEEEISTTNPMATEQYGCVPTNLQERFGNTR

SEQ ID NO: 38328 - protein, 29 aa, Artificial Sequence
  Description of Artificial Sequence: Synthetic peptide
DEEEIATTNPVATEQYGSVATNLEDDGEG

SEQ ID NO: 38329 - protein, 31 aa, Artificial Sequence
  Description of Artificial Sequence: Synthetic polypeptide
DEEEIATTNPVATEQYGSVATNLEDGINNRD

SEQ ID NO: 38330 - protein, 31 aa, Artificial Sequence
  Description of Artificial Sequence: Synthetic polypeptide
DEEEIRTTNPVCTEHYGSVSTGINDDQRGNL

SEQ ID NO: 38331 - protein, 30 aa, Artificial Sequence
  Description of Artificial Sequence: Synthetic polypeptide
DEEEIRTTNPVCTEHYGSVSPPVNEQRGNL

SEQ ID NO: 38332 - protein, 31 aa, Artificial Sequence
  Description of Artificial Sequence: Synthetic polypeptide
DEEEIATTNPVATEQYGSVATNLERPQENDR

SEQ ID NO: 38333 - protein, 30 aa, Artificial Sequence
  Description of Artificial Sequence: Synthetic polypeptide
DEEEIATTNPVATEQYGSVATNLERSEEDR

SEQ ID NO: 38334 - protein, 29 aa, Artificial Sequence
  Description of Artificial Sequence: Synthetic peptide
DEEEIATTNPVATEQYGSVATNLERTDTD

SEQ ID NO: 38335 - protein, 31 aa, Artificial Sequence
  Description of Artificial Sequence: Synthetic polypeptide
DEEEIATTNPVATEQYGSVATNLERTGENDY

SEQ ID NO: 38336 - protein, 31 aa, Artificial Sequence
  Description of Artificial Sequence: Synthetic polypeptide
DEEEIRTTNPVCTEHYGSVSTGPNDQPRGNL

SEQ ID NO: 38337 - protein, 30 aa, Artificial Sequence
  Description of Artificial Sequence: Synthetic polypeptide
DEEEIRTTNPVCTEHYGSVSMPNLQRGEDD

SEQ ID NO: 38338 - protein, 30 aa, Artificial Sequence
  Description of Artificial Sequence: Synthetic polypeptide
DEEEIRTTNPVCTEHYGSVSMPNLQDGNEL

SEQ ID NO: 38339 - protein, 32 aa, Artificial Sequence
  Description of Artificial Sequence: Synthetic polypeptide
DEEEIATTNPVATEQYGSVATNLPEQGGNPRD

SEQ ID NO: 38340 - protein, 31 aa, Artificial Sequence
  Description of Artificial Sequence: Synthetic polypeptide
DEEEISTTNPVATEQYGCVCSTENLQNGNQP

SEQ ID NO: 38341 - protein, 31 aa, Artificial Sequence
  Description of Artificial Sequence: Synthetic polypeptide
DEEEIATTNPVATEQYGSVATNLPERDPNER

SEQ ID NO: 38342 - protein, 31 aa, Artificial Sequence
  Description of Artificial Sequence: Synthetic polypeptide
DEEEIATTNPVATEQYGSVATNLPRDGNDQL

SEQ ID NO: 38343 - protein, 33 aa, Artificial Sequence
  Description of Artificial Sequence: Synthetic polypeptide
DEEEIRTTNPVATEQYGSVGSTNLQTFGVNEDE

SEQ ID NO: 38344 - protein, 31 aa, Artificial Sequence
  Description of Artificial Sequence: Synthetic polypeptide
DEEEIRTTNPVATEQYGSVGCTNGGQPRGVF

SEQ ID NO: 38345 - protein, 30 aa, Artificial Sequence
  Description of Artificial Sequence: Synthetic polypeptide
DEEEIRTTNPVCTEHYGSVSWGNLQNGSNL

SEQ ID NO: 38346 - protein, 31 aa, Artificial Sequence
  Description of Artificial Sequence: Synthetic polypeptide
DEEEIATTNPVATEQYGSVATNLERPGENSN

SEQ ID NO: 38347 - protein, 29 aa, Artificial Sequence
  Description of Artificial Sequence: Synthetic peptide
DEEEIRTTNPVCTEHYGSVSWPNEGRGNL

SEQ ID NO: 38348 - protein, 30 aa, Artificial Sequence
  Description of Artificial Sequence: Synthetic polypeptide
DEEEIRTTNPVCTESYGSVSMPTLQRGNEN

SEQ ID NO: 38349 - protein, 30 aa, Artificial Sequence
  Description of Artificial Sequence: Synthetic polypeptide
DEEEIRTTNPVCTEQYGSVATNLQQNNDPE

SEQ ID NO: 38350 - protein, 31 aa, Artificial Sequence
  Description of Artificial Sequence: Synthetic polypeptide
DEEEIATTNPVATEQYGSVATNLEDRGGENE

SEQ ID NO: 38351 - protein, 32 aa, Artificial Sequence
  Description of Artificial Sequence: Synthetic polypeptide
DEEEIATTNPVATEQYGSVATNLEDRPGENRM

SEQ ID NO: 38352 - protein, 32 aa, Artificial Sequence
  Description of Artificial Sequence: Synthetic polypeptide
DEEEISTTNPVATEGYGSVCSTNLQEHFGSNR

SEQ ID NO: 38353 - protein, 30 aa, Artificial Sequence
  Description of Artificial Sequence: Synthetic polypeptide
DEEEISTTNPVATEQFGTSVSTYLALRGNS

SEQ ID NO: 38354 - protein, 31 aa, Artificial Sequence
  Description of Artificial Sequence: Synthetic polypeptide
DEEEIRTTNPVCTEPYGSTVSIPNELQRGNL

SEQ ID NO: 38355 - protein, 33 aa, Artificial Sequence
  Description of Artificial Sequence: Synthetic polypeptide
DEEEISTTNPVATEQYGCQVCSTNLQRFGSENR

SEQ ID NO: 38356 - protein, 31 aa, Artificial Sequence
  Description of Artificial Sequence: Synthetic polypeptide
DEEEISTTNPVATEQYGCQVSTNLQYFGSER

SEQ ID NO: 38357 - protein, 31 aa, Artificial Sequence
  Description of Artificial Sequence: Synthetic polypeptide
DEEEIRTTNPVCTEHYGSVVSCQPNLQRGNL

SEQ ID NO: 38358 - protein, 30 aa, Artificial Sequence
  Description of Artificial Sequence: Synthetic polypeptide
DEEEIRTTNPVCTEHYGSVSYPNLQRGSEL

SEQ ID NO: 38359 - protein, 30 aa, Artificial Sequence
  Description of Artificial Sequence: Synthetic polypeptide
DEEEIRTTNPVCTEHYGSVSWPNLQNSGNQ

SEQ ID NO: 38360 - protein, 30 aa, Artificial Sequence
  Description of Artificial Sequence: Synthetic polypeptide
DEEEIATTNPVATEQYGSVATNLEREPNAD

SEQ ID NO: 38361 - protein, 31 aa, Artificial Sequence
  Description of Artificial Sequence: Synthetic polypeptide
DEEEIRTTNPVCTEHYGSVSWPNELSQRGNL

SEQ ID NO: 38362 - protein, 30 aa, Artificial Sequence
  Description of Artificial Sequence: Synthetic polypeptide
DEEEIATTNPVATEQYGSVATNLERPDENN

SEQ ID NO: 38363 - protein, 30 aa, Artificial Sequence
  Description of Artificial Sequence: Synthetic polypeptide
DEEEIATTNPVATEQYGSVATNDQEGNPVF

SEQ ID NO: 38364 - protein, 31 aa, Artificial Sequence
  Description of Artificial Sequence: Synthetic polypeptide
DEEEIATTNPVATEHYGSVSCTNLSHGGGNR

SEQ ID NO: 38365 - protein, 32 aa, Artificial Sequence
  Description of Artificial Sequence: Synthetic polypeptide
DEEEIRTTNPVAYEQYGSVSVSGNLQRTVGNQ

SEQ ID NO: 38366 - protein, 29 aa, Artificial Sequence
  Description of Artificial Sequence: Synthetic peptide
DEEQIRTTNPVATEQYGSVSFTHELGGNT

SEQ ID NO: 38367 - protein, 28 aa, Artificial Sequence
  Description of Artificial Sequence: Synthetic peptide
DEFEICTVNPVATEQYGSVSTNLFEGML

SEQ ID NO: 38368 - protein, 31 aa, Artificial Sequence
  Description of Artificial Sequence: Synthetic polypeptide
DEEEIRTTNPVATEQYGSVINTFNLDGQGTR

SEQ ID NO: 38369 - protein, 29 aa, Artificial Sequence
  Description of Artificial Sequence: Synthetic peptide
DEFEICTVNPVATEQYGSVSTNLFEGNNS

SEQ ID NO: 38370 - protein, 29 aa, Artificial Sequence
  Description of Artificial Sequence: Synthetic peptide
DEFEICTVNPVATEQYGSVSTNLFEGNYI

SEQ ID NO: 38371 - protein, 31 aa, Artificial Sequence
  Description of Artificial Sequence: Synthetic polypeptide
DEEEIRTTNPVAYEQYGQVSVTNLQRTVGSQ

SEQ ID NO: 38372 - protein, 32 aa, Artificial Sequence
  Description of Artificial Sequence: Synthetic polypeptide
DDEEIRTTNPVATEQYGQCVCSTALQRGSNRA

SEQ ID NO: 38373 - protein, 29 aa, Artificial Sequence
  Description of Artificial Sequence: Synthetic peptide
DEFEICTVNPVATEQYGSVSTNLFEGGNI

SEQ ID NO: 38374 - protein, 29 aa, Artificial Sequence
  Description of Artificial Sequence: Synthetic peptide
DEFEICTVNPVATEQYGSVSTNLFGGNED

SEQ ID NO: 38375 - protein, 29 aa, Artificial Sequence
  Description of Artificial Sequence: Synthetic peptide
DEFEICTVNPVATEQYGSVSTNLPEGNNH

SEQ ID NO: 38376 - protein, 31 aa, Artificial Sequence
  Description of Artificial Sequence: Synthetic polypeptide
DEEEIRTTNPVATEQYGSVIPPTINEQRNNQ

SEQ ID NO: 38377 - protein, 29 aa, Artificial Sequence
  Description of Artificial Sequence: Synthetic peptide
DEFEICTVNPVATEQYGSVSTNLQFEGED

SEQ ID NO: 38378 - protein, 30 aa, Artificial Sequence
  Description of Artificial Sequence: Synthetic polypeptide
DEFEICTVNPVATEQYGSVSTNLQFEGNEA

SEQ ID NO: 38379 - protein, 31 aa, Artificial Sequence
  Description of Artificial Sequence: Synthetic polypeptide
DEEEIRTTNPVAYEQYGQVSCINLQSTGGNR

SEQ ID NO: 38380 - protein, 32 aa, Artificial Sequence
  Description of Artificial Sequence: Synthetic polypeptide
DEEEIRTTNPVATEQYGSVISCTNGGQRGVAF

SEQ ID NO: 38381 - protein, 29 aa, Artificial Sequence
  Description of Artificial Sequence: Synthetic peptide
DEFEICTVNPVATEQYGSVSTNLNFNGNM

SEQ ID NO: 38382 - protein, 30 aa, Artificial Sequence
  Description of Artificial Sequence: Synthetic polypeptide
DEFEICTVNPVATEQYGSVSTNLQMGEGNT

SEQ ID NO: 38383 - protein, 28 aa, Artificial Sequence
  Description of Artificial Sequence: Synthetic peptide
DEFEICTVNPVATEQYGSVSTNLFEDNI

SEQ ID NO: 38384 - protein, 29 aa, Artificial Sequence
  Description of Artificial Sequence: Synthetic peptide
DEFEICTVNPVATEQYGSVSTNDLFEGNA

SEQ ID NO: 38385 - protein, 32 aa, Artificial Sequence
  Description of Artificial Sequence: Synthetic polypeptide
DDEEIRTTNPVATEQYGSVCSTGNLQHGSNQT

SEQ ID NO: 38386 - protein, 31 aa, Artificial Sequence
  Description of Artificial Sequence: Synthetic polypeptide
DEEEIRTTNPVATEQYGSVCTNLQPRVDSDN

SEQ ID NO: 38387 - protein, 30 aa, Artificial Sequence
  Description of Artificial Sequence: Synthetic polypeptide
DEFEIATVNPVATEQYGSVSTNLQFSEGNH

SEQ ID NO: 38388 - protein, 31 aa, Artificial Sequence
  Description of Artificial Sequence: Synthetic polypeptide
DEEEIRTTNPVATEQYGSVCTNLQPRPILQT

SEQ ID NO: 38389 - protein, 30 aa, Artificial Sequence
  Description of Artificial Sequence: Synthetic polypeptide
DEFEICTTNPMATEQYGSVPTNLQHRGDGR

SEQ ID NO: 38390 - protein, 28 aa, Artificial Sequence
  Description of Artificial Sequence: Synthetic peptide
DEFEICTVNPVATEAYGSVSTNLGEGNH

SEQ ID NO: 38391 - protein, 32 aa, Artificial Sequence
  Description of Artificial Sequence: Synthetic polypeptide
DDEEIRTTNPVATEQYGQCVCSTNLQRSGSNQ

SEQ ID NO: 38392 - protein, 28 aa, Artificial Sequence
  Description of Artificial Sequence: Synthetic peptide
DEFEICTVNPVATEQYGCVSTNLIEGNI

SEQ ID NO: 38393 - protein, 31 aa, Artificial Sequence
  Description of Artificial Sequence: Synthetic polypeptide
DEEEIATTNPVATEQYGSVCATNLEDGDNRI

SEQ ID NO: 38394 - protein, 29 aa, Artificial Sequence
  Description of Artificial Sequence: Synthetic peptide
DEFEICTVNPVATEQYGSVPSTNLDEGNH

SEQ ID NO: 38395 - protein, 32 aa, Artificial Sequence
  Description of Artificial Sequence: Synthetic polypeptide
DDEEIRTTNPVATEQYGQSVCSTNLQNGSQRA

SEQ ID NO: 38396 - protein, 32 aa, Artificial Sequence
  Description of Artificial Sequence: Synthetic polypeptide
DDEEIRTTNPVATEQYGQCVSTNLQRFGSNQQ

SEQ ID NO: 38397 - protein, 29 aa, Artificial Sequence
  Description of Artificial Sequence: Synthetic peptide
DEFEICTVNPVATEQYGSVSTINLFGGNT

SEQ ID NO: 38398 - protein, 31 aa, Artificial Sequence
  Description of Artificial Sequence: Synthetic polypeptide
DEEEIRTTNPVATEQYGSVIMNSLQNEGVQR

SEQ ID NO: 38399 - protein, 28 aa, Artificial Sequence
  Description of Artificial Sequence: Synthetic peptide
DEFEICTVNPVATEQYGEVSTNLFNGNQ

SEQ ID NO: 38400 - protein, 33 aa, Artificial Sequence
  Description of Artificial Sequence: Synthetic polypeptide
DEEEIRTTNPVAYEQYGSTSCTENLSQRTGGNR

SEQ ID NO: 38401 - protein, 28 aa, Artificial Sequence
  Description of Artificial Sequence: Synthetic peptide
DEFEICTVNPVATEQYGVVSTNLFEGNF

SEQ ID NO: 38402 - protein, 29 aa, Artificial Sequence
  Description of Artificial Sequence: Synthetic peptide
DEFEIGTVNPVATEQYGSVSITNLFEGNG

SEQ ID NO: 38403 - protein, 33 aa, Artificial Sequence
  Description of Artificial Sequence: Synthetic polypeptide
DEEEIRTTNPVAYEQYGQSVSVTNLLLQRGEVR

SEQ ID NO: 38404 - protein, 30 aa, Artificial Sequence
  Description of Artificial Sequence: Synthetic polypeptide
DEFVIGTTNPVATEQDGSVSTDALQRGNNR

SEQ ID NO: 38405 - protein, 33 aa, Artificial Sequence
  Description of Artificial Sequence: Synthetic polypeptide
DEEEIRTTNPVAYEQYGQSVSVTNGLDQRGIER

SEQ ID NO: 38406 - protein, 30 aa, Artificial Sequence
  Description of Artificial Sequence: Synthetic polypeptide
DEFVIGTTNPVATEQDGSVSTGELQRGTNR

SEQ ID NO: 38407 - protein, 30 aa, Artificial Sequence
  Description of Artificial Sequence: Synthetic polypeptide
DEFVIGTTNPVATEQSGSVSTDFLQRGNMR

SEQ ID NO: 38408 - protein, 30 aa, Artificial Sequence
  Description of Artificial Sequence: Synthetic polypeptide
DEFVIGTTNPVATEQWGSVSTADLQRGNDR

SEQ ID NO: 38409 - protein, 31 aa, Artificial Sequence
  Description of Artificial Sequence: Synthetic polypeptide
DEEEIRTTNPVATEQYGSVCTNLEEGEGNDE

SEQ ID NO: 38410 - protein, 33 aa, Artificial Sequence
  Description of Artificial Sequence: Synthetic polypeptide
DEEEIRTTNPVAYEQYGQSVSVTNEELQRGILR

SEQ ID NO: 38411 - protein, 32 aa, Artificial Sequence
  Description of Artificial Sequence: Synthetic polypeptide
DEEEIRTTNPVATEQYGSVISETNDQRQMTRQ

SEQ ID NO: 38412 - protein, 32 aa, Artificial Sequence
  Description of Artificial Sequence: Synthetic polypeptide
DEEEIRTTNPVAYEQYGQSVSVNDLVQRGIAR

SEQ ID NO: 38413 - protein, 28 aa, Artificial Sequence
  Description of Artificial Sequence: Synthetic peptide
DEFVIGTTNPVATEQYGCVETNPQRGNE

SEQ ID NO: 38414 - protein, 32 aa, Artificial Sequence
  Description of Artificial Sequence: Synthetic polypeptide
DEEEIRTTNPVAYEQYGQSVSVNDLLQRGIGR

SEQ ID NO: 38415 - protein, 30 aa, Artificial Sequence
  Description of Artificial Sequence: Synthetic polypeptide
DEEEIRTTNPVATEQYGSVCTNGQREDEDD

SEQ ID NO: 38416 - protein, 31 aa, Artificial Sequence
  Description of Artificial Sequence: Synthetic polypeptide
DDEEIRTTNPVATEQYGCVCSTNLQNSGNQA

SEQ ID NO: 38417 - protein, 29 aa, Artificial Sequence
  Description of Artificial Sequence: Synthetic peptide
DEEEIATTNPVATEQYGDVSEALQRENPL

SEQ ID NO: 38418 - protein, 28 aa, Artificial Sequence
  Description of Artificial Sequence: Synthetic peptide
DEFEICTVNPVAYEQYGSVSTNLGEGND

SEQ ID NO: 38419 - protein, 30 aa, Artificial Sequence
  Description of Artificial Sequence: Synthetic polypeptide
DEEEIRTTNPVATEQYGSVCTNLEGEENYS

SEQ ID NO: 38420 - protein, 30 aa, Artificial Sequence
  Description of Artificial Sequence: Synthetic polypeptide
DEEEIATTNPVATEQYGDVSTEALQRENPL

SEQ ID NO: 38421 - protein, 28 aa, Artificial Sequence
  Description of Artificial Sequence: Synthetic peptide
DEFEIGTVNPVATEQYGSVSSNLFEGNQ

SEQ ID NO: 38422 - protein, 33 aa, Artificial Sequence
  Description of Artificial Sequence: Synthetic polypeptide
DEEEIRTTNPVAYEQYGQSVSWTNDLLQRGDQR

SEQ ID NO: 38423 - protein, 33 aa, Artificial Sequence
  Description of Artificial Sequence: Synthetic polypeptide
DEEEIRTTNPVATEQYGSVCTNLNQRQGQEQRM

SEQ ID NO: 38424 - protein, 32 aa, Artificial Sequence
  Description of Artificial Sequence: Synthetic polypeptide
DEEEIRTTNPVAYEQYGQSVSWNDLQQRGIPR

SEQ ID NO: 38425 - protein, 31 aa, Artificial Sequence
  Description of Artificial Sequence: Synthetic polypeptide
DEFEIRTTNPVATEQYGCVSTTYHQRGNERP

SEQ ID NO: 38426 - protein, 31 aa, Artificial Sequence
  Description of Artificial Sequence: Synthetic polypeptide
DEFEIRTTNPVATEQYGEVSTNLQSNGDNGF

SEQ ID NO: 38427 - protein, 29 aa, Artificial Sequence
  Description of Artificial Sequence: Synthetic peptide
DEFVIGTTNPVATEQCGSVSTDDLQGGNR

SEQ ID NO: 38428 - protein, 32 aa, Artificial Sequence
  Description of Artificial Sequence: Synthetic polypeptide
DEEEIRTTNPVAYEQYGQSVSWNDLNQRGITR

SEQ ID NO: 38429 - protein, 32 aa, Artificial Sequence
  Description of Artificial Sequence: Synthetic polypeptide
DEEEIRTTNPVATEQYGSVCTNLLQQRAENEL

SEQ ID NO: 38430 - protein, 32 aa, Artificial Sequence
  Description of Artificial Sequence: Synthetic polypeptide
DEFEIRTTNPVAYEQYGQSVSTNDLIQRGIER

SEQ ID NO: 38431 - protein, 28 aa, Artificial Sequence
  Description of Artificial Sequence: Synthetic peptide
DEFEIVTVNPVATEQYGCVSTNLFSGNQ

SEQ ID NO: 38432 - protein, 31 aa, Artificial Sequence
  Description of Artificial Sequence: Synthetic polypeptide
DEEEIRTTNPVATEQYGSVCTNLEVRGGEHM

SEQ ID NO: 38433 - protein, 30 aa, Artificial Sequence
  Description of Artificial Sequence: Synthetic polypeptide
DEFVIATTNPVATEQWGSTVSTDELQRGNR

SEQ ID NO: 38434 - protein, 29 aa, Artificial Sequence
  Description of Artificial Sequence: Synthetic peptide
DEFVIGTTNPVAIEQDGSVSTDGLQRGNR

SEQ ID NO: 38435 - protein, 30 aa, Artificial Sequence
  Description of Artificial Sequence: Synthetic polypeptide
DDEEIRTTNPVATEQYGECGTGNLQGGSNR

SEQ ID NO: 38436 - protein, 31 aa, Artificial Sequence
  Description of Artificial Sequence: Synthetic polypeptide
DDEEIRTTNPVATEQYGSVCSTNLQNISNQA

SEQ ID NO: 38437 - protein, 28 aa, Artificial Sequence
  Description of Artificial Sequence: Synthetic peptide
DEFCIRTTNPVATEQYGCVETNPQYGER

SEQ ID NO: 38438 - protein, 29 aa, Artificial Sequence
  Description of Artificial Sequence: Synthetic peptide
DEFCIRTTNPVATEQYGCVCEWNPQRGNR

SEQ ID NO: 38439 - protein, 32 aa, Artificial Sequence
  Description of Artificial Sequence: Synthetic polypeptide
DDEEIRTTNPVATEQYGSVSTGNLQGFGSDRD

SEQ ID NO: 38440 - protein, 31 aa, Artificial Sequence
  Description of Artificial Sequence: Synthetic polypeptide
DEEEIRTTNPVATEQYGSVIITNLERPGVEF

SEQ ID NO: 38441 - protein, 32 aa, Artificial Sequence
  Description of Artificial Sequence: Synthetic polypeptide
DDEEIRTTNPVATEQYGSVSTGNLQFFGSNVD

SEQ ID NO: 38442 - protein, 33 aa, Artificial Sequence
  Description of Artificial Sequence: Synthetic polypeptide
DDEEIRTTNPVATEQYGSVSTGNLNQRFGSNQS

SEQ ID NO: 38443 - protein, 33 aa, Artificial Sequence
  Description of Artificial Sequence: Synthetic polypeptide
DEEEIRTTNPVAYEQYGSTVSCTGNLSGRGDNR

SEQ ID NO: 38444 - protein, 31 aa, Artificial Sequence
  Description of Artificial Sequence: Synthetic polypeptide
DDEEIRTTNPVATEQYGSVSTGLEQQFGNDG

SEQ ID NO: 38445 - protein, 32 aa, Artificial Sequence
  Description of Artificial Sequence: Synthetic polypeptide
DDEEIRTTNPVATEQYGSVSTGNLQNFNSNRD

SEQ ID NO: 38446 - protein, 32 aa, Artificial Sequence
  Description of Artificial Sequence: Synthetic polypeptide
DDEEIRTTNPVATEQYGSVSTGELQYFGSNRD

SEQ ID NO: 38447 - protein, 30 aa, Artificial Sequence
  Description of Artificial Sequence: Synthetic polypeptide
DEEVIRTTNPVATEQYGCVSTNHQFFGNQS

SEQ ID NO: 38448 - protein, 32 aa, Artificial Sequence
  Description of Artificial Sequence: Synthetic polypeptide
DDEEIRTTNPVATEQYGSVSTENLQFFGSNQA

SEQ ID NO: 38449 - protein, 32 aa, Artificial Sequence
  Description of Artificial Sequence: Synthetic polypeptide
DEEEIRTTNPVAYEQYGSTVNANLSQRTGGNR

SEQ ID NO: 38450 - protein, 30 aa, Artificial Sequence
  Description of Artificial Sequence: Synthetic polypeptide
DEEVIRTTNPVATEQYGSCSTNLEDNGQNE

SEQ ID NO: 38451 - protein, 31 aa, Artificial Sequence
  Description of Artificial Sequence: Synthetic polypeptide
DEEVIRTTNPVATEQYGSCSTNLQDNGDNNS

SEQ ID NO: 38452 - protein, 30 aa, Artificial Sequence
  Description of Artificial Sequence: Synthetic polypeptide
DEEVIRTTNPVATEQYGSCSTNLQDNMDNN

SEQ ID NO: 38453 - protein, 30 aa, Artificial Sequence
  Description of Artificial Sequence: Synthetic polypeptide
DEEEIRTTNPVATEQYGSVCTNQQQGELVD

SEQ ID NO: 38454 - protein, 31 aa, Artificial Sequence
  Description of Artificial Sequence: Synthetic polypeptide
DEEVIRTTNPVATEQYGSVATNLEDNGQNPR

SEQ ID NO: 38455 - protein, 30 aa, Artificial Sequence
  Description of Artificial Sequence: Synthetic polypeptide
DEEVIRTTNPVATEQYGCVCSTNPQFFGNQ

SEQ ID NO: 38456 - protein, 29 aa, Artificial Sequence
  Description of Artificial Sequence: Synthetic peptide
DEEVIRTTNPVATEQYGCVAATNDQAGNN

SEQ ID NO: 38457 - protein, 30 aa, Artificial Sequence
  Description of Artificial Sequence: Synthetic polypeptide
DEEVIRATNPVATEQWGSVATNNLQQGVNR

SEQ ID NO: 38458 - protein, 28 aa, Artificial Sequence
  Description of Artificial Sequence: Synthetic peptide
DEEVIRATNPVATEQYGCVATNDQPGNS

SEQ ID NO: 38459 - protein, 31 aa, Artificial Sequence
  Description of Artificial Sequence: Synthetic polypeptide
DEEVIRATNPVATEQYGSVSTNLQDNGENDG

SEQ ID NO: 38460 - protein, 30 aa, Artificial Sequence
  Description of Artificial Sequence: Synthetic polypeptide
DEEEIRTTNPVATEQYGSVCTPGLPRGELI

SEQ ID NO: 38461 - protein, 31 aa, Artificial Sequence
  Description of Artificial Sequence: Synthetic polypeptide
DEEVIRTTNPVATECYGSVSTNGLRDDGQNR

SEQ ID NO: 38462 - protein, 32 aa, Artificial Sequence
  Description of Artificial Sequence: Synthetic polypeptide
DEEEIRTTNPVAYEQYGSTVSCTNLQQGGNTQ

SEQ ID NO: 38463 - protein, 29 aa, Artificial Sequence
  Description of Artificial Sequence: Synthetic peptide
DEEVIRTTNPVATEQYGCVATNDQEGNDN

SEQ ID NO: 38464 - protein, 32 aa, Artificial Sequence
  Description of Artificial Sequence: Synthetic polypeptide
DEEEIRTTNPVAYEQYGSTVSCTNLQHSGNSQ

SEQ ID NO: 38465 - protein, 34 aa, Artificial Sequence
  Description of Artificial Sequence: Synthetic polypeptide
DEEEIRTTNPVAYEQYGSTVSCTNLPQNRGGNNR

SEQ ID NO: 38466 - protein, 34 aa, Artificial Sequence
  Description of Artificial Sequence: Synthetic polypeptide
DEEEIRTTNPVAYEQYGSTVSCTNGLSQRTGENR

SEQ ID NO: 38467 - protein, 34 aa, Artificial Sequence
  Description of Artificial Sequence: Synthetic polypeptide
DEEEIRTTNPVAYEQYGSTVSCTNGLAQRTGNNR

SEQ ID NO: 38468 - protein, 32 aa, Artificial Sequence
  Description of Artificial Sequence: Synthetic polypeptide
DEEEIRTTNPVATEQYGSVIITGNLGQRGEII

SEQ ID NO: 38469 - protein, 30 aa, Artificial Sequence
  Description of Artificial Sequence: Synthetic polypeptide
DEEVIRTTNPVATEQWGSVATNNLEPGVNR

SEQ ID NO: 38470 - protein, 31 aa, Artificial Sequence
  Description of Artificial Sequence: Synthetic polypeptide
DEEVIRTTNPVATEQWGSVATNNLSQTGGNR

SEQ ID NO: 38471 - protein, 31 aa, Artificial Sequence
  Description of Artificial Sequence: Synthetic polypeptide
DEEVIRTTNPVATEQWGSVATGNLQVGDNRP

SEQ ID NO: 38472 - protein, 33 aa, Artificial Sequence
  Description of Artificial Sequence: Synthetic polypeptide
DEEEIRTTNPVAYEQYGSTVFCTNALQRTGNYR

SEQ ID NO: 38473 - protein, 31 aa, Artificial Sequence
  Description of Artificial Sequence: Synthetic polypeptide
DEEVIRTTNPVATEQYGSVCSTNLNDNGSNV

SEQ ID NO: 38474 - protein, 32 aa, Artificial Sequence
  Description of Artificial Sequence: Synthetic polypeptide
DEEVIRTTNPVATEQYGSVLSETNLTDNGQNR

SEQ ID NO: 38475 - protein, 32 aa, Artificial Sequence
  Description of Artificial Sequence: Synthetic polypeptide
DEEVIRTTNPVATEQYGSVSTNLRDNSGQNPR

SEQ ID NO: 38476 - protein, 31 aa, Artificial Sequence
  Description of Artificial Sequence: Synthetic polypeptide
DEEVIRTTNPVATEQYGSVSTNLTDNGLQNE

SEQ ID NO: 38477 - protein, 31 aa, Artificial Sequence
  Description of Artificial Sequence: Synthetic polypeptide
DEEVIRTTNPVATEQYGSVSTNLTDNNQNRD

SEQ ID NO: 38478 - protein, 31 aa, Artificial Sequence
  Description of Artificial Sequence: Synthetic polypeptide
DDEEIRTTNPVATEQYGSVITTNLQNDENRD

SEQ ID NO: 38479 - protein, 32 aa, Artificial Sequence
  Description of Artificial Sequence: Synthetic polypeptide
DEEVIRTTNPVATEQYGSVTSTNLNDNGSNRS

SEQ ID NO: 38480 - protein, 31 aa, Artificial Sequence
  Description of Artificial Sequence: Synthetic polypeptide
DEEVIRTTNPVATEWYGSVSTNLGDNGLNDR

SEQ ID NO: 38481 - protein, 31 aa, Artificial Sequence
  Description of Artificial Sequence: Synthetic polypeptide
DEEVIRTTNPVATEQYGSVSTNLRDNGQNSG

SEQ ID NO: 38482 - protein, 31 aa, Artificial Sequence
  Description of Artificial Sequence: Synthetic polypeptide
DEEVIRTTNPVAYEQWGESVSINLQRDGDNR

SEQ ID NO: 38483 - protein, 31 aa, Artificial Sequence
  Description of Artificial Sequence: Synthetic polypeptide
DEEVIRTTNPVAYEQYGSVVSTNLSTNGGNR

SEQ ID NO: 38484 - protein, 29 aa, Artificial Sequence
  Description of Artificial Sequence: Synthetic peptide
DEEVIRTTNPVAYEQYSEEVSTGLQIGNR

SEQ ID NO: 38485 - protein, 31 aa, Artificial Sequence
  Description of Artificial Sequence: Synthetic polypeptide
DEEVIRTTNPVSTEQYGSVPSTHLSQLGGNR

SEQ ID NO: 38486 - protein, 29 aa, Artificial Sequence
  Description of Artificial Sequence: Synthetic peptide
DEEVISTTNPVATEGYGCVNTNPLQRGNQ

SEQ ID NO: 38487 - protein, 30 aa, Artificial Sequence
  Description of Artificial Sequence: Synthetic polypeptide
DEEEIATTNPVATEQYGSVCATNEQDGNDF

SEQ ID NO: 38488 - protein, 31 aa, Artificial Sequence
  Description of Artificial Sequence: Synthetic polypeptide
DEEEIRTTNPVATEQYGSVCTNLQQTGELVA

SEQ ID NO: 38489 - protein, 29 aa, Artificial Sequence
  Description of Artificial Sequence: Synthetic peptide
DEEVIRTTNPVAYEQYGSVSTHELNNGNT

SEQ ID NO: 38490 - protein, 30 aa, Artificial Sequence
  Description of Artificial Sequence: Synthetic polypeptide
DEEVIRTTNPVATEQYGSVSTNLRDNGQEH

SEQ ID NO: 38491 - protein, 31 aa, Artificial Sequence
  Description of Artificial Sequence: Synthetic polypeptide
DEEVIRTTNPVATEQYGSVSTNLRDNGQDSR

SEQ ID NO: 38492 - protein, 33 aa, Artificial Sequence
  Description of Artificial Sequence: Synthetic polypeptide
DEEEIRTTNPVAYEQYGSTVCCTNLSQREGTNR

SEQ ID NO: 38493 - protein, 32 aa, Artificial Sequence
  Description of Artificial Sequence: Synthetic polypeptide
DEEVIRTTNPVATEQYGSVSCTNLSDNGGNRC

SEQ ID NO: 38494 - protein, 31 aa, Artificial Sequence
  Description of Artificial Sequence: Synthetic polypeptide
DEEVIRTTNPVATEQYGSVSGDNLRDNGQNR

SEQ ID NO: 38495 - protein, 31 aa, Artificial Sequence
  Description of Artificial Sequence: Synthetic polypeptide
DEEVIRTTNPVATEQYGSVSMTNLVDNGQNE

SEQ ID NO: 38496 - protein, 31 aa, Artificial Sequence
  Description of Artificial Sequence: Synthetic polypeptide
DEEVIRTTNPVATEQYGSVSNNLRDDNGQNR

SEQ ID NO: 38497 - protein, 28 aa, Artificial Sequence
  Description of Artificial Sequence: Synthetic peptide
DEEVIRTTNPVATEQYGSVSPDELNGNT

SEQ ID NO: 38498 - protein, 31 aa, Artificial Sequence
  Description of Artificial Sequence: Synthetic polypeptide
DEEVIRTTNPVATEQYGSVSTDGERDNGQNR

SEQ ID NO: 38499 - protein, 31 aa, Artificial Sequence
  Description of Artificial Sequence: Synthetic polypeptide
DEEVIRTTNPVATEQYGSVSTDLRDNMGQNR

SEQ ID NO: 38500 - protein, 31 aa, Artificial Sequence
  Description of Artificial Sequence: Synthetic polypeptide
DEEVIRTTNPVATEQYGSVSTGGLNDNGQNR

SEQ ID NO: 38501 - protein, 32 aa, Artificial Sequence
  Description of Artificial Sequence: Synthetic polypeptide
DEEEIRTTNPVATEQYGSVILMNGQPRGENRI

SEQ ID NO: 38502 - protein, 30 aa, Artificial Sequence
  Description of Artificial Sequence: Synthetic polypeptide
DEEEIRTTNPVATEQYGSVCTNLTAGDEDA

SEQ ID NO: 38503 - protein, 31 aa, Artificial Sequence
  Description of Artificial Sequence: Synthetic polypeptide
DEEVIRTTNPVATEQYGSVSTNLEDNEIQNR

SEQ ID NO: 38504 - protein, 31 aa, Artificial Sequence
  Description of Artificial Sequence: Synthetic polypeptide
DEEVIRTTNPVATEQYGSVSTNLEDNFQNRV

SEQ ID NO: 38505 - protein, 31 aa, Artificial Sequence
  Description of Artificial Sequence: Synthetic polypeptide
DEEVIRTTNPVATEQYGSVSTNLEDVNGQNE

SEQ ID NO: 38506 - protein, 32 aa, Artificial Sequence
  Description of Artificial Sequence: Synthetic polypeptide
DEEVIRTTNPVATEQYGSVSTNLIDLNGDNDR

SEQ ID NO: 38507 - protein, 31 aa, Artificial Sequence
  Description of Artificial Sequence: Synthetic polypeptide
DEEVIRTTNPVATEQYGSVSTNLNDGNGQNN

SEQ ID NO: 38508 - protein, 31 aa, Artificial Sequence
  Description of Artificial Sequence: Synthetic polypeptide
DDEEIRTTNPVATEQYGCVCSTNLQNGSNII

SEQ ID NO: 38509 - protein, 32 aa, Artificial Sequence
  Description of Artificial Sequence: Synthetic polypeptide
DEEEIRTTNPVAYEQYGSTVSTANLSGRGGNE

SEQ ID NO: 38510 - protein, 29 aa, Artificial Sequence
  Description of Artificial Sequence: Synthetic peptide
DEFVIRTTNPVATEQYGCVETNPQREDNR

SEQ ID NO: 38511 - protein, 28 aa, Artificial Sequence
  Description of Artificial Sequence: Synthetic peptide
DEFVIRTTNPVATEQYGCVETNPQRGEV

SEQ ID NO: 38512 - protein, 30 aa, Artificial Sequence
  Description of Artificial Sequence: Synthetic polypeptide
DEGEIATTNPVATEQYGSVAMNLQQGNDRN

SEQ ID NO: 38513 - protein, 30 aa, Artificial Sequence
  Description of Artificial Sequence: Synthetic polypeptide
DDEEIRTTNPVATEQWGSQTSTVLQRGLTR

SEQ ID NO: 38514 - protein, 29 aa, Artificial Sequence
  Description of Artificial Sequence: Synthetic peptide
DDEEIRTTNPVATEQWGSNTSTTLQRGTG

SEQ ID NO: 38515 - protein, 29 aa, Artificial Sequence
  Description of Artificial Sequence: Synthetic peptide
DEGEIATTNPVATEQYGSVATALNRMNGR

SEQ ID NO: 38516 - protein, 28 aa, Artificial Sequence
  Description of Artificial Sequence: Synthetic peptide
DEGEIATTNPVATEQYGSVATALSMMNR

SEQ ID NO: 38517 - protein, 31 aa, Artificial Sequence
  Description of Artificial Sequence: Synthetic polypeptide
DEEEIATTNPVATEQYGSVCSTNHQYFNSNR

SEQ ID NO: 38518 - protein, 32 aa, Artificial Sequence
  Description of Artificial Sequence: Synthetic polypeptide
DEEEIRTTNPVATEQYGSVCSVSGNLQRVSNA

SEQ ID NO: 38519 - protein, 33 aa, Artificial Sequence
  Description of Artificial Sequence: Synthetic polypeptide
DEEEIRTTNPVAYEQYGQSVSSTNDLLQRGIVR

SEQ ID NO: 38520 - protein, 33 aa, Artificial Sequence
  Description of Artificial Sequence: Synthetic polypeptide
DEEEIRTTNPVATEQYGSVISGTTNLQQEEGNE

SEQ ID NO: 38521 - protein, 30 aa, Artificial Sequence
  Description of Artificial Sequence: Synthetic polypeptide
DEGEIATTNPVATEQYGSVATNLERGNPTP

SEQ ID NO: 38522 - protein, 32 aa, Artificial Sequence
  Description of Artificial Sequence: Synthetic polypeptide
DEEEIRTTNPVAYEQYGQSVSSNDLLQRGSIR

SEQ ID NO: 38523 - protein, 29 aa, Artificial Sequence
  Description of Artificial Sequence: Synthetic peptide
DEGEIATTNPVATEQYGSVATNLERGQEN

SEQ ID NO: 38524 - protein, 30 aa, Artificial Sequence
  Description of Artificial Sequence: Synthetic polypeptide
DEGEIATTNPVATEQYGSVATNLQNDGNQE

SEQ ID NO: 38525 - protein, 32 aa, Artificial Sequence
  Description of Artificial Sequence: Synthetic polypeptide
DEEEIRTTNPVATEQYGSVCSTWLGVRVENFR

SEQ ID NO: 38526 - protein, 31 aa, Artificial Sequence
  Description of Artificial Sequence: Synthetic polypeptide
DEEEIATTNPVATEQYGCVSTNAQGNMGDNR

SEQ ID NO: 38527 - protein, 30 aa, Artificial Sequence
  Description of Artificial Sequence: Synthetic polypeptide
DDEEIRTTNPVATEQWGCVTSTELQRGTRQ

SEQ ID NO: 38528 - protein, 29 aa, Artificial Sequence
  Description of Artificial Sequence: Synthetic peptide
DDEEIRTTNPVATEQWGSVTSTLDQYGER

SEQ ID NO: 38529 - protein, 30 aa, Artificial Sequence
  Description of Artificial Sequence: Synthetic polypeptide
DDEEIRTTNPVATEQWGSVTSTLLQNGDRQ

SEQ ID NO: 38530 - protein, 28 aa, Artificial Sequence
  Description of Artificial Sequence: Synthetic peptide
DEGEIATTNPVATEQWGSVATNLQAGDQ

SEQ ID NO: 38531 - protein, 33 aa, Artificial Sequence
  Description of Artificial Sequence: Synthetic polypeptide
DEEEIRTTNPVAYEQYGQSVSTNALSQRGGDRV

SEQ ID NO: 38532 - protein, 33 aa, Artificial Sequence
  Description of Artificial Sequence: Synthetic polypeptide
DEEEIRTTNPVAYEQYGQSVSTMNDLLQRGIGR

SEQ ID NO: 38533 - protein, 30 aa, Artificial Sequence
  Description of Artificial Sequence: Synthetic polypeptide
DDEEIRTTNPVATEQWGSVVSTLLQRGTEQ

SEQ ID NO: 38534 - protein, 30 aa, Artificial Sequence
  Description of Artificial Sequence: Synthetic polypeptide
DDEEIRTTNPVATEQWGSVVSTLLQREGTA

SEQ ID NO: 38535 - protein, 29 aa, Artificial Sequence
  Description of Artificial Sequence: Synthetic peptide
DEGEIATTNPVATEQYGIVSTDLQSEGER

SEQ ID NO: 38536 - protein, 28 aa, Artificial Sequence
  Description of Artificial Sequence: Synthetic peptide
DEGEIATTNPVATEQYGSVAMNLEQGNE

SEQ ID NO: 38537 - protein, 33 aa, Artificial Sequence
  Description of Artificial Sequence: Synthetic polypeptide
DEEEIRTTNPVAYEQYGQSVSTGNDLLQRGEER

SEQ ID NO: 38538 - protein, 33 aa, Artificial Sequence
  Description of Artificial Sequence: Synthetic polypeptide
DEEEIRTTNPVAYEQYGQSVSTENDLEQRGIER

SEQ ID NO: 38539 - protein, 31 aa, Artificial Sequence
  Description of Artificial Sequence: Synthetic polypeptide
DDEEIRTTNPVATEQWGSVTSTTLEQREGTR

SEQ ID NO: 38540 - protein, 31 aa, Artificial Sequence
  Description of Artificial Sequence: Synthetic polypeptide
DEEEIATTNPVATEQYGCVSTNLDQQGGGRD

SEQ ID NO: 38541 - protein, 31 aa, Artificial Sequence
  Description of Artificial Sequence: Synthetic polypeptide
DDEEIRTTNPVATEQWGSVTSTLLQRGSERQ

SEQ ID NO: 38542 - protein, 30 aa, Artificial Sequence
  Description of Artificial Sequence: Synthetic polypeptide
DDEEIRTTNPVATEQWGSVTSTLLQRGGEA

SEQ ID NO: 38543 - protein, 31 aa, Artificial Sequence
  Description of Artificial Sequence: Synthetic polypeptide
DEEEIATTNPVATEQYGCVSTNHLFQVRGEF

SEQ ID NO: 38544 - protein, 33 aa, Artificial Sequence
  Description of Artificial Sequence: Synthetic polypeptide
DEEEIRTTNPVAYEQYGQSVSTGNDLDQRGSER

SEQ ID NO: 38545 - protein, 31 aa, Artificial Sequence
  Description of Artificial Sequence: Synthetic polypeptide
DEEEIRTTNPVATEQYGSVCSWELQHFGSNQ

SEQ ID NO: 38546 - protein, 30 aa, Artificial Sequence
  Description of Artificial Sequence: Synthetic polypeptide
DEGEIATTNPVATEQYGSVATNLQVGDNEQ

SEQ ID NO: 38547 - protein, 32 aa, Artificial Sequence
  Description of Artificial Sequence: Synthetic polypeptide
DEEEIRTTNPVATEQYGSVCSTVNDLQRSQDP

SEQ ID NO: 38548 - protein, 33 aa, Artificial Sequence
  Description of Artificial Sequence: Synthetic polypeptide
DEEEIRTTNPVAYEQYGQSVSQTNELLQRGIFR

SEQ ID NO: 38549 - protein, 33 aa, Artificial Sequence
  Description of Artificial Sequence: Synthetic polypeptide
DEEEIRTTNPVATEQYGSVCSTTELQRGSNDQV

SEQ ID NO: 38550 - protein, 32 aa, Artificial Sequence
  Description of Artificial Sequence: Synthetic polypeptide
DEEEIRTTNPVATEQYGSVCSTTALQFGSNAA

SEQ ID NO: 38551 - protein, 32 aa, Artificial Sequence
  Description of Artificial Sequence: Synthetic polypeptide
DEEEIRTTNPVATEQYGSVCSTRDYERNGNRQ

SEQ ID NO: 38552 - protein, 29 aa, Artificial Sequence
  Description of Artificial Sequence: Synthetic peptide
DEGEIATVNPVATEQYGSVATNLEQGGNH

SEQ ID NO: 38553 - protein, 29 aa, Artificial Sequence
  Description of Artificial Sequence: Synthetic peptide
DEGEIATVNPVATEQYGSVSTNLEEGNDQ

SEQ ID NO: 38554 - protein, 33 aa, Artificial Sequence
  Description of Artificial Sequence: Synthetic polypeptide
DEEEIRTTNPVAYEQYGQSVSQTNELSQRGTTR

SEQ ID NO: 38555 - protein, 29 aa, Artificial Sequence
  Description of Artificial Sequence: Synthetic peptide
DEGEICTTNPVATEPYGSVAATNLQQGNE

SEQ ID NO: 38556 - protein, 29 aa, Artificial Sequence
  Description of Artificial Sequence: Synthetic peptide
DEGEICTVNPVATEQYGSVSTNELFEGND

SEQ ID NO: 38557 - protein, 29 aa, Artificial Sequence
  Description of Artificial Sequence: Synthetic peptide
DEGEICTVNPVATEQYGSVSTNLFEGNNQ

SEQ ID NO: 38558 - protein, 29 aa, Artificial Sequence
  Description of Artificial Sequence: Synthetic peptide
DEGEICTVNPVATEQYGSVSTNLFEGNNT

SEQ ID NO: 38559 - protein, 29 aa, Artificial Sequence
  Description of Artificial Sequence: Synthetic peptide
DEGEICTVNPVATEQYGSVSTNLNFEGNN

SEQ ID NO: 38560 - protein, 32 aa, Artificial Sequence
  Description of Artificial Sequence: Synthetic polypeptide
DEGEIGTTNPVATEQYGSVVSTNLVQQLGGNR

SEQ ID NO: 38561 - protein, 33 aa, Artificial Sequence
  Description of Artificial Sequence: Synthetic polypeptide
DEEEIRTTNPVATEQYGSVCSTPNLQEHNSNRL

SEQ ID NO: 38562 - protein, 29 aa, Artificial Sequence
  Description of Artificial Sequence: Synthetic peptide
DEGEICTVNPVATEQYGSVSCTNLGEGNH

SEQ ID NO: 38563 - protein, 32 aa, Artificial Sequence
  Description of Artificial Sequence: Synthetic polypeptide
DEEEIATTNPVATEQYGCVCSTNLQRFNSNRG

SEQ ID NO: 38564 - protein, 33 aa, Artificial Sequence
  Description of Artificial Sequence: Synthetic polypeptide
DEEEIRTTNPVAYEQYGQSVSQTNMLAQRGTIR

SEQ ID NO: 38565 - protein, 33 aa, Artificial Sequence
  Description of Artificial Sequence: Synthetic polypeptide
DEEEIRTTNPVATEQYGSVCSTTMNLQGFGSND

SEQ ID NO: 38566 - protein, 31 aa, Artificial Sequence
  Description of Artificial Sequence: Synthetic polypeptide
DEEEIATTNPVATEQYGCVCSTNLQFGNSND

SEQ ID NO: 38567 - protein, 29 aa, Artificial Sequence
  Description of Artificial Sequence: Synthetic peptide
DEGEIATTNPVATEQYGSVSANLGRNMNL

SEQ ID NO: 38568 - protein, 29 aa, Artificial Sequence
  Description of Artificial Sequence: Synthetic peptide
DEGEIATTNPVATEQYGSVSTDLESEGER

SEQ ID NO: 38569 - protein, 32 aa, Artificial Sequence
  Description of Artificial Sequence: Synthetic polypeptide
DEGEIATTNPVATEQYGSVSTNDLIQRQENRE

SEQ ID NO: 38570 - protein, 33 aa, Artificial Sequence
  Description of Artificial Sequence: Synthetic polypeptide
DEEEIRTTNPVAYEQYGQSVSQTNSLAQRGGSR

SEQ ID NO: 38571 - protein, 33 aa, Artificial Sequence
  Description of Artificial Sequence: Synthetic polypeptide
DEEEIRTTNPVATEQYGSVCSTVFLQNIGSNRD

SEQ ID NO: 38572 - protein, 33 aa, Artificial Sequence
  Description of Artificial Sequence: Synthetic polypeptide
DEEEIRTTNPVATEQYGSVCSTTGNLNQGGSND

SEQ ID NO: 38573 - protein, 31 aa, Artificial Sequence
  Description of Artificial Sequence: Synthetic polypeptide
DEEEIATTNPVATEQYGSVCSTTDQRDGNED

SEQ ID NO: 38574 - protein, 32 aa, Artificial Sequence
  Description of Artificial Sequence: Synthetic polypeptide
DEEEIRTTNPVATEQYGSVCSTTNPQNGSNIQ

SEQ ID NO: 38575 - protein, 33 aa, Artificial Sequence
  Description of Artificial Sequence: Synthetic polypeptide
DEEEIRTTNPVATEQYGSVCSTTNLQQVFGGRA

SEQ ID NO: 38576 - protein, 33 aa, Artificial Sequence
  Description of Artificial Sequence: Synthetic polypeptide
DEEEIRTTNPVATEQYGSVCSTTNLDQYGSNQS

SEQ ID NO: 38577 - protein, 31 aa, Artificial Sequence
  Description of Artificial Sequence: Synthetic polypeptide
DEEEIRTTNPVATEQYGSVCSTTNDQLNDNE

SEQ ID NO: 38578 - protein, 29 aa, Artificial Sequence
  Description of Artificial Sequence: Synthetic peptide
DEGEIATTNPVAYEQYGSVATNLQQGNNQ

SEQ ID NO: 38579 - protein, 30 aa, Artificial Sequence
  Description of Artificial Sequence: Synthetic polypeptide
DEEEIRTTNPVATEQYGSVISNLPQEDPND

SEQ ID NO: 38580 - protein, 32 aa, Artificial Sequence
  Description of Artificial Sequence: Synthetic polypeptide
DEEEIATTNPVATEQYGSVCSTVGDQREGNER

SEQ ID NO: 38581 - protein, 31 aa, Artificial Sequence
  Description of Artificial Sequence: Synthetic polypeptide
DEEEIRTTNPVATEQYGSVCSWELQNFGNQV

SEQ ID NO: 38582 - protein, 31 aa, Artificial Sequence
  Description of Artificial Sequence: Synthetic polypeptide
DEEEIRTTNPVATEQYGSVCSWELQYGSNTQ

SEQ ID NO: 38583 - protein, 33 aa, Artificial Sequence
  Description of Artificial Sequence: Synthetic polypeptide
DEEEIRTTNPVAYEQYGQSVSTNDALQRGVVRP

SEQ ID NO: 38584 - protein, 32 aa, Artificial Sequence
  Description of Artificial Sequence: Synthetic polypeptide
DEEEIRTTNPVAYEQYGQSVSTNGLLQRGVGQ

SEQ ID NO: 38585 - protein, 31 aa, Artificial Sequence
  Description of Artificial Sequence: Synthetic polypeptide
DEEEIRTTNPVATEQYGSVCTNDDRGQSVRP

SEQ ID NO: 38586 - protein, 31 aa, Artificial Sequence
  Description of Artificial Sequence: Synthetic polypeptide
DEEEIATTNPVATEQYGCVSTNLQPMGDNLG

SEQ ID NO: 38587 - protein, 29 aa, Artificial Sequence
  Description of Artificial Sequence: Synthetic peptide
DEGAIRTTNPVATEQYGSFSETNLEIGNQ

SEQ ID NO: 38588 - protein, 33 aa, Artificial Sequence
  Description of Artificial Sequence: Synthetic polypeptide
DEEEIRTTNPVAYEQYGQSVSTNDLMQRGIDER

SEQ ID NO: 38589 - protein, 31 aa, Artificial Sequence
  Description of Artificial Sequence: Synthetic polypeptide
DEEEIRTTNPVATEQYGSVCTLNLQRPELQT

SEQ ID NO: 38590 - protein, 33 aa, Artificial Sequence
  Description of Artificial Sequence: Synthetic polypeptide
DEEEIRTTNPVAYEQYGQSVSTNNLSQRTGGSR

SEQ ID NO: 38591 - protein, 29 aa, Artificial Sequence
  Description of Artificial Sequence: Synthetic peptide
DEGAIRTTNPVATEQYGSFSTNDIIGNRV

SEQ ID NO: 38592 - protein, 31 aa, Artificial Sequence
  Description of Artificial Sequence: Synthetic polypeptide
DDEEIRTTNPVATEQYGCVCSSNLQRFGNQA

SEQ ID NO: 38593 - protein, 32 aa, Artificial Sequence
  Description of Artificial Sequence: Synthetic polypeptide
DEEEIRTTNPVATEQYGSVCTLNLQRMNDVIE

SEQ ID NO: 38594 - protein, 29 aa, Artificial Sequence
  Description of Artificial Sequence: Synthetic peptide
DEGAIRTTNPVATEQYGSFSTNHIHGSNR

SEQ ID NO: 38595 - protein, 30 aa, Artificial Sequence
  Description of Artificial Sequence: Synthetic polypeptide
DEGAIRTTNPVATEQYGSFSTNLAGGNERI

SEQ ID NO: 38596 - protein, 30 aa, Artificial Sequence
  Description of Artificial Sequence: Synthetic polypeptide
DEGAIRTTNPVATEQYGSFSTNLENIGNRG

SEQ ID NO: 38597 - protein, 30 aa, Artificial Sequence
  Description of Artificial Sequence: Synthetic polypeptide
DEGAIRTTNPVATEQYGSFSTNLIIGNNRM

SEQ ID NO: 38598 - protein, 30 aa, Artificial Sequence
  Description of Artificial Sequence: Synthetic polypeptide
DEGAIRTTNPVATEQYGSFSTNGLIEIGNR

SEQ ID NO: 38599 - protein, 32 aa, Artificial Sequence
  Description of Artificial Sequence: Synthetic polypeptide
DEEEIRTTNPVAYEQYGQSVSTNDLLQRTVGR

SEQ ID NO: 38600 - protein, 28 aa, Artificial Sequence
  Description of Artificial Sequence: Synthetic peptide
DEGAIRTTNPVATEQYGCFSTNLIIENR

SEQ ID NO: 38601 - protein, 28 aa, Artificial Sequence
  Description of Artificial Sequence: Synthetic peptide
DEGAIRTTNPVATEQWGSCSTNPIIGNR

SEQ ID NO: 38602 - protein, 28 aa, Artificial Sequence
  Description of Artificial Sequence: Synthetic peptide
DEFVIRTTNPVATEQYGCVETNPQRGGD

SEQ ID NO: 38603 - protein, 29 aa, Artificial Sequence
  Description of Artificial Sequence: Synthetic peptide
DEFVIRTTNPVATEQYGCVETNQQPGNRG

SEQ ID NO: 38604 - protein, 29 aa, Artificial Sequence
  Description of Artificial Sequence: Synthetic peptide
DEFVIRTTNPVATEQYGCVETNQQRMGNM

SEQ ID NO: 38605 - protein, 29 aa, Artificial Sequence
  Description of Artificial Sequence: Synthetic peptide
DEEEIRTTNPVATEQYGSVCTNEIRTEME

SEQ ID NO: 38606 - protein, 31 aa, Artificial Sequence
  Description of Artificial Sequence: Synthetic polypeptide
DEEEIATTNPVATEQYGCVVSGTNGERGNNR

SEQ ID NO: 38607 - protein, 29 aa, Artificial Sequence
  Description of Artificial Sequence: Synthetic peptide
DEFVISTTNPVATEQDGSVSTDFLQRGNE

SEQ ID NO: 38608 - protein, 28 aa, Artificial Sequence
  Description of Artificial Sequence: Synthetic peptide
DEGAIRTTNPVATEQWGSISTNLIDGNA

SEQ ID NO: 38609 - protein, 29 aa, Artificial Sequence
  Description of Artificial Sequence: Synthetic peptide
DEFVISTTNPVATEQYGCVETNPQRGNER

SEQ ID NO: 38610 - protein, 29 aa, Artificial Sequence
  Description of Artificial Sequence: Synthetic peptide
DEGAIATTNPVATEQYGSASTNLIIEGNR

SEQ ID NO: 38611 - protein, 31 aa, Artificial Sequence
  Description of Artificial Sequence: Synthetic polypeptide
DEEEIATTNPVATEQYGSVCATPNLQDGNDF

SEQ ID NO: 38612 - protein, 29 aa, Artificial Sequence
  Description of Artificial Sequence: Synthetic peptide
DEGAICTTNPVATEQYGSVQSTNLIIGNG

SEQ ID NO: 38613 - protein, 30 aa, Artificial Sequence
  Description of Artificial Sequence: Synthetic polypeptide
DEGAICTTNPVATEQYGSVSSTNLEIIGNR

SEQ ID NO: 38614 - protein, 28 aa, Artificial Sequence
  Description of Artificial Sequence: Synthetic peptide
DEGAIGTTNPVATEQYGSTSTNLIIGNS

SEQ ID NO: 38615 - protein, 32 aa, Artificial Sequence
  Description of Artificial Sequence: Synthetic polypeptide
DEEEIRTTNPVATEQYGSVISGTTNDQEGNEE

SEQ ID NO: 38616 - protein, 33 aa, Artificial Sequence
  Description of Artificial Sequence: Synthetic polypeptide
DEEEIRTTNPVAYEQYGQSVSTTNDMLQRGIDR

SEQ ID NO: 38617 - protein, 32 aa, Artificial Sequence
  Description of Artificial Sequence: Synthetic polypeptide
DEEEIRTTNPVATEQYGSVCTLLQRVGVEIRN

SEQ ID NO: 38618 - protein, 30 aa, Artificial Sequence
  Description of Artificial Sequence: Synthetic polypeptide
DEEEIRTTNPVATEQYGSVCTLLQRNELVD

SEQ ID NO: 38619 - protein, 31 aa, Artificial Sequence
  Description of Artificial Sequence: Synthetic polypeptide
DEGAIRTTNPVATEQYGSVFSTNLIEDGNER

SEQ ID NO: 38620 - protein, 28 aa, Artificial Sequence
  Description of Artificial Sequence: Synthetic peptide
DEGEIAPTNPVSTEQYGSVSCNEQRGNG

SEQ ID NO: 38621 - protein, 32 aa, Artificial Sequence
  Description of Artificial Sequence: Synthetic polypeptide
DEEEIRTTNPVAYEQYGQSVSTNDLLQRGIDI

SEQ ID NO: 38622 - protein, 33 aa, Artificial Sequence
  Description of Artificial Sequence: Synthetic polypeptide
DEEEIRTTNPVAYEQYGQSVSTNDLLQRDGIVR

SEQ ID NO: 38623 - protein, 32 aa, Artificial Sequence
  Description of Artificial Sequence: Synthetic polypeptide
DEEEIRTTNPVAYEQYGQSVSTNDLLQEGHRR

SEQ ID NO: 38624 - protein, 32 aa, Artificial Sequence
  Description of Artificial Sequence: Synthetic polypeptide
DEEEIRTTNPVAYEQYGQSVSTNDLLQDGIIR

SEQ ID NO: 38625 - protein, 31 aa, Artificial Sequence
  Description of Artificial Sequence: Synthetic polypeptide
DEEEIRTTNPVATEQYGSVCSWGNLQGISND

SEQ ID NO: 38626 - protein, 33 aa, Artificial Sequence
  Description of Artificial Sequence: Synthetic polypeptide
DEEEIRTTNPVAYEQYGQSVSTNDLLQRGIEND

SEQ ID NO: 38627 - protein, 32 aa, Artificial Sequence
  Description of Artificial Sequence: Synthetic polypeptide
DEEEIRTTNPVAYEQYGQSVSTNDLEQRIIER

SEQ ID NO: 38628 - protein, 33 aa, Artificial Sequence
  Description of Artificial Sequence: Synthetic polypeptide
DEEEIRTTNPVAYEQYGQSVSTNDLDQRGIERI

SEQ ID NO: 38629 - protein, 30 aa, Artificial Sequence
  Description of Artificial Sequence: Synthetic polypeptide
DEGEIATTNPCSTEQYGSVSSTNLQSGMNR

SEQ ID NO: 38630 - protein, 32 aa, Artificial Sequence
  Description of Artificial Sequence: Synthetic polypeptide
DEEEIATTNPVATEQYGCVSTNLQGPGGDNNR

SEQ ID NO: 38631 - protein, 31 aa, Artificial Sequence
  Description of Artificial Sequence: Synthetic polypeptide
DEEEIATTNPVATEQYGCVSTNLNGEMGDNR

SEQ ID NO: 38632 - protein, 32 aa, Artificial Sequence
  Description of Artificial Sequence: Synthetic polypeptide
DEEEIRTTNPVATEQYGSVCSWENLQNPSNRS

SEQ ID NO: 38633 - protein, 29 aa, Artificial Sequence
  Description of Artificial Sequence: Synthetic peptide
DEGEIATTNPVATEPYGSVATNLQQGNDL

SEQ ID NO: 38634 - protein, 33 aa, Artificial Sequence
  Description of Artificial Sequence: Synthetic polypeptide
DEEEIRTTNPVAYEQYGQSVSTNDLDQRGIGLR

SEQ ID NO: 38635 - protein, 28 aa, Artificial Sequence
  Description of Artificial Sequence: Synthetic peptide
DEGEIAPTNPVSTEQYGIVSCNEQRGNR

SEQ ID NO: 38636 - protein, 31 aa, Artificial Sequence
  Description of Artificial Sequence: Synthetic polypeptide
DEEEIRTTNPVATEQYGSVCSWNPQNGSNQQ

SEQ ID NO: 38637 - protein, 33 aa, Artificial Sequence
  Description of Artificial Sequence: Synthetic polypeptide
DEEEIRTTNPVAYEQYGQSVSTNDLLQRGILRV

SEQ ID NO: 38638 - protein, 31 aa, Artificial Sequence
  Description of Artificial Sequence: Synthetic polypeptide
DEGAIRTTNPVATEQYGSVISCTNELTIGNR

SEQ ID NO: 38639 - protein, 28 aa, Artificial Sequence
  Description of Artificial Sequence: Synthetic peptide
DEGAIRTTNPVAYEQWGSASTNLDIGNR

SEQ ID NO: 38640 - protein, 32 aa, Artificial Sequence
  Description of Artificial Sequence: Synthetic polypeptide
DEEEIRTTNPVATEQYGSVCTINEEQRGNENN

SEQ ID NO: 38641 - protein, 28 aa, Artificial Sequence
  Description of Artificial Sequence: Synthetic peptide
DEGAIRTTNPVAYEQWGSYSTNLIDGNR

SEQ ID NO: 38642 - protein, 32 aa, Artificial Sequence
  Description of Artificial Sequence: Synthetic polypeptide
DEEEIATTNPVATEQYGCVSTNLQPMGDNGGR

SEQ ID NO: 38643 - protein, 32 aa, Artificial Sequence
  Description of Artificial Sequence: Synthetic polypeptide
DEEEIRTTNPVAYEQYGQSVSTNDLLQRGSHQ

SEQ ID NO: 38644 - protein, 31 aa, Artificial Sequence
  Description of Artificial Sequence: Synthetic polypeptide
DEEEIRTTNPVATEQYGSVCTGLEQVRTGLL

SEQ ID NO: 38645 - protein, 29 aa, Artificial Sequence
  Description of Artificial Sequence: Synthetic peptide
DEGCIRTTNPVAYEQYGSISTNELGIGNR

SEQ ID NO: 38646 - protein, 32 aa, Artificial Sequence
  Description of Artificial Sequence: Synthetic polypeptide
DEEEIRTTNPVATEQYGSVCTDNLQQRMNLLD

SEQ ID NO: 38647 - protein, 29 aa, Artificial Sequence
  Description of Artificial Sequence: Synthetic peptide
DEGEIACTNPVATEQYGSVATNLQDGNDN

SEQ ID NO: 38648 - protein, 31 aa, Artificial Sequence
  Description of Artificial Sequence: Synthetic polypeptide
DEEEIRTTNPVATEQYGSVCTDALQVRVVDR

SEQ ID NO: 38649 - protein, 31 aa, Artificial Sequence
  Description of Artificial Sequence: Synthetic polypeptide
DEEEIRTTNPVATEQYGSVCSYTELWERNNE

SEQ ID NO: 38650 - protein, 33 aa, Artificial Sequence
  Description of Artificial Sequence: Synthetic polypeptide
DEEEIRTTNPVAYEQYGQSVSTNDLLQRGQERS

SEQ ID NO: 38651 - protein, 32 aa, Artificial Sequence
  Description of Artificial Sequence: Synthetic polypeptide
DEEEIRTTNPVATEQYGSVCSWPNLQHFGSNA

SEQ ID NO: 38652 - protein, 31 aa, Artificial Sequence
  Description of Artificial Sequence: Synthetic polypeptide
DEEEIRTTNPVATEQYGSVCSWPLQHNSNRL

SEQ ID NO: 38653 - protein, 30 aa, Artificial Sequence
  Description of Artificial Sequence: Synthetic polypeptide
DEFVIRTTNPVATEQYGCVETNPQRGENFR

SEQ ID NO: 38654 - protein, 30 aa, Artificial Sequence
  Description of Artificial Sequence: Synthetic polypeptide
DEEQIRTTNPVATEQYGSVSCTHESLRGNS

SEQ ID NO: 38655 - protein, 33 aa, Artificial Sequence
  Description of Artificial Sequence: Synthetic polypeptide
DEEEIRTTNPVAYEQYGSTVSTGNLSQRGGNQG

SEQ ID NO: 38656 - protein, 31 aa, Artificial Sequence
  Description of Artificial Sequence: Synthetic polypeptide
DDEEIRTTNPVATEQYGSVSTNLILAGQNEL

SEQ ID NO: 38657 - protein, 30 aa, Artificial Sequence
  Description of Artificial Sequence: Synthetic polypeptide
DEESIRTTNPVATEQWGSVATNNLQGDVNR

SEQ ID NO: 38658 - protein, 30 aa, Artificial Sequence
  Description of Artificial Sequence: Synthetic polypeptide
DEESIRTTNPVATEQWGSVATNNLQVGDND

SEQ ID NO: 38659 - protein, 30 aa, Artificial Sequence
  Description of Artificial Sequence: Synthetic polypeptide
DEESIRTTNPVATEQWGSVTTNNLQLGVNL

SEQ ID NO: 38660 - protein, 30 aa, Artificial Sequence
  Description of Artificial Sequence: Synthetic polypeptide
DEESIRTTNPVATEQYGCVSTNGQFDGNDE

SEQ ID NO: 38661 - protein, 32 aa, Artificial Sequence
  Description of Artificial Sequence: Synthetic polypeptide
DEEEIRTTNPVAYEQYGSVSCQNLSTRGGNPR

SEQ ID NO: 38662 - protein, 31 aa, Artificial Sequence
  Description of Artificial Sequence: Synthetic polypeptide
DEEEIRTTNPVATEQYGSVDYNVDDRGENER

SEQ ID NO: 38663 - protein, 33 aa, Artificial Sequence
  Description of Artificial Sequence: Synthetic polypeptide
DEEEIRTTNPVAYEQYGSVSCTENLSQGGTNNR

SEQ ID NO: 38664 - protein, 31 aa, Artificial Sequence
  Description of Artificial Sequence: Synthetic polypeptide
DEESIRTTNPVATEQYGHVEWTNLTRGMNDR

SEQ ID NO: 38665 - protein, 31 aa, Artificial Sequence
  Description of Artificial Sequence: Synthetic polypeptide
DEEEIRTTNPVATEQYGSVDTNQGQERNEIR

SEQ ID NO: 38666 - protein, 30 aa, Artificial Sequence
  Description of Artificial Sequence: Synthetic polypeptide
DEESIRTTNPVAYEQWGSVATNNLQGGENR

SEQ ID NO: 38667 - protein, 30 aa, Artificial Sequence
  Description of Artificial Sequence: Synthetic polypeptide
DEESISTTNPVATEAYGISVNTNELQRGNM

SEQ ID NO: 38668 - protein, 29 aa, Artificial Sequence
  Description of Artificial Sequence: Synthetic peptide
DEEEIRTTNPVAYEQYGSVQTNLQVFDEV

SEQ ID NO: 38669 - protein, 29 aa, Artificial Sequence
  Description of Artificial Sequence: Synthetic peptide
DEESISTTNPVATECYGSVNTNTLQGGNS

SEQ ID NO: 38670 - protein, 31 aa, Artificial Sequence
  Description of Artificial Sequence: Synthetic polypeptide
DEEEIRTTNPVAYEQYGSVQSTNHSQKVGNI

SEQ ID NO: 38671 - protein, 31 aa, Artificial Sequence
  Description of Artificial Sequence: Synthetic polypeptide
DEEEIRTTNPVAYEQYGSVSCQNLSQEGGTR

SEQ ID NO: 38672 - protein, 34 aa, Artificial Sequence
  Description of Artificial Sequence: Synthetic polypeptide
DEEEIRTTNPVAYEQYGSVQSTNALSQRPGGNQR

SEQ ID NO: 38673 - protein, 32 aa, Artificial Sequence
  Description of Artificial Sequence: Synthetic polypeptide
DEEEIRTTNPVAYEQYGSVSCTFALSQRPNNR

SEQ ID NO: 38674 - protein, 31 aa, Artificial Sequence
  Description of Artificial Sequence: Synthetic polypeptide
DEEEIRTTNPVAYEQYGSVSCTGHQSTGGNR

SEQ ID NO: 38675 - protein, 28 aa, Artificial Sequence
  Description of Artificial Sequence: Synthetic peptide
DEESICTVNPVATEIYGSVSSNLERGNT

SEQ ID NO: 38676 - protein, 29 aa, Artificial Sequence
  Description of Artificial Sequence: Synthetic peptide
DEESIKTTNPVAYEAYGSVNTNMLQRGNM

SEQ ID NO: 38677 - protein, 33 aa, Artificial Sequence
  Description of Artificial Sequence: Synthetic polypeptide
DEEEIRTTNPVATEQYGSVEITNMLQQGENERT

SEQ ID NO: 38678 - protein, 30 aa, Artificial Sequence
  Description of Artificial Sequence: Synthetic polypeptide
DEESIMTTNPVATECYGSVNTNGLQRGNEM

SEQ ID NO: 38679 - protein, 32 aa, Artificial Sequence
  Description of Artificial Sequence: Synthetic polypeptide
DEEEIRTTNPVATEQYGSVEETILNQRGSENT

SEQ ID NO: 38680 - protein, 29 aa, Artificial Sequence
  Description of Artificial Sequence: Synthetic peptide
DEEEIRTTNPVATEQYGSVEDTADERGEG

SEQ ID NO: 38681 - protein, 31 aa, Artificial Sequence
  Description of Artificial Sequence: Synthetic polypeptide
DEEEIRTTNPVATEQYGSVDYTNLQLDNPQH

SEQ ID NO: 38682 - protein, 30 aa, Artificial Sequence
  Description of Artificial Sequence: Synthetic polypeptide
DEESIMTTNPVATECYGSVNYTNTLQRGNQ

SEQ ID NO: 38683 - protein, 33 aa, Artificial Sequence
  Description of Artificial Sequence: Synthetic polypeptide
DEEEIRTTNPVAYEQYGSVSCTHELSQRNSGNR

SEQ ID NO: 38684 - protein, 30 aa, Artificial Sequence
  Description of Artificial Sequence: Synthetic polypeptide
DEESIMTTNPVATECYGYSVETNDLQRGNM

SEQ ID NO: 38685 - protein, 32 aa, Artificial Sequence
  Description of Artificial Sequence: Synthetic polypeptide
DEEEIRTTNPVAYEQYGSVSCTGNMLQRGGDP

SEQ ID NO: 38686 - protein, 32 aa, Artificial Sequence
  Description of Artificial Sequence: Synthetic polypeptide
DEEEIRTTNPVAYEQYGSVSCTGNMLQNGGMR

SEQ ID NO: 38687 - protein, 32 aa, Artificial Sequence
  Description of Artificial Sequence: Synthetic polypeptide
DEEEIRTTNPVAYEQYGSVSCTGNLGRGGNYE

SEQ ID NO: 38688 - protein, 31 aa, Artificial Sequence
  Description of Artificial Sequence: Synthetic polypeptide
DEEEIRTTNPVATEQYGSVEANLQPNGNNEQ

SEQ ID NO: 38689 - protein, 30 aa, Artificial Sequence
  Description of Artificial Sequence: Synthetic polypeptide
DEESIMTTNPVATECYGSVVTNTLQRGENM

SEQ ID NO: 38690 - protein, 31 aa, Artificial Sequence
  Description of Artificial Sequence: Synthetic polypeptide
DEEEIRTTNPVATEQYGSVENDNLQREQNAD

SEQ ID NO: 38691 - protein, 33 aa, Artificial Sequence
  Description of Artificial Sequence: Synthetic polypeptide
DEEEIRTTNPVAYEQYGSVQHCTNHLSQRSGNR

SEQ ID NO: 38692 - protein, 29 aa, Artificial Sequence
  Description of Artificial Sequence: Synthetic peptide
DEESISTTNPVATECYGSVTTDGLQRGNM

SEQ ID NO: 38693 - protein, 32 aa, Artificial Sequence
  Description of Artificial Sequence: Synthetic polypeptide
DEEEIRTTNPVAYEQYGSVPSTNDSQNPGGNR

SEQ ID NO: 38694 - protein, 33 aa, Artificial Sequence
  Description of Artificial Sequence: Synthetic polypeptide
DEEEIRTTNPVAYEQYGSVPSTFLSQNRTGGNR

SEQ ID NO: 38695 - protein, 33 aa, Artificial Sequence
  Description of Artificial Sequence: Synthetic polypeptide
DEEEIRTTNPVAYEQYGSVPSCTNLSQQEGNPR

SEQ ID NO: 38696 - protein, 30 aa, Artificial Sequence
  Description of Artificial Sequence: Synthetic polypeptide
DEETIRATNPVATEQYGSVSANNFQDRGNL

SEQ ID NO: 38697 - protein, 31 aa, Artificial Sequence
  Description of Artificial Sequence: Synthetic polypeptide
DEEEIRTTNPVATEQYGSVIAPTNLGRGIED

SEQ ID NO: 38698 - protein, 32 aa, Artificial Sequence
  Description of Artificial Sequence: Synthetic polypeptide
DEEEIRTTNPVAYEQYGSVPSCTNLQQEGNEE

SEQ ID NO: 38699 - protein, 31 aa, Artificial Sequence
  Description of Artificial Sequence: Synthetic polypeptide
DEEEIRTTNPVAYEQYGSVPSTNEHQTTVNR

SEQ ID NO: 38700 - protein, 30 aa, Artificial Sequence
  Description of Artificial Sequence: Synthetic polypeptide
DEETIRATNPVATEQYGSVSTMNQQAGNLS

SEQ ID NO: 38701 - protein, 30 aa, Artificial Sequence
  Description of Artificial Sequence: Synthetic polypeptide
DEETIRATNPVATEQYGSVSTQNQQLGNNL

SEQ ID NO: 38702 - protein, 31 aa, Artificial Sequence
  Description of Artificial Sequence: Synthetic polypeptide
DEEEIRTTNPVATEQYGSVDSWNLVQSLERD

SEQ ID NO: 38703 - protein, 30 aa, Artificial Sequence
  Description of Artificial Sequence: Synthetic polypeptide
DEETIRGTNPVATEQYGSVSINGGQRGNGG

SEQ ID NO: 38704 - protein, 30 aa, Artificial Sequence
  Description of Artificial Sequence: Synthetic polypeptide
DEETIRGTNPVATEQYGSVSINGGQRGNGT

SEQ ID NO: 38705 - protein, 30 aa, Artificial Sequence
  Description of Artificial Sequence: Synthetic polypeptide
DEETIRGTNPVATEQYGSVSINNGQRGNDL

SEQ ID NO: 38706 - protein, 30 aa, Artificial Sequence
  Description of Artificial Sequence: Synthetic polypeptide
DEEEIRTTNPVATEQYGSVDSTTVGERGVV

SEQ ID NO: 38707 - protein, 29 aa, Artificial Sequence
  Description of Artificial Sequence: Synthetic peptide
DEETIRATNPVATEQYGSVSTMQQQLGNL

SEQ ID NO: 38708 - protein, 30 aa, Artificial Sequence
  Description of Artificial Sequence: Synthetic polypeptide
DEESISTTNPVATECYGSVNTPNGLQRGNM

SEQ ID NO: 38709 - protein, 31 aa, Artificial Sequence
  Description of Artificial Sequence: Synthetic polypeptide
DEEEIRTTNPVATEQYGSVDTNIGQEGDNID

SEQ ID NO: 38710 - protein, 30 aa, Artificial Sequence
  Description of Artificial Sequence: Synthetic polypeptide
DEETIKTTNPVATECYGSVNTNTLQRGNQI

SEQ ID NO: 38711 - protein, 29 aa, Artificial Sequence
  Description of Artificial Sequence: Synthetic peptide
DEESISTTNPVATEPYGSVNTNELTRGNM

SEQ ID NO: 38712 - protein, 29 aa, Artificial Sequence
  Description of Artificial Sequence: Synthetic peptide
DEESIVTTNPVAVECYGSVNTNTLQRGNM

SEQ ID NO: 38713 - protein, 29 aa, Artificial Sequence
  Description of Artificial Sequence: Synthetic peptide
DEETIATTNPVACEQYGQVSTINQQRGNN

SEQ ID NO: 38714 - protein, 32 aa, Artificial Sequence
  Description of Artificial Sequence: Synthetic polypeptide
DEEEIRTTNPVATEQYGSVHTNLSQATGGNNE

SEQ ID NO: 38715 - protein, 30 aa, Artificial Sequence
  Description of Artificial Sequence: Synthetic polypeptide
DEETIATTNPVATECYGSVNTNGLQRFGNM

SEQ ID NO: 38716 - protein, 30 aa, Artificial Sequence
  Description of Artificial Sequence: Synthetic polypeptide
DEEEIRTTNPVAYEQYGSVPWTNLQGTDSR

SEQ ID NO: 38717 - protein, 29 aa, Artificial Sequence
  Description of Artificial Sequence: Synthetic peptide
DEETIMTTNPVATECYGSVNTNTEQRGNV

SEQ ID NO: 38718 - protein, 29 aa, Artificial Sequence
  Description of Artificial Sequence: Synthetic peptide
DEETIATTNPVATESYGSVNTDTLQRGNE

SEQ ID NO: 38719 - protein, 34 aa, Artificial Sequence
  Description of Artificial Sequence: Synthetic polypeptide
DEEEIRTTNPVAYEQYGSVPSTNMLSQRAGGNRL

SEQ ID NO: 38720 - protein, 30 aa, Artificial Sequence
  Description of Artificial Sequence: Synthetic polypeptide
DEETIATTNPVATESYGSVNTNTLQRGNEM

SEQ ID NO: 38721 - protein, 31 aa, Artificial Sequence
  Description of Artificial Sequence: Synthetic polypeptide
DEEEIRTTNPVAYEQYGSVPSTNLSQQGGDQ

SEQ ID NO: 38722 - protein, 30 aa, Artificial Sequence
  Description of Artificial Sequence: Synthetic polypeptide
DEETICTTNPVSTEQYGSVSTQNLQGGNQT

SEQ ID NO: 38723 - protein, 28 aa, Artificial Sequence
  Description of Artificial Sequence: Synthetic peptide
DEETICTVNPVATESYGSVSDNLERGNA

SEQ ID NO: 38724 - protein, 31 aa, Artificial Sequence
  Description of Artificial Sequence: Synthetic polypeptide
DEEEIRTTNPVAYEQYGSVPSTNHSQHGGTR

SEQ ID NO: 38725 - protein, 29 aa, Artificial Sequence
  Description of Artificial Sequence: Synthetic peptide
DEETIATTNPVATESYGSVNTNTLIRGNQ

SEQ ID NO: 38726 - protein, 30 aa, Artificial Sequence
  Description of Artificial Sequence: Synthetic polypeptide
DEEEIRTTNPVAYEQYGSVSCTNGSQTGSV

SEQ ID NO: 38727 - protein, 32 aa, Artificial Sequence
  Description of Artificial Sequence: Synthetic polypeptide
DEEEIRTTNPVAYEQYGSVSCTNNQQGTGGNR

SEQ ID NO: 38728 - protein, 32 aa, Artificial Sequence
  Description of Artificial Sequence: Synthetic polypeptide
DEEEIRTTNPVATEQYGSVENTGLQRIGNEMM

SEQ ID NO: 38729 - protein, 28 aa, Artificial Sequence
  Description of Artificial Sequence: Synthetic peptide
DEEQIRTTNPVAYEQYGKVSTHETRGNT

SEQ ID NO: 38730 - protein, 31 aa, Artificial Sequence
  Description of Artificial Sequence: Synthetic polypeptide
DEEEIRTTNPVAYEQYGSVSTNPQNFGSNAE

SEQ ID NO: 38731 - protein, 28 aa, Artificial Sequence
  Description of Artificial Sequence: Synthetic peptide
DEEQIRTTNPVAYEQYGSVSTEELNGNT

SEQ ID NO: 38732 - protein, 32 aa, Artificial Sequence
  Description of Artificial Sequence: Synthetic polypeptide
DEEEIRTTNPVAYEQYGSVSTNMTQTRNGDER

SEQ ID NO: 38733 - protein, 31 aa, Artificial Sequence
  Description of Artificial Sequence: Synthetic polypeptide
DEEEIRTTNPVATEQYGSVEPTSLLLGRGTR

SEQ ID NO: 38734 - protein, 29 aa, Artificial Sequence
  Description of Artificial Sequence: Synthetic peptide
DEESIACTNPVATECYGSVATNGLQRGNL

SEQ ID NO: 38735 - protein, 30 aa, Artificial Sequence
  Description of Artificial Sequence: Synthetic polypeptide
DEEEIATTNPVATEQYGSVCAANNLQEGER

SEQ ID NO: 38736 - protein, 33 aa, Artificial Sequence
  Description of Artificial Sequence: Synthetic polypeptide
DEEEIRTTNPVAYEQYGSVSTNMLSQRPGGNEN

SEQ ID NO: 38737 - protein, 32 aa, Artificial Sequence
  Description of Artificial Sequence: Synthetic polypeptide
DEEEIRTTNPVATEQYGSVEPTNMLQRQGLFT

SEQ ID NO: 38738 - protein, 31 aa, Artificial Sequence
  Description of Artificial Sequence: Synthetic polypeptide
DEEEIRTTNPVATEQYGSVEPTNLQQVFGGN

SEQ ID NO: 38739 - protein, 31 aa, Artificial Sequence
  Description of Artificial Sequence: Synthetic polypeptide
DEEEIRTTNPVAYEQYGSVSTNMESQSVGMR

SEQ ID NO: 38740 - protein, 33 aa, Artificial Sequence
  Description of Artificial Sequence: Synthetic polypeptide
DEEEIRTTNPVAYEQYGSVSTNLSQPAGGNNRS

SEQ ID NO: 38741 - protein, 31 aa, Artificial Sequence
  Description of Artificial Sequence: Synthetic polypeptide
DEEEIRTTNPVATEQYGSVEPTNLETMGFNS

SEQ ID NO: 38742 - protein, 31 aa, Artificial Sequence
  Description of Artificial Sequence: Synthetic polypeptide
DEEEIRTTNPVATEQYGSVEPTNLENGEDRD

SEQ ID NO: 38743 - protein, 31 aa, Artificial Sequence
  Description of Artificial Sequence: Synthetic polypeptide
DEEEIRTTNPVATEQYGSVEPTNMQRTNVLS

SEQ ID NO: 38744 - protein, 30 aa, Artificial Sequence
  Description of Artificial Sequence: Synthetic polypeptide
DEEEIRTTNPVATEQYGSVEPTNLDDGVQN

SEQ ID NO: 38745 - protein, 30 aa, Artificial Sequence
  Description of Artificial Sequence: Synthetic polypeptide
DEEQIRTTNPVATEQYGSVSYTVPELRGNT

SEQ ID NO: 38746 - protein, 30 aa, Artificial Sequence
  Description of Artificial Sequence: Synthetic polypeptide
DDEEISTTNPVATEQYGCVSTNLQGFGSNV

SEQ ID NO: 38747 - protein, 30 aa, Artificial Sequence
  Description of Artificial Sequence: Synthetic polypeptide
DEEQIRTTNPVATEQYGSVSTDDEDRNGNT

SEQ ID NO: 38748 - protein, 29 aa, Artificial Sequence
  Description of Artificial Sequence: Synthetic peptide
DEEQIRTTNPVATEQYGSVSTDELGGNTE

SEQ ID NO: 38749 - protein, 32 aa, Artificial Sequence
  Description of Artificial Sequence: Synthetic polypeptide
DEEEIRTTNPVAYEQYGSVSTPLQERFGSNQN

SEQ ID NO: 38750 - protein, 29 aa, Artificial Sequence
  Description of Artificial Sequence: Synthetic peptide
DEEQIRTTNPVATEQYGSVSTGEGDVGNT

SEQ ID NO: 38751 - protein, 30 aa, Artificial Sequence
  Description of Artificial Sequence: Synthetic polypeptide
DEEQIRTTNPVATEQYGSVSTGGNELGGNT

SEQ ID NO: 38752 - protein, 30 aa, Artificial Sequence
  Description of Artificial Sequence: Synthetic polypeptide
DEEQIRTTNPVATEQYGSVSTGHEDDRGNT

SEQ ID NO: 38753 - protein, 31 aa, Artificial Sequence
  Description of Artificial Sequence: Synthetic polypeptide
DEEQIRTTNPVATEQYGSVSTVELTRSGNVT

SEQ ID NO: 38754 - protein, 32 aa, Artificial Sequence
  Description of Artificial Sequence: Synthetic polypeptide
DEEEIRTTNPVAYEQYGSVSTNSHQERTVGIR

SEQ ID NO: 38755 - protein, 33 aa, Artificial Sequence
  Description of Artificial Sequence: Synthetic polypeptide
DEEEIRTTNPVAYEQYGSVSTNSHQERTMGSNR

SEQ ID NO: 38756 - protein, 28 aa, Artificial Sequence
  Description of Artificial Sequence: Synthetic peptide
DEEQIRTTNPVATEQYGSVSTHELGENT

SEQ ID NO: 38757 - protein, 30 aa, Artificial Sequence
  Description of Artificial Sequence: Synthetic polypeptide
DEEQIRTTNPVATEQYGSVSTHEPLDNGNT

SEQ ID NO: 38758 - protein, 29 aa, Artificial Sequence
  Description of Artificial Sequence: Synthetic peptide
DEEQIRTTNPVATEQYGSVSTPEAINGNT

SEQ ID NO: 38759 - protein, 29 aa, Artificial Sequence
  Description of Artificial Sequence: Synthetic peptide
DEEQIRTTNPVATEQYGSVSTQGELGGNT

SEQ ID NO: 38760 - protein, 31 aa, Artificial Sequence
  Description of Artificial Sequence: Synthetic polypeptide
DEEEIRTTNPVAYEQYGSVSTNSHQERDVDR

SEQ ID NO: 38761 - protein, 29 aa, Artificial Sequence
  Description of Artificial Sequence: Synthetic peptide
DEEQIRTTNPVATEQYGSVSTHEERENNE

SEQ ID NO: 38762 - protein, 29 aa, Artificial Sequence
  Description of Artificial Sequence: Synthetic peptide
DEESIATTNPVATEAYGSVNTNTLQSGNM

SEQ ID NO: 38763 - protein, 31 aa, Artificial Sequence
  Description of Artificial Sequence: Synthetic polypeptide
DEEEIRTTNPVATEQYGSVEPTNGLQNGLTP

SEQ ID NO: 38764 - protein, 29 aa, Artificial Sequence
  Description of Artificial Sequence: Synthetic peptide
DEESIATTNPVATECYGSVETNTQQRGND

SEQ ID NO: 38765 - protein, 32 aa, Artificial Sequence
  Description of Artificial Sequence: Synthetic polypeptide
DEEEIRTTNPVAYEQYGSVSTGNMLSGRGGPR

SEQ ID NO: 38766 - protein, 29 aa, Artificial Sequence
  Description of Artificial Sequence: Synthetic peptide
DEEEIRTTNPVATEQYGSVHTNDQLFEQG

SEQ ID NO: 38767 - protein, 31 aa, Artificial Sequence
  Description of Artificial Sequence: Synthetic polypeptide
DEEEIRTTNPVAYEQYGSVSTEDLQGFGSNI

SEQ ID NO: 38768 - protein, 31 aa, Artificial Sequence
  Description of Artificial Sequence: Synthetic polypeptide
DEEEIRTTNPVAYEQYGSVSSLLQRFGSNTH

SEQ ID NO: 38769 - protein, 31 aa, Artificial Sequence
  Description of Artificial Sequence: Synthetic polypeptide
DEEEIRTTNPVAYEQYGSVSMTNPQNFGSND

SEQ ID NO: 38770 - protein, 32 aa, Artificial Sequence
  Description of Artificial Sequence: Synthetic polypeptide
DEEEIRTTNPVATEQYGSVENTTNLQIEDNRE

SEQ ID NO: 38771 - protein, 29 aa, Artificial Sequence
  Description of Artificial Sequence: Synthetic peptide
DEESIATTNPVAYEPYGSVNTNDLQRGNM

SEQ ID NO: 38772 - protein, 31 aa, Artificial Sequence
  Description of Artificial Sequence: Synthetic polypeptide
DEEEIRTTNPVATEQYGSVENTNMMQAGNIQ

SEQ ID NO: 38773 - protein, 32 aa, Artificial Sequence
  Description of Artificial Sequence: Synthetic polypeptide
DEEEIRTTNPVATEQYGSVENTNILIRDENER

SEQ ID NO: 38774 - protein, 31 aa, Artificial Sequence
  Description of Artificial Sequence: Synthetic polypeptide
DEEEIRTTNPVAYEQYGSVSHNEYGRGGNNR

SEQ ID NO: 38775 - protein, 28 aa, Artificial Sequence
  Description of Artificial Sequence: Synthetic peptide
DEESIATVNPVATEPYGSVSGNLEDGNR

SEQ ID NO: 38776 - protein, 31 aa, Artificial Sequence
  Description of Artificial Sequence: Synthetic polypeptide
DEEEIRTTNPVATEQYGSVENTMNGLQRNLT

SEQ ID NO: 38777 - protein, 31 aa, Artificial Sequence
  Description of Artificial Sequence: Synthetic polypeptide
DEEEIRTTNPVAYEQYGSVSDNLSWFGNNRD

SEQ ID NO: 38778 - protein, 30 aa, Artificial Sequence
  Description of Artificial Sequence: Synthetic polypeptide
DEESICTTNPVATEAYGSVSNTNTLQEGNM

SEQ ID NO: 38779 - protein, 31 aa, Artificial Sequence
  Description of Artificial Sequence: Synthetic polypeptide
DEEEIRTTNPVATEQYGSVENTNLINDENDR

SEQ ID NO: 38780 - protein, 29 aa, Artificial Sequence
  Description of Artificial Sequence: Synthetic peptide
DEESIATTNPVAYECYGSVCTNNLQRGNM

SEQ ID NO: 38781 - protein, 33 aa, Artificial Sequence
  Description of Artificial Sequence: Synthetic polypeptide
DEEEIRTTNPVAYEQYGSVSTNADSQRPGGNRW

SEQ ID NO: 38782 - protein, 29 aa, Artificial Sequence
  Description of Artificial Sequence: Synthetic peptide
DEESIATTNPVATEQYGCVSTNQQTGNDQ

SEQ ID NO: 38783 - protein, 32 aa, Artificial Sequence
  Description of Artificial Sequence: Synthetic polypeptide
DEEEIRTTNPVATEQYGSVEPTNALQRVELRD

SEQ ID NO: 38784 - protein, 29 aa, Artificial Sequence
  Description of Artificial Sequence: Synthetic peptide
DEESIATTNPVATECYGSVNTDGLQRGNA

SEQ ID NO: 38785 - protein, 31 aa, Artificial Sequence
  Description of Artificial Sequence: Synthetic polypeptide
DEEEIRTTNPVATEQYGSVEPTLDLQAGNEL

SEQ ID NO: 38786 - protein, 30 aa, Artificial Sequence
  Description of Artificial Sequence: Synthetic polypeptide
DEESIATTNPVATECYGSVNTNDLQRGNME

SEQ ID NO: 38787 - protein, 30 aa, Artificial Sequence
  Description of Artificial Sequence: Synthetic polypeptide
DEESIATTNPVATECYGSVNTNELIQRGNM

SEQ ID NO: 38788 - protein, 29 aa, Artificial Sequence
  Description of Artificial Sequence: Synthetic peptide
DEESIATTNPVATECYGSVNTNQLQQGNM

SEQ ID NO: 38789 - protein, 31 aa, Artificial Sequence
  Description of Artificial Sequence: Synthetic polypeptide
DEEEIRTTNPVAYEQYGSVSTNLQHGDTDME

SEQ ID NO: 38790 - protein, 29 aa, Artificial Sequence
  Description of Artificial Sequence: Synthetic peptide
DEESIATTNPVATECYGSVNTNTLQAGNA

SEQ ID NO: 38791 - protein, 31 aa, Artificial Sequence
  Description of Artificial Sequence: Synthetic polypeptide
DEEEIRTTNPVAYEQYGSVSTNEDSQEGGNE

SEQ ID NO: 38792 - protein, 29 aa, Artificial Sequence
  Description of Artificial Sequence: Synthetic peptide
DEESIATTNPVATEIYGCVATNLQREQNR

SEQ ID NO: 38793 - protein, 29 aa, Artificial Sequence
  Description of Artificial Sequence: Synthetic peptide
DEESIATTNPVATEPYGSVATDTLQRGNM

SEQ ID NO: 38794 - protein, 30 aa, Artificial Sequence
  Description of Artificial Sequence: Synthetic polypeptide
DEESIATTNPVATEPYGSVATNQLDQRGNM

SEQ ID NO: 38795 - protein, 28 aa, Artificial Sequence
  Description of Artificial Sequence: Synthetic peptide
DEESIATTNPVATEQYGCVATNDQDGNF

SEQ ID NO: 38796 - protein, 31 aa, Artificial Sequence
  Description of Artificial Sequence: Synthetic polypeptide
DEEEIRTTNPVAYEQYGSVSTNDSQEGGNNS

SEQ ID NO: 38797 - protein, 30 aa, Artificial Sequence
  Description of Artificial Sequence: Synthetic polypeptide
DEEEIRTTNPVATEQYGSVEPGNLQEGELV

SEQ ID NO: 38798 - protein, 29 aa, Artificial Sequence
  Description of Artificial Sequence: Synthetic peptide
DEETIRTTNPVAAEQYGQVSTIEVQRGNP

SEQ ID NO: 38799 - protein, 31 aa, Artificial Sequence
  Description of Artificial Sequence: Synthetic polypeptide
DDEEIRTTNPVATEQYGSVSTNLANFGSNQA

SEQ ID NO: 38800 - protein, 29 aa, Artificial Sequence
  Description of Artificial Sequence: Synthetic peptide
DEETIRTTNPVAAEQYGTVSTMNVQRVNN

SEQ ID NO: 38801 - protein, 29 aa, Artificial Sequence
  Description of Artificial Sequence: Synthetic peptide
DEETIRTTNPVACEQYGQVSTINVQEGNN

SEQ ID NO: 38802 - protein, 30 aa, Artificial Sequence
  Description of Artificial Sequence: Synthetic polypeptide
DEETIRTTNPVATEQYGTIVSINGQRGDND

SEQ ID NO: 38803 - protein, 28 aa, Artificial Sequence
  Description of Artificial Sequence: Synthetic peptide
DEEEIRTTNPVATEQYGSVDEGPNEGDR

SEQ ID NO: 38804 - protein, 31 aa, Artificial Sequence
  Description of Artificial Sequence: Synthetic polypeptide
DEEEIRTTNPVAYEQYGSVATNLQAEGNNQD

SEQ ID NO: 38805 - protein, 30 aa, Artificial Sequence
  Description of Artificial Sequence: Synthetic polypeptide
DEEEIRTTNPVAYEQYGSVATNLQAEDNSD

SEQ ID NO: 38806 - protein, 32 aa, Artificial Sequence
  Description of Artificial Sequence: Synthetic polypeptide
DEETIRTTNPVATEQYGTVSVTSTNNLQIGNE

SEQ ID NO: 38807 - protein, 31 aa, Artificial Sequence
  Description of Artificial Sequence: Synthetic polypeptide
DEEEIATTNPVATEQYGEVSTNLQDHGQGNG

SEQ ID NO: 38808 - protein, 30 aa, Artificial Sequence
  Description of Artificial Sequence: Synthetic polypeptide
DEEEIRTTNPVAYEQYGSVATNLQAENEDD

SEQ ID NO: 38809 - protein, 31 aa, Artificial Sequence
  Description of Artificial Sequence: Synthetic polypeptide
DEEEIRTTNPVATEQYGSVDCTNLQQRVELL

SEQ ID NO: 38810 - protein, 31 aa, Artificial Sequence
  Description of Artificial Sequence: Synthetic polypeptide
DEETIRTTNPVATEQYGTVVSTNLQQIGNQG

SEQ ID NO: 38811 - protein, 31 aa, Artificial Sequence
  Description of Artificial Sequence: Synthetic polypeptide
DEETIRTTNPVATEQYGTVVSTTNLQIGNTN

SEQ ID NO: 38812 - protein, 31 aa, Artificial Sequence
  Description of Artificial Sequence: Synthetic polypeptide
DEETIRTTNPVATEQYGTVVSTTNLQQIGNQ

SEQ ID NO: 38813 - protein, 30 aa, Artificial Sequence
  Description of Artificial Sequence: Synthetic polypeptide
DEETIRTTNPVATEQYGVVSTNQQFGNTEQ

SEQ ID NO: 38814 - protein, 30 aa, Artificial Sequence
  Description of Artificial Sequence: Synthetic polypeptide
DEETIRTTNPVATEQYGVVSTTNQQFGNME

SEQ ID NO: 38815 - protein, 32 aa, Artificial Sequence
  Description of Artificial Sequence: Synthetic polypeptide
DEEEIRTTNPVAYEQYGSVATNALSQRGGSRG

SEQ ID NO: 38816 - protein, 31 aa, Artificial Sequence
  Description of Artificial Sequence: Synthetic polypeptide
DEETIRTTNPVATEQYGTVVSTNLQIGNNNQ

SEQ ID NO: 38817 - protein, 33 aa, Artificial Sequence
  Description of Artificial Sequence: Synthetic polypeptide
DEEEIRTTNPVAYEQYGSVASTNELSQQTGDNR

SEQ ID NO: 38818 - protein, 30 aa, Artificial Sequence
  Description of Artificial Sequence: Synthetic polypeptide
DEETIRTTNPVATEQYGSVSVTVELGQGNT

SEQ ID NO: 38819 - protein, 30 aa, Artificial Sequence
  Description of Artificial Sequence: Synthetic polypeptide
DEEEIRTTNPVAYEQYGSVATNLQANDGDP

SEQ ID NO: 38820 - protein, 31 aa, Artificial Sequence
  Description of Artificial Sequence: Synthetic polypeptide
DEEEIRTTNPVAYEQYGSVATNLQGETENDR

SEQ ID NO: 38821 - protein, 32 aa, Artificial Sequence
  Description of Artificial Sequence: Synthetic polypeptide
DEEEIRTTNPVATEQYGSVDSNTNLVQTGIQT

SEQ ID NO: 38822 - protein, 32 aa, Artificial Sequence
  Description of Artificial Sequence: Synthetic polypeptide
DEEEIRTTNPVATEQYGSVDSNTNDQRGIEQT

SEQ ID NO: 38823 - protein, 32 aa, Artificial Sequence
  Description of Artificial Sequence: Synthetic polypeptide
DEEEIRTTNPVATEQYGSVDSINLQREGVIEF

SEQ ID NO: 38824 - protein, 31 aa, Artificial Sequence
  Description of Artificial Sequence: Synthetic polypeptide
DEEEIRTTNPVATEQYGSVDQTNLQTGIEPF

SEQ ID NO: 38825 - protein, 31 aa, Artificial Sequence
  Description of Artificial Sequence: Synthetic polypeptide
DEEEIRTTNPVATEQYGSVDQTNGIQEDGNE

SEQ ID NO: 38826 - protein, 31 aa, Artificial Sequence
  Description of Artificial Sequence: Synthetic polypeptide
DEEEIRTTNPVATEQYGSVDITELQKGSNIQ

SEQ ID NO: 38827 - protein, 32 aa, Artificial Sequence
  Description of Artificial Sequence: Synthetic polypeptide
DEEEIATTNPVATEQYGEVSTNLQHNDGGNTR

SEQ ID NO: 38828 - protein, 31 aa, Artificial Sequence
  Description of Artificial Sequence: Synthetic polypeptide
DEEEIATTNPVATEQYGEVSTNLQGEGGGNT

SEQ ID NO: 38829 - protein, 32 aa, Artificial Sequence
  Description of Artificial Sequence: Synthetic polypeptide
DEEEIATTNPVATEQYGEVSTNLQGEDGNNER

SEQ ID NO: 38830 - protein, 32 aa, Artificial Sequence
  Description of Artificial Sequence: Synthetic polypeptide
DEEEIATTNPVATEQYGEVSTNLQGDHGNGRG

SEQ ID NO: 38831 - protein, 31 aa, Artificial Sequence
  Description of Artificial Sequence: Synthetic polypeptide
DEEEIRTTNPVATEQYGSVDNTTNLYGGGTR

SEQ ID NO: 38832 - protein, 31 aa, Artificial Sequence
  Description of Artificial Sequence: Synthetic polypeptide
DEETIRTTNPVATEQYGSVSVSDNLQIGDNG

SEQ ID NO: 38833 - protein, 33 aa, Artificial Sequence
  Description of Artificial Sequence: Synthetic polypeptide
DEETIRTTNPVATEQYGSVSVSVSTNLQIGDNR

SEQ ID NO: 38834 - protein, 30 aa, Artificial Sequence
  Description of Artificial Sequence: Synthetic polypeptide
DEEEIRTTNPVAYEQYGSVATNLQFGEAME

SEQ ID NO: 38835 - protein, 31 aa, Artificial Sequence
  Description of Artificial Sequence: Synthetic polypeptide
DEEEIATTNPVATEQYGEVSTNLQHNGEGNG

SEQ ID NO: 38836 - protein, 32 aa, Artificial Sequence
  Description of Artificial Sequence: Synthetic polypeptide
DEEEIRTTNPVATEQYGSVCYSTNNLNGEMNR

SEQ ID NO: 38837 - protein, 31 aa, Artificial Sequence
  Description of Artificial Sequence: Synthetic polypeptide
DEETIRTTNPVATEQYGVVSVSINLQTGDNA

SEQ ID NO: 38838 - protein, 32 aa, Artificial Sequence
  Description of Artificial Sequence: Synthetic polypeptide
DEEEIRTTNPVATEQYGSVCTTNLQNGQLFRE

SEQ ID NO: 38839 - protein, 32 aa, Artificial Sequence
  Description of Artificial Sequence: Synthetic polypeptide
DEEEIRTTNPVAYEQYGSTVSTNMLSQRGGEH

SEQ ID NO: 38840 - protein, 32 aa, Artificial Sequence
  Description of Artificial Sequence: Synthetic polypeptide
DEEEIRTTNPVAYEQYGSTVSTNMESQEPGNR

SEQ ID NO: 38841 - protein, 29 aa, Artificial Sequence
  Description of Artificial Sequence: Synthetic peptide
DEEVIATTNPVATEQYSEEVSTGLQHGNR

SEQ ID NO: 38842 - protein, 31 aa, Artificial Sequence
  Description of Artificial Sequence: Synthetic polypeptide
DEEEIRTTNPVATEQYGSVCTTLDLTRIGQR

SEQ ID NO: 38843 - protein, 31 aa, Artificial Sequence
  Description of Artificial Sequence: Synthetic polypeptide
DEEEIRTTNPVATEQYGSVCTTFNLGGVGTR

SEQ ID NO: 38844 - protein, 30 aa, Artificial Sequence
  Description of Artificial Sequence: Synthetic polypeptide
DEEVIATTNPVATEQYGSVATNLQDNGANN

SEQ ID NO: 38845 - protein, 31 aa, Artificial Sequence
  Description of Artificial Sequence: Synthetic polypeptide
DEEEIRTTNPVATEQYGSVCTSLQFQGELRP

SEQ ID NO: 38846 - protein, 29 aa, Artificial Sequence
  Description of Artificial Sequence: Synthetic peptide
DEEVIATVNPVATEPYGSVSANLERGNPR

SEQ ID NO: 38847 - protein, 30 aa, Artificial Sequence
  Description of Artificial Sequence: Synthetic polypeptide
DEEVICTTNPVATEIYGCVATNLQRGDNSR

SEQ ID NO: 38848 - protein, 29 aa, Artificial Sequence
  Description of Artificial Sequence: Synthetic peptide
DEEVICTTNPVATEIYGVVATNLQRGDND

SEQ ID NO: 38849 - protein, 32 aa, Artificial Sequence
  Description of Artificial Sequence: Synthetic polypeptide
DEEEIRTTNPVAYEQYGSTVSTNALSVRGGER

SEQ ID NO: 38850 - protein, 30 aa, Artificial Sequence
  Description of Artificial Sequence: Synthetic polypeptide
DEEEIRTTNPVATEQYGSVCTSEEQRGGEL

SEQ ID NO: 38851 - protein, 32 aa, Artificial Sequence
  Description of Artificial Sequence: Synthetic polypeptide
DDEEIRTTNPVATEQYGSVSTNTQRNFDNDRE

SEQ ID NO: 38852 - protein, 28 aa, Artificial Sequence
  Description of Artificial Sequence: Synthetic peptide
DEEVIATVNPVATEPYGSVSANLDRGNP

SEQ ID NO: 38853 - protein, 31 aa, Artificial Sequence
  Description of Artificial Sequence: Synthetic polypeptide
DEEEIRTTNPVAYEQYGSVADTWLDQRSQNR

SEQ ID NO: 38854 - protein, 30 aa, Artificial Sequence
  Description of Artificial Sequence: Synthetic polypeptide
DEEVIATTNPVATEQYGSCSTNLQDNGDNA

SEQ ID NO: 38855 - protein, 32 aa, Artificial Sequence
  Description of Artificial Sequence: Synthetic polypeptide
DEEEIRTTNPVATEQYGSVCTTPNLDYGRGTR

SEQ ID NO: 38856 - protein, 31 aa, Artificial Sequence
  Description of Artificial Sequence: Synthetic polypeptide
DEEEIRTTNPVATEQYGSVCVYANLQNAGNH

SEQ ID NO: 38857 - protein, 32 aa, Artificial Sequence
  Description of Artificial Sequence: Synthetic polypeptide
DEETIRTTNPVATEQYGVVSVSVNNLQIGDNR

SEQ ID NO: 38858 - protein, 31 aa, Artificial Sequence
  Description of Artificial Sequence: Synthetic polypeptide
DEEEIRTTNPVATEQYGSVCVTDLQSTENRD

SEQ ID NO: 38859 - protein, 30 aa, Artificial Sequence
  Description of Artificial Sequence: Synthetic polypeptide
DEEEIRTTNPVATEQYGSVCVLNLQIMENE

SEQ ID NO: 38860 - protein, 31 aa, Artificial Sequence
  Description of Artificial Sequence: Synthetic polypeptide
DEEEIRTTNPVAYEQYGSVACTPLTRTGGNR

SEQ ID NO: 38861 - protein, 32 aa, Artificial Sequence
  Description of Artificial Sequence: Synthetic polypeptide
DEEEIRTTNPVATEQYGSVCVFTNLERGNQIE

SEQ ID NO: 38862 - protein, 31 aa, Artificial Sequence
  Description of Artificial Sequence: Synthetic polypeptide
DEEEIRTTNPVATEQYGSVCTTNLQRPQMMQ

SEQ ID NO: 38863 - protein, 28 aa, Artificial Sequence
  Description of Artificial Sequence: Synthetic peptide
DEETIRVTNPVATEQYGSVSSNQQAGEE

SEQ ID NO: 38864 - protein, 33 aa, Artificial Sequence
  Description of Artificial Sequence: Synthetic polypeptide
DEEEIRTTNPVAYEQYGSTVVSDNALSQRGGNR

SEQ ID NO: 38865 - protein, 29 aa, Artificial Sequence
  Description of Artificial Sequence: Synthetic peptide
DEETIVTTNPVATECYGSVNENGLQRGNM

SEQ ID NO: 38866 - protein, 29 aa, Artificial Sequence
  Description of Artificial Sequence: Synthetic peptide
DEETIVTTNPVATECYGSVNTNGFQRGNA

SEQ ID NO: 38867 - protein, 30 aa, Artificial Sequence
  Description of Artificial Sequence: Synthetic polypeptide
DEEEIRTTNPVATEQYGSVCTVHLQELGEN

SEQ ID NO: 38868 - protein, 31 aa, Artificial Sequence
  Description of Artificial Sequence: Synthetic polypeptide
DDEEIRTTNPVATEQYGSVTVTNDQRGNEQI

SEQ ID NO: 38869 - protein, 34 aa, Artificial Sequence
  Description of Artificial Sequence: Synthetic polypeptide
DEEEIRTTNPVAYEQYGSTVVSCTNALAQRTGNR

SEQ ID NO: 38870 - protein, 28 aa, Artificial Sequence
  Description of Artificial Sequence: Synthetic peptide
DEETIRVTNPVATEQYGSVSSVQQRGEN

SEQ ID NO: 38871 - protein, 30 aa, Artificial Sequence
  Description of Artificial Sequence: Synthetic polypeptide
DEEEIRTTNPVAYEQYGSVATNLQGVNDDQ

SEQ ID NO: 38872 - protein, 31 aa, Artificial Sequence
  Description of Artificial Sequence: Synthetic polypeptide
DEEEIATTNPVATEQYGEVSTNLQNQGDNGD

SEQ ID NO: 38873 - protein, 30 aa, Artificial Sequence
  Description of Artificial Sequence: Synthetic polypeptide
DEETIRTTNPVATEQYGSVSTNQENLGGNT

SEQ ID NO: 38874 - protein, 30 aa, Artificial Sequence
  Description of Artificial Sequence: Synthetic polypeptide
DEEEIATTNPVATEQYGNVTYTNLSERGND

SEQ ID NO: 38875 - protein, 29 aa, Artificial Sequence
  Description of Artificial Sequence: Synthetic peptide
DEEEIRTTNPVAYEQYGSVGTNLQVFDDA

SEQ ID NO: 38876 - protein, 30 aa, Artificial Sequence
  Description of Artificial Sequence: Synthetic polypeptide
DEETIRTTNPVATEQWGSVATNNLTLGTNR

SEQ ID NO: 38877 - protein, 32 aa, Artificial Sequence
  Description of Artificial Sequence: Synthetic polypeptide
DEEEIRTTNPVATEQYGSVDSTNLQAFGSDQP

SEQ ID NO: 38878 - protein, 29 aa, Artificial Sequence
  Description of Artificial Sequence: Synthetic peptide
DDEEISCTNPVATCQYGSVSTNPMRGSNR

SEQ ID NO: 38879 - protein, 32 aa, Artificial Sequence
  Description of Artificial Sequence: Synthetic polypeptide
DEEEIRTTNPVATEQYGSVDSTNLNERGQQDD

SEQ ID NO: 38880 - protein, 32 aa, Artificial Sequence
  Description of Artificial Sequence: Synthetic polypeptide
DEEEIRTTNPVATEQYGSVDSTNLQITAEVRE

SEQ ID NO: 38881 - protein, 31 aa, Artificial Sequence
  Description of Artificial Sequence: Synthetic polypeptide
DEEEIRTTNPVAYEQYGSVFCTNLSQHGNNT

SEQ ID NO: 38882 - protein, 33 aa, Artificial Sequence
  Description of Artificial Sequence: Synthetic polypeptide
DEEEIRTTNPVAYEQYGSVFCTGNLQRPVGNRQ

SEQ ID NO: 38883 - protein, 31 aa, Artificial Sequence
  Description of Artificial Sequence: Synthetic polypeptide
DEETIRTTNPVATEQWGSVATVNLQLGVNTR

SEQ ID NO: 38884 - protein, 31 aa, Artificial Sequence
  Description of Artificial Sequence: Synthetic polypeptide
DEETIRTTNPVATEQWGSVITENLQLGVNGR

SEQ ID NO: 38885 - protein, 31 aa, Artificial Sequence
  Description of Artificial Sequence: Synthetic polypeptide
DEETIRTTNPVATEQWGSVVATPNLQVGVNR

SEQ ID NO: 38886 - protein, 28 aa, Artificial Sequence
  Description of Artificial Sequence: Synthetic peptide
DDEEIRTTNPVGTEQWGCVSWNLQRGVQ

SEQ ID NO: 38887 - protein, 31 aa, Artificial Sequence
  Description of Artificial Sequence: Synthetic polypeptide
DEEEIATTNPVATEQYGNVSTNPGHQNGNER

SEQ ID NO: 38888 - protein, 30 aa, Artificial Sequence
  Description of Artificial Sequence: Synthetic polypeptide
DDEEIRYTNPVATEQYGSVSVNNDRGSNSR

SEQ ID NO: 38889 - protein, 30 aa, Artificial Sequence
  Description of Artificial Sequence: Synthetic polypeptide
DEETIRTTNPVATEQYGCVSTNNQQFGGNE

SEQ ID NO: 38890 - protein, 32 aa, Artificial Sequence
  Description of Artificial Sequence: Synthetic polypeptide
DEEEIRTTNPVAYEQYGSVNILNGLDQRGGNR

SEQ ID NO: 38891 - protein, 32 aa, Artificial Sequence
  Description of Artificial Sequence: Synthetic polypeptide
DEEEIRTTNPVAYEQYGSVPCTNMLSQRGNNT

SEQ ID NO: 38892 - protein, 29 aa, Artificial Sequence
  Description of Artificial Sequence: Synthetic peptide
DEETIRTTNPVACEQYGQVSTTNNQLGNN

SEQ ID NO: 38893 - protein, 29 aa, Artificial Sequence
  Description of Artificial Sequence: Synthetic peptide
DEETIRTTNPVACEQYGTVSTINNQSGNN

SEQ ID NO: 38894 - protein, 32 aa, Artificial Sequence
  Description of Artificial Sequence: Synthetic polypeptide
DEEEIRTTNPVAYEQYGSVPSCTNELQHGGNL

SEQ ID NO: 38895 - protein, 30 aa, Artificial Sequence
  Description of Artificial Sequence: Synthetic polypeptide
DEEEIRTTNPVATEQYGSVIAPTNLQQIVT

SEQ ID NO: 38896 - protein, 30 aa, Artificial Sequence
  Description of Artificial Sequence: Synthetic polypeptide
DEETIRTTNPVATEAYGQVSTTNLQQGSNQ

SEQ ID NO: 38897 - protein, 32 aa, Artificial Sequence
  Description of Artificial Sequence: Synthetic polypeptide
DEEEIRTTNPVAYEQYGSVPSCTNASQSTGNR

SEQ ID NO: 38898 - protein, 30 aa, Artificial Sequence
  Description of Artificial Sequence: Synthetic polypeptide
DEEEIATTNPVATEQYGNVVSGFNGQNGNR

SEQ ID NO: 38899 - protein, 33 aa, Artificial Sequence
  Description of Artificial Sequence: Synthetic polypeptide
DEEEIRTTNPVATEQYGSVDSTNWLQGFGSNQN

SEQ ID NO: 38900 - protein, 33 aa, Artificial Sequence
  Description of Artificial Sequence: Synthetic polypeptide
DEEEIRTTNPVAYEQYGSVPSCTGLSQRHGGNR

SEQ ID NO: 38901 - protein, 32 aa, Artificial Sequence
  Description of Artificial Sequence: Synthetic polypeptide
DEEEIRTTNPVAYEQYGSVPSCTAALSQSGNR

SEQ ID NO: 38902 - protein, 30 aa, Artificial Sequence
  Description of Artificial Sequence: Synthetic polypeptide
DEETIRTTNPVATEQWGSCATENLQLGVNR

SEQ ID NO: 38903 - protein, 30 aa, Artificial Sequence
  Description of Artificial Sequence: Synthetic polypeptide
DEETIRTTNPVATEQWGSVATNLLQLGNND

SEQ ID NO: 38904 - protein, 30 aa, Artificial Sequence
  Description of Artificial Sequence: Synthetic polypeptide
DEETIRTTNPVATEQWGSVATNNLDEGVNR

SEQ ID NO: 38905 - protein, 30 aa, Artificial Sequence
  Description of Artificial Sequence: Synthetic polypeptide
DEETIRTTNPVATEQWGSVATNNLQIGVNQ

SEQ ID NO: 38906 - protein, 30 aa, Artificial Sequence
  Description of Artificial Sequence: Synthetic polypeptide
DEETIRTTNPVATEPYGMATTNLQRGSNRI

SEQ ID NO: 38907 - protein, 32 aa, Artificial Sequence
  Description of Artificial Sequence: Synthetic polypeptide
DEEEIRTTNPVAYEQYGSVCTNMLSQRTSNNR

SEQ ID NO: 38908 - protein, 30 aa, Artificial Sequence
  Description of Artificial Sequence: Synthetic polypeptide
DDEEIRTTNPVGTEQWGAVSTNLQRVGQVR

SEQ ID NO: 38909 - protein, 32 aa, Artificial Sequence
  Description of Artificial Sequence: Synthetic polypeptide
DEEEIRTTNPVAYEQYGSVCSTNHQNMGSNRI

SEQ ID NO: 38910 - protein, 29 aa, Artificial Sequence
  Description of Artificial Sequence: Synthetic peptide
DEETIRTTNPVATEQYGSVSSTQELGGNT

SEQ ID NO: 38911 - protein, 31 aa, Artificial Sequence
  Description of Artificial Sequence: Synthetic polypeptide
DEETIRTTNPVATEQYGSVSTNLNDNGQNEN

SEQ ID NO: 38912 - protein, 32 aa, Artificial Sequence
  Description of Artificial Sequence: Synthetic polypeptide
DEEEIATTNPVATEQYGKVSTNLSQNGGNNRN

SEQ ID NO: 38913 - protein, 32 aa, Artificial Sequence
  Description of Artificial Sequence: Synthetic polypeptide
DEEEIATTNPVATEQYGKVSTNELSQERPGNL

SEQ ID NO: 38914 - protein, 32 aa, Artificial Sequence
  Description of Artificial Sequence: Synthetic polypeptide
DEETIRTTNPVATEQYGSVSTNLQDNEGQNSG

SEQ ID NO: 38915 - protein, 32 aa, Artificial Sequence
  Description of Artificial Sequence: Synthetic polypeptide
DEETIRTTNPVATEQYGSVSTNLQDNGQNNSN

SEQ ID NO: 38916 - protein, 30 aa, Artificial Sequence
  Description of Artificial Sequence: Synthetic polypeptide
DDEEIRTTNPVATHQYGSVSTNGVQNGNNV

SEQ ID NO: 38917 - protein, 32 aa, Artificial Sequence
  Description of Artificial Sequence: Synthetic polypeptide
DEEEIATTNPVATEQYGISVATNLSQRGGNNH

SEQ ID NO: 38918 - protein, 32 aa, Artificial Sequence
  Description of Artificial Sequence: Synthetic polypeptide
DEETIRTTNPVATEQYGSVSTNLQDNNGQNEQ

SEQ ID NO: 38919 - protein, 31 aa, Artificial Sequence
  Description of Artificial Sequence: Synthetic polypeptide
DEETIRTTNPVATEQYGSVSTNLQDNQQQNS

SEQ ID NO: 38920 - protein, 29 aa, Artificial Sequence
  Description of Artificial Sequence: Synthetic peptide
DEEEIRTTNPVAYEQYGSVATNLQVDDPH

SEQ ID NO: 38921 - protein, 32 aa, Artificial Sequence
  Description of Artificial Sequence: Synthetic polypeptide
DEEEIRTTNPVATEQYGSVDSPTPLQRGQEQD

SEQ ID NO: 38922 - protein, 32 aa, Artificial Sequence
  Description of Artificial Sequence: Synthetic polypeptide
DEEEIRTTNPVATEQYGSVDSPTNNQRVGELV

SEQ ID NO: 38923 - protein, 31 aa, Artificial Sequence
  Description of Artificial Sequence: Synthetic polypeptide
DEEEIATTNPVATEQYGEVSTNLTGGQGNTR

SEQ ID NO: 38924 - protein, 30 aa, Artificial Sequence
  Description of Artificial Sequence: Synthetic polypeptide
DEEEIRTTNPVAYEQYGSVATNLQVGDDGD

SEQ ID NO: 38925 - protein, 31 aa, Artificial Sequence
  Description of Artificial Sequence: Synthetic polypeptide
DDEEIRTTNPVATWQYGSVSTNGEQNGNHRS

SEQ ID NO: 38926 - protein, 30 aa, Artificial Sequence
  Description of Artificial Sequence: Synthetic polypeptide
DEEEIRTTNPVAYEQYGSVATPDQRMNDRE

SEQ ID NO: 38927 - protein, 30 aa, Artificial Sequence
  Description of Artificial Sequence: Synthetic polypeptide
DEEEIRTTNPVAYEQYGSVCFTNLQVFDDR

SEQ ID NO: 38928 - protein, 29 aa, Artificial Sequence
  Description of Artificial Sequence: Synthetic peptide
DEETIRTTNPVATEQYGCVSTTQQQFGNE

SEQ ID NO: 38929 - protein, 32 aa, Artificial Sequence
  Description of Artificial Sequence: Synthetic polypeptide
DEETIRTTNPVATEQYGDVSVGSINIQRGDNR

SEQ ID NO: 38930 - protein, 32 aa, Artificial Sequence
  Description of Artificial Sequence: Synthetic polypeptide
DEEEIRTTNPVAYEQYGSVCSTGNLQGGSNDM

SEQ ID NO: 38931 - protein, 32 aa, Artificial Sequence
  Description of Artificial Sequence: Synthetic polypeptide
DEEEIRTTNPVAYEQYGSVCSITNNLQEGGER

SEQ ID NO: 38932 - protein, 32 aa, Artificial Sequence
  Description of Artificial Sequence: Synthetic polypeptide
DEETIRTTNPVATEQYGDVSVSILNLQRFDNR

SEQ ID NO: 38933 - protein, 31 aa, Artificial Sequence
  Description of Artificial Sequence: Synthetic polypeptide
DEETIRTTNPVATEQYGDVVSIDNLQFGDNR

SEQ ID NO: 38934 - protein, 31 aa, Artificial Sequence
  Description of Artificial Sequence: Synthetic polypeptide
DEEEIRTTNPVAYEQYGSVCSCTNLSTQVNR

SEQ ID NO: 38935 - protein, 33 aa, Artificial Sequence
  Description of Artificial Sequence: Synthetic polypeptide
DEEEIRTTNPVATEQYGSVDSTENHQSFGSNRG

SEQ ID NO: 38936 - protein, 34 aa, Artificial Sequence
  Description of Artificial Sequence: Synthetic polypeptide
DEEEIRTTNPVATEQYGSVDSTENHQRFGSNTRS

SEQ ID NO: 38937 - protein, 31 aa, Artificial Sequence
  Description of Artificial Sequence: Synthetic polypeptide
DEETIRTTNPVATEQYGQSVSINGQRGDNDE

SEQ ID NO: 38938 - protein, 30 aa, Artificial Sequence
  Description of Artificial Sequence: Synthetic polypeptide
DEETIRTTNPVATEQYGQVSTTNQQFGNES

SEQ ID NO: 38939 - protein, 32 aa, Artificial Sequence
  Description of Artificial Sequence: Synthetic polypeptide
DEEEIRTTNPVAYEQYGSVCSCTNLSLQGGND

SEQ ID NO: 38940 - protein, 32 aa, Artificial Sequence
  Description of Artificial Sequence: Synthetic polypeptide
DEEEIRTTNPVAYEQYGSVCSCSNLSTQGGNR

SEQ ID NO: 38941 - protein, 30 aa, Artificial Sequence
  Description of Artificial Sequence: Synthetic polypeptide
DEETIRTTNPVATEQYGSVCSMNDERGSNA

SEQ ID NO: 38942 - protein, 32 aa, Artificial Sequence
  Description of Artificial Sequence: Synthetic polypeptide
DEEEIRTTNPVATEQYGSVIDEPNLQQTGNRY

SEQ ID NO: 38943 - protein, 31 aa, Artificial Sequence
  Description of Artificial Sequence: Synthetic polypeptide
DEEEIRTTNPVATEQYGSVDSTTVGERGNEN

SEQ ID NO: 38944 - protein, 29 aa, Artificial Sequence
  Description of Artificial Sequence: Synthetic peptide
DEAEIATTNPVATEPYGSVSTNLQHGDVS

SEQ ID NO: 38945 - protein, 32 aa, Artificial Sequence
  Description of Artificial Sequence: Synthetic polypeptide
DEEEIRTTNPVATEQYGSVCSTGNLQNSGELT

SEQ ID NO: 38946 - protein, 29 aa, Artificial Sequence
  Description of Artificial Sequence: Synthetic peptide
DEEEIRTTNPVSTEQYGSVAINNLQGGQT

SEQ ID NO: 38947 - protein, 31 aa, Artificial Sequence
  Description of Artificial Sequence: Synthetic polypeptide
DEQEIRTTNPVATEQYGSSSTNTNQIEGNSR

SEQ ID NO: 38948 - protein, 30 aa, Artificial Sequence
  Description of Artificial Sequence: Synthetic polypeptide
DEQEIRTTNPVATEQYGSCSTNLEREGDQD

SEQ ID NO: 38949 - protein, 31 aa, Artificial Sequence
  Description of Artificial Sequence: Synthetic polypeptide
DETEICTTNPVATEQYGSVSTNLQGNGNDDN

SEQ ID NO: 38950 - protein, 32 aa, Artificial Sequence
  Description of Artificial Sequence: Synthetic polypeptide
DEEEIRTTNPVATEQYGVVSGTNLQTGGGNGM

SEQ ID NO: 38951 - protein, 30 aa, Artificial Sequence
  Description of Artificial Sequence: Synthetic polypeptide
DEEEIRTTNPVATEQYGVVSMTEPLIFGVR

SEQ ID NO: 38952 - protein, 33 aa, Artificial Sequence
  Description of Artificial Sequence: Synthetic polypeptide
DEEEIRTTNPVATEQYGSVNSTNDDQRGNNGGD

SEQ ID NO: 38953 - protein, 30 aa, Artificial Sequence
  Description of Artificial Sequence: Synthetic polypeptide
DEEEICTTNPMATEQYGSVPTNLQHPGNFE

SEQ ID NO: 38954 - protein, 32 aa, Artificial Sequence
  Description of Artificial Sequence: Synthetic polypeptide
DEEEICTTNPMATEQYGSVPTGNLGQPRGNGR

SEQ ID NO: 38955 - protein, 33 aa, Artificial Sequence
  Description of Artificial Sequence: Synthetic polypeptide
DEEEIRTTNPVATEQYGSVNSTNDDQRGNIELQ

SEQ ID NO: 38956 - protein, 31 aa, Artificial Sequence
  Description of Artificial Sequence: Synthetic polypeptide
DETEICTTNPVATEQYGSVSTNLQGNQGNED

SEQ ID NO: 38957 - protein, 33 aa, Artificial Sequence
  Description of Artificial Sequence: Synthetic polypeptide
DEEEIRTTNPVATEQYGSVNSTNDDQRGNGNGS

SEQ ID NO: 38958 - protein, 31 aa, Artificial Sequence
  Description of Artificial Sequence: Synthetic polypeptide
DETEICTTNPVATEQYGSVSTNLQHDGGNQQ

SEQ ID NO: 38959 - protein, 31 aa, Artificial Sequence
  Description of Artificial Sequence: Synthetic polypeptide
DEEEICTTNPMATEQYGSVPTNLSQYRVNNR

SEQ ID NO: 38960 - protein, 32 aa, Artificial Sequence
  Description of Artificial Sequence: Synthetic polypeptide
DEEEIRTTNPVATEQYGSVNSTNDDQRGIEGN

SEQ ID NO: 38961 - protein, 31 aa, Artificial Sequence
  Description of Artificial Sequence: Synthetic polypeptide
DEEEIRTTNPVATEQYGVVSNTNLNAGNNEM

SEQ ID NO: 38962 - protein, 32 aa, Artificial Sequence
  Description of Artificial Sequence: Synthetic polypeptide
DEEEIRTTNPVATEQYGSTSMTENLNQNIGQR

SEQ ID NO: 38963 - protein, 29 aa, Artificial Sequence
  Description of Artificial Sequence: Synthetic peptide
DEQEIRTTNPVATEQYGAVSVLLQRPNDE

SEQ ID NO: 38964 - protein, 32 aa, Artificial Sequence
  Description of Artificial Sequence: Synthetic polypeptide
DEQEIRTTNPVATEQWGSVSTNLPQDREGENG

SEQ ID NO: 38965 - protein, 31 aa, Artificial Sequence
  Description of Artificial Sequence: Synthetic polypeptide
DEEEIRTTNPVATEQYGVVSNTNQLNDGGNL

SEQ ID NO: 38966 - protein, 31 aa, Artificial Sequence
  Description of Artificial Sequence: Synthetic polypeptide
DEEEIRTTNPVATEQYGVVSSDNLQMSNGNQ

SEQ ID NO: 38967 - protein, 31 aa, Artificial Sequence
  Description of Artificial Sequence: Synthetic polypeptide
DEEEIRTTNPVATEQYGSVNTEDALQRGSQG

SEQ ID NO: 38968 - protein, 31 aa, Artificial Sequence
  Description of Artificial Sequence: Synthetic polypeptide
DEAEIATTNPVATEQYGSVSATNLQGGNPEE

SEQ ID NO: 38969 - protein, 33 aa, Artificial Sequence
  Description of Artificial Sequence: Synthetic polypeptide
DEEEIRTTNPVATEQYGSTSMTENLNQGIGNRS

SEQ ID NO: 38970 - protein, 33 aa, Artificial Sequence
  Description of Artificial Sequence: Synthetic polypeptide
DEEEIRTTNPVATEQYGTVISTINSLSQRVGNE

SEQ ID NO: 38971 - protein, 31 aa, Artificial Sequence
  Description of Artificial Sequence: Synthetic polypeptide
DEEEICTTNPMATEQWGSVATNLSQHRGNNR

SEQ ID NO: 38972 - protein, 31 aa, Artificial Sequence
  Description of Artificial Sequence: Synthetic polypeptide
DEQEIRTTNPVATECYGSVSCINLQDREGNG

SEQ ID NO: 38973 - protein, 31 aa, Artificial Sequence
  Description of Artificial Sequence: Synthetic polypeptide
DEEEICTTNPMATEQYGSVPDYNLQERGNGR

SEQ ID NO: 38974 - protein, 31 aa, Artificial Sequence
  Description of Artificial Sequence: Synthetic polypeptide
DEQEIRTTNPVATEQYGSTVDSITNDLRGNL

SEQ ID NO: 38975 - protein, 29 aa, Artificial Sequence
  Description of Artificial Sequence: Synthetic peptide
DEAEIATTNPVATEQYGSVSPNLDNGDNQ

SEQ ID NO: 38976 - protein, 31 aa, Artificial Sequence
  Description of Artificial Sequence: Synthetic polypeptide
DEQEIRTTNPVATEQYGSVCSTNVNDRGEDR

SEQ ID NO: 38977 - protein, 29 aa, Artificial Sequence
  Description of Artificial Sequence: Synthetic peptide
CEEEIACTNPVATEQYGVVSTNLQQGNDM

SEQ ID NO: 38978 - protein, 33 aa, Artificial Sequence
  Description of Artificial Sequence: Synthetic polypeptide
DEEEIRTTNPVATEQYGSTSMTENLSQRIGDQR

SEQ ID NO: 38979 - protein, 32 aa, Artificial Sequence
  Description of Artificial Sequence: Synthetic polypeptide
DEQEIRTTNPVATEQYGSVSTNLPEDREGENL

SEQ ID NO: 38980 - protein, 32 aa, Artificial Sequence
  Description of Artificial Sequence: Synthetic polypeptide
DEQEIRTTNPVATEQYGSVSTNLPEDREGENG

SEQ ID NO: 38981 - protein, 31 aa, Artificial Sequence
  Description of Artificial Sequence: Synthetic polypeptide
DEQEIRTTNPVATEQYGSVSTNLEDHEGENL

SEQ ID NO: 38982 - protein, 31 aa, Artificial Sequence
  Description of Artificial Sequence: Synthetic polypeptide
DEQEIRTTNPVATEQYGSVSTNDLQNFGEQD

SEQ ID NO: 38983 - protein, 31 aa, Artificial Sequence
  Description of Artificial Sequence: Synthetic polypeptide
DEQEIRTTNPVATEQYGSVSTINEEDREGNG

SEQ ID NO: 38984 - protein, 30 aa, Artificial Sequence
  Description of Artificial Sequence: Synthetic polypeptide
DEAEIATTNPVATEQYGSVSTNHNQGNGNM

SEQ ID NO: 38985 - protein, 33 aa, Artificial Sequence
  Description of Artificial Sequence: Synthetic polypeptide
DEEEIRTTNPVATEQYGSTSMTENLSQLRIGNG

SEQ ID NO: 38986 - protein, 30 aa, Artificial Sequence
  Description of Artificial Sequence: Synthetic polypeptide
DEQEIRTTNPVATEQYGSVSTGLQVVILNP

SEQ ID NO: 38987 - protein, 31 aa, Artificial Sequence
  Description of Artificial Sequence: Synthetic polypeptide
DEQEIRTTNPVATEQYGSVSSTIWNNQNGNE

SEQ ID NO: 38988 - protein, 30 aa, Artificial Sequence
  Description of Artificial Sequence: Synthetic polypeptide
DEEEICTTNPMATETYGSVPTNLQARGEGR

SEQ ID NO: 38989 - protein, 33 aa, Artificial Sequence
  Description of Artificial Sequence: Synthetic polypeptide
DEEEIRTTNPVATEQYGSTSMTENLSQGGGNGR

SEQ ID NO: 38990 - protein, 31 aa, Artificial Sequence
  Description of Artificial Sequence: Synthetic polypeptide
DEQEIRTTNPVATEQYGSVSPDNLEQNGNEQ

SEQ ID NO: 38991 - protein, 30 aa, Artificial Sequence
  Description of Artificial Sequence: Synthetic polypeptide
DETEICTTNPVATEQYGSVSTNLQGNGDDQ

SEQ ID NO: 38992 - protein, 33 aa, Artificial Sequence
  Description of Artificial Sequence: Synthetic polypeptide
DEEEIRTTNPVATEQYGSTSMTENLQQRIGNEE

SEQ ID NO: 38993 - protein, 31 aa, Artificial Sequence
  Description of Artificial Sequence: Synthetic polypeptide
DEEEICTTNPMATETYGSVPTNDLQARGNER

SEQ ID NO: 38994 - protein, 31 aa, Artificial Sequence
  Description of Artificial Sequence: Synthetic polypeptide
DEEEIRTTNPVATEQYGSVASTNQNNIGNGE

SEQ ID NO: 38995 - protein, 32 aa, Artificial Sequence
  Description of Artificial Sequence: Synthetic polypeptide
DEEEIRTTNPVATEQYGSVNSTNDDQRGVETS

SEQ ID NO: 38996 - protein, 31 aa, Artificial Sequence
  Description of Artificial Sequence: Synthetic polypeptide
DETEICTTNPVATEQYGSVSTNLQGNGDNGD

SEQ ID NO: 38997 - protein, 31 aa, Artificial Sequence
  Description of Artificial Sequence: Synthetic polypeptide
DEAEIATTNPVATEQYGSVSTDLQGDRGNQH

SEQ ID NO: 38998 - protein, 31 aa, Artificial Sequence
  Description of Artificial Sequence: Synthetic polypeptide
DEEEIRTTNPVATEQYGSVASTQDQRENQDL

SEQ ID NO: 38999 - protein, 29 aa, Artificial Sequence
  Description of Artificial Sequence: Synthetic peptide
DEQEIRTTNPVATEQYGSVQTVALIGENR

SEQ ID NO: 39000 - protein, 28 aa, Artificial Sequence
  Description of Artificial Sequence: Synthetic peptide
DEQEIRTTNPVATEQYGSVQTALIGMNV

SEQ ID NO: 39001 - protein, 33 aa, Artificial Sequence
  Description of Artificial Sequence: Synthetic polypeptide
DEEEIRTTNPVATEQYGSVNSTNDDQRGNNSIS

SEQ ID NO: 39002 - protein, 31 aa, Artificial Sequence
  Description of Artificial Sequence: Synthetic polypeptide
DEEEICTTNPMATEQYGSVPTNPQAHRGNGR

SEQ ID NO: 39003 - protein, 30 aa, Artificial Sequence
  Description of Artificial Sequence: Synthetic polypeptide
DEEEICTTNPMATEQYGSVPTNLVNRGNGD

SEQ ID NO: 39004 - protein, 30 aa, Artificial Sequence
  Description of Artificial Sequence: Synthetic polypeptide
DEEEIRTTNPVATEQYGVVSSNPQFFGSNA

SEQ ID NO: 39005 - protein, 31 aa, Artificial Sequence
  Description of Artificial Sequence: Synthetic polypeptide
DEQEIRTTNPVATEQYGSVSTNLQVPTDGRE

SEQ ID NO: 39006 - protein, 30 aa, Artificial Sequence
  Description of Artificial Sequence: Synthetic polypeptide
DEEEICTTNPMATECYGSVATNLQHDGNGR

SEQ ID NO: 39007 - protein, 30 aa, Artificial Sequence
  Description of Artificial Sequence: Synthetic polypeptide
DETEICTTNPVAYEQYGSVSTNLQDGGNEK

SEQ ID NO: 39008 - protein, 30 aa, Artificial Sequence
  Description of Artificial Sequence: Synthetic polypeptide
DEEEICTTNPCATEQYGSVVTNLQHGGNGD

SEQ ID NO: 39009 - protein, 33 aa, Artificial Sequence
  Description of Artificial Sequence: Synthetic polypeptide
DETEIRTTNPVATEAYGSTVSCTNLSQRSGNYR

SEQ ID NO: 39010 - protein, 30 aa, Artificial Sequence
  Description of Artificial Sequence: Synthetic polypeptide
DEEEICTTNPCATEQYGSVPTNLVHRNNGR

SEQ ID NO: 39011 - protein, 31 aa, Artificial Sequence
  Description of Artificial Sequence: Synthetic polypeptide
DEEEICTTNPCATEQYGSVPTNLQEYGSNGR

SEQ ID NO: 39012 - protein, 32 aa, Artificial Sequence
  Description of Artificial Sequence: Synthetic polypeptide
DETEIRTTNPVATEAYGSTVSYTNLSQRSGNQ

SEQ ID NO: 39013 - protein, 33 aa, Artificial Sequence
  Description of Artificial Sequence: Synthetic polypeptide
DETEIRTTNPVATEAYGSVCSCTNLSQRTGNNR

SEQ ID NO: 39014 - protein, 30 aa, Artificial Sequence
  Description of Artificial Sequence: Synthetic polypeptide
DEAEIATTNPVATEQYGSVSANDLQNGNDT

SEQ ID NO: 39015 - protein, 31 aa, Artificial Sequence
  Description of Artificial Sequence: Synthetic polypeptide
DEEEICTTNPCATEQYGSVPTNLQERFGNNQ

SEQ ID NO: 39016 - protein, 32 aa, Artificial Sequence
  Description of Artificial Sequence: Synthetic polypeptide
DEEEIRTTNPVATEQYGSVNSTNDDQNGNMGG

SEQ ID NO: 39017 - protein, 32 aa, Artificial Sequence
  Description of Artificial Sequence: Synthetic polypeptide
DETEIRTTNPVATEAYGSVPSCTNLSQHGNNR

SEQ ID NO: 39018 - protein, 31 aa, Artificial Sequence
  Description of Artificial Sequence: Synthetic polypeptide
DETEIRTTNPVATECYGEVSTNLQGDGDNPR

SEQ ID NO: 39019 - protein, 32 aa, Artificial Sequence
  Description of Artificial Sequence: Synthetic polypeptide
DEEEIRTTNPVATEQYGVVSTANLQGSGNNVP

SEQ ID NO: 39020 - protein, 33 aa, Artificial Sequence
  Description of Artificial Sequence: Synthetic polypeptide
DEEEIRTTNPVATEQYGSTSCTGNHSQRNGGNR

SEQ ID NO: 39021 - protein, 30 aa, Artificial Sequence
  Description of Artificial Sequence: Synthetic polypeptide
DEEEIRTTNPVATEQYGTVGTVNLEQGINF

SEQ ID NO: 39022 - protein, 30 aa, Artificial Sequence
  Description of Artificial Sequence: Synthetic polypeptide
DEEEICTTNPCATEQYGSVATNLQHEGNGT

SEQ ID NO: 39023 - protein, 31 aa, Artificial Sequence
  Description of Artificial Sequence: Synthetic polypeptide
DEEEIRTTNPVATEQYGVVSTDLQGDENERG

SEQ ID NO: 39024 - protein, 30 aa, Artificial Sequence
  Description of Artificial Sequence: Synthetic polypeptide
DETEIRTTNPVATECYGSVSTNDQRGDGEN

SEQ ID NO: 39025 - protein, 30 aa, Artificial Sequence
  Description of Artificial Sequence: Synthetic polypeptide
DEQEIATTNPVAYEQYGSVDATNLQAGNRF

SEQ ID NO: 39026 - protein, 30 aa, Artificial Sequence
  Description of Artificial Sequence: Synthetic polypeptide
CEEEIATTNPVATEQYGSVATNLQQGDNQM

SEQ ID NO: 39027 - protein, 31 aa, Artificial Sequence
  Description of Artificial Sequence: Synthetic polypeptide
DEEEIRTTNPVATEQYGSVNSTNDDERYGEQ

SEQ ID NO: 39028 - protein, 30 aa, Artificial Sequence
  Description of Artificial Sequence: Synthetic polypeptide
DEQEIATTNPVAYEQYGSVATNLQRGDNDN

SEQ ID NO: 39029 - protein, 32 aa, Artificial Sequence
  Description of Artificial Sequence: Synthetic polypeptide
DEEEIRTTNPVATEQYGVVSTDNLQPDGNFGV

SEQ ID NO: 39030 - protein, 31 aa, Artificial Sequence
  Description of Artificial Sequence: Synthetic polypeptide
DETEIRTTNPVATECYGSVSTNLQRGGDGGS

SEQ ID NO: 39031 - protein, 31 aa, Artificial Sequence
  Description of Artificial Sequence: Synthetic polypeptide
DEEEIRTTNPVATEQYGVVSTEDQRFGSERA

SEQ ID NO: 39032 - protein, 31 aa, Artificial Sequence
  Description of Artificial Sequence: Synthetic polypeptide
DEEEIRTTNPVATEQYGVVSTEDQYFGSNRF

SEQ ID NO: 39033 - protein, 29 aa, Artificial Sequence
  Description of Artificial Sequence: Synthetic peptide
DEEEIRTTNPVATEQYGVVSTEDQYNSNQ

SEQ ID NO: 39034 - protein, 30 aa, Artificial Sequence
  Description of Artificial Sequence: Synthetic polypeptide
DEEEICTTNPCATEQYGSVPTNHQERGNGQ

SEQ ID NO: 39035 - protein, 29 aa, Artificial Sequence
  Description of Artificial Sequence: Synthetic peptide
DETEIRTTNPVATDQYGSVNTVLQQLGND

SEQ ID NO: 39036 - protein, 28 aa, Artificial Sequence
  Description of Artificial Sequence: Synthetic peptide
DETEIRTTNPVATDQYGSVNTQGQLGND

SEQ ID NO: 39037 - protein, 30 aa, Artificial Sequence
  Description of Artificial Sequence: Synthetic polypeptide
CEEEIATTNPVATEQYGNVSVTWLQGGENR

SEQ ID NO: 39038 - protein, 28 aa, Artificial Sequence
  Description of Artificial Sequence: Synthetic peptide
DEQEIRTTNPVATDQYGSVNTQQQNGND

SEQ ID NO: 39039 - protein, 30 aa, Artificial Sequence
  Description of Artificial Sequence: Synthetic polypeptide
DETEICTTNPVAYEQYGSVSTNLQGNGNAD

SEQ ID NO: 39040 - protein, 29 aa, Artificial Sequence
  Description of Artificial Sequence: Synthetic peptide
DEQEIRTTNPVATDQYGSVNTQLQIGNTD

SEQ ID NO: 39041 - protein, 28 aa, Artificial Sequence
  Description of Artificial Sequence: Synthetic peptide
DEQEIRTTNPVATDQYGSVNEQLQQGND

SEQ ID NO: 39042 - protein, 31 aa, Artificial Sequence
  Description of Artificial Sequence: Synthetic polypeptide
DEEEIRTTNPVATEQYGSVNTEGLSQRGEDN

SEQ ID NO: 39043 - protein, 31 aa, Artificial Sequence
  Description of Artificial Sequence: Synthetic polypeptide
DEEEIRTTNPVATEQYGSVASYTNGQTSEQR

SEQ ID NO: 39044 - protein, 29 aa, Artificial Sequence
  Description of Artificial Sequence: Synthetic peptide
DEQEIRCTNPVATEQYGSVSTDLERGEDL

SEQ ID NO: 39045 - protein, 32 aa, Artificial Sequence
  Description of Artificial Sequence: Synthetic polypeptide
DEEEICTTNPLATEQYGSVPTNLSQYRGGNNR

SEQ ID NO: 39046 - protein, 30 aa, Artificial Sequence
  Description of Artificial Sequence: Synthetic polypeptide
DEQEIRCTNPIATEQYGSVSATNLMRGEDR

SEQ ID NO: 39047 - protein, 32 aa, Artificial Sequence
  Description of Artificial Sequence: Synthetic polypeptide
DEEEIRTTNPVATEQYGSTSMTEEDNQRIGNR

SEQ ID NO: 39048 - protein, 30 aa, Artificial Sequence
  Description of Artificial Sequence: Synthetic polypeptide
DEEEIRTTNPVATEQYGSVATAPQRGPDQM

SEQ ID NO: 39049 - protein, 33 aa, Artificial Sequence
  Description of Artificial Sequence: Synthetic polypeptide
DEEEIRTTNPVATEQYGSTSMEENLSQRIGNRD

SEQ ID NO: 39050 - protein, 28 aa, Artificial Sequence
  Description of Artificial Sequence: Synthetic peptide
DETEIRTTNCVAYCQYGSVATNLQRGDS

SEQ ID NO: 39051 - protein, 28 aa, Artificial Sequence
  Description of Artificial Sequence: Synthetic peptide
DETEIRTTNPCATEQYGSVSVNIPRVND

SEQ ID NO: 39052 - protein, 28 aa, Artificial Sequence
  Description of Artificial Sequence: Synthetic peptide
DEEEIASVNPVATEQYGSVSTAGQSGNQ

SEQ ID NO: 39053 - protein, 30 aa, Artificial Sequence
  Description of Artificial Sequence: Synthetic polypeptide
DETEIRTTNPVATDQYGSVNTGLQREGNND

SEQ ID NO: 39054 - protein, 31 aa, Artificial Sequence
  Description of Artificial Sequence: Synthetic polypeptide
DEEEIRTTNPVATEQYGVVSSTNLNRGMGET

SEQ ID NO: 39055 - protein, 28 aa, Artificial Sequence
  Description of Artificial Sequence: Synthetic peptide
DETEIRTTNPVATDQYGSVNTLLQANND

SEQ ID NO: 39056 - protein, 28 aa, Artificial Sequence
  Description of Artificial Sequence: Synthetic peptide
DEQEICTVNPVATEQYGSVSTILFEGNH

SEQ ID NO: 39057 - protein, 30 aa, Artificial Sequence
  Description of Artificial Sequence: Synthetic polypeptide
DEQEICTTNPVATEQYGSVSTSNMQSGNQN

SEQ ID NO: 39058 - protein, 28 aa, Artificial Sequence
  Description of Artificial Sequence: Synthetic peptide
DEEEIASVNPVATEQYGSVSTAGQSGNV

SEQ ID NO: 39059 - protein, 30 aa, Artificial Sequence
  Description of Artificial Sequence: Synthetic polypeptide
DEQEICTTNPTATEQYGSVATNLQHGGNGR

SEQ ID NO: 39060 - protein, 31 aa, Artificial Sequence
  Description of Artificial Sequence: Synthetic polypeptide
DEEEICTTNPDATEQYGSVPTNLEHRGNGRP

SEQ ID NO: 39061 - protein, 31 aa, Artificial Sequence
  Description of Artificial Sequence: Synthetic polypeptide
DEEEIRTTNPVATEQYGSVATDGNQRVGNSE

SEQ ID NO: 39062 - protein, 29 aa, Artificial Sequence
  Description of Artificial Sequence: Synthetic peptide
DETEIRTTNPVATDQYGSVNTLQQRGVND

SEQ ID NO: 39063 - protein, 30 aa, Artificial Sequence
  Description of Artificial Sequence: Synthetic polypeptide
DEAEIATTNPVATEQYGSVSANLGRNMNRN

SEQ ID NO: 39064 - protein, 29 aa, Artificial Sequence
  Description of Artificial Sequence: Synthetic peptide
DEQEIATTNPVSSEQYGSVSTNLQDSGER

SEQ ID NO: 39065 - protein, 33 aa, Artificial Sequence
  Description of Artificial Sequence: Synthetic polypeptide
DEEEIRTTNPVATEQYGSTSMTENLIQGNIGNR

SEQ ID NO: 39066 - protein, 30 aa, Artificial Sequence
  Description of Artificial Sequence: Synthetic polypeptide
DEAEIATTNPVATEQYGSVCTNLQNRENEQ

SEQ ID NO: 39067 - protein, 32 aa, Artificial Sequence
  Description of Artificial Sequence: Synthetic polypeptide
DEQEIRTTNPVATEQYGSVSTNLQVRMNNLVD

SEQ ID NO: 39068 - protein, 32 aa, Artificial Sequence
  Description of Artificial Sequence: Synthetic polypeptide
DEQEIRTTNPVATEQYGSVSTNLVRVGEMMRG

SEQ ID NO: 39069 - protein, 30 aa, Artificial Sequence
  Description of Artificial Sequence: Synthetic polypeptide
DEREIRTTNPVATEQYGSVSTNHQNFGEQS

SEQ ID NO: 39070 - protein, 31 aa, Artificial Sequence
  Description of Artificial Sequence: Synthetic polypeptide
DEREIRTTNPVATEQYGSVSTNEQDNQNSRS

SEQ ID NO: 39071 - protein, 31 aa, Artificial Sequence
  Description of Artificial Sequence: Synthetic polypeptide
DETEIATTNPVATEQYGSVSTNLQRGGDGGH

SEQ ID NO: 39072 - protein, 31 aa, Artificial Sequence
  Description of Artificial Sequence: Synthetic polypeptide
DETEIATTNPVATEQYGSVSTNPGQDEHGNR

SEQ ID NO: 39073 - protein, 30 aa, Artificial Sequence
  Description of Artificial Sequence: Synthetic polypeptide
DETEIATTNPVATEQYGTVSTNLQGDGNQI

SEQ ID NO: 39074 - protein, 31 aa, Artificial Sequence
  Description of Artificial Sequence: Synthetic polypeptide
DEAEIATTNPVATEQYGSVSTNLQHQGGNDA

SEQ ID NO: 39075 - protein, 33 aa, Artificial Sequence
  Description of Artificial Sequence: Synthetic polypeptide
DEREIRTTNPVATEQYGSVFSNTNLEQRFGERT

SEQ ID NO: 39076 - protein, 30 aa, Artificial Sequence
  Description of Artificial Sequence: Synthetic polypeptide
DETEIATTNPVATEQYGVVSTNLQDGNDAT

SEQ ID NO: 39077 - protein, 30 aa, Artificial Sequence
  Description of Artificial Sequence: Synthetic polypeptide
DEAEIATTNPVATEQYGSVSTNLQHQGDVQ

SEQ ID NO: 39078 - protein, 31 aa, Artificial Sequence
  Description of Artificial Sequence: Synthetic polypeptide
DEEEIRTTNPVATEQYGTVSDTELQNFNSNR

SEQ ID NO: 39079 - protein, 31 aa, Artificial Sequence
  Description of Artificial Sequence: Synthetic polypeptide
DEAEIATTNPVATEQYGSVSTNLQHNGGNNS

SEQ ID NO: 39080 - protein, 30 aa, Artificial Sequence
  Description of Artificial Sequence: Synthetic polypeptide
DEREIRTTNPVATEQYGETCSTNLQRFGDQ

SEQ ID NO: 39081 - protein, 29 aa, Artificial Sequence
  Description of Artificial Sequence: Synthetic peptide
DEAEIATTNPVAYEQYGSISATNLGRPNR

SEQ ID NO: 39082 - protein, 32 aa, Artificial Sequence
  Description of Artificial Sequence: Synthetic polypeptide
DEEEIGTTNPAATEQYGSVPTNTLVQHRGNGR

SEQ ID NO: 39083 - protein, 32 aa, Artificial Sequence
  Description of Artificial Sequence: Synthetic polypeptide
DEEEIRTTNPVATEQYGSTSTENLDQRGEEID

SEQ ID NO: 39084 - protein, 32 aa, Artificial Sequence
  Description of Artificial Sequence: Synthetic polypeptide
DEEEIRTTNPVATEQYGSTSSTENLQQGTGNT

SEQ ID NO: 39085 - protein, 32 aa, Artificial Sequence
  Description of Artificial Sequence: Synthetic polypeptide
DEEEIRTTNPVATEQYGSTSSTENLNQGIGNG

SEQ ID NO: 39086 - protein, 31 aa, Artificial Sequence
  Description of Artificial Sequence: Synthetic polypeptide
DEAEIATTNPVATEQYGSVSTNLQHNGGNAM

SEQ ID NO: 39087 - protein, 29 aa, Artificial Sequence
  Description of Artificial Sequence: Synthetic peptide
DEREIATTNPVATDQYGMVSTPALQGGNR

SEQ ID NO: 39088 - protein, 32 aa, Artificial Sequence
  Description of Artificial Sequence: Synthetic polypeptide
DEEEIRTTNPVATEQYGSTSPTENVSERIGNR

SEQ ID NO: 39089 - protein, 31 aa, Artificial Sequence
  Description of Artificial Sequence: Synthetic polypeptide
DEQVIRTTNPVATEQYGSVSTNLEDNMGQNR

SEQ ID NO: 39090 - protein, 28 aa, Artificial Sequence
  Description of Artificial Sequence: Synthetic peptide
DEQVIRTTNPVATEQYGCVTTNPQAGNI

SEQ ID NO: 39091 - protein, 30 aa, Artificial Sequence
  Description of Artificial Sequence: Synthetic polypeptide
DEQVIATTNPVATEQWGSVSTDNLQRDGNA

SEQ ID NO: 39092 - protein, 29 aa, Artificial Sequence
  Description of Artificial Sequence: Synthetic peptide
DEQVIATTNPVATEQWGSVSTDELQQGNR

SEQ ID NO: 39093 - protein, 30 aa, Artificial Sequence
  Description of Artificial Sequence: Synthetic polypeptide
DEEEIACTNPVATEQYGVVSTNLQQGNEAA

SEQ ID NO: 39094 - protein, 30 aa, Artificial Sequence
  Description of Artificial Sequence: Synthetic polypeptide
DEQVIATTNPVATEQWGSVSTDALQNRGNR

SEQ ID NO: 39095 - protein, 31 aa, Artificial Sequence
  Description of Artificial Sequence: Synthetic polypeptide
DEEEIRTTNPVATEQYGSVANTPLQTGENVT

SEQ ID NO: 39096 - protein, 31 aa, Artificial Sequence
  Description of Artificial Sequence: Synthetic polypeptide
DEREIRTTNPVATEQYGSVSTNLFRGDIDQD

SEQ ID NO: 39097 - protein, 30 aa, Artificial Sequence
  Description of Artificial Sequence: Synthetic polypeptide
DEREIRTTNPVATEQYGYVVSTKLQGRPND

SEQ ID NO: 39098 - protein, 28 aa, Artificial Sequence
  Description of Artificial Sequence: Synthetic peptide
DEREIRTTNPVATKHYGQVSTNLERTNN

SEQ ID NO: 39099 - protein, 31 aa, Artificial Sequence
  Description of Artificial Sequence: Synthetic polypeptide
DETEIATTNPVATEQYGSVSTNLQHGGGNDH

SEQ ID NO: 39100 - protein, 32 aa, Artificial Sequence
  Description of Artificial Sequence: Synthetic polypeptide
DEEEIRTTNPVATEQYGSVAISANLQREVNDI

SEQ ID NO: 39101 - protein, 31 aa, Artificial Sequence
  Description of Artificial Sequence: Synthetic polypeptide
DEEEIRTTNPVATEQYGSVAISANLQRVDDL

SEQ ID NO: 39102 - protein, 33 aa, Artificial Sequence
  Description of Artificial Sequence: Synthetic polypeptide
DEEEIRTTNPVATEQYGSVAITNALSQRGGDNS

SEQ ID NO: 39103 - protein, 31 aa, Artificial Sequence
  Description of Artificial Sequence: Synthetic polypeptide
DETEIATTNPVATEQYGSVSTNLQHNGGNDL

SEQ ID NO: 39104 - protein, 29 aa, Artificial Sequence
  Description of Artificial Sequence: Synthetic peptide
DESEIACTNPVSTEQYGSVAAENLQRGNR

SEQ ID NO: 39105 - protein, 30 aa, Artificial Sequence
  Description of Artificial Sequence: Synthetic polypeptide
DEEEIRTTNPVATEQYGSVAIVNNQEQGNQ

SEQ ID NO: 39106 - protein, 30 aa, Artificial Sequence
  Description of Artificial Sequence: Synthetic polypeptide
DEEEIRTTNPVATEQYGSVAMNDTDRGGND

SEQ ID NO: 39107 - protein, 31 aa, Artificial Sequence
  Description of Artificial Sequence: Synthetic polypeptide
DETEIATTNPVATEQYGSVSTNLQQGMGEGR

SEQ ID NO: 39108 - protein, 30 aa, Artificial Sequence
  Description of Artificial Sequence: Synthetic polypeptide
DEAEIATTNPVATEQYGSVSTNLQQGGDVQ

SEQ ID NO: 39109 - protein, 28 aa, Artificial Sequence
  Description of Artificial Sequence: Synthetic peptide
DESCSRTTNPIAYEQYGEVSTNLQRGNL

SEQ ID NO: 39110 - protein, 29 aa, Artificial Sequence
  Description of Artificial Sequence: Synthetic peptide
DESCIRCTNPVATEQYGSVSWPNMQRGNQ

SEQ ID NO: 39111 - protein, 30 aa, Artificial Sequence
  Description of Artificial Sequence: Synthetic polypeptide
DEEEIRTTNPVATEQYGSVANNLQDGPDQH

SEQ ID NO: 39112 - protein, 31 aa, Artificial Sequence
  Description of Artificial Sequence: Synthetic polypeptide
DETEIATTNPVATEQYGSVSTNLQQNGNENE

SEQ ID NO: 39113 - protein, 28 aa, Artificial Sequence
  Description of Artificial Sequence: Synthetic peptide
DESCIRCTNPVATEQYGSVSWEFQRGNL

SEQ ID NO: 39114 - protein, 34 aa, Artificial Sequence
  Description of Artificial Sequence: Synthetic polypeptide
DEEEIRTTNPVATEQYGSVNSTNDLDQLRGEFER

SEQ ID NO: 39115 - protein, 29 aa, Artificial Sequence
  Description of Artificial Sequence: Synthetic peptide
DESAIRTTNPVATEQYGSFSTNLIIGSNV

SEQ ID NO: 39116 - protein, 32 aa, Artificial Sequence
  Description of Artificial Sequence: Synthetic polypeptide
DEAEIATTNPVATEQYGSVSTNLQNNGENSRE

SEQ ID NO: 39117 - protein, 31 aa, Artificial Sequence
  Description of Artificial Sequence: Synthetic polypeptide
DEEEIRTTNPVATEQYGSVNTDPLQQGESRQ

SEQ ID NO: 39118 - protein, 30 aa, Artificial Sequence
  Description of Artificial Sequence: Synthetic polypeptide
DESAIRTTNPVATEQYGSFCSTNLIIGNRS

SEQ ID NO: 39119 - protein, 28 aa, Artificial Sequence
  Description of Artificial Sequence: Synthetic peptide
DERVIRTTNPVATEQYGCVETAPQRGNQ

SEQ ID NO: 39120 - protein, 31 aa, Artificial Sequence
  Description of Artificial Sequence: Synthetic polypeptide
DETEIATTNPVATEQYGSVSTNLQQNGQNDL

SEQ ID NO: 39121 - protein, 29 aa, Artificial Sequence
  Description of Artificial Sequence: Synthetic peptide
DEREIYTTNPVATEQYGSVSTNLDYDNTD

SEQ ID NO: 39122 - protein, 31 aa, Artificial Sequence
  Description of Artificial Sequence: Synthetic polypeptide
DEREISTTNPVATEQYGSVSTNSLFQVRGEF

SEQ ID NO: 39123 - protein, 31 aa, Artificial Sequence
  Description of Artificial Sequence: Synthetic polypeptide
DEAEIATTNPVATEQYGSVSTNLQLGEDNGE

SEQ ID NO: 39124 - protein, 31 aa, Artificial Sequence
  Description of Artificial Sequence: Synthetic polypeptide
DEEEIRTTNPVATEQYGTVSHTDDGQRSQNR

SEQ ID NO: 39125 - protein, 31 aa, Artificial Sequence
  Description of Artificial Sequence: Synthetic polypeptide
DEEEIRTTNPVATEQYGSVANNPQRGPNDQT

SEQ ID NO: 39126 - protein, 30 aa, Artificial Sequence
  Description of Artificial Sequence: Synthetic polypeptide
DEEEIACTNPVATEQYGVVSTNLQQGDNDA

SEQ ID NO: 39127 - protein, 32 aa, Artificial Sequence
  Description of Artificial Sequence: Synthetic polypeptide
DEQEIRTTNPVATEQYGSVSTNLVPVGENERA

SEQ ID NO: 39128 - protein, 31 aa, Artificial Sequence
  Description of Artificial Sequence: Synthetic polypeptide
DEEEIGTTNPSATEFYGSVPTGNLQHRGNGR

SEQ ID NO: 39129 - protein, 32 aa, Artificial Sequence
  Description of Artificial Sequence: Synthetic polypeptide
DEEEIGTTNPVATECYGSVSTNLLQERMGNLF

SEQ ID NO: 39130 - protein, 31 aa, Artificial Sequence
  Description of Artificial Sequence: Synthetic polypeptide
DEQEIRTTNPVATEQYGSVSWNLERGGDNEM

SEQ ID NO: 39131 - protein, 30 aa, Artificial Sequence
  Description of Artificial Sequence: Synthetic polypeptide
DEQEIRTTNPVATEQYGSVSVTNPIVSGNP

SEQ ID NO: 39132 - protein, 31 aa, Artificial Sequence
  Description of Artificial Sequence: Synthetic polypeptide
DEEEICTTNPTATEQYGSVATNLQDRGNDQM

SEQ ID NO: 39133 - protein, 31 aa, Artificial Sequence
  Description of Artificial Sequence: Synthetic polypeptide
DEEEICTTNPTATEQYGSVATNLQDHGNSRM

SEQ ID NO: 39134 - protein, 31 aa, Artificial Sequence
  Description of Artificial Sequence: Synthetic polypeptide
DEAEIATTNPVATEQYGSVSTNLQERGGEQD

SEQ ID NO: 39135 - protein, 30 aa, Artificial Sequence
  Description of Artificial Sequence: Synthetic polypeptide
DEAEIATTNPVATEQYGSVSTNLQDGGDVD

SEQ ID NO: 39136 - protein, 31 aa, Artificial Sequence
  Description of Artificial Sequence: Synthetic polypeptide
DEAEIATTNPVATEQYGSVSTNLQDGENGME

SEQ ID NO: 39137 - protein, 31 aa, Artificial Sequence
  Description of Artificial Sequence: Synthetic polypeptide
DETEICTTNPVATEQYGSVSTNLGNGDNDDR

SEQ ID NO: 39138 - protein, 30 aa, Artificial Sequence
  Description of Artificial Sequence: Synthetic polypeptide
DEAEIATTNPVATEQYGSVSTNLQDGDPVM

SEQ ID NO: 39139 - protein, 29 aa, Artificial Sequence
  Description of Artificial Sequence: Synthetic peptide
DEQEIRTTNPVATEQYGSVSTVTQAISNY

SEQ ID NO: 39140 - protein, 30 aa, Artificial Sequence
  Description of Artificial Sequence: Synthetic polypeptide
DETEICTTNPVATEQYGSVSTNLNGDGNDN

SEQ ID NO: 39141 - protein, 33 aa, Artificial Sequence
  Description of Artificial Sequence: Synthetic polypeptide
DEEEIRTTNPVATEQYGSTSMTENPLSQVIGNR

SEQ ID NO: 39142 - protein, 30 aa, Artificial Sequence
  Description of Artificial Sequence: Synthetic polypeptide
DEAEIATTNPVATEQYGSVSTNLQGDENEQ

SEQ ID NO: 39143 - protein, 30 aa, Artificial Sequence
  Description of Artificial Sequence: Synthetic polypeptide
DEAEIATTNPVATEQYGSVSTNLQAEQNEE

SEQ ID NO: 39144 - protein, 32 aa, Artificial Sequence
  Description of Artificial Sequence: Synthetic polypeptide
DEEEIRTTNPVATEQYGSTSMTENLTQNIGND

SEQ ID NO: 39145 - protein, 33 aa, Artificial Sequence
  Description of Artificial Sequence: Synthetic polypeptide
DEEEIRTTNPVATEQYGSTSMTENLSQRIGSNN

SEQ ID NO: 39146 - protein, 33 aa, Artificial Sequence
  Description of Artificial Sequence: Synthetic polypeptide
DEEEIRTTNPVATEQYGSTSMTENLSQRIGNPE

SEQ ID NO: 39147 - protein, 30 aa, Artificial Sequence
  Description of Artificial Sequence: Synthetic polypeptide
DEQEIRTTNPVATEQYGSVSTQNLFSNMNG

SEQ ID NO: 39148 - protein, 34 aa, Artificial Sequence
  Description of Artificial Sequence: Synthetic polypeptide
DEEEIRTTNPVATEQYGSTSMTENLSQRIGNNRF

SEQ ID NO: 39149 - protein, 30 aa, Artificial Sequence
  Description of Artificial Sequence: Synthetic polypeptide
DEQEIRTTNPVATEQYGSVSTPLNDEDNDR

SEQ ID NO: 39150 - protein, 30 aa, Artificial Sequence
  Description of Artificial Sequence: Synthetic polypeptide
DEQEIRTTNPVATEQYGSVSTPLDHSGEDR

SEQ ID NO: 39151 - protein, 33 aa, Artificial Sequence
  Description of Artificial Sequence: Synthetic polypeptide
DEEEIRTTNPVATEQYGSTSMTENLSQRIGNIL

SEQ ID NO: 39152 - protein, 32 aa, Artificial Sequence
  Description of Artificial Sequence: Synthetic polypeptide
DEQEIRTTNPVATEQYGSVSTNLVVVGENVRE

SEQ ID NO: 39153 - protein, 32 aa, Artificial Sequence
  Description of Artificial Sequence: Synthetic polypeptide
DEQEIRTTNPVATEQYGSVSTNLVRVIENPRA

SEQ ID NO: 39154 - protein, 33 aa, Artificial Sequence
  Description of Artificial Sequence: Synthetic polypeptide
DEEEIRTTNPVATEQYGSTSMTENLSQRIGERI

SEQ ID NO: 39155 - protein, 30 aa, Artificial Sequence
  Description of Artificial Sequence: Synthetic polypeptide
DEAEIATTNPVATEQYGSVSTNLERGDTDI

SEQ ID NO: 39156 - protein, 31 aa, Artificial Sequence
  Description of Artificial Sequence: Synthetic polypeptide
DEQEIRTTNPVATEQYGSVSTTTGDQRGNPP

SEQ ID NO: 39157 - protein, 30 aa, Artificial Sequence
  Description of Artificial Sequence: Synthetic polypeptide
DETEICTTNPVATEQYGSVSTNLEGNGNDG

SEQ ID NO: 39158 - protein, 31 aa, Artificial Sequence
  Description of Artificial Sequence: Synthetic polypeptide
DEAEIATTNPVATEQYGSVSTNLQGDHGNTD

SEQ ID NO: 39159 - protein, 30 aa, Artificial Sequence
  Description of Artificial Sequence: Synthetic polypeptide
DETEICTTNPVATEQYGSVSTDNLGNMGND

SEQ ID NO: 39160 - protein, 30 aa, Artificial Sequence
  Description of Artificial Sequence: Synthetic polypeptide
DETEIATTNPVAYEQYGSVSTNPQDEGMNR

SEQ ID NO: 39161 - protein, 30 aa, Artificial Sequence
  Description of Artificial Sequence: Synthetic polypeptide
DEQEITTTNPCATEQYGSVSCTNLCEQGNR

SEQ ID NO: 39162 - protein, 31 aa, Artificial Sequence
  Description of Artificial Sequence: Synthetic polypeptide
DEAEIATTNPVATEQYGSVSTNLQHNGDNNS

SEQ ID NO: 39163 - protein, 28 aa, Artificial Sequence
  Description of Artificial Sequence: Synthetic peptide
DEQEISTTNPDATEQYGGVSTNLETGNQ

SEQ ID NO: 39164 - protein, 31 aa, Artificial Sequence
  Description of Artificial Sequence: Synthetic polypeptide
DEAEIATTNPVATEQYGSVSTNLQHGENADE

SEQ ID NO: 39165 - protein, 30 aa, Artificial Sequence
  Description of Artificial Sequence: Synthetic polypeptide
DETEIATTNPVAYEQYGSVSTNPQDHGNDR

SEQ ID NO: 39166 - protein, 29 aa, Artificial Sequence
  Description of Artificial Sequence: Synthetic peptide
DETEIATTNPVAYEQYGTVSTNLQDGNQS

SEQ ID NO: 39167 - protein, 32 aa, Artificial Sequence
  Description of Artificial Sequence: Synthetic polypeptide
DEEEIRTTNPVATEQYGSVAQTNMVQQGENER

SEQ ID NO: 39168 - protein, 30 aa, Artificial Sequence
  Description of Artificial Sequence: Synthetic polypeptide
DEAEIATTNPVATEQYGSVSTNLQHDENHE

SEQ ID NO: 39169 - protein, 32 aa, Artificial Sequence
  Description of Artificial Sequence: Synthetic polypeptide
DEEEIRTTNPVATEQYGSVASLTNMQRGMVLF

SEQ ID NO: 39170 - protein, 30 aa, Artificial Sequence
  Description of Artificial Sequence: Synthetic polypeptide
DEEEIRTTNPVATEQYGSVASNLERGELDI

SEQ ID NO: 39171 - protein, 30 aa, Artificial Sequence
  Description of Artificial Sequence: Synthetic polypeptide
DEEEIRTTNPVATEQYGSTSNNNQLQGDNT

SEQ ID NO: 39172 - protein, 29 aa, Artificial Sequence
  Description of Artificial Sequence: Synthetic peptide
DEQEIRTTNPVATEQYGVVSTVVQRLEND

SEQ ID NO: 39173 - protein, 30 aa, Artificial Sequence
  Description of Artificial Sequence: Synthetic polypeptide
DEQEIRTTNPVATEQYGVVSTLLQQRPNDE

SEQ ID NO: 39174 - protein, 30 aa, Artificial Sequence
  Description of Artificial Sequence: Synthetic polypeptide
DETEIATTNPVAYEQYGTVSTNLQGGGDNR

SEQ ID NO: 39175 - protein, 33 aa, Artificial Sequence
  Description of Artificial Sequence: Synthetic polypeptide
DEEEIRTTNPVATEQYGSTSMTNNDPQRIGNDR

SEQ ID NO: 39176 - protein, 30 aa, Artificial Sequence
  Description of Artificial Sequence: Synthetic polypeptide
DETEIATTNPVAYEQYGVVSTNLQAGDNNR

SEQ ID NO: 39177 - protein, 30 aa, Artificial Sequence
  Description of Artificial Sequence: Synthetic polypeptide
DEEEIACTNPVATEQYGVVSTNLQNGDNDL

SEQ ID NO: 39178 - protein, 30 aa, Artificial Sequence
  Description of Artificial Sequence: Synthetic polypeptide
DEAEIATTNPVATEQYGSVSTNLQGQDGDV

SEQ ID NO: 39179 - protein, 29 aa, Artificial Sequence
  Description of Artificial Sequence: Synthetic peptide
DEQEIRTTNPVATEQYGVVSPVLQREEND

SEQ ID NO: 39180 - protein, 31 aa, Artificial Sequence
  Description of Artificial Sequence: Synthetic polypeptide
DEEEICTTNPVATEAYGSVACTNLQSGGNNR

SEQ ID NO: 39181 - protein, 31 aa, Artificial Sequence
  Description of Artificial Sequence: Synthetic polypeptide
DEAEIATTNPVATEQYGSVSTNLQGDVGNQE

SEQ ID NO: 39182 - protein, 33 aa, Artificial Sequence
  Description of Artificial Sequence: Synthetic polypeptide
DEEEIRTTNPVATEQYGSVASPTGNLQPTDVNR

SEQ ID NO: 39183 - protein, 31 aa, Artificial Sequence
  Description of Artificial Sequence: Synthetic polypeptide
DEEEIRTTNPVATEQYGSVASPTNLQQIVTD

SEQ ID NO: 39184 - protein, 30 aa, Artificial Sequence
  Description of Artificial Sequence: Synthetic polypeptide
DEQEIRTTNPVATEQYGSVYTTLQERIDRQ

SEQ ID NO: 39185 - protein, 31 aa, Artificial Sequence
  Description of Artificial Sequence: Synthetic polypeptide
DEEEICTTNPVASEQYGSVSTNNLQPPGNAN

SEQ ID NO: 39186 - protein, 31 aa, Artificial Sequence
  Description of Artificial Sequence: Synthetic polypeptide
DEQEIRTTNPVATEQYGSVVSYQNEGQRVNR

SEQ ID NO: 39187 - protein, 28 aa, Artificial Sequence
  Description of Artificial Sequence: Synthetic peptide
DEQNIRTTNPVATEQYGCVETNPQGGNT

SEQ ID NO: 39188 - protein, 28 aa, Artificial Sequence
  Description of Artificial Sequence: Synthetic peptide
DESEIATTNPVATDHYGKVSTNLQRVNM

SEQ ID NO: 39189 - protein, 31 aa, Artificial Sequence
  Description of Artificial Sequence: Synthetic polypeptide
DEEEICTTNPCATEQYGCVCPTNLQERGNTR

SEQ ID NO: 39190 - protein, 30 aa, Artificial Sequence
  Description of Artificial Sequence: Synthetic polypeptide
DEEEICTTNPAATEQYGSVPTNLQMEGNGT

SEQ ID NO: 39191 - protein, 31 aa, Artificial Sequence
  Description of Artificial Sequence: Synthetic polypeptide
DETEIRTTNPVATEQYGTVSTNLQPDGGNQS

SEQ ID NO: 39192 - protein, 32 aa, Artificial Sequence
  Description of Artificial Sequence: Synthetic polypeptide
DEPEIRTTNPVATEQYGSVSTPTEEQRMGNER

SEQ ID NO: 39193 - protein, 33 aa, Artificial Sequence
  Description of Artificial Sequence: Synthetic polypeptide
DEPEIRTTNPVATEQYGSVSTNPLQQRGVNEFG

SEQ ID NO: 39194 - protein, 31 aa, Artificial Sequence
  Description of Artificial Sequence: Synthetic polypeptide
DETEIRTTNPVATEQYGTVSTNLQPDGNNQG

SEQ ID NO: 39195 - protein, 32 aa, Artificial Sequence
  Description of Artificial Sequence: Synthetic polypeptide
CEEEIRTTNPVATEQYGAVSTNLQDRNGDQRD

SEQ ID NO: 39196 - protein, 32 aa, Artificial Sequence
  Description of Artificial Sequence: Synthetic polypeptide
DEEEIRTTNPVATEQYGSVNSPTLTEQRGNLT

SEQ ID NO: 39197 - protein, 32 aa, Artificial Sequence
  Description of Artificial Sequence: Synthetic polypeptide
DETEIRTTNPVATEQYGTVSTNLQRDGNNGDD

SEQ ID NO: 39198 - protein, 28 aa, Artificial Sequence
  Description of Artificial Sequence: Synthetic peptide
AENEIVTTNPVATEQYGEASTNPQRGGR

SEQ ID NO: 39199 - protein, 30 aa, Artificial Sequence
  Description of Artificial Sequence: Synthetic polypeptide
DEPEIRTTNPVATEQYGSVSTELQQQGDLE

SEQ ID NO: 39200 - protein, 29 aa, Artificial Sequence
  Description of Artificial Sequence: Synthetic peptide
DETEIRTTNPVATEQYGVVSITKLQRPTD

SEQ ID NO: 39201 - protein, 31 aa, Artificial Sequence
  Description of Artificial Sequence: Synthetic polypeptide
DEEEIRTTNPVATEQYGVVSTNDQFFGSNLA

SEQ ID NO: 39202 - protein, 30 aa, Artificial Sequence
  Description of Artificial Sequence: Synthetic polypeptide
DEPEIRTTNPVATEQYGSVSTELQQQDVLR

SEQ ID NO: 39203 - protein, 30 aa, Artificial Sequence
  Description of Artificial Sequence: Synthetic polypeptide
DEPEIRTTNPVATEQYGSVSTPVGFQRDNN

SEQ ID NO: 39204 - protein, 30 aa, Artificial Sequence
  Description of Artificial Sequence: Synthetic polypeptide
DEPEIRTTNPVATEQYGSVSQNLEFQNVNN

SEQ ID NO: 39205 - protein, 30 aa, Artificial Sequence
  Description of Artificial Sequence: Synthetic polypeptide
DEPEIRTTNPVATEQYGSVSQNLAVTNVNR

SEQ ID NO: 39206 - protein, 32 aa, Artificial Sequence
  Description of Artificial Sequence: Synthetic polypeptide
DEEEIRTTNPVATEQYGVVSTNLDQRSENQSL

SEQ ID NO: 39207 - protein, 29 aa, Artificial Sequence
  Description of Artificial Sequence: Synthetic peptide
DEPEIRTTNPVATEQYGSVSQDLFRNVNN

SEQ ID NO: 39208 - protein, 32 aa, Artificial Sequence
  Description of Artificial Sequence: Synthetic polypeptide
DEEEIRTTNPVATEQYGTVTVSTNLLQLGENE

SEQ ID NO: 39209 - protein, 31 aa, Artificial Sequence
  Description of Artificial Sequence: Synthetic polypeptide
DEPEIRTTNPVATEQYGSVSPPEHEQRFGNR

SEQ ID NO: 39210 - protein, 31 aa, Artificial Sequence
  Description of Artificial Sequence: Synthetic polypeptide
DEEEIRTTNPVATEQYGVVSTNLQNFTSNAP

SEQ ID NO: 39211 - protein, 33 aa, Artificial Sequence
  Description of Artificial Sequence: Synthetic polypeptide
DEPEIRTTNPVATEQYGSVSLTNLQRNGAEQND

SEQ ID NO: 39212 - protein, 31 aa, Artificial Sequence
  Description of Artificial Sequence: Synthetic polypeptide
DEPEIRTTNPVATEQYGSVSINLLQRQGEEV

SEQ ID NO: 39213 - protein, 30 aa, Artificial Sequence
  Description of Artificial Sequence: Synthetic polypeptide
DEEEIATTNPVAYEWWGCVSTGNLQRGNRN

SEQ ID NO: 39214 - protein, 30 aa, Artificial Sequence
  Description of Artificial Sequence: Synthetic polypeptide
DETEIRTTNPVATEQYGVVSTDLQPDGNPE

SEQ ID NO: 39215 - protein, 31 aa, Artificial Sequence
  Description of Artificial Sequence: Synthetic polypeptide
DEEEIRTTNPVATEQYGSVATNLQDNGTTDD

SEQ ID NO: 39216 - protein, 31 aa, Artificial Sequence
  Description of Artificial Sequence: Synthetic polypeptide
DEPEIRTTNPVATEQYGSVISTNTGQREGSN

SEQ ID NO: 39217 - protein, 32 aa, Artificial Sequence
  Description of Artificial Sequence: Synthetic polypeptide
DEEEIRTTNPVATEQYGVVSTNLDFRGNEEGQ

SEQ ID NO: 39218 - protein, 31 aa, Artificial Sequence
  Description of Artificial Sequence: Synthetic polypeptide
DEEEIRTTNPVATEQYGSVATNLQANGEGGT

SEQ ID NO: 39219 - protein, 32 aa, Artificial Sequence
  Description of Artificial Sequence: Synthetic polypeptide
DEPEIRTTNPVATEQYGSVSTTELQRQGDLGR

SEQ ID NO: 39220 - protein, 30 aa, Artificial Sequence
  Description of Artificial Sequence: Synthetic polypeptide
DETEIRTTNPVATEQYGTVSTNLQPDGDMQ

SEQ ID NO: 39221 - protein, 34 aa, Artificial Sequence
  Description of Artificial Sequence: Synthetic polypeptide
DETEIRTTNPVATEQYGSVSTVNLSQDRPGNGRS

SEQ ID NO: 39222 - protein, 33 aa, Artificial Sequence
  Description of Artificial Sequence: Synthetic polypeptide
DEEEIRTTNPVATEQYGSVNSSTNLQNDGDEND

SEQ ID NO: 39223 - protein, 31 aa, Artificial Sequence
  Description of Artificial Sequence: Synthetic polypeptide
DETEIRTTNPVATEQYGSVSVGNGQRNGNAD

SEQ ID NO: 39224 - protein, 30 aa, Artificial Sequence
  Description of Artificial Sequence: Synthetic polypeptide
DETEIRTTNPVATEQYGSVTSTNTQGEGTT

SEQ ID NO: 39225 - protein, 31 aa, Artificial Sequence
  Description of Artificial Sequence: Synthetic polypeptide
DEEEIGTTNPVATEQYGCVSTELQRFGSERA

SEQ ID NO: 39226 - protein, 30 aa, Artificial Sequence
  Description of Artificial Sequence: Synthetic polypeptide
DETEIRTTNPVATEQYGSVVSVLLQRPEND

SEQ ID NO: 39227 - protein, 28 aa, Artificial Sequence
  Description of Artificial Sequence: Synthetic peptide
DEQEIACTNPVATEQYGEASTNLERGER

SEQ ID NO: 39228 - protein, 30 aa, Artificial Sequence
  Description of Artificial Sequence: Synthetic polypeptide
DEEEIRTTNPVATEQYGSVATNLQADDMDN

SEQ ID NO: 39229 - protein, 33 aa, Artificial Sequence
  Description of Artificial Sequence: Synthetic polypeptide
DETEIRTTNPVATEQYGTSVSTDLQDQRGENRL

SEQ ID NO: 39230 - protein, 31 aa, Artificial Sequence
  Description of Artificial Sequence: Synthetic polypeptide
DETEIRTTNPVATEQYGTVSTNLQGDVGNNQ

SEQ ID NO: 39231 - protein, 31 aa, Artificial Sequence
  Description of Artificial Sequence: Synthetic polypeptide
CEEEIRTTNPVATEAYGSVSNTNLHRGDQRD

SEQ ID NO: 39232 - protein, 29 aa, Artificial Sequence
  Description of Artificial Sequence: Synthetic peptide
DEPEISTTNPVATWQYGMVSTTEQRGQNR

SEQ ID NO: 39233 - protein, 30 aa, Artificial Sequence
  Description of Artificial Sequence: Synthetic polypeptide
DEEEIATTNPVCTEQYGSVSDNLQDSEGNQ

SEQ ID NO: 39234 - protein, 31 aa, Artificial Sequence
  Description of Artificial Sequence: Synthetic polypeptide
DETEIRTTNPVATEQYGTVSTNLQGGGDDSR

SEQ ID NO: 39235 - protein, 29 aa, Artificial Sequence
  Description of Artificial Sequence: Synthetic peptide
DEPEISTTNPVATDQYGMVSTTEQRGNVR

SEQ ID NO: 39236 - protein, 31 aa, Artificial Sequence
  Description of Artificial Sequence: Synthetic polypeptide
DETEIRTTNPVATEQYGTVSTNLQGQGDDGR

SEQ ID NO: 39237 - protein, 32 aa, Artificial Sequence
  Description of Artificial Sequence: Synthetic polypeptide
DEEEIRTTNPVATEQYGSVNSSNVLPRTGNPI

SEQ ID NO: 39238 - protein, 30 aa, Artificial Sequence
  Description of Artificial Sequence: Synthetic polypeptide
DEPEIRTTNPVAYEIYGSVSTNGLQGNSNR

SEQ ID NO: 39239 - protein, 31 aa, Artificial Sequence
  Description of Artificial Sequence: Synthetic polypeptide
DEEEIGTTNPVATEQYGCVSTNLLQESMGNQ

SEQ ID NO: 39240 - protein, 31 aa, Artificial Sequence
  Description of Artificial Sequence: Synthetic polypeptide
DEPEIRTTNPVATEQYGYTISTNELQRGNEQ

SEQ ID NO: 39241 - protein, 32 aa, Artificial Sequence
  Description of Artificial Sequence: Synthetic polypeptide
DEEEIRTTNPVATEQYGTVCSTNHQRSGSDNQ

SEQ ID NO: 39242 - protein, 31 aa, Artificial Sequence
  Description of Artificial Sequence: Synthetic polypeptide
DEEEIRTTNPVATEQYGSVNSQTNLQDDTES

SEQ ID NO: 39243 - protein, 30 aa, Artificial Sequence
  Description of Artificial Sequence: Synthetic polypeptide
DEPEIRTTNPVATEQYGSVSYNLANNVNPR

SEQ ID NO: 39244 - protein, 31 aa, Artificial Sequence
  Description of Artificial Sequence: Synthetic polypeptide
DEPEIRTTNPVATEQYGSVSVNLQNTGDNTQ

SEQ ID NO: 39245 - protein, 30 aa, Artificial Sequence
  Description of Artificial Sequence: Synthetic polypeptide
DEPEIRTTNPVATEQYGSVSTYLNQHDNNF

SEQ ID NO: 39246 - protein, 32 aa, Artificial Sequence
  Description of Artificial Sequence: Synthetic polypeptide
DEPEIRTTNPVATEQYGSVSTVVTLQRGNEVQ

SEQ ID NO: 39247 - protein, 31 aa, Artificial Sequence
  Description of Artificial Sequence: Synthetic polypeptide
DETEIRTTNPVATEQYGTVSTNLQHDGGNGQ

SEQ ID NO: 39248 - protein, 32 aa, Artificial Sequence
  Description of Artificial Sequence: Synthetic polypeptide
DEEEIRTTNPVATEQYGVVSTNLVQGQGEGNE

SEQ ID NO: 39249 - protein, 29 aa, Artificial Sequence
  Description of Artificial Sequence: Synthetic peptide
DEQEIACTNPVATEQYGSVATNLERGERN

SEQ ID NO: 39250 - protein, 30 aa, Artificial Sequence
  Description of Artificial Sequence: Synthetic polypeptide
DEPEIRTTNPVATEQYGSVEVNLQRGDGEE

SEQ ID NO: 39251 - protein, 29 aa, Artificial Sequence
  Description of Artificial Sequence: Synthetic peptide
DEPEIRTTNPVATEQYGSISTVQQQEGLR

SEQ ID NO: 39252 - protein, 31 aa, Artificial Sequence
  Description of Artificial Sequence: Synthetic polypeptide
DEEEIATTNPVAYERYGSVSTGNLQGGGDNR

SEQ ID NO: 39253 - protein, 29 aa, Artificial Sequence
  Description of Artificial Sequence: Synthetic peptide
DEPEIRTTNPVATDQYGCVSTDNGERGND

SEQ ID NO: 39254 - protein, 30 aa, Artificial Sequence
  Description of Artificial Sequence: Synthetic polypeptide
DEPEIKTTNPVATEQYGSVSTNLMEVGSNT

SEQ ID NO: 39255 - protein, 29 aa, Artificial Sequence
  Description of Artificial Sequence: Synthetic peptide
DEAEIATTNPVATEQYGSVATNPQVGNES

SEQ ID NO: 39256 - protein, 30 aa, Artificial Sequence
  Description of Artificial Sequence: Synthetic polypeptide
DEAEIATTNPVATEQYGSVATNPQNAGNRD

SEQ ID NO: 39257 - protein, 30 aa, Artificial Sequence
  Description of Artificial Sequence: Synthetic polypeptide
DEEEIRTTNPVATEQYGSSSTNDVDAGNSS

SEQ ID NO: 39258 - protein, 29 aa, Artificial Sequence
  Description of Artificial Sequence: Synthetic peptide
DETEIRTTNPVAVEQYGSISTNMERQLNR

SEQ ID NO: 39259 - protein, 31 aa, Artificial Sequence
  Description of Artificial Sequence: Synthetic polypeptide
DEEEIRTTNPVATEQYGSVATNLQQGDLIMI

SEQ ID NO: 39260 - protein, 28 aa, Artificial Sequence
  Description of Artificial Sequence: Synthetic peptide
DEAEIATTNPVATEQYGSVATNPQADNN

SEQ ID NO: 39261 - protein, 30 aa, Artificial Sequence
  Description of Artificial Sequence: Synthetic polypeptide
DETEIRTTNPVAVEQYGSVISTNLERENNG

SEQ ID NO: 39262 - protein, 29 aa, Artificial Sequence
  Description of Artificial Sequence: Synthetic peptide
DEPEIATTNPVATWQYGEVSATTEQRGNR

SEQ ID NO: 39263 - protein, 32 aa, Artificial Sequence
  Description of Artificial Sequence: Synthetic polypeptide
DETEIRTTNPVAVEQYGSVISTNLQERGNGNG

SEQ ID NO: 39264 - protein, 31 aa, Artificial Sequence
  Description of Artificial Sequence: Synthetic polypeptide
DEEEIRTTNPVATEQYGSVNSNTTDQRMNEE

SEQ ID NO: 39265 - protein, 28 aa, Artificial Sequence
  Description of Artificial Sequence: Synthetic peptide
DEPEIATTNPVATEQYGSVSSNLMEGTT

SEQ ID NO: 39266 - protein, 30 aa, Artificial Sequence
  Description of Artificial Sequence: Synthetic polypeptide
DEPAIRTTNPVATEQYGSASTNLEIEIGNR

SEQ ID NO: 39267 - protein, 29 aa, Artificial Sequence
  Description of Artificial Sequence: Synthetic peptide
DENVIVTTNPVATEQYGMVETNEEQRGNR

SEQ ID NO: 39268 - protein, 31 aa, Artificial Sequence
  Description of Artificial Sequence: Synthetic polypeptide
DEEEIRTTNPVATEQYGSVATNLQRDSDPMD

SEQ ID NO: 39269 - protein, 28 aa, Artificial Sequence
  Description of Artificial Sequence: Synthetic peptide
DENVIRTTNPVATEQYGCVETNPQGLNR

SEQ ID NO: 39270 - protein, 31 aa, Artificial Sequence
  Description of Artificial Sequence: Synthetic polypeptide
DETEIRTTNPVAVEQYGSVISTNLQERNENQ

SEQ ID NO: 39271 - protein, 30 aa, Artificial Sequence
  Description of Artificial Sequence: Synthetic polypeptide
DENVIGTTNPVATEQWGSVSTDDLQRGNRA

SEQ ID NO: 39272 - protein, 31 aa, Artificial Sequence
  Description of Artificial Sequence: Synthetic polypeptide
CEEEIRTTNPVATEQYGCVCSTNDQRGSNFN

SEQ ID NO: 39273 - protein, 31 aa, Artificial Sequence
  Description of Artificial Sequence: Synthetic polypeptide
DETEIRTTNPVAVEQYGSVISTTNLQERNNG

SEQ ID NO: 39274 - protein, 32 aa, Artificial Sequence
  Description of Artificial Sequence: Synthetic polypeptide
DEEEIRTTNPVATEQYGVVSTQNLQEGGNFGV

SEQ ID NO: 39275 - protein, 30 aa, Artificial Sequence
  Description of Artificial Sequence: Synthetic polypeptide
DENVIGTTNPVATEQWGSVSTDALQRGSNR

SEQ ID NO: 39276 - protein, 32 aa, Artificial Sequence
  Description of Artificial Sequence: Synthetic polypeptide
DEEEIRTTNPVATEQYGVVSTQNLQTNGNFGV

SEQ ID NO: 39277 - protein, 32 aa, Artificial Sequence
  Description of Artificial Sequence: Synthetic polypeptide
DEEEIRTTNPVATEQYGVVSTSNLQESGENGG

SEQ ID NO: 39278 - protein, 32 aa, Artificial Sequence
  Description of Artificial Sequence: Synthetic polypeptide
DEEEIRTTNPVATEQYGSVATNLQRAGPEGAQ

SEQ ID NO: 39279 - protein, 29 aa, Artificial Sequence
  Description of Artificial Sequence: Synthetic peptide
DEPEIRTTNPVATDQYGDVSTNDERGNGD

SEQ ID NO: 39280 - protein, 31 aa, Artificial Sequence
  Description of Artificial Sequence: Synthetic polypeptide
DEEEIRTTNPVATEQYGSVNSPLHQRGNENP

SEQ ID NO: 39281 - protein, 31 aa, Artificial Sequence
  Description of Artificial Sequence: Synthetic polypeptide
DEEEIRTTNPVATEQYGSVNSPQGLERGNLT

SEQ ID NO: 39282 - protein, 30 aa, Artificial Sequence
  Description of Artificial Sequence: Synthetic polypeptide
DEPEIRTTNPVATEQYGSISTNQPQEGVLR

SEQ ID NO: 39283 - protein, 31 aa, Artificial Sequence
  Description of Artificial Sequence: Synthetic polypeptide
DEPEIRTTNPVATEQYGSISDTNTQTEGLNR

SEQ ID NO: 39284 - protein, 29 aa, Artificial Sequence
  Description of Artificial Sequence: Synthetic peptide
DEPEIRTTNPVATEQYGETYETNLQRGDD

SEQ ID NO: 39285 - protein, 32 aa, Artificial Sequence
  Description of Artificial Sequence: Synthetic polypeptide
DEEEIRTTNPVATEQYGVVSTNNLQGTGGNFT

SEQ ID NO: 39286 - protein, 31 aa, Artificial Sequence
  Description of Artificial Sequence: Synthetic polypeptide
DEEEIRTTNPVATEQYGVVSTNTLQGQGIDT

SEQ ID NO: 39287 - protein, 28 aa, Artificial Sequence
  Description of Artificial Sequence: Synthetic peptide
DEPEIRTTNPVATEQYGETSTNLQIQDI

SEQ ID NO: 39288 - protein, 30 aa, Artificial Sequence
  Description of Artificial Sequence: Synthetic polypeptide
DEPEIRTTNPVATEQYGETNSTNLQRGVDI

SEQ ID NO: 39289 - protein, 30 aa, Artificial Sequence
  Description of Artificial Sequence: Synthetic polypeptide
DEPEIRTTNPVATEQYGETNSTNLQRGMIG

SEQ ID NO: 39290 - protein, 32 aa, Artificial Sequence
  Description of Artificial Sequence: Synthetic polypeptide
DEEEIRTTNPVATEQYGVVSTNWLQNFGSNAN

SEQ ID NO: 39291 - protein, 29 aa, Artificial Sequence
  Description of Artificial Sequence: Synthetic peptide
DEPEIRTTNPVATEQYGENSTNLQIGDSV

SEQ ID NO: 39292 - protein, 28 aa, Artificial Sequence
  Description of Artificial Sequence: Synthetic peptide
AENEIVTTNPVATEQYGEASENLQRGGR

SEQ ID NO: 39293 - protein, 31 aa, Artificial Sequence
  Description of Artificial Sequence: Synthetic polypeptide
DEPEIRTTNPVATEQYGDTSTNLQRGVDNSV

SEQ ID NO: 39294 - protein, 31 aa, Artificial Sequence
  Description of Artificial Sequence: Synthetic polypeptide
DETEIRTTNPVATEQYGVVSTLNLQRQPEND

SEQ ID NO: 39295 - protein, 32 aa, Artificial Sequence
  Description of Artificial Sequence: Synthetic polypeptide
DEEEIRTTNPVATEQYGVVSTPNLQFGGGNTG

SEQ ID NO: 39296 - protein, 32 aa, Artificial Sequence
  Description of Artificial Sequence: Synthetic polypeptide
DEEEIRTTNPVATEQYGVVSTPNLQGSGNFGV

SEQ ID NO: 39297 - protein, 28 aa, Artificial Sequence
  Description of Artificial Sequence: Synthetic peptide
DEPEIRTTNPVATDQYGTVSTNGEGGND

SEQ ID NO: 39298 - protein, 31 aa, Artificial Sequence
  Description of Artificial Sequence: Synthetic polypeptide
DETEIRTTNPVATERYGSVSTDNTLDQRGEQ

SEQ ID NO: 39299 - protein, 28 aa, Artificial Sequence
  Description of Artificial Sequence: Synthetic peptide
DEPEIRTTNPVATDQYGSVNTQQVRGND

SEQ ID NO: 39300 - protein, 30 aa, Artificial Sequence
  Description of Artificial Sequence: Synthetic polypeptide
DETEIRTTNPVATTAYGSVSTNGLQRTNMQ

SEQ ID NO: 39301 - protein, 32 aa, Artificial Sequence
  Description of Artificial Sequence: Synthetic polypeptide
DEEEIRTTNPVATEQYGVVSTPNLQQGEFNNQ

SEQ ID NO: 39302 - protein, 28 aa, Artificial Sequence
  Description of Artificial Sequence: Synthetic peptide
DEPEIRTTNPVATDQYGSVNTQDQRGGD

SEQ ID NO: 39303 - protein, 32 aa, Artificial Sequence
  Description of Artificial Sequence: Synthetic polypeptide
DEEEIRTTNPVATEQYGVVSTPNLQVNGGNIV

SEQ ID NO: 39304 - protein, 32 aa, Artificial Sequence
  Description of Artificial Sequence: Synthetic polypeptide
DEEEIRTTNPVATEQYGVVSTPNLVDQGGNGD

SEQ ID NO: 39305 - protein, 31 aa, Artificial Sequence
  Description of Artificial Sequence: Synthetic polypeptide
DEEEIRTTNPVATEQYGSVATNLQHGEEGID

SEQ ID NO: 39306 - protein, 30 aa, Artificial Sequence
  Description of Artificial Sequence: Synthetic polypeptide
DEPEIRTTNPVATDQYGDVSTNGLERTGND

SEQ ID NO: 39307 - protein, 29 aa, Artificial Sequence
  Description of Artificial Sequence: Synthetic peptide
DETEIRTTNPVATTPYGSVSTNLQVVNPM

SEQ ID NO: 39308 - protein, 31 aa, Artificial Sequence
  Description of Artificial Sequence: Synthetic polypeptide
DEEEIRTTNPVATEQYGSVATNLQHPGETPH

SEQ ID NO: 39309 - protein, 31 aa, Artificial Sequence
  Description of Artificial Sequence: Synthetic polypeptide
CEEEIRTTNPVATEQYGCVCSNTNLQRGSDV

SEQ ID NO: 39310 - protein, 32 aa, Artificial Sequence
  Description of Artificial Sequence: Synthetic polypeptide
DEEEIRTTNPVATEQYGSVNSTNDDDRGNEGS

SEQ ID NO: 39311 - protein, 31 aa, Artificial Sequence
  Description of Artificial Sequence: Synthetic polypeptide
DETEIRTTNPVATEQYGSVSTTSNPQNGNPP

SEQ ID NO: 39312 - protein, 29 aa, Artificial Sequence
  Description of Artificial Sequence: Synthetic peptide
DEEEIATTNPVCTETYGSVSVPNLQDGND

SEQ ID NO: 39313 - protein, 28 aa, Artificial Sequence
  Description of Artificial Sequence: Synthetic peptide
DEEEIASVNPVCTEQYGVVSCNLQRGNQ

SEQ ID NO: 39314 - protein, 31 aa, Artificial Sequence
  Description of Artificial Sequence: Synthetic polypeptide
DEQEIATTNPVATEQYGSVSTNLQHNGGDNE

SEQ ID NO: 39315 - protein, 30 aa, Artificial Sequence
  Description of Artificial Sequence: Synthetic polypeptide
DEQEIATTNPVATEQYGSVSTNLQHEGEDL

SEQ ID NO: 39316 - protein, 29 aa, Artificial Sequence
  Description of Artificial Sequence: Synthetic peptide
AEQEIATTNPVATEQYGSVATNLQQGNDE

SEQ ID NO: 39317 - protein, 33 aa, Artificial Sequence
  Description of Artificial Sequence: Synthetic polypeptide
DEEEIRTTNPVATEQYGSVNSTGNLQQTGGNGE

SEQ ID NO: 39318 - protein, 30 aa, Artificial Sequence
  Description of Artificial Sequence: Synthetic polypeptide
DEEEIRTTNPVATEQYGSVATNDERNNPPT

SEQ ID NO: 39319 - protein, 33 aa, Artificial Sequence
  Description of Artificial Sequence: Synthetic polypeptide
DEEEIRTTNPVATEQYGSVNSTGNLQQTFGVNE

SEQ ID NO: 39320 - protein, 31 aa, Artificial Sequence
  Description of Artificial Sequence: Synthetic polypeptide
DEQEIATTNPVATEQYGSVSTNLQGNDSGNN

SEQ ID NO: 39321 - protein, 31 aa, Artificial Sequence
  Description of Artificial Sequence: Synthetic polypeptide
DEQEIATTNPVATEQYGSVSTNLQGNDNGNS

SEQ ID NO: 39322 - protein, 30 aa, Artificial Sequence
  Description of Artificial Sequence: Synthetic polypeptide
DEEEIRTTNPVATEQYGSVATNDERNPNPV

SEQ ID NO: 39323 - protein, 31 aa, Artificial Sequence
  Description of Artificial Sequence: Synthetic polypeptide
DEQEIATTNPVATEQYGSVSTNLQGEDQENR

SEQ ID NO: 39324 - protein, 32 aa, Artificial Sequence
  Description of Artificial Sequence: Synthetic polypeptide
DEQEIATTNPVATEQYGSVSTNLQGDGDNQRA

SEQ ID NO: 39325 - protein, 31 aa, Artificial Sequence
  Description of Artificial Sequence: Synthetic polypeptide
DEQEIATTNPVATEQYGSVSTNLQNDSNGNS

SEQ ID NO: 39326 - protein, 33 aa, Artificial Sequence
  Description of Artificial Sequence: Synthetic polypeptide
DEEEIRTTNPVATEQYGSVNSTGNLQMNGGGND

SEQ ID NO: 39327 - protein, 31 aa, Artificial Sequence
  Description of Artificial Sequence: Synthetic polypeptide
DEQEIATTNPVATEQYGSVSTNLQGDAGNGE

SEQ ID NO: 39328 - protein, 29 aa, Artificial Sequence
  Description of Artificial Sequence: Synthetic peptide
DEEEIRTTNPVATEQYGSVATNDERTPDD

SEQ ID NO: 39329 - protein, 30 aa, Artificial Sequence
  Description of Artificial Sequence: Synthetic polypeptide
DETEIRTTNPVATEQYGSTSTNLTQGEGTE

SEQ ID NO: 39330 - protein, 30 aa, Artificial Sequence
  Description of Artificial Sequence: Synthetic polypeptide
DETEIRTTNPVATEQYGSTSTNLTQNEGED

SEQ ID NO: 39331 - protein, 31 aa, Artificial Sequence
  Description of Artificial Sequence: Synthetic polypeptide
DEQEIATTNPVATEQYGSVSTNLNMGGDNNR

SEQ ID NO: 39332 - protein, 31 aa, Artificial Sequence
  Description of Artificial Sequence: Synthetic polypeptide
DEQEIATTNPVATEQYGSVSTNLEDREGNDL

SEQ ID NO: 39333 - protein, 29 aa, Artificial Sequence
  Description of Artificial Sequence: Synthetic peptide
DEQEIATTNPVATEQYGSVSTNLEDHGEL

SEQ ID NO: 39334 - protein, 29 aa, Artificial Sequence
  Description of Artificial Sequence: Synthetic peptide
DEEEIATVNPVCTEQYGVVSDNLPQRGNQ

SEQ ID NO: 39335 - protein, 29 aa, Artificial Sequence
  Description of Artificial Sequence: Synthetic peptide
DETEIRTTNPVATEQYGSTSTNQQGEGTQ

SEQ ID NO: 39336 - protein, 29 aa, Artificial Sequence
  Description of Artificial Sequence: Synthetic peptide
DETEIRTTNPVATEQYGSTSTNTQEEGGS

SEQ ID NO: 39337 - protein, 28 aa, Artificial Sequence
  Description of Artificial Sequence: Synthetic peptide
DEEEIASVNPVCTEQYGVVSDNLQRGNQ

SEQ ID NO: 39338 - protein, 29 aa, Artificial Sequence
  Description of Artificial Sequence: Synthetic peptide
DETEIRTTNPVATEQYGSTSTNTQQEGIL

SEQ ID NO: 39339 - protein, 33 aa, Artificial Sequence
  Description of Artificial Sequence: Synthetic polypeptide
DEEEIRTTNPVATEQYGSTASCIPNMLQRVGNR

SEQ ID NO: 39340 - protein, 31 aa, Artificial Sequence
  Description of Artificial Sequence: Synthetic polypeptide
DEEEIRTTNPVATEQYGSVNSTLDDQRGQEQ

SEQ ID NO: 39341 - protein, 32 aa, Artificial Sequence
  Description of Artificial Sequence: Synthetic polypeptide
DETEIRTTNPVATEQYGMQVGSTVNDQRGNIR

SEQ ID NO: 39342 - protein, 31 aa, Artificial Sequence
  Description of Artificial Sequence: Synthetic polypeptide
DEQEIATTNPVATEQYGSVSTNLQNGSGDNS

SEQ ID NO: 39343 - protein, 30 aa, Artificial Sequence
  Description of Artificial Sequence: Synthetic polypeptide
DEAEIATTNPVATEQYGSVCTNLQAQGNNH

SEQ ID NO: 39344 - protein, 33 aa, Artificial Sequence
  Description of Artificial Sequence: Synthetic polypeptide
DEEEIRTTNPVATEQYGSTMPTENLVQRIGNQR

SEQ ID NO: 39345 - protein, 30 aa, Artificial Sequence
  Description of Artificial Sequence: Synthetic polypeptide
DETEIRTTNPVATECYGTVSTNLQPDGNHQ

SEQ ID NO: 39346 - protein, 31 aa, Artificial Sequence
  Description of Artificial Sequence: Synthetic polypeptide
DEEEIRTTNPVATEQYGVVSTEHQRMGSNQA

SEQ ID NO: 39347 - protein, 30 aa, Artificial Sequence
  Description of Artificial Sequence: Synthetic polypeptide
DEEEICTTNPAATEQYGSVPTNLQHSGNVG

SEQ ID NO: 39348 - protein, 34 aa, Artificial Sequence
  Description of Artificial Sequence: Synthetic polypeptide
DEEEIRTTNPVATEQYGSTISCTGNLSQRGGNRD

SEQ ID NO: 39349 - protein, 30 aa, Artificial Sequence
  Description of Artificial Sequence: Synthetic polypeptide
DEEEIRTTNPVATEQYGSVNTELQLEGEMD

SEQ ID NO: 39350 - protein, 30 aa, Artificial Sequence
  Description of Artificial Sequence: Synthetic polypeptide
DEEEIRTTNPVATEQYGVVSTELQGNSNNI

SEQ ID NO: 39351 - protein, 30 aa, Artificial Sequence
  Description of Artificial Sequence: Synthetic polypeptide
DEAEIATTNPVAYEQYGSVAATNLQRGNLE

SEQ ID NO: 39352 - protein, 28 aa, Artificial Sequence
  Description of Artificial Sequence: Synthetic peptide
DETEIRTTNPVATEQYGAVQTGLIRMNT

SEQ ID NO: 39353 - protein, 31 aa, Artificial Sequence
  Description of Artificial Sequence: Synthetic polypeptide
DEEEIACTNPVATEQYGSVSTNSLSQVRGEF

SEQ ID NO: 39354 - protein, 32 aa, Artificial Sequence
  Description of Artificial Sequence: Synthetic polypeptide
DEEEIRTTNPVATEQYGVVSTENLQGSGNGET

SEQ ID NO: 39355 - protein, 31 aa, Artificial Sequence
  Description of Artificial Sequence: Synthetic polypeptide
CEEEIATTNPVATEQYGSVCATNLQDRGNEN

SEQ ID NO: 39356 - protein, 30 aa, Artificial Sequence
  Description of Artificial Sequence: Synthetic polypeptide
DEEEICTTNPAATEQYGSVDTNLQHIGNGD

SEQ ID NO: 39357 - protein, 28 aa, Artificial Sequence
  Description of Artificial Sequence: Synthetic peptide
AEQEIATTNPVAYEPYGSVATNLQRGNL

SEQ ID NO: 39358 - protein, 32 aa, Artificial Sequence
  Description of Artificial Sequence: Synthetic polypeptide
DEEEIRTTNPVATEQYGVVSTENLQRFMSNDF

SEQ ID NO: 39359 - protein, 28 aa, Artificial Sequence
  Description of Artificial Sequence: Synthetic peptide
DEQEIATTNPVAYEPYGSVATNLQRGQD

SEQ ID NO: 39360 - protein, 31 aa, Artificial Sequence
  Description of Artificial Sequence: Synthetic polypeptide
DEEEIRTTNPVATEQYGVVSTEPQRFGSERS

SEQ ID NO: 39361 - protein, 29 aa, Artificial Sequence
  Description of Artificial Sequence: Synthetic peptide
AEQEIATTNPVATEQYGSVSTNLQHGGDL

SEQ ID NO: 39362 - protein, 29 aa, Artificial Sequence
  Description of Artificial Sequence: Synthetic peptide
AEQEIATTNPVATEQYGSVSENLQRGGDL

SEQ ID NO: 39363 - protein, 30 aa, Artificial Sequence
  Description of Artificial Sequence: Synthetic polypeptide
DEQEIATTNPVATETYGSVSTNLQNGNNDQ

SEQ ID NO: 39364 - protein, 31 aa, Artificial Sequence
  Description of Artificial Sequence: Synthetic polypeptide
DEEEIRTTNPVATEQYGVVSTGNHQGGSNQG

SEQ ID NO: 39365 - protein, 30 aa, Artificial Sequence
  Description of Artificial Sequence: Synthetic polypeptide
DEQEIATTNPVATERYGSVSTNDQRGNDME

SEQ ID NO: 39366 - protein, 31 aa, Artificial Sequence
  Description of Artificial Sequence: Synthetic polypeptide
DEEEICCTNPVATEQYGTVSTNGLQRGSNDN

SEQ ID NO: 39367 - protein, 29 aa, Artificial Sequence
  Description of Artificial Sequence: Synthetic peptide
CEEEIATTNPVATEQYGSVSAPHDQRGER

SEQ ID NO: 39368 - protein, 32 aa, Artificial Sequence
  Description of Artificial Sequence: Synthetic polypeptide
CEEEIATTNPVATEQYGSVSTGNLGQHGENDR

SEQ ID NO: 39369 - protein, 32 aa, Artificial Sequence
  Description of Artificial Sequence: Synthetic polypeptide
DEEEIRTTNPVATEQYGSVNSTLNQQEFGGNG

SEQ ID NO: 39370 - protein, 29 aa, Artificial Sequence
  Description of Artificial Sequence: Synthetic peptide
DETEIRTTNPVATEQYGSTSTNTQSEGEE

SEQ ID NO: 39371 - protein, 32 aa, Artificial Sequence
  Description of Artificial Sequence: Synthetic polypeptide
DETEIRTTNPVATEQYGSVSTTGNGQDGNNDR

SEQ ID NO: 39372 - protein, 32 aa, Artificial Sequence
  Description of Artificial Sequence: Synthetic polypeptide
DEEEIRTTNPVATEQYGVVSTMNLDQQEGENQ

SEQ ID NO: 39373 - protein, 30 aa, Artificial Sequence
  Description of Artificial Sequence: Synthetic polypeptide
DEEEIRTTNPVATEQYGSVATNDQANPENH

SEQ ID NO: 39374 - protein, 28 aa, Artificial Sequence
  Description of Artificial Sequence: Synthetic peptide
DEEEIATTNPVSTEQYGSVTFNLQDGQT

SEQ ID NO: 39375 - protein, 29 aa, Artificial Sequence
  Description of Artificial Sequence: Synthetic peptide
DEQEIATTNPVATEQWGSVSQNLQDQGDR

SEQ ID NO: 39376 - protein, 31 aa, Artificial Sequence
  Description of Artificial Sequence: Synthetic polypeptide
DETEIRTTNPVATEQYGSVSPTVEQRPENRS

SEQ ID NO: 39377 - protein, 32 aa, Artificial Sequence
  Description of Artificial Sequence: Synthetic polypeptide
CEEEIRATNPVATEQYGSVATSNLEQRGDNDR

SEQ ID NO: 39378 - protein, 29 aa, Artificial Sequence
  Description of Artificial Sequence: Synthetic peptide
DEQEIATTNPVATEQWGSVATNLERGDND

SEQ ID NO: 39379 - protein, 30 aa, Artificial Sequence
  Description of Artificial Sequence: Synthetic polypeptide
DEQEIATTNPVATEPYGSVAATNLQDQGNR

SEQ ID NO: 39380 - protein, 31 aa, Artificial Sequence
  Description of Artificial Sequence: Synthetic polypeptide
DEQEIATTNPVATEHYGSVSTNLQRGENGEQ

SEQ ID NO: 39381 - protein, 29 aa, Artificial Sequence
  Description of Artificial Sequence: Synthetic peptide
DETEIRTTNPVATEQYGSVSQNLGNNMNE

SEQ ID NO: 39382 - protein, 28 aa, Artificial Sequence
  Description of Artificial Sequence: Synthetic peptide
CEEEIRCTNPIATEQWGSVSENLMRGGR

SEQ ID NO: 39383 - protein, 32 aa, Artificial Sequence
  Description of Artificial Sequence: Synthetic polypeptide
DETEIRTTNPVATEQYGSVSTNLQGNDGQNQQ

SEQ ID NO: 39384 - protein, 29 aa, Artificial Sequence
  Description of Artificial Sequence: Synthetic peptide
CEEEIRCTNPIATEQYGSVSENLMRGDLR

SEQ ID NO: 39385 - protein, 30 aa, Artificial Sequence
  Description of Artificial Sequence: Synthetic polypeptide
DEQEIATTNPVATEHYGSVSTNLQGGENDQ

SEQ ID NO: 39386 - protein, 29 aa, Artificial Sequence
  Description of Artificial Sequence: Synthetic peptide
DEQEIATTNPVATEQYGCVATNLQQGNDQ

SEQ ID NO: 39387 - protein, 30 aa, Artificial Sequence
  Description of Artificial Sequence: Synthetic polypeptide
DEQEIATTNPVATECYGSVSTNLQRGEDDQ

SEQ ID NO: 39388 - protein, 32 aa, Artificial Sequence
  Description of Artificial Sequence: Synthetic polypeptide
DEEEIRTTNPVATEQYGSVATNLERPGDNPDM

SEQ ID NO: 39389 - protein, 32 aa, Artificial Sequence
  Description of Artificial Sequence: Synthetic polypeptide
DEEEIRTTNPVATEQYGSVATNLERPGENTNH

SEQ ID NO: 39390 - protein, 30 aa, Artificial Sequence
  Description of Artificial Sequence: Synthetic polypeptide
DEQEIATTNPIATEQYGSVSATDLMDRGNR

SEQ ID NO: 39391 - protein, 32 aa, Artificial Sequence
  Description of Artificial Sequence: Synthetic polypeptide
DEEEIRTTNPVATEQYGSVATNLERPGPNPEQ

SEQ ID NO: 39392 - protein, 32 aa, Artificial Sequence
  Description of Artificial Sequence: Synthetic polypeptide
DEEEIRTTNPVATEQYGSVNSTANQQEFGNGE

SEQ ID NO: 39393 - protein, 32 aa, Artificial Sequence
  Description of Artificial Sequence: Synthetic polypeptide
DETEIRTTNPVATEQYGSVSTNLQPNGDNGHQ

SEQ ID NO: 39394 - protein, 30 aa, Artificial Sequence
  Description of Artificial Sequence: Synthetic polypeptide
DEEEIRTTNPVATEQYGSVATNLETDENET

SEQ ID NO: 39395 - protein, 33 aa, Artificial Sequence
  Description of Artificial Sequence: Synthetic polypeptide
DETEIRTTNPVATEQYGSVSTPNLEQRMGANEF

SEQ ID NO: 39396 - protein, 32 aa, Artificial Sequence
  Description of Artificial Sequence: Synthetic polypeptide
DEEEIRTTNPVATEQYGTVCSTNHQRSNSNRT

SEQ ID NO: 39397 - protein, 30 aa, Artificial Sequence
  Description of Artificial Sequence: Synthetic polypeptide
CEEEIRTTNPCATEQYGSVSWYELQRFGNI

SEQ ID NO: 39398 - protein, 28 aa, Artificial Sequence
  Description of Artificial Sequence: Synthetic peptide
DEQEIAPTNPVSSEQYGSVSTNLQSGER

SEQ ID NO: 39399 - protein, 29 aa, Artificial Sequence
  Description of Artificial Sequence: Synthetic peptide
DEQEIACTNPVATEQYGSVSEDLMRGNDR

SEQ ID NO: 39400 - protein, 32 aa, Artificial Sequence
  Description of Artificial Sequence: Synthetic polypeptide
DEEEIRTTNPVATEQYGTVCSTNLQFFGSNLQ

SEQ ID NO: 39401 - protein, 29 aa, Artificial Sequence
  Description of Artificial Sequence: Synthetic peptide
DETEIRTTNPVATEQYGSVSNNLFNNMNN

SEQ ID NO: 39402 - protein, 31 aa, Artificial Sequence
  Description of Artificial Sequence: Synthetic polypeptide
DEQEIATTNPVATEQYGEVSATNLQDRGEDR

SEQ ID NO: 39403 - protein, 32 aa, Artificial Sequence
  Description of Artificial Sequence: Synthetic polypeptide
CEEEIGTTNPVATEQYGSVNSTNQLQERMGNL

SEQ ID NO: 39404 - protein, 29 aa, Artificial Sequence
  Description of Artificial Sequence: Synthetic peptide
DEQEIATTNPVATEQYGSVSEDLQRGEDL

SEQ ID NO: 39405 - protein, 28 aa, Artificial Sequence
  Description of Artificial Sequence: Synthetic peptide
DEQEIATTNPVATEQYGSVSEDLQHGEL

SEQ ID NO: 39406 - protein, 31 aa, Artificial Sequence
  Description of Artificial Sequence: Synthetic polypeptide
DEEEIRTTNPVATEQYGSVNSTELELGDMER

SEQ ID NO: 39407 - protein, 29 aa, Artificial Sequence
  Description of Artificial Sequence: Synthetic peptide
DEEEIATVNPVATEQYGVVSATDLQSGNQ

SEQ ID NO: 39408 - protein, 31 aa, Artificial Sequence
  Description of Artificial Sequence: Synthetic polypeptide
DEEEIGTTNPVATEQYGCVCSTNLQHNSNRL

SEQ ID NO: 39409 - protein, 32 aa, Artificial Sequence
  Description of Artificial Sequence: Synthetic polypeptide
DEEEIGTTNPVATEQYGCVCSTNLQRNSNPRP

SEQ ID NO: 39410 - protein, 32 aa, Artificial Sequence
  Description of Artificial Sequence: Synthetic polypeptide
DEEEIRTTNPVATEQYGVVSTMNLGQEGGGNT

SEQ ID NO: 39411 - protein, 31 aa, Artificial Sequence
  Description of Artificial Sequence: Synthetic polypeptide
DEEEIRTTNPVATEQYGSVATNGLTNPGENH

SEQ ID NO: 39412 - protein, 30 aa, Artificial Sequence
  Description of Artificial Sequence: Synthetic polypeptide
DEEEIATVNPVATEQYGSVSSTDAGQRGNV

SEQ ID NO: 39413 - protein, 32 aa, Artificial Sequence
  Description of Artificial Sequence: Synthetic polypeptide
DEEEIRTTNPVATEQYGVVSTMNLNQVQGNND

SEQ ID NO: 39414 - protein, 32 aa, Artificial Sequence
  Description of Artificial Sequence: Synthetic polypeptide
DEEEIRTTNPVATEQYGVVSTMNLQNVNGGNV

SEQ ID NO: 39415 - protein, 33 aa, Artificial Sequence
  Description of Artificial Sequence: Synthetic polypeptide
DEEEIRTTNPVATEQYGSVATNLDQRIGEEERS

SEQ ID NO: 39416 - protein, 30 aa, Artificial Sequence
  Description of Artificial Sequence: Synthetic polypeptide
DEEEIRTTNPVATEQYGSVATNLDRTETGV

SEQ ID NO: 39417 - protein, 31 aa, Artificial Sequence
  Description of Artificial Sequence: Synthetic polypeptide
DEEEIRTTNPVATEQYGSVATNLEDGDNNVI

SEQ ID NO: 39418 - protein, 32 aa, Artificial Sequence
  Description of Artificial Sequence: Synthetic polypeptide
DEEEIRTTNPVATEQYGSVATNLEDPGENDRN

SEQ ID NO: 39419 - protein, 30 aa, Artificial Sequence
  Description of Artificial Sequence: Synthetic polypeptide
DEQEIATTNPVATEQYGSVATNLQSGDNDP

SEQ ID NO: 39420 - protein, 29 aa, Artificial Sequence
  Description of Artificial Sequence: Synthetic peptide
DETEIRTTNPVATEQYGSVQTGLIRENET

SEQ ID NO: 39421 - protein, 29 aa, Artificial Sequence
  Description of Artificial Sequence: Synthetic peptide
DEQEIATTNPVATEQYGSVATNLQQGDEQ

SEQ ID NO: 39422 - protein, 30 aa, Artificial Sequence
  Description of Artificial Sequence: Synthetic polypeptide
DEQEIATTNPVATEQYGSVATNLQQDGNDD

SEQ ID NO: 39423 - protein, 30 aa, Artificial Sequence
  Description of Artificial Sequence: Synthetic polypeptide
DEQEIATTNPVATEQYGSVATNLQEAGNEN

SEQ ID NO: 39424 - protein, 30 aa, Artificial Sequence
  Description of Artificial Sequence: Synthetic polypeptide
DETEIRTTNPVATEQYGSVQTGLIRGMNTE

SEQ ID NO: 39425 - protein, 31 aa, Artificial Sequence
  Description of Artificial Sequence: Synthetic polypeptide
DEEEIRTTNPVATEQYGVVSTMNLVDQGNDD

SEQ ID NO: 39426 - protein, 29 aa, Artificial Sequence
  Description of Artificial Sequence: Synthetic peptide
DETEIRTTNPVATEQYGSVQTGLIRMNDN

SEQ ID NO: 39427 - protein, 32 aa, Artificial Sequence
  Description of Artificial Sequence: Synthetic polypeptide
DETEIRTTNPVATEQYGSVSAENLQRGVNISE

SEQ ID NO: 39428 - protein, 31 aa, Artificial Sequence
  Description of Artificial Sequence: Synthetic polypeptide
DETEIRTTNPVATEQYGSVSCTNGGQREGKD

SEQ ID NO: 39429 - protein, 32 aa, Artificial Sequence
  Description of Artificial Sequence: Synthetic polypeptide
DEQEIATTNPVATEQYGSVASATNLQERGNDD

SEQ ID NO: 39430 - protein, 31 aa, Artificial Sequence
  Description of Artificial Sequence: Synthetic polypeptide
DEEEIRTTNPVATEQYGSVATNLERDENDNH

SEQ ID NO: 39431 - protein, 31 aa, Artificial Sequence
  Description of Artificial Sequence: Synthetic polypeptide
DETEIRTTNPVATEQYGSTVSCNLQRPGGVE

SEQ ID NO: 39432 - protein, 29 aa, Artificial Sequence
  Description of Artificial Sequence: Synthetic peptide
DESEIATTNPVATDHYGSVSTNLQRDDNM

SEQ ID NO: 39433 - protein, 32 aa, Artificial Sequence
  Description of Artificial Sequence: Synthetic polypeptide
DETEIATTNPVATEQYGSVSTNLQGNDNGNTR

SEQ ID NO: 39434 - protein, 31 aa, Artificial Sequence
  Description of Artificial Sequence: Synthetic polypeptide
DEAEIATTNPVATEQYGSVSTNLQREENTHE

SEQ ID NO: 39435 - protein, 35 aa, Artificial Sequence
  Description of Artificial Sequence: Synthetic polypeptide
DEEEIRTTNPVATEQYGSTVPSCTQNLSQRGGNVR

SEQ ID NO: 39436 - protein, 34 aa, Artificial Sequence
  Description of Artificial Sequence: Synthetic polypeptide
DEEEIRTTNPVATEQYGSTVPSCTNLSQETGNRA

SEQ ID NO: 39437 - protein, 30 aa, Artificial Sequence
  Description of Artificial Sequence: Synthetic polypeptide
DESEIRTTNPVATEQYGSVQSQNLFNNMNR

SEQ ID NO: 39438 - protein, 32 aa, Artificial Sequence
  Description of Artificial Sequence: Synthetic polypeptide
DEEEICTTNPVATEQYGSVSTNLQNGGGNDGS

SEQ ID NO: 39439 - protein, 33 aa, Artificial Sequence
  Description of Artificial Sequence: Synthetic polypeptide
DESEIRTTNPVATEQYGSVNNTNLQERFGDNFR

SEQ ID NO: 39440 - protein, 31 aa, Artificial Sequence
  Description of Artificial Sequence: Synthetic polypeptide
DESEIRTTNPVATEQYGSVITNDLQGGNVDQ

SEQ ID NO: 39441 - protein, 31 aa, Artificial Sequence
  Description of Artificial Sequence: Synthetic polypeptide
DEEEIRTTNPVATEQYGVVCSTELNQHGSNQ

SEQ ID NO: 39442 - protein, 31 aa, Artificial Sequence
  Description of Artificial Sequence: Synthetic polypeptide
DESEIRTTNPVATEQYGSVISTNTGQREGLG

SEQ ID NO: 39443 - protein, 32 aa, Artificial Sequence
  Description of Artificial Sequence: Synthetic polypeptide
DEEEIRTTNPVATEQYGTVSTTVNLDQDEGNE

SEQ ID NO: 39444 - protein, 31 aa, Artificial Sequence
  Description of Artificial Sequence: Synthetic polypeptide
DESEIRTTNPVATEQYGSVCSTPLQRGSEQP

SEQ ID NO: 39445 - protein, 33 aa, Artificial Sequence
  Description of Artificial Sequence: Synthetic polypeptide
DESEIRTTNPVATEQYGSVCSTGNLQHFGSNRP

SEQ ID NO: 39446 - protein, 32 aa, Artificial Sequence
  Description of Artificial Sequence: Synthetic polypeptide
DEEEIRTTNPVATEQYGSVNSTSLEQRDDDRQ

SEQ ID NO: 39447 - protein, 31 aa, Artificial Sequence
  Description of Artificial Sequence: Synthetic polypeptide
DESEIRTTNPVATEQYGSVSAEDLQRGDGRQ

SEQ ID NO: 39448 - protein, 32 aa, Artificial Sequence
  Description of Artificial Sequence: Synthetic polypeptide
DESEIRTTNPVATEQYGSVCSTDNMERFGDNR

SEQ ID NO: 39449 - protein, 30 aa, Artificial Sequence
  Description of Artificial Sequence: Synthetic polypeptide
DEEEICTTNPVAYEQYGKVSCTNLQAGGNE

SEQ ID NO: 39450 - protein, 32 aa, Artificial Sequence
  Description of Artificial Sequence: Synthetic polypeptide
DEEEIRTTNPVATEQYGTVSTTNLQGFGGNTG

SEQ ID NO: 39451 - protein, 32 aa, Artificial Sequence
  Description of Artificial Sequence: Synthetic polypeptide
DEEEIRTTNPVATEQYGTVSTTNLQFGEIGNG

SEQ ID NO: 39452 - protein, 32 aa, Artificial Sequence
  Description of Artificial Sequence: Synthetic polypeptide
DEEEIRTTNPVATEQYGVVCSTELQEGNSNRL

SEQ ID NO: 39453 - protein, 29 aa, Artificial Sequence
  Description of Artificial Sequence: Synthetic peptide
DESSIRTTNPCATEQFGSVSENLQHSGNR

SEQ ID NO: 39454 - protein, 30 aa, Artificial Sequence
  Description of Artificial Sequence: Synthetic polypeptide
DESEIRTTNPVATEQYGSVATNLERANMSM

SEQ ID NO: 39455 - protein, 29 aa, Artificial Sequence
  Description of Artificial Sequence: Synthetic peptide
DESEIRTTNPVATEQYGSVATEGQLVGNT

SEQ ID NO: 39456 - protein, 32 aa, Artificial Sequence
  Description of Artificial Sequence: Synthetic polypeptide
DEEEICTTNPVATEQYGSVSTNLQGNGGDNGD

SEQ ID NO: 39457 - protein, 31 aa, Artificial Sequence
  Description of Artificial Sequence: Synthetic polypeptide
DESEIRTTNPVATEQYGSVASTNIQRGDSQG

SEQ ID NO: 39458 - protein, 32 aa, Artificial Sequence
  Description of Artificial Sequence: Synthetic polypeptide
DEEEICTTNPVATEQYGSVSTNLQGNDGQNES

SEQ ID NO: 39459 - protein, 32 aa, Artificial Sequence
  Description of Artificial Sequence: Synthetic polypeptide
DEEEICTTNPVATEQYGSVSTNLQGNDGNGEN

SEQ ID NO: 39460 - protein, 32 aa, Artificial Sequence
  Description of Artificial Sequence: Synthetic polypeptide
DEEEICTTNPVATEQYGSVSTNLQGNDGGNTN

SEQ ID NO: 39461 - protein, 31 aa, Artificial Sequence
  Description of Artificial Sequence: Synthetic polypeptide
DESEIRTTNPVATEQYGSVCSLNLQENGERI

SEQ ID NO: 39462 - protein, 33 aa, Artificial Sequence
  Description of Artificial Sequence: Synthetic polypeptide
DEEEIRTTNPVATEQYGSTVPSTNAHQNSGGNR

SEQ ID NO: 39463 - protein, 32 aa, Artificial Sequence
  Description of Artificial Sequence: Synthetic polypeptide
DESEIRTTNPVATEQYGSVSATNLQPVDDNPR

SEQ ID NO: 39464 - protein, 30 aa, Artificial Sequence
  Description of Artificial Sequence: Synthetic polypeptide
DEEEIRTTNPVATEQYGVVCSTEHQGNSVR

SEQ ID NO: 39465 - protein, 32 aa, Artificial Sequence
  Description of Artificial Sequence: Synthetic polypeptide
DESEIRTTNPVATEQYGSVSTNWILQQFDNDR

SEQ ID NO: 39466 - protein, 32 aa, Artificial Sequence
  Description of Artificial Sequence: Synthetic polypeptide
DESEIRTTNPVATEQYGSVSTNNNLQGDGNDL

SEQ ID NO: 39467 - protein, 34 aa, Artificial Sequence
  Description of Artificial Sequence: Synthetic polypeptide
DEEEIRTTNPVATEQYGVTVSCTNMLSQERGGNR

SEQ ID NO: 39468 - protein, 31 aa, Artificial Sequence
  Description of Artificial Sequence: Synthetic polypeptide
DEEEICTTNPVATEQYGSVSTNQLGEDMGNL

SEQ ID NO: 39469 - protein, 32 aa, Artificial Sequence
  Description of Artificial Sequence: Synthetic polypeptide
DESEIRTTNPVATEQYGSVSTNLQGDAGNGGD

SEQ ID NO: 39470 - protein, 29 aa, Artificial Sequence
  Description of Artificial Sequence: Synthetic peptide
DESEISATTNPVAYEPYGSVATNLQRGND

SEQ ID NO: 39471 - protein, 32 aa, Artificial Sequence
  Description of Artificial Sequence: Synthetic polypeptide
DEEEICTTNPVATEQYGSVSTNQLAERMGNLD

SEQ ID NO: 39472 - protein, 31 aa, Artificial Sequence
  Description of Artificial Sequence: Synthetic polypeptide
DESEISTTNPVATEQYGSVCSTNLTQERQNA

SEQ ID NO: 39473 - protein, 30 aa, Artificial Sequence
  Description of Artificial Sequence: Synthetic polypeptide
DESEIRTTNPVATEQYGSVSTNLENNENQY

SEQ ID NO: 39474 - protein, 31 aa, Artificial Sequence
  Description of Artificial Sequence: Synthetic polypeptide
DESEIYTTNPVATEQYGSVSTNNQFGSNPRY

SEQ ID NO: 39475 - protein, 32 aa, Artificial Sequence
  Description of Artificial Sequence: Synthetic polypeptide
DEEEIRTTNPVATEQYGVVCSLTEHQRSGSNR

SEQ ID NO: 39476 - protein, 31 aa, Artificial Sequence
  Description of Artificial Sequence: Synthetic polypeptide
CEAEIRTTNPVATEQYGCVCSTNLQRNSNRD

SEQ ID NO: 39477 - protein, 32 aa, Artificial Sequence
  Description of Artificial Sequence: Synthetic polypeptide
DESEIRTTNPVATEQYGSVSTINQQVSGNQRN

SEQ ID NO: 39478 - protein, 32 aa, Artificial Sequence
  Description of Artificial Sequence: Synthetic polypeptide
DESEIRTTNPVATEQYGSVSTDDDLQNEEGNR

SEQ ID NO: 39479 - protein, 31 aa, Artificial Sequence
  Description of Artificial Sequence: Synthetic polypeptide
DEEEICTTNPVATEQYGSVSTNPGNDDGNPR

SEQ ID NO: 39480 - protein, 31 aa, Artificial Sequence
  Description of Artificial Sequence: Synthetic polypeptide
DEEEIRTTNPVATEQYGVVCSMWELQRGSER

SEQ ID NO: 39481 - protein, 28 aa, Artificial Sequence
  Description of Artificial Sequence: Synthetic peptide
DESEIRTTNPVATEQYGSVSNNLVPNEW

SEQ ID NO: 39482 - protein, 31 aa, Artificial Sequence
  Description of Artificial Sequence: Synthetic polypeptide
DEEEIRTTNPVATEQYGVVCSNTEHQERGNQ

SEQ ID NO: 39483 - protein, 29 aa, Artificial Sequence
  Description of Artificial Sequence: Synthetic peptide
DESEVRCTNPIATEQYGSVSAENLMRGNR

SEQ ID NO: 39484 - protein, 31 aa, Artificial Sequence
  Description of Artificial Sequence: Synthetic polypeptide
DEEEIRTTNPVATEQYGSVNSTQYDQRGEQE

SEQ ID NO: 39485 - protein, 30 aa, Artificial Sequence
  Description of Artificial Sequence: Synthetic polypeptide
DESEIRTTNPVATEQYGSVSDNNQRGEDDD

SEQ ID NO: 39486 - protein, 32 aa, Artificial Sequence
  Description of Artificial Sequence: Synthetic polypeptide
DESEIRTTNPVATEQYGSVSCNLPQDREGENQ

SEQ ID NO: 39487 - protein, 33 aa, Artificial Sequence
  Description of Artificial Sequence: Synthetic polypeptide
DEEEIRTTNPVATEQYGSVNSTNLQFEMGNEFE

SEQ ID NO: 39488 - protein, 31 aa, Artificial Sequence
  Description of Artificial Sequence: Synthetic polypeptide
DESEIRTTNPVATEQYGSVSCINLPMDRGNG

SEQ ID NO: 39489 - protein, 33 aa, Artificial Sequence
  Description of Artificial Sequence: Synthetic polypeptide
DEEEIRTTNPVATEQYGVVCSNTNLQERGGSNQ

SEQ ID NO: 39490 - protein, 30 aa, Artificial Sequence
  Description of Artificial Sequence: Synthetic polypeptide
DESEIRTTNPVATEQYGSVSAVLQVEGING

SEQ ID NO: 39491 - protein, 31 aa, Artificial Sequence
  Description of Artificial Sequence: Synthetic polypeptide
DEEEIRTTNPVATEQYGVVCSTDLQYSGSNQ

SEQ ID NO: 39492 - protein, 31 aa, Artificial Sequence
  Description of Artificial Sequence: Synthetic polypeptide
DEEEIRTTNPVATEQYGVVCSTELQGLNSER

SEQ ID NO: 39493 - protein, 31 aa, Artificial Sequence
  Description of Artificial Sequence: Synthetic polypeptide
DEEEICTTNPVAYEQWGSVSTNELQERTGNL

SEQ ID NO: 39494 - protein, 33 aa, Artificial Sequence
  Description of Artificial Sequence: Synthetic polypeptide
DEEEIRTTNPVATEQYGSVNSTNLDQNRSGDLE

SEQ ID NO: 39495 - protein, 31 aa, Artificial Sequence
  Description of Artificial Sequence: Synthetic polypeptide
DESEIRTTNPVATEQYGSTISTNHQREGGSR

SEQ ID NO: 39496 - protein, 31 aa, Artificial Sequence
  Description of Artificial Sequence: Synthetic polypeptide
DEEEICTTNPVATEQYGSVSTGNNGQDGNDE

SEQ ID NO: 39497 - protein, 29 aa, Artificial Sequence
  Description of Artificial Sequence: Synthetic peptide
DESEIRTTNPVATEGYGVVSSNLPQRGDI

SEQ ID NO: 39498 - protein, 31 aa, Artificial Sequence
  Description of Artificial Sequence: Synthetic polypeptide
DEEEICTTNPVAYEQYGSVATNLQDRGNAEM

SEQ ID NO: 39499 - protein, 31 aa, Artificial Sequence
  Description of Artificial Sequence: Synthetic polypeptide
DEEEICTTNPVATEQYGSVSTGNDNQDGGMR

SEQ ID NO: 39500 - protein, 32 aa, Artificial Sequence
  Description of Artificial Sequence: Synthetic polypeptide
DEEEIRTTNPVATEQYGTVSTSNLQDGGNVGG

SEQ ID NO: 39501 - protein, 34 aa, Artificial Sequence
  Description of Artificial Sequence: Synthetic polypeptide
DEEEIRTTNPVATEQYGSTVNTGNALSQRGGNRT

SEQ ID NO: 39502 - protein, 30 aa, Artificial Sequence
  Description of Artificial Sequence: Synthetic polypeptide
DESEIRTTNPVATECYGSVSDNEPQDRGNQ

SEQ ID NO: 39503 - protein, 31 aa, Artificial Sequence
  Description of Artificial Sequence: Synthetic polypeptide
DESEIRTTNPVATECYGSVSCINEQDREGNR

SEQ ID NO: 39504 - protein, 31 aa, Artificial Sequence
  Description of Artificial Sequence: Synthetic polypeptide
DESEIRTTNPVATECYGSASCINLPQREGNR

SEQ ID NO: 39505 - protein, 33 aa, Artificial Sequence
  Description of Artificial Sequence: Synthetic polypeptide
DEEEIRTTNPVATEQYGSTVSTQNLSGSGGNNR

SEQ ID NO: 39506 - protein, 32 aa, Artificial Sequence
  Description of Artificial Sequence: Synthetic polypeptide
DEEEIRTTNPVATEQYGSTVCYTGNLTNRGTR

SEQ ID NO: 39507 - protein, 29 aa, Artificial Sequence
  Description of Artificial Sequence: Synthetic peptide
CEDEIATTNPVATEQYGSVATNLQDGMER

SEQ ID NO: 39508 - protein, 32 aa, Artificial Sequence
  Description of Artificial Sequence: Synthetic polypeptide
DEEEIRTTNPVATEQYGTVSTSNLQENGTNEG

SEQ ID NO: 39509 - protein, 32 aa, Artificial Sequence
  Description of Artificial Sequence: Synthetic polypeptide
DEEEICTTNPVATEQYGSVSTDNGLDQPRGEF

SEQ ID NO: 39510 - protein, 32 aa, Artificial Sequence
  Description of Artificial Sequence: Synthetic polypeptide
DEEEICTTNPVATEQYGSVSTDGGNNQRDGNH

SEQ ID NO: 39511 - protein, 32 aa, Artificial Sequence
  Description of Artificial Sequence: Synthetic polypeptide
DEEEICTTNPVATEQYGSVSTANQGQERMGNS

SEQ ID NO: 39512 - protein, 33 aa, Artificial Sequence
  Description of Artificial Sequence: Synthetic polypeptide
DEEEIRTTNPVATEQYGSTVCFTNLQRLVNIRD

SEQ ID NO: 39513 - protein, 32 aa, Artificial Sequence
  Description of Artificial Sequence: Synthetic polypeptide
DEEEIRTTNPVATEQYGSTVSVNLSGSTGGNR

SEQ ID NO: 39514 - protein, 32 aa, Artificial Sequence
  Description of Artificial Sequence: Synthetic polypeptide
DEEEIRTTNPVATEQYGSTVSVTNNDQRPGDH

SEQ ID NO: 39515 - protein, 31 aa, Artificial Sequence
  Description of Artificial Sequence: Synthetic polypeptide
DEEEICTTNPVATEQYGSVSANTLFQVRGEF

SEQ ID NO: 39516 - protein, 31 aa, Artificial Sequence
  Description of Artificial Sequence: Synthetic polypeptide
DEEEIRTTNPVATEQYGVVCSTGNHQGGNQS

SEQ ID NO: 39517 - protein, 32 aa, Artificial Sequence
  Description of Artificial Sequence: Synthetic polypeptide
DEEEIRTTNPVATEQYGVVCSTGNLQGGSNDS

SEQ ID NO: 39518 - protein, 35 aa, Artificial Sequence
  Description of Artificial Sequence: Synthetic polypeptide
DEEEIRTTNPVATEQYGSTVSYTNALSQRTGGNAR

SEQ ID NO: 39519 - protein, 34 aa, Artificial Sequence
  Description of Artificial Sequence: Synthetic polypeptide
DEEEIRTTNPVATEQYGSTVSYTNLSQETGGNRG

SEQ ID NO: 39520 - protein, 34 aa, Artificial Sequence
  Description of Artificial Sequence: Synthetic polypeptide
DEEEIRTTNPVATEQYGSTVASCTNLSQTGGNRG

SEQ ID NO: 39521 - protein, 32 aa, Artificial Sequence
  Description of Artificial Sequence: Synthetic polypeptide
DESEIRTTNPVATEAYGSVSITNELSQRSGNQ

SEQ ID NO: 39522 - protein, 31 aa, Artificial Sequence
  Description of Artificial Sequence: Synthetic polypeptide
DEEEICTTNPVATEQYGSVSTDNGGQQGNHN

SEQ ID NO: 39523 - protein, 28 aa, Artificial Sequence
  Description of Artificial Sequence: Synthetic peptide
DESEIRTTNPVATEGYGVVSSTLQRGDI

SEQ ID NO: 39524 - protein, 33 aa, Artificial Sequence
  Description of Artificial Sequence: Synthetic polypeptide
DEEEIRTTNPVATEQYGSTVSTNLSGTTGGNRC

SEQ ID NO: 39525 - protein, 32 aa, Artificial Sequence
  Description of Artificial Sequence: Synthetic polypeptide
DEEEIRTTNPVATEQYGSVNSTNLDNGSLNGG

SEQ ID NO: 39526 - protein, 31 aa, Artificial Sequence
  Description of Artificial Sequence: Synthetic polypeptide
DEEEIRTTNPVATEQYGVVCSTELQRFGDQA

SEQ ID NO: 39527 - protein, 31 aa, Artificial Sequence
  Description of Artificial Sequence: Synthetic polypeptide
DESEIRTTNPVATEQYGSIPSTNHSQREGSR

SEQ ID NO: 39528 - protein, 31 aa, Artificial Sequence
  Description of Artificial Sequence: Synthetic polypeptide
DEEEIRTTNPVATEQYGVVCSTELQSFGNQD

SEQ ID NO: 39529 - protein, 32 aa, Artificial Sequence
  Description of Artificial Sequence: Synthetic polypeptide
DEEEICTTNPVAYEQYGSTVASCTNLSTRGNR

SEQ ID NO: 39530 - protein, 29 aa, Artificial Sequence
  Description of Artificial Sequence: Synthetic peptide
DESEIRTTNPVATEQYGSCNWNLERGEDR

SEQ ID NO: 39531 - protein, 31 aa, Artificial Sequence
  Description of Artificial Sequence: Synthetic polypeptide
DEEEICTTNPVATEQYGSVSTNLQGDGGDDA

SEQ ID NO: 39532 - protein, 32 aa, Artificial Sequence
  Description of Artificial Sequence: Synthetic polypeptide
DESEIRTTNPVATEQYGKTVSCTGNLSQGGNR

SEQ ID NO: 39533 - protein, 34 aa, Artificial Sequence
  Description of Artificial Sequence: Synthetic polypeptide
DESEIRTTNPVATEQYGISTVSTGNLSQRPGGNR

SEQ ID NO: 39534 - protein, 32 aa, Artificial Sequence
  Description of Artificial Sequence: Synthetic polypeptide
DEEEICTTNPVAYEQYGSTVSCTNLSGRGNER

SEQ ID NO: 39535 - protein, 30 aa, Artificial Sequence
  Description of Artificial Sequence: Synthetic polypeptide
DESEIRTTNPVATEQYGEVATNLQRAEDDR

SEQ ID NO: 39536 - protein, 32 aa, Artificial Sequence
  Description of Artificial Sequence: Synthetic polypeptide
DEEEICTTNPVAYEQYGSTVSTNALAGRGGNR

SEQ ID NO: 39537 - protein, 30 aa, Artificial Sequence
  Description of Artificial Sequence: Synthetic polypeptide
DESEIRTTNPVATEQYGCVSTNLQHNSNDY

SEQ ID NO: 39538 - protein, 32 aa, Artificial Sequence
  Description of Artificial Sequence: Synthetic polypeptide
DEEEICTTNPVATEQYGSVSTNLNQNGGDNGD

SEQ ID NO: 39539 - protein, 30 aa, Artificial Sequence
  Description of Artificial Sequence: Synthetic polypeptide
DESEIRTTNPVATEQWGSVSDNEPQREGNG

SEQ ID NO: 39540 - protein, 31 aa, Artificial Sequence
  Description of Artificial Sequence: Synthetic polypeptide
DESEIRTTNPVATEQWGSVSCNLPQDREGNG

SEQ ID NO: 39541 - protein, 31 aa, Artificial Sequence
  Description of Artificial Sequence: Synthetic polypeptide
DESEIRTTNPVATEQWGSVSCINLPQDRGNG

SEQ ID NO: 39542 - protein, 32 aa, Artificial Sequence
  Description of Artificial Sequence: Synthetic polypeptide
DEEEICTTNPVATEQYGSVSTNGLMEQRGEGH

SEQ ID NO: 39543 - protein, 31 aa, Artificial Sequence
  Description of Artificial Sequence: Synthetic polypeptide
DEEEICTTNPVATEQYGSVSTNELQPVNNEA

SEQ ID NO: 39544 - protein, 31 aa, Artificial Sequence
  Description of Artificial Sequence: Synthetic polypeptide
DEEEICTTNPVAYEQYGSTVSTNQSGRGGNR

SEQ ID NO: 39545 - protein, 31 aa, Artificial Sequence
  Description of Artificial Sequence: Synthetic polypeptide
DESEIRTTNPVATEQWGSASCNLPQREGENR

SEQ ID NO: 39546 - protein, 28 aa, Artificial Sequence
  Description of Artificial Sequence: Synthetic peptide
DESEIRTTNPVATEQWGNVSTGLDRGTM

SEQ ID NO: 39547 - protein, 32 aa, Artificial Sequence
  Description of Artificial Sequence: Synthetic polypeptide
DESEIRTTNPVATEPYGSVCSCTNLSGQGGNR

SEQ ID NO: 39548 - protein, 33 aa, Artificial Sequence
  Description of Artificial Sequence: Synthetic polypeptide
DEEEIRTTNPVATEQYGSVNSTNLDQNREGDGQ

SEQ ID NO: 39549 - protein, 29 aa, Artificial Sequence
  Description of Artificial Sequence: Synthetic peptide
DESTICTTNPVATEQWGSVSTQLLQRGNM

SEQ ID NO: 39550 - protein, 31 aa, Artificial Sequence
  Description of Artificial Sequence: Synthetic polypeptide
DESEIRTTNPVATEPYGSVCFTNLTRTGGNR

SEQ ID NO: 39551 - protein, 31 aa, Artificial Sequence
  Description of Artificial Sequence: Synthetic polypeptide
DESEIRTTNPVATEPYGSVCFTNDLTRGGNR

SEQ ID NO: 39552 - protein, 32 aa, Artificial Sequence
  Description of Artificial Sequence: Synthetic polypeptide
DEEEIRTTNPVATEQYGSTVSTNLSGPTGGER

SEQ ID NO: 39553 - protein, 31 aa, Artificial Sequence
  Description of Artificial Sequence: Synthetic polypeptide
DEEEICTTNPVATEQYGSVSTNLQGNDGDAN

SEQ ID NO: 39554 - protein, 30 aa, Artificial Sequence
  Description of Artificial Sequence: Synthetic polypeptide
DESVIGTTNPVATEQDGSVSTQDELQRGNR

SEQ ID NO: 39555 - protein, 31 aa, Artificial Sequence
  Description of Artificial Sequence: Synthetic polypeptide
DESEIRTTNPVATEQYGSVSTPLQERFGSEQ

SEQ ID NO: 39556 - protein, 31 aa, Artificial Sequence
  Description of Artificial Sequence: Synthetic polypeptide
DESEIRTTNPVATEQYGSVSVADLQRGDGRD

SEQ ID NO: 39557 - protein, 32 aa, Artificial Sequence
  Description of Artificial Sequence: Synthetic polypeptide
DESEIRTTNPVAYEQYGQSVSTNALSQRGTSR

SEQ ID NO: 39558 - protein, 33 aa, Artificial Sequence
  Description of Artificial Sequence: Synthetic polypeptide
DEEEIRTTNPVATEQYGSVNSTNNDERGNNEER

SEQ ID NO: 39559 - protein, 30 aa, Artificial Sequence
  Description of Artificial Sequence: Synthetic polypeptide
DESEIRTTNPVATQQYGKTVSTNLSERGNP

SEQ ID NO: 39560 - protein, 29 aa, Artificial Sequence
  Description of Artificial Sequence: Synthetic peptide
DESEIRTTNPVATQQYGCVSTNLTRVTNP

SEQ ID NO: 39561 - protein, 31 aa, Artificial Sequence
  Description of Artificial Sequence: Synthetic polypeptide
DEEEIRTTNPVATEQYGTVWSTDNPIQRENN

SEQ ID NO: 39562 - protein, 32 aa, Artificial Sequence
  Description of Artificial Sequence: Synthetic polypeptide
DEEEIRTTNPVATEQYGSTVSCTNELSQGVNL

SEQ ID NO: 39563 - protein, 29 aa, Artificial Sequence
  Description of Artificial Sequence: Synthetic peptide
CAEEIATTNPVATEQYGVVSTNLQAGPNE

SEQ ID NO: 39564 - protein, 29 aa, Artificial Sequence
  Description of Artificial Sequence: Synthetic peptide
DESEIRTTNPVATKSYGSVSTNLERTNNM

SEQ ID NO: 39565 - protein, 29 aa, Artificial Sequence
  Description of Artificial Sequence: Synthetic peptide
DESEIRTTNPVATKHYGSVSTNLPERTNS

SEQ ID NO: 39566 - protein, 29 aa, Artificial Sequence
  Description of Artificial Sequence: Synthetic peptide
DESEIRTTNPVATKHYGSVSTNDLQRTTG

SEQ ID NO: 39567 - protein, 31 aa, Artificial Sequence
  Description of Artificial Sequence: Synthetic polypeptide
DEEEIRTTNPVATEQYGTWGSTINPLQRVNN

SEQ ID NO: 39568 - protein, 32 aa, Artificial Sequence
  Description of Artificial Sequence: Synthetic polypeptide
DEEEIRTTNPVATEQYGSTVSTNESQTRSVNA

SEQ ID NO: 39569 - protein, 34 aa, Artificial Sequence
  Description of Artificial Sequence: Synthetic polypeptide
DEEEIRTTNPVATEQYGSTVSTNALSQHTGTNNR

SEQ ID NO: 39570 - protein, 32 aa, Artificial Sequence
  Description of Artificial Sequence: Synthetic polypeptide
DEEEIRTTNPVATEQYGSTVSTNFSGKTGGNR

SEQ ID NO: 39571 - protein, 30 aa, Artificial Sequence
  Description of Artificial Sequence: Synthetic polypeptide
DESEIRTTNPVATKAYGSVPSTNLSQRVNM

SEQ ID NO: 39572 - protein, 31 aa, Artificial Sequence
  Description of Artificial Sequence: Synthetic polypeptide
DEEEIRTTNPVATEQYGTWSLPNDLQNRDNR

SEQ ID NO: 39573 - protein, 28 aa, Artificial Sequence
  Description of Artificial Sequence: Synthetic peptide
DESEIRTTNPVATGHYGSVSTNTQETNM

SEQ ID NO: 39574 - protein, 29 aa, Artificial Sequence
  Description of Artificial Sequence: Synthetic peptide
DESEIRTTNPVATGHYGSVSATNLERTNN

SEQ ID NO: 39575 - protein, 30 aa, Artificial Sequence
  Description of Artificial Sequence: Synthetic polypeptide
DEEEICTTNPVATEQYGVVSTSMLSGRGNV

SEQ ID NO: 39576 - protein, 31 aa, Artificial Sequence
  Description of Artificial Sequence: Synthetic polypeptide
DEEEIRTTNPVATEQYGTWSTINDLSQRENN

SEQ ID NO: 39577 - protein, 31 aa, Artificial Sequence
  Description of Artificial Sequence: Synthetic polypeptide
DESEIRTTNPVATERYGSVSCTGNLSGAGNR

SEQ ID NO: 39578 - protein, 32 aa, Artificial Sequence
  Description of Artificial Sequence: Synthetic polypeptide
DESEIRTTNPVAYEQYGSLVSTNLSQRGGSNL

SEQ ID NO: 39579 - protein, 31 aa, Artificial Sequence
  Description of Artificial Sequence: Synthetic polypeptide
DESEIRTTNPVAYEQYGSTISCTNLSQRGSR

SEQ ID NO: 39580 - protein, 29 aa, Artificial Sequence
  Description of Artificial Sequence: Synthetic peptide
DESEIRTTNPVAYEQYGSVAATNDQNGND

SEQ ID NO: 39581 - protein, 31 aa, Artificial Sequence
  Description of Artificial Sequence: Synthetic polypeptide
DESEIRTTNPVAYEQYGSVATNLQRGQNEDQ

SEQ ID NO: 39582 - protein, 31 aa, Artificial Sequence
  Description of Artificial Sequence: Synthetic polypeptide
DEEEIRTTNPVATEQYGTWSTINNLQRDENN

SEQ ID NO: 39583 - protein, 28 aa, Artificial Sequence
  Description of Artificial Sequence: Synthetic peptide
DESEIRTTNPVATKHYGSVSDLLQRTNE

SEQ ID NO: 39584 - protein, 29 aa, Artificial Sequence
  Description of Artificial Sequence: Synthetic peptide
DESEIRTTNPVATTAYGSVSTNLQGTNMT

SEQ ID NO: 39585 - protein, 31 aa, Artificial Sequence
  Description of Artificial Sequence: Synthetic polypeptide
DEEEIRTTNPVATEQYGSVNSTNNLERNEEF

SEQ ID NO: 39586 - protein, 34 aa, Artificial Sequence
  Description of Artificial Sequence: Synthetic polypeptide
DEEEIRTTNPVATEQYGTVVSYTNLSQRTGGNPR

SEQ ID NO: 39587 - protein, 32 aa, Artificial Sequence
  Description of Artificial Sequence: Synthetic polypeptide
DEEEIRTTNPVATEQYGSVNSTNQQAGGNQEE

SEQ ID NO: 39588 - protein, 32 aa, Artificial Sequence
  Description of Artificial Sequence: Synthetic polypeptide
DEEEIRTTNPVATEQYGSVNSTNNLQSLQTRQ

SEQ ID NO: 39589 - protein, 30 aa, Artificial Sequence
  Description of Artificial Sequence: Synthetic polypeptide
DEEEIRTTNPVATEQYGTVVDTNLQLNNFI

SEQ ID NO: 39590 - protein, 30 aa, Artificial Sequence
  Description of Artificial Sequence: Synthetic polypeptide
DESEIRTTNPVAYEQWGSVSTNLQGGNGDT

SEQ ID NO: 39591 - protein, 31 aa, Artificial Sequence
  Description of Artificial Sequence: Synthetic polypeptide
DEEEICTTNPVAYEAYGSVSCTNMLQRGGNS

SEQ ID NO: 39592 - protein, 31 aa, Artificial Sequence
  Description of Artificial Sequence: Synthetic polypeptide
DEEEIRTTNPVATEQYGSTVSCTNLSTTVNE

SEQ ID NO: 39593 - protein, 31 aa, Artificial Sequence
  Description of Artificial Sequence: Synthetic polypeptide
DEEEIRTTNPVATEQYGSTVSCTNQFLSGNA

SEQ ID NO: 39594 - protein, 33 aa, Artificial Sequence
  Description of Artificial Sequence: Synthetic polypeptide
DEEEIRTTNPVATEQYGSTVSCTPNLSTRGNNE

SEQ ID NO: 39595 - protein, 30 aa, Artificial Sequence
  Description of Artificial Sequence: Synthetic polypeptide
DEEEIRTTNPVATEQYGTVVSGIELQDGNS

SEQ ID NO: 39596 - protein, 32 aa, Artificial Sequence
  Description of Artificial Sequence: Synthetic polypeptide
DESEIRTTNPVAYEAYGISVCSCTNLSQRGNR

SEQ ID NO: 39597 - protein, 32 aa, Artificial Sequence
  Description of Artificial Sequence: Synthetic polypeptide
DEEEIRTTNPVATEQYGTVTTSTNNNLQRENN

SEQ ID NO: 39598 - protein, 32 aa, Artificial Sequence
  Description of Artificial Sequence: Synthetic polypeptide
DEEEIRTTNPVATEQYGTVVSTNDMQAGQGNR

SEQ ID NO: 39599 - protein, 34 aa, Artificial Sequence
  Description of Artificial Sequence: Synthetic polypeptide
DEEEIRTTNPVATEQYGSTVSCTQNLSQGGGNDR

SEQ ID NO: 39600 - protein, 32 aa, Artificial Sequence
  Description of Artificial Sequence: Synthetic polypeptide
DEEEIRTTNPVATEQYGTVTTSTNLLQQGNAE

SEQ ID NO: 39601 - protein, 31 aa, Artificial Sequence
  Description of Artificial Sequence: Synthetic polypeptide
DEEEIRTTNPVATEQYGTVTSTNNLLQQENN

SEQ ID NO: 39602 - protein, 32 aa, Artificial Sequence
  Description of Artificial Sequence: Synthetic polypeptide
DEEEIRTTNPVATEQYGSTVSCVNHSQDGGNR

SEQ ID NO: 39603 - protein, 32 aa, Artificial Sequence
  Description of Artificial Sequence: Synthetic polypeptide
DEEEIRTTNPVATEQYGSTVSCTNLGESGSNM

SEQ ID NO: 39604 - protein, 32 aa, Artificial Sequence
  Description of Artificial Sequence: Synthetic polypeptide
DEEEIRTTNPVATEQYGTVTSTINNLQQGENN

SEQ ID NO: 39605 - protein, 31 aa, Artificial Sequence
  Description of Artificial Sequence: Synthetic polypeptide
DEEEIRTTNPVATEQYGTVTSTGNQLQGENN

SEQ ID NO: 39606 - protein, 29 aa, Artificial Sequence
  Description of Artificial Sequence: Synthetic peptide
DESEIRTTNPVAYAAYGSVSTNLQRVNNM

SEQ ID NO: 39607 - protein, 28 aa, Artificial Sequence
  Description of Artificial Sequence: Synthetic peptide
DESEIRTTNPVAVEQYGSTSTNLENNNG

SEQ ID NO: 39608 - protein, 29 aa, Artificial Sequence
  Description of Artificial Sequence: Synthetic peptide
ATEEEIATTNPVAYEPYGSVATNLQRGND

SEQ ID NO: 39609 - protein, 30 aa, Artificial Sequence
  Description of Artificial Sequence: Synthetic polypeptide
DEEEICTTNPVAYEAYGVVSTNLSQRGGNS

SEQ ID NO: 39610 - protein, 29 aa, Artificial Sequence
  Description of Artificial Sequence: Synthetic peptide
DESEIRTTNPVATTSYGSVSTNLQGTNTM

SEQ ID NO: 39611 - protein, 29 aa, Artificial Sequence
  Description of Artificial Sequence: Synthetic peptide
DESEIRTTNPVATTHWGSVSTNLQRTNME

SEQ ID NO: 39612 - protein, 29 aa, Artificial Sequence
  Description of Artificial Sequence: Synthetic peptide
DESEIRTTNPVATTAYGSVSTTNLQETNM

SEQ ID NO: 39613 - protein, 33 aa, Artificial Sequence
  Description of Artificial Sequence: Synthetic polypeptide
DEEEIRTTNPVATEQYGTVSYTNLSQRTVTNNR

SEQ ID NO: 39614 - protein, 33 aa, Artificial Sequence
  Description of Artificial Sequence: Synthetic polypeptide
DESEIRTTNPVATERYGSTVSTNLSQRTGGNRG

SEQ ID NO: 39615 - protein, 31 aa, Artificial Sequence
  Description of Artificial Sequence: Synthetic polypeptide
DESEIRTTNPVATEQYGSVSTTNLQNGDIQA

SEQ ID NO: 39616 - protein, 32 aa, Artificial Sequence
  Description of Artificial Sequence: Synthetic polypeptide
DEEEICTTNPVATEQYGTVVSTNLSQHTGGNR

SEQ ID NO: 39617 - protein, 30 aa, Artificial Sequence
  Description of Artificial Sequence: Synthetic polypeptide
DEEEIRTTNPVATEQYGTWSTINPEQRENV

SEQ ID NO: 39618 - protein, 31 aa, Artificial Sequence
  Description of Artificial Sequence: Synthetic polypeptide
DESEIRTTNPVATEQYGSVYDTNDLQGMGND

SEQ ID NO: 39619 - protein, 33 aa, Artificial Sequence
  Description of Artificial Sequence: Synthetic polypeptide
DEEEIRTTNPVATEQYGVCVCSTGNLQRGSNQG

SEQ ID NO: 39620 - protein, 31 aa, Artificial Sequence
  Description of Artificial Sequence: Synthetic polypeptide
DEEEIRTTNPVATEQYGVIWSTINNLQRENN

SEQ ID NO: 39621 - protein, 34 aa, Artificial Sequence
  Description of Artificial Sequence: Synthetic polypeptide
DEEEIRTTNPVATEQYGSVNSTNLQQFMGVNQRS

SEQ ID NO: 39622 - protein, 32 aa, Artificial Sequence
  Description of Artificial Sequence: Synthetic polypeptide
DEEEIRTTNPVATEQYGVSVSTGNHQFFGSNQ

SEQ ID NO: 39623 - protein, 32 aa, Artificial Sequence
  Description of Artificial Sequence: Synthetic polypeptide
DEEEIRTTNPVATEQYGTVSWNELDNRGGMNR

SEQ ID NO: 39624 - protein, 32 aa, Artificial Sequence
  Description of Artificial Sequence: Synthetic polypeptide
DEEEIRTTNPVATEQYGSVNSTNLQNNNEEFE

SEQ ID NO: 39625 - protein, 33 aa, Artificial Sequence
  Description of Artificial Sequence: Synthetic polypeptide
DESEIRTTNPVATEQYGSVVSYTGNLSQRGGND

SEQ ID NO: 39626 - protein, 31 aa, Artificial Sequence
  Description of Artificial Sequence: Synthetic polypeptide
DEEEIRTTNPVATEQYGVSYSLPNMDQRDNR

SEQ ID NO: 39627 - protein, 32 aa, Artificial Sequence
  Description of Artificial Sequence: Synthetic polypeptide
DEEEIRTTNPVATEQYGSTVSCTALSQSGGER

SEQ ID NO: 39628 - protein, 29 aa, Artificial Sequence
  Description of Artificial Sequence: Synthetic peptide
DESEIRTTNPVAYQHYGSVSTNLQRTENM

SEQ ID NO: 39629 - protein, 31 aa, Artificial Sequence
  Description of Artificial Sequence: Synthetic polypeptide
DEEEIRTTNPVATEQYGVTCSTNELQNGSNQ

SEQ ID NO: 39630 - protein, 32 aa, Artificial Sequence
  Description of Artificial Sequence: Synthetic polypeptide
DESEIRTTNPVATEQYGSYSTNSLVQSGQNRS

SEQ ID NO: 39631 - protein, 32 aa, Artificial Sequence
  Description of Artificial Sequence: Synthetic polypeptide
DESEIRTTNPVATEQYGSVVSTDLQRAGNGDD

SEQ ID NO: 39632 - protein, 31 aa, Artificial Sequence
  Description of Artificial Sequence: Synthetic polypeptide
DEEEIRTTNPVATEQYGTVSWELQRFGSERA

SEQ ID NO: 39633 - protein, 30 aa, Artificial Sequence
  Description of Artificial Sequence: Synthetic polypeptide
DESEIRTTNPVATEQYGSVVNNNLEVEGNR

SEQ ID NO: 39634 - protein, 31 aa, Artificial Sequence
  Description of Artificial Sequence: Synthetic polypeptide
DESEIRTTNPVATEQYGSVTTTNLQLFGNTG

SEQ ID NO: 39635 - protein, 29 aa, Artificial Sequence
  Description of Artificial Sequence: Synthetic peptide
CDEEIRTTNPVATEQYGSVQTNEQRPNDV

SEQ ID NO: 39636 - protein, 29 aa, Artificial Sequence
  Description of Artificial Sequence: Synthetic peptide
DESEIRTTNPVCTEQYGVVSDINLQSGNQ

SEQ ID NO: 39637 - protein, 33 aa, Artificial Sequence
  Description of Artificial Sequence: Synthetic polypeptide
DEEEIRTTNPVATEQYGSTVPTENDSQRDGNDR

SEQ ID NO: 39638 - protein, 32 aa, Artificial Sequence
  Description of Artificial Sequence: Synthetic polypeptide
DEEEICTTNPVATEQYGSVSTNSLFQVRGGEG

SEQ ID NO: 39639 - protein, 31 aa, Artificial Sequence
  Description of Artificial Sequence: Synthetic polypeptide
DEEEICTTNPVATEQYGSVSTNSGDQGRGEF

SEQ ID NO: 39640 - protein, 33 aa, Artificial Sequence
  Description of Artificial Sequence: Synthetic polypeptide
DEEEIRTTNPVATEQYGVTVSCTGNLSQGGTNR

SEQ ID NO: 39641 - protein, 31 aa, Artificial Sequence
  Description of Artificial Sequence: Synthetic polypeptide
DESEIRTTNPVATEQYGSVSWNLDDERGVIR

SEQ ID NO: 39642 - protein, 31 aa, Artificial Sequence
  Description of Artificial Sequence: Synthetic polypeptide
DEEEICTTNPVATEQYGSVSTNQQGNDGNMS

SEQ ID NO: 39643 - protein, 29 aa, Artificial Sequence
  Description of Artificial Sequence: Synthetic peptide
DESEIRTTNPVATEQYGSVSVLLNAGNDG

SEQ ID NO: 39644 - protein, 31 aa, Artificial Sequence
  Description of Artificial Sequence: Synthetic polypeptide
DEEEIRTTNPVATEQYGVTSTINPLQREDNN

SEQ ID NO: 39645 - protein, 30 aa, Artificial Sequence
  Description of Artificial Sequence: Synthetic polypeptide
DESEIRTTNPVATEQYGTVSNNLMTSGTNR

SEQ ID NO: 39646 - protein, 31 aa, Artificial Sequence
  Description of Artificial Sequence: Synthetic polypeptide
DEEEIRTTNPVATEQYGVCSTINPLQRENNT

SEQ ID NO: 39647 - protein, 31 aa, Artificial Sequence
  Description of Artificial Sequence: Synthetic polypeptide
DESEIRTTNPVAYEQYGSVVSTTNLQSNGNF

SEQ ID NO: 39648 - protein, 32 aa, Artificial Sequence
  Description of Artificial Sequence: Synthetic polypeptide
DESEIRTTNPVAYEQYGSVSCTLNLSQAGNNR

SEQ ID NO: 39649 - protein, 34 aa, Artificial Sequence
  Description of Artificial Sequence: Synthetic polypeptide
DEEEIRTTNPVATEQYGSTVSCTLNGSQRGGNRK

SEQ ID NO: 39650 - protein, 31 aa, Artificial Sequence
  Description of Artificial Sequence: Synthetic polypeptide
DESEIRTTNPVATEQYGVVVSTNLQAVGFNT

SEQ ID NO: 39651 - protein, 30 aa, Artificial Sequence
  Description of Artificial Sequence: Synthetic polypeptide
DESEIRTTNPVATEQYGVVSTTDLQRENID

SEQ ID NO: 39652 - protein, 31 aa, Artificial Sequence
  Description of Artificial Sequence: Synthetic polypeptide
DESEIRTTNPVAYEQYGSVSINLSQNTGNNR

SEQ ID NO: 39653 - protein, 31 aa, Artificial Sequence
  Description of Artificial Sequence: Synthetic polypeptide
DESEIRTTNPVATEQYGVVSTNLQGDGNGNK

SEQ ID NO: 39654 - protein, 29 aa, Artificial Sequence
  Description of Artificial Sequence: Synthetic peptide
AETEIRTTNPVATEQYGSVTTNLQQIGST

SEQ ID NO: 39655 - protein, 29 aa, Artificial Sequence
  Description of Artificial Sequence: Synthetic peptide
AETEIRTTNPVATEQYGSVTTNLQIGSEN

SEQ ID NO: 39656 - protein, 30 aa, Artificial Sequence
  Description of Artificial Sequence: Synthetic polypeptide
DEEEIRTTNPVATEQYGTWSTINPLQEENG

SEQ ID NO: 39657 - protein, 33 aa, Artificial Sequence
  Description of Artificial Sequence: Synthetic polypeptide
DEEEICTTNPVATEQYGSVVSCTNLSQRGGNNV

SEQ ID NO: 39658 - protein, 30 aa, Artificial Sequence
  Description of Artificial Sequence: Synthetic polypeptide
DESEIRTTNPVATEQYGVVSTDLQRIVNED

SEQ ID NO: 39659 - protein, 32 aa, Artificial Sequence
  Description of Artificial Sequence: Synthetic polypeptide
DEEEICTTNPVATEQYGSVVSCINLSQPGGNR

SEQ ID NO: 39660 - protein, 30 aa, Artificial Sequence
  Description of Artificial Sequence: Synthetic polypeptide
DESEIRTTNPVATEQYGVVSTDLQRIEGDD

SEQ ID NO: 39661 - protein, 30 aa, Artificial Sequence
  Description of Artificial Sequence: Synthetic polypeptide
DESEIRTTNPVATEQYGVVSTDLQREDNGD

SEQ ID NO: 39662 - protein, 31 aa, Artificial Sequence
  Description of Artificial Sequence: Synthetic polypeptide
DESEIRTTNPVATEQYGVVSTDLQRAGNDDQ

SEQ ID NO: 39663 - protein, 31 aa, Artificial Sequence
  Description of Artificial Sequence: Synthetic polypeptide
DEEEIRTTNPVATEQYGTWSTINPLQRVENQ

SEQ ID NO: 39664 - protein, 29 aa, Artificial Sequence
  Description of Artificial Sequence: Synthetic peptide
DESEIRTTNPVATEQYGVVSTDLQFPNGD

SEQ ID NO: 39665 - protein, 31 aa, Artificial Sequence
  Description of Artificial Sequence: Synthetic polypeptide
DEEEIRTTNPVATEQYGTWSTMNPLQRNSNA

SEQ ID NO: 39666 - protein, 30 aa, Artificial Sequence
  Description of Artificial Sequence: Synthetic polypeptide
DEEEIRTTNPVATEQYGTWTTGNPLQRENN

SEQ ID NO: 39667 - protein, 30 aa, Artificial Sequence
  Description of Artificial Sequence: Synthetic polypeptide
AETEIRTTNPVATEQYGSVSTNLQETSNAE

SEQ ID NO: 39668 - protein, 29 aa, Artificial Sequence
  Description of Artificial Sequence: Synthetic peptide
AETEIRTTNPVATEQYGSVNTNLQIGSTQ

SEQ ID NO: 39669 - protein, 30 aa, Artificial Sequence
  Description of Artificial Sequence: Synthetic polypeptide
DESEIRTTNPVATEQYGVVSSTNLIDNGNA

SEQ ID NO: 39670 - protein, 31 aa, Artificial Sequence
  Description of Artificial Sequence: Synthetic polypeptide
DESEIRTTNPVAYEQYGSVSTNLQDGGGNAN

SEQ ID NO: 39671 - protein, 32 aa, Artificial Sequence
  Description of Artificial Sequence: Synthetic polypeptide
DEEEICTTNPVATEQYGSVSTWNGLDQGRGEA

SEQ ID NO: 39672 - protein, 33 aa, Artificial Sequence
  Description of Artificial Sequence: Synthetic polypeptide
DESEIRTTNPVATEQYGVSVSCTNLSQAGGNNR

SEQ ID NO: 39673 - protein, 31 aa, Artificial Sequence
  Description of Artificial Sequence: Synthetic polypeptide
DEEEIRTTNPVATEQYGSVNSTQDQRGEQDQ

SEQ ID NO: 39674 - protein, 34 aa, Artificial Sequence
  Description of Artificial Sequence: Synthetic polypeptide
DEEEIRTTNPVATEQYGSTVSCTGNALQRTGGVR

SEQ ID NO: 39675 - protein, 32 aa, Artificial Sequence
  Description of Artificial Sequence: Synthetic polypeptide
DESEIRTTNPVAYEQYGSVPSTYLSQRTGGNR

SEQ ID NO: 39676 - protein, 32 aa, Artificial Sequence
  Description of Artificial Sequence: Synthetic polypeptide
DESEIRTTNPVATEAYGSVSCTNLSNRTGVNR

SEQ ID NO: 39677 - protein, 33 aa, Artificial Sequence
  Description of Artificial Sequence: Synthetic polypeptide
DEEEIRTTNPVATEQYGSTVACTPALQRTGGNR

SEQ ID NO: 39678 - protein, 30 aa, Artificial Sequence
  Description of Artificial Sequence: Synthetic polypeptide
DESEIRTTNPVATEAYGSVSCNNLQRGGTM

SEQ ID NO: 39679 - protein, 30 aa, Artificial Sequence
  Description of Artificial Sequence: Synthetic polypeptide
DEEEIRTTNPVATEQYGSVAANLQTEENQE

SEQ ID NO: 39680 - protein, 33 aa, Artificial Sequence
  Description of Artificial Sequence: Synthetic polypeptide
DEEEIRTTNPVATEQYGSVAASTNLDQEHGTNE

SEQ ID NO: 39681 - protein, 32 aa, Artificial Sequence
  Description of Artificial Sequence: Synthetic polypeptide
DEEEIRTTNPVATEQYGSVAATANEQRNGPVR

SEQ ID NO: 39682 - protein, 28 aa, Artificial Sequence
  Description of Artificial Sequence: Synthetic peptide
DESEIATTNPVAYGHYGSVSTNLQRHNM

SEQ ID NO: 39683 - protein, 31 aa, Artificial Sequence
  Description of Artificial Sequence: Synthetic polypeptide
DESEIATTNPVAYEQYGSVVSATNLQRGNEQ

SEQ ID NO: 39684 - protein, 30 aa, Artificial Sequence
  Description of Artificial Sequence: Synthetic polypeptide
DEEEIRTTNPVATEQYGSVAATNDIRGEVD

SEQ ID NO: 39685 - protein, 31 aa, Artificial Sequence
  Description of Artificial Sequence: Synthetic polypeptide
DEEEIRTTNPVATEQYGSVAATNDIRGGEDR

SEQ ID NO: 39686 - protein, 30 aa, Artificial Sequence
  Description of Artificial Sequence: Synthetic polypeptide
DESEIATTNPVAYEQYGSVSTNLQDGGNNG

SEQ ID NO: 39687 - protein, 31 aa, Artificial Sequence
  Description of Artificial Sequence: Synthetic polypeptide
DEEEIRTTNPVATEQYGTVSSTNNTLQGENN

SEQ ID NO: 39688 - protein, 31 aa, Artificial Sequence
  Description of Artificial Sequence: Synthetic polypeptide
DEEEIRTTNPVATEQYGSVAATNDQRNGPQD

SEQ ID NO: 39689 - protein, 29 aa, Artificial Sequence
  Description of Artificial Sequence: Synthetic peptide
DETCIRTTNPLATEQFGSVSFNLQIGNRD

SEQ ID NO: 39690 - protein, 31 aa, Artificial Sequence
  Description of Artificial Sequence: Synthetic polypeptide
DEEEIRTTNPVATEQYGVVSEWTNLEQAMAR

SEQ ID NO: 39691 - protein, 29 aa, Artificial Sequence
  Description of Artificial Sequence: Synthetic peptide
DETCIRTTNPLATEQFGSVSCENLQSGNR

SEQ ID NO: 39692 - protein, 31 aa, Artificial Sequence
  Description of Artificial Sequence: Synthetic polypeptide
DEEEIRTTNPVATEQYGSVNSTNDQGEDTRI

SEQ ID NO: 39693 - protein, 29 aa, Artificial Sequence
  Description of Artificial Sequence: Synthetic peptide
DETCIRTTNPLATEQFGSVSSENLQSGNR

SEQ ID NO: 39694 - protein, 32 aa, Artificial Sequence
  Description of Artificial Sequence: Synthetic polypeptide
DEEEIRTTNPVATEQYGSVAATNEQRNGPARS

SEQ ID NO: 39695 - protein, 28 aa, Artificial Sequence
  Description of Artificial Sequence: Synthetic peptide
DEAEIATTNPVAYEQYGEVSTNLQHGDV

SEQ ID NO: 39696 - protein, 30 aa, Artificial Sequence
  Description of Artificial Sequence: Synthetic polypeptide
DEAEIATTNPVATEQYGSVSTPNLQNRNEM

SEQ ID NO: 39697 - protein, 33 aa, Artificial Sequence
  Description of Artificial Sequence: Synthetic polypeptide
DEEEIRTTNPVATEQYGSVNSTNDQAGSENGRD

SEQ ID NO: 39698 - protein, 31 aa, Artificial Sequence
  Description of Artificial Sequence: Synthetic polypeptide
DEEEIRTTNPVATEQYGSVAATNEQRNGPDF

SEQ ID NO: 39699 - protein, 31 aa, Artificial Sequence
  Description of Artificial Sequence: Synthetic polypeptide
DEEEICTTNPVATEQYGAVSTNLQGGGDGNP

SEQ ID NO: 39700 - protein, 31 aa, Artificial Sequence
  Description of Artificial Sequence: Synthetic polypeptide
DEEEIRTTNPVATEQYGSVAATNLQDAEPRE

SEQ ID NO: 39701 - protein, 30 aa, Artificial Sequence
  Description of Artificial Sequence: Synthetic polypeptide
DESEIATTNPVAYEQWGSVSCTNLQRGGNL

SEQ ID NO: 39702 - protein, 29 aa, Artificial Sequence
  Description of Artificial Sequence: Synthetic peptide
DEEEICTVNPVATEQYGSVSTALQGNQQE

SEQ ID NO: 39703 - protein, 31 aa, Artificial Sequence
  Description of Artificial Sequence: Synthetic polypeptide
DEEEICTTNPVATEQWGISVSTTELLRGGNR

SEQ ID NO: 39704 - protein, 28 aa, Artificial Sequence
  Description of Artificial Sequence: Synthetic peptide
DESEIATTNPVATMHYGSVSTNLDRTNM

SEQ ID NO: 39705 - protein, 30 aa, Artificial Sequence
  Description of Artificial Sequence: Synthetic polypeptide
DESEIATTNPVAYEQYGSVATNLQRGDNDE

SEQ ID NO: 39706 - protein, 30 aa, Artificial Sequence
  Description of Artificial Sequence: Synthetic polypeptide
DESEICTTNPAATEQYGSVPTNLQHSGNER

SEQ ID NO: 39707 - protein, 31 aa, Artificial Sequence
  Description of Artificial Sequence: Synthetic polypeptide
DEEEIRTTNPVATEQYGTVSTANLVVGNNGQ

SEQ ID NO: 39708 - protein, 29 aa, Artificial Sequence
  Description of Artificial Sequence: Synthetic peptide
DESEICTTNPVATEMYGSVATNLERGNDE

SEQ ID NO: 39709 - protein, 29 aa, Artificial Sequence
  Description of Artificial Sequence: Synthetic peptide
CEEEIACTNPIATEQYGSVSENLMRGNRD

SEQ ID NO: 39710 - protein, 31 aa, Artificial Sequence
  Description of Artificial Sequence: Synthetic polypeptide
DEEEIRTTNPVATEQYGTVSTETQYFGSNRT

SEQ ID NO: 39711 - protein, 30 aa, Artificial Sequence
  Description of Artificial Sequence: Synthetic polypeptide
DESEICTTNPVATEQYGSVSCTNLSMTGNT

SEQ ID NO: 39712 - protein, 30 aa, Artificial Sequence
  Description of Artificial Sequence: Synthetic polypeptide
DEEEICTTNPVATEQYGEVSTNTNQQGNMT

SEQ ID NO: 39713 - protein, 30 aa, Artificial Sequence
  Description of Artificial Sequence: Synthetic polypeptide
DESEICTTNPVATEQYGSVATPNLERGNDD

SEQ ID NO: 39714 - protein, 29 aa, Artificial Sequence
  Description of Artificial Sequence: Synthetic peptide
DESEICTTNPVATEQYGSVATNLVDGNED

SEQ ID NO: 39715 - protein, 29 aa, Artificial Sequence
  Description of Artificial Sequence: Synthetic peptide
DESEICTTNPVATEQYGSVATNLTAGNDD

SEQ ID NO: 39716 - protein, 30 aa, Artificial Sequence
  Description of Artificial Sequence: Synthetic polypeptide
DESEICTTNPVATEQYGSVATNLQEPDGNM

SEQ ID NO: 39717 - protein, 29 aa, Artificial Sequence
  Description of Artificial Sequence: Synthetic peptide
DESEICTTNPVATEQYGSVATNLERGTEM

SEQ ID NO: 39718 - protein, 30 aa, Artificial Sequence
  Description of Artificial Sequence: Synthetic polypeptide
DESEICTTNPVATEQYGSVATNLERGNQDM

SEQ ID NO: 39719 - protein, 30 aa, Artificial Sequence
  Description of Artificial Sequence: Synthetic polypeptide
DEEEIRTTNPVATEQYGTVSTEPQSFGSND

SEQ ID NO: 39720 - protein, 30 aa, Artificial Sequence
  Description of Artificial Sequence: Synthetic polypeptide
DEAEIATTNPVATEQYGSVTTNLQAGGNNH

SEQ ID NO: 39721 - protein, 30 aa, Artificial Sequence
  Description of Artificial Sequence: Synthetic polypeptide
DESEICTTNPVATEQYGSVATNLERGNEHQ

SEQ ID NO: 39722 - protein, 30 aa, Artificial Sequence
  Description of Artificial Sequence: Synthetic polypeptide
DESEICTTNPVATEQYGSVATNLERGNDFP

SEQ ID NO: 39723 - protein, 30 aa, Artificial Sequence
  Description of Artificial Sequence: Synthetic polypeptide
DESEICTTNPVATEQYGSVATNLERGGNES

SEQ ID NO: 39724 - protein, 32 aa, Artificial Sequence
  Description of Artificial Sequence: Synthetic polypeptide
DEEEIRTTNPVATEQYGVVSCTGNLSQRVNNE

SEQ ID NO: 39725 - protein, 30 aa, Artificial Sequence
  Description of Artificial Sequence: Synthetic polypeptide
DESEICTTNPVATEQYGSVATNLENRGNDQ

SEQ ID NO: 39726 - protein, 30 aa, Artificial Sequence
  Description of Artificial Sequence: Synthetic polypeptide
DEEEIRTTNPVATEQYGSVNSTVDERTGEQ

SEQ ID NO: 39727 - protein, 30 aa, Artificial Sequence
  Description of Artificial Sequence: Synthetic polypeptide
DEEEIRTTNPVATEQYGSVNSTVDQYGQEN

SEQ ID NO: 39728 - protein, 29 aa, Artificial Sequence
  Description of Artificial Sequence: Synthetic peptide
DESEICTTNPVATEQYGSVATNLEMGNVD

SEQ ID NO: 39729 - protein, 31 aa, Artificial Sequence
  Description of Artificial Sequence: Synthetic polypeptide
DEEEICTTNPVATEQYGEVSTNLQGGDGNSG

SEQ ID NO: 39730 - protein, 32 aa, Artificial Sequence
  Description of Artificial Sequence: Synthetic polypeptide
DEEEIRTTNPVATEQYGVVSDNLQDMGPNGRQ

SEQ ID NO: 39731 - protein, 28 aa, Artificial Sequence
  Description of Artificial Sequence: Synthetic peptide
DESEICTTNPVATEQYGSVANNLEDGND

SEQ ID NO: 39732 - protein, 29 aa, Artificial Sequence
  Description of Artificial Sequence: Synthetic peptide
DESEICTTNPVATEQWGSVATNLERGNDD

SEQ ID NO: 39733 - protein, 31 aa, Artificial Sequence
  Description of Artificial Sequence: Synthetic polypeptide
DEEEIRTTNPVATEQYGSVNSTNDQGSENND

SEQ ID NO: 39734 - protein, 29 aa, Artificial Sequence
  Description of Artificial Sequence: Synthetic peptide
DESEICTTNPVATEQWGSVATNLERGNDA

SEQ ID NO: 39735 - protein, 30 aa, Artificial Sequence
  Description of Artificial Sequence: Synthetic polypeptide
DEAEIATTNPVATEQYGSVSTVLQHGDGNQ

SEQ ID NO: 39736 - protein, 30 aa, Artificial Sequence
  Description of Artificial Sequence: Synthetic polypeptide
DESEIATTNPVATEVYGSVSTNLQGGPNNH

SEQ ID NO: 39737 - protein, 32 aa, Artificial Sequence
  Description of Artificial Sequence: Synthetic polypeptide
DEEEICTTNPVATEQYGKTVSTNALQRVGNTE

SEQ ID NO: 39738 - protein, 31 aa, Artificial Sequence
  Description of Artificial Sequence: Synthetic polypeptide
DESEIATTNPVATEQYGVVSTNLQRGEDNNL

SEQ ID NO: 39739 - protein, 28 aa, Artificial Sequence
  Description of Artificial Sequence: Synthetic peptide
DETEIATTNPVATDQYGVVSTALQLGND

SEQ ID NO: 39740 - protein, 30 aa, Artificial Sequence
  Description of Artificial Sequence: Synthetic polypeptide
DESEIATTNPVATEQYGSVAATNLERGNDQ

SEQ ID NO: 39741 - protein, 30 aa, Artificial Sequence
  Description of Artificial Sequence: Synthetic polypeptide
DEAEIATTNPVATEQYGSVSTPLQRPNGDP

SEQ ID NO: 39742 - protein, 30 aa, Artificial Sequence
  Description of Artificial Sequence: Synthetic polypeptide
DETEIATTNPVATEQYGSVSAGNDLQNGNQ

SEQ ID NO: 39743 - protein, 30 aa, Artificial Sequence
  Description of Artificial Sequence: Synthetic polypeptide
DEAEIATTNPVATEQYGSVSTPLQRPDNMD

SEQ ID NO: 39744 - protein, 30 aa, Artificial Sequence
  Description of Artificial Sequence: Synthetic polypeptide
DEEEICTTNPVATEHYGAVSTNLQAGESRW

SEQ ID NO: 39745 - protein, 31 aa, Artificial Sequence
  Description of Artificial Sequence: Synthetic polypeptide
DESEIATTNPVATEQYGNVSTNLQGNMGDNR

SEQ ID NO: 39746 - protein, 31 aa, Artificial Sequence
  Description of Artificial Sequence: Synthetic polypeptide
DEEEIRTTNPVATEQYGSVACVNDLQPGDLR

SEQ ID NO: 39747 - protein, 28 aa, Artificial Sequence
  Description of Artificial Sequence: Synthetic peptide
DEEEIASTNPVCTEQYGVVSDNLQSGNQ

SEQ ID NO: 39748 - protein, 28 aa, Artificial Sequence
  Description of Artificial Sequence: Synthetic peptide
DETEIATTNPVATEQYGSVSANDMQGNT

SEQ ID NO: 39749 - protein, 31 aa, Artificial Sequence
  Description of Artificial Sequence: Synthetic polypeptide
DEEEICTTNPVATEEYGSVSTNASARGNNRY

SEQ ID NO: 39750 - protein, 30 aa, Artificial Sequence
  Description of Artificial Sequence: Synthetic polypeptide
DESEIATTNPVATEQYGEVSTNLQGGDPNE

SEQ ID NO: 39751 - protein, 31 aa, Artificial Sequence
  Description of Artificial Sequence: Synthetic polypeptide
DESEIATTNPVATEQYGCVSTNLQRGGDPND

SEQ ID NO: 39752 - protein, 30 aa, Artificial Sequence
  Description of Artificial Sequence: Synthetic polypeptide
DEEEICTTNPVATEHYGSVSTGNDQGGGDR

SEQ ID NO: 39753 - protein, 31 aa, Artificial Sequence
  Description of Artificial Sequence: Synthetic polypeptide
DEEEIRTTNPVATEQYGSVADTWLAQDSDNR

SEQ ID NO: 39754 - protein, 32 aa, Artificial Sequence
  Description of Artificial Sequence: Synthetic polypeptide
DEEEIRTTNPVATEQYGSVADTWLAQRSENRV

SEQ ID NO: 39755 - protein, 29 aa, Artificial Sequence
  Description of Artificial Sequence: Synthetic peptide
DETEIATTNPVATEQYGSVSANNQEQGNE

SEQ ID NO: 39756 - protein, 31 aa, Artificial Sequence
  Description of Artificial Sequence: Synthetic polypeptide
DETEIATTNPVATEQYGSVSTNLNGNTGNDR

SEQ ID NO: 39757 - protein, 29 aa, Artificial Sequence
  Description of Artificial Sequence: Synthetic peptide
DESEIATTNPVATEQWGSASEINEQRGNR

SEQ ID NO: 39758 - protein, 31 aa, Artificial Sequence
  Description of Artificial Sequence: Synthetic polypeptide
DEAEIATTNPVATEQYGSVSTNLQVGDGNEA

SEQ ID NO: 39759 - protein, 28 aa, Artificial Sequence
  Description of Artificial Sequence: Synthetic peptide
DESEIATTNPVATECYGSVATNDQRGDS

SEQ ID NO: 39760 - protein, 31 aa, Artificial Sequence
  Description of Artificial Sequence: Synthetic polypeptide
DETEIATTNPVATEQYGSVSTNLQGGGMNDL

SEQ ID NO: 39761 - protein, 32 aa, Artificial Sequence
  Description of Artificial Sequence: Synthetic polypeptide
DETEIATTNPVATEQYGSVSTNLQGNAGENNR

SEQ ID NO: 39762 - protein, 29 aa, Artificial Sequence
  Description of Artificial Sequence: Synthetic peptide
DESEIATTNPVATECYGSASEINLQRGGR

SEQ ID NO: 39763 - protein, 31 aa, Artificial Sequence
  Description of Artificial Sequence: Synthetic polypeptide
DEEEICTTNPVATECYGSVSTNLQGGGNGNE

SEQ ID NO: 39764 - protein, 31 aa, Artificial Sequence
  Description of Artificial Sequence: Synthetic polypeptide
DETEIATTNPVATEQYGSVSTNLQGNDGNHQ

SEQ ID NO: 39765 - protein, 30 aa, Artificial Sequence
  Description of Artificial Sequence: Synthetic polypeptide
DESEIATTNPVATEAYGSVSTNLQMGDNET

SEQ ID NO: 39766 - protein, 29 aa, Artificial Sequence
  Description of Artificial Sequence: Synthetic peptide
DESEIATTNPVATEQWGSVSDNEQREGNG

SEQ ID NO: 39767 - protein, 29 aa, Artificial Sequence
  Description of Artificial Sequence: Synthetic peptide
DETEIATTNPVATEQYGSVATNLQAANEQ

SEQ ID NO: 39768 - protein, 28 aa, Artificial Sequence
  Description of Artificial Sequence: Synthetic peptide
DESEIATTNPVATEQYGSVANNLEQGNQ

SEQ ID NO: 39769 - protein, 30 aa, Artificial Sequence
  Description of Artificial Sequence: Synthetic polypeptide
DESEIATTNPVATEQYGSVATNLENRGNDH

SEQ ID NO: 39770 - protein, 30 aa, Artificial Sequence
  Description of Artificial Sequence: Synthetic polypeptide
DESEIATTNPVATEQYGSVSTNLSMMGNNE

SEQ ID NO: 39771 - protein, 31 aa, Artificial Sequence
  Description of Artificial Sequence: Synthetic polypeptide
DETEIATTNPVATEHYGEVSTNLQRDGDNPR

SEQ ID NO: 39772 - protein, 29 aa, Artificial Sequence
  Description of Artificial Sequence: Synthetic peptide
DETEIATTNPVATEPYGSVSANLQEQGNQ

SEQ ID NO: 39773 - protein, 32 aa, Artificial Sequence
  Description of Artificial Sequence: Synthetic polypeptide
DEEEICTTNPVATEPYGSTVCCTNLSQRGNNR

SEQ ID NO: 39774 - protein, 32 aa, Artificial Sequence
  Description of Artificial Sequence: Synthetic polypeptide
DESEIATTNPVATEQYGSVSTNLQNDGGENRN

SEQ ID NO: 39775 - protein, 32 aa, Artificial Sequence
  Description of Artificial Sequence: Synthetic polypeptide
DESEIATTNPVATEQYGSVSTNLQGQMGGNER

SEQ ID NO: 39776 - protein, 30 aa, Artificial Sequence
  Description of Artificial Sequence: Synthetic polypeptide
DEEEIRTTNPVATEQYGSVAATNLQHAEPQ

SEQ ID NO: 39777 - protein, 30 aa, Artificial Sequence
  Description of Artificial Sequence: Synthetic polypeptide
DESEIATTNPVATEQYGSVSTNLQDGGQEH

SEQ ID NO: 39778 - protein, 31 aa, Artificial Sequence
  Description of Artificial Sequence: Synthetic polypeptide
DESEIATTNPVATEQYGSVSTNLQDDGGNGH

SEQ ID NO: 39779 - protein, 29 aa, Artificial Sequence
  Description of Artificial Sequence: Synthetic peptide
DETEIATTNPVATEQWGSVSTANLMQGNT

SEQ ID NO: 39780 - protein, 31 aa, Artificial Sequence
  Description of Artificial Sequence: Synthetic polypeptide
DESEIATTNPVATEQYGSVSTNLNGDGGNRH

SEQ ID NO: 39781 - protein, 30 aa, Artificial Sequence
  Description of Artificial Sequence: Synthetic polypeptide
DESEIATTNPVATEQYGSVSTNHSMQGGNT

SEQ ID NO: 39782 - protein, 31 aa, Artificial Sequence
  Description of Artificial Sequence: Synthetic polypeptide
DETEIATTNPVATEQYGNVSTNLQGDGPNER

SEQ ID NO: 39783 - protein, 30 aa, Artificial Sequence
  Description of Artificial Sequence: Synthetic polypeptide
DESEIATTNPVATEQYGSVSTNALSMQGNT

SEQ ID NO: 39784 - protein, 30 aa, Artificial Sequence
  Description of Artificial Sequence: Synthetic polypeptide
DETEIATTNPVATEQYGQVSTNLQGDGNND

SEQ ID NO: 39785 - protein, 29 aa, Artificial Sequence
  Description of Artificial Sequence: Synthetic peptide
DETEIATTNPVATEQYGSVAANDLQNGNE

SEQ ID NO: 39786 - protein, 28 aa, Artificial Sequence
  Description of Artificial Sequence: Synthetic peptide
DETEIATTNPVATEQYGSVAANLMQGND

SEQ ID NO: 39787 - protein, 29 aa, Artificial Sequence
  Description of Artificial Sequence: Synthetic peptide
DESEIATTNPVATEQYGSVATNLERVNDD

SEQ ID NO: 39788 - protein, 30 aa, Artificial Sequence
  Description of Artificial Sequence: Synthetic polypeptide
DESEIATTNPVATEQYGSVATNLERHGNED

SEQ ID NO: 39789 - protein, 30 aa, Artificial Sequence
  Description of Artificial Sequence: Synthetic polypeptide
DESEIATTNPVATEQYGSVATNLERGNVDI

SEQ ID NO: 39790 - protein, 30 aa, Artificial Sequence
  Description of Artificial Sequence: Synthetic polypeptide
DESEIATTNPVATEQYGSVATNLERGNEQA

SEQ ID NO: 39791 - protein, 32 aa, Artificial Sequence
  Description of Artificial Sequence: Synthetic polypeptide
DETEIATTNPVATEQYGSVAITNLQQRGDNRL

SEQ ID NO: 39792 - protein, 31 aa, Artificial Sequence
  Description of Artificial Sequence: Synthetic polypeptide
DEEEIRTTNPVATEQYGSVNSVTNLDRTDEG

SEQ ID NO: 39793 - protein, 30 aa, Artificial Sequence
  Description of Artificial Sequence: Synthetic polypeptide
DETEIATTNPVATEQYGSVATNLDRGDNED

SEQ ID NO: 39794 - protein, 30 aa, Artificial Sequence
  Description of Artificial Sequence: Synthetic polypeptide
DESEIATTNPVATEQYGSVATNLERGENDE

SEQ ID NO: 39795 - protein, 30 aa, Artificial Sequence
  Description of Artificial Sequence: Synthetic polypeptide
DESEIATTNPVATEQYGSVATNLERGDNPD

SEQ ID NO: 39796 - protein, 30 aa, Artificial Sequence
  Description of Artificial Sequence: Synthetic polypeptide
DETEIATTNPVATEQYGSVATNLERDGNQF

SEQ ID NO: 39797 - protein, 30 aa, Artificial Sequence
  Description of Artificial Sequence: Synthetic polypeptide
DESEIATTNPVATEQYGSVSTVLEHGGNDR

SEQ ID NO: 39798 - protein, 30 aa, Artificial Sequence
  Description of Artificial Sequence: Synthetic polypeptide
DESEICTTNPVATEQYGSVSTNELSMSGNT

SEQ ID NO: 39799 - protein, 32 aa, Artificial Sequence
  Description of Artificial Sequence: Synthetic polypeptide
DEEEIRTTNPVATEQYGTVSTGNLQAFGSNQS

SEQ ID NO: 39800 - protein, 30 aa, Artificial Sequence
  Description of Artificial Sequence: Synthetic polypeptide
DESEICTTNPVATEQYGSVSTNNDHGGDNR

SEQ ID NO: 39801 - protein, 32 aa, Artificial Sequence
  Description of Artificial Sequence: Synthetic polypeptide
DEEEIRTTNPVATEQYGVVCSTPELQRGGSNA

SEQ ID NO: 39802 - protein, 30 aa, Artificial Sequence
  Description of Artificial Sequence: Synthetic polypeptide
DESEIRTTNPVATDQYGSTVNTGLQRGGND

SEQ ID NO: 39803 - protein, 30 aa, Artificial Sequence
  Description of Artificial Sequence: Synthetic polypeptide
DESEIRTTNPVATDQYGQCVSTNLERGGNP

SEQ ID NO: 39804 - protein, 29 aa, Artificial Sequence
  Description of Artificial Sequence: Synthetic peptide
DESEIRTTNPVATDQYGKVNTQLQRGGND

SEQ ID NO: 39805 - protein, 30 aa, Artificial Sequence
  Description of Artificial Sequence: Synthetic polypeptide
DESEIRTTNPVATDHYGSVSTNMLAQRVNM

SEQ ID NO: 39806 - protein, 30 aa, Artificial Sequence
  Description of Artificial Sequence: Synthetic polypeptide
AESEIRTTNPVATEQYGEVSCNLQDRGEGR

SEQ ID NO: 39807 - protein, 30 aa, Artificial Sequence
  Description of Artificial Sequence: Synthetic polypeptide
AESEIRTTNPVATEQYGEVSCNEQDRGENR

SEQ ID NO: 39808 - protein, 29 aa, Artificial Sequence
  Description of Artificial Sequence: Synthetic peptide
DESEIRTTNPVATDHYGSVSTNLQHTNEQ

SEQ ID NO: 39809 - protein, 29 aa, Artificial Sequence
  Description of Artificial Sequence: Synthetic peptide
DESEIRTTNPVATDHYGSVSTNLQGNTNM

SEQ ID NO: 39810 - protein, 30 aa, Artificial Sequence
  Description of Artificial Sequence: Synthetic polypeptide
DESEIRTTNPVATDHYGSVSTNLQGDEGNM

SEQ ID NO: 39811 - protein, 29 aa, Artificial Sequence
  Description of Artificial Sequence: Synthetic peptide
DESVIRTTNPVATEQYGCVATNPQGMGNR

SEQ ID NO: 39812 - protein, 30 aa, Artificial Sequence
  Description of Artificial Sequence: Synthetic polypeptide
DESEIRTTNPVATDHWGSVSTNLQRQEGNM

SEQ ID NO: 39813 - protein, 30 aa, Artificial Sequence
  Description of Artificial Sequence: Synthetic polypeptide
DESEIRTTNPVATDQYGSVNCTPLQRGGND

SEQ ID NO: 39814 - protein, 28 aa, Artificial Sequence
  Description of Artificial Sequence: Synthetic peptide
DESVIRTTNPVATEQYGCVATNPQMGNE

SEQ ID NO: 39815 - protein, 28 aa, Artificial Sequence
  Description of Artificial Sequence: Synthetic peptide
DESEIRTTNPVATDHWGSVSTNLQHENM

SEQ ID NO: 39816 - protein, 32 aa, Artificial Sequence
  Description of Artificial Sequence: Synthetic polypeptide
DEEEIRTTNPVATEQYGSVNSTNFHQERDMIR

SEQ ID NO: 39817 - protein, 29 aa, Artificial Sequence
  Description of Artificial Sequence: Synthetic peptide
DESEIRTTNPVATCHYGSVSTNLQNTNQQ

SEQ ID NO: 39818 - protein, 31 aa, Artificial Sequence
  Description of Artificial Sequence: Synthetic polypeptide
DEEEIRTTNPVATEQYGVVCSTYDQFGSNRA

SEQ ID NO: 39819 - protein, 29 aa, Artificial Sequence
  Description of Artificial Sequence: Synthetic peptide
DESEIRTTNPVATCHYGSVSTNHQRTNQG

SEQ ID NO: 39820 - protein, 29 aa, Artificial Sequence
  Description of Artificial Sequence: Synthetic peptide
DESVIRTTNPVATEQYGCVTTNPGQMGNR

SEQ ID NO: 39821 - protein, 30 aa, Artificial Sequence
  Description of Artificial Sequence: Synthetic polypeptide
DEAEIATTNPVAYEQWGSVSTNLQNGGENR

SEQ ID NO: 39822 - protein, 28 aa, Artificial Sequence
  Description of Artificial Sequence: Synthetic peptide
DESVIRTTNPVATEQYGCVTTNPQDGNV

SEQ ID NO: 39823 - protein, 30 aa, Artificial Sequence
  Description of Artificial Sequence: Synthetic polypeptide
DEAEIATTNPVATERYGSVATNLQSGDNQR

SEQ ID NO: 39824 - protein, 28 aa, Artificial Sequence
  Description of Artificial Sequence: Synthetic peptide
DESEIRTTNPVATCHYGSVSTELQRTQQ

SEQ ID NO: 39825 - protein, 28 aa, Artificial Sequence
  Description of Artificial Sequence: Synthetic peptide
DEAEIATTNPVATEQYGVVSTTLQRPDD

SEQ ID NO: 39826 - protein, 29 aa, Artificial Sequence
  Description of Artificial Sequence: Synthetic peptide
DEAEIATTNPVATEQYGVVSTNLQHGDVE

SEQ ID NO: 39827 - protein, 29 aa, Artificial Sequence
  Description of Artificial Sequence: Synthetic peptide
DESVIRTTNPVATEQYGCVATNPQTRGNQ

SEQ ID NO: 39828 - protein, 29 aa, Artificial Sequence
  Description of Artificial Sequence: Synthetic peptide
DESEIRTTNPVATDQYGSVNTGLQGNGND

SEQ ID NO: 39829 - protein, 30 aa, Artificial Sequence
  Description of Artificial Sequence: Synthetic polypeptide
DESEIRTTNPVATDQYGSVNTGLQRNGNED

SEQ ID NO: 39830 - protein, 32 aa, Artificial Sequence
  Description of Artificial Sequence: Synthetic polypeptide
DEEEIRTTNPVATEQYGVVCSTNLQRFGSDIT

SEQ ID NO: 39831 - protein, 30 aa, Artificial Sequence
  Description of Artificial Sequence: Synthetic polypeptide
DESEIRTTNPVATEAYGSTVSNNLSQRGTQ

SEQ ID NO: 39832 - protein, 31 aa, Artificial Sequence
  Description of Artificial Sequence: Synthetic polypeptide
DEEEIRTTNPVATEQYGVVCSTNDTQNGSNQ

SEQ ID NO: 39833 - protein, 32 aa, Artificial Sequence
  Description of Artificial Sequence: Synthetic polypeptide
DEEEIRTTNPVATEQYGSVNSTNIEQNQNEER

SEQ ID NO: 39834 - protein, 32 aa, Artificial Sequence
  Description of Artificial Sequence: Synthetic polypeptide
DEEEIRTTNPVATEQYGSVNSTNIDDRNGEDR

SEQ ID NO: 39835 - protein, 32 aa, Artificial Sequence
  Description of Artificial Sequence: Synthetic polypeptide
DESEIRTTNPVATEAYGCVCSCTNLSQRGGNR

SEQ ID NO: 39836 - protein, 29 aa, Artificial Sequence
  Description of Artificial Sequence: Synthetic peptide
DESEIRTTNPVATDTYGSVSTNLQRTVVD

SEQ ID NO: 39837 - protein, 34 aa, Artificial Sequence
  Description of Artificial Sequence: Synthetic polypeptide
DEEEIRTTNPVATEQYGSTTSYTGNLSQRPGGNR

SEQ ID NO: 39838 - protein, 31 aa, Artificial Sequence
  Description of Artificial Sequence: Synthetic polypeptide
DEEEIRTTNPVATEQYGVVCSTNHQSNSNRT

SEQ ID NO: 39839 - protein, 30 aa, Artificial Sequence
  Description of Artificial Sequence: Synthetic polypeptide
DESEIRTTNPVATDSYGSVSTNLQRTTNMG

SEQ ID NO: 39840 - protein, 30 aa, Artificial Sequence
  Description of Artificial Sequence: Synthetic polypeptide
DESEIRTTNPVATDSYGSVSTNLQRTNNEM

SEQ ID NO: 39841 - protein, 33 aa, Artificial Sequence
  Description of Artificial Sequence: Synthetic polypeptide
DEEEIRTTNPVATEQYGSTSYTGNLSQTTGGNR

SEQ ID NO: 39842 - protein, 30 aa, Artificial Sequence
  Description of Artificial Sequence: Synthetic polypeptide
DESEIRTTNPVATDSYGSVSTNLQRMTINM

SEQ ID NO: 39843 - protein, 29 aa, Artificial Sequence
  Description of Artificial Sequence: Synthetic peptide
DESEIRTTNPVATDSYGSVSTNLQFTNGM

SEQ ID NO: 39844 - protein, 28 aa, Artificial Sequence
  Description of Artificial Sequence: Synthetic peptide
DESEIRTTNPVATDSYGSVSTNGQETNM

SEQ ID NO: 39845 - protein, 29 aa, Artificial Sequence
  Description of Artificial Sequence: Synthetic peptide
DESVIKTTNPVATEQWGTVSTDFLQRGNR

SEQ ID NO: 39846 - protein, 32 aa, Artificial Sequence
  Description of Artificial Sequence: Synthetic polypeptide
DEEEIRTTNPVATEQYGVVCSTNLDQRGSDQY

SEQ ID NO: 39847 - protein, 30 aa, Artificial Sequence
  Description of Artificial Sequence: Synthetic polypeptide
DEEEICTTNPVATEQYGSVATNWQRIENLP

SEQ ID NO: 39848 - protein, 31 aa, Artificial Sequence
  Description of Artificial Sequence: Synthetic polypeptide
DEEEIRTTNPVATEQYGTVSTNNLGVGGNNG

SEQ ID NO: 39849 - protein, 31 aa, Artificial Sequence
  Description of Artificial Sequence: Synthetic polypeptide
DEEEICTTNPVATEQYGSVATNQLQESMGNL

SEQ ID NO: 39850 - protein, 32 aa, Artificial Sequence
  Description of Artificial Sequence: Synthetic polypeptide
DEEEIRTTNPVATEQYGVVCSTNLHQGFGSNQ

SEQ ID NO: 39851 - protein, 30 aa, Artificial Sequence
  Description of Artificial Sequence: Synthetic polypeptide
DEEEIRTTNPVATEQYGSVNSTTNDRGEGM

SEQ ID NO: 39852 - protein, 31 aa, Artificial Sequence
  Description of Artificial Sequence: Synthetic polypeptide
DEEEICTTNPVATEQYGSVATNLTQGGNGDD

SEQ ID NO: 39853 - protein, 31 aa, Artificial Sequence
  Description of Artificial Sequence: Synthetic polypeptide
DEEEIRTTNPVATEQYGVVCSTNLQGFGDAT

SEQ ID NO: 39854 - protein, 30 aa, Artificial Sequence
  Description of Artificial Sequence: Synthetic polypeptide
DEAEIATTNPVATETYGSVSTNLQAGGNAM

SEQ ID NO: 39855 - protein, 31 aa, Artificial Sequence
  Description of Artificial Sequence: Synthetic polypeptide
DEEEIRTTNPVATEQYGVVCSTNLQNFNSEQ

SEQ ID NO: 39856 - protein, 31 aa, Artificial Sequence
  Description of Artificial Sequence: Synthetic polypeptide
DEAEIATTNPVATESYGSVSTNLQFGEDGNR

SEQ ID NO: 39857 - protein, 30 aa, Artificial Sequence
  Description of Artificial Sequence: Synthetic polypeptide
DESVIRTTNPVATEQYGCVATNPQARGNDR

SEQ ID NO: 39858 - protein, 31 aa, Artificial Sequence
  Description of Artificial Sequence: Synthetic polypeptide
DEEEICTTNPVATEQYGSVATNLQRANNNLA

SEQ ID NO: 39859 - protein, 31 aa, Artificial Sequence
  Description of Artificial Sequence: Synthetic polypeptide
DEAEIATTNPVATEQYGVVSTNLQGNEGNPR

SEQ ID NO: 39860 - protein, 31 aa, Artificial Sequence
  Description of Artificial Sequence: Synthetic polypeptide
DEEEICTTNPVAYEQYGSVSTNEPSQRVGNT

SEQ ID NO: 39861 - protein, 31 aa, Artificial Sequence
  Description of Artificial Sequence: Synthetic polypeptide
DEEEIRTTNPVATEQYGSVNSTNEQEMGQDA

SEQ ID NO: 39862 - protein, 32 aa, Artificial Sequence
  Description of Artificial Sequence: Synthetic polypeptide
DEEEIRTTNPVATEQYGSVNSTNDVRGDNVVV

SEQ ID NO: 39863 - protein, 32 aa, Artificial Sequence
  Description of Artificial Sequence: Synthetic polypeptide
DEEEIRTTNPVATEQYGTVSTLNLQFGNGNSN

SEQ ID NO: 39864 - protein, 29 aa, Artificial Sequence
  Description of Artificial Sequence: Synthetic peptide
DESEIRCTNPISTEQYGSVAAENLQRGNR

SEQ ID NO: 39865 - protein, 31 aa, Artificial Sequence
  Description of Artificial Sequence: Synthetic polypeptide
DEEEIRTTNPVATEQYGVVITFNLQSEGNFG

SEQ ID NO: 39866 - protein, 30 aa, Artificial Sequence
  Description of Artificial Sequence: Synthetic polypeptide
DEEEICTTNPVATEQYGSVAATNLERGETD

SEQ ID NO: 39867 - protein, 33 aa, Artificial Sequence
  Description of Artificial Sequence: Synthetic polypeptide
DEEEIRTTNPVATEQYGSVNSTTNNDDQRGDRI

SEQ ID NO: 39868 - protein, 28 aa, Artificial Sequence
  Description of Artificial Sequence: Synthetic peptide
DESEIRCTNPIATEQYGSVSENEMRGNG

SEQ ID NO: 39869 - protein, 29 aa, Artificial Sequence
  Description of Artificial Sequence: Synthetic peptide
DEAEIATTNPVATEQYGSVVTNLQVGDVQ

SEQ ID NO: 39870 - protein, 32 aa, Artificial Sequence
  Description of Artificial Sequence: Synthetic polypeptide
DEEEIRTTNPVATEQYGSVNSTNDQRVETNEG

SEQ ID NO: 39871 - protein, 28 aa, Artificial Sequence
  Description of Artificial Sequence: Synthetic peptide
DESEIRCTNPIATEQYGNVSENIMRGNR

SEQ ID NO: 39872 - protein, 28 aa, Artificial Sequence
  Description of Artificial Sequence: Synthetic peptide
DESEIGTTNPVAYEPYGSVATNLQDGND

SEQ ID NO: 39873 - protein, 32 aa, Artificial Sequence
  Description of Artificial Sequence: Synthetic polypeptide
DEEEIRTTNPVATEQYGSTSTTTNLNQGIGNN

SEQ ID NO: 39874 - protein, 31 aa, Artificial Sequence
  Description of Artificial Sequence: Synthetic polypeptide
DESEIGTTNPVATEQYGSVSANQLQEREGNL

SEQ ID NO: 39875 - protein, 32 aa, Artificial Sequence
  Description of Artificial Sequence: Synthetic polypeptide
DEEEIRTTNPVATEQYGSTSTTQNLQQGIGNG

SEQ ID NO: 39876 - protein, 32 aa, Artificial Sequence
  Description of Artificial Sequence: Synthetic polypeptide
DEEEIRTTNPVATEQYGTVSTGNLQHFGSERM

SEQ ID NO: 39877 - protein, 30 aa, Artificial Sequence
  Description of Artificial Sequence: Synthetic polypeptide
DESEIGTTNPVATEQYGCVSTNLNQAGSNG

SEQ ID NO: 39878 - protein, 29 aa, Artificial Sequence
  Description of Artificial Sequence: Synthetic peptide
DETAICTTNPVATEQWGSVSTDTLQRGNA

SEQ ID NO: 39879 - protein, 31 aa, Artificial Sequence
  Description of Artificial Sequence: Synthetic polypeptide
DEEEICTTNPVATEQYGSCATNPLDQMGNRV

SEQ ID NO: 39880 - protein, 29 aa, Artificial Sequence
  Description of Artificial Sequence: Synthetic peptide
DESEICTVNPVATEQYGSVSTTNLFEGNN

SEQ ID NO: 39881 - protein, 29 aa, Artificial Sequence
  Description of Artificial Sequence: Synthetic peptide
DESEICTVNPVATEQYGSVSTNNLFEGNH

SEQ ID NO: 39882 - protein, 30 aa, Artificial Sequence
  Description of Artificial Sequence: Synthetic polypeptide
DETAICTTNPVATEQYGSVSSTNLIIGTNR

SEQ ID NO: 39883 - protein, 32 aa, Artificial Sequence
  Description of Artificial Sequence: Synthetic polypeptide
DEEEIRTTNPVATEQYGSVNSTNDQRSLNDQI

SEQ ID NO: 39884 - protein, 32 aa, Artificial Sequence
  Description of Artificial Sequence: Synthetic polypeptide
DEAEIATTNPVATEQYGSVVATNLQDRPGENR

SEQ ID NO: 39885 - protein, 31 aa, Artificial Sequence
  Description of Artificial Sequence: Synthetic polypeptide
DEEEICTTNPVATEQYGNVSTNLQGGGNGNA

SEQ ID NO: 39886 - protein, 28 aa, Artificial Sequence
  Description of Artificial Sequence: Synthetic peptide
DETAIRTTNPCATEQWGSVSFNLQSGDR

SEQ ID NO: 39887 - protein, 30 aa, Artificial Sequence
  Description of Artificial Sequence: Synthetic polypeptide
DEEEIRTTNPVATEQYGSVAANLQDPNGEH

SEQ ID NO: 39888 - protein, 32 aa, Artificial Sequence
  Description of Artificial Sequence: Synthetic polypeptide
DEEEIRTTNPVATEQYGSTSTTENLNQGEGNI

SEQ ID NO: 39889 - protein, 29 aa, Artificial Sequence
  Description of Artificial Sequence: Synthetic peptide
DEEEICTTNPVATEQYGSVATNDERNNEP

SEQ ID NO: 39890 - protein, 32 aa, Artificial Sequence
  Description of Artificial Sequence: Synthetic polypeptide
DEEEIRTTNPVATEQYGVVSTSNLQGSGNFGG

SEQ ID NO: 39891 - protein, 32 aa, Artificial Sequence
  Description of Artificial Sequence: Synthetic polypeptide
DEEEIRTTNPVATEQYGVVGVSTNLQRSGMEF

SEQ ID NO: 39892 - protein, 31 aa, Artificial Sequence
  Description of Artificial Sequence: Synthetic polypeptide
DEEEIRTTNPVATEQYGTVSTNDQNGGSNQS

SEQ ID NO: 39893 - protein, 30 aa, Artificial Sequence
  Description of Artificial Sequence: Synthetic polypeptide
DESEIRTTNPVATCHYGSVSNTNLQRSTNQ

SEQ ID NO: 39894 - protein, 30 aa, Artificial Sequence
  Description of Artificial Sequence: Synthetic polypeptide
DEAEIATTNPVATEQYGTVSTNLQGNGDPR

SEQ ID NO: 39895 - protein, 31 aa, Artificial Sequence
  Description of Artificial Sequence: Synthetic polypeptide
DEEEICTTNPVATEQYGSVATNLQQEENPRE

SEQ ID NO: 39896 - protein, 30 aa, Artificial Sequence
  Description of Artificial Sequence: Synthetic polypeptide
DESEIRTTNPVATCHYGSVCSTNLQERTNA

SEQ ID NO: 39897 - protein, 31 aa, Artificial Sequence
  Description of Artificial Sequence: Synthetic polypeptide
DEEEICTTNPVATEQYGSVATNLQNDGNDFE

SEQ ID NO: 39898 - protein, 30 aa, Artificial Sequence
  Description of Artificial Sequence: Synthetic polypeptide
DEAEIATTNPVATEQYGTVSATNLNRGNEL

SEQ ID NO: 39899 - protein, 30 aa, Artificial Sequence
  Description of Artificial Sequence: Synthetic polypeptide
DEEEICTTNPVATEQYGSVATNLQHGDETM

SEQ ID NO: 39900 - protein, 31 aa, Artificial Sequence
  Description of Artificial Sequence: Synthetic polypeptide
DEEEICTTNPVAYEQYGSVSTNPQGEDGNER

SEQ ID NO: 39901 - protein, 29 aa, Artificial Sequence
  Description of Artificial Sequence: Synthetic peptide
DESVIRTTNPVATEQYGCVTTNPQGNGNR

SEQ ID NO: 39902 - protein, 29 aa, Artificial Sequence
  Description of Artificial Sequence: Synthetic peptide
DESVIRTTNPVATEQYGCVTTNPQRDGDR

SEQ ID NO: 39903 - protein, 31 aa, Artificial Sequence
  Description of Artificial Sequence: Synthetic polypeptide
DEEEIRTTNPVATEQYGTVSTNLNVVGNGGD

SEQ ID NO: 39904 - protein, 29 aa, Artificial Sequence
  Description of Artificial Sequence: Synthetic peptide
DESEIRTTNPIATEQYGSVSCNEPMRGNG

SEQ ID NO: 39905 - protein, 31 aa, Artificial Sequence
  Description of Artificial Sequence: Synthetic polypeptide
DEEEIRTTNPVATEQYGSVNSTNEQATENGD

SEQ ID NO: 39906 - protein, 30 aa, Artificial Sequence
  Description of Artificial Sequence: Synthetic polypeptide
DESEIRTTNPCATEQYGSVSTELEEPDGNR

SEQ ID NO: 39907 - protein, 28 aa, Artificial Sequence
  Description of Artificial Sequence: Synthetic peptide
DESEIRSTNPVCTEQWGVVSDNLQRGNG

SEQ ID NO: 39908 - protein, 31 aa, Artificial Sequence
  Description of Artificial Sequence: Synthetic polypeptide
DEEEICTTNPVATEQYGSVATNLQEAGNNPM

SEQ ID NO: 39909 - protein, 31 aa, Artificial Sequence
  Description of Artificial Sequence: Synthetic polypeptide
DEEEICTTNPVATEQYGSVATNLQDQGGNEN

SEQ ID NO: 39910 - protein, 30 aa, Artificial Sequence
  Description of Artificial Sequence: Synthetic polypeptide
DEEEICTTNPVATEQYGSVATNLQDDPNMF

SEQ ID NO: 39911 - protein, 32 aa, Artificial Sequence
  Description of Artificial Sequence: Synthetic polypeptide
DEEEIRTTNPVATEQYGSVNSTNEDQEQNEER

SEQ ID NO: 39912 - protein, 29 aa, Artificial Sequence
  Description of Artificial Sequence: Synthetic peptide
DESEIRSTNPIATEQYGSVSAETIQRGNR

SEQ ID NO: 39913 - protein, 30 aa, Artificial Sequence
  Description of Artificial Sequence: Synthetic polypeptide
DEEEICTTNPVAYEQYGSVSTNPQGEHGNA

SEQ ID NO: 39914 - protein, 29 aa, Artificial Sequence
  Description of Artificial Sequence: Synthetic peptide
DESEIRSTNPIATEQYGSVSAENIMRGNR

SEQ ID NO: 39915 - protein, 31 aa, Artificial Sequence
  Description of Artificial Sequence: Synthetic polypeptide
DEEEICTTNPVATEQYGSVATNLERGDNEIE

SEQ ID NO: 39916 - protein, 32 aa, Artificial Sequence
  Description of Artificial Sequence: Synthetic polypeptide
DEEEIRTTNPVATEQYGVVGSDTNLQTGGGNI

SEQ ID NO: 39917 - protein, 30 aa, Artificial Sequence
  Description of Artificial Sequence: Synthetic polypeptide
DEEEICTTNPVATEQYGSVATNLERDENEM

SEQ ID NO: 39918 - protein, 31 aa, Artificial Sequence
  Description of Artificial Sequence: Synthetic polypeptide
DEEEICTTNPVAYEQYGSVSTTANLQETGNE

SEQ ID NO: 39919 - protein, 31 aa, Artificial Sequence
  Description of Artificial Sequence: Synthetic polypeptide
DEEEICTTNPVATEQYGSVATNLARDGDNQL

SEQ ID NO: 39920 - protein, 29 aa, Artificial Sequence
  Description of Artificial Sequence: Synthetic peptide
DEEEICTTNPVATEQYGSVATNDTSGNVD

SEQ ID NO: 39921 - protein, 32 aa, Artificial Sequence
  Description of Artificial Sequence: Synthetic polypeptide
CEEEIRTTNPVATEQYGCVCSTNLQERGSNVS

SEQ ID NO: 39922 - protein, 32 aa, Artificial Sequence
  Description of Artificial Sequence: Synthetic polypeptide
DEEEIRTTNPVATEQYGVVSTNLEQVQGNNMD

SEQ ID NO: 39923 - protein, 30 aa, Artificial Sequence
  Description of Artificial Sequence: Synthetic polypeptide
DEVEIATTNPVATEPYGSVSTNLQHQNGER

SEQ ID NO: 39924 - protein, 29 aa, Artificial Sequence
  Description of Artificial Sequence: Synthetic peptide
DENEIRTTNPVATEQYGDVSENEMNRGNA

SEQ ID NO: 39925 - protein, 31 aa, Artificial Sequence
  Description of Artificial Sequence: Synthetic polypeptide
DEEEIRTTNPVATEQYGYTISWTPELQRGQR

SEQ ID NO: 39926 - protein, 30 aa, Artificial Sequence
  Description of Artificial Sequence: Synthetic polypeptide
DEEEIRTTNPVATEQYGYTITTNELQRGEG

SEQ ID NO: 39927 - protein, 32 aa, Artificial Sequence
  Description of Artificial Sequence: Synthetic polypeptide
DEEEIRTTNPVATEQYGSVCNTFNDSGRGNTR

SEQ ID NO: 39928 - protein, 32 aa, Artificial Sequence
  Description of Artificial Sequence: Synthetic polypeptide
DEEEIRTTNPVATEQYGSVCNTFNELDGRGTR

SEQ ID NO: 39929 - protein, 31 aa, Artificial Sequence
  Description of Artificial Sequence: Synthetic polypeptide
DEEEIATTNPVATEAYGSVSTNNQRNGDNDG

SEQ ID NO: 39930 - protein, 32 aa, Artificial Sequence
  Description of Artificial Sequence: Synthetic polypeptide
DEEEIRTTNPVATEQYGYVGSTDNLQDGNGNA

SEQ ID NO: 39931 - protein, 32 aa, Artificial Sequence
  Description of Artificial Sequence: Synthetic polypeptide
DEEEIATTNPVATEAYGSVVASTNSSQRGGNR

SEQ ID NO: 39932 - protein, 29 aa, Artificial Sequence
  Description of Artificial Sequence: Synthetic peptide
DEVEIATTNPVATEQYGSVATNLQVDNSE

SEQ ID NO: 39933 - protein, 30 aa, Artificial Sequence
  Description of Artificial Sequence: Synthetic polypeptide
DEAEIATTNPVSTEQYGSVSTNLQDGNDFP

SEQ ID NO: 39934 - protein, 32 aa, Artificial Sequence
  Description of Artificial Sequence: Synthetic polypeptide
DEEEIRTTNPVATEQYGSVCNTFNLDGRGGDR

SEQ ID NO: 39935 - protein, 32 aa, Artificial Sequence
  Description of Artificial Sequence: Synthetic polypeptide
DEEEIRTTNPVATEQYGSYYSTNCIQKCSGNR

SEQ ID NO: 39936 - protein, 31 aa, Artificial Sequence
  Description of Artificial Sequence: Synthetic polypeptide
DENEIRTTNPVATEQYGCVSWTNLNPGMNDR

SEQ ID NO: 39937 - protein, 30 aa, Artificial Sequence
  Description of Artificial Sequence: Synthetic polypeptide
DEEEIRTTNPVATEQYGSVNTNNQRDSIEV

SEQ ID NO: 39938 - protein, 30 aa, Artificial Sequence
  Description of Artificial Sequence: Synthetic polypeptide
DEVEIATTNPVATEQYGSVSGTAPLQRPNV

SEQ ID NO: 39939 - protein, 32 aa, Artificial Sequence
  Description of Artificial Sequence: Synthetic polypeptide
DEEEIATTNPVATEAYGSVVSCTNLSQRGNYA

SEQ ID NO: 39940 - protein, 28 aa, Artificial Sequence
  Description of Artificial Sequence: Synthetic peptide
AENEIATTNPVATEQYGEASENLQRGGR

SEQ ID NO: 39941 - protein, 31 aa, Artificial Sequence
  Description of Artificial Sequence: Synthetic polypeptide
DEEEIATTNPVATEAYGTVPSTNPSQRPGNR

SEQ ID NO: 39942 - protein, 28 aa, Artificial Sequence
  Description of Artificial Sequence: Synthetic peptide
AENEIATTNPVATEQYGEASENLQRGER

SEQ ID NO: 39943 - protein, 31 aa, Artificial Sequence
  Description of Artificial Sequence: Synthetic polypeptide
DEEEIRTTNPVATEQYGSNSTGSLQRSDEDR

SEQ ID NO: 39944 - protein, 30 aa, Artificial Sequence
  Description of Artificial Sequence: Synthetic polypeptide
DEVEIATTNPVATEQYGSVSTNLGDFGNNN

SEQ ID NO: 39945 - protein, 33 aa, Artificial Sequence
  Description of Artificial Sequence: Synthetic polypeptide
DEEEIRTTNPVATEQYGSYVPTNLNRQGNNERT

SEQ ID NO: 39946 - protein, 32 aa, Artificial Sequence
  Description of Artificial Sequence: Synthetic polypeptide
DEEEIRTTNPVATEQYGSVCNTFNLEGRDGTR

SEQ ID NO: 39947 - protein, 30 aa, Artificial Sequence
  Description of Artificial Sequence: Synthetic polypeptide
DENEIRTTNPVATEQYGCVSTNLDQDTEGR

SEQ ID NO: 39948 - protein, 30 aa, Artificial Sequence
  Description of Artificial Sequence: Synthetic polypeptide
DENEIRTTNPVATEQYGCVSTYLQHGSNQP

SEQ ID NO: 39949 - protein, 30 aa, Artificial Sequence
  Description of Artificial Sequence: Synthetic polypeptide
DEEEIRTTNPVATEQYGSYYTPNLQRNEEG

SEQ ID NO: 39950 - protein, 31 aa, Artificial Sequence
  Description of Artificial Sequence: Synthetic polypeptide
DEEEIRTTNPVATEQYGYTISTNMGQRGNGE

SEQ ID NO: 39951 - protein, 30 aa, Artificial Sequence
  Description of Artificial Sequence: Synthetic polypeptide
DEVEIATTNPVATEQYGSVATNLQREGHMV

SEQ ID NO: 39952 - protein, 28 aa, Artificial Sequence
  Description of Artificial Sequence: Synthetic peptide
AENEIATTNPVATEQYGEVSENLQRGEL

SEQ ID NO: 39953 - protein, 31 aa, Artificial Sequence
  Description of Artificial Sequence: Synthetic polypeptide
DEEEIRTTNPVATEQYGTASTQNPLQRMENN

SEQ ID NO: 39954 - protein, 32 aa, Artificial Sequence
  Description of Artificial Sequence: Synthetic polypeptide
DEEEIRTTNPVATEQYGSVCNTANLLGRGETR

SEQ ID NO: 39955 - protein, 32 aa, Artificial Sequence
  Description of Artificial Sequence: Synthetic polypeptide
DEEEIATTNPVATEAYGQSVSCTNLSPRGGNR

SEQ ID NO: 39956 - protein, 30 aa, Artificial Sequence
  Description of Artificial Sequence: Synthetic polypeptide
DEAEIATTNPVATEQYGSVAATNLQDGNNQ

SEQ ID NO: 39957 - protein, 30 aa, Artificial Sequence
  Description of Artificial Sequence: Synthetic polypeptide
DEEEIRTTNPVATEQYGTASTANPLQSENN

SEQ ID NO: 39958 - protein, 31 aa, Artificial Sequence
  Description of Artificial Sequence: Synthetic polypeptide
DEEEIATTNPVATEAYGSTVSCTDLSQRVNR

SEQ ID NO: 39959 - protein, 29 aa, Artificial Sequence
  Description of Artificial Sequence: Synthetic peptide
DENEIRTTNPVATEQYGSCSTNLEGEGDD

SEQ ID NO: 39960 - protein, 29 aa, Artificial Sequence
  Description of Artificial Sequence: Synthetic peptide
DENEIRTTNPVATEQYGSCSTNDQIGGDQ

SEQ ID NO: 39961 - protein, 32 aa, Artificial Sequence
  Description of Artificial Sequence: Synthetic polypeptide
DEEEIRTTNPVATEQYGYTISSNELEQRGVNR

SEQ ID NO: 39962 - protein, 29 aa, Artificial Sequence
  Description of Artificial Sequence: Synthetic peptide
DEVEIATTNPVATEQYGSVATNLQHAENE

SEQ ID NO: 39963 - protein, 29 aa, Artificial Sequence
  Description of Artificial Sequence: Synthetic peptide
DEAEIATTNPVATEQYGSVAATNLERGVD

SEQ ID NO: 39964 - protein, 30 aa, Artificial Sequence
  Description of Artificial Sequence: Synthetic polypeptide
DENEIRTTNPVATEQYGSASTNTQQEGVLR

SEQ ID NO: 39965 - protein, 33 aa, Artificial Sequence
  Description of Artificial Sequence: Synthetic polypeptide
DEEEIATTNPVATEAYGSTVSVTNLSQRGGNRQ

SEQ ID NO: 39966 - protein, 29 aa, Artificial Sequence
  Description of Artificial Sequence: Synthetic peptide
DENEIRTTNPVATEQYGSASTNQQQEVLR

SEQ ID NO: 39967 - protein, 29 aa, Artificial Sequence
  Description of Artificial Sequence: Synthetic peptide
DEVEIATTNPVATEQYGSVATNLQHDNPE

SEQ ID NO: 39968 - protein, 31 aa, Artificial Sequence
  Description of Artificial Sequence: Synthetic polypeptide
DEEEIRTTNPVATEQYGSVCNTDNLDGRGTQ

SEQ ID NO: 39969 - protein, 32 aa, Artificial Sequence
  Description of Artificial Sequence: Synthetic polypeptide
DENEIRTTNPVATEQYGHVYSWTNLNRGENRD

SEQ ID NO: 39970 - protein, 29 aa, Artificial Sequence
  Description of Artificial Sequence: Synthetic peptide
DEEEIATTNPVAYEQYGSVATADQRGNEA

SEQ ID NO: 39971 - protein, 30 aa, Artificial Sequence
  Description of Artificial Sequence: Synthetic polypeptide
DEVEIATTNPVATEQYGSVATNLQMGNDEE

SEQ ID NO: 39972 - protein, 31 aa, Artificial Sequence
  Description of Artificial Sequence: Synthetic polypeptide
DEEEIRTTNPVATEQYGSVCNTENEQNGNDD

SEQ ID NO: 39973 - protein, 32 aa, Artificial Sequence
  Description of Artificial Sequence: Synthetic polypeptide
DEEEIRTTNPVATEQYGSVCNTENLIERGDRS

SEQ ID NO: 39974 - protein, 30 aa, Artificial Sequence
  Description of Artificial Sequence: Synthetic polypeptide
DEEEIRTTNPVATEQYGYTISTNEGQRGDG

SEQ ID NO: 39975 - protein, 29 aa, Artificial Sequence
  Description of Artificial Sequence: Synthetic peptide
DEVEIATTNPVATEQYGSVATNLQNDNDN

SEQ ID NO: 39976 - protein, 31 aa, Artificial Sequence
  Description of Artificial Sequence: Synthetic polypeptide
DEEEIRTTNPVATEQYGYTISTNELQEGERN

SEQ ID NO: 39977 - protein, 30 aa, Artificial Sequence
  Description of Artificial Sequence: Synthetic polypeptide
DEEEIRTTNPVATEQYGYVSQLNTQNGMNL

SEQ ID NO: 39978 - protein, 32 aa, Artificial Sequence
  Description of Artificial Sequence: Synthetic polypeptide
DEEEIATTNPVATEAYGQSVPSTNLSQEGGNR

SEQ ID NO: 39979 - protein, 31 aa, Artificial Sequence
  Description of Artificial Sequence: Synthetic polypeptide
DEEEIRTTNPVATEQYGSVCNTFNLEHDGTR

SEQ ID NO: 39980 - protein, 30 aa, Artificial Sequence
  Description of Artificial Sequence: Synthetic polypeptide
DENEIRTTNPVATEQYGCVSGTDLTRGSNE

SEQ ID NO: 39981 - protein, 31 aa, Artificial Sequence
  Description of Artificial Sequence: Synthetic polypeptide
DEAEIATTNPVATEQYGCVSTNLQPMGDNTR

SEQ ID NO: 39982 - protein, 32 aa, Artificial Sequence
  Description of Artificial Sequence: Synthetic polypeptide
DEEEIRTTNPVATEQYGSVCNTGNLIERFGER

SEQ ID NO: 39983 - protein, 31 aa, Artificial Sequence
  Description of Artificial Sequence: Synthetic polypeptide
DEEEIRTTNPVATEQYGSVCNTGNLMGAGTR

SEQ ID NO: 39984 - protein, 30 aa, Artificial Sequence
  Description of Artificial Sequence: Synthetic polypeptide
DEAEIATTNPVATEQYGCVSTNLQNTGPRE

SEQ ID NO: 39985 - protein, 30 aa, Artificial Sequence
  Description of Artificial Sequence: Synthetic polypeptide
DEEEIRTTNPVATEQYGSVNTPLVDGEERN

SEQ ID NO: 39986 - protein, 32 aa, Artificial Sequence
  Description of Artificial Sequence: Synthetic polypeptide
DEEEIRTTNPVATEQYGSVNGTNLQQEVGNIG

SEQ ID NO: 39987 - protein, 29 aa, Artificial Sequence
  Description of Artificial Sequence: Synthetic peptide
DEAEIATTNPVATEQYGCVSTNLQGENHE

SEQ ID NO: 39988 - protein, 31 aa, Artificial Sequence
  Description of Artificial Sequence: Synthetic polypeptide
DEEEIRTTNPVATEQYGSVCNTGNLNGGGTR

SEQ ID NO: 39989 - protein, 29 aa, Artificial Sequence
  Description of Artificial Sequence: Synthetic peptide
DENEIRTTNPVATEPYGSVSNNDLQHGTS

SEQ ID NO: 39990 - protein, 31 aa, Artificial Sequence
  Description of Artificial Sequence: Synthetic polypeptide
DEEEIATTNPVAYEQYGSTVSCTNALQGGNS

SEQ ID NO: 39991 - protein, 31 aa, Artificial Sequence
  Description of Artificial Sequence: Synthetic polypeptide
DEVEIATTNPVATEQYGSVSTNLQHQNGDMR

SEQ ID NO: 39992 - protein, 31 aa, Artificial Sequence
  Description of Artificial Sequence: Synthetic polypeptide
DEEEIRTTNPVATEQYGSVCNTGNLEGRDTR

SEQ ID NO: 39993 - protein, 31 aa, Artificial Sequence
  Description of Artificial Sequence: Synthetic polypeptide
DEVEIATTNPVATEQYGSVSTNLQIGDGNTD

SEQ ID NO: 39994 - protein, 32 aa, Artificial Sequence
  Description of Artificial Sequence: Synthetic polypeptide
DEEEIRTTNPVATEQYGSVCNTNDIQLGNDRL

SEQ ID NO: 39995 - protein, 29 aa, Artificial Sequence
  Description of Artificial Sequence: Synthetic peptide
DENEIRTTNPVATEIYGTVSNNLPQRGTW

SEQ ID NO: 39996 - protein, 30 aa, Artificial Sequence
  Description of Artificial Sequence: Synthetic polypeptide
DEEEIKTTNPVATEQYGCVSTELQNFGNQT

SEQ ID NO: 39997 - protein, 30 aa, Artificial Sequence
  Description of Artificial Sequence: Synthetic polypeptide
DEAEIATTNPVATEQYGCVSTNLQGAGNDV

SEQ ID NO: 39998 - protein, 30 aa, Artificial Sequence
  Description of Artificial Sequence: Synthetic polypeptide
DEEEIRTTNPVATEQYGSVCNTNGQLMGFA

SEQ ID NO: 39999 - protein, 29 aa, Artificial Sequence
  Description of Artificial Sequence: Synthetic peptide
DENEIRTTNPVATEIYGSVSWNLQNFGDA

SEQ ID NO: 40000 - protein, 32 aa, Artificial Sequence
  Description of Artificial Sequence: Synthetic polypeptide
DEEEIRTTNPVATEQYGSVNGTNLQNGGNGTN

SEQ ID NO: 40001 - protein, 30 aa, Artificial Sequence
  Description of Artificial Sequence: Synthetic polypeptide
DENEIRTTNPVATEIYGSVSWGNLQRGSEA

SEQ ID NO: 40002 - protein, 29 aa, Artificial Sequence
  Description of Artificial Sequence: Synthetic peptide
DENEIRTTNPVATEIYGSVSVNLQRLTEE

SEQ ID NO: 40003 - protein, 31 aa, Artificial Sequence
  Description of Artificial Sequence: Synthetic polypeptide
DEVEIATTNPVATEQYGSVSTNLQLMGDNGT

SEQ ID NO: 40004 - protein, 32 aa, Artificial Sequence
  Description of Artificial Sequence: Synthetic polypeptide
DEEEIRTTNPVATEQYGYVSTSNLQQGGNGPD

SEQ ID NO: 40005 - protein, 31 aa, Artificial Sequence
  Description of Artificial Sequence: Synthetic polypeptide
DEVEIATTNPVATEQYGSVSTNLQIGGGNMQ

SEQ ID NO: 40006 - protein, 30 aa, Artificial Sequence
  Description of Artificial Sequence: Synthetic polypeptide
DEAEIATTNPVATEQYGDVSTELQEGDNRE

SEQ ID NO: 40007 - protein, 32 aa, Artificial Sequence
  Description of Artificial Sequence: Synthetic polypeptide
DEEEIRTTNPVATEQYGSVNGTNLQQEVVNRQ

SEQ ID NO: 40008 - protein, 32 aa, Artificial Sequence
  Description of Artificial Sequence: Synthetic polypeptide
DEEEIRTTNPVATEQYGSVNGTNLQRLVAIRD

SEQ ID NO: 40009 - protein, 30 aa, Artificial Sequence
  Description of Artificial Sequence: Synthetic polypeptide
DEVEIATTNPVATEQYGSVSTNLQEEGEDL

SEQ ID NO: 40010 - protein, 31 aa, Artificial Sequence
  Description of Artificial Sequence: Synthetic polypeptide
DEEEIRTTNPVATEQYGSVCNTFNLNGEGTR

SEQ ID NO: 40011 - protein, 32 aa, Artificial Sequence
  Description of Artificial Sequence: Synthetic polypeptide
DEEEIRTTNPVATEQYGSVCNTFNLPGRQGTR

SEQ ID NO: 40012 - protein, 31 aa, Artificial Sequence
  Description of Artificial Sequence: Synthetic polypeptide
DENEIRTTNPVATEQYGCVCSTNLQFGSNII

SEQ ID NO: 40013 - protein, 32 aa, Artificial Sequence
  Description of Artificial Sequence: Synthetic polypeptide
DEEEIRTTNPVATEQYGSNCSTNDLQNGENPQ

SEQ ID NO: 40014 - protein, 31 aa, Artificial Sequence
  Description of Artificial Sequence: Synthetic polypeptide
DEEEIATTNPVAYEQYGSVACTPNLGRGGNR

SEQ ID NO: 40015 - protein, 31 aa, Artificial Sequence
  Description of Artificial Sequence: Synthetic polypeptide
DEEEIATTNPVAYEQYGSVACTNLSQQGNQR

SEQ ID NO: 40016 - protein, 31 aa, Artificial Sequence
  Description of Artificial Sequence: Synthetic polypeptide
DEEEIATTNPVAYEQYGSVACTGNALQSGNR

SEQ ID NO: 40017 - protein, 31 aa, Artificial Sequence
  Description of Artificial Sequence: Synthetic polypeptide
DEVEIATTNPVATEQYGSVSTNLQGDGNTTE

SEQ ID NO: 40018 - protein, 31 aa, Artificial Sequence
  Description of Artificial Sequence: Synthetic polypeptide
DEEEIRTTNPVATEQYGSVCNTFNLVGFGDR

SEQ ID NO: 40019 - protein, 31 aa, Artificial Sequence
  Description of Artificial Sequence: Synthetic polypeptide
DEEEIRTTNPVATEQYGSVCNTFNLYDEGTR

SEQ ID NO: 40020 - protein, 30 aa, Artificial Sequence
  Description of Artificial Sequence: Synthetic polypeptide
DEEEIRTTNPVATEQYGSVNNANELDLGER

SEQ ID NO: 40021 - protein, 33 aa, Artificial Sequence
  Description of Artificial Sequence: Synthetic polypeptide
DEEEIRTTNPVATEQYGSVCNTFNLYGREGTNR

SEQ ID NO: 40022 - protein, 31 aa, Artificial Sequence
  Description of Artificial Sequence: Synthetic polypeptide
DEEEIRTTNPVATEQYGSVNTNPLQNTGSQF

SEQ ID NO: 40023 - protein, 30 aa, Artificial Sequence
  Description of Artificial Sequence: Synthetic polypeptide
DEVEIATTNPVATEQYGSVSTNLQGQGGID

SEQ ID NO: 40024 - protein, 31 aa, Artificial Sequence
  Description of Artificial Sequence: Synthetic polypeptide
DEEEIRTTNPVATEQYGSVNGTNPDQRGEDD

SEQ ID NO: 40025 - protein, 31 aa, Artificial Sequence
  Description of Artificial Sequence: Synthetic polypeptide
DEVEIATTNPVATEQYGSVSTNLQHDEGGNV

SEQ ID NO: 40026 - protein, 31 aa, Artificial Sequence
  Description of Artificial Sequence: Synthetic polypeptide
DEEEIRTTNPVATEQYGSVNTPLQEGENVEN

SEQ ID NO: 40027 - protein, 32 aa, Artificial Sequence
  Description of Artificial Sequence: Synthetic polypeptide
DEEEIRTTNPVATEQYGSVCNTFNLYNRGDTR

SEQ ID NO: 40028 - protein, 31 aa, Artificial Sequence
  Description of Artificial Sequence: Synthetic polypeptide
DEEEIRTTNPVATEQYGSVCNTGNLAEGGQR

SEQ ID NO: 40029 - protein, 30 aa, Artificial Sequence
  Description of Artificial Sequence: Synthetic polypeptide
DEEEIRTTNPVATEQYGSVNTPLQERSTDA

SEQ ID NO: 40030 - protein, 30 aa, Artificial Sequence
  Description of Artificial Sequence: Synthetic polypeptide
DENEIRTTNPVATEQWGEVSCNLPQRGENG

SEQ ID NO: 40031 - protein, 29 aa, Artificial Sequence
  Description of Artificial Sequence: Synthetic peptide
DENEIRTTNPVATEQWGEASENLPQRGNG

SEQ ID NO: 40032 - protein, 32 aa, Artificial Sequence
  Description of Artificial Sequence: Synthetic polypeptide
DEEEIRTTNPVATEQYGSVNGTNLTQGEGNTN

SEQ ID NO: 40033 - protein, 31 aa, Artificial Sequence
  Description of Artificial Sequence: Synthetic polypeptide
DEVEIATTNPVATEQYGSVSTNLQHNGGNTT

SEQ ID NO: 40034 - protein, 32 aa, Artificial Sequence
  Description of Artificial Sequence: Synthetic polypeptide
DEAEIATTNPVATEQYGSTVACTNMLSQRGNR

SEQ ID NO: 40035 - protein, 30 aa, Artificial Sequence
  Description of Artificial Sequence: Synthetic polypeptide
DENEIRTTNPVATEIYGSVSTNNLQSGVTT

SEQ ID NO: 40036 - protein, 31 aa, Artificial Sequence
  Description of Artificial Sequence: Synthetic polypeptide
DEEEIRTTNPVATEQYGSVCMTNLQQGELVA

SEQ ID NO: 40037 - protein, 30 aa, Artificial Sequence
  Description of Artificial Sequence: Synthetic polypeptide
DENEIRTTNPVATEQYGSISTNTDQREGLQ

SEQ ID NO: 40038 - protein, 30 aa, Artificial Sequence
  Description of Artificial Sequence: Synthetic polypeptide
DEEEIRTTNPVATEQYGSQSTMMEHRGVNL

SEQ ID NO: 40039 - protein, 30 aa, Artificial Sequence
  Description of Artificial Sequence: Synthetic polypeptide
DENEIRTTNPVATEQYGSVSAQNLFTNMNR

SEQ ID NO: 40040 - protein, 31 aa, Artificial Sequence
  Description of Artificial Sequence: Synthetic polypeptide
DEEEIATTNPVATAQYGQVSCVNELQRGGNR

SEQ ID NO: 40041 - protein, 31 aa, Artificial Sequence
  Description of Artificial Sequence: Synthetic polypeptide
DENEIRTTNPVATEQYGSVSALLEQRGNEED

SEQ ID NO: 40042 - protein, 33 aa, Artificial Sequence
  Description of Artificial Sequence: Synthetic polypeptide
DEEEIRTTNPVATEQYGSVNNTNLDQRGNNDGS

SEQ ID NO: 40043 - protein, 32 aa, Artificial Sequence
  Description of Artificial Sequence: Synthetic polypeptide
DEEEIGTTNPVAYEQYGSVSTNDLQERMGSNL

SEQ ID NO: 40044 - protein, 30 aa, Artificial Sequence
  Description of Artificial Sequence: Synthetic polypeptide
DENEIRTTNPVATEQYGSVQTGLIRNGNGD

SEQ ID NO: 40045 - protein, 30 aa, Artificial Sequence
  Description of Artificial Sequence: Synthetic polypeptide
DENEIRTTNPVATEQYGSVQTGLIRGMNTD

SEQ ID NO: 40046 - protein, 31 aa, Artificial Sequence
  Description of Artificial Sequence: Synthetic polypeptide
DEEEIRTTNPVATEQYGSVNNTNEQRQEERL

SEQ ID NO: 40047 - protein, 31 aa, Artificial Sequence
  Description of Artificial Sequence: Synthetic polypeptide
DEEEIRTTNPVATEQYGSVNNTNELEGNGER

SEQ ID NO: 40048 - protein, 30 aa, Artificial Sequence
  Description of Artificial Sequence: Synthetic polypeptide
DENEIRTTNPVATEQYGSVQTGLIRGEGNG

SEQ ID NO: 40049 - protein, 30 aa, Artificial Sequence
  Description of Artificial Sequence: Synthetic polypeptide
DEVEIATTNPVATDQYGVVSTDLQRGGNTR

SEQ ID NO: 40050 - protein, 29 aa, Artificial Sequence
  Description of Artificial Sequence: Synthetic peptide
DENEIRTTNPVATEQYGSVQTGALIRMNQ

SEQ ID NO: 40051 - protein, 31 aa, Artificial Sequence
  Description of Artificial Sequence: Synthetic polypeptide
DEEEIRTTNPVATEQYGSQPSVTNEQVMNDR

SEQ ID NO: 40052 - protein, 30 aa, Artificial Sequence
  Description of Artificial Sequence: Synthetic polypeptide
DENEIRTTNPVATEQYGSVQTALIRSMSNR

SEQ ID NO: 40053 - protein, 30 aa, Artificial Sequence
  Description of Artificial Sequence: Synthetic polypeptide
DEEEIRTTNPVATEQYGSVCGFNPQRHEND

SEQ ID NO: 40054 - protein, 31 aa, Artificial Sequence
  Description of Artificial Sequence: Synthetic polypeptide
DENEIRTTNPVATEQYGSVPTNNLQIFGNDE

SEQ ID NO: 40055 - protein, 31 aa, Artificial Sequence
  Description of Artificial Sequence: Synthetic polypeptide
DEEEIRTTNPVATEQYGSQCSTNNQEGDEDR

SEQ ID NO: 40056 - protein, 30 aa, Artificial Sequence
  Description of Artificial Sequence: Synthetic polypeptide
DEVEIATTNPVATECYGSVSTNLQEGGNEG

SEQ ID NO: 40057 - protein, 32 aa, Artificial Sequence
  Description of Artificial Sequence: Synthetic polypeptide
DEEEIRTTNPVATEQYGSVNNTNEDDRGENRD

SEQ ID NO: 40058 - protein, 31 aa, Artificial Sequence
  Description of Artificial Sequence: Synthetic polypeptide
DEVEIATTNPVATECYGSVSTNLQGDMGNAR

SEQ ID NO: 40059 - protein, 30 aa, Artificial Sequence
  Description of Artificial Sequence: Synthetic polypeptide
DENEIRTTNPVATEQYGSVMTGLIRGMNGQ

SEQ ID NO: 40060 - protein, 32 aa, Artificial Sequence
  Description of Artificial Sequence: Synthetic polypeptide
DEEEIRTTNPVATEQYGVVYSTPDLQPRGNQD

SEQ ID NO: 40061 - protein, 30 aa, Artificial Sequence
  Description of Artificial Sequence: Synthetic polypeptide
DEVEIATTNPVATECYGSVSTNLQGGNDTE

SEQ ID NO: 40062 - protein, 29 aa, Artificial Sequence
  Description of Artificial Sequence: Synthetic peptide
DEAEIATTNPVAYEQYGSVSTNLQVGDEV

SEQ ID NO: 40063 - protein, 33 aa, Artificial Sequence
  Description of Artificial Sequence: Synthetic polypeptide
DEEEIRTTNPVATEQYGSVCEVTELQRGLNQRD

SEQ ID NO: 40064 - protein, 31 aa, Artificial Sequence
  Description of Artificial Sequence: Synthetic polypeptide
DEEEIRTTNPVATEQYGSQSTPNEQRGVIAN

SEQ ID NO: 40065 - protein, 32 aa, Artificial Sequence
  Description of Artificial Sequence: Synthetic polypeptide
DEEEIRTTNPVATEQYGVVTISTNENLQAGNG

SEQ ID NO: 40066 - protein, 32 aa, Artificial Sequence
  Description of Artificial Sequence: Synthetic polypeptide
DEEEIRTTNPVATEQYGSVNTNLDDRIGEIRS

SEQ ID NO: 40067 - protein, 29 aa, Artificial Sequence
  Description of Artificial Sequence: Synthetic peptide
DEVEIATTNPVATCQYGCVSTALQNGNNR

SEQ ID NO: 40068 - protein, 32 aa, Artificial Sequence
  Description of Artificial Sequence: Synthetic polypeptide
DEEEIRTTNPVATEQYGSQSVTNMLQRGLIQS

SEQ ID NO: 40069 - protein, 29 aa, Artificial Sequence
  Description of Artificial Sequence: Synthetic peptide
DEVEIATTNPVATCQYGCVSTALQSGNRG

SEQ ID NO: 40070 - protein, 32 aa, Artificial Sequence
  Description of Artificial Sequence: Synthetic polypeptide
DEEEIRTTNPVATEQYGSVNNTNLERGSDQRE

SEQ ID NO: 40071 - protein, 31 aa, Artificial Sequence
  Description of Artificial Sequence: Synthetic polypeptide
DEEEIRTTNPVATEQYGVVSWTLLNREMNER

SEQ ID NO: 40072 - protein, 30 aa, Artificial Sequence
  Description of Artificial Sequence: Synthetic polypeptide
DEEEIRTTNPVATEQYGSVCENEQQREGEE

SEQ ID NO: 40073 - protein, 29 aa, Artificial Sequence
  Description of Artificial Sequence: Synthetic peptide
DEVEIATTNPVATCQYGCVSTATQRFGNR

SEQ ID NO: 40074 - protein, 30 aa, Artificial Sequence
  Description of Artificial Sequence: Synthetic polypeptide
DEVEIATTNPVATDQYGCVSTAELQRGNNR

SEQ ID NO: 40075 - protein, 31 aa, Artificial Sequence
  Description of Artificial Sequence: Synthetic polypeptide
DEEEIRTTNPVATEQYGVVSWVNLNRGMQQR

SEQ ID NO: 40076 - protein, 30 aa, Artificial Sequence
  Description of Artificial Sequence: Synthetic polypeptide
DEAEIATTNPVATEQYGSVAMNLQQAGNRN

SEQ ID NO: 40077 - protein, 31 aa, Artificial Sequence
  Description of Artificial Sequence: Synthetic polypeptide
DEEEIATTNPVAYEQYGSVATNLQDRGNMDM

SEQ ID NO: 40078 - protein, 31 aa, Artificial Sequence
  Description of Artificial Sequence: Synthetic polypeptide
DEEEIATTNPVAYEQYGSVATNLQDRGDNVE

SEQ ID NO: 40079 - protein, 28 aa, Artificial Sequence
  Description of Artificial Sequence: Synthetic peptide
DEVEIATTNPVATDQYGDVSTDLDRGNG

SEQ ID NO: 40080 - protein, 29 aa, Artificial Sequence
  Description of Artificial Sequence: Synthetic peptide
DEVEIATTNPVATDQYGDVSTDLNQRGNI

SEQ ID NO: 40081 - protein, 31 aa, Artificial Sequence
  Description of Artificial Sequence: Synthetic polypeptide
DEEEIRTTNPVATEQYGSVNNTNLENGSNMI

SEQ ID NO: 40082 - protein, 29 aa, Artificial Sequence
  Description of Artificial Sequence: Synthetic peptide
DEVEIATTNPVATDQYGDVSTDLQRMGNQ

SEQ ID NO: 40083 - protein, 31 aa, Artificial Sequence
  Description of Artificial Sequence: Synthetic polypeptide
DEEEIRTTNPVATEQYGSVCETNLQPINGLE

SEQ ID NO: 40084 - protein, 29 aa, Artificial Sequence
  Description of Artificial Sequence: Synthetic peptide
DEAEIATTNPVAYEQYGSVSTNLQREDHE

SEQ ID NO: 40085 - protein, 33 aa, Artificial Sequence
  Description of Artificial Sequence: Synthetic polypeptide
DEEEIRTTNPVATEQYGVVSYTNLSQRTGGNNP

SEQ ID NO: 40086 - protein, 30 aa, Artificial Sequence
  Description of Artificial Sequence: Synthetic polypeptide
DEAEIATTNPVAYEQYGSVSTNLQSGPMRE

SEQ ID NO: 40087 - protein, 29 aa, Artificial Sequence
  Description of Artificial Sequence: Synthetic peptide
DEVEIATTNPVATDQYGMVSTAIQRGNQR

SEQ ID NO: 40088 - protein, 29 aa, Artificial Sequence
  Description of Artificial Sequence: Synthetic peptide
DEAEIATTNPVATEQYGSVAMNLDNDGNR

SEQ ID NO: 40089 - protein, 32 aa, Artificial Sequence
  Description of Artificial Sequence: Synthetic polypeptide
DENEIRTTNPVATEQYGSVSDPNLQERFGDQR

SEQ ID NO: 40090 - protein, 29 aa, Artificial Sequence
  Description of Artificial Sequence: Synthetic peptide
AENEICATNPVATEQYGSVTSENLQRGER

SEQ ID NO: 40091 - protein, 32 aa, Artificial Sequence
  Description of Artificial Sequence: Synthetic polypeptide
DEEEIRTTNPVATEQYGSVCGNTNLQRFGSQQ

SEQ ID NO: 40092 - protein, 30 aa, Artificial Sequence
  Description of Artificial Sequence: Synthetic polypeptide
DENEIRTTNPVATEQYGSISTNQQVIEGLR

SEQ ID NO: 40093 - protein, 30 aa, Artificial Sequence
  Description of Artificial Sequence: Synthetic polypeptide
DEAEIATTNPVATEQYGSVAITNLQRENSE

SEQ ID NO: 40094 - protein, 30 aa, Artificial Sequence
  Description of Artificial Sequence: Synthetic polypeptide
DEAEIATTNPVATEQYGSVAITNLERDGND

SEQ ID NO: 40095 - protein, 30 aa, Artificial Sequence
  Description of Artificial Sequence: Synthetic polypeptide
DEEEIKTTNPAATEQYGSVPTNLQHSGNGP

SEQ ID NO: 40096 - protein, 31 aa, Artificial Sequence
  Description of Artificial Sequence: Synthetic polypeptide
DENEIRTTNPVATEQYGSVCSTNLQENFGEQ

SEQ ID NO: 40097 - protein, 31 aa, Artificial Sequence
  Description of Artificial Sequence: Synthetic polypeptide
DEEEIRTTNPVATEQYGSVNNTNDDQRGEII

SEQ ID NO: 40098 - protein, 32 aa, Artificial Sequence
  Description of Artificial Sequence: Synthetic polypeptide
DEEEIRTTNPVATEQYGYTICTNELQRGDNFR

SEQ ID NO: 40099 - protein, 31 aa, Artificial Sequence
  Description of Artificial Sequence: Synthetic polypeptide
DEEEIRTTNPVATEQYGSVNNTFNLDGGETR

SEQ ID NO: 40100 - protein, 29 aa, Artificial Sequence
  Description of Artificial Sequence: Synthetic peptide
AENEIATTNPVATEQYGSASENLQDRGGR

SEQ ID NO: 40101 - protein, 31 aa, Artificial Sequence
  Description of Artificial Sequence: Synthetic polypeptide
DEEEIRTTNPVATEQYGTCSTINPLQERANN

SEQ ID NO: 40102 - protein, 30 aa, Artificial Sequence
  Description of Artificial Sequence: Synthetic polypeptide
DEEEIATTNPVAYEQYGSVATNDQDTGNAR

SEQ ID NO: 40103 - protein, 30 aa, Artificial Sequence
  Description of Artificial Sequence: Synthetic polypeptide
DEAEIATTNPVAYEQYGSVVSTNLQGGNAE

SEQ ID NO: 40104 - protein, 31 aa, Artificial Sequence
  Description of Artificial Sequence: Synthetic polypeptide
DEEEIRTTNPVATEQYGYTISESNENQRGNR

SEQ ID NO: 40105 - protein, 30 aa, Artificial Sequence
  Description of Artificial Sequence: Synthetic polypeptide
DEEEIRTTNPVATEQYGYTISMNELQREER

SEQ ID NO: 40106 - protein, 28 aa, Artificial Sequence
  Description of Artificial Sequence: Synthetic peptide
AENEIATTNPVATEQYGSVSEDLQRGGL

SEQ ID NO: 40107 - protein, 31 aa, Artificial Sequence
  Description of Artificial Sequence: Synthetic polypeptide
DEAEIATTNPVAYEQYGSVVSTNLQRGNEQA

SEQ ID NO: 40108 - protein, 31 aa, Artificial Sequence
  Description of Artificial Sequence: Synthetic polypeptide
DENEIRTTNPVATEQYGSVCNTFNLNGRGTR

SEQ ID NO: 40109 - protein, 30 aa, Artificial Sequence
  Description of Artificial Sequence: Synthetic polypeptide
DEEEIRTTNPVATEQYGSVNNTELDRGEFA

SEQ ID NO: 40110 - protein, 30 aa, Artificial Sequence
  Description of Artificial Sequence: Synthetic polypeptide
DENEIRTTNPVATEQYGSVATDLEREGNNQ

SEQ ID NO: 40111 - protein, 33 aa, Artificial Sequence
  Description of Artificial Sequence: Synthetic polypeptide
DEEEIATTNPVATEAYGQSVCSYTNLSQRGGNR

SEQ ID NO: 40112 - protein, 31 aa, Artificial Sequence
  Description of Artificial Sequence: Synthetic polypeptide
DEEEIRTTNPVATEQYGTCSTINALQREPNN

SEQ ID NO: 40113 - protein, 32 aa, Artificial Sequence
  Description of Artificial Sequence: Synthetic polypeptide
DEEEIRTTNPVATEQYGSVNTNLQGTGGNNGE

SEQ ID NO: 40114 - protein, 30 aa, Artificial Sequence
  Description of Artificial Sequence: Synthetic polypeptide
DEVEIATTNPVATEQYGEVSTNLQHQDGER

SEQ ID NO: 40115 - protein, 31 aa, Artificial Sequence
  Description of Artificial Sequence: Synthetic polypeptide
DEAEIATTNPVATEQYGSVAATNLQQGNPRQ

SEQ ID NO: 40116 - protein, 29 aa, Artificial Sequence
  Description of Artificial Sequence: Synthetic peptide
DENEIRTTNPVATEQYGSISTNTERELLR

SEQ ID NO: 40117 - protein, 30 aa, Artificial Sequence
  Description of Artificial Sequence: Synthetic polypeptide
DEEEIRTTNPVATEQYGTCSTIDALQRENN

SEQ ID NO: 40118 - protein, 28 aa, Artificial Sequence
  Description of Artificial Sequence: Synthetic peptide
DEVEIATTNPVATEQYGSIPTNEQHFNR

SEQ ID NO: 40119 - protein, 28 aa, Artificial Sequence
  Description of Artificial Sequence: Synthetic peptide
AENEIATTNPVATEQYGSASEDLQRGGR

SEQ ID NO: 40120 - protein, 30 aa, Artificial Sequence
  Description of Artificial Sequence: Synthetic polypeptide
DEVEIATTNPVATEQYGDVSTNLQEGGNEA

SEQ ID NO: 40121 - protein, 28 aa, Artificial Sequence
  Description of Artificial Sequence: Synthetic peptide
DEAEIATTNPVATEQYGSVAENLTAGNE

SEQ ID NO: 40122 - protein, 32 aa, Artificial Sequence
  Description of Artificial Sequence: Synthetic polypeptide
DENEIRTTNPVATEQYGSVCSTNLQRFGSEVL

SEQ ID NO: 40123 - protein, 31 aa, Artificial Sequence
  Description of Artificial Sequence: Synthetic polypeptide
DEVEIATTNPVATECYGSVSTNLQGQDSGNR

SEQ ID NO: 40124 - protein, 29 aa, Artificial Sequence
  Description of Artificial Sequence: Synthetic peptide
DEAEIATTNPVAYEQYGSVSTNLQVGDQM

SEQ ID NO: 40125 - protein, 30 aa, Artificial Sequence
  Description of Artificial Sequence: Synthetic polypeptide
DEEEIRTTNPVATEQYGSVCGSDPDQVGDR

SEQ ID NO: 40126 - protein, 31 aa, Artificial Sequence
  Description of Artificial Sequence: Synthetic polypeptide
DEEEIRTTNPVATEQYGSQCDTNLQQGELRD

SEQ ID NO: 40127 - protein, 31 aa, Artificial Sequence
  Description of Artificial Sequence: Synthetic polypeptide
DEEEIRTTNPVATEQYGSVNNTNDERGFEND

SEQ ID NO: 40128 - protein, 30 aa, Artificial Sequence
  Description of Artificial Sequence: Synthetic polypeptide
DEVEIATTNPVATECYGSVSTNLQQGDNDT

SEQ ID NO: 40129 - protein, 30 aa, Artificial Sequence
  Description of Artificial Sequence: Synthetic polypeptide
DEAEIATTNPVATEQYGSVAGTNLQDGNVD

SEQ ID NO: 40130 - protein, 32 aa, Artificial Sequence
  Description of Artificial Sequence: Synthetic polypeptide
DEEEIRTTNPVATEQYGTCVCSTNLQNGSNQG

SEQ ID NO: 40131 - protein, 32 aa, Artificial Sequence
  Description of Artificial Sequence: Synthetic polypeptide
DEEEIATTNPVATEAYGISTVSTNLSQRGNNS

SEQ ID NO: 40132 - protein, 32 aa, Artificial Sequence
  Description of Artificial Sequence: Synthetic polypeptide
DENEIRTTNPVATEQYGSVISTVNTQREGLGR

SEQ ID NO: 40133 - protein, 31 aa, Artificial Sequence
  Description of Artificial Sequence: Synthetic polypeptide
DEEEIRTTNPVATEQYGYSSSTVGMNQLGNR

SEQ ID NO: 40134 - protein, 29 aa, Artificial Sequence
  Description of Artificial Sequence: Synthetic peptide
DEEEIRTTNPVATEQYGYSVSDNNGEPNQ

SEQ ID NO: 40135 - protein, 30 aa, Artificial Sequence
  Description of Artificial Sequence: Synthetic polypeptide
DEVEIATTNPVATEEYGSVSTNLQDGGMNG

SEQ ID NO: 40136 - protein, 31 aa, Artificial Sequence
  Description of Artificial Sequence: Synthetic polypeptide
DEVEIATTNPVATEGYGSVSTNLQGNDDGNR

SEQ ID NO: 40137 - protein, 29 aa, Artificial Sequence
  Description of Artificial Sequence: Synthetic peptide
DENEIRTTNPVATEQYGSVETALIRMEQR

SEQ ID NO: 40138 - protein, 30 aa, Artificial Sequence
  Description of Artificial Sequence: Synthetic polypeptide
DEVEIATTNPVATEIYGSVSTNLQHGDDDR

SEQ ID NO: 40139 - protein, 31 aa, Artificial Sequence
  Description of Artificial Sequence: Synthetic polypeptide
DEEEIRTTNPVATEQYGSVNTNLIGGGNQGT

SEQ ID NO: 40140 - protein, 33 aa, Artificial Sequence
  Description of Artificial Sequence: Synthetic polypeptide
DEEEIRTTNPVATEQYGSVCGTNMLDQRGDNSE

SEQ ID NO: 40141 - protein, 30 aa, Artificial Sequence
  Description of Artificial Sequence: Synthetic polypeptide
DENEIRTTNPVATEQYGSVCSTVLIRGEDT

SEQ ID NO: 40142 - protein, 31 aa, Artificial Sequence
  Description of Artificial Sequence: Synthetic polypeptide
DEVEIATTNPVATEIYGSVSTNLQRGDGDSR

SEQ ID NO: 40143 - protein, 30 aa, Artificial Sequence
  Description of Artificial Sequence: Synthetic polypeptide
DEVEIATTNPVATENYGSVSTNLQQDGNES

SEQ ID NO: 40144 - protein, 29 aa, Artificial Sequence
  Description of Artificial Sequence: Synthetic peptide
DENVICTTNPVATEQWGSVSTDNLQDGNV

SEQ ID NO: 40145 - protein, 32 aa, Artificial Sequence
  Description of Artificial Sequence: Synthetic polypeptide
DENEIRTTNPVATEQYGSVCSTNLQYFGSNVA

SEQ ID NO: 40146 - protein, 30 aa, Artificial Sequence
  Description of Artificial Sequence: Synthetic polypeptide
DEEEIRTTNPVATEQYGTCSTINQIQRENN

SEQ ID NO: 40147 - protein, 31 aa, Artificial Sequence
  Description of Artificial Sequence: Synthetic polypeptide
DEEEIRTTNPVATEQYGTCSTINPLQRENTE

SEQ ID NO: 40148 - protein, 29 aa, Artificial Sequence
  Description of Artificial Sequence: Synthetic peptide
DEVEIATTNPVATECYGSVSTNLQGQDDR

SEQ ID NO: 40149 - protein, 30 aa, Artificial Sequence
  Description of Artificial Sequence: Synthetic polypeptide
DENEIRTTNPVATEIYGSVSTNNLQQGTTT

SEQ ID NO: 40150 - protein, 32 aa, Artificial Sequence
  Description of Artificial Sequence: Synthetic polypeptide
DEEEIRTTNPVATEQYGSVCNTNNLQYGDGTR

SEQ ID NO: 40151 - protein, 32 aa, Artificial Sequence
  Description of Artificial Sequence: Synthetic polypeptide
DEEEIRTTNPVATEQYGSYTISTNEGQRGNEG

SEQ ID NO: 40152 - protein, 29 aa, Artificial Sequence
  Description of Artificial Sequence: Synthetic peptide
DENEIRTTNPVATDQYGSVNTTQLQEGND

SEQ ID NO: 40153 - protein, 30 aa, Artificial Sequence
  Description of Artificial Sequence: Synthetic polypeptide
DEEEIRTTNPVATEQYGSVNTTLQMFNSNY

SEQ ID NO: 40154 - protein, 30 aa, Artificial Sequence
  Description of Artificial Sequence: Synthetic polypeptide
DEAEIATTNPVATEQYGAVSTNLQGNGMDR

SEQ ID NO: 40155 - protein, 31 aa, Artificial Sequence
  Description of Artificial Sequence: Synthetic polypeptide
DEEEIRTTNPVATEQYGSVCSNTEHQRNNQY

SEQ ID NO: 40156 - protein, 31 aa, Artificial Sequence
  Description of Artificial Sequence: Synthetic polypeptide
DEEEIRTTNPVATEQYGSLCSTDLQRDDNQI

SEQ ID NO: 40157 - protein, 30 aa, Artificial Sequence
  Description of Artificial Sequence: Synthetic polypeptide
DEAEIATTNPVATEQYGAVSTNLQGNAGDR

SEQ ID NO: 40158 - protein, 30 aa, Artificial Sequence
  Description of Artificial Sequence: Synthetic polypeptide
DENEIRTTNPVATDQYGSVNTQGLDQRGND

SEQ ID NO: 40159 - protein, 30 aa, Artificial Sequence
  Description of Artificial Sequence: Synthetic polypeptide
DENEIRTTNPVATDQYGSVNTGLQRNGNDG

SEQ ID NO: 40160 - protein, 33 aa, Artificial Sequence
  Description of Artificial Sequence: Synthetic polypeptide
DEEEIKTTNPVAYEQYGSTVPSTNLSQRGGNDR

SEQ ID NO: 40161 - protein, 32 aa, Artificial Sequence
  Description of Artificial Sequence: Synthetic polypeptide
DEEEIRTTNPVATEQYGSVCSNTELQHFNSDR

SEQ ID NO: 40162 - protein, 30 aa, Artificial Sequence
  Description of Artificial Sequence: Synthetic polypeptide
DEVEIATTNPVAYEQYGSVSTNLQDGGNVD

SEQ ID NO: 40163 - protein, 32 aa, Artificial Sequence
  Description of Artificial Sequence: Synthetic polypeptide
DEEEIRTTNPVATEQYGSVCSNTEELQRNNQG

SEQ ID NO: 40164 - protein, 30 aa, Artificial Sequence
  Description of Artificial Sequence: Synthetic polypeptide
DEAEIATTNPVATEQYGAVSTNLQGDNGPR

SEQ ID NO: 40165 - protein, 31 aa, Artificial Sequence
  Description of Artificial Sequence: Synthetic polypeptide
DEAEIATTNPVATEQYGAVSTNLDQGNGNPR

SEQ ID NO: 40166 - protein, 28 aa, Artificial Sequence
  Description of Artificial Sequence: Synthetic peptide
DENEIRTTNPIATEQYGDVSEILMAGNR

SEQ ID NO: 40167 - protein, 32 aa, Artificial Sequence
  Description of Artificial Sequence: Synthetic polypeptide
DEEEIRTTNPVATEQYGSVCSNTENEQGGSND

SEQ ID NO: 40168 - protein, 29 aa, Artificial Sequence
  Description of Artificial Sequence: Synthetic peptide
DEAEIATTNPVATEQYGAVSTNLDGNGER

SEQ ID NO: 40169 - protein, 30 aa, Artificial Sequence
  Description of Artificial Sequence: Synthetic polypeptide
DEVEIATTNPVAYEQYGSVSTNLQGGDGNM

SEQ ID NO: 40170 - protein, 31 aa, Artificial Sequence
  Description of Artificial Sequence: Synthetic polypeptide
DEVEIATTNPVAYEQYGSVSTNLQGGGGNVR

SEQ ID NO: 40171 - protein, 30 aa, Artificial Sequence
  Description of Artificial Sequence: Synthetic polypeptide
DEVEIATTNPVAYEQYGSVSTNLQHDGGNM

SEQ ID NO: 40172 - protein, 35 aa, Artificial Sequence
  Description of Artificial Sequence: Synthetic polypeptide
DEEEIRTTNPVATEQYGSVCSNTGNLEQRFGSNRG

SEQ ID NO: 40173 - protein, 28 aa, Artificial Sequence
  Description of Artificial Sequence: Synthetic peptide
AENEIASTNPVATEQYGVVSENLQRGNQ

SEQ ID NO: 40174 - protein, 34 aa, Artificial Sequence
  Description of Artificial Sequence: Synthetic polypeptide
DEEEIRTTNPVATESYGQSVVSTENLQDRIGNRA

SEQ ID NO: 40175 - protein, 32 aa, Artificial Sequence
  Description of Artificial Sequence: Synthetic polypeptide
DEEEIRTTNPVATEQYGSVCSNTGNLQGGSQD

SEQ ID NO: 40176 - protein, 31 aa, Artificial Sequence
  Description of Artificial Sequence: Synthetic polypeptide
DENEIRTTNPIATEQYGSVSEENLQMRNGNH

SEQ ID NO: 40177 - protein, 30 aa, Artificial Sequence
  Description of Artificial Sequence: Synthetic polypeptide
DEAEIATTNPVATEQYGAVSTNLQHNNGER

SEQ ID NO: 40178 - protein, 30 aa, Artificial Sequence
  Description of Artificial Sequence: Synthetic polypeptide
DENEIRTTNPVATDQYGSVSNTQLQEGNDD

SEQ ID NO: 40179 - protein, 30 aa, Artificial Sequence
  Description of Artificial Sequence: Synthetic polypeptide
DEAEIATTNPVATEQYGAVSTNLQNGDERQ

SEQ ID NO: 40180 - protein, 28 aa, Artificial Sequence
  Description of Artificial Sequence: Synthetic peptide
DEVEIATTNPVATTQYGEVSTALQSGNA

SEQ ID NO: 40181 - protein, 30 aa, Artificial Sequence
  Description of Artificial Sequence: Synthetic polypeptide
DEVEIATTNPVATTQYGMVSTDLQRGENER

SEQ ID NO: 40182 - protein, 33 aa, Artificial Sequence
  Description of Artificial Sequence: Synthetic polypeptide
DEEEIRTTNPVATEQYGSVCSMNELQRGNQNEG

SEQ ID NO: 40183 - protein, 29 aa, Artificial Sequence
  Description of Artificial Sequence: Synthetic peptide
DEVEIATTNPVATTQYGNVSTALQGGNER

SEQ ID NO: 40184 - protein, 29 aa, Artificial Sequence
  Description of Artificial Sequence: Synthetic peptide
DEVEIATTNPVATTQYGVVSTALQSGNDR

SEQ ID NO: 40185 - protein, 32 aa, Artificial Sequence
  Description of Artificial Sequence: Synthetic polypeptide
DEEEIRTTNPVATERYGSVSCTALSQPGGNNR

SEQ ID NO: 40186 - protein, 33 aa, Artificial Sequence
  Description of Artificial Sequence: Synthetic polypeptide
DEEEIRTTNPVATEQYGSVCSMSGNLQNGSNRT

SEQ ID NO: 40187 - protein, 32 aa, Artificial Sequence
  Description of Artificial Sequence: Synthetic polypeptide
DEEEIRTTNPVATERYGSVSCTNALSQSTVNR

SEQ ID NO: 40188 - protein, 32 aa, Artificial Sequence
  Description of Artificial Sequence: Synthetic polypeptide
DEEEIRTTNPVATERYGSVSTGNLLGDEGNRT

SEQ ID NO: 40189 - protein, 29 aa, Artificial Sequence
  Description of Artificial Sequence: Synthetic peptide
DEVEIATTNPVAYAQYGEVSTALQRGNER

SEQ ID NO: 40190 - protein, 31 aa, Artificial Sequence
  Description of Artificial Sequence: Synthetic polypeptide
CEEEVRTTNPVATEQYGCVSTMNLDQRIGNA

SEQ ID NO: 40191 - protein, 29 aa, Artificial Sequence
  Description of Artificial Sequence: Synthetic peptide
DEVEIATTNPVAYDQYGCTVSTALQRGNR

SEQ ID NO: 40192 - protein, 32 aa, Artificial Sequence
  Description of Artificial Sequence: Synthetic polypeptide
DEEEIKTTNPVATEQYGSVSTTNQLQEEEGNL

SEQ ID NO: 40193 - protein, 32 aa, Artificial Sequence
  Description of Artificial Sequence: Synthetic polypeptide
DEEEIRTTNPVATERYGSVSTNDSQRVGNNPA

SEQ ID NO: 40194 - protein, 34 aa, Artificial Sequence
  Description of Artificial Sequence: Synthetic polypeptide
DEEEIRTTNPVATEQYGSVCSNANWLQRGSNQRI

SEQ ID NO: 40195 - protein, 30 aa, Artificial Sequence
  Description of Artificial Sequence: Synthetic polypeptide
DEEEIRTTNPVATEQYGSYSVMDQRGDEDR

SEQ ID NO: 40196 - protein, 32 aa, Artificial Sequence
  Description of Artificial Sequence: Synthetic polypeptide
DEEEIRTTNPVATERYGSVVSTPLSTRGGNNR

SEQ ID NO: 40197 - protein, 29 aa, Artificial Sequence
  Description of Artificial Sequence: Synthetic peptide
DENEIRTTNPVATEAYGSVSNNLSQRVTQ

SEQ ID NO: 40198 - protein, 31 aa, Artificial Sequence
  Description of Artificial Sequence: Synthetic polypeptide
DEEEIRTTNPVATEQYGSYSTTNLQDPMNVE

SEQ ID NO: 40199 - protein, 30 aa, Artificial Sequence
  Description of Artificial Sequence: Synthetic polypeptide
DEEEIRTTNPVATEQYGSYSTTLERLVTNM

SEQ ID NO: 40200 - protein, 31 aa, Artificial Sequence
  Description of Artificial Sequence: Synthetic polypeptide
DEEEIATTNPVATECYGSVSTNLQLQGDNDS

SEQ ID NO: 40201 - protein, 31 aa, Artificial Sequence
  Description of Artificial Sequence: Synthetic polypeptide
DEEEIRTTNPVATEQYGSVCSNNLEGGENIQ

SEQ ID NO: 40202 - protein, 29 aa, Artificial Sequence
  Description of Artificial Sequence: Synthetic peptide
CEESICTTNPVATEQYGSVSMNSQRGENS

SEQ ID NO: 40203 - protein, 29 aa, Artificial Sequence
  Description of Artificial Sequence: Synthetic peptide
DENEIRTTNPVATEAYGSVSINLQEVGTP

SEQ ID NO: 40204 - protein, 30 aa, Artificial Sequence
  Description of Artificial Sequence: Synthetic polypeptide
DEEEIATTNPVATECYGSVSTNLQQGDDTG

SEQ ID NO: 40205 - protein, 30 aa, Artificial Sequence
  Description of Artificial Sequence: Synthetic polypeptide
DEEEIRTTNPVATEQYGSIVTDLNQRGEDM

SEQ ID NO: 40206 - protein, 29 aa, Artificial Sequence
  Description of Artificial Sequence: Synthetic peptide
DEVEIATTNPVATTQYGEVSTALQGGDNR

SEQ ID NO: 40207 - protein, 31 aa, Artificial Sequence
  Description of Artificial Sequence: Synthetic polypeptide
DEEEIRTTNPVATEQYGSYSTNLGRGEEFDT

SEQ ID NO: 40208 - protein, 30 aa, Artificial Sequence
  Description of Artificial Sequence: Synthetic polypeptide
DEVEIATTNPVAYEQYGSVSTNLQTGNGNV

SEQ ID NO: 40209 - protein, 28 aa, Artificial Sequence
  Description of Artificial Sequence: Synthetic peptide
CEEVICTTNPVATEQYGSVSANSQHGNS

SEQ ID NO: 40210 - protein, 30 aa, Artificial Sequence
  Description of Artificial Sequence: Synthetic polypeptide
CEEVIRTTNPVATEQYGSVSCTNFSQKGNH

SEQ ID NO: 40211 - protein, 28 aa, Artificial Sequence
  Description of Artificial Sequence: Synthetic peptide
DENEICTTNPVATEIYGSVSNNLQGGTQ

SEQ ID NO: 40212 - protein, 32 aa, Artificial Sequence
  Description of Artificial Sequence: Synthetic polypeptide
DEEEIRTTNPVATEQYGSVCSNTNLQYLSNQG

SEQ ID NO: 40213 - protein, 29 aa, Artificial Sequence
  Description of Artificial Sequence: Synthetic peptide
DEEEIRTTNPVATEQYGSVNAELDRGEIA

SEQ ID NO: 40214 - protein, 30 aa, Artificial Sequence
  Description of Artificial Sequence: Synthetic polypeptide
DEEEIRTTNPVATESYGSWSLPNDLQRDHR

SEQ ID NO: 40215 - protein, 28 aa, Artificial Sequence
  Description of Artificial Sequence: Synthetic peptide
DENEIATVNPVAYEQYGSVSTNLDDGNH

SEQ ID NO: 40216 - protein, 29 aa, Artificial Sequence
  Description of Artificial Sequence: Synthetic peptide
DEVEIATTNPVAYMQYGMVSTALDQRGNR

SEQ ID NO: 40217 - protein, 29 aa, Artificial Sequence
  Description of Artificial Sequence: Synthetic peptide
DENEIATVNPVATEQYGSVSTNLDTGENH

SEQ ID NO: 40218 - protein, 28 aa, Artificial Sequence
  Description of Artificial Sequence: Synthetic peptide
DENEIATVNPVATEQYGSVCTNLDEGNH

SEQ ID NO: 40219 - protein, 30 aa, Artificial Sequence
  Description of Artificial Sequence: Synthetic polypeptide
DEVEIATTNPVSTEQYGSVSTNLQDGNDQH

SEQ ID NO: 40220 - protein, 29 aa, Artificial Sequence
  Description of Artificial Sequence: Synthetic peptide
CEEVIATTNPVATEQYGSVSTNLTMLNRI

SEQ ID NO: 40221 - protein, 31 aa, Artificial Sequence
  Description of Artificial Sequence: Synthetic polypeptide
DEEEIRTTNPVATEQYGSVNVNLDRGGNNII

SEQ ID NO: 40222 - protein, 30 aa, Artificial Sequence
  Description of Artificial Sequence: Synthetic polypeptide
DEEEIRTTNPVATESYGTVSSTNLEQANNF

SEQ ID NO: 40223 - protein, 32 aa, Artificial Sequence
  Description of Artificial Sequence: Synthetic polypeptide
DEEEIRTTNPVATEQYGSIVCNTPNLYSRGTR

SEQ ID NO: 40224 - protein, 31 aa, Artificial Sequence
  Description of Artificial Sequence: Synthetic polypeptide
DEEEIRTTNPVATEQYGSYSTNDLGERINDE

SEQ ID NO: 40225 - protein, 33 aa, Artificial Sequence
  Description of Artificial Sequence: Synthetic polypeptide
DEEEIRTTNPVATEQYGSVCSNTVELQNGSNRG

SEQ ID NO: 40226 - protein, 32 aa, Artificial Sequence
  Description of Artificial Sequence: Synthetic polypeptide
DEEEIRTTNPVATEQYGSYSQPNLQRGVNLFN

SEQ ID NO: 40227 - protein, 30 aa, Artificial Sequence
  Description of Artificial Sequence: Synthetic polypeptide
DENEIATTNPVAYEQYGSVVSTNLQHGNDQ

SEQ ID NO: 40228 - protein, 31 aa, Artificial Sequence
  Description of Artificial Sequence: Synthetic polypeptide
DEEEIRTTNPVATEQYGSVNVNLEDRGNNDI

SEQ ID NO: 40229 - protein, 32 aa, Artificial Sequence
  Description of Artificial Sequence: Synthetic polypeptide
DEEEINTTNPVATEQYGMSVSTNSLIQVRGEF

SEQ ID NO: 40230 - protein, 32 aa, Artificial Sequence
  Description of Artificial Sequence: Synthetic polypeptide
DEEEIRTTNPVATEQYGSVCSNWNLQRGSDQP

SEQ ID NO: 40231 - protein, 30 aa, Artificial Sequence
  Description of Artificial Sequence: Synthetic polypeptide
DEVEICTTNPVATEQYGSVSTNNQGDGNDL

SEQ ID NO: 40232 - protein, 31 aa, Artificial Sequence
  Description of Artificial Sequence: Synthetic polypeptide
DEEEIRTTNPVATEQYGSVCSPDNLQDLNQA

SEQ ID NO: 40233 - protein, 30 aa, Artificial Sequence
  Description of Artificial Sequence: Synthetic polypeptide
DEVEICTTNPVATECYGSVSTNLQGGGMNG

SEQ ID NO: 40234 - protein, 33 aa, Artificial Sequence
  Description of Artificial Sequence: Synthetic polypeptide
DEEEIRTTNPVATEQYGSVCSNTNLQRVEVEFR

SEQ ID NO: 40235 - protein, 30 aa, Artificial Sequence
  Description of Artificial Sequence: Synthetic polypeptide
DENEICTTNPVATEPYGSVSATNLQHGNDS

SEQ ID NO: 40236 - protein, 30 aa, Artificial Sequence
  Description of Artificial Sequence: Synthetic polypeptide
DEVEIATTNPVAYEQYGTVSTNLQSGGNDR

SEQ ID NO: 40237 - protein, 29 aa, Artificial Sequence
  Description of Artificial Sequence: Synthetic peptide
DEAEIATTNPVATEQWGSVSENLQDGNVM

SEQ ID NO: 40238 - protein, 30 aa, Artificial Sequence
  Description of Artificial Sequence: Synthetic polypeptide
DEEEIRTTNPVATEQYGSYSTNLEQLPSSD

SEQ ID NO: 40239 - protein, 32 aa, Artificial Sequence
  Description of Artificial Sequence: Synthetic polypeptide
DEEEIRTTNPVATEQYGSYSTNLDDRNAENER

SEQ ID NO: 40240 - protein, 34 aa, Artificial Sequence
  Description of Artificial Sequence: Synthetic polypeptide
DEEEIRTTNPVATEQYGSVNCTNLSQRPGGNNRP

SEQ ID NO: 40241 - protein, 31 aa, Artificial Sequence
  Description of Artificial Sequence: Synthetic polypeptide
DEEEIRTTNPVATEQYGSVNCTDDSQRGERS

SEQ ID NO: 40242 - protein, 28 aa, Artificial Sequence
  Description of Artificial Sequence: Synthetic peptide
DEAEIATTNPVATEQWGSVAMNLERGND

SEQ ID NO: 40243 - protein, 32 aa, Artificial Sequence
  Description of Artificial Sequence: Synthetic polypeptide
DEEEIRTTNPVATEQYGSVCSNTNHQRGSDQG

SEQ ID NO: 40244 - protein, 33 aa, Artificial Sequence
  Description of Artificial Sequence: Synthetic polypeptide
DEEEIRTTNPVATEQYGSVCSNTNHQRIGSNQE

SEQ ID NO: 40245 - protein, 30 aa, Artificial Sequence
  Description of Artificial Sequence: Synthetic polypeptide
DEVEIATTNPVAYEQYGTVSTNLQDGGNGR

SEQ ID NO: 40246 - protein, 34 aa, Artificial Sequence
  Description of Artificial Sequence: Synthetic polypeptide
DEEEIRTTNPVATEQYGSVCSNTNLNQGSGSNRG

SEQ ID NO: 40247 - protein, 34 aa, Artificial Sequence
  Description of Artificial Sequence: Synthetic polypeptide
DEEEIRTTNPVATEQYGSVCSNTNLQENGSNTRM

SEQ ID NO: 40248 - protein, 28 aa, Artificial Sequence
  Description of Artificial Sequence: Synthetic peptide
AENEIAPTNPVATEQYGEVSENLQRGGR

SEQ ID NO: 40249 - protein, 28 aa, Artificial Sequence
  Description of Artificial Sequence: Synthetic peptide
DENEIRCTNPVATEQYGDASENLQREDR

SEQ ID NO: 40250 - protein, 28 aa, Artificial Sequence
  Description of Artificial Sequence: Synthetic peptide
DENEIRCTNPVATEQWGDVSENLQREDR

SEQ ID NO: 40251 - protein, 29 aa, Artificial Sequence
  Description of Artificial Sequence: Synthetic peptide
DEEEIRTTNPVATEQYGSVNCLLQDNEER

SEQ ID NO: 40252 - protein, 32 aa, Artificial Sequence
  Description of Artificial Sequence: Synthetic polypeptide
DEEEIRTTNPVATESYGSVSTNNLQGFTGIRE

SEQ ID NO: 40253 - protein, 30 aa, Artificial Sequence
  Description of Artificial Sequence: Synthetic polypeptide
DEVEIATTNPVAYEQYGTVSTNLQGDGNRD

SEQ ID NO: 40254 - protein, 32 aa, Artificial Sequence
  Description of Artificial Sequence: Synthetic polypeptide
DEEEIRTTNPVATEQYGSVNCATDIDQRGNDR

SEQ ID NO: 40255 - protein, 30 aa, Artificial Sequence
  Description of Artificial Sequence: Synthetic polypeptide
DEEEIRTTNPVATEQYGSVNATTTQRTVND

SEQ ID NO: 40256 - protein, 29 aa, Artificial Sequence
  Description of Artificial Sequence: Synthetic peptide
DENEIRCTNPIATEQYGSVSEENLMRGNH

SEQ ID NO: 40257 - protein, 30 aa, Artificial Sequence
  Description of Artificial Sequence: Synthetic polypeptide
DENEIRCTNPIATEQYGSVSEDLQMRNGNR

SEQ ID NO: 40258 - protein, 29 aa, Artificial Sequence
  Description of Artificial Sequence: Synthetic peptide
DENEIRCTNPIATEQYGSVSEDLMRNGNR

SEQ ID NO: 40259 - protein, 30 aa, Artificial Sequence
  Description of Artificial Sequence: Synthetic polypeptide
DEEEIRTTNPVATEQYGSVNATNSDRNDNE

SEQ ID NO: 40260 - protein, 28 aa, Artificial Sequence
  Description of Artificial Sequence: Synthetic peptide
DENEICTVNPVATEQYGSVSTNLFEPNH

SEQ ID NO: 40261 - protein, 29 aa, Artificial Sequence
  Description of Artificial Sequence: Synthetic peptide
DENEICTVNPVATEQYGSVSTALQRNNQE

SEQ ID NO: 40262 - protein, 31 aa, Artificial Sequence
  Description of Artificial Sequence: Synthetic polypeptide
DEEEIATTNPVATEEYGSVSTNLQGDGGNQP

SEQ ID NO: 40263 - protein, 29 aa, Artificial Sequence
  Description of Artificial Sequence: Synthetic peptide
DEAEICTTNPVATECYGSVATNLQDGNDN

SEQ ID NO: 40264 - protein, 32 aa, Artificial Sequence
  Description of Artificial Sequence: Synthetic polypeptide
DEEEIKTTNPVATEQYGSVSTLNDLFQVRGEF

SEQ ID NO: 40265 - protein, 31 aa, Artificial Sequence
  Description of Artificial Sequence: Synthetic polypeptide
DEEEIATTNPVATECYGSVSTNLQDQGNDTA

SEQ ID NO: 40266 - protein, 30 aa, Artificial Sequence
  Description of Artificial Sequence: Synthetic polypeptide
DEVEIATTNPVATEQYGSVVTNLQDGNDEA

SEQ ID NO: 40267 - protein, 29 aa, Artificial Sequence
  Description of Artificial Sequence: Synthetic peptide
DENEIRTTNPVATEIYGSVSNNLQQSGTV

SEQ ID NO: 40268 - protein, 31 aa, Artificial Sequence
  Description of Artificial Sequence: Synthetic polypeptide
DEAEIATTNPVATEQYGCVATNLQERGDNRE

SEQ ID NO: 40269 - protein, 31 aa, Artificial Sequence
  Description of Artificial Sequence: Synthetic polypeptide
DEEEIRTTNPVATEQYGSVCQTELQEAGSND

SEQ ID NO: 40270 - protein, 30 aa, Artificial Sequence
  Description of Artificial Sequence: Synthetic polypeptide
DEVEIATTNPVATEQYGSVVTNLQGEGNDE

SEQ ID NO: 40271 - protein, 28 aa, Artificial Sequence
  Description of Artificial Sequence: Synthetic peptide
DENEIRTTNPVATEIYGSVSNNLQDVTW

SEQ ID NO: 40272 - protein, 29 aa, Artificial Sequence
  Description of Artificial Sequence: Synthetic peptide
DENEIRTTNPVATEIYGSVSNNLQDGTDE

SEQ ID NO: 40273 - protein, 30 aa, Artificial Sequence
  Description of Artificial Sequence: Synthetic polypeptide
DENEIRTTNPVATEIYGSVSNNLNQRNGTA

SEQ ID NO: 40274 - protein, 30 aa, Artificial Sequence
  Description of Artificial Sequence: Synthetic polypeptide
DEEEIRTTNPVATEQYGSVCQTNLINGELI

SEQ ID NO: 40275 - protein, 30 aa, Artificial Sequence
  Description of Artificial Sequence: Synthetic polypeptide
DEVEIATTNPVATEQYGTVSTNLQMGDNET

SEQ ID NO: 40276 - protein, 29 aa, Artificial Sequence
  Description of Artificial Sequence: Synthetic peptide
DENEIRTTNPVATEIYGSVSNNLEQIGTT

SEQ ID NO: 40277 - protein, 29 aa, Artificial Sequence
  Description of Artificial Sequence: Synthetic peptide
DENEIRTTNPVATEIYGSVSNNLQRDTQE

SEQ ID NO: 40278 - protein, 29 aa, Artificial Sequence
  Description of Artificial Sequence: Synthetic peptide
DEVEIATTNPVATERYGSVSTNLQEGGEG

SEQ ID NO: 40279 - protein, 31 aa, Artificial Sequence
  Description of Artificial Sequence: Synthetic polypeptide
DENEIRTTNPVATEIYGSVSNNLDQRNGNTQ

SEQ ID NO: 40280 - protein, 31 aa, Artificial Sequence
  Description of Artificial Sequence: Synthetic polypeptide
DEEEIKTTNPVATEQYGSVGTNGLFQVRGEF

SEQ ID NO: 40281 - protein, 31 aa, Artificial Sequence
  Description of Artificial Sequence: Synthetic polypeptide
DEEEIRTTNPVATEQYGSVCQTNLQTPQMMR

SEQ ID NO: 40282 - protein, 32 aa, Artificial Sequence
  Description of Artificial Sequence: Synthetic polypeptide
DEEEIRTTNPVATEQYGSVCSAANQLERDNHR

SEQ ID NO: 40283 - protein, 29 aa, Artificial Sequence
  Description of Artificial Sequence: Synthetic peptide
DENEIRTTNPVATEIYGSVSNNGQRGTWN

SEQ ID NO: 40284 - protein, 28 aa, Artificial Sequence
  Description of Artificial Sequence: Synthetic peptide
DENEIRTTNPVATEIYGSVSNNGNRGTW

SEQ ID NO: 40285 - protein, 33 aa, Artificial Sequence
  Description of Artificial Sequence: Synthetic polypeptide
DEEEIRTTNPVATERWGSTVSCTNALPQRGNNR

SEQ ID NO: 40286 - protein, 30 aa, Artificial Sequence
  Description of Artificial Sequence: Synthetic polypeptide
DEVEIATTNPVATESYGTVSTNLQGDSGNR

SEQ ID NO: 40287 - protein, 32 aa, Artificial Sequence
  Description of Artificial Sequence: Synthetic polypeptide
DEEEIKTTNPVATEQYGSVQATNLSQRGTNNA

SEQ ID NO: 40288 - protein, 33 aa, Artificial Sequence
  Description of Artificial Sequence: Synthetic polypeptide
DEEEIRTTNPVATEQYGSVCSATENLQQGNEME

SEQ ID NO: 40289 - protein, 30 aa, Artificial Sequence
  Description of Artificial Sequence: Synthetic polypeptide
DENEIRTTNPVATEIYGSVSNGNLDQRGIF

SEQ ID NO: 40290 - protein, 33 aa, Artificial Sequence
  Description of Artificial Sequence: Synthetic polypeptide
DEEEIRTTNPVATEQYGSVCQTNLQEYFGSNRP

SEQ ID NO: 40291 - protein, 30 aa, Artificial Sequence
  Description of Artificial Sequence: Synthetic polypeptide
DEVEIATTNPVATEQYGSVSVDDNLQRVNQ

SEQ ID NO: 40292 - protein, 30 aa, Artificial Sequence
  Description of Artificial Sequence: Synthetic polypeptide
DEVEIATTNPVATEQYGSVSTVLQHGGDNQ

SEQ ID NO: 40293 - protein, 30 aa, Artificial Sequence
  Description of Artificial Sequence: Synthetic polypeptide
DEVEIATTNPVATEQYGSVSTVLQGGMGNQ

SEQ ID NO: 40294 - protein, 30 aa, Artificial Sequence
  Description of Artificial Sequence: Synthetic polypeptide
DENEIRTTNPVATEIYGSVSPNLQRQGTWS

SEQ ID NO: 40295 - protein, 28 aa, Artificial Sequence
  Description of Artificial Sequence: Synthetic peptide
AENEIATTNPVATEQYGDVSENLQRGEL

SEQ ID NO: 40296 - protein, 31 aa, Artificial Sequence
  Description of Artificial Sequence: Synthetic polypeptide
DEEEIRTTNPVATEQYGSVCNTTNLMGRGEM

SEQ ID NO: 40297 - protein, 31 aa, Artificial Sequence
  Description of Artificial Sequence: Synthetic polypeptide
DEVEIATTNPVATEQYGSVSTNLQRDGEHGV

SEQ ID NO: 40298 - protein, 30 aa, Artificial Sequence
  Description of Artificial Sequence: Synthetic polypeptide
DENEIRTTNPVATEIYGSVSNVLLQRGNEF

SEQ ID NO: 40299 - protein, 31 aa, Artificial Sequence
  Description of Artificial Sequence: Synthetic polypeptide
DEVEIATTNPVATEQYGSVSTNLQSEGDGNV

SEQ ID NO: 40300 - protein, 28 aa, Artificial Sequence
  Description of Artificial Sequence: Synthetic peptide
AENEIATTNPVATEQYGDASENLQRGGR

SEQ ID NO: 40301 - protein, 32 aa, Artificial Sequence
  Description of Artificial Sequence: Synthetic polypeptide
DEEEIRTTNPVATEQYGSVCNTVNLIERGSDR

SEQ ID NO: 40302 - protein, 29 aa, Artificial Sequence
  Description of Artificial Sequence: Synthetic peptide
DEEEIRTTNPVATEQYGSVCPNLIASGDQ

SEQ ID NO: 40303 - protein, 30 aa, Artificial Sequence
  Description of Artificial Sequence: Synthetic polypeptide
DENEIRTTNPVATEIYGSVSNQNLQRGTGD

SEQ ID NO: 40304 - protein, 31 aa, Artificial Sequence
  Description of Artificial Sequence: Synthetic polypeptide
DEEEIRTTNPVATEQYGSVCPSPNLNRQGEE

SEQ ID NO: 40305 - protein, 31 aa, Artificial Sequence
  Description of Artificial Sequence: Synthetic polypeptide
DEEEIRTTNPVATEQYGSYTISTGEDQRGNG

SEQ ID NO: 40306 - protein, 30 aa, Artificial Sequence
  Description of Artificial Sequence: Synthetic polypeptide
DENEIRTTNPVATEIYGSVSNNNLQREGTD

SEQ ID NO: 40307 - protein, 29 aa, Artificial Sequence
  Description of Artificial Sequence: Synthetic peptide
DENEIRTTNPVATEIYGSVSNNNLQIGTV

SEQ ID NO: 40308 - protein, 33 aa, Artificial Sequence
  Description of Artificial Sequence: Synthetic polypeptide
DEEEIRTTNPVATEQYGSVCPTNFLNQRGSNTQ

SEQ ID NO: 40309 - protein, 30 aa, Artificial Sequence
  Description of Artificial Sequence: Synthetic polypeptide
DEEEIRTTNPVATEQYGSYSVSELDQRGEM

SEQ ID NO: 40310 - protein, 31 aa, Artificial Sequence
  Description of Artificial Sequence: Synthetic polypeptide
DEEEIRTTNPVATEQYGSVCPTNLQNENVLM

SEQ ID NO: 40311 - protein, 29 aa, Artificial Sequence
  Description of Artificial Sequence: Synthetic peptide
DENEIRTTNPVATEIYGSVSNNLTRGTQN

SEQ ID NO: 40312 - protein, 31 aa, Artificial Sequence
  Description of Artificial Sequence: Synthetic polypeptide
DEVEIATTNPVATEQYGSVSTNLQSGNGNVP

SEQ ID NO: 40313 - protein, 29 aa, Artificial Sequence
  Description of Artificial Sequence: Synthetic peptide
DENEIRTTNPVATEIYGSVSNNLQTGTES

SEQ ID NO: 40314 - protein, 32 aa, Artificial Sequence
  Description of Artificial Sequence: Synthetic polypeptide
DEEEIRTTNPVATEQYGSVCPTNLQRVGELVA

SEQ ID NO: 40315 - protein, 30 aa, Artificial Sequence
  Description of Artificial Sequence: Synthetic polypeptide
DEVEIATTNPVATEQYGSVSTNQQHMGGNM

SEQ ID NO: 40316 - protein, 31 aa, Artificial Sequence
  Description of Artificial Sequence: Synthetic polypeptide
DEEEIKTTNPVATEQYGHVSWTNLNNGMNVR

SEQ ID NO: 40317 - protein, 29 aa, Artificial Sequence
  Description of Artificial Sequence: Synthetic peptide
DENEIRTTNPVATEIYGSVSNNLQSGGTT

SEQ ID NO: 40318 - protein, 30 aa, Artificial Sequence
  Description of Artificial Sequence: Synthetic polypeptide
DEEEIRTTNPVATEQYGSMSVLLQRDNQIP

SEQ ID NO: 40319 - protein, 33 aa, Artificial Sequence
  Description of Artificial Sequence: Synthetic polypeptide
DEEEIRTTNPVATEQYGSVCSATNQLQRTTNLE

SEQ ID NO: 40320 - protein, 32 aa, Artificial Sequence
  Description of Artificial Sequence: Synthetic polypeptide
DEEEIRTTNPVATEQYGSVNGTDNLQEEGNNS

SEQ ID NO: 40321 - protein, 34 aa, Artificial Sequence
  Description of Artificial Sequence: Synthetic polypeptide
DEEEIRTTNPVATEQYGSVCSCTGNVSQRTGNNR

SEQ ID NO: 40322 - protein, 31 aa, Artificial Sequence
  Description of Artificial Sequence: Synthetic polypeptide
DENEIRTTNPVATEIYGSVSFNVLQRGNTFN

SEQ ID NO: 40323 - protein, 31 aa, Artificial Sequence
  Description of Artificial Sequence: Synthetic polypeptide
DEEEIRTTNPVATEQYGSVCSEILQRSGEEF

SEQ ID NO: 40324 - protein, 31 aa, Artificial Sequence
  Description of Artificial Sequence: Synthetic polypeptide
CEEEISTTNPVATEQYGVVSTNLQRFGSNAN

SEQ ID NO: 40325 - protein, 32 aa, Artificial Sequence
  Description of Artificial Sequence: Synthetic polypeptide
DEEEIRTTNPVATEQYGSLVPTNYQRTPGVNG

SEQ ID NO: 40326 - protein, 29 aa, Artificial Sequence
  Description of Artificial Sequence: Synthetic peptide
DENEIRTTNPVATECYGSVSNNLQDGTDS

SEQ ID NO: 40327 - protein, 33 aa, Artificial Sequence
  Description of Artificial Sequence: Synthetic polypeptide
DEEEIRTTNPVATEQYGSVCSETNDLNRNGNID

SEQ ID NO: 40328 - protein, 30 aa, Artificial Sequence
  Description of Artificial Sequence: Synthetic polypeptide
DEEEIRTTNPVATEQYGSVCSFDLEPGANP

SEQ ID NO: 40329 - protein, 32 aa, Artificial Sequence
  Description of Artificial Sequence: Synthetic polypeptide
DEEEIRTTNPVATEQYGSVCSGENLQSQGQRH

SEQ ID NO: 40330 - protein, 31 aa, Artificial Sequence
  Description of Artificial Sequence: Synthetic polypeptide
DEEEIRTTNPVATERYGKTVSTNFSQRGGNS

SEQ ID NO: 40331 - protein, 31 aa, Artificial Sequence
  Description of Artificial Sequence: Synthetic polypeptide
DEEEIRTTNPVATEQYGSLSVYDLTQRGNEQ

SEQ ID NO: 40332 - protein, 28 aa, Artificial Sequence
  Description of Artificial Sequence: Synthetic peptide
DENEIRTTNPVATECYGDVSENLQHGEL

SEQ ID NO: 40333 - protein, 33 aa, Artificial Sequence
  Description of Artificial Sequence: Synthetic polypeptide
DEEEIRTTNPVATEQYGSVCSGTENLEDYDGNR

SEQ ID NO: 40334 - protein, 33 aa, Artificial Sequence
  Description of Artificial Sequence: Synthetic polypeptide
DEEEIATTNPVAYEQYGQSVSQTNDLDQRGNQR

SEQ ID NO: 40335 - protein, 31 aa, Artificial Sequence
  Description of Artificial Sequence: Synthetic polypeptide
DEEEIRTTNPVATEQYGSVNETNLNVGNMVL

SEQ ID NO: 40336 - protein, 33 aa, Artificial Sequence
  Description of Artificial Sequence: Synthetic polypeptide
DEEEIRTTNPVATERYGSTVPSCTNALSQFGNR

SEQ ID NO: 40337 - protein, 33 aa, Artificial Sequence
  Description of Artificial Sequence: Synthetic polypeptide
DEEEIRTTNPVATERYGSTVSCTIELSQRGGNR

SEQ ID NO: 40338 - protein, 33 aa, Artificial Sequence
  Description of Artificial Sequence: Synthetic polypeptide
DEEEIRTTNPVATERYGSTVSCTNALPQKGGNR

SEQ ID NO: 40339 - protein, 34 aa, Artificial Sequence
  Description of Artificial Sequence: Synthetic polypeptide
DEEEIRTTNPVATERYGSTVSCTNMLPQRTGNNR

SEQ ID NO: 40340 - protein, 32 aa, Artificial Sequence
  Description of Artificial Sequence: Synthetic polypeptide
DEEEIRTTNPVATERYGSTVSTNAQSQFGGNR

SEQ ID NO: 40341 - protein, 31 aa, Artificial Sequence
  Description of Artificial Sequence: Synthetic polypeptide
DEEEIRTTNPVATEQYGSVNTTFNLNGNGTR

SEQ ID NO: 40342 - protein, 30 aa, Artificial Sequence
  Description of Artificial Sequence: Synthetic polypeptide
DEEEIRTTNPVATEQYGSVNETNDDEGNEI

SEQ ID NO: 40343 - protein, 28 aa, Artificial Sequence
  Description of Artificial Sequence: Synthetic peptide
DEVEIATTNPVATIQYGMVSTALQRGGD

SEQ ID NO: 40344 - protein, 29 aa, Artificial Sequence
  Description of Artificial Sequence: Synthetic peptide
DEVEIATTNPVATIQYGMVSTALQRGNEH

SEQ ID NO: 40345 - protein, 28 aa, Artificial Sequence
  Description of Artificial Sequence: Synthetic peptide
DEVEIATTNPVATIQYGMVSTALQSGQR

SEQ ID NO: 40346 - protein, 30 aa, Artificial Sequence
  Description of Artificial Sequence: Synthetic polypeptide
DENEIRTTNPVATECWGSVSCNEPQRGENR

SEQ ID NO: 40347 - protein, 33 aa, Artificial Sequence
  Description of Artificial Sequence: Synthetic polypeptide
DEEEIRTTNPVATERYGSTVSYTNALSQTGNNR

SEQ ID NO: 40348 - protein, 30 aa, Artificial Sequence
  Description of Artificial Sequence: Synthetic polypeptide
DEEEIRTTNPVATEQYGSVCSEDNLQNNQE

SEQ ID NO: 40349 - protein, 30 aa, Artificial Sequence
  Description of Artificial Sequence: Synthetic polypeptide
DEEEIATTNPVAYEQYGSVATNLQENPGER

SEQ ID NO: 40350 - protein, 29 aa, Artificial Sequence
  Description of Artificial Sequence: Synthetic peptide
DEVEIATTNPVATIQWGMVSTALQRGENR

SEQ ID NO: 40351 - protein, 31 aa, Artificial Sequence
  Description of Artificial Sequence: Synthetic polypeptide
DEEEIRTTNPVATEQYGSVCSEDLQRMINDN

SEQ ID NO: 40352 - protein, 29 aa, Artificial Sequence
  Description of Artificial Sequence: Synthetic peptide
DEVEIATTNPVATETYGCVSTNLGDGNER

SEQ ID NO: 40353 - protein, 31 aa, Artificial Sequence
  Description of Artificial Sequence: Synthetic polypeptide
DENEIRTTNPVATEIYGSVSFNVLQRGNEKG

SEQ ID NO: 40354 - protein, 34 aa, Artificial Sequence
  Description of Artificial Sequence: Synthetic polypeptide
DEEEIRTTNPVATEQYGSVCSCTNELSTQGGNRV

SEQ ID NO: 40355 - protein, 30 aa, Artificial Sequence
  Description of Artificial Sequence: Synthetic polypeptide
DEEEIRTTNPVATEQYGSMNVYDLQRGNEQ

SEQ ID NO: 40356 - protein, 29 aa, Artificial Sequence
  Description of Artificial Sequence: Synthetic peptide
DENEIRTTNPVATEIYGSVSEPLQRGTQQ

SEQ ID NO: 40357 - protein, 32 aa, Artificial Sequence
  Description of Artificial Sequence: Synthetic polypeptide
DEEEIRTTNPVATEQYGSVCSCTNGDQRGSEF

SEQ ID NO: 40358 - protein, 32 aa, Artificial Sequence
  Description of Artificial Sequence: Synthetic polypeptide
DEEEIRTTNPVATERYGCVVCCTNLSQRGSNR

SEQ ID NO: 40359 - protein, 28 aa, Artificial Sequence
  Description of Artificial Sequence: Synthetic peptide
DENEIRTTNPVATEIYGSVDNNLQGGTI

SEQ ID NO: 40360 - protein, 33 aa, Artificial Sequence
  Description of Artificial Sequence: Synthetic polypeptide
DEEEIRTTNPVATEQYGSVCSCTNLSGQTGGNN

SEQ ID NO: 40361 - protein, 30 aa, Artificial Sequence
  Description of Artificial Sequence: Synthetic polypeptide
DENEIRTTNPVATEIYGSVCSWNLQRGSEW

SEQ ID NO: 40362 - protein, 28 aa, Artificial Sequence
  Description of Artificial Sequence: Synthetic peptide
DENEIRTTNPVATEIYGSCSNPLQRGTQ

SEQ ID NO: 40363 - protein, 30 aa, Artificial Sequence
  Description of Artificial Sequence: Synthetic polypeptide
DENEIRTTNPVATEIYGQSVSWNLQRGSDQ

SEQ ID NO: 40364 - protein, 31 aa, Artificial Sequence
  Description of Artificial Sequence: Synthetic polypeptide
DEEEIRTTNPVATEQYGSVCSDNLQTGLEMT

SEQ ID NO: 40365 - protein, 31 aa, Artificial Sequence
  Description of Artificial Sequence: Synthetic polypeptide
DEEEIRTTNPVATEQYGSYSVNDQRGGEEER

SEQ ID NO: 40366 - protein, 29 aa, Artificial Sequence
  Description of Artificial Sequence: Synthetic peptide
DENEIRTTNPVATEIYGCVSWNLQRGSVA

SEQ ID NO: 40367 - protein, 30 aa, Artificial Sequence
  Description of Artificial Sequence: Synthetic polypeptide
DEEEIRTTNPVATEQYGSYSVNDQIGNEEF

SEQ ID NO: 40368 - protein, 30 aa, Artificial Sequence
  Description of Artificial Sequence: Synthetic polypeptide
DEVEIATTNPVATEVYGSVSTNLQGMGDNS

SEQ ID NO: 40369 - protein, 29 aa, Artificial Sequence
  Description of Artificial Sequence: Synthetic peptide
DENEIRTTNPVATEIWGSVSTNEQMTGNF

SEQ ID NO: 40370 - protein, 33 aa, Artificial Sequence
  Description of Artificial Sequence: Synthetic polypeptide
DEEEIRTTNPVATEQYGSVCSDTNTNQNFGSNR

SEQ ID NO: 40371 - protein, 32 aa, Artificial Sequence
  Description of Artificial Sequence: Synthetic polypeptide
DEEEIRTTNPVATEQYGSVCSDTPLQEGGSNQ

SEQ ID NO: 40372 - protein, 30 aa, Artificial Sequence
  Description of Artificial Sequence: Synthetic polypeptide
DEVEIATTNPVATEWYGSVSTNLQDGGTNE

SEQ ID NO: 40373 - protein, 30 aa, Artificial Sequence
  Description of Artificial Sequence: Synthetic polypeptide
DEEEIKTTNPVATEQYGSVSSNDQFFGSKR

SEQ ID NO: 40374 - protein, 30 aa, Artificial Sequence
  Description of Artificial Sequence: Synthetic polypeptide
DEEEIRTTNPVATEQYGSLVSYDLDNGERV

SEQ ID NO: 40375 - protein, 30 aa, Artificial Sequence
  Description of Artificial Sequence: Synthetic polypeptide
DEVEIATTNPVATHQYGCVSTALQRGSNRS

SEQ ID NO: 40376 - protein, 32 aa, Artificial Sequence
  Description of Artificial Sequence: Synthetic polypeptide
DEEEIRTTNPVATEQYGSVCSDTYLNQSSQNR

SEQ ID NO: 40377 - protein, 31 aa, Artificial Sequence
  Description of Artificial Sequence: Synthetic polypeptide
CEEEISTTNPVATEQYGSVCSNTELQFGSNR

SEQ ID NO: 40378 - protein, 32 aa, Artificial Sequence
  Description of Artificial Sequence: Synthetic polypeptide
DEEEIRTTNPVATEQYGSVNNTNLQNREGDEN

SEQ ID NO: 40379 - protein, 32 aa, Artificial Sequence
  Description of Artificial Sequence: Synthetic polypeptide
DEEEIRTTNPVATEQYGTVTVSTNLEQYGNEA

SEQ ID NO: 40380 - protein, 30 aa, Artificial Sequence
  Description of Artificial Sequence: Synthetic polypeptide
DEAEIATTNPVAYEQYGSVSTNLQGDGNHE

SEQ ID NO: 40381 - protein, 31 aa, Artificial Sequence
  Description of Artificial Sequence: Synthetic polypeptide
DEEEIRTTNPVATEQYGSVATPNLQDGPEVM

SEQ ID NO: 40382 - protein, 31 aa, Artificial Sequence
  Description of Artificial Sequence: Synthetic polypeptide
DEEEIRTTNPVATEQYGSVATPNLQDGPVQD

SEQ ID NO: 40383 - protein, 31 aa, Artificial Sequence
  Description of Artificial Sequence: Synthetic polypeptide
CEEEIRTTNPVATEQYGSVDSTNLQNNSNQP

SEQ ID NO: 40384 - protein, 32 aa, Artificial Sequence
  Description of Artificial Sequence: Synthetic polypeptide
DEEEIGTTNPVATEQYGSVSTELLQERMGNQE

SEQ ID NO: 40385 - protein, 32 aa, Artificial Sequence
  Description of Artificial Sequence: Synthetic polypeptide
DEEEIRTTNPVATEQYGSVNSGNLQDEEGNEA

SEQ ID NO: 40386 - protein, 30 aa, Artificial Sequence
  Description of Artificial Sequence: Synthetic polypeptide
DEEEIGTTNPVATEQYGSVSTELQGGSDQP

SEQ ID NO: 40387 - protein, 33 aa, Artificial Sequence
  Description of Artificial Sequence: Synthetic polypeptide
CEEEIRTTNPVATEQYGSVFYTDNLKQRGENDR

SEQ ID NO: 40388 - protein, 33 aa, Artificial Sequence
  Description of Artificial Sequence: Synthetic polypeptide
DEEEIGTTNPVATEQYGSVSTENLLQERMGSNL

SEQ ID NO: 40389 - protein, 32 aa, Artificial Sequence
  Description of Artificial Sequence: Synthetic polypeptide
DEEEIATTNPVAYEQYGSVPSCTNLQSEGNER

SEQ ID NO: 40390 - protein, 33 aa, Artificial Sequence
  Description of Artificial Sequence: Synthetic polypeptide
DEEEIATTNPVAYEQYGSVPSCTNLQRGGNNRL

SEQ ID NO: 40391 - protein, 32 aa, Artificial Sequence
  Description of Artificial Sequence: Synthetic polypeptide
DEEEIGTTNPVATEQYGSVSTENQLQERMGPL

SEQ ID NO: 40392 - protein, 29 aa, Artificial Sequence
  Description of Artificial Sequence: Synthetic peptide
DEEEIRTTNPVATEQYGSVATTPQDLNDD

SEQ ID NO: 40393 - protein, 30 aa, Artificial Sequence
  Description of Artificial Sequence: Synthetic polypeptide
DEEEIRTTNPVATEQYGSVNTLLDDRINEE

SEQ ID NO: 40394 - protein, 32 aa, Artificial Sequence
  Description of Artificial Sequence: Synthetic polypeptide
DEAEIATTNPVATEQYGSVATNLQDRGDNNRD

SEQ ID NO: 40395 - protein, 32 aa, Artificial Sequence
  Description of Artificial Sequence: Synthetic polypeptide
CEEEIRTTNPVATEQYGSVNTSNLDGRGENYR

SEQ ID NO: 40396 - protein, 31 aa, Artificial Sequence
  Description of Artificial Sequence: Synthetic polypeptide
DEEEIRTTNPVATEQYGTFSTINPLQRFENA

SEQ ID NO: 40397 - protein, 33 aa, Artificial Sequence
  Description of Artificial Sequence: Synthetic polypeptide
CEEEIRTTNPVATEQYGSVPSCTNLSQRGGNQE

SEQ ID NO: 40398 - protein, 32 aa, Artificial Sequence
  Description of Artificial Sequence: Synthetic polypeptide
DEEEIGTTNPVATEQYGSVSTGNQGQERNGNH

SEQ ID NO: 40399 - protein, 31 aa, Artificial Sequence
  Description of Artificial Sequence: Synthetic polypeptide
DEEEIRTTNPVATEQYGTTISTLNALQRENN

SEQ ID NO: 40400 - protein, 32 aa, Artificial Sequence
  Description of Artificial Sequence: Synthetic polypeptide
CEEEIRTTNPVATEQYGSVPSCTNLSQRVNND

SEQ ID NO: 40401 - protein, 31 aa, Artificial Sequence
  Description of Artificial Sequence: Synthetic polypeptide
DEEEIRTTNPVATEQYGTTISPNELQHDGNR

SEQ ID NO: 40402 - protein, 31 aa, Artificial Sequence
  Description of Artificial Sequence: Synthetic polypeptide
DEEEIGTTNPVATEQYGSVSTDQSQERMGNL

SEQ ID NO: 40403 - protein, 32 aa, Artificial Sequence
  Description of Artificial Sequence: Synthetic polypeptide
DEEEIGTTNPVATEQYGSVSTGNQLQDNMGNL

SEQ ID NO: 40404 - protein, 29 aa, Artificial Sequence
  Description of Artificial Sequence: Synthetic peptide
DEEEIRTTNPVATEQYGSVNTENTNNQER

SEQ ID NO: 40405 - protein, 31 aa, Artificial Sequence
  Description of Artificial Sequence: Synthetic polypeptide
CEEEIRTTNPVATEQYGSVCSTPNLQNFGED

SEQ ID NO: 40406 - protein, 31 aa, Artificial Sequence
  Description of Artificial Sequence: Synthetic polypeptide
DEEEIATTNPVAYEQYGSVSMTGLQRGNSTI

SEQ ID NO: 40407 - protein, 29 aa, Artificial Sequence
  Description of Artificial Sequence: Synthetic peptide
DEAEIATTNPVATEQYGSVATNLQGDNDN

SEQ ID NO: 40408 - protein, 33 aa, Artificial Sequence
  Description of Artificial Sequence: Synthetic polypeptide
DEEEIGTTNPVATEQYGSVSPTNQLEQERMGNL

SEQ ID NO: 40409 - protein, 31 aa, Artificial Sequence
  Description of Artificial Sequence: Synthetic polypeptide
DETEIRTTNPVAYEQYGTVSTNLQGGGDDNR

SEQ ID NO: 40410 - protein, 31 aa, Artificial Sequence
  Description of Artificial Sequence: Synthetic polypeptide
CEEEIRTTNPVATEQYGSCSTNLQNNGEDRI

SEQ ID NO: 40411 - protein, 33 aa, Artificial Sequence
  Description of Artificial Sequence: Synthetic polypeptide
DEEEIGTTNPVATEQYGSVSPTPNQLQERMGNL

SEQ ID NO: 40412 - protein, 31 aa, Artificial Sequence
  Description of Artificial Sequence: Synthetic polypeptide
CEEEIRTTNPVATEQYGSSVSTENPTGGNRT

SEQ ID NO: 40413 - protein, 30 aa, Artificial Sequence
  Description of Artificial Sequence: Synthetic polypeptide
DETEIRTTNPVAYEQYGTVSTNLQGQGNEQ

SEQ ID NO: 40414 - protein, 29 aa, Artificial Sequence
  Description of Artificial Sequence: Synthetic peptide
DEAEIATTNPVATEQYGSVATNLQESGDK

SEQ ID NO: 40415 - protein, 31 aa, Artificial Sequence
  Description of Artificial Sequence: Synthetic polypeptide
DEEEIRTTNPVATEQYGSVATNVLQTEGIPD

SEQ ID NO: 40416 - protein, 31 aa, Artificial Sequence
  Description of Artificial Sequence: Synthetic polypeptide
CEEEIRTTNPVATEQYGSTVSAMNLDEFGNR

SEQ ID NO: 40417 - protein, 30 aa, Artificial Sequence
  Description of Artificial Sequence: Synthetic polypeptide
DEEEIRTTNPVATEQYGSVATPAIQGGNDQ

SEQ ID NO: 40418 - protein, 30 aa, Artificial Sequence
  Description of Artificial Sequence: Synthetic polypeptide
CEEEIRTTNPVATEQYGSVATALEQNGDFR

SEQ ID NO: 40419 - protein, 31 aa, Artificial Sequence
  Description of Artificial Sequence: Synthetic polypeptide
DENEIRTTNPVATEQYGSVSYDNLVQRGEDQ

SEQ ID NO: 40420 - protein, 30 aa, Artificial Sequence
  Description of Artificial Sequence: Synthetic polypeptide
DETEIRTTNPVAYEQYGTVSTNLQNGGNSS

SEQ ID NO: 40421 - protein, 30 aa, Artificial Sequence
  Description of Artificial Sequence: Synthetic polypeptide
DEEEIRTTNPVATEQYGTTSTNNQLQDENN

SEQ ID NO: 40422 - protein, 30 aa, Artificial Sequence
  Description of Artificial Sequence: Synthetic polypeptide
DETEIRTTNPVAYEQYGTVSTNLQPDGNDT

SEQ ID NO: 40423 - protein, 32 aa, Artificial Sequence
  Description of Artificial Sequence: Synthetic polypeptide
DEEEIRTTNPVATEQYGSVNTENDLQRGSSQD

SEQ ID NO: 40424 - protein, 33 aa, Artificial Sequence
  Description of Artificial Sequence: Synthetic polypeptide
CEEEIRTTNPVATEQYGSVCSTNLNQRFGSNQA

SEQ ID NO: 40425 - protein, 30 aa, Artificial Sequence
  Description of Artificial Sequence: Synthetic polypeptide
DETEIRTTNPVAYEQYGTVSTNLQPDNGNQ

SEQ ID NO: 40426 - protein, 31 aa, Artificial Sequence
  Description of Artificial Sequence: Synthetic polypeptide
DEEEIRTTNPVATEQYGSVATPNLDRNGTES

SEQ ID NO: 40427 - protein, 29 aa, Artificial Sequence
  Description of Artificial Sequence: Synthetic peptide
DETEIRTTNPVAYEQYGTVSTNQQNGNES

SEQ ID NO: 40428 - protein, 30 aa, Artificial Sequence
  Description of Artificial Sequence: Synthetic polypeptide
DEEEIRTTNPVATEQYGSVCAANLQDDNEH

SEQ ID NO: 40429 - protein, 29 aa, Artificial Sequence
  Description of Artificial Sequence: Synthetic peptide
AENEIRTTNPVATECYGSVSENEQDRGGR

SEQ ID NO: 40430 - protein, 31 aa, Artificial Sequence
  Description of Artificial Sequence: Synthetic polypeptide
DEEEIRTTNPVATEQYGTTCSTGNMLQRENN

SEQ ID NO: 40431 - protein, 29 aa, Artificial Sequence
  Description of Artificial Sequence: Synthetic peptide
DEAEIATTNPVATEQYGSVATNLERGIED

SEQ ID NO: 40432 - protein, 28 aa, Artificial Sequence
  Description of Artificial Sequence: Synthetic peptide
DETSIATTNPLATEQWGSVSFNLQDGNR

SEQ ID NO: 40433 - protein, 28 aa, Artificial Sequence
  Description of Artificial Sequence: Synthetic peptide
DEAEIATTNPVAYEQYGSVATNLQSGSV

SEQ ID NO: 40434 - protein, 31 aa, Artificial Sequence
  Description of Artificial Sequence: Synthetic polypeptide
DEEEIRTTNPVATEQYGSVCATNDEQGDGNS

SEQ ID NO: 40435 - protein, 33 aa, Artificial Sequence
  Description of Artificial Sequence: Synthetic polypeptide
DEEEIGTTNPVATEQYGSVSTNGLPQERMGNQL

SEQ ID NO: 40436 - protein, 28 aa, Artificial Sequence
  Description of Artificial Sequence: Synthetic peptide
DEAEIATTNPVAYEQYGSVATNLQVGDA

SEQ ID NO: 40437 - protein, 32 aa, Artificial Sequence
  Description of Artificial Sequence: Synthetic polypeptide
DENEIRTTNPVATEQYGSVSTNNADQRGNDGQ

SEQ ID NO: 40438 - protein, 30 aa, Artificial Sequence
  Description of Artificial Sequence: Synthetic polypeptide
DEAEIATTNPVATEQYGSVATNLERGDNPN

SEQ ID NO: 40439 - protein, 28 aa, Artificial Sequence
  Description of Artificial Sequence: Synthetic peptide
DETSIRCTNPEATEQWGSVSANLQDGNR

SEQ ID NO: 40440 - protein, 30 aa, Artificial Sequence
  Description of Artificial Sequence: Synthetic polypeptide
DEAEIATTNPVATEQYGSVATNLERGDNDD

SEQ ID NO: 40441 - protein, 28 aa, Artificial Sequence
  Description of Artificial Sequence: Synthetic peptide
DETSIRTTNPCATEQFGSVSFNLQSGNQ

SEQ ID NO: 40442 - protein, 31 aa, Artificial Sequence
  Description of Artificial Sequence: Synthetic polypeptide
CEEEIRTTNPVATEQYGSVSTELQAFGSENQ

SEQ ID NO: 40443 - protein, 31 aa, Artificial Sequence
  Description of Artificial Sequence: Synthetic polypeptide
CEEEIRTTNPVATEQYGSVSTELQGMGSNQM

SEQ ID NO: 40444 - protein, 32 aa, Artificial Sequence
  Description of Artificial Sequence: Synthetic polypeptide
DEEEIRTTNPVATEQYGSVCATNETRGENDRQ

SEQ ID NO: 40445 - protein, 31 aa, Artificial Sequence
  Description of Artificial Sequence: Synthetic polypeptide
CEEEIRTTNPVATEQYGSVSTGLQRNANFGT

SEQ ID NO: 40446 - protein, 28 aa, Artificial Sequence
  Description of Artificial Sequence: Synthetic peptide
DETSIRTTNPCATEQFGSVSFNLQSGNV

SEQ ID NO: 40447 - protein, 29 aa, Artificial Sequence
  Description of Artificial Sequence: Synthetic peptide
DEAEIATTNPVATEQYGSVATNLERDNDA

SEQ ID NO: 40448 - protein, 29 aa, Artificial Sequence
  Description of Artificial Sequence: Synthetic peptide
DEAEIATTNPVATEQYGSVATNLEQMNER

SEQ ID NO: 40449 - protein, 29 aa, Artificial Sequence
  Description of Artificial Sequence: Synthetic peptide
DETSIRTTNPCATEQFGSVSFNLSQSGNR

SEQ ID NO: 40450 - protein, 32 aa, Artificial Sequence
  Description of Artificial Sequence: Synthetic polypeptide
CEEEIRTTNPVATEQYGSVSTGNLQERNSNFA

SEQ ID NO: 40451 - protein, 31 aa, Artificial Sequence
  Description of Artificial Sequence: Synthetic polypeptide
DEEEIRTTNPVATEQYGTSSTINPLQRESNV

SEQ ID NO: 40452 - protein, 28 aa, Artificial Sequence
  Description of Artificial Sequence: Synthetic peptide
DETSIATTNPCATEQFGSVSYNLQSGNR

SEQ ID NO: 40453 - protein, 28 aa, Artificial Sequence
  Description of Artificial Sequence: Synthetic peptide
DETNIRTTNPVATEQYGCVETNPQNGNE

SEQ ID NO: 40454 - protein, 30 aa, Artificial Sequence
  Description of Artificial Sequence: Synthetic polypeptide
DENEIRTTNPVATEQYGSVSTNPLTNNLNS

SEQ ID NO: 40455 - protein, 30 aa, Artificial Sequence
  Description of Artificial Sequence: Synthetic polypeptide
DEAEIATTNPVATEQYGSVATNLERGLNNL

SEQ ID NO: 40456 - protein, 28 aa, Artificial Sequence
  Description of Artificial Sequence: Synthetic peptide
AENEIRTTNPVATECYGEVSENEQRGGR

SEQ ID NO: 40457 - protein, 31 aa, Artificial Sequence
  Description of Artificial Sequence: Synthetic polypeptide
DEEEIATTNPMATEQYGSVPATNLQRGGNQA

SEQ ID NO: 40458 - protein, 30 aa, Artificial Sequence
  Description of Artificial Sequence: Synthetic polypeptide
DEAEIATTNPVATEQYGSVATNLQANGNDH

SEQ ID NO: 40459 - protein, 30 aa, Artificial Sequence
  Description of Artificial Sequence: Synthetic polypeptide
DEAEIATTNPVATEQYGSVATNLQAEENRD

SEQ ID NO: 40460 - protein, 29 aa, Artificial Sequence
  Description of Artificial Sequence: Synthetic peptide
DEAEIATTNPVATEQYGSVATNLQADNDN

SEQ ID NO: 40461 - protein, 30 aa, Artificial Sequence
  Description of Artificial Sequence: Synthetic polypeptide
DEAEIATTNPVATEQYGSVATNLQADGNDD

SEQ ID NO: 40462 - protein, 30 aa, Artificial Sequence
  Description of Artificial Sequence: Synthetic polypeptide
DEAEIATTNPVATEQYGSVATNLERTGNVD

SEQ ID NO: 40463 - protein, 31 aa, Artificial Sequence
  Description of Artificial Sequence: Synthetic polypeptide
DEEEIGTTNPVATEQYGSVSTLQLQETMGNL

SEQ ID NO: 40464 - protein, 31 aa, Artificial Sequence
  Description of Artificial Sequence: Synthetic polypeptide
DEEEIRTTNPVATEQYGSVNTMDLQRVGDQE

SEQ ID NO: 40465 - protein, 31 aa, Artificial Sequence
  Description of Artificial Sequence: Synthetic polypeptide
DEEEIRTTNPVATEQYGSVCAMNEQRGPNQD

SEQ ID NO: 40466 - protein, 28 aa, Artificial Sequence
  Description of Artificial Sequence: Synthetic peptide
AENEIRTTNPVATEQYGDASENLQRGDA

SEQ ID NO: 40467 - protein, 30 aa, Artificial Sequence
  Description of Artificial Sequence: Synthetic polypeptide
DEEEIRTTNPVATEQYGSVNTNDLGQLEEQ

SEQ ID NO: 40468 - protein, 32 aa, Artificial Sequence
  Description of Artificial Sequence: Synthetic polypeptide
DEEEIRTTNPVATEQYGSVCATDNDEQDDGNR

SEQ ID NO: 40469 - protein, 29 aa, Artificial Sequence
  Description of Artificial Sequence: Synthetic peptide
DEEEIRTTNPVATEQYGSVNSEDDRGDRI

SEQ ID NO: 40470 - protein, 30 aa, Artificial Sequence
  Description of Artificial Sequence: Synthetic polypeptide
DEAEIATTNPVATEQYGSVATNLERGQNED

SEQ ID NO: 40471 - protein, 29 aa, Artificial Sequence
  Description of Artificial Sequence: Synthetic peptide
DEAEIATTNPVATEQYGSVATNLERGPYD

SEQ ID NO: 40472 - protein, 30 aa, Artificial Sequence
  Description of Artificial Sequence: Synthetic polypeptide
DENEIRTTNPVATEQYGSVSTPNDQEGEDT

SEQ ID NO: 40473 - protein, 31 aa, Artificial Sequence
  Description of Artificial Sequence: Synthetic polypeptide
DENEIRTTNPVATEQYGSVSTPNDLQNQNDM

SEQ ID NO: 40474 - protein, 28 aa, Artificial Sequence
  Description of Artificial Sequence: Synthetic peptide
DETGIRTTNPCATEQWGSVSVNLVAGNR

SEQ ID NO: 40475 - protein, 32 aa, Artificial Sequence
  Description of Artificial Sequence: Synthetic polypeptide
DENEIRTTNPVATEQYGSVSTNTERSGENMRN

SEQ ID NO: 40476 - protein, 28 aa, Artificial Sequence
  Description of Artificial Sequence: Synthetic peptide
DETGIRTTNPCATEQWGSVSVTLQTGNR

SEQ ID NO: 40477 - protein, 30 aa, Artificial Sequence
  Description of Artificial Sequence: Synthetic polypeptide
DEAEIATTNPVATEQYGSVATNLERGNTDP

SEQ ID NO: 40478 - protein, 30 aa, Artificial Sequence
  Description of Artificial Sequence: Synthetic polypeptide
DEEEIRTTNPVATEQYGSVCAQNDQPGEDR

SEQ ID NO: 40479 - protein, 28 aa, Artificial Sequence
  Description of Artificial Sequence: Synthetic peptide
AENEIRTTNPVATEQYGEAAENLQRGGR

SEQ ID NO: 40480 - protein, 30 aa, Artificial Sequence
  Description of Artificial Sequence: Synthetic polypeptide
DEAEIATTNPVATEQYGSVATNLQGGPNNQ

SEQ ID NO: 40481 - protein, 29 aa, Artificial Sequence
  Description of Artificial Sequence: Synthetic peptide
AENEIRTTNPVATEQYGEASENIQRNGNR

SEQ ID NO: 40482 - protein, 29 aa, Artificial Sequence
  Description of Artificial Sequence: Synthetic peptide
DEAEIATTNPVATEQYGSVATNLQVAGDL

SEQ ID NO: 40483 - protein, 31 aa, Artificial Sequence
  Description of Artificial Sequence: Synthetic polypeptide
DEEEIRTTNPVATEQYGSVNTELQQQRGMQL

SEQ ID NO: 40484 - protein, 33 aa, Artificial Sequence
  Description of Artificial Sequence: Synthetic polypeptide
DEEEIRTTNPVATEQYGSVNSGTNLQNDVGNED

SEQ ID NO: 40485 - protein, 29 aa, Artificial Sequence
  Description of Artificial Sequence: Synthetic peptide
DENEIRTTNPVAYEAYGSVSNNLSQRGSV

SEQ ID NO: 40486 - protein, 29 aa, Artificial Sequence
  Description of Artificial Sequence: Synthetic peptide
DENEIRTTNPVAYEAYGSVSNNLQRGGSD

SEQ ID NO: 40487 - protein, 29 aa, Artificial Sequence
  Description of Artificial Sequence: Synthetic peptide
DEAEIATTNPVATEQYGSVATNLQSGDPY

SEQ ID NO: 40488 - protein, 32 aa, Artificial Sequence
  Description of Artificial Sequence: Synthetic polypeptide
DEEEIRTTNPVATEQYGTVCSTENLQNGSQRA

SEQ ID NO: 40489 - protein, 32 aa, Artificial Sequence
  Description of Artificial Sequence: Synthetic polypeptide
CEEEIRTTNPVATEQYGISVCSTELQRFGSER

SEQ ID NO: 40490 - protein, 30 aa, Artificial Sequence
  Description of Artificial Sequence: Synthetic polypeptide
DEEEIATTNPVAYEQYGSVSTNLNGDMGNA

SEQ ID NO: 40491 - protein, 31 aa, Artificial Sequence
  Description of Artificial Sequence: Synthetic polypeptide
DEEEIATTNPVAYEQYGSVSTNLGGGGDNNR

SEQ ID NO: 40492 - protein, 30 aa, Artificial Sequence
  Description of Artificial Sequence: Synthetic polypeptide
DEEEIATTNPVAYEQYGSVSTNGNQQGNEQ

SEQ ID NO: 40493 - protein, 30 aa, Artificial Sequence
  Description of Artificial Sequence: Synthetic polypeptide
DEAEIATTNPVATEQYGSVATNLQRNNNQM

SEQ ID NO: 40494 - protein, 32 aa, Artificial Sequence
  Description of Artificial Sequence: Synthetic polypeptide
DEEEIGTTNPVATEQYGSVCSTNLFRGGNPTF

SEQ ID NO: 40495 - protein, 32 aa, Artificial Sequence
  Description of Artificial Sequence: Synthetic polypeptide
DEEEIATTNPVAYEQYGSVSTNELSQERHGNL

SEQ ID NO: 40496 - protein, 30 aa, Artificial Sequence
  Description of Artificial Sequence: Synthetic polypeptide
DENEIRTTNPVAVEQYGSVSTTNLEEDENR

SEQ ID NO: 40497 - protein, 30 aa, Artificial Sequence
  Description of Artificial Sequence: Synthetic polypeptide
DEEEIATTNPVAYEQYGSVSTNDQGPGNPD

SEQ ID NO: 40498 - protein, 29 aa, Artificial Sequence
  Description of Artificial Sequence: Synthetic peptide
DENEIRTTNPVAVEQYGSVSTTNLDDENG

SEQ ID NO: 40499 - protein, 30 aa, Artificial Sequence
  Description of Artificial Sequence: Synthetic polypeptide
DENEIRTTNPVAVEQYGSVSISTNLERENG

SEQ ID NO: 40500 - protein, 28 aa, Artificial Sequence
  Description of Artificial Sequence: Synthetic peptide
DEEEIATTNPIATEPYGSVATNGGRGNA

SEQ ID NO: 40501 - protein, 30 aa, Artificial Sequence
  Description of Artificial Sequence: Synthetic polypeptide
DENEIRTTNPVAVEQYGSVISTNLERNIRE

SEQ ID NO: 40502 - protein, 29 aa, Artificial Sequence
  Description of Artificial Sequence: Synthetic peptide
DENEIRTTNPVAVEQYGSVISTNLEGTNT

SEQ ID NO: 40503 - protein, 31 aa, Artificial Sequence
  Description of Artificial Sequence: Synthetic polypeptide
DEEEIATTNPVAYEQYGSVSTNPQPGEGDNR

SEQ ID NO: 40504 - protein, 32 aa, Artificial Sequence
  Description of Artificial Sequence: Synthetic polypeptide
DENEIRTTNPVAYEQYGSVSCTLNLSQASGNR

SEQ ID NO: 40505 - protein, 31 aa, Artificial Sequence
  Description of Artificial Sequence: Synthetic polypeptide
DEEEIACTNPVATEQYGSVSTNLDRGGNDSD

SEQ ID NO: 40506 - protein, 32 aa, Artificial Sequence
  Description of Artificial Sequence: Synthetic polypeptide
DEEEIRTTNPVATEQYGTVCSTNDQNGGSNRQ

SEQ ID NO: 40507 - protein, 30 aa, Artificial Sequence
  Description of Artificial Sequence: Synthetic polypeptide
DENTIRTTNPVATEQYGSTTSETNLVIGNR

SEQ ID NO: 40508 - protein, 29 aa, Artificial Sequence
  Description of Artificial Sequence: Synthetic peptide
DENTIRTTNPVATEQYGCVETNQQRGNGN

SEQ ID NO: 40509 - protein, 29 aa, Artificial Sequence
  Description of Artificial Sequence: Synthetic peptide
DENTIRTTNPVATEQYGCVETNQQREGNQ

SEQ ID NO: 40510 - protein, 30 aa, Artificial Sequence
  Description of Artificial Sequence: Synthetic polypeptide
CEEEIRTTNPVATEQYGCVCSTPEQRGSNQ

SEQ ID NO: 40511 - protein, 33 aa, Artificial Sequence
  Description of Artificial Sequence: Synthetic polypeptide
DEEEIRTTNPVATEQYGSSCSMTENLSQRIGNA

SEQ ID NO: 40512 - protein, 28 aa, Artificial Sequence
  Description of Artificial Sequence: Synthetic peptide
DENTIRTTNPVATEQYGCVETNPQAGNV

SEQ ID NO: 40513 - protein, 31 aa, Artificial Sequence
  Description of Artificial Sequence: Synthetic polypeptide
DEEEIRTTNPVATEQYGSVATNLQRNPEPDP

SEQ ID NO: 40514 - protein, 29 aa, Artificial Sequence
  Description of Artificial Sequence: Synthetic peptide
DENTICTTNPVATEQWGSVSTDSLQDGNR

SEQ ID NO: 40515 - protein, 30 aa, Artificial Sequence
  Description of Artificial Sequence: Synthetic polypeptide
DEAEIATTNPVATEQYGSVATNLTRPGDND

SEQ ID NO: 40516 - protein, 31 aa, Artificial Sequence
  Description of Artificial Sequence: Synthetic polypeptide
DEEEIRTTNPVATEQYGSVNSNLNRGENEIF

SEQ ID NO: 40517 - protein, 30 aa, Artificial Sequence
  Description of Artificial Sequence: Synthetic polypeptide
DENEIRTTNPVAVEQYGSVISTNLEGDPNR

SEQ ID NO: 40518 - protein, 31 aa, Artificial Sequence
  Description of Artificial Sequence: Synthetic polypeptide
CEEEIRTTNPVATEQYGCVDSTNLQRGSDQA

SEQ ID NO: 40519 - protein, 30 aa, Artificial Sequence
  Description of Artificial Sequence: Synthetic polypeptide
DETEIRTTNPVAYECYGSVSTNLQGGGNNQ

SEQ ID NO: 40520 - protein, 31 aa, Artificial Sequence
  Description of Artificial Sequence: Synthetic polypeptide
DEEEIACTNPVATEQYGSVSTNLQERGDQDA

SEQ ID NO: 40521 - protein, 31 aa, Artificial Sequence
  Description of Artificial Sequence: Synthetic polypeptide
CEEEIRTTNPVATEQYGCVSTGNLQSNSNRD

SEQ ID NO: 40522 - protein, 33 aa, Artificial Sequence
  Description of Artificial Sequence: Synthetic polypeptide
DEEEIRTTNPVATEQYGSVNSITNLQTEMGTNE

SEQ ID NO: 40523 - protein, 32 aa, Artificial Sequence
  Description of Artificial Sequence: Synthetic polypeptide
DEEEIGTTNPVATEQYGSVCSTEDLQERMGNQ

SEQ ID NO: 40524 - protein, 28 aa, Artificial Sequence
  Description of Artificial Sequence: Synthetic peptide
AENEIRTTNPVSTEQYGTISENLQRGGR

SEQ ID NO: 40525 - protein, 31 aa, Artificial Sequence
  Description of Artificial Sequence: Synthetic polypeptide
CEEEIRTTNPVATEQYGCVSTNHQRFNSQRD

SEQ ID NO: 40526 - protein, 31 aa, Artificial Sequence
  Description of Artificial Sequence: Synthetic polypeptide
CEEEIRTTNPVATEQYGCVSTNHQRGSNNVS

SEQ ID NO: 40527 - protein, 31 aa, Artificial Sequence
  Description of Artificial Sequence: Synthetic polypeptide
CEEEIRTTNPVATEQYGCVSTNLQERNSNQQ

SEQ ID NO: 40528 - protein, 31 aa, Artificial Sequence
  Description of Artificial Sequence: Synthetic polypeptide
CEEEIRTTNPVATEQYGCVSTNLQNFGSNQN

SEQ ID NO: 40529 - protein, 29 aa, Artificial Sequence
  Description of Artificial Sequence: Synthetic peptide
DEEEIATTNPVAYEQYGSVWTNLQGFVSR

SEQ ID NO: 40530 - protein, 31 aa, Artificial Sequence
  Description of Artificial Sequence: Synthetic polypeptide
DEEEIRTTNPVATEQYGVVSVEMDLQRGDRF

SEQ ID NO: 40531 - protein, 30 aa, Artificial Sequence
  Description of Artificial Sequence: Synthetic polypeptide
DEAEIATTNPVATEQYGSVATNLQRMENEE

SEQ ID NO: 40532 - protein, 31 aa, Artificial Sequence
  Description of Artificial Sequence: Synthetic polypeptide
DENEIRTTNPVAVEQYGSVISTDLQERNNRG

SEQ ID NO: 40533 - protein, 31 aa, Artificial Sequence
  Description of Artificial Sequence: Synthetic polypeptide
DEAEIATTNPVATEQYGSVATNLQQGGNPRD

SEQ ID NO: 40534 - protein, 30 aa, Artificial Sequence
  Description of Artificial Sequence: Synthetic polypeptide
DENEIRTTNPVATESYGSVSNNLQQRGTWQ

SEQ ID NO: 40535 - protein, 32 aa, Artificial Sequence
  Description of Artificial Sequence: Synthetic polypeptide
DEEEIRTTNPVATEQYGVVSTTNLAQGDGNEQ

SEQ ID NO: 40536 - protein, 34 aa, Artificial Sequence
  Description of Artificial Sequence: Synthetic polypeptide
DEEEIRTTNPVATEQYGTVCSNTNALMQRGFNRE

SEQ ID NO: 40537 - protein, 30 aa, Artificial Sequence
  Description of Artificial Sequence: Synthetic polypeptide
DENEIRTTNPVATESYGSVSNNLQPRGTEE

SEQ ID NO: 40538 - protein, 28 aa, Artificial Sequence
  Description of Artificial Sequence: Synthetic peptide
DEEEIATTNPLATEQYGSVPTGLARGKE

SEQ ID NO: 40539 - protein, 29 aa, Artificial Sequence
  Description of Artificial Sequence: Synthetic peptide
AENEIRTTNPVATEQYGEASTENLNRGNV

SEQ ID NO: 40540 - protein, 29 aa, Artificial Sequence
  Description of Artificial Sequence: Synthetic peptide
DEAEIATTNPVATEQYGSVATNLQMDNSD

SEQ ID NO: 40541 - protein, 29 aa, Artificial Sequence
  Description of Artificial Sequence: Synthetic peptide
DEAEIATTNPVATEQYGSVATNLQHGDVD

SEQ ID NO: 40542 - protein, 30 aa, Artificial Sequence
  Description of Artificial Sequence: Synthetic polypeptide
DEAEIATTNPVATEQYGSVATNLQHDENRE

SEQ ID NO: 40543 - protein, 32 aa, Artificial Sequence
  Description of Artificial Sequence: Synthetic polypeptide
DEEEIGTTNPVATEQYGSVSNTNDLQEEMGNG

SEQ ID NO: 40544 - protein, 32 aa, Artificial Sequence
  Description of Artificial Sequence: Synthetic polypeptide
DEEEIRTTNPVATEQYGTVACTNLSTRSGNPR

SEQ ID NO: 40545 - protein, 30 aa, Artificial Sequence
  Description of Artificial Sequence: Synthetic polypeptide
DENEIRTTNPVATEQYGVVSTELQRPQNDG

SEQ ID NO: 40546 - protein, 30 aa, Artificial Sequence
  Description of Artificial Sequence: Synthetic polypeptide
DEEEIRTTNPVATEQYGTTSTTNALQEENN

SEQ ID NO: 40547 - protein, 30 aa, Artificial Sequence
  Description of Artificial Sequence: Synthetic polypeptide
DETEIRTTNPVAYEQYGTVSTNLQDDGNQG

SEQ ID NO: 40548 - protein, 31 aa, Artificial Sequence
  Description of Artificial Sequence: Synthetic polypeptide
DEEEIATTNPLAYEQYGSVSTNHSQRPGNNR

SEQ ID NO: 40549 - protein, 30 aa, Artificial Sequence
  Description of Artificial Sequence: Synthetic polypeptide
DEEEIRTTNPVATEQYGSVATNNQGSGEFN

SEQ ID NO: 40550 - protein, 29 aa, Artificial Sequence
  Description of Artificial Sequence: Synthetic peptide
DEEEIATTNPVAYEQYGSVSTDLGDHGNI

SEQ ID NO: 40551 - protein, 29 aa, Artificial Sequence
  Description of Artificial Sequence: Synthetic peptide
AENEIRTTNPVATEQYGEASENLQRNGGR

SEQ ID NO: 40552 - protein, 29 aa, Artificial Sequence
  Description of Artificial Sequence: Synthetic peptide
AENEIRTTNPVATEQYGEASENLPQRGNG

SEQ ID NO: 40553 - protein, 28 aa, Artificial Sequence
  Description of Artificial Sequence: Synthetic peptide
AENEIRTTNPVATEQYGEASENLNRGNV

SEQ ID NO: 40554 - protein, 29 aa, Artificial Sequence
  Description of Artificial Sequence: Synthetic peptide
DETEIRTTNPVAYEQYGSVSTNPQHGDTQ

SEQ ID NO: 40555 - protein, 29 aa, Artificial Sequence
  Description of Artificial Sequence: Synthetic peptide
DENEIRTTNPVATEWYGSVATNLTDGNMD

SEQ ID NO: 40556 - protein, 30 aa, Artificial Sequence
  Description of Artificial Sequence: Synthetic polypeptide
DEEEIRTTNPVATEQYGSQVSTNNQDIDEF

SEQ ID NO: 40557 - protein, 29 aa, Artificial Sequence
  Description of Artificial Sequence: Synthetic peptide
DENEIRTTNPVATTAYGSVSTNLQETNNM

SEQ ID NO: 40558 - protein, 30 aa, Artificial Sequence
  Description of Artificial Sequence: Synthetic polypeptide
DEAEIATTNPVATEQYGSVATNLQRENNSN

SEQ ID NO: 40559 - protein, 29 aa, Artificial Sequence
  Description of Artificial Sequence: Synthetic peptide
DENEIRTTNPVAVEQYGSTSTNLEIGTNI

SEQ ID NO: 40560 - protein, 28 aa, Artificial Sequence
  Description of Artificial Sequence: Synthetic peptide
DENEIRTTNPVAVEQYGSTSTNLEDTNT

SEQ ID NO: 40561 - protein, 33 aa, Artificial Sequence
  Description of Artificial Sequence: Synthetic polypeptide
DEEEIGTTNPVATEQYGSVCSTNLQRFGSENQQ

SEQ ID NO: 40562 - protein, 31 aa, Artificial Sequence
  Description of Artificial Sequence: Synthetic polypeptide
DEEEIGTTNPVATEQYGSVCSTNLQSFGEQI

SEQ ID NO: 40563 - protein, 31 aa, Artificial Sequence
  Description of Artificial Sequence: Synthetic polypeptide
DEEEIRTTNPVATEQYGTVCSTDGPVERGNR

SEQ ID NO: 40564 - protein, 33 aa, Artificial Sequence
  Description of Artificial Sequence: Synthetic polypeptide
DEEEIGTTNPVATEQYGSVCSTNWLQRFGSNQN

SEQ ID NO: 40565 - protein, 30 aa, Artificial Sequence
  Description of Artificial Sequence: Synthetic polypeptide
DETEIRTTNPVAYEQWGSVTTNELSQRGNG

SEQ ID NO: 40566 - protein, 29 aa, Artificial Sequence
  Description of Artificial Sequence: Synthetic peptide
DENEIRTTNPVAVEQYGSISTNLEHRLND

SEQ ID NO: 40567 - protein, 31 aa, Artificial Sequence
  Description of Artificial Sequence: Synthetic polypeptide
DEEEIATTNPVAYEQYGSVSTGNLQNDGDRD

SEQ ID NO: 40568 - protein, 29 aa, Artificial Sequence
  Description of Artificial Sequence: Synthetic peptide
DEEEIATTNPVAYEQYGSVSTNDDTGNED

SEQ ID NO: 40569 - protein, 29 aa, Artificial Sequence
  Description of Artificial Sequence: Synthetic peptide
DETEIRTTNPVAYEQWGTVSTNLQGDGNQ

SEQ ID NO: 40570 - protein, 31 aa, Artificial Sequence
  Description of Artificial Sequence: Synthetic polypeptide
DEEEIGTTNPVATEQYGSVITNQLVERMGNL

SEQ ID NO: 40571 - protein, 30 aa, Artificial Sequence
  Description of Artificial Sequence: Synthetic polypeptide
DETEIRTTNPVAYEQYGNVSTNLQDNGNQN

SEQ ID NO: 40572 - protein, 32 aa, Artificial Sequence
  Description of Artificial Sequence: Synthetic polypeptide
DEEEIATTNPVAYEQYGSVSTGNLDQNDGDNR

SEQ ID NO: 40573 - protein, 31 aa, Artificial Sequence
  Description of Artificial Sequence: Synthetic polypeptide
DEAEIATTNPVATEQYGSVATNLQREENPRV

SEQ ID NO: 40574 - protein, 31 aa, Artificial Sequence
  Description of Artificial Sequence: Synthetic polypeptide
DEAEIATTNPVATEQYGSVATNLQREEGPRE

SEQ ID NO: 40575 - protein, 29 aa, Artificial Sequence
  Description of Artificial Sequence: Synthetic peptide
DENEIRTTNPVATTAYGSVSTNLQRTEME

SEQ ID NO: 40576 - protein, 30 aa, Artificial Sequence
  Description of Artificial Sequence: Synthetic polypeptide
DEAEIATTNPVATEQYGSVATNLQRDENDM

SEQ ID NO: 40577 - protein, 33 aa, Artificial Sequence
  Description of Artificial Sequence: Synthetic polypeptide
DEEEIGTTNPVATEQYGSVPSTNQLQERMGNLV

SEQ ID NO: 40578 - protein, 32 aa, Artificial Sequence
  Description of Artificial Sequence: Synthetic polypeptide
DEEEIRTTNPVATEQYGSVNSGTMLQDGQVRE

SEQ ID NO: 40579 - protein, 29 aa, Artificial Sequence
  Description of Artificial Sequence: Synthetic peptide
DETEIRTTNPVAYEQYGSVSTNPQHGDHQ

SEQ ID NO: 40580 - protein, 29 aa, Artificial Sequence
  Description of Artificial Sequence: Synthetic peptide
DEEEIRTTNPVATEQYGSVNTELQVMDQE

SEQ ID NO: 40581 - protein, 28 aa, Artificial Sequence
  Description of Artificial Sequence: Synthetic peptide
DETSIRTTNPCATEQWGSVSENLQGGNG

SEQ ID NO: 40582 - protein, 30 aa, Artificial Sequence
  Description of Artificial Sequence: Synthetic polypeptide
DEEEIRTTNPVATEQYGSVCAAENLTQGNE

SEQ ID NO: 40583 - protein, 31 aa, Artificial Sequence
  Description of Artificial Sequence: Synthetic polypeptide
DEEEIRTTNPVATEQYGSVNNTQNLLGQGTR

SEQ ID NO: 40584 - protein, 30 aa, Artificial Sequence
  Description of Artificial Sequence: Synthetic polypeptide
DEEEIGTTNPVATEQYGTVSTNDLNRGSDH

SEQ ID NO: 40585 - protein, 33 aa, Artificial Sequence
  Description of Artificial Sequence: Synthetic polypeptide
CEEEIRTTNPVATERYGSVVSCTNMLSQRGNNR

SEQ ID NO: 40586 - protein, 30 aa, Artificial Sequence
  Description of Artificial Sequence: Synthetic polypeptide
DEEEIATTNPVAYEQYGSVATNLTRGDNDQ

SEQ ID NO: 40587 - protein, 32 aa, Artificial Sequence
  Description of Artificial Sequence: Synthetic polypeptide
DEEEIGTTNPVATEQYGSVSTQNQLQEIGGNL

SEQ ID NO: 40588 - protein, 32 aa, Artificial Sequence
  Description of Artificial Sequence: Synthetic polypeptide
DEEEIRTTNPVATEQYGSVNTNINQRSGEERM

SEQ ID NO: 40589 - protein, 28 aa, Artificial Sequence
  Description of Artificial Sequence: Synthetic peptide
DETSIRTTNPTAYEQWGSVSQNLQSGNR

SEQ ID NO: 40590 - protein, 31 aa, Artificial Sequence
  Description of Artificial Sequence: Synthetic polypeptide
CEEEIRTTNPVATESYGSVSQTNLQTGINTD

SEQ ID NO: 40591 - protein, 33 aa, Artificial Sequence
  Description of Artificial Sequence: Synthetic polypeptide
DEEEIRTTNPVATEQYGSVNSDGNLQRGNNNGG

SEQ ID NO: 40592 - protein, 32 aa, Artificial Sequence
  Description of Artificial Sequence: Synthetic polypeptide
DEEEIGTTNPVATEQYGSVSTNQLGQERMNNL

SEQ ID NO: 40593 - protein, 28 aa, Artificial Sequence
  Description of Artificial Sequence: Synthetic peptide
DETSIRTTNPLATEQFGSVSSNLTGGNR

SEQ ID NO: 40594 - protein, 29 aa, Artificial Sequence
  Description of Artificial Sequence: Synthetic peptide
DETSIRTTNPLATEQWGSVSANLSQSGNR

SEQ ID NO: 40595 - protein, 32 aa, Artificial Sequence
  Description of Artificial Sequence: Synthetic polypeptide
DEEEIRTTNPVATEQYGVVSVSTNLNQGQNVD

SEQ ID NO: 40596 - protein, 31 aa, Artificial Sequence
  Description of Artificial Sequence: Synthetic polypeptide
CEEEIRTTNPVATEQYGVVCSMTNLQGGSNA

SEQ ID NO: 40597 - protein, 29 aa, Artificial Sequence
  Description of Artificial Sequence: Synthetic peptide
DETSIRTTNPLATEQWGSVSLNMLQSGNR

SEQ ID NO: 40598 - protein, 31 aa, Artificial Sequence
  Description of Artificial Sequence: Synthetic polypeptide
DEEEIGTTNPVATEQYGSVSTNQDQEEGGNL

SEQ ID NO: 40599 - protein, 28 aa, Artificial Sequence
  Description of Artificial Sequence: Synthetic peptide
DETSIRTTNPLATEQFGSVSGNLQSGND

SEQ ID NO: 40600 - protein, 32 aa, Artificial Sequence
  Description of Artificial Sequence: Synthetic polypeptide
DEEEIGTTNPVATEQYGSVSTNSLFQVRGEQS

SEQ ID NO: 40601 - protein, 31 aa, Artificial Sequence
  Description of Artificial Sequence: Synthetic polypeptide
DEEEIRTTNPVATEQYGTIPSTINELQRENL

SEQ ID NO: 40602 - protein, 32 aa, Artificial Sequence
  Description of Artificial Sequence: Synthetic polypeptide
DEEEIRTTNPVATEQYGVVSVSTNLNQEQQND

SEQ ID NO: 40603 - protein, 32 aa, Artificial Sequence
  Description of Artificial Sequence: Synthetic polypeptide
DEEEIRTTNPVATEQYGVVSVVTNLNQQGQNM

SEQ ID NO: 40604 - protein, 32 aa, Artificial Sequence
  Description of Artificial Sequence: Synthetic polypeptide
DEEEIRTTNPVATEQYGSVCCTPNLHERGGTR

SEQ ID NO: 40605 - protein, 30 aa, Artificial Sequence
  Description of Artificial Sequence: Synthetic polypeptide
DEEEIATTNPVAYEQYGSVATNLQRPGEED

SEQ ID NO: 40606 - protein, 31 aa, Artificial Sequence
  Description of Artificial Sequence: Synthetic polypeptide
DEEEIRTTNPVATEQYGTQSTANPLQMRENN

SEQ ID NO: 40607 - protein, 32 aa, Artificial Sequence
  Description of Artificial Sequence: Synthetic polypeptide
DEEEIGTTNPVATEQYGSVSTNMLQERMGSQL

SEQ ID NO: 40608 - protein, 29 aa, Artificial Sequence
  Description of Artificial Sequence: Synthetic peptide
CEEEIRTTNPVATEYYGSVSTNPQFSNQI

SEQ ID NO: 40609 - protein, 32 aa, Artificial Sequence
  Description of Artificial Sequence: Synthetic polypeptide
DEEEIRTTNPVATEQYGSVCATNLQQRGDTEM

SEQ ID NO: 40610 - protein, 33 aa, Artificial Sequence
  Description of Artificial Sequence: Synthetic polypeptide
DEEEIRTTNPVATEQYGVVSVSTNLNNQQGQNM

SEQ ID NO: 40611 - protein, 30 aa, Artificial Sequence
  Description of Artificial Sequence: Synthetic polypeptide
DEAEIATTNPVATEQYGSVATNDLTRGNED

SEQ ID NO: 40612 - protein, 29 aa, Artificial Sequence
  Description of Artificial Sequence: Synthetic peptide
DEAEIATTNPVATEQYGSVATNITRGNES

SEQ ID NO: 40613 - protein, 31 aa, Artificial Sequence
  Description of Artificial Sequence: Synthetic polypeptide
DEEEIRTTNPVATEQYGTISCTQNELQRVNN

SEQ ID NO: 40614 - protein, 32 aa, Artificial Sequence
  Description of Artificial Sequence: Synthetic polypeptide
DEEEIGTTNPVATEQYGSVSTNSLFQVRGGEF

SEQ ID NO: 40615 - protein, 30 aa, Artificial Sequence
  Description of Artificial Sequence: Synthetic polypeptide
DENEIRTTNPVATEQYGSVSSNPQRLPNQP

SEQ ID NO: 40616 - protein, 29 aa, Artificial Sequence
  Description of Artificial Sequence: Synthetic peptide
DEVAIRTTNPLATEQFGSVSFNLQSGQNR

SEQ ID NO: 40617 - protein, 29 aa, Artificial Sequence
  Description of Artificial Sequence: Synthetic peptide
DEAEIATTNPVATEQYGSVATALERGNDS

SEQ ID NO: 40618 - protein, 32 aa, Artificial Sequence
  Description of Artificial Sequence: Synthetic polypeptide
DEEEIRTTNPVATEQYGSVCATNPLQTAEGNE

SEQ ID NO: 40619 - protein, 31 aa, Artificial Sequence
  Description of Artificial Sequence: Synthetic polypeptide
DEAEIATTNPVATEQYGSVASNLQRAGENGR

SEQ ID NO: 40620 - protein, 32 aa, Artificial Sequence
  Description of Artificial Sequence: Synthetic polypeptide
DEEEIGTTNPVATEQYGSVSTTNQLQEQQGNL

SEQ ID NO: 40621 - protein, 32 aa, Artificial Sequence
  Description of Artificial Sequence: Synthetic polypeptide
DEEEIRTTNPVATEQYGVVSVTNQLQNLGNNL

SEQ ID NO: 40622 - protein, 31 aa, Artificial Sequence
  Description of Artificial Sequence: Synthetic polypeptide
DEEEIRTTNPVATEQYGTISTDNALSQRENN

SEQ ID NO: 40623 - protein, 28 aa, Artificial Sequence
  Description of Artificial Sequence: Synthetic peptide
DETTIRTTNPCATEQWGSVSENLQSGNA

SEQ ID NO: 40624 - protein, 30 aa, Artificial Sequence
  Description of Artificial Sequence: Synthetic polypeptide
DEEEIATTNPVAYEQYGSVATNLQRVNQQN

SEQ ID NO: 40625 - protein, 33 aa, Artificial Sequence
  Description of Artificial Sequence: Synthetic polypeptide
DEEEIRTTNPVATEQYGVVSVSTNLNNQQGQNT

SEQ ID NO: 40626 - protein, 31 aa, Artificial Sequence
  Description of Artificial Sequence: Synthetic polypeptide
DEEEIGTTNPVATEQYGSVSTNQEQENMGNL

SEQ ID NO: 40627 - protein, 28 aa, Artificial Sequence
  Description of Artificial Sequence: Synthetic peptide
DETSIRTTNPLATEQFGSVSWNLQGNNR

SEQ ID NO: 40628 - protein, 32 aa, Artificial Sequence
  Description of Artificial Sequence: Synthetic polypeptide
DEEEIATTNPNATEQYGSVPVTNLQVRQGNGR

SEQ ID NO: 40629 - protein, 28 aa, Artificial Sequence
  Description of Artificial Sequence: Synthetic peptide
DETSIRTTNPLATEQWGSVSANLQDGND

SEQ ID NO: 40630 - protein, 30 aa, Artificial Sequence
  Description of Artificial Sequence: Synthetic polypeptide
DEEEIRTTNPVATEQYGVVSVVNLNQGMNE

SEQ ID NO: 40631 - protein, 30 aa, Artificial Sequence
  Description of Artificial Sequence: Synthetic polypeptide
DETTIRTTNPVATEQYGCVETNNDQRGNTR

SEQ ID NO: 40632 - protein, 33 aa, Artificial Sequence
  Description of Artificial Sequence: Synthetic polypeptide
DEEEIRTTNPVATEQYGSVCCTGNLTVRGGTNR

SEQ ID NO: 40633 - protein, 31 aa, Artificial Sequence
  Description of Artificial Sequence: Synthetic polypeptide
DEEEIRTTNPVATEQYGSVNSCTPDMQEGER

SEQ ID NO: 40634 - protein, 30 aa, Artificial Sequence
  Description of Artificial Sequence: Synthetic polypeptide
DEEEIATTNPVAYEQYGSVATNLQRPNEPL

SEQ ID NO: 40635 - protein, 32 aa, Artificial Sequence
  Description of Artificial Sequence: Synthetic polypeptide
DEEEIRTTNPVATEQYGSVCCTNDEQRGNILM

SEQ ID NO: 40636 - protein, 33 aa, Artificial Sequence
  Description of Artificial Sequence: Synthetic polypeptide
DEEEIRTTNPVATEQYGSVCATNPLEAREGDNR

SEQ ID NO: 40637 - protein, 32 aa, Artificial Sequence
  Description of Artificial Sequence: Synthetic polypeptide
DEEEIRTTNPVATEQYGSVCCTPNALTNRGTR

SEQ ID NO: 40638 - protein, 31 aa, Artificial Sequence
  Description of Artificial Sequence: Synthetic polypeptide
DEEEIATTNPTATEQYGSVPTDNLQHDGNGR

SEQ ID NO: 40639 - protein, 31 aa, Artificial Sequence
  Description of Artificial Sequence: Synthetic polypeptide
CEEEIRTTNPVATEQYGVVSVSNLDQIGNER

SEQ ID NO: 40640 - protein, 32 aa, Artificial Sequence
  Description of Artificial Sequence: Synthetic polypeptide
DEEEIGTTNPVATEQYGSVSTSNQLGERQGNL

SEQ ID NO: 40641 - protein, 29 aa, Artificial Sequence
  Description of Artificial Sequence: Synthetic peptide
DETTIRTTNPVATEQYGCVETNPGDRGNR

SEQ ID NO: 40642 - protein, 31 aa, Artificial Sequence
  Description of Artificial Sequence: Synthetic polypeptide
CEEEIRTTNPVATEQYGSVYTNLDMRDGNGV

SEQ ID NO: 40643 - protein, 28 aa, Artificial Sequence
  Description of Artificial Sequence: Synthetic peptide
DETVIRTTNPLATEQFGSVSWNLQSGNA

SEQ ID NO: 40644 - protein, 32 aa, Artificial Sequence
  Description of Artificial Sequence: Synthetic polypeptide
DEEEIRTTNPVATEQYGSVCCTGNELDTRGTR

SEQ ID NO: 40645 - protein, 28 aa, Artificial Sequence
  Description of Artificial Sequence: Synthetic peptide
DETYIRTTNPCATEQWGSVSVNDQTGNR

SEQ ID NO: 40646 - protein, 32 aa, Artificial Sequence
  Description of Artificial Sequence: Synthetic polypeptide
DEEEIGTTNPVATEQYGTSVITNQLQQRMGNL

SEQ ID NO: 40647 - protein, 28 aa, Artificial Sequence
  Description of Artificial Sequence: Synthetic peptide
DETSIRTTNPLATEQFGSVSDNHQSGNR

SEQ ID NO: 40648 - protein, 29 aa, Artificial Sequence
  Description of Artificial Sequence: Synthetic peptide
DEAEIATTNPVATEQYGSVATEDQRGNES

SEQ ID NO: 40649 - protein, 30 aa, Artificial Sequence
  Description of Artificial Sequence: Synthetic polypeptide
DEAEIATTNPVATEQYGSVATNDQDRGNEP

SEQ ID NO: 40650 - protein, 30 aa, Artificial Sequence
  Description of Artificial Sequence: Synthetic polypeptide
DENEIRTTNPVATEQYGSVSQNLDFVNMNR

SEQ ID NO: 40651 - protein, 32 aa, Artificial Sequence
  Description of Artificial Sequence: Synthetic polypeptide
CEEEIRTTNPVATEQYGSVSTNLNQFFGSNDE

SEQ ID NO: 40652 - protein, 32 aa, Artificial Sequence
  Description of Artificial Sequence: Synthetic polypeptide
DEEEIRTTNPVATEQYGVVSVSTNLNGQQQNT

SEQ ID NO: 40653 - protein, 28 aa, Artificial Sequence
  Description of Artificial Sequence: Synthetic peptide
DETSIRTTNPCATEQWGSVSNNLQPGNQ

SEQ ID NO: 40654 - protein, 31 aa, Artificial Sequence
  Description of Artificial Sequence: Synthetic polypeptide
DENEIRTTNPVATEQYGSVSPTDLERGEQRD

SEQ ID NO: 40655 - protein, 31 aa, Artificial Sequence
  Description of Artificial Sequence: Synthetic polypeptide
DEEEIRTTNPVATEQYGSVCATNLEHGEEDR

SEQ ID NO: 40656 - protein, 30 aa, Artificial Sequence
  Description of Artificial Sequence: Synthetic polypeptide
DENEIRTTNPVATEQYGSVSTGEHQGGSNQ

SEQ ID NO: 40657 - protein, 29 aa, Artificial Sequence
  Description of Artificial Sequence: Synthetic peptide
DENEIRTTNPVATEQYGSVSTEHQNFGEQ

SEQ ID NO: 40658 - protein, 29 aa, Artificial Sequence
  Description of Artificial Sequence: Synthetic peptide
DENEIRTTNPVATEQYGSVSTEPDTNGNS

SEQ ID NO: 40659 - protein, 28 aa, Artificial Sequence
  Description of Artificial Sequence: Synthetic peptide
DETSIRTTNPCATEQWGSVSVNLQSGND

SEQ ID NO: 40660 - protein, 32 aa, Artificial Sequence
  Description of Artificial Sequence: Synthetic polypeptide
DEEEIRTTNPVATEQYGSVNSDTNLFNGGNEQ

SEQ ID NO: 40661 - protein, 30 aa, Artificial Sequence
  Description of Artificial Sequence: Synthetic polypeptide
DEEEIATTNPVAYEQYGSVATNLQQGDERG

SEQ ID NO: 40662 - protein, 32 aa, Artificial Sequence
  Description of Artificial Sequence: Synthetic polypeptide
DENEIRTTNPVATEQYGSVSTGDLTQEGNDDR

SEQ ID NO: 40663 - protein, 31 aa, Artificial Sequence
  Description of Artificial Sequence: Synthetic polypeptide
CEEEIRTTNPVATEQYGSVSTNLQNFGSEFA

SEQ ID NO: 40664 - protein, 32 aa, Artificial Sequence
  Description of Artificial Sequence: Synthetic polypeptide
DEEEIRTTNPVATEQYGSVCCTTNLTTRGGTR

SEQ ID NO: 40665 - protein, 32 aa, Artificial Sequence
  Description of Artificial Sequence: Synthetic polypeptide
DENEIRTTNPVATEQYGSVSTNDLQHRDTDRQ

SEQ ID NO: 40666 - protein, 32 aa, Artificial Sequence
  Description of Artificial Sequence: Synthetic polypeptide
DEEEIRTTNPVATEQYGTISTENELSQRVGNN

SEQ ID NO: 40667 - protein, 32 aa, Artificial Sequence
  Description of Artificial Sequence: Synthetic polypeptide
CEEEIRTTNPVATEQYGSVSTNLQNNNGNDEI

SEQ ID NO: 40668 - protein, 30 aa, Artificial Sequence
  Description of Artificial Sequence: Synthetic polypeptide
DENEIRTTNPVATEQYGSVSTNDQMGDEDQ

SEQ ID NO: 40669 - protein, 31 aa, Artificial Sequence
  Description of Artificial Sequence: Synthetic polypeptide
DEEEIRTTNPVATEQYGVVSWGNLQRFGSEQ

SEQ ID NO: 40670 - protein, 29 aa, Artificial Sequence
  Description of Artificial Sequence: Synthetic peptide
DEAEIATTNPVATEQYGSVATNDQQRGED

SEQ ID NO: 40671 - protein, 28 aa, Artificial Sequence
  Description of Artificial Sequence: Synthetic peptide
DEAEIATTNPVATEQYGSVATNLARNTE

SEQ ID NO: 40672 - protein, 33 aa, Artificial Sequence
  Description of Artificial Sequence: Synthetic polypeptide
DEEEIRTTNPVATEQYGSVNSDTNLQMNGNNIA

SEQ ID NO: 40673 - protein, 31 aa, Artificial Sequence
  Description of Artificial Sequence: Synthetic polypeptide
DEEEIRTTNPVATEQYGSVNSAVNQQDGNDD

SEQ ID NO: 40674 - protein, 32 aa, Artificial Sequence
  Description of Artificial Sequence: Synthetic polypeptide
DEEEIRTTNPVATEQYGVVSVSTNLNQGQNME

SEQ ID NO: 40675 - protein, 31 aa, Artificial Sequence
  Description of Artificial Sequence: Synthetic polypeptide
DENEIRTTNPVATEQYGSVSTMLQRSINNQS

SEQ ID NO: 40676 - protein, 30 aa, Artificial Sequence
  Description of Artificial Sequence: Synthetic polypeptide
DEEEIATTNPVAYEQYGSVATNLQRNHDRA

SEQ ID NO: 40677 - protein, 32 aa, Artificial Sequence
  Description of Artificial Sequence: Synthetic polypeptide
DEEEIRTTNPVATEQYGSVNQVTNDQRGNEQI

SEQ ID NO: 40678 - protein, 29 aa, Artificial Sequence
  Description of Artificial Sequence: Synthetic peptide
DEAEIATTNPVAYEQYGSVSTNLQDGDVS

SEQ ID NO: 40679 - protein, 31 aa, Artificial Sequence
  Description of Artificial Sequence: Synthetic polypeptide
DEEEIGTTNPVATEQYGSVSTNSLQQVDGEF

SEQ ID NO: 40680 - protein, 31 aa, Artificial Sequence
  Description of Artificial Sequence: Synthetic polypeptide
DENEIRTTNPVATEQYGSVSPTDLERGENQE

SEQ ID NO: 40681 - protein, 28 aa, Artificial Sequence
  Description of Artificial Sequence: Synthetic peptide
AENEIRCTNPVATEQYGEASMNLQRGGR

SEQ ID NO: 40682 - protein, 32 aa, Artificial Sequence
  Description of Artificial Sequence: Synthetic polypeptide
CEEEIRTTNPVATEQYGSVSTSNEGQRGENGQ

SEQ ID NO: 40683 - protein, 28 aa, Artificial Sequence
  Description of Artificial Sequence: Synthetic peptide
AENEIRCTNPVATEQYGEASENLQRGGR

SEQ ID NO: 40684 - protein, 29 aa, Artificial Sequence
  Description of Artificial Sequence: Synthetic peptide
AENEIRCTNPVATEQYGSASENLQRNGGR

SEQ ID NO: 40685 - protein, 31 aa, Artificial Sequence
  Description of Artificial Sequence: Synthetic polypeptide
DEEEIRTTNPVATEQYGSVCATVPLQLQGNE

SEQ ID NO: 40686 - protein, 30 aa, Artificial Sequence
  Description of Artificial Sequence: Synthetic polypeptide
DEEEIRTTNPVATEQYGVVSWEELQNGSER

SEQ ID NO: 40687 - protein, 30 aa, Artificial Sequence
  Description of Artificial Sequence: Synthetic polypeptide
DEVEIATTNPVATAQYGCVSTAELQRGGNR

SEQ ID NO: 40688 - protein, 31 aa, Artificial Sequence
  Description of Artificial Sequence: Synthetic polypeptide
DEEEIGTTNPVATEQYGSVSTNLQAFGSDQA

SEQ ID NO: 40689 - protein, 30 aa, Artificial Sequence
  Description of Artificial Sequence: Synthetic polypeptide
DEAEIATTNPVAYEQYGSVSAANLQDGNRN

SEQ ID NO: 40690 - protein, 28 aa, Artificial Sequence
  Description of Artificial Sequence: Synthetic peptide
AENEIRCTNPVATEQYGEASENLQRGPR

SEQ ID NO: 40691 - protein, 31 aa, Artificial Sequence
  Description of Artificial Sequence: Synthetic polypeptide
DEEEIRTTNPVATEQYGVVSWELQRFGSERL

SEQ ID NO: 40692 - protein, 28 aa, Artificial Sequence
  Description of Artificial Sequence: Synthetic peptide
DEVEIATTNPVATAQYGCVATNLERGNN

SEQ ID NO: 40693 - protein, 30 aa, Artificial Sequence
  Description of Artificial Sequence: Synthetic polypeptide
CEEEIRTTNPVATEQYGSVTVTSEAQGGNR

SEQ ID NO: 40694 - protein, 33 aa, Artificial Sequence
  Description of Artificial Sequence: Synthetic polypeptide
DEEEIRTTNPVATEGYGSVSTINNILQDMGSND

SEQ ID NO: 40695 - protein, 32 aa, Artificial Sequence
  Description of Artificial Sequence: Synthetic polypeptide
DEEEIRTTNPVATEQYGSVNYTETEDDRGNRG

SEQ ID NO: 40696 - protein, 33 aa, Artificial Sequence
  Description of Artificial Sequence: Synthetic polypeptide
DEEEIRTTNPVATEQYGSVPPLNLQRIMENNRI

SEQ ID NO: 40697 - protein, 33 aa, Artificial Sequence
  Description of Artificial Sequence: Synthetic polypeptide
DEEEIRTTNPVATEQYGSVSNTNLGLGSGNGNA

SEQ ID NO: 40698 - protein, 31 aa, Artificial Sequence
  Description of Artificial Sequence: Synthetic polypeptide
DEEEIRTTNPVATEGYGSVSTELQGFNSNDS

SEQ ID NO: 40699 - protein, 33 aa, Artificial Sequence
  Description of Artificial Sequence: Synthetic polypeptide
DEEEIRTTNPVATEQYGCVCSTGNLQFGSNNAV

SEQ ID NO: 40700 - protein, 34 aa, Artificial Sequence
  Description of Artificial Sequence: Synthetic polypeptide
DEEEIRTTNPVATEQYGSVGSTVNLQFNEGGNGG

SEQ ID NO: 40701 - protein, 34 aa, Artificial Sequence
  Description of Artificial Sequence: Synthetic polypeptide
DEEEIRTTNPVATEQYGSVGSNTNLQMNGENEGQ

SEQ ID NO: 40702 - protein, 32 aa, Artificial Sequence
  Description of Artificial Sequence: Synthetic polypeptide
DEEEIRTTNPVATEQYGSVGSTDDGQQTGNGE

SEQ ID NO: 40703 - protein, 34 aa, Artificial Sequence
  Description of Artificial Sequence: Synthetic polypeptide
DEEEIRTTNPVATEQYGSVGSNTNLQFNGGNEQT

SEQ ID NO: 40704 - protein, 31 aa, Artificial Sequence
  Description of Artificial Sequence: Synthetic polypeptide
DEEEIRTTNPVATEQYGSVGTGNDGQNQGQG

SEQ ID NO: 40705 - protein, 33 aa, Artificial Sequence
  Description of Artificial Sequence: Synthetic polypeptide
DEEEIRTTNPVATEQYGSVNSTQNLNENGENIG

SEQ ID NO: 40706 - protein, 33 aa, Artificial Sequence
  Description of Artificial Sequence: Synthetic polypeptide
DEEEIRTTNPVATEQYGCVCSTGNLQHMGSNDE

SEQ ID NO: 40707 - protein, 33 aa, Artificial Sequence
  Description of Artificial Sequence: Synthetic polypeptide
DEEEIRTTNPVATEQYGSVGSTDLQMDVGENGV

SEQ ID NO: 40708 - protein, 33 aa, Artificial Sequence
  Description of Artificial Sequence: Synthetic polypeptide
DEEEIATTNPVATEQYGSTVCCTNLSQAGGNQR

SEQ ID NO: 40709 - protein, 30 aa, Artificial Sequence
  Description of Artificial Sequence: Synthetic polypeptide
DEEEIRTTNPVATEQYGSVSMDLNNREDST

SEQ ID NO: 40710 - protein, 33 aa, Artificial Sequence
  Description of Artificial Sequence: Synthetic polypeptide
DEEEIRTTNPVATEQYGCVCSTGNLQEYFGNQE

SEQ ID NO: 40711 - protein, 33 aa, Artificial Sequence
  Description of Artificial Sequence: Synthetic polypeptide
DEEEIRTTNPVATEPWGISVSTVNLQDRQDKNR

SEQ ID NO: 40712 - protein, 31 aa, Artificial Sequence
  Description of Artificial Sequence: Synthetic polypeptide
DEEEIRTTNPVATEQYGSVPPNELQGGVEFN

SEQ ID NO: 40713 - protein, 30 aa, Artificial Sequence
  Description of Artificial Sequence: Synthetic polypeptide
DEEEIRTTNPVATEIYGCVSTEHQRGSEDS

SEQ ID NO: 40714 - protein, 29 aa, Artificial Sequence
  Description of Artificial Sequence: Synthetic peptide
DEEAICTVNPVATEAYGSVSDNLQENGNQ

SEQ ID NO: 40715 - protein, 30 aa, Artificial Sequence
  Description of Artificial Sequence: Synthetic polypeptide
DEEEIRTTNPVATEQYGSVPMLIDLQRMAN

SEQ ID NO: 40716 - protein, 31 aa, Artificial Sequence
  Description of Artificial Sequence: Synthetic polypeptide
DEEEIRTTNPVATEQYGSVQSWTEPLDVGEM

SEQ ID NO: 40717 - protein, 31 aa, Artificial Sequence
  Description of Artificial Sequence: Synthetic polypeptide
DEEEIRTTNPVATEIYGEVSTNEQQPGNNTE

SEQ ID NO: 40718 - protein, 32 aa, Artificial Sequence
  Description of Artificial Sequence: Synthetic polypeptide
DEEEIACTNPVATEQYGSVATNLQQAGENGRE

SEQ ID NO: 40719 - protein, 33 aa, Artificial Sequence
  Description of Artificial Sequence: Synthetic polypeptide
DEEEIRTTNPVATEQYGSVNYDNLEQLMGENER

SEQ ID NO: 40720 - protein, 30 aa, Artificial Sequence
  Description of Artificial Sequence: Synthetic polypeptide
DEEEIACTNPVATEQYGSVSTDLMDHEGNL

SEQ ID NO: 40721 - protein, 33 aa, Artificial Sequence
  Description of Artificial Sequence: Synthetic polypeptide
DEEEIRTTNPVATEAYGCSVSCTAALSQRGGER

SEQ ID NO: 40722 - protein, 33 aa, Artificial Sequence
  Description of Artificial Sequence: Synthetic polypeptide
DEEEIRTTNPVATEQYGSVGSTVNMQNEGGNGG

SEQ ID NO: 40723 - protein, 33 aa, Artificial Sequence
  Description of Artificial Sequence: Synthetic polypeptide
DEEAEIRTTNPVAYEQWGSVSTNLNQGQGGDNR

SEQ ID NO: 40724 - protein, 32 aa, Artificial Sequence
  Description of Artificial Sequence: Synthetic polypeptide
DEEEIRTTNPVATEQYGSVGSTNVDEDGGNND

SEQ ID NO: 40725 - protein, 33 aa, Artificial Sequence
  Description of Artificial Sequence: Synthetic polypeptide
DEEEIRTTNPVATEQYGSVSLTNQHQERDMIRI

SEQ ID NO: 40726 - protein, 33 aa, Artificial Sequence
  Description of Artificial Sequence: Synthetic polypeptide
DEEEIRTTNPVATEQYGSVGTPNLQFNFGNQNE

SEQ ID NO: 40727 - protein, 33 aa, Artificial Sequence
  Description of Artificial Sequence: Synthetic polypeptide
DEEEIRTTNPVATEQYGSVSLTNQHQEREQIER

SEQ ID NO: 40728 - protein, 32 aa, Artificial Sequence
  Description of Artificial Sequence: Synthetic polypeptide
DEEEIRTTNPVATEPYGASVSTVGAQPRIVNR

SEQ ID NO: 40729 - protein, 32 aa, Artificial Sequence
  Description of Artificial Sequence: Synthetic polypeptide
DEEEIRTTNPVATEQYGSVSLTNSNQTIGEEE

SEQ ID NO: 40730 - protein, 29 aa, Artificial Sequence
  Description of Artificial Sequence: Synthetic peptide
DEEEIATTNPVATEQYGSASTDLEHEGEK

SEQ ID NO: 40731 - protein, 33 aa, Artificial Sequence
  Description of Artificial Sequence: Synthetic polypeptide
DEEEIRTTNPVATEQYGSVGSYDNLIEEDTGNR

SEQ ID NO: 40732 - protein, 34 aa, Artificial Sequence
  Description of Artificial Sequence: Synthetic polypeptide
DEEEIRTTNPVATEQYGSVSLTPNGLQQRHAVER

SEQ ID NO: 40733 - protein, 31 aa, Artificial Sequence
  Description of Artificial Sequence: Synthetic polypeptide
DEEEIRTTNPVATEQYGSVNSTTDDQRNEQD

SEQ ID NO: 40734 - protein, 34 aa, Artificial Sequence
  Description of Artificial Sequence: Synthetic polypeptide
DEEEIRTTNPVATEQYGSVSLTPNGLQSLEGVER

SEQ ID NO: 40735 - protein, 32 aa, Artificial Sequence
  Description of Artificial Sequence: Synthetic polypeptide
DEEEIRTTNPVATEQYGSVGTGEVRMGLNPRD

SEQ ID NO: 40736 - protein, 34 aa, Artificial Sequence
  Description of Artificial Sequence: Synthetic polypeptide
DEEEIRTTNPVATEQYGSVQSVTNLTQDNGVNEH

SEQ ID NO: 40737 - protein, 32 aa, Artificial Sequence
  Description of Artificial Sequence: Synthetic polypeptide
DEEEIRTTNPVATEQYGSVPLAPNLEMRGEQR

SEQ ID NO: 40738 - protein, 33 aa, Artificial Sequence
  Description of Artificial Sequence: Synthetic polypeptide
DEEEIRTTNPVATEQYGCVCSTGNLQERFGSDI

SEQ ID NO: 40739 - protein, 28 aa, Artificial Sequence
  Description of Artificial Sequence: Synthetic peptide
DEECIATVNPVATEYYGCVSSNLERGNQ

SEQ ID NO: 40740 - protein, 32 aa, Artificial Sequence
  Description of Artificial Sequence: Synthetic polypeptide
DEEEIRTTNPVATEPWGSVFTNELSQRNVGPR

SEQ ID NO: 40741 - protein, 33 aa, Artificial Sequence
  Description of Artificial Sequence: Synthetic polypeptide
DEEEIRTTNPVATEQYGCVCSTGNLQENGSENQ

SEQ ID NO: 40742 - protein, 32 aa, Artificial Sequence
  Description of Artificial Sequence: Synthetic polypeptide
DEEEIRTTNPVATEQYGSVSLTPNMQRQDEET

SEQ ID NO: 40743 - protein, 30 aa, Artificial Sequence
  Description of Artificial Sequence: Synthetic polypeptide
DEEEIRTTNPVATEIYGSVSNNNNQRNTAN

SEQ ID NO: 40744 - protein, 32 aa, Artificial Sequence
  Description of Artificial Sequence: Synthetic polypeptide
DEEEIRTTNPVATEQYGSVGSNTNNFNIGNED

SEQ ID NO: 40745 - protein, 33 aa, Artificial Sequence
  Description of Artificial Sequence: Synthetic polypeptide
DEEEIRTTNPVATEQYGSVHPTTTLQRGQPQRN

SEQ ID NO: 40746 - protein, 30 aa, Artificial Sequence
  Description of Artificial Sequence: Synthetic polypeptide
DEECIFTVNPVATEWYGSVSDPNLQERGTR

SEQ ID NO: 40747 - protein, 33 aa, Artificial Sequence
  Description of Artificial Sequence: Synthetic polypeptide
DEEEIRTTNPVATEQYGSVHPTNNQRQNEEPRY

SEQ ID NO: 40748 - protein, 33 aa, Artificial Sequence
  Description of Artificial Sequence: Synthetic polypeptide
DEEEIRTTNPVATEAYGCSTVSCTRLSQRGGER

SEQ ID NO: 40749 - protein, 32 aa, Artificial Sequence
  Description of Artificial Sequence: Synthetic polypeptide
DEEEIRTTNPVATEQYGSVGSTSNDQNNMNDP

SEQ ID NO: 40750 - protein, 32 aa, Artificial Sequence
  Description of Artificial Sequence: Synthetic polypeptide
DEEEIRTTNPVATEGYGSVSTDNMTQGGGNIQ

SEQ ID NO: 40751 - protein, 34 aa, Artificial Sequence
  Description of Artificial Sequence: Synthetic polypeptide
DEEEIRTTNPVATEQYGSVGSTVNLQQIIGNGNE

SEQ ID NO: 40752 - protein, 33 aa, Artificial Sequence
  Description of Artificial Sequence: Synthetic polypeptide
DEEEIRTTNPVATEQYGSVSLTNLQQRPVQDFI

SEQ ID NO: 40753 - protein, 33 aa, Artificial Sequence
  Description of Artificial Sequence: Synthetic polypeptide
DEEEIRTTNPVATEQYGSVNTDTGNLQNGTNGD

SEQ ID NO: 40754 - protein, 33 aa, Artificial Sequence
  Description of Artificial Sequence: Synthetic polypeptide
DEEEIRTTNPVATEQYGSVGSNTNLFNNGNEGN

SEQ ID NO: 40755 - protein, 32 aa, Artificial Sequence
  Description of Artificial Sequence: Synthetic polypeptide
DEEEIRTTNPVATEQYGSVIAPTNLEERGPED

SEQ ID NO: 40756 - protein, 33 aa, Artificial Sequence
  Description of Artificial Sequence: Synthetic polypeptide
DEEEIRTTNPVATEGYGSVCFTNLTERGGSNRS

SEQ ID NO: 40757 - protein, 32 aa, Artificial Sequence
  Description of Artificial Sequence: Synthetic polypeptide
DEEEIRTTNPVATEQYGSVNSTPGQGGTGNQQ

SEQ ID NO: 40758 - protein, 33 aa, Artificial Sequence
  Description of Artificial Sequence: Synthetic polypeptide
DEEEIRTTNPVATEPWGISVSTVNLQDRLKNDR

SEQ ID NO: 40759 - protein, 31 aa, Artificial Sequence
  Description of Artificial Sequence: Synthetic polypeptide
DEEEIRTTNPVATEQYGSVNTNLDNPELFNE

SEQ ID NO: 40760 - protein, 33 aa, Artificial Sequence
  Description of Artificial Sequence: Synthetic polypeptide
DEEEIRTTNPVATEQYGSVNSTPNLDGFGNNEG

SEQ ID NO: 40761 - protein, 30 aa, Artificial Sequence
  Description of Artificial Sequence: Synthetic polypeptide
DEEEIATTNPVATEQYGSVAANLQEDGGQN

SEQ ID NO: 40762 - protein, 35 aa, Artificial Sequence
  Description of Artificial Sequence: Synthetic polypeptide
DEEEIRTTNPVATEQYGSVSLTPNGLQQRTGVERV

SEQ ID NO: 40763 - protein, 33 aa, Artificial Sequence
  Description of Artificial Sequence: Synthetic polypeptide
DEEEIATTNPVATEQYGQVSTTGNNLDQIQGNR

SEQ ID NO: 40764 - protein, 30 aa, Artificial Sequence
  Description of Artificial Sequence: Synthetic polypeptide
DEEEIRTTNPVATEQYGSVNTNIQDEYQSD

SEQ ID NO: 40765 - protein, 34 aa, Artificial Sequence
  Description of Artificial Sequence: Synthetic polypeptide
DEEEIRTTNPVATEQYGSVGSTVNLQNVGINGNT

SEQ ID NO: 40766 - protein, 33 aa, Artificial Sequence
  Description of Artificial Sequence: Synthetic polypeptide
DEEEIRTTNPVATEQYGSVGSNTNLFNSGTNEE

SEQ ID NO: 40767 - protein, 34 aa, Artificial Sequence
  Description of Artificial Sequence: Synthetic polypeptide
DEEEIRTTNPVATEQYGSVNSTPNLQFNFGNQNT

SEQ ID NO: 40768 - protein, 32 aa, Artificial Sequence
  Description of Artificial Sequence: Synthetic polypeptide
DEEEIRTTNPVATEQYGSVQTNDLDDRNGQEV

SEQ ID NO: 40769 - protein, 32 aa, Artificial Sequence
  Description of Artificial Sequence: Synthetic polypeptide
DEEEIRTTNPVATEAYGCVSVTNLSQNGGDYR

SEQ ID NO: 40770 - protein, 32 aa, Artificial Sequence
  Description of Artificial Sequence: Synthetic polypeptide
DEEEIRTTNPVATEQYGSVGWPNLQQRGVTEN

SEQ ID NO: 40771 - protein, 33 aa, Artificial Sequence
  Description of Artificial Sequence: Synthetic polypeptide
DEEEIRTTNPVATENYGSVSTTNDLNQMGNVNW

SEQ ID NO: 40772 - protein, 31 aa, Artificial Sequence
  Description of Artificial Sequence: Synthetic polypeptide
DEEEIRTTNPVATEQYGSVPNTTLEGMNNER

SEQ ID NO: 40773 - protein, 32 aa, Artificial Sequence
  Description of Artificial Sequence: Synthetic polypeptide
DEEEIRTTNPVATEQYGSVNSTNVQMSYQGDQ

SEQ ID NO: 40774 - protein, 33 aa, Artificial Sequence
  Description of Artificial Sequence: Synthetic polypeptide
DEEEIRTTNPVATEGYGSVSGTNLQMEGGNGEE

SEQ ID NO: 40775 - protein, 30 aa, Artificial Sequence
  Description of Artificial Sequence: Synthetic polypeptide
DEEEIACTNPVATEQYGSVATNLTAPGMRE

SEQ ID NO: 40776 - protein, 30 aa, Artificial Sequence
  Description of Artificial Sequence: Synthetic polypeptide
DEEEIACTNPVAYEQYGSVATNLQGNPEGR

SEQ ID NO: 40777 - protein, 33 aa, Artificial Sequence
  Description of Artificial Sequence: Synthetic polypeptide
DEEEIRTTNPVATEPYGISVSTVNDLQDRIVGR

SEQ ID NO: 40778 - protein, 30 aa, Artificial Sequence
  Description of Artificial Sequence: Synthetic polypeptide
DEECIATVNPVATEAYGSVSCDNLTRGGNR

SEQ ID NO: 40779 - protein, 32 aa, Artificial Sequence
  Description of Artificial Sequence: Synthetic polypeptide
DEEEIRTTNPVATEQYGCVCSTEPQRGSDNQV

SEQ ID NO: 40780 - protein, 28 aa, Artificial Sequence
  Description of Artificial Sequence: Synthetic peptide
DEEEIATTNPVATEQYGSAPTVLQHEEK

SEQ ID NO: 40781 - protein, 33 aa, Artificial Sequence
  Description of Artificial Sequence: Synthetic polypeptide
DEEEIRTTNPVATEQYGSVPPTNVQTRGGLNVE

SEQ ID NO: 40782 - protein, 33 aa, Artificial Sequence
  Description of Artificial Sequence: Synthetic polypeptide
DEEEIRTTNPVATEPYGISVSTVNDLQDRIDNE

SEQ ID NO: 40783 - protein, 31 aa, Artificial Sequence
  Description of Artificial Sequence: Synthetic polypeptide
DEEEIRTTNPVATEQYGSVQTSLQPVVQDNF

SEQ ID NO: 40784 - protein, 31 aa, Artificial Sequence
  Description of Artificial Sequence: Synthetic polypeptide
DEEEIRTTNPVATEGYGSVCFTNLTYGGSDR

SEQ ID NO: 40785 - protein, 33 aa, Artificial Sequence
  Description of Artificial Sequence: Synthetic polypeptide
DEEEIRTTNPVATEQYGCVCSTGNLQFFGSQRA

SEQ ID NO: 40786 - protein, 32 aa, Artificial Sequence
  Description of Artificial Sequence: Synthetic polypeptide
DEEEIRTTNPVATEQYGSVGVMVNLPQGGNDQ

SEQ ID NO: 40787 - protein, 34 aa, Artificial Sequence
  Description of Artificial Sequence: Synthetic polypeptide
DEEEIRTTNPVATEQYGSVGSTVNLQNEGGNQGI

SEQ ID NO: 40788 - protein, 33 aa, Artificial Sequence
  Description of Artificial Sequence: Synthetic polypeptide
DEEEIRTTNPVATEGYGSVSITNLVGQGGGNES

SEQ ID NO: 40789 - protein, 32 aa, Artificial Sequence
  Description of Artificial Sequence: Synthetic polypeptide
DEEEIRTTNPVATEQYGCVCSTEPQRGSNDQA

SEQ ID NO: 40790 - protein, 32 aa, Artificial Sequence
  Description of Artificial Sequence: Synthetic polypeptide
DEEEIRTTNPVATEGYGCVSTNDLQNFGSNDD

SEQ ID NO: 40791 - protein, 33 aa, Artificial Sequence
  Description of Artificial Sequence: Synthetic polypeptide
DEEEIRTTNPVATEAYGSVACTMVLSQRTGGNR

SEQ ID NO: 40792 - protein, 32 aa, Artificial Sequence
  Description of Artificial Sequence: Synthetic polypeptide
DEEEIRTTNPVATEGYGSVSNTDLQVGENGQG

SEQ ID NO: 40793 - protein, 31 aa, Artificial Sequence
  Description of Artificial Sequence: Synthetic polypeptide
DEEEIRTTNPVATEQYGCVCSTEPQRISERS

SEQ ID NO: 40794 - protein, 32 aa, Artificial Sequence
  Description of Artificial Sequence: Synthetic polypeptide
DEEEIRTTNPVATEGYGSVSGTSNGQGGGNET

SEQ ID NO: 40795 - protein, 35 aa, Artificial Sequence
  Description of Artificial Sequence: Synthetic polypeptide
DEEEIATTNPVATEQYGQSTVPSTNALSQRAGTNR

SEQ ID NO: 40796 - protein, 31 aa, Artificial Sequence
  Description of Artificial Sequence: Synthetic polypeptide
DEEEIATTNPVATEQYGSVAANLQENNGNPQ

SEQ ID NO: 40797 - protein, 32 aa, Artificial Sequence
  Description of Artificial Sequence: Synthetic polypeptide
DEEEIRTTNPVATEQYGSVPNTNDQQRSGDEW

SEQ ID NO: 40798 - protein, 33 aa, Artificial Sequence
  Description of Artificial Sequence: Synthetic polypeptide
DEEEIRTTNPVATEQYGSVGSTVNLQNDGIEDD

SEQ ID NO: 40799 - protein, 33 aa, Artificial Sequence
  Description of Artificial Sequence: Synthetic polypeptide
DEEEIRTTNPVATEQYGSVGSNTNLIFNGGNEG

SEQ ID NO: 40800 - protein, 32 aa, Artificial Sequence
  Description of Artificial Sequence: Synthetic polypeptide
DEEEIRTTNPVATEMYGVVSTNLQINVGNQGI

SEQ ID NO: 40801 - protein, 32 aa, Artificial Sequence
  Description of Artificial Sequence: Synthetic polypeptide
DEEEIRTTNPVATEMYGSVCATNNLSLRTGSR

SEQ ID NO: 40802 - protein, 28 aa, Artificial Sequence
  Description of Artificial Sequence: Synthetic peptide
DEEEIRTTNPVATEHYGAHSTAEQYINF

SEQ ID NO: 40803 - protein, 31 aa, Artificial Sequence
  Description of Artificial Sequence: Synthetic polypeptide
DEEEIRTTNPVATEQYGSVPCDNGGGQRGTH

SEQ ID NO: 40804 - protein, 29 aa, Artificial Sequence
  Description of Artificial Sequence: Synthetic peptide
DEEEIRTTNPVATEQYGSVNTTTEGGQEM

SEQ ID NO: 40805 - protein, 31 aa, Artificial Sequence
  Description of Artificial Sequence: Synthetic polypeptide
DEEEIRTTNPVATEQYGCVCSTNDQGNSEQM

SEQ ID NO: 40806 - protein, 32 aa, Artificial Sequence
  Description of Artificial Sequence: Synthetic polypeptide
DEEEIRTTNPVATEQYGCVCSTGPLQYGSNQE

SEQ ID NO: 40807 - protein, 31 aa, Artificial Sequence
  Description of Artificial Sequence: Synthetic polypeptide
DEEEIACTNPVATEQYGSVSTNDIFQVRGEF

SEQ ID NO: 40808 - protein, 34 aa, Artificial Sequence
  Description of Artificial Sequence: Synthetic polypeptide
DEEEIRTTNPVATEAYGCSVVSTNALSQRTGNNS

SEQ ID NO: 40809 - protein, 31 aa, Artificial Sequence
  Description of Artificial Sequence: Synthetic polypeptide
DEEEIRTTNPVATEQYGCVCSTNDQFGSDQA

SEQ ID NO: 40810 - protein, 31 aa, Artificial Sequence
  Description of Artificial Sequence: Synthetic polypeptide
DEEEIRTTNPVATEQYGSVQTNDAQTLNEEN

SEQ ID NO: 40811 - protein, 33 aa, Artificial Sequence
  Description of Artificial Sequence: Synthetic polypeptide
DEEEIRTTNPVATEQYGSVGSNTNLLGSGGNNE

SEQ ID NO: 40812 - protein, 34 aa, Artificial Sequence
  Description of Artificial Sequence: Synthetic polypeptide
DEEEIRTTNPVATEQYGSVGSTVNLQQIEGGNGE

SEQ ID NO: 40813 - protein, 32 aa, Artificial Sequence
  Description of Artificial Sequence: Synthetic polypeptide
DEEEIRTTNPVATEQYGSVSNTNHNQSFGSEQ

SEQ ID NO: 40814 - protein, 30 aa, Artificial Sequence
  Description of Artificial Sequence: Synthetic polypeptide
DEEEIRTTNPVATEIYGSVSTSFQNDGIDT

SEQ ID NO: 40815 - protein, 32 aa, Artificial Sequence
  Description of Artificial Sequence: Synthetic polypeptide
DEEEIRTTNPVATEQYGSVPPTNVQQINEVRD

SEQ ID NO: 40816 - protein, 30 aa, Artificial Sequence
  Description of Artificial Sequence: Synthetic polypeptide
DEEEIRTTNPVATEGYGSVSTEHQGFGSQQ

SEQ ID NO: 40817 - protein, 33 aa, Artificial Sequence
  Description of Artificial Sequence: Synthetic polypeptide
DEEEIRTTNPVATEQYGSVNSTQNLENDGNIQG

SEQ ID NO: 40818 - protein, 31 aa, Artificial Sequence
  Description of Artificial Sequence: Synthetic polypeptide
DEEEIACTNPVATEQYGSVATNLQPRNQNEE

SEQ ID NO: 40819 - protein, 32 aa, Artificial Sequence
  Description of Artificial Sequence: Synthetic polypeptide
DEEAEIATTNPVATEPYGSVSTNLQGNGDNGQ

SEQ ID NO: 40820 - protein, 33 aa, Artificial Sequence
  Description of Artificial Sequence: Synthetic polypeptide
DEEEIRTTNPVATEQYGSVNSTQNLFEGNGNIG

SEQ ID NO: 40821 - protein, 33 aa, Artificial Sequence
  Description of Artificial Sequence: Synthetic polypeptide
DEEEIATTNPVATEQYGSVAAAANNLQERGNDR

SEQ ID NO: 40822 - protein, 33 aa, Artificial Sequence
  Description of Artificial Sequence: Synthetic polypeptide
DEEEIRTTNPVATEQYGSVNSTPNNQGEGNEEV

SEQ ID NO: 40823 - protein, 31 aa, Artificial Sequence
  Description of Artificial Sequence: Synthetic polypeptide
DEEEIRTTNPVATEGYGSVCSTELQGFGSEA

SEQ ID NO: 40824 - protein, 33 aa, Artificial Sequence
  Description of Artificial Sequence: Synthetic polypeptide
DEEEIRTTNPVATEQYGSVGSNTNLLFNGGNGQ

SEQ ID NO: 40825 - protein, 32 aa, Artificial Sequence
  Description of Artificial Sequence: Synthetic polypeptide
DEEEIRTTNPVATEMYGSVSTNNELDDQKGKA

SEQ ID NO: 40826 - protein, 30 aa, Artificial Sequence
  Description of Artificial Sequence: Synthetic polypeptide
DEEEIACTNPVATEQYGSVATNLTDGNNDQ

SEQ ID NO: 40827 - protein, 31 aa, Artificial Sequence
  Description of Artificial Sequence: Synthetic polypeptide
DEECIGTTNPVATEQYGCVCSTNLQNGSNQE

SEQ ID NO: 40828 - protein, 32 aa, Artificial Sequence
  Description of Artificial Sequence: Synthetic polypeptide
DEEEIRTTNPVATEAWGQQTVSTNWSQRGGNR

SEQ ID NO: 40829 - protein, 32 aa, Artificial Sequence
  Description of Artificial Sequence: Synthetic polypeptide
DEEEIRTTNPVATEQYGSVPENLQINGENESP

SEQ ID NO: 40830 - protein, 33 aa, Artificial Sequence
  Description of Artificial Sequence: Synthetic polypeptide
DEEEIRTTNPVATEAWGKVVSVTNLSQRGGNRD

SEQ ID NO: 40831 - protein, 33 aa, Artificial Sequence
  Description of Artificial Sequence: Synthetic polypeptide
DEEEIRTTNPVATEGYGSVSTANLQDEGGNQEI

SEQ ID NO: 40832 - protein, 31 aa, Artificial Sequence
  Description of Artificial Sequence: Synthetic polypeptide
DEEEIRTTNPVATCQYGCVCSTNLQYFGSDD

SEQ ID NO: 40833 - protein, 34 aa, Artificial Sequence
  Description of Artificial Sequence: Synthetic polypeptide
DEEEIRTTNPVATEQYGSVPSCTNEHQERDVSNR

SEQ ID NO: 40834 - protein, 32 aa, Artificial Sequence
  Description of Artificial Sequence: Synthetic polypeptide
DEEEIATTNPVATEQYGSVAAAPNLQEAGNDR

SEQ ID NO: 40835 - protein, 33 aa, Artificial Sequence
  Description of Artificial Sequence: Synthetic polypeptide
DEEEIRTTNPVATEGYGICVSTVNLQERISNRS

SEQ ID NO: 40836 - protein, 29 aa, Artificial Sequence
  Description of Artificial Sequence: Synthetic peptide
DEEAIATTNPVATEQYGCVSWNDQMNGNA

SEQ ID NO: 40837 - protein, 32 aa, Artificial Sequence
  Description of Artificial Sequence: Synthetic polypeptide
DEEEIRTTNPVATEQYGSVSNTNHQGFLSNQS

SEQ ID NO: 40838 - protein, 32 aa, Artificial Sequence
  Description of Artificial Sequence: Synthetic polypeptide
DEEEIRTTNPVATEGYGSVSTDLQVGFENGQG

SEQ ID NO: 40839 - protein, 32 aa, Artificial Sequence
  Description of Artificial Sequence: Synthetic polypeptide
DEEEIRTTNPVATEGYGSVSGNLVGQGGGNQS

SEQ ID NO: 40840 - protein, 32 aa, Artificial Sequence
  Description of Artificial Sequence: Synthetic polypeptide
DEEEIRTTNPVATEGYGSVSTDNGQIEGQGNE

SEQ ID NO: 40841 - protein, 33 aa, Artificial Sequence
  Description of Artificial Sequence: Synthetic polypeptide
DEEEIRTTNPVATEQYGSVSNTNLLQIPNVVDI

SEQ ID NO: 40842 - protein, 32 aa, Artificial Sequence
  Description of Artificial Sequence: Synthetic polypeptide
DEEEIRTTNPVATEGYGISVSWVNLQERISNQ

SEQ ID NO: 40843 - protein, 31 aa, Artificial Sequence
  Description of Artificial Sequence: Synthetic polypeptide
DEEEIRTTNPVATEAWGKVVCTNLSQREGNG

SEQ ID NO: 40844 - protein, 32 aa, Artificial Sequence
  Description of Artificial Sequence: Synthetic polypeptide
DEEEIRTTNPVATEGYGIVVSTVNLQDRNINN

SEQ ID NO: 40845 - protein, 29 aa, Artificial Sequence
  Description of Artificial Sequence: Synthetic peptide
DEEEIRTTNPVATEQYGSVPMSLQTNPIT

SEQ ID NO: 40846 - protein, 33 aa, Artificial Sequence
  Description of Artificial Sequence: Synthetic polypeptide
DEEEIATTNPVATEQYGSVAAATNLQQDGNDRH

SEQ ID NO: 40847 - protein, 33 aa, Artificial Sequence
  Description of Artificial Sequence: Synthetic polypeptide
DEEEIRTTNPVATEHYGYSISTNELGQRGFEGR

SEQ ID NO: 40848 - protein, 33 aa, Artificial Sequence
  Description of Artificial Sequence: Synthetic polypeptide
DEEEIRTTNPVATEQYGSVHPTVLSQRGQNQDD

SEQ ID NO: 40849 - protein, 32 aa, Artificial Sequence
  Description of Artificial Sequence: Synthetic polypeptide
DEEEIRTTNPVATEGYGSVSTMELEQDEGGNE

SEQ ID NO: 40850 - protein, 33 aa, Artificial Sequence
  Description of Artificial Sequence: Synthetic polypeptide
DEEEIRTTNPVATEQYGCVCSTNALQFFGSNTA

SEQ ID NO: 40851 - protein, 33 aa, Artificial Sequence
  Description of Artificial Sequence: Synthetic polypeptide
DEEEIRTTNPVATEQYGCVCSTMNLQRFGSQQF

SEQ ID NO: 40852 - protein, 32 aa, Artificial Sequence
  Description of Artificial Sequence: Synthetic polypeptide
DEEEIRTTNPVATEQYGSVGTNNLNDFGGNEQ

SEQ ID NO: 40853 - protein, 32 aa, Artificial Sequence
  Description of Artificial Sequence: Synthetic polypeptide
DEEEIRTTNPVATEGYGSVSTMNLNEMGNGDG

SEQ ID NO: 40854 - protein, 33 aa, Artificial Sequence
  Description of Artificial Sequence: Synthetic polypeptide
DEEEIRTTNPVATEQYGSVGSTGNGHQMRDMER

SEQ ID NO: 40855 - protein, 30 aa, Artificial Sequence
  Description of Artificial Sequence: Synthetic polypeptide
DEEEIACTNPVATEQYGSVSANNNQEQGNQ

SEQ ID NO: 40856 - protein, 30 aa, Artificial Sequence
  Description of Artificial Sequence: Synthetic polypeptide
DEECIATVNPVATEPYGSVSDNLSTRGNNR

SEQ ID NO: 40857 - protein, 30 aa, Artificial Sequence
  Description of Artificial Sequence: Synthetic polypeptide
DEEEIRTTNPVATEAYGKCSCTNESQRVNF

SEQ ID NO: 40858 - protein, 31 aa, Artificial Sequence
  Description of Artificial Sequence: Synthetic polypeptide
DEEEIRTTNPVATEQYGCVCSTGAHQNSGNQ

SEQ ID NO: 40859 - protein, 31 aa, Artificial Sequence
  Description of Artificial Sequence: Synthetic polypeptide
DEEEIRTTNPVATEQYGSVSLTVQTQDGEPD

SEQ ID NO: 40860 - protein, 32 aa, Artificial Sequence
  Description of Artificial Sequence: Synthetic polypeptide
DEEEIACTNPVATEQYGSVATNLQRDQGENNN

SEQ ID NO: 40861 - protein, 33 aa, Artificial Sequence
  Description of Artificial Sequence: Synthetic polypeptide
DEEEIRTTNPVATEQYGSVSNTNLELIGGNQNE

SEQ ID NO: 40862 - protein, 28 aa, Artificial Sequence
  Description of Artificial Sequence: Synthetic peptide
DEECIETVNPVATEWYGSVSDNLEMGNL

SEQ ID NO: 40863 - protein, 33 aa, Artificial Sequence
  Description of Artificial Sequence: Synthetic polypeptide
DEEEIRTTNPVATEQYGCVCSTMNPQRFGSNQM

SEQ ID NO: 40864 - protein, 31 aa, Artificial Sequence
  Description of Artificial Sequence: Synthetic polypeptide
DEEEIRTTNPVATEQYGSVQTDLVSVGEEER

SEQ ID NO: 40865 - protein, 32 aa, Artificial Sequence
  Description of Artificial Sequence: Synthetic polypeptide
DEEEIRTTNPVATEQYGCVCSTGALQYGSNAS

SEQ ID NO: 40866 - protein, 32 aa, Artificial Sequence
  Description of Artificial Sequence: Synthetic polypeptide
DEEEIACTNPVATEQYGSVSTNQLQEQMGGNP

SEQ ID NO: 40867 - protein, 32 aa, Artificial Sequence
  Description of Artificial Sequence: Synthetic polypeptide
DEEEIATTNPVATEQYGSCSMTGNLEARDGDR

SEQ ID NO: 40868 - protein, 32 aa, Artificial Sequence
  Description of Artificial Sequence: Synthetic polypeptide
DEEEIRTTNPVATEQYGCVCSTGNLANGGSNA

SEQ ID NO: 40869 - protein, 32 aa, Artificial Sequence
  Description of Artificial Sequence: Synthetic polypeptide
DEEEIRTTNPVATEQYGSVPSANLERNINNEQ

SEQ ID NO: 40870 - protein, 28 aa, Artificial Sequence
  Description of Artificial Sequence: Synthetic peptide
DEECIETVNPVATEWYGSVSDNGEDGNR

SEQ ID NO: 40871 - protein, 32 aa, Artificial Sequence
  Description of Artificial Sequence: Synthetic polypeptide
DEEEIRTTNPVATEQYGSVQTNLQVVNNNDFL

SEQ ID NO: 40872 - protein, 33 aa, Artificial Sequence
  Description of Artificial Sequence: Synthetic polypeptide
DEEEIRTTNPVATEPYGICVSTVNDLQERISNR

SEQ ID NO: 40873 - protein, 30 aa, Artificial Sequence
  Description of Artificial Sequence: Synthetic polypeptide
DEECIATVNPVATEPYGSVSDNLERNGNER

SEQ ID NO: 40874 - protein, 33 aa, Artificial Sequence
  Description of Artificial Sequence: Synthetic polypeptide
DEEEIRTTNPVATEAWGSVSTLNMLSQNGGNRC

SEQ ID NO: 40875 - protein, 31 aa, Artificial Sequence
  Description of Artificial Sequence: Synthetic polypeptide
DEECIATVNPVATEHYGSVHSDNLQERDGNR

SEQ ID NO: 40876 - protein, 32 aa, Artificial Sequence
  Description of Artificial Sequence: Synthetic polypeptide
DEEEIRTTNPVATEQYGSVPPTNLERTENEDD

SEQ ID NO: 40877 - protein, 34 aa, Artificial Sequence
  Description of Artificial Sequence: Synthetic polypeptide
DEEEIRTTNPVATEQYGCVCSTNDDQRFGSNNRD

SEQ ID NO: 40878 - protein, 31 aa, Artificial Sequence
  Description of Artificial Sequence: Synthetic polypeptide
DEEEIACTNPVATEQYGSVATNQLQNPMGNL

SEQ ID NO: 40879 - protein, 32 aa, Artificial Sequence
  Description of Artificial Sequence: Synthetic polypeptide
DEEEIRTTNPVATEGYGSVSTMNLEAFGENDG

SEQ ID NO: 40880 - protein, 34 aa, Artificial Sequence
  Description of Artificial Sequence: Synthetic polypeptide
DEEEIRTTNPVATEQYGSVGSTVNLFQNGGGNGD

SEQ ID NO: 40881 - protein, 32 aa, Artificial Sequence
  Description of Artificial Sequence: Synthetic polypeptide
DEEEIRTTNPVATEQYGSVGSTQNVNFGGNGQ

SEQ ID NO: 40882 - protein, 32 aa, Artificial Sequence
  Description of Artificial Sequence: Synthetic polypeptide
DEEEIRTTNPVATEAWGSVSTNLTRTGGNNQY

SEQ ID NO: 40883 - protein, 31 aa, Artificial Sequence
  Description of Artificial Sequence: Synthetic polypeptide
DEEEIRTTNPVATEQYGSVNTNDPIQRDIEV

SEQ ID NO: 40884 - protein, 32 aa, Artificial Sequence
  Description of Artificial Sequence: Synthetic polypeptide
DEEEIRTTNPVATEGYGSVSTMNLNDQGEGGN

SEQ ID NO: 40885 - protein, 33 aa, Artificial Sequence
  Description of Artificial Sequence: Synthetic polypeptide
DEEEIRTTNPVATEPYGISTCSTENLQPRIVNR

SEQ ID NO: 40886 - protein, 32 aa, Artificial Sequence
  Description of Artificial Sequence: Synthetic polypeptide
DEEEIRTTNPVATEQYGSVNSVTEPLDRTNMG

SEQ ID NO: 40887 - protein, 33 aa, Artificial Sequence
  Description of Artificial Sequence: Synthetic polypeptide
DEEEIRTTNPVATEGYGSVSTTDNLQESGGNIQ

SEQ ID NO: 40888 - protein, 33 aa, Artificial Sequence
  Description of Artificial Sequence: Synthetic polypeptide
DEEEIRTTNPVATEQYGCVCSTMNLQNGSNNQA

SEQ ID NO: 40889 - protein, 34 aa, Artificial Sequence
  Description of Artificial Sequence: Synthetic polypeptide
DEEEIRTTNPVATEAYGSTSYTENLSQRTGGNNR

SEQ ID NO: 40890 - protein, 33 aa, Artificial Sequence
  Description of Artificial Sequence: Synthetic polypeptide
DEEEIRTTNPVATEQYGSVGSTNDIQETGNNNE

SEQ ID NO: 40891 - protein, 33 aa, Artificial Sequence
  Description of Artificial Sequence: Synthetic polypeptide
DEEEIRTTNPVATEQYGSVNSVTENLDDRTNDG

SEQ ID NO: 40892 - protein, 32 aa, Artificial Sequence
  Description of Artificial Sequence: Synthetic polypeptide
DEEEIRTTNPVATEQYGCVCSTEWHQERGSNQ

SEQ ID NO: 40893 - protein, 32 aa, Artificial Sequence
  Description of Artificial Sequence: Synthetic polypeptide
DEEEIRTTNPVATEQYGSVNTMDLQRSMDDRL

SEQ ID NO: 40894 - protein, 33 aa, Artificial Sequence
  Description of Artificial Sequence: Synthetic polypeptide
DEEEIRTTNPVATEQYGSVSNTNFGQNEGGNEG

SEQ ID NO: 40895 - protein, 32 aa, Artificial Sequence
  Description of Artificial Sequence: Synthetic polypeptide
DEEEIRTTNPVATEQYGCVCSTEYDQFGSNRG

SEQ ID NO: 40896 - protein, 33 aa, Artificial Sequence
  Description of Artificial Sequence: Synthetic polypeptide
DEEEIRTTNPVATEAYGSTCSCIVNLSQRGGNR

SEQ ID NO: 40897 - protein, 33 aa, Artificial Sequence
  Description of Artificial Sequence: Synthetic polypeptide
DEEEIRTTNPVATEQYGSVQTNLVITNGENERQ

SEQ ID NO: 40898 - protein, 32 aa, Artificial Sequence
  Description of Artificial Sequence: Synthetic polypeptide
DEEEIRTTNPVATEQYGCVCSTGEEHQGGSNR

SEQ ID NO: 40899 - protein, 31 aa, Artificial Sequence
  Description of Artificial Sequence: Synthetic polypeptide
DEEEIRTTNPVATEQYGSVNTNDIQREYDSD

SEQ ID NO: 40900 - protein, 32 aa, Artificial Sequence
  Description of Artificial Sequence: Synthetic polypeptide
DEEEIRTTNPVATEHYGSTVGCQNLSTRGGNR

SEQ ID NO: 40901 - protein, 29 aa, Artificial Sequence
  Description of Artificial Sequence: Synthetic peptide
DEECIATVNPVATEWYGNVSGDNLERGNR

SEQ ID NO: 40902 - protein, 32 aa, Artificial Sequence
  Description of Artificial Sequence: Synthetic polypeptide
DEEEIRTTNPVATEHYGSTVCQNALSQAGGNR

SEQ ID NO: 40903 - protein, 32 aa, Artificial Sequence
  Description of Artificial Sequence: Synthetic polypeptide
DEEEIRTTNPVATEGYGSVSTMNLVGQGGGQS

SEQ ID NO: 40904 - protein, 33 aa, Artificial Sequence
  Description of Artificial Sequence: Synthetic polypeptide
DEEEIRTTNPVATEQYGSVSLTNLQVTEFGAID

SEQ ID NO: 40905 - protein, 32 aa, Artificial Sequence
  Description of Artificial Sequence: Synthetic polypeptide
DEEEIRTTNPVATEQYGCVCSTNAHQECGSNQ

SEQ ID NO: 40906 - protein, 34 aa, Artificial Sequence
  Description of Artificial Sequence: Synthetic polypeptide
DEEEIRTTNPVATEAYGISTVSCTNLSQRSGARF

SEQ ID NO: 40907 - protein, 33 aa, Artificial Sequence
  Description of Artificial Sequence: Synthetic polypeptide
DEEEIRTTNPVATEQYGCVCSTGELNQRGSNAA

SEQ ID NO: 40908 - protein, 29 aa, Artificial Sequence
  Description of Artificial Sequence: Synthetic peptide
DEECIATVNPVATEWYGSVSDNLENGMNR

SEQ ID NO: 40909 - protein, 32 aa, Artificial Sequence
  Description of Artificial Sequence: Synthetic polypeptide
DEEEIRTTNPVATEQYGCVCSTNAHQFGSNAA

SEQ ID NO: 40910 - protein, 33 aa, Artificial Sequence
  Description of Artificial Sequence: Synthetic polypeptide
DEEEIATTNPVATEQYGSCSATENLEARDGNRH

SEQ ID NO: 40911 - protein, 34 aa, Artificial Sequence
  Description of Artificial Sequence: Synthetic polypeptide
DEEEIRTTNPVATEPYGISVSTANLSQDRVTNNR

SEQ ID NO: 40912 - protein, 32 aa, Artificial Sequence
  Description of Artificial Sequence: Synthetic polypeptide
DEEEIRTTNPVATEAWGSVSTGNLSASGGNRY

SEQ ID NO: 40913 - protein, 33 aa, Artificial Sequence
  Description of Artificial Sequence: Synthetic polypeptide
DEEEIRTTNPVATEQYGCVCSTGNHQRSGSNPQ

SEQ ID NO: 40914 - protein, 33 aa, Artificial Sequence
  Description of Artificial Sequence: Synthetic polypeptide
DEEEIRTTNPVATEQYGSVNSTVSDDQRGENGQ

SEQ ID NO: 40915 - protein, 33 aa, Artificial Sequence
  Description of Artificial Sequence: Synthetic polypeptide
DEEEIRTTNPVATEQYGSVGSTTLQNDGGNEDF

SEQ ID NO: 40916 - protein, 31 aa, Artificial Sequence
  Description of Artificial Sequence: Synthetic polypeptide
DEEEIRTTNPVATEQYGSVQTEHQNFNSNRA

SEQ ID NO: 40917 - protein, 30 aa, Artificial Sequence
  Description of Artificial Sequence: Synthetic polypeptide
DEEEIACTNPVATEQWGSVATNLQDGGTRQ

SEQ ID NO: 40918 - protein, 34 aa, Artificial Sequence
  Description of Artificial Sequence: Synthetic polypeptide
DEEEIRTTNPVATEAYGISVSTGNLSARGGNNRY

SEQ ID NO: 40919 - protein, 33 aa, Artificial Sequence
  Description of Artificial Sequence: Synthetic polypeptide
DEEEIRTTNPVATEQYGSVGSTLNIENGQGGNQ

SEQ ID NO: 40920 - protein, 32 aa, Artificial Sequence
  Description of Artificial Sequence: Synthetic polypeptide
DEEEIRTTNPVATEGYGSVSTMNLVAEGGNDG

SEQ ID NO: 40921 - protein, 33 aa, Artificial Sequence
  Description of Artificial Sequence: Synthetic polypeptide
DEEEIRTTNPVATDQYGSVSTSNLQDTTGNNGD

SEQ ID NO: 40922 - protein, 34 aa, Artificial Sequence
  Description of Artificial Sequence: Synthetic polypeptide
DEEEIRTTNPVATEQYGSVSNTNGLEQGGGENTT

SEQ ID NO: 40923 - protein, 29 aa, Artificial Sequence
  Description of Artificial Sequence: Synthetic peptide
DEECIETVNPVATEWYGSVIEDNLERGNR

SEQ ID NO: 40924 - protein, 33 aa, Artificial Sequence
  Description of Artificial Sequence: Synthetic polypeptide
DEEEIRTTNPVATDQYGSVSCTTNLSQTGGNNE

SEQ ID NO: 40925 - protein, 29 aa, Artificial Sequence
  Description of Artificial Sequence: Synthetic peptide
DEEEIRTTNPVATEQYGSVQTEADRNQEE

SEQ ID NO: 40926 - protein, 31 aa, Artificial Sequence
  Description of Artificial Sequence: Synthetic polypeptide
DEEEIRTTNPVATEQYGCVCSTGNHQGGDQV

SEQ ID NO: 40927 - protein, 31 aa, Artificial Sequence
  Description of Artificial Sequence: Synthetic polypeptide
DEECIATVNPVATEPYGSVSHDNLQERGGNR

SEQ ID NO: 40928 - protein, 33 aa, Artificial Sequence
  Description of Artificial Sequence: Synthetic polypeptide
DEEEIRTTNPVATEPYGISVSTGNGSQDRVTNR

SEQ ID NO: 40929 - protein, 31 aa, Artificial Sequence
  Description of Artificial Sequence: Synthetic polypeptide
DEEEIACTNPVATEQYGSVATNLQREGGEEA

SEQ ID NO: 40930 - protein, 31 aa, Artificial Sequence
  Description of Artificial Sequence: Synthetic polypeptide
DEEEIACTNPVATEQYGSVSTNSLFQQDGEF

SEQ ID NO: 40931 - protein, 33 aa, Artificial Sequence
  Description of Artificial Sequence: Synthetic polypeptide
DEEEIRTTNPVATEGYGSVSTMNLQATGGNEDG

SEQ ID NO: 40932 - protein, 32 aa, Artificial Sequence
  Description of Artificial Sequence: Synthetic polypeptide
DEEEIRTTNPVATEQYGSVGSTMNGTGGGNEG

SEQ ID NO: 40933 - protein, 31 aa, Artificial Sequence
  Description of Artificial Sequence: Synthetic polypeptide
DEEEIRTTNPVATEQYGCVCSTGEHQNGSNT

SEQ ID NO: 40934 - protein, 30 aa, Artificial Sequence
  Description of Artificial Sequence: Synthetic polypeptide
DEECIETVNPVATEWYGSVSDGNLYERGNR

SEQ ID NO: 40935 - protein, 33 aa, Artificial Sequence
  Description of Artificial Sequence: Synthetic polypeptide
DEEEIRTTNPVATEGYGSVSTMNLQEAGENGDG

SEQ ID NO: 40936 - protein, 30 aa, Artificial Sequence
  Description of Artificial Sequence: Synthetic polypeptide
DEECIETVNPVATEWYGSVNSDNLERGNRA

SEQ ID NO: 40937 - protein, 33 aa, Artificial Sequence
  Description of Artificial Sequence: Synthetic polypeptide
DEEEIRTTNPVATEQYGSVNSTVSDDQRGENVE

SEQ ID NO: 40938 - protein, 33 aa, Artificial Sequence
  Description of Artificial Sequence: Synthetic polypeptide
DEEEIRTTNPVATEAYGSASVPNMLSQRVGNNR

SEQ ID NO: 40939 - protein, 32 aa, Artificial Sequence
  Description of Artificial Sequence: Synthetic polypeptide
DEEEIRTTNPVATEQYGCVCSTGEHQRGSQRV

SEQ ID NO: 40940 - protein, 34 aa, Artificial Sequence
  Description of Artificial Sequence: Synthetic polypeptide
DEEEIRTTNPVATEPYGISVPSTGNLQDRVTNNR

SEQ ID NO: 40941 - protein, 33 aa, Artificial Sequence
  Description of Artificial Sequence: Synthetic polypeptide
DEEEIRTTNPVATEPYGISVSAVNLQDRIKNRP

SEQ ID NO: 40942 - protein, 32 aa, Artificial Sequence
  Description of Artificial Sequence: Synthetic polypeptide
DEEEIATTNPVATEQYGSCSMTENLEARDGNN

SEQ ID NO: 40943 - protein, 33 aa, Artificial Sequence
  Description of Artificial Sequence: Synthetic polypeptide
DEEEIRTTNPVATEQYGSVSLTTLQNLAGENQQ

SEQ ID NO: 40944 - protein, 29 aa, Artificial Sequence
  Description of Artificial Sequence: Synthetic peptide
DEEEIACTNPVATEQWGSVATNLQADNNE

SEQ ID NO: 40945 - protein, 33 aa, Artificial Sequence
  Description of Artificial Sequence: Synthetic polypeptide
DEEEIRTTNPVATEQYGSVGSTMNDQNGINGGE

SEQ ID NO: 40946 - protein, 30 aa, Artificial Sequence
  Description of Artificial Sequence: Synthetic polypeptide
DEECIATVNPVATEAYGSVPSCDNLERGNR

SEQ ID NO: 40947 - protein, 33 aa, Artificial Sequence
  Description of Artificial Sequence: Synthetic polypeptide
DEEEIRTTNPVATEPYGISVSNTVNLQDRINND

SEQ ID NO: 40948 - protein, 29 aa, Artificial Sequence
  Description of Artificial Sequence: Synthetic peptide
DEECIATVNPVATEAYGSVSDNLERFGNQ

SEQ ID NO: 40949 - protein, 32 aa, Artificial Sequence
  Description of Artificial Sequence: Synthetic polypeptide
DEEEIRTTNPVATEGYGSVSTMNLQEDFNGQG

SEQ ID NO: 40950 - protein, 32 aa, Artificial Sequence
  Description of Artificial Sequence: Synthetic polypeptide
DEEEIACTNPVATEQYGSVATNLQRDGPEPNG

SEQ ID NO: 40951 - protein, 33 aa, Artificial Sequence
  Description of Artificial Sequence: Synthetic polypeptide
DEEEIRTTNPVATEHYGSTVSTTNMLDQIGNYH

SEQ ID NO: 40952 - protein, 31 aa, Artificial Sequence
  Description of Artificial Sequence: Synthetic polypeptide
DEEEIRTTNPVATEHYGSVACQNLSTRGGNA

SEQ ID NO: 40953 - protein, 34 aa, Artificial Sequence
  Description of Artificial Sequence: Synthetic polypeptide
DEEEIRTTNPVATEQYGSVPSCTGNAISQNKGNR

SEQ ID NO: 40954 - protein, 31 aa, Artificial Sequence
  Description of Artificial Sequence: Synthetic polypeptide
DEEEIRTTNPVATEGYGSVYSTNCIQKCSNT

SEQ ID NO: 40955 - protein, 34 aa, Artificial Sequence
  Description of Artificial Sequence: Synthetic polypeptide
DEEEIRTTNPVATEQYGSVGSTVNLQETGGENNI

SEQ ID NO: 40956 - protein, 31 aa, Artificial Sequence
  Description of Artificial Sequence: Synthetic polypeptide
DEEEIRTTNPVATEAYGKVSVTNISTRGGND

SEQ ID NO: 40957 - protein, 29 aa, Artificial Sequence
  Description of Artificial Sequence: Synthetic peptide
DEEAICTTNPVTTEQYGSVSTVNNQGGQT

SEQ ID NO: 40958 - protein, 34 aa, Artificial Sequence
  Description of Artificial Sequence: Synthetic polypeptide
DEEEIRTTNPVATEQYGSVGSTDNGLQEQGENIE

SEQ ID NO: 40959 - protein, 33 aa, Artificial Sequence
  Description of Artificial Sequence: Synthetic polypeptide
DEEEIRTTNPVATEQYGSVGSTDNGNQNGGNIE

SEQ ID NO: 40960 - protein, 32 aa, Artificial Sequence
  Description of Artificial Sequence: Synthetic polypeptide
DEEEIRTTNPVATEGYGSVSTMELQDEGGGNT

SEQ ID NO: 40961 - protein, 35 aa, Artificial Sequence
  Description of Artificial Sequence: Synthetic polypeptide
DEEEIRTTNPVATEAYGSTVPSTNMLPQRTGGNRP

SEQ ID NO: 40962 - protein, 34 aa, Artificial Sequence
  Description of Artificial Sequence: Synthetic polypeptide
DEEEIRTTNPVATEQYGSVNSTTNDDDQRGTEER

SEQ ID NO: 40963 - protein, 33 aa, Artificial Sequence
  Description of Artificial Sequence: Synthetic polypeptide
DEEEIRTTNPVATEQYGCVCSTMELQRFGSNGQ

SEQ ID NO: 40964 - protein, 32 aa, Artificial Sequence
  Description of Artificial Sequence: Synthetic polypeptide
DEEEIRTTNPVATEAYGKVVSVTNLSTRGGNH

SEQ ID NO: 40965 - protein, 32 aa, Artificial Sequence
  Description of Artificial Sequence: Synthetic polypeptide
DEEEIRTTNPVATEGYGSVSTMELQEFGGNET

SEQ ID NO: 40966 - protein, 33 aa, Artificial Sequence
  Description of Artificial Sequence: Synthetic polypeptide
DEEEIRTTNPVATEQYGSVSLTNPLPRGEPETL

SEQ ID NO: 40967 - protein, 33 aa, Artificial Sequence
  Description of Artificial Sequence: Synthetic polypeptide
DEEEIRTTNPVATEQYGSVGSTNGGQEGGNEDE

SEQ ID NO: 40968 - protein, 32 aa, Artificial Sequence
  Description of Artificial Sequence: Synthetic polypeptide
DEEEIRTTNPVATEQYGSVSNTNDQSNEGETN

SEQ ID NO: 40969 - protein, 32 aa, Artificial Sequence
  Description of Artificial Sequence: Synthetic polypeptide
DEEEIRTTNPVATEQYGSVQTDDVQREGDQRD

SEQ ID NO: 40970 - protein, 32 aa, Artificial Sequence
  Description of Artificial Sequence: Synthetic polypeptide
DEEEIRTTNPVATEGYGSVDFTNELTRGGNGG

SEQ ID NO: 40971 - protein, 33 aa, Artificial Sequence
  Description of Artificial Sequence: Synthetic polypeptide
DEEEIRTTNPVATEGYGSVSTMNLDQEGGNNGQ

SEQ ID NO: 40972 - protein, 31 aa, Artificial Sequence
  Description of Artificial Sequence: Synthetic polypeptide
DEEEIRTTNPVATEQYGCVCSTGELQGGSQA

SEQ ID NO: 40973 - protein, 33 aa, Artificial Sequence
  Description of Artificial Sequence: Synthetic polypeptide
DEEEIRTTNPVATEQYGSVGSTDNGQTDEGGNT

SEQ ID NO: 40974 - protein, 31 aa, Artificial Sequence
  Description of Artificial Sequence: Synthetic polypeptide
DEEEIACTNPVATEQYGSVATNLQQGGGNDQ

SEQ ID NO: 40975 - protein, 33 aa, Artificial Sequence
  Description of Artificial Sequence: Synthetic polypeptide
DEEEIRTTNPVATEQYGSVGTPGLQRFGNMVDT

SEQ ID NO: 40976 - protein, 31 aa, Artificial Sequence
  Description of Artificial Sequence: Synthetic polypeptide
DEEEIRTTNPVATEQYGSVNSTTNDLGVQGV

SEQ ID NO: 40977 - protein, 34 aa, Artificial Sequence
  Description of Artificial Sequence: Synthetic polypeptide
DEEEIRTTNPVATEQYGSVGSTVNLQETGGQNIG

SEQ ID NO: 40978 - protein, 32 aa, Artificial Sequence
  Description of Artificial Sequence: Synthetic polypeptide
DEEEIRTTNPVATEQYGCVCSTGNLQNFGEQE

SEQ ID NO: 40979 - protein, 32 aa, Artificial Sequence
  Description of Artificial Sequence: Synthetic polypeptide
DEEEIRTTNPVATEQYGCVCSTGNDLQNGSDQ

SEQ ID NO: 40980 - protein, 34 aa, Artificial Sequence
  Description of Artificial Sequence: Synthetic polypeptide
DEEEIRTTNPVATEQYGSVSLTNLQVGEGDNQID

SEQ ID NO: 40981 - protein, 33 aa, Artificial Sequence
  Description of Artificial Sequence: Synthetic polypeptide
DEEEIRTTNPVATEQYGSVSNTNDQQGGGGNIN

SEQ ID NO: 40982 - protein, 31 aa, Artificial Sequence
  Description of Artificial Sequence: Synthetic polypeptide
DEEEIRTTNPVATEQYGSVNTTEDLDRGEDA

SEQ ID NO: 40983 - protein, 33 aa, Artificial Sequence
  Description of Artificial Sequence: Synthetic polypeptide
DEEEIRTTNPVATEHYGICVSTVNLQDRISNRF

SEQ ID NO: 40984 - protein, 30 aa, Artificial Sequence
  Description of Artificial Sequence: Synthetic polypeptide
DEEEIACTNPVATEQYGSVSTDLEDHEGNL

SEQ ID NO: 40985 - protein, 30 aa, Artificial Sequence
  Description of Artificial Sequence: Synthetic polypeptide
DEEEIACTNPVATEQYGSVATNLQQDQGEN

SEQ ID NO: 40986 - protein, 32 aa, Artificial Sequence
  Description of Artificial Sequence: Synthetic polypeptide
DEEEIRTTNPVATEQYGSVNTSIIREGENERT

SEQ ID NO: 40987 - protein, 33 aa, Artificial Sequence
  Description of Artificial Sequence: Synthetic polypeptide
DEEEIRTTNPVATEQYGCVCSTNDLQNGSNTQS

SEQ ID NO: 40988 - protein, 33 aa, Artificial Sequence
  Description of Artificial Sequence: Synthetic polypeptide
DEEEIRTTNPVATEQYGSVSNTNDQQIGVGGNE

SEQ ID NO: 40989 - protein, 32 aa, Artificial Sequence
  Description of Artificial Sequence: Synthetic polypeptide
DEEEIRTTNPVATEGYGSVMSNVNLQARIING

SEQ ID NO: 40990 - protein, 32 aa, Artificial Sequence
  Description of Artificial Sequence: Synthetic polypeptide
DEEEIRTTNPVATEQYGSVSLWPNQQRVELRQ

SEQ ID NO: 40991 - protein, 30 aa, Artificial Sequence
  Description of Artificial Sequence: Synthetic polypeptide
DEEEIRTTNPVATEQYGSVNSTTDERIEEG

SEQ ID NO: 40992 - protein, 32 aa, Artificial Sequence
  Description of Artificial Sequence: Synthetic polypeptide
DEEEIRTTNPVATEQYGSVSLTNQAQERDQIV

SEQ ID NO: 40993 - protein, 32 aa, Artificial Sequence
  Description of Artificial Sequence: Synthetic polypeptide
DEEEIRTTNPVATEQYGSVGSTPNVNFGGNQG

SEQ ID NO: 40994 - protein, 32 aa, Artificial Sequence
  Description of Artificial Sequence: Synthetic polypeptide
DEEEIRTTNPVATEGYGSVSTMELQDEFGNGE

SEQ ID NO: 40995 - protein, 33 aa, Artificial Sequence
  Description of Artificial Sequence: Synthetic polypeptide
DEEEIRTTNPVATEQYGCVCSTGNLDQRFGSQQ

SEQ ID NO: 40996 - protein, 32 aa, Artificial Sequence
  Description of Artificial Sequence: Synthetic polypeptide
DEEEIRTTNPVATEQYGCVCSTGNAIQENGNQ

SEQ ID NO: 40997 - protein, 32 aa, Artificial Sequence
  Description of Artificial Sequence: Synthetic polypeptide
DEEEIRTTNPVATEAWGCQTVSTNLSQRGGNT

SEQ ID NO: 40998 - protein, 30 aa, Artificial Sequence
  Description of Artificial Sequence: Synthetic polypeptide
DEEEIRTTNPVATEQYGSVQTNDDPGEEHT

SEQ ID NO: 40999 - protein, 31 aa, Artificial Sequence
  Description of Artificial Sequence: Synthetic polypeptide
DEEEIRTTNPVATEGYGSVCSTYLQGFNSND

SEQ ID NO: 41000 - protein, 30 aa, Artificial Sequence
  Description of Artificial Sequence: Synthetic polypeptide
DEEEIACTNPVATESYGSVATNLQDGDDRY

SEQ ID NO: 41001 - protein, 31 aa, Artificial Sequence
  Description of Artificial Sequence: Synthetic polypeptide
DEEEIRTTNPVATEGYGSVCSTNHQNGSDQS

SEQ ID NO: 41002 - protein, 32 aa, Artificial Sequence
  Description of Artificial Sequence: Synthetic polypeptide
DEEEIRTTNPVATEHYGSVVSTNPIEQTDENR

SEQ ID NO: 41003 - protein, 33 aa, Artificial Sequence
  Description of Artificial Sequence: Synthetic polypeptide
DEEEIRTTNPVATEGYGSVSTMNLDQGGNNDGD

SEQ ID NO: 41004 - protein, 31 aa, Artificial Sequence
  Description of Artificial Sequence: Synthetic polypeptide
DEEEIRTTNPVATEQYGSVPINSERGNEEDI

SEQ ID NO: 41005 - protein, 32 aa, Artificial Sequence
  Description of Artificial Sequence: Synthetic polypeptide
DEEEIRTTNPVATDQYGVVSTGNLQNEMGNEG

SEQ ID NO: 41006 - protein, 31 aa, Artificial Sequence
  Description of Artificial Sequence: Synthetic polypeptide
DEEEIRTTNPVATEQYGSVSLTWTQDQNMNW

SEQ ID NO: 41007 - protein, 30 aa, Artificial Sequence
  Description of Artificial Sequence: Synthetic polypeptide
DEEEIACTNPVATEQYGSVATNLQRDDHDN

SEQ ID NO: 41008 - protein, 32 aa, Artificial Sequence
  Description of Artificial Sequence: Synthetic polypeptide
DEEEIRTTNPVATEQYGSVGSTNDQNNMNFPD

SEQ ID NO: 41009 - protein, 32 aa, Artificial Sequence
  Description of Artificial Sequence: Synthetic polypeptide
DEEEIRTTNPVATEQYGCVCSTNDHNQECGNQ

SEQ ID NO: 41010 - protein, 31 aa, Artificial Sequence
  Description of Artificial Sequence: Synthetic polypeptide
DEEEIRTTNPVATEQYGSVNSTTNDRGVQML

SEQ ID NO: 41011 - protein, 28 aa, Artificial Sequence
  Description of Artificial Sequence: Synthetic peptide
DEECIATVNPVATEGYGSVSWELERGNA

SEQ ID NO: 41012 - protein, 33 aa, Artificial Sequence
  Description of Artificial Sequence: Synthetic polypeptide
DEEEIRTTNPVATEQYGCVCSTMNHQERGSNQE

SEQ ID NO: 41013 - protein, 32 aa, Artificial Sequence
  Description of Artificial Sequence: Synthetic polypeptide
DEEEIRTTNPVATEQYGSVPANLQQVVNVFTR

SEQ ID NO: 41014 - protein, 32 aa, Artificial Sequence
  Description of Artificial Sequence: Synthetic polypeptide
DEEEIRTTNPVATEQYGCVCSTGNNQNGSNII

SEQ ID NO: 41015 - protein, 32 aa, Artificial Sequence
  Description of Artificial Sequence: Synthetic polypeptide
DEEEIRTTNPVATEQYGCVCSTGNLQYFNSQQ

SEQ ID NO: 41016 - protein, 29 aa, Artificial Sequence
  Description of Artificial Sequence: Synthetic peptide
DEECIETVNPVATEWYGSVSDNLERGGNE

SEQ ID NO: 41017 - protein, 29 aa, Artificial Sequence
  Description of Artificial Sequence: Synthetic peptide
DEECIETVNPVATEWYGSVSDNLERELNR

SEQ ID NO: 41018 - protein, 31 aa, Artificial Sequence
  Description of Artificial Sequence: Synthetic polypeptide
DEECIATVNPVATEWYGSVSGDNLQERGENR

SEQ ID NO: 41019 - protein, 34 aa, Artificial Sequence
  Description of Artificial Sequence: Synthetic polypeptide
DEEEIRTTNPVATDQYGSVQMTGNLQVRFGNPRD

SEQ ID NO: 41020 - protein, 31 aa, Artificial Sequence
  Description of Artificial Sequence: Synthetic polypeptide
DEEEIRTTNPVATEQYGSVQTNNQVRVFQLG

SEQ ID NO: 41021 - protein, 31 aa, Artificial Sequence
  Description of Artificial Sequence: Synthetic polypeptide
DEEEIRTTNPVATEQYGSVQTDGVQREMDRT

SEQ ID NO: 41022 - protein, 33 aa, Artificial Sequence
  Description of Artificial Sequence: Synthetic polypeptide
DEEEIRTTNPVATEHYGSVACTPLSQRTGGNER

SEQ ID NO: 41023 - protein, 33 aa, Artificial Sequence
  Description of Artificial Sequence: Synthetic polypeptide
DEEEIRTTNPVATEQYGCVCSTMNLQEGIGSND

SEQ ID NO: 41024 - protein, 33 aa, Artificial Sequence
  Description of Artificial Sequence: Synthetic polypeptide
DEEEIRTTNPVATEQYGSVPPPNLQPRDGEDRD

SEQ ID NO: 41025 - protein, 34 aa, Artificial Sequence
  Description of Artificial Sequence: Synthetic polypeptide
DEEEIRTTNPVATEQYGSVGSTVNLNQNGINGED

SEQ ID NO: 41026 - protein, 28 aa, Artificial Sequence
  Description of Artificial Sequence: Synthetic peptide
DEECIETVNPVATEPYGSVSDNLEAGNT

SEQ ID NO: 41027 - protein, 33 aa, Artificial Sequence
  Description of Artificial Sequence: Synthetic polypeptide
DEEEIRTTNPVATEQYGSVGSTQNPGQINGNDD

SEQ ID NO: 41028 - protein, 32 aa, Artificial Sequence
  Description of Artificial Sequence: Synthetic polypeptide
DEEEIRTTNPVATEQYGCVCSTGELQFFGSDR

SEQ ID NO: 41029 - protein, 33 aa, Artificial Sequence
  Description of Artificial Sequence: Synthetic polypeptide
DEEEIATTNPVATEQYGSIVCSTNLGQRMQDNV

SEQ ID NO: 41030 - protein, 31 aa, Artificial Sequence
  Description of Artificial Sequence: Synthetic polypeptide
DEEEIRTTNPVATEQYGSVNTIVEDQVLNRF

SEQ ID NO: 41031 - protein, 33 aa, Artificial Sequence
  Description of Artificial Sequence: Synthetic polypeptide
DEEEIRTTNPVATEQYGSVSNTNEQIVGGENFE

SEQ ID NO: 41032 - protein, 33 aa, Artificial Sequence
  Description of Artificial Sequence: Synthetic polypeptide
DEEEIRTTNPVATEQYGSVSNTNEQNSGGNDGD

SEQ ID NO: 41033 - protein, 30 aa, Artificial Sequence
  Description of Artificial Sequence: Synthetic polypeptide
DEEEIRTTNPVATEQYGSVQTDEDQETENM

SEQ ID NO: 41034 - protein, 30 aa, Artificial Sequence
  Description of Artificial Sequence: Synthetic polypeptide
DEEEIRTTNPVATEAYGKHSTNEESQRVNM

SEQ ID NO: 41035 - protein, 32 aa, Artificial Sequence
  Description of Artificial Sequence: Synthetic polypeptide
DEEEIRTTNPVATEQYGSVGSTDNTQTEGGGQ

SEQ ID NO: 41036 - protein, 31 aa, Artificial Sequence
  Description of Artificial Sequence: Synthetic polypeptide
DEEEIRTTNPVATEQYGSVQTILETTRVDRF

SEQ ID NO: 41037 - protein, 31 aa, Artificial Sequence
  Description of Artificial Sequence: Synthetic polypeptide
DEEEIACTNPVATEQYGSVATNLQRDAPDNQ

SEQ ID NO: 41038 - protein, 32 aa, Artificial Sequence
  Description of Artificial Sequence: Synthetic polypeptide
DEEEIRTTNPVATEGYGSVVSTDLQIEFGNEQ

SEQ ID NO: 41039 - protein, 34 aa, Artificial Sequence
  Description of Artificial Sequence: Synthetic polypeptide
DEEEIRTTNPVATEAYGSTVPSCTNLPQPTGNRP

SEQ ID NO: 41040 - protein, 32 aa, Artificial Sequence
  Description of Artificial Sequence: Synthetic polypeptide
DEEEIRTTNPVATEQYGCVCSTNDLNQNGSEQ

SEQ ID NO: 41041 - protein, 33 aa, Artificial Sequence
  Description of Artificial Sequence: Synthetic polypeptide
DEEEIRTTNPVATEQYGSVPACSPLSQRTGGNR

SEQ ID NO: 41042 - protein, 32 aa, Artificial Sequence
  Description of Artificial Sequence: Synthetic polypeptide
DEEEIRTTNPVATEGYGSVVNFTNLIRGGGNI

SEQ ID NO: 41043 - protein, 29 aa, Artificial Sequence
  Description of Artificial Sequence: Synthetic peptide
DEEEIACTNPVATEQWGSVAMNLERGNNQ

SEQ ID NO: 41044 - protein, 31 aa, Artificial Sequence
  Description of Artificial Sequence: Synthetic polypeptide
DEEEIRTTNPVATEAYGEVSINMHSQRGGNQ

SEQ ID NO: 41045 - protein, 28 aa, Artificial Sequence
  Description of Artificial Sequence: Synthetic peptide
DEECIATVNPVATEEYGSVSWNLEHGNQ

SEQ ID NO: 41046 - protein, 32 aa, Artificial Sequence
  Description of Artificial Sequence: Synthetic polypeptide
DEEEIRTTNPVATEQYGSVSLTNPGQVELVVR

SEQ ID NO: 41047 - protein, 32 aa, Artificial Sequence
  Description of Artificial Sequence: Synthetic polypeptide
DEEEIRTTNPVATEQYGSVPPPNLQPLEGVRD

SEQ ID NO: 41048 - protein, 31 aa, Artificial Sequence
  Description of Artificial Sequence: Synthetic polypeptide
DEEEIRTTNPVATEQYGCVCSTETQNFGNEQ

SEQ ID NO: 41049 - protein, 31 aa, Artificial Sequence
  Description of Artificial Sequence: Synthetic polypeptide
DEEEIRTTNPVATEGYGCVCSTNHQNGSNQE

SEQ ID NO: 41050 - protein, 30 aa, Artificial Sequence
  Description of Artificial Sequence: Synthetic polypeptide
DEEEIRTTNPVATEQYGSVQTIEQEVDDRF

SEQ ID NO: 41051 - protein, 33 aa, Artificial Sequence
  Description of Artificial Sequence: Synthetic polypeptide
DEEEIRTTNPVATEAYGCIPSTNEELSQRGGNR

SEQ ID NO: 41052 - protein, 33 aa, Artificial Sequence
  Description of Artificial Sequence: Synthetic polypeptide
DEEEIRTTNPVATDQYGSTVSSTANLDKTGNNR

SEQ ID NO: 41053 - protein, 30 aa, Artificial Sequence
  Description of Artificial Sequence: Synthetic polypeptide
DEECIETVNPVATEWYGSVSEDDNLERGNR

SEQ ID NO: 41054 - protein, 30 aa, Artificial Sequence
  Description of Artificial Sequence: Synthetic polypeptide
DEEEIRTTNPVATEQYGSVPPAVLQTGQLV

SEQ ID NO: 41055 - protein, 32 aa, Artificial Sequence
  Description of Artificial Sequence: Synthetic polypeptide
DEEEIRTTNPVATEQWGSVVSCQGNLGTGGNR

SEQ ID NO: 41056 - protein, 33 aa, Artificial Sequence
  Description of Artificial Sequence: Synthetic polypeptide
DEEEIRTTNPVATEPYGISVSTVNLQDGIKERI

SEQ ID NO: 41057 - protein, 36 aa, Artificial Sequence
  Description of Artificial Sequence: Synthetic polypeptide
DEEEIRTTNPVATEQYGCSVSCTNMLSQIRGGNNRD

SEQ ID NO: 41058 - protein, 31 aa, Artificial Sequence
  Description of Artificial Sequence: Synthetic polypeptide
DEEEIATTNPTATEQYGSVPCNDLQHDGNGR

SEQ ID NO: 41059 - protein, 35 aa, Artificial Sequence
  Description of Artificial Sequence: Synthetic polypeptide
DEEEIRTTNPVATEQYGCSVQSTVNLNQGGSNTRT

SEQ ID NO: 41060 - protein, 33 aa, Artificial Sequence
  Description of Artificial Sequence: Synthetic polypeptide
DEEEIRTTNPVATEQYGSVNQTHELGRGMNIRG

SEQ ID NO: 41061 - protein, 36 aa, Artificial Sequence
  Description of Artificial Sequence: Synthetic polypeptide
DEEEIRTTNPVATEQYGCSTVPSYTNALSQRTGNRP

SEQ ID NO: 41062 - protein, 31 aa, Artificial Sequence
  Description of Artificial Sequence: Synthetic polypeptide
DEEEIRTTNPVATECYGKCSTNHSQRVGNNF

SEQ ID NO: 41063 - protein, 32 aa, Artificial Sequence
  Description of Artificial Sequence: Synthetic polypeptide
DEEAIRTTNPVATEQYGSITSTNLEQNSGIRA

SEQ ID NO: 41064 - protein, 33 aa, Artificial Sequence
  Description of Artificial Sequence: Synthetic polypeptide
DEEEIRTTNPVATEQYGCSCSTNELQGFGSNQS

SEQ ID NO: 41065 - protein, 32 aa, Artificial Sequence
  Description of Artificial Sequence: Synthetic polypeptide
DEEEIRTTNPVATEQYGCSCSTGNPHQRISNQ

SEQ ID NO: 41066 - protein, 33 aa, Artificial Sequence
  Description of Artificial Sequence: Synthetic polypeptide
DEEEIRTTNPVATEQYGCSCSMTENLNQSIGNQ

SEQ ID NO: 41067 - protein, 32 aa, Artificial Sequence
  Description of Artificial Sequence: Synthetic polypeptide
DEEEIRTTNPVATEQYGSVITNLVQQAQEERP

SEQ ID NO: 41068 - protein, 32 aa, Artificial Sequence
  Description of Artificial Sequence: Synthetic polypeptide
DEEEIRTTNPVATEQYGSVNSATTDDRNGDDR

SEQ ID NO: 41069 - protein, 29 aa, Artificial Sequence
  Description of Artificial Sequence: Synthetic peptide
DEEEIRTTNPVATECYGIVSTVPQSREDL

SEQ ID NO: 41070 - protein, 32 aa, Artificial Sequence
  Description of Artificial Sequence: Synthetic polypeptide
DEEEIRTTNPVATEQYGCQVSTNHQNFGSERA

SEQ ID NO: 41071 - protein, 32 aa, Artificial Sequence
  Description of Artificial Sequence: Synthetic polypeptide
DEEEIRTTNPVATEQYGCQVSTGNLQNFGSDQ

SEQ ID NO: 41072 - protein, 32 aa, Artificial Sequence
  Description of Artificial Sequence: Synthetic polypeptide
DEEEIRTTNPVATEQYGCQVSTEDLQNFGSER

SEQ ID NO: 41073 - protein, 32 aa, Artificial Sequence
  Description of Artificial Sequence: Synthetic polypeptide
DEEEIRTTNPVATEQYGSVITNMIQHMGNPEL

SEQ ID NO: 41074 - protein, 33 aa, Artificial Sequence
  Description of Artificial Sequence: Synthetic polypeptide
DEEEIRTTNPVATEQYGSVSMTSDLQPEGENVD

SEQ ID NO: 41075 - protein, 31 aa, Artificial Sequence
  Description of Artificial Sequence: Synthetic polypeptide
DEEEIRTTNPVATEQYGSVNNTTNLNGNGTA

SEQ ID NO: 41076 - protein, 29 aa, Artificial Sequence
  Description of Artificial Sequence: Synthetic peptide
DEEEIATTNPVATEQWGSVAMNLEQGNQE

SEQ ID NO: 41077 - protein, 32 aa, Artificial Sequence
  Description of Artificial Sequence: Synthetic polypeptide
DEEEIRTTNPVATEQYGCIVSTNLQSFGSEQN

SEQ ID NO: 41078 - protein, 32 aa, Artificial Sequence
  Description of Artificial Sequence: Synthetic polypeptide
DEEEIRTTNPVATEQYGSVITNMIQRMGIAEQ

SEQ ID NO: 41079 - protein, 33 aa, Artificial Sequence
  Description of Artificial Sequence: Synthetic polypeptide
DEEEIRTTNPVATEQYGSVITNMIQRMGINPEY

SEQ ID NO: 41080 - protein, 32 aa, Artificial Sequence
  Description of Artificial Sequence: Synthetic polypeptide
DEEEIRTTNPVATEQYGSVITNMIQRMGVGED

SEQ ID NO: 41081 - protein, 33 aa, Artificial Sequence
  Description of Artificial Sequence: Synthetic polypeptide
DEEEIRTTNPVATEQYGSVNNTTNLQYGNNDTQ

SEQ ID NO: 41082 - protein, 31 aa, Artificial Sequence
  Description of Artificial Sequence: Synthetic polypeptide
DEEEIRTTNPVATEQYGSVQPTLLQRSMEFN

SEQ ID NO: 41083 - protein, 32 aa, Artificial Sequence
  Description of Artificial Sequence: Synthetic polypeptide
DEEEIRTTNPVATEQYGSVQPTNELQPQGEVA

SEQ ID NO: 41084 - protein, 33 aa, Artificial Sequence
  Description of Artificial Sequence: Synthetic polypeptide
DEEEIRTTNPVATEQWGSVPSQGNLSQTGGNDR

SEQ ID NO: 41085 - protein, 31 aa, Artificial Sequence
  Description of Artificial Sequence: Synthetic polypeptide
DEEEIRTTNPVATEQYGCVAATNLERDGTEN

SEQ ID NO: 41086 - protein, 32 aa, Artificial Sequence
  Description of Artificial Sequence: Synthetic polypeptide
DEEEIRTTNPVATEQWGSVAVQGNLSQTGGNR

SEQ ID NO: 41087 - protein, 31 aa, Artificial Sequence
  Description of Artificial Sequence: Synthetic polypeptide
DEEEIRTTNPVATEQYGCVAATNLERDGPDG

SEQ ID NO: 41088 - protein, 34 aa, Artificial Sequence
  Description of Artificial Sequence: Synthetic polypeptide
DEEEIRTTNPVATEQYGSVNSDTGNLGQNEGTND

SEQ ID NO: 41089 - protein, 32 aa, Artificial Sequence
  Description of Artificial Sequence: Synthetic polypeptide
DEEEIRTTNPVATECYGKVISCTNESQRPGNF

SEQ ID NO: 41090 - protein, 33 aa, Artificial Sequence
  Description of Artificial Sequence: Synthetic polypeptide
DEEEIRTTNPVATEQYGSVNSDGTNLQNDENGD

SEQ ID NO: 41091 - protein, 31 aa, Artificial Sequence
  Description of Artificial Sequence: Synthetic polypeptide
DEEEIRTTNPVATEQYGSVSNNLQSTEMQLI

SEQ ID NO: 41092 - protein, 31 aa, Artificial Sequence
  Description of Artificial Sequence: Synthetic polypeptide
DEEEIRTTNPVATEQWGSVFCTNGSQRGGSF

SEQ ID NO: 41093 - protein, 31 aa, Artificial Sequence
  Description of Artificial Sequence: Synthetic polypeptide
DEEEIRTTNPVATEQYGCVAANLQTREPNDE

SEQ ID NO: 41094 - protein, 32 aa, Artificial Sequence
  Description of Artificial Sequence: Synthetic polypeptide
DEEEIRTTNPVATEQYGCVAAMTNLARGMGDR

SEQ ID NO: 41095 - protein, 31 aa, Artificial Sequence
  Description of Artificial Sequence: Synthetic polypeptide
DEECEIATTNPVAYEQWGSVSTNLQGDGDDR

SEQ ID NO: 41096 - protein, 31 aa, Artificial Sequence
  Description of Artificial Sequence: Synthetic polypeptide
DEEEIRTTNPVATEQYGSVQPTNLPPENVLI

SEQ ID NO: 41097 - protein, 32 aa, Artificial Sequence
  Description of Artificial Sequence: Synthetic polypeptide
DEEEIRTTNPVATEQYGSVQPTNLINGELTRY

SEQ ID NO: 41098 - protein, 31 aa, Artificial Sequence
  Description of Artificial Sequence: Synthetic polypeptide
DEEEIRTTNPVATEQYGSVPTDWMQEREDQR

SEQ ID NO: 41099 - protein, 33 aa, Artificial Sequence
  Description of Artificial Sequence: Synthetic polypeptide
DEEEIRTTNPVATEQYGSVNSDGNLDQEGGNED

SEQ ID NO: 41100 - protein, 33 aa, Artificial Sequence
  Description of Artificial Sequence: Synthetic polypeptide
DEEEIRTTNPVATEQYGCTSMTENLSQRIGGRE

SEQ ID NO: 41101 - protein, 33 aa, Artificial Sequence
  Description of Artificial Sequence: Synthetic polypeptide
DEEEIRTTNPVATEQYGCTPSTGELSQRTGGNR

SEQ ID NO: 41102 - protein, 33 aa, Artificial Sequence
  Description of Artificial Sequence: Synthetic polypeptide
DEEEIACTNPVATEQYGSVAATNLQREGPNERV

SEQ ID NO: 41103 - protein, 32 aa, Artificial Sequence
  Description of Artificial Sequence: Synthetic polypeptide
DEEEIRTTNPVATEQWGSVFTAALQTRGTNET

SEQ ID NO: 41104 - protein, 33 aa, Artificial Sequence
  Description of Artificial Sequence: Synthetic polypeptide
DEEEIATTNPVATEQWGSVPCCTNALSQRGNQR

SEQ ID NO: 41105 - protein, 31 aa, Artificial Sequence
  Description of Artificial Sequence: Synthetic polypeptide
DEEEIRTTNPVATEQYGCTCSWGELQRFGNQ

SEQ ID NO: 41106 - protein, 31 aa, Artificial Sequence
  Description of Artificial Sequence: Synthetic polypeptide
DEEEIRTTNPVATECYGKISTNEESQRVGNL

SEQ ID NO: 41107 - protein, 33 aa, Artificial Sequence
  Description of Artificial Sequence: Synthetic polypeptide
DEEEIRTTNPVATEQYGSVNSCTENGGQRFGTF

SEQ ID NO: 41108 - protein, 33 aa, Artificial Sequence
  Description of Artificial Sequence: Synthetic polypeptide
DEEEIRTTNPVATEQYGSVPTEYNLQERIIVER

SEQ ID NO: 41109 - protein, 32 aa, Artificial Sequence
  Description of Artificial Sequence: Synthetic polypeptide
DEEEIATTNPVATEQWGSVCCTNLSTRGTNNR

SEQ ID NO: 41110 - protein, 31 aa, Artificial Sequence
  Description of Artificial Sequence: Synthetic polypeptide
DEEEIRTTNPVATEQYGSVSMVDQRGGQDHP

SEQ ID NO: 41111 - protein, 28 aa, Artificial Sequence
  Description of Artificial Sequence: Synthetic peptide
DEEEIRTTNPVATECYGMTDTNEQADNF

SEQ ID NO: 41112 - protein, 29 aa, Artificial Sequence
  Description of Artificial Sequence: Synthetic peptide
DEEEIATTNPVATEQWGSVAENLTQGNEQ

SEQ ID NO: 41113 - protein, 29 aa, Artificial Sequence
  Description of Artificial Sequence: Synthetic peptide
DEEEIRTTNPVATEQYGSVSMVVDLGEHD

SEQ ID NO: 41114 - protein, 32 aa, Artificial Sequence
  Description of Artificial Sequence: Synthetic polypeptide
DEEEIRTTNPVATEQYGSVNNTNDQVRDNEQG

SEQ ID NO: 41115 - protein, 31 aa, Artificial Sequence
  Description of Artificial Sequence: Synthetic polypeptide
DEEEIRTTNPVATEQYGCCVSTELQHFGSEQ

SEQ ID NO: 41116 - protein, 30 aa, Artificial Sequence
  Description of Artificial Sequence: Synthetic polypeptide
DEEEIATTNPVATDQYGSVSTNNPPERGQA

SEQ ID NO: 41117 - protein, 31 aa, Artificial Sequence
  Description of Artificial Sequence: Synthetic polypeptide
DEEEIATTNPVATEAWGSVCCTNLSQSGNQR

SEQ ID NO: 41118 - protein, 32 aa, Artificial Sequence
  Description of Artificial Sequence: Synthetic polypeptide
DEEEIATTNPVATEAYGCVSTNALSQPGENRM

SEQ ID NO: 41119 - protein, 31 aa, Artificial Sequence
  Description of Artificial Sequence: Synthetic polypeptide
DEEEIRTTNPVATEQYGSVNNTNDNLNENNN

SEQ ID NO: 41120 - protein, 31 aa, Artificial Sequence
  Description of Artificial Sequence: Synthetic polypeptide
DEEEIRTTNPVATEQYGSVSNDDTLEQMGDS

SEQ ID NO: 41121 - protein, 32 aa, Artificial Sequence
  Description of Artificial Sequence: Synthetic polypeptide
DEEEIRTTNPVATEQYGSVNNTNDERGEEERI

SEQ ID NO: 41122 - protein, 31 aa, Artificial Sequence
  Description of Artificial Sequence: Synthetic polypeptide
DEEEIRTTNPVATEQYGSVSNNLQPVPEVDF

SEQ ID NO: 41123 - protein, 32 aa, Artificial Sequence
  Description of Artificial Sequence: Synthetic polypeptide
DEEEIRTTNPVATEQYGSVSNDNLDQNEGEGN

SEQ ID NO: 41124 - protein, 33 aa, Artificial Sequence
  Description of Artificial Sequence: Synthetic polypeptide
DEEEIRTTNPVATEQYGSVSNDNLDQNEGGNGQ

SEQ ID NO: 41125 - protein, 32 aa, Artificial Sequence
  Description of Artificial Sequence: Synthetic polypeptide
DEEEIRTTNPVATEQYGCCVSTNPQRFGSEQS

SEQ ID NO: 41126 - protein, 33 aa, Artificial Sequence
  Description of Artificial Sequence: Synthetic polypeptide
DEEEIRTTNPVATEQYGSVSNDNLFQEEGGNNS

SEQ ID NO: 41127 - protein, 33 aa, Artificial Sequence
  Description of Artificial Sequence: Synthetic polypeptide
DEEEIRTTNPVATEQYGSVIVETESGLDQRGER

SEQ ID NO: 41128 - protein, 31 aa, Artificial Sequence
  Description of Artificial Sequence: Synthetic polypeptide
DEEEIRTTNPVATEQYGSVSNNLQINFPESM

SEQ ID NO: 41129 - protein, 33 aa, Artificial Sequence
  Description of Artificial Sequence: Synthetic polypeptide
DEEEIRTTNPVATEQYGCAVCSTTNHQRFGSDR

SEQ ID NO: 41130 - protein, 33 aa, Artificial Sequence
  Description of Artificial Sequence: Synthetic polypeptide
DEEEIRTTNPVATEQYGSVNNTNDDQRGNIEVE

SEQ ID NO: 41131 - protein, 33 aa, Artificial Sequence
  Description of Artificial Sequence: Synthetic polypeptide
DEEEIRTTNPVATEQYGCAVCSTNLQRFGSEVA

SEQ ID NO: 41132 - protein, 34 aa, Artificial Sequence
  Description of Artificial Sequence: Synthetic polypeptide
DEEEIRTTNPVATEQYGCAVCSTNLQRFGSENQS

SEQ ID NO: 41133 - protein, 32 aa, Artificial Sequence
  Description of Artificial Sequence: Synthetic polypeptide
DEEEIRTTNPVATEQYGSVIVTDLLEQQGNVE

SEQ ID NO: 41134 - protein, 31 aa, Artificial Sequence
  Description of Artificial Sequence: Synthetic polypeptide
DEEEIRTTNPVATEQYGSVQNTFNLDGGGQT

SEQ ID NO: 41135 - protein, 31 aa, Artificial Sequence
  Description of Artificial Sequence: Synthetic polypeptide
DEEEIRTTNPVATEQYGSVSNDNLQPTEVDQ

SEQ ID NO: 41136 - protein, 32 aa, Artificial Sequence
  Description of Artificial Sequence: Synthetic polypeptide
DEEEIRTTNPVATEQYGSVQNTFNELDGGGTR

SEQ ID NO: 41137 - protein, 32 aa, Artificial Sequence
  Description of Artificial Sequence: Synthetic polypeptide
DEEEIRTTNPVATEQYGCAVCSDTEHQRGSNQ

SEQ ID NO: 41138 - protein, 31 aa, Artificial Sequence
  Description of Artificial Sequence: Synthetic polypeptide
DEEEIRTTNPVATEQYGSVIVDMQLRGNEDQ

SEQ ID NO: 41139 - protein, 31 aa, Artificial Sequence
  Description of Artificial Sequence: Synthetic polypeptide
DEEEIRTTNPVATEQYGSVITTLQQTGPELY

SEQ ID NO: 41140 - protein, 32 aa, Artificial Sequence
  Description of Artificial Sequence: Synthetic polypeptide
DEEEIRTTNPVATEQYGSVNNTNEDQRENDDS

SEQ ID NO: 41141 - protein, 32 aa, Artificial Sequence
  Description of Artificial Sequence: Synthetic polypeptide
DEEEIRTTNPVATEQYGSVQNTPGLQRVLEND

SEQ ID NO: 41142 - protein, 32 aa, Artificial Sequence
  Description of Artificial Sequence: Synthetic polypeptide
DEEEIRTTNPVATEQYGSVPTNGVQLRIGPQQ

SEQ ID NO: 41143 - protein, 31 aa, Artificial Sequence
  Description of Artificial Sequence: Synthetic polypeptide
DEEEIATTNPVATEQWGSVAATNLQDRDNTV

SEQ ID NO: 41144 - protein, 32 aa, Artificial Sequence
  Description of Artificial Sequence: Synthetic polypeptide
DEEEIRTTNPVATEQYGSVSNAENLEPDGNDQ

SEQ ID NO: 41145 - protein, 30 aa, Artificial Sequence
  Description of Artificial Sequence: Synthetic polypeptide
DEEEIATTNPVATEQWGSVAAPNLDEGENR

SEQ ID NO: 41146 - protein, 32 aa, Artificial Sequence
  Description of Artificial Sequence: Synthetic polypeptide
DEEEIRTTNPVATEQYGSVSNNLQQTQGVPIA

SEQ ID NO: 41147 - protein, 31 aa, Artificial Sequence
  Description of Artificial Sequence: Synthetic polypeptide
DEEEIRTTNPVATEQWGSVQTLHQEWGSNRQ

SEQ ID NO: 41148 - protein, 32 aa, Artificial Sequence
  Description of Artificial Sequence: Synthetic polypeptide
DEEEIRTTNPVATEQYGCIVSTNHQERFGSEQ

SEQ ID NO: 41149 - protein, 32 aa, Artificial Sequence
  Description of Artificial Sequence: Synthetic polypeptide
DEEEIRTTNPVATEQYGCIVSTGPLQSPNMRY

SEQ ID NO: 41150 - protein, 32 aa, Artificial Sequence
  Description of Artificial Sequence: Synthetic polypeptide
DEEEIRTTNPVATEQYGSVSNNLQQEGQVDEE

SEQ ID NO: 41151 - protein, 33 aa, Artificial Sequence
  Description of Artificial Sequence: Synthetic polypeptide
DEEEIRTTNPVATEQYGSVITPTNPLQRGQMIQ

SEQ ID NO: 41152 - protein, 32 aa, Artificial Sequence
  Description of Artificial Sequence: Synthetic polypeptide
DEEEIRTTNPVATEQWGSVSCINEPQDREGNG

SEQ ID NO: 41153 - protein, 33 aa, Artificial Sequence
  Description of Artificial Sequence: Synthetic polypeptide
DEEEIRTTNPVATEQYGSVSNCNLQRENEENEI

SEQ ID NO: 41154 - protein, 31 aa, Artificial Sequence
  Description of Artificial Sequence: Synthetic polypeptide
DEEEIRTTNPVATEQYGSVITSGQRGQTFEM

SEQ ID NO: 41155 - protein, 32 aa, Artificial Sequence
  Description of Artificial Sequence: Synthetic polypeptide
DEEEIRTTNPVATEQYGSVNNTNLENGSGDER

SEQ ID NO: 41156 - protein, 30 aa, Artificial Sequence
  Description of Artificial Sequence: Synthetic polypeptide
DEEEIRTTNPVATECYGCISTNEQRFSSNQ

SEQ ID NO: 41157 - protein, 32 aa, Artificial Sequence
  Description of Artificial Sequence: Synthetic polypeptide
DEEEIRTTNPVATEQYGCIVSQIDLQRHENRQ

SEQ ID NO: 41158 - protein, 32 aa, Artificial Sequence
  Description of Artificial Sequence: Synthetic polypeptide
DEEEIRTTNPVATEQYGSVITSMIQRMGNPED

SEQ ID NO: 41159 - protein, 32 aa, Artificial Sequence
  Description of Artificial Sequence: Synthetic polypeptide
DEEEIRTTNPVATEQYGCIVCSTNLQNFGSEL

SEQ ID NO: 41160 - protein, 32 aa, Artificial Sequence
  Description of Artificial Sequence: Synthetic polypeptide
DEEEIRTTNPVATEQYGCIVCSTNHQSFGSER

SEQ ID NO: 41161 - protein, 30 aa, Artificial Sequence
  Description of Artificial Sequence: Synthetic polypeptide
DEEEIRTTNPVATEQYGCISTEHQGFGSDR

SEQ ID NO: 41162 - protein, 32 aa, Artificial Sequence
  Description of Artificial Sequence: Synthetic polypeptide
DEEEIRTTNPVATEQWGSVSCNEPQDREGENG

SEQ ID NO: 41163 - protein, 32 aa, Artificial Sequence
  Description of Artificial Sequence: Synthetic polypeptide
DEEEIRTTNPVATEQYGSVITSNDDEGQGGNI

SEQ ID NO: 41164 - protein, 34 aa, Artificial Sequence
  Description of Artificial Sequence: Synthetic polypeptide
DEEEIRTTNPVATEQYGSVNNTNILQNREGDGND

SEQ ID NO: 41165 - protein, 33 aa, Artificial Sequence
  Description of Artificial Sequence: Synthetic polypeptide
DEEEIRTTNPVATEQWGSVSCQGNLSQTGGNRR

SEQ ID NO: 41166 - protein, 31 aa, Artificial Sequence
  Description of Artificial Sequence: Synthetic polypeptide
DEEEIRTTNPVATEQYGCICSWPNDLQRDNQ

SEQ ID NO: 41167 - protein, 33 aa, Artificial Sequence
  Description of Artificial Sequence: Synthetic polypeptide
DEEEIRTTNPVATEQYGSVNNTNLQVREGDGEG

SEQ ID NO: 41168 - protein, 32 aa, Artificial Sequence
  Description of Artificial Sequence: Synthetic polypeptide
DEEEIRTTNPVATEQYGSVSNDNMQGEGGNEG

SEQ ID NO: 41169 - protein, 30 aa, Artificial Sequence
  Description of Artificial Sequence: Synthetic polypeptide
DEEEIRTTNPVATECYGMTVSTNGQERNQF

SEQ ID NO: 41170 - protein, 32 aa, Artificial Sequence
  Description of Artificial Sequence: Synthetic polypeptide
DEEEIRTTNPVATEQYGCVADTWLAQRSENDR

SEQ ID NO: 41171 - protein, 30 aa, Artificial Sequence
  Description of Artificial Sequence: Synthetic polypeptide
DEEEIATTNPVATEQWGSVSTDNDNQGGDQ

SEQ ID NO: 41172 - protein, 33 aa, Artificial Sequence
  Description of Artificial Sequence: Synthetic polypeptide
DEEEIRTTNPVATEQYGSVNSGNNLQEGGENIG

SEQ ID NO: 41173 - protein, 33 aa, Artificial Sequence
  Description of Artificial Sequence: Synthetic polypeptide
DEEEIRTTNPVATEQYGCVCSMTGNLQFFGSNV

SEQ ID NO: 41174 - protein, 33 aa, Artificial Sequence
  Description of Artificial Sequence: Synthetic polypeptide
DEEEIRTTNPVATEQYGCVCSMTGNHQFGSNRA

SEQ ID NO: 41175 - protein, 31 aa, Artificial Sequence
  Description of Artificial Sequence: Synthetic polypeptide
DEEEIATTNPVATEQWGSVSQGNQSQTGGNR

SEQ ID NO: 41176 - protein, 33 aa, Artificial Sequence
  Description of Artificial Sequence: Synthetic polypeptide
DEEEIRTTNPVATEQYGCVCSLTGNHQRFGSDR

SEQ ID NO: 41177 - protein, 34 aa, Artificial Sequence
  Description of Artificial Sequence: Synthetic polypeptide
DEEEIRTTNPVATEQWGSTVSCTNALSDRGNNRE

SEQ ID NO: 41178 - protein, 33 aa, Artificial Sequence
  Description of Artificial Sequence: Synthetic polypeptide
DEEEIRTTNPVATEQYGSVNSGNLQSGEGNNAT

SEQ ID NO: 41179 - protein, 33 aa, Artificial Sequence
  Description of Artificial Sequence: Synthetic polypeptide
DEEEIRTTNPVATEQYGCVCSDTNLQEYGSNQY

SEQ ID NO: 41180 - protein, 32 aa, Artificial Sequence
  Description of Artificial Sequence: Synthetic polypeptide
DEEEIRTTNPVATEQYGSVSMTDDLQGGEVQG

SEQ ID NO: 41181 - protein, 33 aa, Artificial Sequence
  Description of Artificial Sequence: Synthetic polypeptide
DEEEIRTTNPVATEQYGCVCSDTNHQRFGSNDY

SEQ ID NO: 41182 - protein, 33 aa, Artificial Sequence
  Description of Artificial Sequence: Synthetic polypeptide
DEEEIRTTNPVATEQYGCVCSMTPNLQYGSERS

SEQ ID NO: 41183 - protein, 33 aa, Artificial Sequence
  Description of Artificial Sequence: Synthetic polypeptide
DEEEIRTTNPVATEQYGCVCSDTENHQRIGSNQ

SEQ ID NO: 41184 - protein, 32 aa, Artificial Sequence
  Description of Artificial Sequence: Synthetic polypeptide
DEEEIRTTNPVATEQYGCVCSDTELDQRSQNA

SEQ ID NO: 41185 - protein, 31 aa, Artificial Sequence
  Description of Artificial Sequence: Synthetic polypeptide
DEEEIRTTNPVATEQYGCVCSCTNHNQYGQQ

SEQ ID NO: 41186 - protein, 32 aa, Artificial Sequence
  Description of Artificial Sequence: Synthetic polypeptide
DEEEIRTTNPVATEQYGCVCSANLQNFGSNAN

SEQ ID NO: 41187 - protein, 31 aa, Artificial Sequence
  Description of Artificial Sequence: Synthetic polypeptide
DEEEIRTTNPVATEQYGCVCQTELQRGSEAA

SEQ ID NO: 41188 - protein, 31 aa, Artificial Sequence
  Description of Artificial Sequence: Synthetic polypeptide
DEEEIRTTNPVATEQYGCVCPTNHQGISNRS

SEQ ID NO: 41189 - protein, 31 aa, Artificial Sequence
  Description of Artificial Sequence: Synthetic polypeptide
DEEEIRTTNPVATEQYGCVCNTGNLIENGER

SEQ ID NO: 41190 - protein, 33 aa, Artificial Sequence
  Description of Artificial Sequence: Synthetic polypeptide
DEEEIRTTNPVATEQWGSTVSCTNALSQRTENI

SEQ ID NO: 41191 - protein, 32 aa, Artificial Sequence
  Description of Artificial Sequence: Synthetic polypeptide
DEEEIRTTNPVATEQYGCVCITNNLGQRGADM

SEQ ID NO: 41192 - protein, 31 aa, Artificial Sequence
  Description of Artificial Sequence: Synthetic polypeptide
DEEEIRTTNPVATEQYGCVCGTNLQNGSDDA

SEQ ID NO: 41193 - protein, 33 aa, Artificial Sequence
  Description of Artificial Sequence: Synthetic polypeptide
DEEEIRTTNPVATEQYGSVISTVLQGTGINEET

SEQ ID NO: 41194 - protein, 32 aa, Artificial Sequence
  Description of Artificial Sequence: Synthetic polypeptide
DEEEIRTTNPVATEAYGTVVSTVNLQDAIDNR

SEQ ID NO: 41195 - protein, 33 aa, Artificial Sequence
  Description of Artificial Sequence: Synthetic polypeptide
DEEEIRTTNPVATEQYGSVNSGNLQGPGNNNEG

SEQ ID NO: 41196 - protein, 32 aa, Artificial Sequence
  Description of Artificial Sequence: Synthetic polypeptide
DEEEIRTTNPVATEQYGSVSNNPQTRVSNQDD

SEQ ID NO: 41197 - protein, 30 aa, Artificial Sequence
  Description of Artificial Sequence: Synthetic polypeptide
DEEEIRTTNPVATEAYGTVTSTNEQANTNF

SEQ ID NO: 41198 - protein, 32 aa, Artificial Sequence
  Description of Artificial Sequence: Synthetic polypeptide
DEEEIRTTNPVATEQYGCVCSMWGELQFGSNR

SEQ ID NO: 41199 - protein, 32 aa, Artificial Sequence
  Description of Artificial Sequence: Synthetic polypeptide
DEEEIRTTNPVATEQWGSSYSLPNDLQRDTNR

SEQ ID NO: 41200 - protein, 32 aa, Artificial Sequence
  Description of Artificial Sequence: Synthetic polypeptide
DEEEIRTTNPVATEQYGCVCSNTELQSGSQRE

SEQ ID NO: 41201 - protein, 31 aa, Artificial Sequence
  Description of Artificial Sequence: Synthetic polypeptide
DEEEIRTTNPVATEQWGSSYSLPNMEQRDNR

SEQ ID NO: 41202 - protein, 32 aa, Artificial Sequence
  Description of Artificial Sequence: Synthetic polypeptide
DEEEIRTTNPVATEQYGSVSNNTTNLGGNGTE

SEQ ID NO: 41203 - protein, 32 aa, Artificial Sequence
  Description of Artificial Sequence: Synthetic polypeptide
DEEEIRTTNPVATEQYGCVCSNTELQRGSDII

SEQ ID NO: 41204 - protein, 29 aa, Artificial Sequence
  Description of Artificial Sequence: Synthetic peptide
DEEAIRTTNPVATEQYGCVSTECMQFMNE

SEQ ID NO: 41205 - protein, 32 aa, Artificial Sequence
  Description of Artificial Sequence: Synthetic polypeptide
DEEEIRTTNPVATEQYGCVCSNTELQHFNNRQ

SEQ ID NO: 41206 - protein, 33 aa, Artificial Sequence
  Description of Artificial Sequence: Synthetic polypeptide
DEEEIRTTNPVATEQYGCVCSNTELQERGSDNQ

SEQ ID NO: 41207 - protein, 33 aa, Artificial Sequence
  Description of Artificial Sequence: Synthetic polypeptide
DEEEIRTTNPVATEQYGSVISTPVLAPRGINDQ

SEQ ID NO: 41208 - protein, 32 aa, Artificial Sequence
  Description of Artificial Sequence: Synthetic polypeptide
DEEEIRTTNPVATEQYGCVCSNTEHQRGSNQS

SEQ ID NO: 41209 - protein, 35 aa, Artificial Sequence
  Description of Artificial Sequence: Synthetic polypeptide
DEEEIRTTNPVATEQYGSVISTQDSLVQERGENRQ

SEQ ID NO: 41210 - protein, 32 aa, Artificial Sequence
  Description of Artificial Sequence: Synthetic polypeptide
DEEEIRTTNPVATEQYGCVCSNTEDLQSGSDR

SEQ ID NO: 41211 - protein, 30 aa, Artificial Sequence
  Description of Artificial Sequence: Synthetic polypeptide
DEEEIRTTNPVATEQYGSVSMPNMDNVGVQ

SEQ ID NO: 41212 - protein, 33 aa, Artificial Sequence
  Description of Artificial Sequence: Synthetic polypeptide
DEEEIRTTNPVATEQYGCVCSNTEDLQFGSNRS

SEQ ID NO: 41213 - protein, 33 aa, Artificial Sequence
  Description of Artificial Sequence: Synthetic polypeptide
DEEEIRTTNPVATEQWGSTTPSCTNLSQRTENR

SEQ ID NO: 41214 - protein, 33 aa, Artificial Sequence
  Description of Artificial Sequence: Synthetic polypeptide
DEEEIRTTNPVATEQYGCVCSNTEAHQRGSNRS

SEQ ID NO: 41215 - protein, 32 aa, Artificial Sequence
  Description of Artificial Sequence: Synthetic polypeptide
DEEEIRTTNPVATEQYGCVCSNTALQSGSNAA

SEQ ID NO: 41216 - protein, 31 aa, Artificial Sequence
  Description of Artificial Sequence: Synthetic polypeptide
DEEEIRTTNPVATEQYGSVNSGTMLADGVVI

SEQ ID NO: 41217 - protein, 34 aa, Artificial Sequence
  Description of Artificial Sequence: Synthetic polypeptide
DEEEIRTTNPVATEQYGSVNSGTDNLQEEGGNNS

SEQ ID NO: 41218 - protein, 31 aa, Artificial Sequence
  Description of Artificial Sequence: Synthetic polypeptide
DEEEIRTTNPVATEQYGCVCSNSNTQNGSNA

SEQ ID NO: 41219 - protein, 32 aa, Artificial Sequence
  Description of Artificial Sequence: Synthetic polypeptide
DEEEIRTTNPVATEQYGSVSMSGTGGQRGPQF

SEQ ID NO: 41220 - protein, 32 aa, Artificial Sequence
  Description of Artificial Sequence: Synthetic polypeptide
DEEEIRTTNPVATEQYGCVCSNSELQRGSERF

SEQ ID NO: 41221 - protein, 32 aa, Artificial Sequence
  Description of Artificial Sequence: Synthetic polypeptide
DEEEIRTTNPVATEQYGSVSNNQNIGQSGNNV

SEQ ID NO: 41222 - protein, 33 aa, Artificial Sequence
  Description of Artificial Sequence: Synthetic polypeptide
DEEEIRTTNPVATEQYGSVNSGNNLQSGEGGNG

SEQ ID NO: 41223 - protein, 32 aa, Artificial Sequence
  Description of Artificial Sequence: Synthetic polypeptide
DEEEIRTTNPVATEQWGSTVPWTALSQMVGNR

SEQ ID NO: 41224 - protein, 33 aa, Artificial Sequence
  Description of Artificial Sequence: Synthetic polypeptide
DEEEIRTTNPVATEQYGSVISTVLQQNGINGEN

SEQ ID NO: 41225 - protein, 31 aa, Artificial Sequence
  Description of Artificial Sequence: Synthetic polypeptide
DEEEIRTTNPVATEQYGCVAATNPARGNDQL

SEQ ID NO: 41226 - protein, 32 aa, Artificial Sequence
  Description of Artificial Sequence: Synthetic polypeptide
DEEEIRTTNPVATEQYGCVAWTNLNRDGMNEH

SEQ ID NO: 41227 - protein, 34 aa, Artificial Sequence
  Description of Artificial Sequence: Synthetic polypeptide
DEEEIRTTNPVATEQYGSVISTYLEQNRGVSERE

SEQ ID NO: 41228 - protein, 29 aa, Artificial Sequence
  Description of Artificial Sequence: Synthetic peptide
DEEEIACTNPVATEQYGSVANNNQEAGNE

SEQ ID NO: 41229 - protein, 30 aa, Artificial Sequence
  Description of Artificial Sequence: Synthetic polypeptide
DEEEIRTTNPVATEQYGCVATNLEIEPDNV

SEQ ID NO: 41230 - protein, 31 aa, Artificial Sequence
  Description of Artificial Sequence: Synthetic polypeptide
DEEEIRTTNPVATEQYGSVPSVTGLNDGEES

SEQ ID NO: 41231 - protein, 31 aa, Artificial Sequence
  Description of Artificial Sequence: Synthetic polypeptide
DEEEIRTTNPVATEQYGSVQPTTLQQMGTLY

SEQ ID NO: 41232 - protein, 31 aa, Artificial Sequence
  Description of Artificial Sequence: Synthetic polypeptide
DEEEIRTTNPVATECYGSVCSGELLEQRNNP

SEQ ID NO: 41233 - protein, 31 aa, Artificial Sequence
  Description of Artificial Sequence: Synthetic polypeptide
DEEEIRTTNPVATECYGSVATGSLDDGMGNR

SEQ ID NO: 41234 - protein, 32 aa, Artificial Sequence
  Description of Artificial Sequence: Synthetic polypeptide
DEEEIRTTNPVATEQYGSVITGNMQGNAGNDG

SEQ ID NO: 41235 - protein, 30 aa, Artificial Sequence
  Description of Artificial Sequence: Synthetic polypeptide
DEEEIRTTNPVATEQYGSVITNDEMDEERG

SEQ ID NO: 41236 - protein, 30 aa, Artificial Sequence
  Description of Artificial Sequence: Synthetic polypeptide
DEEEIRTTNPVATEQYGSVITNDNIPIHNV

SEQ ID NO: 41237 - protein, 31 aa, Artificial Sequence
  Description of Artificial Sequence: Synthetic polypeptide
DEEEIRTTNPVATEQYGSVITNDVQQYNNVQ

SEQ ID NO: 41238 - protein, 28 aa, Artificial Sequence
  Description of Artificial Sequence: Synthetic peptide
DEECIACTNPVATEQYGSVANNDQRMNL

SEQ ID NO: 41239 - protein, 32 aa, Artificial Sequence
  Description of Artificial Sequence: Synthetic polypeptide
DEEEIATTNPMATEQYGSVPTVLQIRQGVNGR

SEQ ID NO: 41240 - protein, 32 aa, Artificial Sequence
  Description of Artificial Sequence: Synthetic polypeptide
DEEEIRTTNPVATEQYGSVITNEQLENNEERQ

SEQ ID NO: 41241 - protein, 32 aa, Artificial Sequence
  Description of Artificial Sequence: Synthetic polypeptide
DEEEIRTTNPVATEQYGCVAMTNLNREGMGDR

SEQ ID NO: 41242 - protein, 34 aa, Artificial Sequence
  Description of Artificial Sequence: Synthetic polypeptide
DEEEIRTTNPVATEQYGSVPSYTNNIQQIQGNIR

SEQ ID NO: 41243 - protein, 32 aa, Artificial Sequence
  Description of Artificial Sequence: Synthetic polypeptide
DEEEIRTTNPVATEQYGCVAMTNLNRDGMNDA

SEQ ID NO: 41244 - protein, 34 aa, Artificial Sequence
  Description of Artificial Sequence: Synthetic polypeptide
DEEEIRTTNPVATEQYGSVNSDTNNLQMNGGNIN

SEQ ID NO: 41245 - protein, 32 aa, Artificial Sequence
  Description of Artificial Sequence: Synthetic polypeptide
DEEEIRTTNPVATEQYGSVITNEQLEVNELRY

SEQ ID NO: 41246 - protein, 29 aa, Artificial Sequence
  Description of Artificial Sequence: Synthetic peptide
DEEEIRTTNPVATECYGQYVTNEQQRINF

SEQ ID NO: 41247 - protein, 32 aa, Artificial Sequence
  Description of Artificial Sequence: Synthetic polypeptide
DEEEIRTTNPVATEQYGSVITNGQERVEVPRF

SEQ ID NO: 41248 - protein, 31 aa, Artificial Sequence
  Description of Artificial Sequence: Synthetic polypeptide
DEEEIRTTNPVATEQYGSVQPTNLQTEDDLI

SEQ ID NO: 41249 - protein, 32 aa, Artificial Sequence
  Description of Artificial Sequence: Synthetic polypeptide
DEEEIRTTNPVATEQYGSVQPTNLQPLGLDTN

SEQ ID NO: 41250 - protein, 34 aa, Artificial Sequence
  Description of Artificial Sequence: Synthetic polypeptide
DEEEIRTTNPVATEQYGSVNSDTNLQNDGPENDD

SEQ ID NO: 41251 - protein, 31 aa, Artificial Sequence
  Description of Artificial Sequence: Synthetic polypeptide
DEEEIRTTNPVATEQYGCVADTWLDGRSENR

SEQ ID NO: 41252 - protein, 29 aa, Artificial Sequence
  Description of Artificial Sequence: Synthetic peptide
DEECIACTNPVATEQYGSVAMNDQRGNEL

SEQ ID NO: 41253 - protein, 31 aa, Artificial Sequence
  Description of Artificial Sequence: Synthetic polypeptide
DEEEIRTTNPVATEQYGSVNSENLGERMEID

SEQ ID NO: 41254 - protein, 30 aa, Artificial Sequence
  Description of Artificial Sequence: Synthetic polypeptide
DEEEIRTTNPVATEQYGCVATNLERDEMED

SEQ ID NO: 41255 - protein, 32 aa, Artificial Sequence
  Description of Artificial Sequence: Synthetic polypeptide
DEEEIRTTNPVATEQYGSVSMTENDSGVRGEQ

SEQ ID NO: 41256 - protein, 32 aa, Artificial Sequence
  Description of Artificial Sequence: Synthetic polypeptide
DEEEIRTTNPVATEQYGSVISTYLQNMEVSER

SEQ ID NO: 41257 - protein, 31 aa, Artificial Sequence
  Description of Artificial Sequence: Synthetic polypeptide
DEEEIRTTNPVATEQYGSVQPVLVDQRGDML

SEQ ID NO: 41258 - protein, 33 aa, Artificial Sequence
  Description of Artificial Sequence: Synthetic polypeptide
DEEEIRTTNPVATEQWGSTVSCTNMSSQRTENR

SEQ ID NO: 41259 - protein, 30 aa, Artificial Sequence
  Description of Artificial Sequence: Synthetic polypeptide
DEEEIRTTNPVATEQYGCVATPNLDNGTES

SEQ ID NO: 41260 - protein, 30 aa, Artificial Sequence
  Description of Artificial Sequence: Synthetic polypeptide
DEEAIRTTNPVATEQYGCVSTNPQEFPENE

SEQ ID NO: 41261 - protein, 30 aa, Artificial Sequence
  Description of Artificial Sequence: Synthetic polypeptide
DEEEIRTTNPVATEQYGCVATNNDRGTPEE

SEQ ID NO: 41262 - protein, 32 aa, Artificial Sequence
  Description of Artificial Sequence: Synthetic polypeptide
DEEEIRTTNPVATECYGSVSATNLQDHEGEDD

SEQ ID NO: 41263 - protein, 33 aa, Artificial Sequence
  Description of Artificial Sequence: Synthetic polypeptide
DEEEIRTTNPVATEQYGSVISVTHDLQGGGEQR

SEQ ID NO: 41264 - protein, 32 aa, Artificial Sequence
  Description of Artificial Sequence: Synthetic polypeptide
DEEEIRTTNPVATEQYGSVSMTDLGENGQNEG

SEQ ID NO: 41265 - protein, 32 aa, Artificial Sequence
  Description of Artificial Sequence: Synthetic polypeptide
DEEEIRTTNPVATEQYGSVITDEDFQGGNEER

SEQ ID NO: 41266 - protein, 30 aa, Artificial Sequence
  Description of Artificial Sequence: Synthetic polypeptide
DEEEIRTTNPVATEQYGSVITDIQRDSSQF

SEQ ID NO: 41267 - protein, 33 aa, Artificial Sequence
  Description of Artificial Sequence: Synthetic polypeptide
DEEEIRTTNPVATEQWGSTVSQGNLSQTGGNRH

SEQ ID NO: 41268 - protein, 31 aa, Artificial Sequence
  Description of Artificial Sequence: Synthetic polypeptide
DEEEIRTTNPVATEQYGSVSMTDMNGEDLER

SEQ ID NO: 41269 - protein, 30 aa, Artificial Sequence
  Description of Artificial Sequence: Synthetic polypeptide
DEEEIRTTNPVATEQYGSVSMTDMNGESRM

SEQ ID NO: 41270 - protein, 30 aa, Artificial Sequence
  Description of Artificial Sequence: Synthetic polypeptide
DEEEIACTNPVATEQYGEASEPNLQRNGGR

SEQ ID NO: 41271 - protein, 31 aa, Artificial Sequence
  Description of Artificial Sequence: Synthetic polypeptide
DEEEIRTTNPVATEQYGSVSMTDMNGIENQR

SEQ ID NO: 41272 - protein, 31 aa, Artificial Sequence
  Description of Artificial Sequence: Synthetic polypeptide
DEEEIRTTNPVATEQYGSVSMTDMNGTENNQ

SEQ ID NO: 41273 - protein, 34 aa, Artificial Sequence
  Description of Artificial Sequence: Synthetic polypeptide
DEEEIRTTNPVATEQYGSVNSGMTNLQNDGVNDD

SEQ ID NO: 41274 - protein, 30 aa, Artificial Sequence
  Description of Artificial Sequence: Synthetic polypeptide
DEECIACTNPVAYEQYYYSVSPNLQRGDNR

SEQ ID NO: 41275 - protein, 30 aa, Artificial Sequence
  Description of Artificial Sequence: Synthetic polypeptide
DEEEIRTTNPVATEQYGCVATNLGERNDPL

SEQ ID NO: 41276 - protein, 31 aa, Artificial Sequence
  Description of Artificial Sequence: Synthetic polypeptide
DEEEIRTTNPVATEQYGSVSMTDMQVRSSQG

SEQ ID NO: 41277 - protein, 30 aa, Artificial Sequence
  Description of Artificial Sequence: Synthetic polypeptide
DEEEIACTNPVATEQYGEVSEPALQRNGGR

SEQ ID NO: 41278 - protein, 30 aa, Artificial Sequence
  Description of Artificial Sequence: Synthetic polypeptide
DEEEIRTTNPVATEAYGVVNSTNEQNNENF

SEQ ID NO: 41279 - protein, 33 aa, Artificial Sequence
  Description of Artificial Sequence: Synthetic polypeptide
DEEEIRTTNPVATEQYGSVPSTNVIQQAQVNVR

SEQ ID NO: 41280 - protein, 33 aa, Artificial Sequence
  Description of Artificial Sequence: Synthetic polypeptide
DEEEIRTTNPVATEAYGVVSTGNLSARGGNNRA

SEQ ID NO: 41281 - protein, 34 aa, Artificial Sequence
  Description of Artificial Sequence: Synthetic polypeptide
DEEEIRTTNPVATEQWGSTVSCTNLSQRASGARF

SEQ ID NO: 41282 - protein, 34 aa, Artificial Sequence
  Description of Artificial Sequence: Synthetic polypeptide
DEEEIRTTNPVATEQYGSVQNPSPNLEQRGVNFG

SEQ ID NO: 41283 - protein, 33 aa, Artificial Sequence
  Description of Artificial Sequence: Synthetic polypeptide
DEEEIRTTNPVATEQYGSVIVTNLENGGNEDRQ

SEQ ID NO: 41284 - protein, 31 aa, Artificial Sequence
  Description of Artificial Sequence: Synthetic polypeptide
DEEEIRTTNPVATEQYGSVIWTNDIRDNENG

SEQ ID NO: 41285 - protein, 32 aa, Artificial Sequence
  Description of Artificial Sequence: Synthetic polypeptide
DEEEIRTTNPVATEQYGSVSNNELQQVGPTPE

SEQ ID NO: 41286 - protein, 32 aa, Artificial Sequence
  Description of Artificial Sequence: Synthetic polypeptide
DEEEIATTNPVATEPYGISVSTVNLQDRIDNA

SEQ ID NO: 41287 - protein, 33 aa, Artificial Sequence
  Description of Artificial Sequence: Synthetic polypeptide
DEEEIRTTNPVATEQYGSVMSTNEGQEGDNIEN

SEQ ID NO: 41288 - protein, 32 aa, Artificial Sequence
  Description of Artificial Sequence: Synthetic polypeptide
DEEEIATTNPVATECYGSVSTNLNRGEGNGEQ

SEQ ID NO: 41289 - protein, 32 aa, Artificial Sequence
  Description of Artificial Sequence: Synthetic polypeptide
DEEEIRTTNPVATEQYGSVMSTNEGQFEDNIG

SEQ ID NO: 41290 - protein, 33 aa, Artificial Sequence
  Description of Artificial Sequence: Synthetic polypeptide
DEEEIRTTNPVATEQYGAISMTENMSQERIGNR

SEQ ID NO: 41291 - protein, 29 aa, Artificial Sequence
  Description of Artificial Sequence: Synthetic peptide
DEEEIRTTNPVATECWGCHSTNEDQRMNF

SEQ ID NO: 41292 - protein, 30 aa, Artificial Sequence
  Description of Artificial Sequence: Synthetic polypeptide
DEEEIRTTNPVATEQYGSVPTNNERIETQQ

SEQ ID NO: 41293 - protein, 32 aa, Artificial Sequence
  Description of Artificial Sequence: Synthetic polypeptide
DEEEIRTTNPVATEQYGSVSNNGGQGRGLEVD

SEQ ID NO: 41294 - protein, 31 aa, Artificial Sequence
  Description of Artificial Sequence: Synthetic polypeptide
DEEEIRTTNPVATEQYGSVPTNNLEAGSTEI

SEQ ID NO: 41295 - protein, 32 aa, Artificial Sequence
  Description of Artificial Sequence: Synthetic polypeptide
DEEEIRTTNPVATEQYGSVPTNNLEQIFNGDE

SEQ ID NO: 41296 - protein, 30 aa, Artificial Sequence
  Description of Artificial Sequence: Synthetic polypeptide
DEEEIRTTNPVATEQYGSVNGCINDQNGEQ

SEQ ID NO: 41297 - protein, 34 aa, Artificial Sequence
  Description of Artificial Sequence: Synthetic polypeptide
DEEEIRTTNPVATEQYGSVMSTYNWQQRYGENND

SEQ ID NO: 41298 - protein, 33 aa, Artificial Sequence
  Description of Artificial Sequence: Synthetic polypeptide
DEEEIRTTNPVATEQYGSVMSVTHDLTRGDEQR

SEQ ID NO: 41299 - protein, 33 aa, Artificial Sequence
  Description of Artificial Sequence: Synthetic polypeptide
DEEEIRTTNPVATEQWGYYTISTNELQRDGQNR

SEQ ID NO: 41300 - protein, 33 aa, Artificial Sequence
  Description of Artificial Sequence: Synthetic polypeptide
DEEEIRTTNPVATEQWGYYTISTNELQRDGDNR

SEQ ID NO: 41301 - protein, 32 aa, Artificial Sequence
  Description of Artificial Sequence: Synthetic polypeptide
DEEEIRTTNPVATEQYGSVSNNGQQAPNVVDR

SEQ ID NO: 41302 - protein, 32 aa, Artificial Sequence
  Description of Artificial Sequence: Synthetic polypeptide
DEEEIRTTNPVATEQYGSVMTGMLGHRGINES

SEQ ID NO: 41303 - protein, 32 aa, Artificial Sequence
  Description of Artificial Sequence: Synthetic polypeptide
DEEEIRTTNPVATEQYGSVSNNIQERSDESRS

SEQ ID NO: 41304 - protein, 32 aa, Artificial Sequence
  Description of Artificial Sequence: Synthetic polypeptide
DEEEIRTTNPVATEQYGSVSNNIQERVGDEFS

SEQ ID NO: 41305 - protein, 31 aa, Artificial Sequence
  Description of Artificial Sequence: Synthetic polypeptide
DEEEIATTNPVATECYGSVSTNLQGQGGDDT

SEQ ID NO: 41306 - protein, 31 aa, Artificial Sequence
  Description of Artificial Sequence: Synthetic polypeptide
DEEEIRTTNPVATEQYGSVMTNEFQDIDDDR

SEQ ID NO: 41307 - protein, 32 aa, Artificial Sequence
  Description of Artificial Sequence: Synthetic polypeptide
DEEEIRTTNPVATEQWGYTISTNELQDGHNNR

SEQ ID NO: 41308 - protein, 32 aa, Artificial Sequence
  Description of Artificial Sequence: Synthetic polypeptide
DEEEIRTTNPVATEQYGSVPTNTLELNNQIDR

SEQ ID NO: 41309 - protein, 32 aa, Artificial Sequence
  Description of Artificial Sequence: Synthetic polypeptide
DEEEIRTTNPVATEQYGSVMSVLFNLQGVNIE

SEQ ID NO: 41310 - protein, 33 aa, Artificial Sequence
  Description of Artificial Sequence: Synthetic polypeptide
DEEEIRTTNPVATEQYGSVQCTQNLQRDQNQDQ

SEQ ID NO: 41311 - protein, 29 aa, Artificial Sequence
  Description of Artificial Sequence: Synthetic peptide
DEEEIRTTNPVATECWGKHSTNDQRRNDF

SEQ ID NO: 41312 - protein, 33 aa, Artificial Sequence
  Description of Artificial Sequence: Synthetic polypeptide
DEEEIRTTNPVATEQYGASVYSTALQNFGGNNF

SEQ ID NO: 41313 - protein, 31 aa, Artificial Sequence
  Description of Artificial Sequence: Synthetic polypeptide
DEEEIRTTNPVATEQYGSVNGTLDDQGGNDE

SEQ ID NO: 41314 - protein, 29 aa, Artificial Sequence
  Description of Artificial Sequence: Synthetic peptide
DEEEIRTTNPVATECWGKHSTNEQRDRNT

SEQ ID NO: 41315 - protein, 30 aa, Artificial Sequence
  Description of Artificial Sequence: Synthetic polypeptide
DEEEIRTTNPVATECWGKHSTNEQRDQGNF

SEQ ID NO: 41316 - protein, 33 aa, Artificial Sequence
  Description of Artificial Sequence: Synthetic polypeptide
DEEEIRTTNPVATEQYGAVSGTNLQGEGGGNTT

SEQ ID NO: 41317 - protein, 34 aa, Artificial Sequence
  Description of Artificial Sequence: Synthetic polypeptide
DEEEIRTTNPVATEQYGSVQCTTNLQQTGENFRQ

SEQ ID NO: 41318 - protein, 32 aa, Artificial Sequence
  Description of Artificial Sequence: Synthetic polypeptide
DEEEIRTTNPVATEQYGAVSGDNLNGNQIGND

SEQ ID NO: 41319 - protein, 32 aa, Artificial Sequence
  Description of Artificial Sequence: Synthetic polypeptide
DEEEIRTTNPVATEQYGAVSGDNLNGNQGGNN

SEQ ID NO: 41320 - protein, 31 aa, Artificial Sequence
  Description of Artificial Sequence: Synthetic polypeptide
DEEEIRTTNPVATEQYGAVSGDGNGNQTGNI

SEQ ID NO: 41321 - protein, 31 aa, Artificial Sequence
  Description of Artificial Sequence: Synthetic polypeptide
DEEEIRTTNPVATEQYGAVSGDGNGNQGGNN

SEQ ID NO: 41322 - protein, 32 aa, Artificial Sequence
  Description of Artificial Sequence: Synthetic polypeptide
DEEEIRTTNPVATEQYGSVSNNDIQERGDETS

SEQ ID NO: 41323 - protein, 31 aa, Artificial Sequence
  Description of Artificial Sequence: Synthetic polypeptide
DEEEIRTTNPVATEQYGSVNGMNDQADNERG

SEQ ID NO: 41324 - protein, 31 aa, Artificial Sequence
  Description of Artificial Sequence: Synthetic polypeptide
DEEEIRTTNPVATEQYGAVSATNIQQAENTM

SEQ ID NO: 41325 - protein, 33 aa, Artificial Sequence
  Description of Artificial Sequence: Synthetic polypeptide
DEEEIRTTNPVATEQYGSVMSGMFNLQEEIGNI

SEQ ID NO: 41326 - protein, 33 aa, Artificial Sequence
  Description of Artificial Sequence: Synthetic polypeptide
DEEEIRTTNPVATEQYGAVDSDTNLGQEFGNIN

SEQ ID NO: 41327 - protein, 32 aa, Artificial Sequence
  Description of Artificial Sequence: Synthetic polypeptide
DEEEIRTTNPVATEQYGSVMSINMSQVVGGQR

SEQ ID NO: 41328 - protein, 30 aa, Artificial Sequence
  Description of Artificial Sequence: Synthetic polypeptide
DEEEIRTTNPVATEQYGSVNGELDQGDNEQ

SEQ ID NO: 41329 - protein, 33 aa, Artificial Sequence
  Description of Artificial Sequence: Synthetic polypeptide
DEEEIRTTNPVATEQYGAVDSDTNLGQEEGGNG

SEQ ID NO: 41330 - protein, 33 aa, Artificial Sequence
  Description of Artificial Sequence: Synthetic polypeptide
DEEEIRTTNPVATEQYGSVSNNDLQAPNVEDRN

SEQ ID NO: 41331 - protein, 33 aa, Artificial Sequence
  Description of Artificial Sequence: Synthetic polypeptide
DEEEIRTTNPVATEQYGSVNGDTFNLQVGNIGG

SEQ ID NO: 41332 - protein, 31 aa, Artificial Sequence
  Description of Artificial Sequence: Synthetic polypeptide
DEEEIRTTNPVATEQYGSVSNNDLQQDPILM

SEQ ID NO: 41333 - protein, 29 aa, Artificial Sequence
  Description of Artificial Sequence: Synthetic peptide
DEEEIRTTNPVATECWGKHSTNEQHDGNF

SEQ ID NO: 41334 - protein, 32 aa, Artificial Sequence
  Description of Artificial Sequence: Synthetic polypeptide
DEEEIRTTNPVATEQYGSVMSLPIMLQRDQRQ

SEQ ID NO: 41335 - protein, 28 aa, Artificial Sequence
  Description of Artificial Sequence: Synthetic peptide
DEEEIRTTNPVATECWGKHSTNEQGDNS

SEQ ID NO: 41336 - protein, 30 aa, Artificial Sequence
  Description of Artificial Sequence: Synthetic polypeptide
DEEEIRTTNPVATECWGKHSTNEDQHRGNA

SEQ ID NO: 41337 - protein, 31 aa, Artificial Sequence
  Description of Artificial Sequence: Synthetic polypeptide
DEEEIATTNPVATEPYGSVCATNETRGGNDR

SEQ ID NO: 41338 - protein, 30 aa, Artificial Sequence
  Description of Artificial Sequence: Synthetic polypeptide
DEEEIRTTNPVATEQWGYTIATNELQAGNA

SEQ ID NO: 41339 - protein, 31 aa, Artificial Sequence
  Description of Artificial Sequence: Synthetic polypeptide
DEEEIATTNPVATEPYGSVSTNLGDDGNNGN

SEQ ID NO: 41340 - protein, 32 aa, Artificial Sequence
  Description of Artificial Sequence: Synthetic polypeptide
DEEEIATTNPVATECYGSVSTNLQNMGDNDGQ

SEQ ID NO: 41341 - protein, 31 aa, Artificial Sequence
  Description of Artificial Sequence: Synthetic polypeptide
DEEEIRTTNPVATEQWGTVVSTYLLRDGNNS

SEQ ID NO: 41342 - protein, 32 aa, Artificial Sequence
  Description of Artificial Sequence: Synthetic polypeptide
DEEEIRTTNPVATEQYGSVQCMSNLEQRGLFQ

SEQ ID NO: 41343 - protein, 31 aa, Artificial Sequence
  Description of Artificial Sequence: Synthetic polypeptide
DEEEIRTTNPVATEQWGTSVVTQLLRDGNES

SEQ ID NO: 41344 - protein, 31 aa, Artificial Sequence
  Description of Artificial Sequence: Synthetic polypeptide
DEEEIACTNPVATEQYGSASTEPNGPQRGNV

SEQ ID NO: 41345 - protein, 30 aa, Artificial Sequence
  Description of Artificial Sequence: Synthetic polypeptide
DEEEIRTTNPVATEQYGSVPYMSLQTQVNL

SEQ ID NO: 41346 - protein, 30 aa, Artificial Sequence
  Description of Artificial Sequence: Synthetic polypeptide
DEEEIRTTNPVATEQWGTSVSTLGILGGNS

SEQ ID NO: 41347 - protein, 32 aa, Artificial Sequence
  Description of Artificial Sequence: Synthetic polypeptide
DEEEIRTTNPVATEQYGSVPWPVLIQVGENQR

SEQ ID NO: 41348 - protein, 32 aa, Artificial Sequence
  Description of Artificial Sequence: Synthetic polypeptide
DEEEIATTNPVATEHYGSVSTNLQPQDGNEGM

SEQ ID NO: 41349 - protein, 31 aa, Artificial Sequence
  Description of Artificial Sequence: Synthetic polypeptide
DEEEIATTNPVATEHYGSVSTNLQHNGGGDH

SEQ ID NO: 41350 - protein, 31 aa, Artificial Sequence
  Description of Artificial Sequence: Synthetic polypeptide
DEEEIRTTNPVATEQWGTSVSAYLLRDGNNS

SEQ ID NO: 41351 - protein, 31 aa, Artificial Sequence
  Description of Artificial Sequence: Synthetic polypeptide
DEEEIRTTNPVATEQWGTSVSAWLLRGENDS

SEQ ID NO: 41352 - protein, 30 aa, Artificial Sequence
  Description of Artificial Sequence: Synthetic polypeptide
DEEEIRTTNPVATEQWGTSVSAALLGNGNS

SEQ ID NO: 41353 - protein, 30 aa, Artificial Sequence
  Description of Artificial Sequence: Synthetic polypeptide
DEEEIRTTNPVATEQWGTVSTNGQNGTDES

SEQ ID NO: 41354 - protein, 31 aa, Artificial Sequence
  Description of Artificial Sequence: Synthetic polypeptide
DEEEIRTTNPVATEQWGSVSYQPQLGSGNMR

SEQ ID NO: 41355 - protein, 31 aa, Artificial Sequence
  Description of Artificial Sequence: Synthetic polypeptide
DEEEIATTNPVATEHYGSVSTNLQGQGDEQM

SEQ ID NO: 41356 - protein, 33 aa, Artificial Sequence
  Description of Artificial Sequence: Synthetic polypeptide
DEEEIRTTNPVATEQYGSVMYVTHDLQRGDEDR

SEQ ID NO: 41357 - protein, 30 aa, Artificial Sequence
  Description of Artificial Sequence: Synthetic polypeptide
DEEEIATTNPVATEHYGAVSTNLQQGDEQM

SEQ ID NO: 41358 - protein, 31 aa, Artificial Sequence
  Description of Artificial Sequence: Synthetic polypeptide
DEEEIRTTNPVATEQWGTNSTDNNLQREENN

SEQ ID NO: 41359 - protein, 31 aa, Artificial Sequence
  Description of Artificial Sequence: Synthetic polypeptide
DEEEIRTTNPVATEQWGTASTGNPLQRENEN

SEQ ID NO: 41360 - protein, 31 aa, Artificial Sequence
  Description of Artificial Sequence: Synthetic polypeptide
DEEEIATTNPVATEHYGCVSTNLQDHNGGNH

SEQ ID NO: 41361 - protein, 32 aa, Artificial Sequence
  Description of Artificial Sequence: Synthetic polypeptide
DEEEIRTTNPVATEQWGSVYHWTNDHQNTGNR

SEQ ID NO: 41362 - protein, 32 aa, Artificial Sequence
  Description of Artificial Sequence: Synthetic polypeptide
DEEEIRTTNPVATEQYGSVPVSFNVQRVNEIN

SEQ ID NO: 41363 - protein, 31 aa, Artificial Sequence
  Description of Artificial Sequence: Synthetic polypeptide
DEEEIATTNPVATEHYGCVSTNLQPMGDNDA

SEQ ID NO: 41364 - protein, 30 aa, Artificial Sequence
  Description of Artificial Sequence: Synthetic polypeptide
DEEEIRTTNPVATEQYGSVPVSFMVNRVNI

SEQ ID NO: 41365 - protein, 32 aa, Artificial Sequence
  Description of Artificial Sequence: Synthetic polypeptide
DEEEIRTTNPVATEQYGSVMWETTLQRNNDVF

SEQ ID NO: 41366 - protein, 34 aa, Artificial Sequence
  Description of Artificial Sequence: Synthetic polypeptide
DEEEIRTTNPVATEQWGSVSYTHALSQRPVGNRN

SEQ ID NO: 41367 - protein, 31 aa, Artificial Sequence
  Description of Artificial Sequence: Synthetic polypeptide
DEEEIRTTNPVATEQWGSVSTQLQDYEVGRP

SEQ ID NO: 41368 - protein, 33 aa, Artificial Sequence
  Description of Artificial Sequence: Synthetic polypeptide
DEEEIRTTNPVATEQYGSVPTTNLNQNRGLEDD

SEQ ID NO: 41369 - protein, 31 aa, Artificial Sequence
  Description of Artificial Sequence: Synthetic polypeptide
DEEEIRTTNPVATEQYGSVPTTLERDEDVRI

SEQ ID NO: 41370 - protein, 32 aa, Artificial Sequence
  Description of Artificial Sequence: Synthetic polypeptide
DEEEIRTTNPVATEAYGYVSTNLQEGGGNNGD

SEQ ID NO: 41371 - protein, 31 aa, Artificial Sequence
  Description of Artificial Sequence: Synthetic polypeptide
DEEEIRTTNPVATEQWGTVVSTVNLLQGTNS

SEQ ID NO: 41372 - protein, 30 aa, Artificial Sequence
  Description of Artificial Sequence: Synthetic polypeptide
DEEAIRTTNPVATEQYGSVSTNIDVTEQNE

SEQ ID NO: 41373 - protein, 32 aa, Artificial Sequence
  Description of Artificial Sequence: Synthetic polypeptide
DEEEIRTTNPVATEAYGYVSTNLQDEFGGNNG

SEQ ID NO: 41374 - protein, 32 aa, Artificial Sequence
  Description of Artificial Sequence: Synthetic polypeptide
DEEEIATTNPVATENYGSVSTGLQDRGSNGED

SEQ ID NO: 41375 - protein, 32 aa, Artificial Sequence
  Description of Artificial Sequence: Synthetic polypeptide
DEEEIRTTNPVATEAYGWVSVTNLSTNGGNNR

SEQ ID NO: 41376 - protein, 31 aa, Artificial Sequence
  Description of Artificial Sequence: Synthetic polypeptide
DEEEIRTTNPVATEQYGSVMTNHTTDGSENE

SEQ ID NO: 41377 - protein, 30 aa, Artificial Sequence
  Description of Artificial Sequence: Synthetic polypeptide
DEEEIRTTNPVATEQWGTVVSTTLLLGNES

SEQ ID NO: 41378 - protein, 32 aa, Artificial Sequence
  Description of Artificial Sequence: Synthetic polypeptide
DEEEIRTTNPVATEQYGSVSNNLDFNEGGNNV

SEQ ID NO: 41379 - protein, 31 aa, Artificial Sequence
  Description of Artificial Sequence: Synthetic polypeptide
DEEEIATTNPVATENYGEVSTNLQHQGNDES

SEQ ID NO: 41380 - protein, 32 aa, Artificial Sequence
  Description of Artificial Sequence: Synthetic polypeptide
DEEEIATTNPVATECYGVVSTNLQHDGGQNQR

SEQ ID NO: 41381 - protein, 33 aa, Artificial Sequence
  Description of Artificial Sequence: Synthetic polypeptide
DEEEIATTNPVATEEYGSTVPSTNSSQRGGNTR

SEQ ID NO: 41382 - protein, 31 aa, Artificial Sequence
  Description of Artificial Sequence: Synthetic polypeptide
DEEEIRTTNPVATEAYGWVSCTNLSTNGGER

SEQ ID NO: 41383 - protein, 30 aa, Artificial Sequence
  Description of Artificial Sequence: Synthetic polypeptide
DEEEIATTNPVATENWGSVSTNLQGGMDGA

SEQ ID NO: 41384 - protein, 30 aa, Artificial Sequence
  Description of Artificial Sequence: Synthetic polypeptide
DEEEIRTTNPVATEQYGSVPTPDLQDVEEG

SEQ ID NO: 41385 - protein, 31 aa, Artificial Sequence
  Description of Artificial Sequence: Synthetic polypeptide
DEEEIATTNPVATEMYGSVATNLQEAGNIEN

SEQ ID NO: 41386 - protein, 31 aa, Artificial Sequence
  Description of Artificial Sequence: Synthetic polypeptide
DEEEIATTNPVATEMYGSVATNLERGDNDLP

SEQ ID NO: 41387 - protein, 29 aa, Artificial Sequence
  Description of Artificial Sequence: Synthetic peptide
DEEEIRTTNPVATEQWGTVVSTELLVGTS

SEQ ID NO: 41388 - protein, 32 aa, Artificial Sequence
  Description of Artificial Sequence: Synthetic polypeptide
DEEEIRTTNPVATEAYGWVPSVTNLSTGGGNR

SEQ ID NO: 41389 - protein, 33 aa, Artificial Sequence
  Description of Artificial Sequence: Synthetic polypeptide
DEEAIRTTNPVATEQYGSVSTNDHQGVGLDNRF

SEQ ID NO: 41390 - protein, 32 aa, Artificial Sequence
  Description of Artificial Sequence: Synthetic polypeptide
DEEEIRTTNPVATEQWGSVSTNMISPQTGSNH

SEQ ID NO: 41391 - protein, 31 aa, Artificial Sequence
  Description of Artificial Sequence: Synthetic polypeptide
DEEEIRTTNPVATEQYGSVNCMNLAIRGVEQ

SEQ ID NO: 41392 - protein, 31 aa, Artificial Sequence
  Description of Artificial Sequence: Synthetic polypeptide
DEEEIRTTNPVATEQYGSVPTTLEQVISMQR

SEQ ID NO: 41393 - protein, 31 aa, Artificial Sequence
  Description of Artificial Sequence: Synthetic polypeptide
DEEEIATTNPVATEIYGSVSTNLNGEGNNED

SEQ ID NO: 41394 - protein, 30 aa, Artificial Sequence
  Description of Artificial Sequence: Synthetic polypeptide
DEEEIRTTNPVATEQWGTVVSTELLIGTNS

SEQ ID NO: 41395 - protein, 31 aa, Artificial Sequence
  Description of Artificial Sequence: Synthetic polypeptide
DEEEIRTTNPVATEQWGTVVVSTSNLLGGNS

SEQ ID NO: 41396 - protein, 31 aa, Artificial Sequence
  Description of Artificial Sequence: Synthetic polypeptide
DEEEIATTNPVATEPYGSVSTNLGGDMGNTG

SEQ ID NO: 41397 - protein, 31 aa, Artificial Sequence
  Description of Artificial Sequence: Synthetic polypeptide
DEEAIRTTNPVAYEQYGAVSTINVQRIGNQD

SEQ ID NO: 41398 - protein, 33 aa, Artificial Sequence
  Description of Artificial Sequence: Synthetic polypeptide
DEEEIRTTNPVATEQYGAVSNTNLQELTGENFD

SEQ ID NO: 41399 - protein, 32 aa, Artificial Sequence
  Description of Artificial Sequence: Synthetic polypeptide
DEEEIRTTNPVATECWGSVSEINEPQDRGENR

SEQ ID NO: 41400 - protein, 32 aa, Artificial Sequence
  Description of Artificial Sequence: Synthetic polypeptide
DEEEIRTTNPVATEQYGSVSNNLQASEGVLEE

SEQ ID NO: 41401 - protein, 32 aa, Artificial Sequence
  Description of Artificial Sequence: Synthetic polypeptide
DEEEIRTTNPVATEQYGSVLEPTNNGFERDNR

SEQ ID NO: 41402 - protein, 32 aa, Artificial Sequence
  Description of Artificial Sequence: Synthetic polypeptide
DEEEIRTTNPVATECWGSVSCINEPQDRGENR

SEQ ID NO: 41403 - protein, 32 aa, Artificial Sequence
  Description of Artificial Sequence: Synthetic polypeptide
DEEEIRTTNPVATEQYGSVQLTNLQQTGPSVD

SEQ ID NO: 41404 - protein, 33 aa, Artificial Sequence
  Description of Artificial Sequence: Synthetic polypeptide
DEEEIATTNPVATEAYGSVPSTGNLSARGGNRY

SEQ ID NO: 41405 - protein, 31 aa, Artificial Sequence
  Description of Artificial Sequence: Synthetic polypeptide
DEEEIRTTNPVATEQYGSVLPTNQQLDGLVQ

SEQ ID NO: 41406 - protein, 31 aa, Artificial Sequence
  Description of Artificial Sequence: Synthetic polypeptide
DEEEIATTNPVATEQWGCVSTNLQPMGDNDM

SEQ ID NO: 41407 - protein, 31 aa, Artificial Sequence
  Description of Artificial Sequence: Synthetic polypeptide
DEEEIRTTNPVATEQYGSVLSDDFNLQGVGI

SEQ ID NO: 41408 - protein, 33 aa, Artificial Sequence
  Description of Artificial Sequence: Synthetic polypeptide
DEEEIRTTNPVATEQYGAVTSTNLQDNGNNINT

SEQ ID NO: 41409 - protein, 33 aa, Artificial Sequence
  Description of Artificial Sequence: Synthetic polypeptide
DEEEIRTTNPVATEQYGSVLSENELERSGENDG

SEQ ID NO: 41410 - protein, 31 aa, Artificial Sequence
  Description of Artificial Sequence: Synthetic polypeptide
DEEEIRTTNPVATEQYGSVKTEPWHQENGDR

SEQ ID NO: 41411 - protein, 31 aa, Artificial Sequence
  Description of Artificial Sequence: Synthetic polypeptide
DEEEIRTTNPVATEQYGSVPTNLLVMESGEQ

SEQ ID NO: 41412 - protein, 32 aa, Artificial Sequence
  Description of Artificial Sequence: Synthetic polypeptide
DEEEIRTTNPVATEQYGSVNNPNNLDQVRGDV

SEQ ID NO: 41413 - protein, 30 aa, Artificial Sequence
  Description of Artificial Sequence: Synthetic polypeptide
DEEEIRTTNPVATEQYGSVNNNNDSEGNEQ

SEQ ID NO: 41414 - protein, 31 aa, Artificial Sequence
  Description of Artificial Sequence: Synthetic polypeptide
DEEEIRTTNPVATEQYGSVLSIMELQRQDEL

SEQ ID NO: 41415 - protein, 32 aa, Artificial Sequence
  Description of Artificial Sequence: Synthetic polypeptide
DEEEIRTTNPVATEQYGSVSNMDLQEREDNNE

SEQ ID NO: 41416 - protein, 33 aa, Artificial Sequence
  Description of Artificial Sequence: Synthetic polypeptide
DEEEIRTTNPVATEQWGSVSQGNMLQTTGGNNR

SEQ ID NO: 41417 - protein, 32 aa, Artificial Sequence
  Description of Artificial Sequence: Synthetic polypeptide
DEEEIRTTNPVATEQYGAVSTVNLPEGGGNDF

SEQ ID NO: 41418 - protein, 33 aa, Artificial Sequence
  Description of Artificial Sequence: Synthetic polypeptide
DEEEIRTTNPVATEQYGSVLSLTSLLQRDNNEF

SEQ ID NO: 41419 - protein, 32 aa, Artificial Sequence
  Description of Artificial Sequence: Synthetic polypeptide
DEEEIRTTNPVATEQYGAVSTVNLNPEFGENF

SEQ ID NO: 41420 - protein, 31 aa, Artificial Sequence
  Description of Artificial Sequence: Synthetic polypeptide
DEEEIRTTNPVATEQYGSVNNETLVQRGEQD

SEQ ID NO: 41421 - protein, 32 aa, Artificial Sequence
  Description of Artificial Sequence: Synthetic polypeptide
DEEEIRTTNPVATEQYGAVSTVNLFEGGNGFT

SEQ ID NO: 41422 - protein, 32 aa, Artificial Sequence
  Description of Artificial Sequence: Synthetic polypeptide
DEEEIRTTNPVATEQYGAVSTVNLDPEGGNGF

SEQ ID NO: 41423 - protein, 30 aa, Artificial Sequence
  Description of Artificial Sequence: Synthetic polypeptide
DEEEIRTTNPVATEQYGAVSYNLGGMNEID

SEQ ID NO: 41424 - protein, 32 aa, Artificial Sequence
  Description of Artificial Sequence: Synthetic polypeptide
DEEEIRTTNPVATEQYGAVWQTINNLQRENNE

SEQ ID NO: 41425 - protein, 33 aa, Artificial Sequence
  Description of Artificial Sequence: Synthetic polypeptide
DEEEIRTTNPVATEQYGSVNNTDNEQNREGDNS

SEQ ID NO: 41426 - protein, 31 aa, Artificial Sequence
  Description of Artificial Sequence: Synthetic polypeptide
DEEEIRTTNPVATEQYGSVSNLMLERVAEER

SEQ ID NO: 41427 - protein, 31 aa, Artificial Sequence
  Description of Artificial Sequence: Synthetic polypeptide
DEEEIRTTNPVATEQYGSVNNTNDDNRSENE

SEQ ID NO: 41428 - protein, 31 aa, Artificial Sequence
  Description of Artificial Sequence: Synthetic polypeptide
DEEEIRTTNPVATEQYGAVWSTINPNQDENN

SEQ ID NO: 41429 - protein, 31 aa, Artificial Sequence
  Description of Artificial Sequence: Synthetic polypeptide
DEEEIRTTNPVATEQYGSVPTNLERQLVEET

SEQ ID NO: 41430 - protein, 31 aa, Artificial Sequence
  Description of Artificial Sequence: Synthetic polypeptide
DEEEIRTTNPVATEQYGAVWSTINPLNREVN

SEQ ID NO: 41431 - protein, 32 aa, Artificial Sequence
  Description of Artificial Sequence: Synthetic polypeptide
DEEEIRTTNPVATEQYGSVPTNLERTSDNQQF

SEQ ID NO: 41432 - protein, 33 aa, Artificial Sequence
  Description of Artificial Sequence: Synthetic polypeptide
DEEEIRTTNPVATEQYGAVWSTINPGQREGNNT

SEQ ID NO: 41433 - protein, 33 aa, Artificial Sequence
  Description of Artificial Sequence: Synthetic polypeptide
DEEEIRTTNPVATEQYGSVSNENLQNVGLEIRL

SEQ ID NO: 41434 - protein, 31 aa, Artificial Sequence
  Description of Artificial Sequence: Synthetic polypeptide
DEEEIRTTNPVATEQYGSVQNNTELDVGEER

SEQ ID NO: 41435 - protein, 31 aa, Artificial Sequence
  Description of Artificial Sequence: Synthetic polypeptide
DEEEIRTTNPVATEQYGSVNNTENLGGNGTG

SEQ ID NO: 41436 - protein, 32 aa, Artificial Sequence
  Description of Artificial Sequence: Synthetic polypeptide
DEEEIRTTNPVATEQYGSVSNENLQVAIDPRS

SEQ ID NO: 41437 - protein, 31 aa, Artificial Sequence
  Description of Artificial Sequence: Synthetic polypeptide
DEEEIRTTNPVATEQYGSVSNENMIRGEMEA

SEQ ID NO: 41438 - protein, 32 aa, Artificial Sequence
  Description of Artificial Sequence: Synthetic polypeptide
DEEEIRTTNPVATEQYGSVSNETDMQRSVNTS

SEQ ID NO: 41439 - protein, 31 aa, Artificial Sequence
  Description of Artificial Sequence: Synthetic polypeptide
DEEEIRTTNPVATEQYGSVSNGIEAEGNTRN

SEQ ID NO: 41440 - protein, 32 aa, Artificial Sequence
  Description of Artificial Sequence: Synthetic polypeptide
DEEEIRTTNPVATEQYGAVWSTINPGQREGEG

SEQ ID NO: 41441 - protein, 32 aa, Artificial Sequence
  Description of Artificial Sequence: Synthetic polypeptide
DEEEIRTTNPVATEQYGAVWSTINPEDQRENN

SEQ ID NO: 41442 - protein, 32 aa, Artificial Sequence
  Description of Artificial Sequence: Synthetic polypeptide
DEEEIRTTNPVATEQYGSVSNNLQEVFQNIEE

SEQ ID NO: 41443 - protein, 29 aa, Artificial Sequence
  Description of Artificial Sequence: Synthetic peptide
DEEEIRTTNPVATEQWGSVSEILMNAENA

SEQ ID NO: 41444 - protein, 33 aa, Artificial Sequence
  Description of Artificial Sequence: Synthetic polypeptide
DEEEIRTTNPVATEQYGSVIYIPNLQRGLQTRI

SEQ ID NO: 41445 - protein, 32 aa, Artificial Sequence
  Description of Artificial Sequence: Synthetic polypeptide
DEEEIRTTNPVATEQWGSVSEINCPQDRGENK

SEQ ID NO: 41446 - protein, 32 aa, Artificial Sequence
  Description of Artificial Sequence: Synthetic polypeptide
DEEEIRTTNPVATEQYGSVQLTNSQTLGANED

SEQ ID NO: 41447 - protein, 30 aa, Artificial Sequence
  Description of Artificial Sequence: Synthetic polypeptide
DEEEIRTTNPVATEQWGSVSENLMNAAGDA

SEQ ID NO: 41448 - protein, 31 aa, Artificial Sequence
  Description of Artificial Sequence: Synthetic polypeptide
DEEEIRTTNPVATEQYGSVSNGLEQLIVERE

SEQ ID NO: 41449 - protein, 33 aa, Artificial Sequence
  Description of Artificial Sequence: Synthetic polypeptide
DEEEIRTTNPVATEQYGAVWSTINMGQREGNGN

SEQ ID NO: 41450 - protein, 34 aa, Artificial Sequence
  Description of Artificial Sequence: Synthetic polypeptide
DEEEIRTTNPVATEQYGSVSNGTNLQNSGVNEGE

SEQ ID NO: 41451 - protein, 33 aa, Artificial Sequence
  Description of Artificial Sequence: Synthetic polypeptide
DEEEIRTTNPVATEQYGSVIYTNGNEQRMGEND

SEQ ID NO: 41452 - protein, 32 aa, Artificial Sequence
  Description of Artificial Sequence: Synthetic polypeptide
DEEEIRTTNPVATEQYGAVSTTNLQFEINGGD

SEQ ID NO: 41453 - protein, 33 aa, Artificial Sequence
  Description of Artificial Sequence: Synthetic polypeptide
DEEEIRTTNPVATEQYGAVSTSNLQQNGGNGGD

SEQ ID NO: 41454 - protein, 32 aa, Artificial Sequence
  Description of Artificial Sequence: Synthetic polypeptide
DEEEIRTTNPVATEQYGSVSNMNFEQGGENTE

SEQ ID NO: 41455 - protein, 32 aa, Artificial Sequence
  Description of Artificial Sequence: Synthetic polypeptide
DEEEIRTTNPVATEQYGSVNMVTNDQRDEERG

SEQ ID NO: 41456 - protein, 32 aa, Artificial Sequence
  Description of Artificial Sequence: Synthetic polypeptide
DEEEIRTTNPVATEQYGSVSNNLESGGNMEEQ

SEQ ID NO: 41457 - protein, 33 aa, Artificial Sequence
  Description of Artificial Sequence: Synthetic polypeptide
DEEEIRTTNPVATEQYGSVSNMNLGQFGNNTQQ

SEQ ID NO: 41458 - protein, 33 aa, Artificial Sequence
  Description of Artificial Sequence: Synthetic polypeptide
DEEEIRTTNPVATEQYGSVSNMNLGQQEGGNGQ

SEQ ID NO: 41459 - protein, 31 aa, Artificial Sequence
  Description of Artificial Sequence: Synthetic polypeptide
DEEEIRTTNPVATEQYGSVQGMANEQDTGNM

SEQ ID NO: 41460 - protein, 33 aa, Artificial Sequence
  Description of Artificial Sequence: Synthetic polypeptide
DEEEIRTTNPVATEQYGSVSNMNLQEDGGNEED

SEQ ID NO: 41461 - protein, 31 aa, Artificial Sequence
  Description of Artificial Sequence: Synthetic polypeptide
DEEEIRTTNPVATEQYGSVQETQTDQEQGNW

SEQ ID NO: 41462 - protein, 30 aa, Artificial Sequence
  Description of Artificial Sequence: Synthetic polypeptide
DEEEIRTTNPVATEQYGSVMPNHQTDSNQE

SEQ ID NO: 41463 - protein, 33 aa, Artificial Sequence
  Description of Artificial Sequence: Synthetic polypeptide
DEEEIRTTNPVATEQYGSVMQPTNLQPEGLINN

SEQ ID NO: 41464 - protein, 33 aa, Artificial Sequence
  Description of Artificial Sequence: Synthetic polypeptide
DEEEIRTTNPVATEQYGSVMSCTHDLQGGEQRM

SEQ ID NO: 41465 - protein, 34 aa, Artificial Sequence
  Description of Artificial Sequence: Synthetic polypeptide
DEEEIRTTNPVATEQYGSVSNNLEQNREGLEQRL

SEQ ID NO: 41466 - protein, 32 aa, Artificial Sequence
  Description of Artificial Sequence: Synthetic polypeptide
DEEEIATTNPVATEPYGSVSTTNLGGDGNNGR

SEQ ID NO: 41467 - protein, 32 aa, Artificial Sequence
  Description of Artificial Sequence: Synthetic polypeptide
DEEEIRTTNPVATEQYGAVSTDLDQQGDEERN

SEQ ID NO: 41468 - protein, 31 aa, Artificial Sequence
  Description of Artificial Sequence: Synthetic polypeptide
DEEEIATTNPVATEPYGSVSTNTSQDGGNNL

SEQ ID NO: 41469 - protein, 32 aa, Artificial Sequence
  Description of Artificial Sequence: Synthetic polypeptide
DEEEIRTTNPVATEQYGAVSSTTLGQGGGGNE

SEQ ID NO: 41470 - protein, 33 aa, Artificial Sequence
  Description of Artificial Sequence: Synthetic polypeptide
DEEEIRTTNPVATEQYGAVSSTNLQGEGGNNET

SEQ ID NO: 41471 - protein, 32 aa, Artificial Sequence
  Description of Artificial Sequence: Synthetic polypeptide
DEEEIATTNPVATEPYGSVSTNLQGQGDGNNG

SEQ ID NO: 41472 - protein, 33 aa, Artificial Sequence
  Description of Artificial Sequence: Synthetic polypeptide
DEEEIRTTNPVATEQYGAVSSTNLDQGEGGNTT

SEQ ID NO: 41473 - protein, 31 aa, Artificial Sequence
  Description of Artificial Sequence: Synthetic polypeptide
DEEEIRTTNPVATEQYGSVSNNLEGGGQSEQ

SEQ ID NO: 41474 - protein, 33 aa, Artificial Sequence
  Description of Artificial Sequence: Synthetic polypeptide
DEEEIRTTNPVATEQYGSVSNMNNLQIEIGNIT

SEQ ID NO: 41475 - protein, 34 aa, Artificial Sequence
  Description of Artificial Sequence: Synthetic polypeptide
DEEEIRTTNPVATEQYGSVSNMNNLQQRGDNNED

SEQ ID NO: 41476 - protein, 32 aa, Artificial Sequence
  Description of Artificial Sequence: Synthetic polypeptide
DEEEIRTTNPVATEQYGSVNGTNDQRMENEGG

SEQ ID NO: 41477 - protein, 32 aa, Artificial Sequence
  Description of Artificial Sequence: Synthetic polypeptide
DEEEIRTTNPVATEQYGAVSSDNLNQGEGGNT

SEQ ID NO: 41478 - protein, 32 aa, Artificial Sequence
  Description of Artificial Sequence: Synthetic polypeptide
DEEEIRTTNPVATEQYGSVNGTNDQLDENERG

SEQ ID NO: 41479 - protein, 31 aa, Artificial Sequence
  Description of Artificial Sequence: Synthetic polypeptide
DEEEIRTTNPVATEQYGSVSNMNQGEGGNEQ

SEQ ID NO: 41480 - protein, 33 aa, Artificial Sequence
  Description of Artificial Sequence: Synthetic polypeptide
DEEEIRTTNPVATEQYGSVSNMNSLEQREDSNE

SEQ ID NO: 41481 - protein, 33 aa, Artificial Sequence
  Description of Artificial Sequence: Synthetic polypeptide
DEEEIRTTNPVATEQYGSVQGPTNLIPRGELRS

SEQ ID NO: 41482 - protein, 33 aa, Artificial Sequence
  Description of Artificial Sequence: Synthetic polypeptide
DEEEIRTTNPVATEQYGCVCSNTENLQAGSNAG

SEQ ID NO: 41483 - protein, 31 aa, Artificial Sequence
  Description of Artificial Sequence: Synthetic polypeptide
DEEEIRTTNPVATEQYGSVNGTNELDNGETS

SEQ ID NO: 41484 - protein, 32 aa, Artificial Sequence
  Description of Artificial Sequence: Synthetic polypeptide
DEEEIRTTNPVATEQYGSVNGTNELDNSGERF

SEQ ID NO: 41485 - protein, 33 aa, Artificial Sequence
  Description of Artificial Sequence: Synthetic polypeptide
DEEEIRTTNPVATEQYGSVSNNLLQQQRDNLIQ

SEQ ID NO: 41486 - protein, 31 aa, Artificial Sequence
  Description of Artificial Sequence: Synthetic polypeptide
DEEEIRTTNPVATEQYGSVNGVTNLDNIGEI

SEQ ID NO: 41487 - protein, 32 aa, Artificial Sequence
  Description of Artificial Sequence: Synthetic polypeptide
DEEEIRTTNPVATEQYGSVQLTNLQQEGLLEL

SEQ ID NO: 41488 - protein, 32 aa, Artificial Sequence
  Description of Artificial Sequence: Synthetic polypeptide
DEEEIRTTNPVATEQYGSVSNMNGLGEGGNEQ

SEQ ID NO: 41489 - protein, 33 aa, Artificial Sequence
  Description of Artificial Sequence: Synthetic polypeptide
DEEEIRTTNPVATEQYGSVNGTNSDQDRGFEND

SEQ ID NO: 41490 - protein, 32 aa, Artificial Sequence
  Description of Artificial Sequence: Synthetic polypeptide
DEEEIRTTNPVATEQYGSVQLTNGQPRIEDRM

SEQ ID NO: 41491 - protein, 33 aa, Artificial Sequence
  Description of Artificial Sequence: Synthetic polypeptide
DEEEIRTTNPVATEQYGSVSNMNLDQDIGNEED

SEQ ID NO: 41492 - protein, 31 aa, Artificial Sequence
  Description of Artificial Sequence: Synthetic polypeptide
DEEEIATTNPVATECWGSVSTNLQQGDNDTE

SEQ ID NO: 41493 - protein, 31 aa, Artificial Sequence
  Description of Artificial Sequence: Synthetic polypeptide
DEEEIATTNPVATECYGCVSTNLQPMGDNND

SEQ ID NO: 41494 - protein, 32 aa, Artificial Sequence
  Description of Artificial Sequence: Synthetic polypeptide
DEEEIRTTNPVATEQYGAVSTNLQNREAETDV

SEQ ID NO: 41495 - protein, 33 aa, Artificial Sequence
  Description of Artificial Sequence: Synthetic polypeptide
DEEEIRTTNPVATEQYGSVLSTNQQPRQPEERS

SEQ ID NO: 41496 - protein, 33 aa, Artificial Sequence
  Description of Artificial Sequence: Synthetic polypeptide
DEEAIRTTNPVATEQYGSVSETEESLQRLFNRE

SEQ ID NO: 41497 - protein, 33 aa, Artificial Sequence
  Description of Artificial Sequence: Synthetic polypeptide
DEEEIRTTNPVATEQWGSVSTHALSQRPVGNTA

SEQ ID NO: 41498 - protein, 32 aa, Artificial Sequence
  Description of Artificial Sequence: Synthetic polypeptide
DEEEIRTTNPVATEQYGSVQLTFNLYGTQGTR

SEQ ID NO: 41499 - protein, 33 aa, Artificial Sequence
  Description of Artificial Sequence: Synthetic polypeptide
DEEEIRTTNPVATEQYGSVSNMNLDQFGNNEQG

SEQ ID NO: 41500 - protein, 30 aa, Artificial Sequence
  Description of Artificial Sequence: Synthetic polypeptide
DEEEIRTTNPVATEQWGSVSTIENNAAENA

SEQ ID NO: 41501 - protein, 33 aa, Artificial Sequence
  Description of Artificial Sequence: Synthetic polypeptide
DEEEIRTTNPVATEQYGSVNGTNLQNVGGNIGD

SEQ ID NO: 41502 - protein, 31 aa, Artificial Sequence
  Description of Artificial Sequence: Synthetic polypeptide
DEEEIRTTNPVATEQWGSVSTIENNAAGMNA

SEQ ID NO: 41503 - protein, 31 aa, Artificial Sequence
  Description of Artificial Sequence: Synthetic polypeptide
DEEEIRTTNPVATEQYGSVPTNLQQTMEIEE

SEQ ID NO: 41504 - protein, 32 aa, Artificial Sequence
  Description of Artificial Sequence: Synthetic polypeptide
DEEEIRTTNPVATEQYGSVNGTNLQNIGGVGD

SEQ ID NO: 41505 - protein, 29 aa, Artificial Sequence
  Description of Artificial Sequence: Synthetic peptide
DEEEIRTTNPVATECWGKHSTNEQRNENF

SEQ ID NO: 41506 - protein, 32 aa, Artificial Sequence
  Description of Artificial Sequence: Synthetic polypeptide
DEEEIRTTNPVATEQYGSVSNMNLDQNEGGEN

SEQ ID NO: 41507 - protein, 33 aa, Artificial Sequence
  Description of Artificial Sequence: Synthetic polypeptide
DEEEIRTTNPVATEQYGSVLVTGLQRIGINEQN

SEQ ID NO: 41508 - protein, 32 aa, Artificial Sequence
  Description of Artificial Sequence: Synthetic polypeptide
DEEEIRTTNPVATEQYGSVLVTNELFRSGEED

SEQ ID NO: 41509 - protein, 31 aa, Artificial Sequence
  Description of Artificial Sequence: Synthetic polypeptide
DEEEIRTTNPVATEQYGSVNGTNLDDNSGEI

SEQ ID NO: 41510 - protein, 33 aa, Artificial Sequence
  Description of Artificial Sequence: Synthetic polypeptide
DEEEIRTTNPVATEQYGSVSNMNLGQFGGNNQE

SEQ ID NO: 41511 - protein, 33 aa, Artificial Sequence
  Description of Artificial Sequence: Synthetic polypeptide
DEEEIRTTNPVATEQYGCVCSNTENLQGGSNTD

SEQ ID NO: 41512 - protein, 34 aa, Artificial Sequence
  Description of Artificial Sequence: Synthetic polypeptide
DEEEIRTTNPVATEQYGCVCSNTGNHQERGGSNR

SEQ ID NO: 41513 - protein, 34 aa, Artificial Sequence
  Description of Artificial Sequence: Synthetic polypeptide
DEEEIRTTNPVATEQYGCVCSNTGNLQRFGSNQI

SEQ ID NO: 41514 - protein, 31 aa, Artificial Sequence
  Description of Artificial Sequence: Synthetic polypeptide
DEEEIRTTNPVATEPYGSVVGTNMTRGGNGG

SEQ ID NO: 41515 - protein, 34 aa, Artificial Sequence
  Description of Artificial Sequence: Synthetic polypeptide
DEEEIRTTNPVATEPYGSVVPSCTGNLSGRDGNR

SEQ ID NO: 41516 - protein, 32 aa, Artificial Sequence
  Description of Artificial Sequence: Synthetic polypeptide
DEEEIRTTNPVATEQYGSVSMDNLVNSGVENE

SEQ ID NO: 41517 - protein, 32 aa, Artificial Sequence
  Description of Artificial Sequence: Synthetic polypeptide
DEEEIRTTNPVATEQYGSVSMEEELQNRGDEE

SEQ ID NO: 41518 - protein, 34 aa, Artificial Sequence
  Description of Artificial Sequence: Synthetic polypeptide
DEEEIRTTNPVATEAYGSVSTLNLSQNTGTNNRC

SEQ ID NO: 41519 - protein, 33 aa, Artificial Sequence
  Description of Artificial Sequence: Synthetic polypeptide
DEEEIRTTNPVATEFYGSVSTMNLVGQGGGNDG

SEQ ID NO: 41520 - protein, 33 aa, Artificial Sequence
  Description of Artificial Sequence: Synthetic polypeptide
DEEEIRTTNPVATEFYGSVSTMNLQPEQGINEQ

SEQ ID NO: 41521 - protein, 33 aa, Artificial Sequence
  Description of Artificial Sequence: Synthetic polypeptide
DEEEIRTTNPVATEQYGSVSNTENLQHFGSDQG

SEQ ID NO: 41522 - protein, 33 aa, Artificial Sequence
  Description of Artificial Sequence: Synthetic polypeptide
DEEEIRTTNPVATEAYGSVSTNELSDQNGGGNP

SEQ ID NO: 41523 - protein, 33 aa, Artificial Sequence
  Description of Artificial Sequence: Synthetic polypeptide
DEEEIRTTNPVATEQYGCVCSTENLQNGNSNQQ

SEQ ID NO: 41524 - protein, 33 aa, Artificial Sequence
  Description of Artificial Sequence: Synthetic polypeptide
DEEEIRTTNPVATEFYGSVSTMNLQEDGGENDQ

SEQ ID NO: 41525 - protein, 32 aa, Artificial Sequence
  Description of Artificial Sequence: Synthetic polypeptide
DEEEIRTTNPVATEFYGSVSTPNLQEDGEITG

SEQ ID NO: 41526 - protein, 32 aa, Artificial Sequence
  Description of Artificial Sequence: Synthetic polypeptide
DEEEIRTTNPVATEQYGSVSMGLMDQGENERL

SEQ ID NO: 41527 - protein, 33 aa, Artificial Sequence
  Description of Artificial Sequence: Synthetic polypeptide
DEEEIRTTNPVATEPYGSVVSTVNLEDRIVNRI

SEQ ID NO: 41528 - protein, 32 aa, Artificial Sequence
  Description of Artificial Sequence: Synthetic polypeptide
DEEEIRTTNPVATEPYGSVVSTVNLQDEIQNE

SEQ ID NO: 41529 - protein, 33 aa, Artificial Sequence
  Description of Artificial Sequence: Synthetic polypeptide
DEEEIRTTNPVATEQYGCVCSTENLQGIGSNDM

SEQ ID NO: 41530 - protein, 33 aa, Artificial Sequence
  Description of Artificial Sequence: Synthetic polypeptide
DEEEIRTTNPVATEQYGSVSMHPNLARQGVNDE

SEQ ID NO: 41531 - protein, 32 aa, Artificial Sequence
  Description of Artificial Sequence: Synthetic polypeptide
DEEEIRTTNPVATEQYGSVSMLNLNQQRVEMG

SEQ ID NO: 41532 - protein, 31 aa, Artificial Sequence
  Description of Artificial Sequence: Synthetic polypeptide
DEEEIACTNPVATEQYGSVATNLQEAGNVDD

SEQ ID NO: 41533 - protein, 29 aa, Artificial Sequence
  Description of Artificial Sequence: Synthetic peptide
DEEEIRTTNPVATEFYGSVSTGQQADLAE

SEQ ID NO: 41534 - protein, 34 aa, Artificial Sequence
  Description of Artificial Sequence: Synthetic polypeptide
DEEEIRTTNPVATEQYGSVISGTTNLQLEMGNGE

SEQ ID NO: 41535 - protein, 32 aa, Artificial Sequence
  Description of Artificial Sequence: Synthetic polypeptide
DEEEIRTTNPVATEPYGSVVVTVNLQDATDNR

SEQ ID NO: 41536 - protein, 32 aa, Artificial Sequence
  Description of Artificial Sequence: Synthetic polypeptide
DEEEIRTTNPVATEQYGSVSMLPLQRGVEELQ

SEQ ID NO: 41537 - protein, 31 aa, Artificial Sequence
  Description of Artificial Sequence: Synthetic polypeptide
DEEEIACTNPVATEQYGSVATNLQEAEGNEN

SEQ ID NO: 41538 - protein, 33 aa, Artificial Sequence
  Description of Artificial Sequence: Synthetic polypeptide
DEEEIRTTNPVATEQYGSVSMGLQMGVGVNERL

SEQ ID NO: 41539 - protein, 33 aa, Artificial Sequence
  Description of Artificial Sequence: Synthetic polypeptide
DEEEIRTTNPVATEQYGSVSNTFNDLQSEGLIM

SEQ ID NO: 41540 - protein, 34 aa, Artificial Sequence
  Description of Artificial Sequence: Synthetic polypeptide
DEEEIRTTNPVATEAYGSVSTGNLSVREGGNNRY

SEQ ID NO: 41541 - protein, 32 aa, Artificial Sequence
  Description of Artificial Sequence: Synthetic polypeptide
DEEAIRTTNPEATEQYGSVSITELQPRGGSQR

SEQ ID NO: 41542 - protein, 30 aa, Artificial Sequence
  Description of Artificial Sequence: Synthetic polypeptide
DEEEIATTNPVATEQYGDVSTEALNRENPL

SEQ ID NO: 41543 - protein, 32 aa, Artificial Sequence
  Description of Artificial Sequence: Synthetic polypeptide
DEEEIRTTNPVATEQYGSVNSTNGNNQEGFES

SEQ ID NO: 41544 - protein, 34 aa, Artificial Sequence
  Description of Artificial Sequence: Synthetic polypeptide
DEEEIRTTNPVATEAYGSVSCTNNLSTRTGTNRY

SEQ ID NO: 41545 - protein, 33 aa, Artificial Sequence
  Description of Artificial Sequence: Synthetic polypeptide
DEEEIRTTNPVATEAYGSVSCTNNLSTRVNNRY

SEQ ID NO: 41546 - protein, 32 aa, Artificial Sequence
  Description of Artificial Sequence: Synthetic polypeptide
DEEEIRTTNPVATEPYGSVSGTILNTSGGVNR

SEQ ID NO: 41547 - protein, 31 aa, Artificial Sequence
  Description of Artificial Sequence: Synthetic polypeptide
DEEEIRTTNPVATEQYGSVNSTNGHNEGGES

SEQ ID NO: 41548 - protein, 34 aa, Artificial Sequence
  Description of Artificial Sequence: Synthetic polypeptide
DEEEIRTTNPVATEQYGSVISGTGNLQNEGGGNE

SEQ ID NO: 41549 - protein, 33 aa, Artificial Sequence
  Description of Artificial Sequence: Synthetic polypeptide
DEEEIRTTNPVATEQYGCVCSTENPLQNGSNQA

SEQ ID NO: 41550 - protein, 28 aa, Artificial Sequence
  Description of Artificial Sequence: Synthetic peptide
DEEEIASTNPVCTEQYGDVSDILQSGNQ

SEQ ID NO: 41551 - protein, 33 aa, Artificial Sequence
  Description of Artificial Sequence: Synthetic polypeptide
DEEEIRTTNPVATEQYGSVSNTGALQGFGSNQN

SEQ ID NO: 41552 - protein, 28 aa, Artificial Sequence
  Description of Artificial Sequence: Synthetic peptide
DEEAIRTTNPDAYEGYGSCSTNLAVGND

SEQ ID NO: 41553 - protein, 32 aa, Artificial Sequence
  Description of Artificial Sequence: Synthetic polypeptide
DEEEIRTTNPVATEQYGCVCSTENLQYGSDQP

SEQ ID NO: 41554 - protein, 32 aa, Artificial Sequence
  Description of Artificial Sequence: Synthetic polypeptide
DEEEIRTTNPVATEQYGCVCSTENLQSGSEAY

SEQ ID NO: 41555 - protein, 33 aa, Artificial Sequence
  Description of Artificial Sequence: Synthetic polypeptide
DEEEIRTTNPVATEPYGSVSTTNLTQGGNNEGE

SEQ ID NO: 41556 - protein, 33 aa, Artificial Sequence
  Description of Artificial Sequence: Synthetic polypeptide
DEEEIRTTNPVATEQYGCVCSTENLQNGSNPII

SEQ ID NO: 41557 - protein, 32 aa, Artificial Sequence
  Description of Artificial Sequence: Synthetic polypeptide
DEEEIRTTNPVATEQYGSVSNTFNNGQGENED

SEQ ID NO: 41558 - protein, 33 aa, Artificial Sequence
  Description of Artificial Sequence: Synthetic polypeptide
DEEEIRTTNPVATEFYGSVSTSNLQSIGGGNED

SEQ ID NO: 41559 - protein, 33 aa, Artificial Sequence
  Description of Artificial Sequence: Synthetic polypeptide
DEEEIRTTNPVATEQYGSVISGTTNDQTEEGNE

SEQ ID NO: 41560 - protein, 33 aa, Artificial Sequence
  Description of Artificial Sequence: Synthetic polypeptide
DEEEIRTTNPVATEFYGSVSTSNLQIVGTGNEE

SEQ ID NO: 41561 - protein, 32 aa, Artificial Sequence
  Description of Artificial Sequence: Synthetic polypeptide
DEEEIRTTNPVATEAYGSVSTGLSQNGGGNND

SEQ ID NO: 41562 - protein, 33 aa, Artificial Sequence
  Description of Artificial Sequence: Synthetic polypeptide
DEEEIRTTNPVATEAYGSVSTGNEFSARGGNRY

SEQ ID NO: 41563 - protein, 33 aa, Artificial Sequence
  Description of Artificial Sequence: Synthetic polypeptide
DEEEIRTTNPVATEAYGSVSTGNLSEIGGNNRY

SEQ ID NO: 41564 - protein, 33 aa, Artificial Sequence
  Description of Artificial Sequence: Synthetic polypeptide
DEEEIRTTNPVATEAYGSVSTGNLSMRGGNNPY

SEQ ID NO: 41565 - protein, 33 aa, Artificial Sequence
  Description of Artificial Sequence: Synthetic polypeptide
DEEEIRTTNPVATEPYGSVSVSTVNLQDEEQNR

SEQ ID NO: 41566 - protein, 34 aa, Artificial Sequence
  Description of Artificial Sequence: Synthetic polypeptide
DEEEIRTTNPVATEQYGSVSNTFNLEQDGGENTS

SEQ ID NO: 41567 - protein, 33 aa, Artificial Sequence
  Description of Artificial Sequence: Synthetic polypeptide
DEEEIRTTNPVATEQYGSVSMMPNLQRQGVVDE

SEQ ID NO: 41568 - protein, 33 aa, Artificial Sequence
  Description of Artificial Sequence: Synthetic polypeptide
DEEEIRTTNPVATEPYGSVSCTNALVRTGGNNH

SEQ ID NO: 41569 - protein, 33 aa, Artificial Sequence
  Description of Artificial Sequence: Synthetic polypeptide
DEEEIRTTNPVATEQYGSVQSTNLPMRGGVEQD

SEQ ID NO: 41570 - protein, 34 aa, Artificial Sequence
  Description of Artificial Sequence: Synthetic polypeptide
DEEEIRTTNPVATEQYGSVISGTTNLQVEEGGNE

SEQ ID NO: 41571 - protein, 32 aa, Artificial Sequence
  Description of Artificial Sequence: Synthetic polypeptide
DEEEIRTTNPVATEQYGCVCSTENHQAGSNAM

SEQ ID NO: 41572 - protein, 34 aa, Artificial Sequence
  Description of Artificial Sequence: Synthetic polypeptide
DEEEIRTTNPVATEQYGSVSMNLDQGRFGQNQDL

SEQ ID NO: 41573 - protein, 33 aa, Artificial Sequence
  Description of Artificial Sequence: Synthetic polypeptide
DEEEIRTTNPVATEQYGSVNSTNDMVIMGNQER

SEQ ID NO: 41574 - protein, 32 aa, Artificial Sequence
  Description of Artificial Sequence: Synthetic polypeptide
DEEEIRTTNPVATEQYGCVCSTENEQRSGSEQ

SEQ ID NO: 41575 - protein, 32 aa, Artificial Sequence
  Description of Artificial Sequence: Synthetic polypeptide
DEEEIRTTNPVATEQYGCVCSTENEQRNSNDI

SEQ ID NO: 41576 - protein, 32 aa, Artificial Sequence
  Description of Artificial Sequence: Synthetic polypeptide
DEEEIRTTNPVATEPYGVVSSTVNLQDETENR

SEQ ID NO: 41577 - protein, 32 aa, Artificial Sequence
  Description of Artificial Sequence: Synthetic polypeptide
DEEEIRTTNPVATEPYGVVVSTVNLQDEIGNS

SEQ ID NO: 41578 - protein, 33 aa, Artificial Sequence
  Description of Artificial Sequence: Synthetic polypeptide
DEEEIRTTNPVATEQYGSVSNTELQHFGSENQS

SEQ ID NO: 41579 - protein, 33 aa, Artificial Sequence
  Description of Artificial Sequence: Synthetic polypeptide
DEEEIRTTNPVATEQYGCVCSTENEQRFGSNAI

SEQ ID NO: 41580 - protein, 31 aa, Artificial Sequence
  Description of Artificial Sequence: Synthetic polypeptide
DEEEIRTTNPVATEQYGSVISPENNIERGQQ

SEQ ID NO: 41581 - protein, 33 aa, Artificial Sequence
  Description of Artificial Sequence: Synthetic polypeptide
DEEEIRTTNPVATEPYGYAVCSTVNLQPRIVNR

SEQ ID NO: 41582 - protein, 33 aa, Artificial Sequence
  Description of Artificial Sequence: Synthetic polypeptide
DEEEIRTTNPVATEFYGSVSGDGTNLQEGNNII

SEQ ID NO: 41583 - protein, 34 aa, Artificial Sequence
  Description of Artificial Sequence: Synthetic polypeptide
DEEEIRTTNPVATEPYGYSVSETVNLQSRNIVNR

SEQ ID NO: 41584 - protein, 32 aa, Artificial Sequence
  Description of Artificial Sequence: Synthetic polypeptide
DEEEIRTTNPVATEQYGCVCSTELQNSGSERG

SEQ ID NO: 41585 - protein, 33 aa, Artificial Sequence
  Description of Artificial Sequence: Synthetic polypeptide
DEEEIRTTNPVATEPYGYSVSPTVNQQPRIVNR

SEQ ID NO: 41586 - protein, 32 aa, Artificial Sequence
  Description of Artificial Sequence: Synthetic polypeptide
DEEEIRTTNPVATEQYGCVCSTELQHMGSNAA

SEQ ID NO: 41587 - protein, 34 aa, Artificial Sequence
  Description of Artificial Sequence: Synthetic polypeptide
DEEEIRTTNPVATEQWGSVVPSCTQNLSPRGNNR

SEQ ID NO: 41588 - protein, 31 aa, Artificial Sequence
  Description of Artificial Sequence: Synthetic polypeptide
DEEEIRTTNPVATEQYGCVCSTELQHFGDQA

SEQ ID NO: 41589 - protein, 31 aa, Artificial Sequence
  Description of Artificial Sequence: Synthetic polypeptide
DEEEIRTTNPVATEQYGCVCSTELQGSNSDQ

SEQ ID NO: 41590 - protein, 31 aa, Artificial Sequence
  Description of Artificial Sequence: Synthetic polypeptide
DEEEIRTTNPVATEQYGCVCSTELQGNSQQM

SEQ ID NO: 41591 - protein, 34 aa, Artificial Sequence
  Description of Artificial Sequence: Synthetic polypeptide
DEEEIRTTNPVATEQYGSVISPLWDLQREGENRE

SEQ ID NO: 41592 - protein, 31 aa, Artificial Sequence
  Description of Artificial Sequence: Synthetic polypeptide
DEEEIRTTNPVATEQYGSVSMNLEEMGEPDF

SEQ ID NO: 41593 - protein, 30 aa, Artificial Sequence
  Description of Artificial Sequence: Synthetic polypeptide
DEEEIRTTNPVATEQYGSVSMNLEEVETDG

SEQ ID NO: 41594 - protein, 31 aa, Artificial Sequence
  Description of Artificial Sequence: Synthetic polypeptide
DEEEIRTTNPVATEQFGEVVSTNMSQRTGSQ

SEQ ID NO: 41595 - protein, 32 aa, Artificial Sequence
  Description of Artificial Sequence: Synthetic polypeptide
DEEEIRTTNPVATEQYGSVISPINLQRNMVDM

SEQ ID NO: 41596 - protein, 33 aa, Artificial Sequence
  Description of Artificial Sequence: Synthetic polypeptide
DEEEIRTTNPVATEQYGCVCSTENHQRSGSNDA

SEQ ID NO: 41597 - protein, 33 aa, Artificial Sequence
  Description of Artificial Sequence: Synthetic polypeptide
DEEEIRTTNPVATEAYGSVSTTNLTQQGGNNGE

SEQ ID NO: 41598 - protein, 33 aa, Artificial Sequence
  Description of Artificial Sequence: Synthetic polypeptide
DEEEIRTTNPVATEAYGSVSTTNLSQGGNNNTD

SEQ ID NO: 41599 - protein, 34 aa, Artificial Sequence
  Description of Artificial Sequence: Synthetic polypeptide
DEEEIRTTNPVATEQYGSVISGTTNLVQEGGGNE

SEQ ID NO: 41600 - protein, 31 aa, Artificial Sequence
  Description of Artificial Sequence: Synthetic polypeptide
DEEEIATTNPVATEQYGCVCSWNLQNFNSNR

SEQ ID NO: 41601 - protein, 29 aa, Artificial Sequence
  Description of Artificial Sequence: Synthetic peptide
DEEEIASTNPVCTEQYGVVSDINLQSGNQ

SEQ ID NO: 41602 - protein, 31 aa, Artificial Sequence
  Description of Artificial Sequence: Synthetic polypeptide
DEEAIRTTNPVATEAWGSVISTNLQKGPPNL

SEQ ID NO: 41603 - protein, 33 aa, Artificial Sequence
  Description of Artificial Sequence: Synthetic polypeptide
DEEEIRTTNPVATEQYGSVQSTNLMVQVGPEDL

SEQ ID NO: 41604 - protein, 32 aa, Artificial Sequence
  Description of Artificial Sequence: Synthetic polypeptide
DEEEIRTTNPVATEPYGTVVSTQNLQDETENR

SEQ ID NO: 41605 - protein, 33 aa, Artificial Sequence
  Description of Artificial Sequence: Synthetic polypeptide
DEEEIRTTNPVATEQYGSVQSTNLEQERMTPPD

SEQ ID NO: 41606 - protein, 31 aa, Artificial Sequence
  Description of Artificial Sequence: Synthetic polypeptide
DEEEIRTTNPVATEQYGSVISNLVREGQEEN

SEQ ID NO: 41607 - protein, 33 aa, Artificial Sequence
  Description of Artificial Sequence: Synthetic polypeptide
DEEEIRTTNPVATEQYGSVSMNDLTQMGGNEID

SEQ ID NO: 41608 - protein, 33 aa, Artificial Sequence
  Description of Artificial Sequence: Synthetic polypeptide
DEEEIRTTNPVATEQYGSVSMNDLYQMGGPNID

SEQ ID NO: 41609 - protein, 34 aa, Artificial Sequence
  Description of Artificial Sequence: Synthetic polypeptide
DEEEIRTTNPVATEAYGSVSTPNELSARGGNNRY

SEQ ID NO: 41610 - protein, 32 aa, Artificial Sequence
  Description of Artificial Sequence: Synthetic polypeptide
DEEEIRTTNPVATEAYGSVSTPNLDEFGNNEE

SEQ ID NO: 41611 - protein, 34 aa, Artificial Sequence
  Description of Artificial Sequence: Synthetic polypeptide
DEEEIRTTNPVATEPYGVSPSTVNDLQDRDGNDR

SEQ ID NO: 41612 - protein, 33 aa, Artificial Sequence
  Description of Artificial Sequence: Synthetic polypeptide
DEEEIRTTNPVATEPYGVSTSTVNDLQDRITNR

SEQ ID NO: 41613 - protein, 32 aa, Artificial Sequence
  Description of Artificial Sequence: Synthetic polypeptide
DEEEIRTTNPVATEQYGSVQSTNGGEPGNLMG

SEQ ID NO: 41614 - protein, 32 aa, Artificial Sequence
  Description of Artificial Sequence: Synthetic polypeptide
DEEEIRTTNPVATEQYGCVCSTENLEYFGSNV

SEQ ID NO: 41615 - protein, 29 aa, Artificial Sequence
  Description of Artificial Sequence: Synthetic peptide
DEEEIASTNPVCTEQYGVVSDNLQSGMNQ

SEQ ID NO: 41616 - protein, 33 aa, Artificial Sequence
  Description of Artificial Sequence: Synthetic polypeptide
DEEEIRTTNPVATEFYGSVSGTSNLQGGTGNGT

SEQ ID NO: 41617 - protein, 33 aa, Artificial Sequence
  Description of Artificial Sequence: Synthetic polypeptide
DEEEIRTTNPVATEAYGSVSTTNLNQLGGNSNQ

SEQ ID NO: 41618 - protein, 33 aa, Artificial Sequence
  Description of Artificial Sequence: Synthetic polypeptide
DEEEIRTTNPVATEAYGSVSTTNLQGQAGNNTD

SEQ ID NO: 41619 - protein, 32 aa, Artificial Sequence
  Description of Artificial Sequence: Synthetic polypeptide
DEEEIRTTNPVATEQYGSVSNTELQNFGSVDY

SEQ ID NO: 41620 - protein, 33 aa, Artificial Sequence
  Description of Artificial Sequence: Synthetic polypeptide
DEEEIRTTNPVATEQYGSVSNTELQNFGSNFQP

SEQ ID NO: 41621 - protein, 32 aa, Artificial Sequence
  Description of Artificial Sequence: Synthetic polypeptide
DEEEIRTTNPVATEQYGCVCSTENHTHGSNRG

SEQ ID NO: 41622 - protein, 31 aa, Artificial Sequence
  Description of Artificial Sequence: Synthetic polypeptide
DEEEIRTTNPVATEPYGVTISTAELQRDGNN

SEQ ID NO: 41623 - protein, 32 aa, Artificial Sequence
  Description of Artificial Sequence: Synthetic polypeptide
DEEEIRTTNPVATEPYGVTVSTVNLQDESTNR

SEQ ID NO: 41624 - protein, 33 aa, Artificial Sequence
  Description of Artificial Sequence: Synthetic polypeptide
DEEEIRTTNPVATEQYGCVCSTENLQEGGSNDI

SEQ ID NO: 41625 - protein, 33 aa, Artificial Sequence
  Description of Artificial Sequence: Synthetic polypeptide
DEEEIRTTNPVATEQYGSVISETELLQRNGTQN

SEQ ID NO: 41626 - protein, 33 aa, Artificial Sequence
  Description of Artificial Sequence: Synthetic polypeptide
DEEEIRTTNPVATEAYGSVSCTNLSQIVENNRP

SEQ ID NO: 41627 - protein, 30 aa, Artificial Sequence
  Description of Artificial Sequence: Synthetic polypeptide
DEEEIRTTNPVATEPYGSVDDTNMTEGGNG

SEQ ID NO: 41628 - protein, 34 aa, Artificial Sequence
  Description of Artificial Sequence: Synthetic polypeptide
DEEEIRTTNPVATEAYGSVPSCTFALSQRHGGNR

SEQ ID NO: 41629 - protein, 32 aa, Artificial Sequence
  Description of Artificial Sequence: Synthetic polypeptide
DEEEIACTNPVATEQYGSVATNLQGAGENNRW

SEQ ID NO: 41630 - protein, 32 aa, Artificial Sequence
  Description of Artificial Sequence: Synthetic polypeptide
DEEEIATTNPVATEQYGKVSTNSLSQVRGGEQ

SEQ ID NO: 41631 - protein, 31 aa, Artificial Sequence
  Description of Artificial Sequence: Synthetic polypeptide
DEEEIRTTNPVATEQYGSVSNTNDEGGKDVD

SEQ ID NO: 41632 - protein, 31 aa, Artificial Sequence
  Description of Artificial Sequence: Synthetic polypeptide
DEEEIAPTNPCATEQYGIVSTCPNLQRNGTR

SEQ ID NO: 41633 - protein, 34 aa, Artificial Sequence
  Description of Artificial Sequence: Synthetic polypeptide
DEEEIRTTNPVATEPYGSTVSCTGNLSTRGINNR

SEQ ID NO: 41634 - protein, 34 aa, Artificial Sequence
  Description of Artificial Sequence: Synthetic polypeptide
DEEEIRTTNPVATEQYGSVQSTPNQIQEQEGNER

SEQ ID NO: 41635 - protein, 32 aa, Artificial Sequence
  Description of Artificial Sequence: Synthetic polypeptide
DEEEIATTNPVATEQYGEVSTNLQLGDGNNSG

SEQ ID NO: 41636 - protein, 33 aa, Artificial Sequence
  Description of Artificial Sequence: Synthetic polypeptide
DEEEIRTTNPVATEPYGSTVSCTNAHQETGNNR

SEQ ID NO: 41637 - protein, 34 aa, Artificial Sequence
  Description of Artificial Sequence: Synthetic polypeptide
DEEEIRTTNPVATEPYGSTVSCTNLSTTRGTNNR

SEQ ID NO: 41638 - protein, 33 aa, Artificial Sequence
  Description of Artificial Sequence: Synthetic polypeptide
DEEEIRTTNPVATEQYGSVSNTMNMEQGGENTS

SEQ ID NO: 41639 - protein, 32 aa, Artificial Sequence
  Description of Artificial Sequence: Synthetic polypeptide
DEEEIRTTNPVATEPYGNVVSTVNMQDRNSNR

SEQ ID NO: 41640 - protein, 33 aa, Artificial Sequence
  Description of Artificial Sequence: Synthetic polypeptide
DEEEIRTTNPVATEPYGSTVSCTNLSVRGTNNQ

SEQ ID NO: 41641 - protein, 32 aa, Artificial Sequence
  Description of Artificial Sequence: Synthetic polypeptide
DEEEIRTTNPVATEPYGSVCETNQYHNRGGNR

SEQ ID NO: 41642 - protein, 32 aa, Artificial Sequence
  Description of Artificial Sequence: Synthetic polypeptide
DEEEIATTNPVATEQYGEVSTNLQGDAGNDEQ

SEQ ID NO: 41643 - protein, 33 aa, Artificial Sequence
  Description of Artificial Sequence: Synthetic polypeptide
DEEEIRTTNPVATEQYGSVQSTPNGIQEQEGSR

SEQ ID NO: 41644 - protein, 33 aa, Artificial Sequence
  Description of Artificial Sequence: Synthetic polypeptide
DEEEIRTTNPVATEQYGSVQSTPNCIPEQEGDR

SEQ ID NO: 41645 - protein, 34 aa, Artificial Sequence
  Description of Artificial Sequence: Synthetic polypeptide
DEEEIRTTNPVATEQYGSVSNTMLLQRVGENEQM

SEQ ID NO: 41646 - protein, 34 aa, Artificial Sequence
  Description of Artificial Sequence: Synthetic polypeptide
DEEEIRTTNPVATEAYGSVPSCTNNLSTRGGNRY

SEQ ID NO: 41647 - protein, 33 aa, Artificial Sequence
  Description of Artificial Sequence: Synthetic polypeptide
DEEEIRTTNPVATEQYGSVQSTPNCINEQEMNR

SEQ ID NO: 41648 - protein, 31 aa, Artificial Sequence
  Description of Artificial Sequence: Synthetic polypeptide
DEEEIRTTNPVATEQYGSVSNTMLFNPNIAA

SEQ ID NO: 41649 - protein, 32 aa, Artificial Sequence
  Description of Artificial Sequence: Synthetic polypeptide
DEEEIRTTNPVATEQYGSVIEPTNLQPVGELE

SEQ ID NO: 41650 - protein, 32 aa, Artificial Sequence
  Description of Artificial Sequence: Synthetic polypeptide
DEEEIRTTNPVATEPYGSVCETYLTRVGQNAR

SEQ ID NO: 41651 - protein, 33 aa, Artificial Sequence
  Description of Artificial Sequence: Synthetic polypeptide
DEEEIRTTNPVATEPYGSVCFCTNLSTREGGNR

SEQ ID NO: 41652 - protein, 32 aa, Artificial Sequence
  Description of Artificial Sequence: Synthetic polypeptide
DEEEIATTNPVATEQYGEVSTNLQGDGPNGHG

SEQ ID NO: 41653 - protein, 34 aa, Artificial Sequence
  Description of Artificial Sequence: Synthetic polypeptide
DEEEIRTTNPVATEPYGNTVPSTGNLSQRGGNRA

SEQ ID NO: 41654 - protein, 34 aa, Artificial Sequence
  Description of Artificial Sequence: Synthetic polypeptide
DEEEIRTTNPVATEQYGSVICPTNPLQRIGDNIQ

SEQ ID NO: 41655 - protein, 33 aa, Artificial Sequence
  Description of Artificial Sequence: Synthetic polypeptide
DEEEIRTTNPVATEQYGSVIATTNLQFVGEVDR

SEQ ID NO: 41656 - protein, 32 aa, Artificial Sequence
  Description of Artificial Sequence: Synthetic polypeptide
DEEEIRTTNPVATEPYGISVSTVNLQDSIKER

SEQ ID NO: 41657 - protein, 33 aa, Artificial Sequence
  Description of Artificial Sequence: Synthetic polypeptide
DEEEIRTTNPVATEQYGSVNSTNNLQSLQTNDQ

SEQ ID NO: 41658 - protein, 32 aa, Artificial Sequence
  Description of Artificial Sequence: Synthetic polypeptide
DEEEIACTNPVATEQYGSVATNLQNDGGNERE

SEQ ID NO: 41659 - protein, 30 aa, Artificial Sequence
  Description of Artificial Sequence: Synthetic polypeptide
DEEEIRTTNPVATEQYGCVCSTEPQNGDDP

SEQ ID NO: 41660 - protein, 31 aa, Artificial Sequence
  Description of Artificial Sequence: Synthetic polypeptide
DEEEIRTTNPVATEQYGCVCSTEPQEGGSER

SEQ ID NO: 41661 - protein, 34 aa, Artificial Sequence
  Description of Artificial Sequence: Synthetic polypeptide
DEEEIRTTNPVATEPYGISVSTVNNLQDRIKNDR

SEQ ID NO: 41662 - protein, 32 aa, Artificial Sequence
  Description of Artificial Sequence: Synthetic polypeptide
DEEEIRTTNPVATEQYGSVIAPTPLQDDNQRQ

SEQ ID NO: 41663 - protein, 33 aa, Artificial Sequence
  Description of Artificial Sequence: Synthetic polypeptide
DEEEIRTTNPVATEQYGCVCSTEPLERFGSNRF

SEQ ID NO: 41664 - protein, 32 aa, Artificial Sequence
  Description of Artificial Sequence: Synthetic polypeptide
DEEEIRTTNPVATEPYGISVSTVYLQDRIKNE

SEQ ID NO: 41665 - protein, 32 aa, Artificial Sequence
  Description of Artificial Sequence: Synthetic polypeptide
DEEEIRTTNPVATEPYGISVSWVNLQDRISGR

SEQ ID NO: 41666 - protein, 32 aa, Artificial Sequence
  Description of Artificial Sequence: Synthetic polypeptide
DEEEIRTTNPVATEQYGSVIATGPLQRDNQEQ

SEQ ID NO: 41667 - protein, 33 aa, Artificial Sequence
  Description of Artificial Sequence: Synthetic polypeptide
DEEEIRTTNPVATEPYGITVSTVNLQDGGIKNR

SEQ ID NO: 41668 - protein, 33 aa, Artificial Sequence
  Description of Artificial Sequence: Synthetic polypeptide
DEEEIRTTNPVATEAYGSVNTANMLSTRGGNNR

SEQ ID NO: 41669 - protein, 34 aa, Artificial Sequence
  Description of Artificial Sequence: Synthetic polypeptide
DEEEIRTTNPVATEQYGSVQSTTNELQNGVDERM

SEQ ID NO: 41670 - protein, 32 aa, Artificial Sequence
  Description of Artificial Sequence: Synthetic polypeptide
DEEEIRTTNPVATEPYGIVVSTVNLQDDTVNR

SEQ ID NO: 41671 - protein, 32 aa, Artificial Sequence
  Description of Artificial Sequence: Synthetic polypeptide
DEEEIRTTNPVATEPYGIVVSTVNLQDGIVNA

SEQ ID NO: 41672 - protein, 30 aa, Artificial Sequence
  Description of Artificial Sequence: Synthetic polypeptide
DEEEIACTNPVATEQYGSVATNLQNANNTH

SEQ ID NO: 41673 - protein, 31 aa, Artificial Sequence
  Description of Artificial Sequence: Synthetic polypeptide
DEEEIRTTNPVATEPYGKTISTNESQRVGNF

SEQ ID NO: 41674 - protein, 33 aa, Artificial Sequence
  Description of Artificial Sequence: Synthetic polypeptide
DEEEIRTTNPVATEQYGSVSNTNDMEQTPGNQE

SEQ ID NO: 41675 - protein, 33 aa, Artificial Sequence
  Description of Artificial Sequence: Synthetic polypeptide
DEEEIRTTNPVATEQYGSVNSTNNGQGEFGGNG

SEQ ID NO: 41676 - protein, 32 aa, Artificial Sequence
  Description of Artificial Sequence: Synthetic polypeptide
DEEEIRTTNPVATEQYGSVSNTNDLTSIGSIE

SEQ ID NO: 41677 - protein, 33 aa, Artificial Sequence
  Description of Artificial Sequence: Synthetic polypeptide
DEEEIRTTNPVATEQYGSVNSTNNDERGNEEMY

SEQ ID NO: 41678 - protein, 34 aa, Artificial Sequence
  Description of Artificial Sequence: Synthetic polypeptide
DEEEIRTTNPVATEQYGSVSNTNDLQREGSEFED

SEQ ID NO: 41679 - protein, 33 aa, Artificial Sequence
  Description of Artificial Sequence: Synthetic polypeptide
DEEEIRTTNPVATEAYGSVPNCTNALQRGGDDR

SEQ ID NO: 41680 - protein, 30 aa, Artificial Sequence
  Description of Artificial Sequence: Synthetic polypeptide
DEEEIACTNPVATEQYGSVATNLQGNPEGG

SEQ ID NO: 41681 - protein, 34 aa, Artificial Sequence
  Description of Artificial Sequence: Synthetic polypeptide
DEEEIRTTNPVATEQYGSVIETNNMLQFVGEANR

SEQ ID NO: 41682 - protein, 32 aa, Artificial Sequence
  Description of Artificial Sequence: Synthetic polypeptide
DEEEIRTTNPVATEQYGSVIETSLQPVGQNEG

SEQ ID NO: 41683 - protein, 32 aa, Artificial Sequence
  Description of Artificial Sequence: Synthetic polypeptide
DEEEIRTTNPVATEQYGCVCSTENTQYGSNQF

SEQ ID NO: 41684 - protein, 33 aa, Artificial Sequence
  Description of Artificial Sequence: Synthetic polypeptide
DEEEIRTTNPVATEQYGSVIETTNLQFGELDRE

SEQ ID NO: 41685 - protein, 31 aa, Artificial Sequence
  Description of Artificial Sequence: Synthetic polypeptide
DEEEIRTTNPVATEPYGSVCFTNLTNFGSNA

SEQ ID NO: 41686 - protein, 31 aa, Artificial Sequence
  Description of Artificial Sequence: Synthetic polypeptide
DEEEIRTTNPVATEPYGSVCFTNLTRGGEHF

SEQ ID NO: 41687 - protein, 32 aa, Artificial Sequence
  Description of Artificial Sequence: Synthetic polypeptide
DEEEIASTNPVATEQYGSVSTNPTGQMRVGNV

SEQ ID NO: 41688 - protein, 33 aa, Artificial Sequence
  Description of Artificial Sequence: Synthetic polypeptide
DEEEIRTTNPVATEAYGSVSCTNALSQRGGDDQ

SEQ ID NO: 41689 - protein, 32 aa, Artificial Sequence
  Description of Artificial Sequence: Synthetic polypeptide
DEEEIASTNPVATEQYGSVSTNPTIQSRVGNV

SEQ ID NO: 41690 - protein, 31 aa, Artificial Sequence
  Description of Artificial Sequence: Synthetic polypeptide
DEEEIACTNPVATEQYGSVATNLQEDGNNQN

SEQ ID NO: 41691 - protein, 31 aa, Artificial Sequence
  Description of Artificial Sequence: Synthetic polypeptide
DEEEIRTTNPVATEQYGSVILTNLVEGPEIP

SEQ ID NO: 41692 - protein, 30 aa, Artificial Sequence
  Description of Artificial Sequence: Synthetic polypeptide
DEEEIRTTNPVATEPYGSVCFTNLTSGGDM

SEQ ID NO: 41693 - protein, 33 aa, Artificial Sequence
  Description of Artificial Sequence: Synthetic polypeptide
DEEEIRTTNPVATEPYGSVCFTNPLTPRIGNMR

SEQ ID NO: 41694 - protein, 33 aa, Artificial Sequence
  Description of Artificial Sequence: Synthetic polypeptide
DEEEIRTTNPVATEQYGSVILTNMLMQAGELER

SEQ ID NO: 41695 - protein, 33 aa, Artificial Sequence
  Description of Artificial Sequence: Synthetic polypeptide
DEEEIRTTNPVATEQYGSVILTNMLQEGELVRE

SEQ ID NO: 41696 - protein, 32 aa, Artificial Sequence
  Description of Artificial Sequence: Synthetic polypeptide
DEEEIRTTNPVATEQYGSVIMLTLQRGVTENV

SEQ ID NO: 41697 - protein, 33 aa, Artificial Sequence
  Description of Artificial Sequence: Synthetic polypeptide
DEEEIRTTNPVATEQYGSVSNTGNIGQNGGGNT

SEQ ID NO: 41698 - protein, 32 aa, Artificial Sequence
  Description of Artificial Sequence: Synthetic polypeptide
DEEEIRTTNPVATEPYGSVCFTNQHGRGGNRL

SEQ ID NO: 41699 - protein, 32 aa, Artificial Sequence
  Description of Artificial Sequence: Synthetic polypeptide
DEEEIRTTNPVATEPYGSVCFTSNQTNRGQNR

SEQ ID NO: 41700 - protein, 32 aa, Artificial Sequence
  Description of Artificial Sequence: Synthetic polypeptide
DEEEIRTTNPVATEQYGSVINNLEQRLENGLA

SEQ ID NO: 41701 - protein, 33 aa, Artificial Sequence
  Description of Artificial Sequence: Synthetic polypeptide
DEEEIRTTNPVATEQYGSVNSTNLAERETENEQ

SEQ ID NO: 41702 - protein, 32 aa, Artificial Sequence
  Description of Artificial Sequence: Synthetic polypeptide
DEEEIRTTNPVATEPYGSVCFVANLTQIGNNR

SEQ ID NO: 41703 - protein, 30 aa, Artificial Sequence
  Description of Artificial Sequence: Synthetic polypeptide
DEEEIRTTNPVATEQYGSVIPNLIETQEVN

SEQ ID NO: 41704 - protein, 31 aa, Artificial Sequence
  Description of Artificial Sequence: Synthetic polypeptide
DEEEIRTTNPVATEQYGSVIPPTLHERDNRQ

SEQ ID NO: 41705 - protein, 34 aa, Artificial Sequence
  Description of Artificial Sequence: Synthetic polypeptide
DEEEIRTTNPVATEQYGSVIPTNLEQQRTENERA

SEQ ID NO: 41706 - protein, 30 aa, Artificial Sequence
  Description of Artificial Sequence: Synthetic polypeptide
DEEEIACTNPVATEQYGSVATNLQEDGEGT

SEQ ID NO: 41707 - protein, 30 aa, Artificial Sequence
  Description of Artificial Sequence: Synthetic polypeptide
DEEAIRSTNPVATEQYGSVSVNQDRGSNSM

SEQ ID NO: 41708 - protein, 33 aa, Artificial Sequence
  Description of Artificial Sequence: Synthetic polypeptide
DEEEIRTTNPVATEQYGSVISENSGQPRIGNQI

SEQ ID NO: 41709 - protein, 30 aa, Artificial Sequence
  Description of Artificial Sequence: Synthetic polypeptide
DEEAIRTCNPVATEQYGSVSTYLQGNNQIE

SEQ ID NO: 41710 - protein, 29 aa, Artificial Sequence
  Description of Artificial Sequence: Synthetic peptide
DEEEIASTNPVATEQYGSVSTDLESGEDQ

SEQ ID NO: 41711 - protein, 33 aa, Artificial Sequence
  Description of Artificial Sequence: Synthetic polypeptide
DEEAIRTTNPVATEEYWGSVCSNTPNLTRNGNR

SEQ ID NO: 41712 - protein, 33 aa, Artificial Sequence
  Description of Artificial Sequence: Synthetic polypeptide
DEEEIRTTNPVATEPYGSVCFTNLSTRTGGNPR

SEQ ID NO: 41713 - protein, 33 aa, Artificial Sequence
  Description of Artificial Sequence: Synthetic polypeptide
DEEEIRTTNPVATEQYGSVNSTNLDEGDDETRM

SEQ ID NO: 41714 - protein, 32 aa, Artificial Sequence
  Description of Artificial Sequence: Synthetic polypeptide
DEEEIRTTNPVATEGYGCTCSTNELQRFGSNQ

SEQ ID NO: 41715 - protein, 33 aa, Artificial Sequence
  Description of Artificial Sequence: Synthetic polypeptide
DEEEIRTTNPVATEQYGSVIETTNLQFGENDVL

SEQ ID NO: 41716 - protein, 30 aa, Artificial Sequence
  Description of Artificial Sequence: Synthetic polypeptide
DEEEIASTNPVATEQWGSVSDNEPQREGNQ

SEQ ID NO: 41717 - protein, 29 aa, Artificial Sequence
  Description of Artificial Sequence: Synthetic peptide
DEEEIRTTNPVATEQYGSVIGEGGERGEN

SEQ ID NO: 41718 - protein, 30 aa, Artificial Sequence
  Description of Artificial Sequence: Synthetic polypeptide
DEEEIRTTNPVATEGYGCSCSTNEQRPSDQ

SEQ ID NO: 41719 - protein, 32 aa, Artificial Sequence
  Description of Artificial Sequence: Synthetic polypeptide
DEEEIRTTNPVATEPYGSVCFTANLNTSGGNR

SEQ ID NO: 41720 - protein, 32 aa, Artificial Sequence
  Description of Artificial Sequence: Synthetic polypeptide
DEEEIRTTNPVATEPYGSVCFTANLTPVGVNR

SEQ ID NO: 41721 - protein, 31 aa, Artificial Sequence
  Description of Artificial Sequence: Synthetic polypeptide
DEEEIRTTNPVATEPYGSVCFTDLTRGGQRE

SEQ ID NO: 41722 - protein, 33 aa, Artificial Sequence
  Description of Artificial Sequence: Synthetic polypeptide
DEEEIRTTNPVATEQYGSVIGPTPNLEREVNRF

SEQ ID NO: 41723 - protein, 32 aa, Artificial Sequence
  Description of Artificial Sequence: Synthetic polypeptide
DEEEIRTTNPVATEQYGSVNSTNLDWGSMTEG

SEQ ID NO: 41724 - protein, 31 aa, Artificial Sequence
  Description of Artificial Sequence: Synthetic polypeptide
DEEEIRTTNPVATEPYGSVCFTDNDTRGGDR

SEQ ID NO: 41725 - protein, 32 aa, Artificial Sequence
  Description of Artificial Sequence: Synthetic polypeptide
DEEEIRTTNPVATEPYGSVCFTDNHDRGGDNR

SEQ ID NO: 41726 - protein, 32 aa, Artificial Sequence
  Description of Artificial Sequence: Synthetic polypeptide
DEEEIRTTNPVATEAYGSVSCTANGSQRGGSF

SEQ ID NO: 41727 - protein, 33 aa, Artificial Sequence
  Description of Artificial Sequence: Synthetic polypeptide
DEEEIRTTNPVATEPYGSVCFTDNLDRGGQNDR

SEQ ID NO: 41728 - protein, 29 aa, Artificial Sequence
  Description of Artificial Sequence: Synthetic peptide
DEEAICTVNPVATEAYGSVSVNLERGNVD

SEQ ID NO: 41729 - protein, 32 aa, Artificial Sequence
  Description of Artificial Sequence: Synthetic polypeptide
DEEEIRTTNPVATEPYGSVCFTMGLTQIGGNR

SEQ ID NO: 41730 - protein, 31 aa, Artificial Sequence
  Description of Artificial Sequence: Synthetic polypeptide
DEEEIRTTNPVATEQYGSVIITNLQTPETEF

SEQ ID NO: 41731 - protein, 31 aa, Artificial Sequence
  Description of Artificial Sequence: Synthetic polypeptide
DEEEIRTTNPVATEPYGSVCFTNDTGGGNRG

SEQ ID NO: 41732 - protein, 31 aa, Artificial Sequence
  Description of Artificial Sequence: Synthetic polypeptide
DEEEIRTTNPVATEQYGSVIITPALQHLNQA

SEQ ID NO: 41733 - protein, 32 aa, Artificial Sequence
  Description of Artificial Sequence: Synthetic polypeptide
DEEEIRTTNPVATEPYGSVCFTNDTRGGDNER

SEQ ID NO: 41734 - protein, 30 aa, Artificial Sequence
  Description of Artificial Sequence: Synthetic polypeptide
DEEAICTVNPVATEIYGSVSTDNLERGNVG

SEQ ID NO: 41735 - protein, 32 aa, Artificial Sequence
  Description of Artificial Sequence: Synthetic polypeptide
DEEEIRTTNPVATEQYGSVILANLEVDRGNND

SEQ ID NO: 41736 - protein, 28 aa, Artificial Sequence
  Description of Artificial Sequence: Synthetic peptide
DEEAICTVNPVATEPYGSVSDNLENGNV

SEQ ID NO: 41737 - protein, 29 aa, Artificial Sequence
  Description of Artificial Sequence: Synthetic peptide
DEEAICTVNPVATESYGSVSNDNLERGNV

SEQ ID NO: 41738 - protein, 33 aa, Artificial Sequence
  Description of Artificial Sequence: Synthetic polypeptide
DEEEIRTTNPVATEQYGSVNSTNLDQGNQNQEG

SEQ ID NO: 41739 - protein, 29 aa, Artificial Sequence
  Description of Artificial Sequence: Synthetic peptide
DEEEIRTTNPVATEGYGCICSTNEQHPNF

SEQ ID NO: 41740 - protein, 32 aa, Artificial Sequence
  Description of Artificial Sequence: Synthetic polypeptide
DEEEIRTTNPVATEQYGSVIAPTNLGRGSEDE

SEQ ID NO: 41741 - protein, 32 aa, Artificial Sequence
  Description of Artificial Sequence: Synthetic polypeptide
DEEEIRTTNPVATEQYGSVSMNLHQRSDEDYE

SEQ ID NO: 41742 - protein, 32 aa, Artificial Sequence
  Description of Artificial Sequence: Synthetic polypeptide
DEEEIRTTNPVATEQYGSVSMNLMADGSDQRG

SEQ ID NO: 41743 - protein, 32 aa, Artificial Sequence
  Description of Artificial Sequence: Synthetic polypeptide
DEEEIRTTNPVATEQYGCVCSSNLQNFMSNNR

SEQ ID NO: 41744 - protein, 32 aa, Artificial Sequence
  Description of Artificial Sequence: Synthetic polypeptide
DEEEIRTTNPVATEQYGSVQSNTEDLQEINGQ

SEQ ID NO: 41745 - protein, 31 aa, Artificial Sequence
  Description of Artificial Sequence: Synthetic polypeptide
DEEEIACTNPVATEQYGCVATNLQREGENEN

SEQ ID NO: 41746 - protein, 33 aa, Artificial Sequence
  Description of Artificial Sequence: Synthetic polypeptide
DEEEIRTTNPVATEQYGSVSNSVNLQFTNGNID

SEQ ID NO: 41747 - protein, 29 aa, Artificial Sequence
  Description of Artificial Sequence: Synthetic peptide
DEEEIRTTNPVATEEYGCISTNEQHSSNF

SEQ ID NO: 41748 - protein, 29 aa, Artificial Sequence
  Description of Artificial Sequence: Synthetic peptide
DEEEIATTNPVATEQWGTVSAENEQQGNN

SEQ ID NO: 41749 - protein, 33 aa, Artificial Sequence
  Description of Artificial Sequence: Synthetic polypeptide
DEEEIRTTNPVATEQYGSVNSSSNLQRLVNSDQ

SEQ ID NO: 41750 - protein, 30 aa, Artificial Sequence
  Description of Artificial Sequence: Synthetic polypeptide
DEEEIACTNPVATEQYGSVATNLQAEDNDN

SEQ ID NO: 41751 - protein, 31 aa, Artificial Sequence
  Description of Artificial Sequence: Synthetic polypeptide
DEEAIRTTNPVATEQYDACVCSINLQRGSNQ

SEQ ID NO: 41752 - protein, 32 aa, Artificial Sequence
  Description of Artificial Sequence: Synthetic polypeptide
DEEEIRTTNPVATEQYGCVCSSNLDQNGSNQS

SEQ ID NO: 41753 - protein, 32 aa, Artificial Sequence
  Description of Artificial Sequence: Synthetic polypeptide
DEEEIRTTNPVATEQYGCVCSSNHQRGSNNQI

SEQ ID NO: 41754 - protein, 30 aa, Artificial Sequence
  Description of Artificial Sequence: Synthetic polypeptide
DEEEIACTNPVATEQYGCVATNLQQGNIQE

SEQ ID NO: 41755 - protein, 32 aa, Artificial Sequence
  Description of Artificial Sequence: Synthetic polypeptide
DEEEIRTTNPVATEEYGASVGTETQQRGSNRE

SEQ ID NO: 41756 - protein, 33 aa, Artificial Sequence
  Description of Artificial Sequence: Synthetic polypeptide
DEEEIRTTNPVATEQYGSVNSQTNNDLQQDVRA

SEQ ID NO: 41757 - protein, 30 aa, Artificial Sequence
  Description of Artificial Sequence: Synthetic polypeptide
DEEAIRTTNPVATEQYDYCVPINLQRGDNE

SEQ ID NO: 41758 - protein, 31 aa, Artificial Sequence
  Description of Artificial Sequence: Synthetic polypeptide
DEEAIRTTNPVATEQYDYCVSLINLQREDNR

SEQ ID NO: 41759 - protein, 32 aa, Artificial Sequence
  Description of Artificial Sequence: Synthetic polypeptide
DEEEIRTTNPVATEQYGSVPSTALLEDMLGNV

SEQ ID NO: 41760 - protein, 30 aa, Artificial Sequence
  Description of Artificial Sequence: Synthetic polypeptide
DEEEIRTTNPVATECYGYHSTNEQRNEVNF

SEQ ID NO: 41761 - protein, 30 aa, Artificial Sequence
  Description of Artificial Sequence: Synthetic polypeptide
DEEEIATTNPVATEQWGTSVSTTGLRGNDS

SEQ ID NO: 41762 - protein, 33 aa, Artificial Sequence
  Description of Artificial Sequence: Synthetic polypeptide
DEEEIRTTNPVATEQYGCVCSSNELQFFGSNRV

SEQ ID NO: 41763 - protein, 33 aa, Artificial Sequence
  Description of Artificial Sequence: Synthetic polypeptide
DEEEIRTTNPVATEQYGSVNSPTTLQANGNNLN

SEQ ID NO: 41764 - protein, 31 aa, Artificial Sequence
  Description of Artificial Sequence: Synthetic polypeptide
DEEEIRTTNPVATEQYGCVCSSNDIQENGNQ

SEQ ID NO: 41765 - protein, 32 aa, Artificial Sequence
  Description of Artificial Sequence: Synthetic polypeptide
DEEAIRTTNPVATEQYDYSSCSINNLQRGDNR

SEQ ID NO: 41766 - protein, 31 aa, Artificial Sequence
  Description of Artificial Sequence: Synthetic polypeptide
DEEEIRTTNPVATEQYGSVPSTASLGFGGEI

SEQ ID NO: 41767 - protein, 33 aa, Artificial Sequence
  Description of Artificial Sequence: Synthetic polypeptide
DEEEIRTTNPVATEQYGSVPSPTNNQRVGVELQ

SEQ ID NO: 41768 - protein, 31 aa, Artificial Sequence
  Description of Artificial Sequence: Synthetic polypeptide
DEEEIRTTNPVATEQYGCVCSTAHQNGSNQA

SEQ ID NO: 41769 - protein, 34 aa, Artificial Sequence
  Description of Artificial Sequence: Synthetic polypeptide
DEEEIRTTNPVATEQWGEVTPSCTNELSQREGNR

SEQ ID NO: 41770 - protein, 32 aa, Artificial Sequence
  Description of Artificial Sequence: Synthetic polypeptide
DEEEIRTTNPVATEQYGCVCSTALQFFGSNVS

SEQ ID NO: 41771 - protein, 29 aa, Artificial Sequence
  Description of Artificial Sequence: Synthetic peptide
DEEEIASVNPVCTEQYGVVSDNLQMRGNQ

SEQ ID NO: 41772 - protein, 28 aa, Artificial Sequence
  Description of Artificial Sequence: Synthetic peptide
DEEEIASVNPVCTEQYGVVSDNLQSGNQ

SEQ ID NO: 41773 - protein, 33 aa, Artificial Sequence
  Description of Artificial Sequence: Synthetic polypeptide
DEEEIRTTNPVATEQYGSVNSTGNLDGEGNNGD

SEQ ID NO: 41774 - protein, 32 aa, Artificial Sequence
  Description of Artificial Sequence: Synthetic polypeptide
DEEEIRTTNPVATEEYGICVSTVNLQDNISNR

SEQ ID NO: 41775 - protein, 33 aa, Artificial Sequence
  Description of Artificial Sequence: Synthetic polypeptide
DEEEIRTTNPVATEQYGSVQSQNLQPDGEEQRI

SEQ ID NO: 41776 - protein, 31 aa, Artificial Sequence
  Description of Artificial Sequence: Synthetic polypeptide
DEEEIRTTNPVATEQYGCVCSTEDHQFGNQT

SEQ ID NO: 41777 - protein, 32 aa, Artificial Sequence
  Description of Artificial Sequence: Synthetic polypeptide
DEEEIRTTNPVATEQYGSVPSPNPLQVVNELG

SEQ ID NO: 41778 - protein, 31 aa, Artificial Sequence
  Description of Artificial Sequence: Synthetic polypeptide
DEEEIRTTNPVATEQWGCTISKNEGQRDGNR

SEQ ID NO: 41779 - protein, 33 aa, Artificial Sequence
  Description of Artificial Sequence: Synthetic polypeptide
DEEEIRTTNPVATEQYGSVNSTDLQQGQGGNID

SEQ ID NO: 41780 - protein, 33 aa, Artificial Sequence
  Description of Artificial Sequence: Synthetic polypeptide
DEEEIRTTNPVATEQYGCVCSTEALQRFGSERA

SEQ ID NO: 41781 - protein, 33 aa, Artificial Sequence
  Description of Artificial Sequence: Synthetic polypeptide
DEEEIRTTNPVATEQYGSVNSTDLQMNEGGNIM

SEQ ID NO: 41782 - protein, 31 aa, Artificial Sequence
  Description of Artificial Sequence: Synthetic polypeptide
DEEEIRTTNPVATEQYGSVISTNIVELDNPV

SEQ ID NO: 41783 - protein, 33 aa, Artificial Sequence
  Description of Artificial Sequence: Synthetic polypeptide
DEEEIRTTNPVATEQYGSVNSTDLQEEGGNNQQ

SEQ ID NO: 41784 - protein, 31 aa, Artificial Sequence
  Description of Artificial Sequence: Synthetic polypeptide
DEEEIRTTNPVATEEYGCVCSTEDQRGSNQS

SEQ ID NO: 41785 - protein, 32 aa, Artificial Sequence
  Description of Artificial Sequence: Synthetic polypeptide
DEEEIRTTNPVATEAYGTTVSVTNELSTRVNR

SEQ ID NO: 41786 - protein, 32 aa, Artificial Sequence
  Description of Artificial Sequence: Synthetic polypeptide
DEEEIRTTNPVATEEYGCVCSTALQRFGSNQS

SEQ ID NO: 41787 - protein, 31 aa, Artificial Sequence
  Description of Artificial Sequence: Synthetic polypeptide
DEEEIRTTNPVATEQYGCVCSTALQSSGSDQ

SEQ ID NO: 41788 - protein, 34 aa, Artificial Sequence
  Description of Artificial Sequence: Synthetic polypeptide
DEEEIRTTNPVATEQYGSVQSPTNIQRIGNIGFQ

SEQ ID NO: 41789 - protein, 32 aa, Artificial Sequence
  Description of Artificial Sequence: Synthetic polypeptide
DEEEIRTTNPVATEQYGCVCSTALQRFNSQQS

SEQ ID NO: 41790 - protein, 32 aa, Artificial Sequence
  Description of Artificial Sequence: Synthetic polypeptide
DEEEIRTTNPVATEQYGSVNSTDLDQQRDEEF

SEQ ID NO: 41791 - protein, 32 aa, Artificial Sequence
  Description of Artificial Sequence: Synthetic polypeptide
DEEEIRTTNPVATEQYGCVCSTALQNIGSNAS

SEQ ID NO: 41792 - protein, 32 aa, Artificial Sequence
  Description of Artificial Sequence: Synthetic polypeptide
DEEEIRTTNPVATEQWGETVSCTNLSGRTENR

SEQ ID NO: 41793 - protein, 32 aa, Artificial Sequence
  Description of Artificial Sequence: Synthetic polypeptide
DEEEIRTTNPVATEQWGEVPSTNADSQRGGNT

SEQ ID NO: 41794 - protein, 33 aa, Artificial Sequence
  Description of Artificial Sequence: Synthetic polypeptide
DEEEIRTTNPVATEQYGSVNSTANQQEFGGNED

SEQ ID NO: 41795 - protein, 33 aa, Artificial Sequence
  Description of Artificial Sequence: Synthetic polypeptide
DEEEIRTTNPVATEQYGSVQSPNLEEERGMVRN

SEQ ID NO: 41796 - protein, 33 aa, Artificial Sequence
  Description of Artificial Sequence: Synthetic polypeptide
DEEEIRTTNPVATEQYGCVCSSMNLQRFGSNQS

SEQ ID NO: 41797 - protein, 33 aa, Artificial Sequence
  Description of Artificial Sequence: Synthetic polypeptide
DEEEIRTTNPVATEQYGCVCSTEDLQEFGSNRS

SEQ ID NO: 41798 - protein, 33 aa, Artificial Sequence
  Description of Artificial Sequence: Synthetic polypeptide
DEEEIRTTNPVATEQYGSVQSMNLEQRLVVERL

SEQ ID NO: 41799 - protein, 32 aa, Artificial Sequence
  Description of Artificial Sequence: Synthetic polypeptide
DEEEIRTTNPVATEQYGCVCSSENLQNGSNAY

SEQ ID NO: 41800 - protein, 34 aa, Artificial Sequence
  Description of Artificial Sequence: Synthetic polypeptide
DEEEIRTTNPVATEQYGSVQSDTGNGQERIMNRM

SEQ ID NO: 41801 - protein, 30 aa, Artificial Sequence
  Description of Artificial Sequence: Synthetic polypeptide
DEEEIRTTNPVATEQYGSVSMPLQVSDDEE

SEQ ID NO: 41802 - protein, 31 aa, Artificial Sequence
  Description of Artificial Sequence: Synthetic polypeptide
DEEEIACTNPVATEQYGSVATNLDRGPNENL

SEQ ID NO: 41803 - protein, 33 aa, Artificial Sequence
  Description of Artificial Sequence: Synthetic polypeptide
DEEEIRTTNPVATEQYGSVNSINLQEREGDEDL

SEQ ID NO: 41804 - protein, 33 aa, Artificial Sequence
  Description of Artificial Sequence: Synthetic polypeptide
DEEEIRTTNPVATEQYGSVNSINLQEMEGEDER

SEQ ID NO: 41805 - protein, 30 aa, Artificial Sequence
  Description of Artificial Sequence: Synthetic polypeptide
DEEEIRTTNPVATEQYGSVNSINIDNREDG

SEQ ID NO: 41806 - protein, 31 aa, Artificial Sequence
  Description of Artificial Sequence: Synthetic polypeptide
DEEEIRTTNPVATEQWGNTTSNNELQGNGNR

SEQ ID NO: 41807 - protein, 31 aa, Artificial Sequence
  Description of Artificial Sequence: Synthetic polypeptide
DEEEIRTTNPVATEQYGSVNSINDNREDNEL

SEQ ID NO: 41808 - protein, 31 aa, Artificial Sequence
  Description of Artificial Sequence: Synthetic polypeptide
DEEEIRTTNPVATEQYGSVNSILQSLQELNE

SEQ ID NO: 41809 - protein, 32 aa, Artificial Sequence
  Description of Artificial Sequence: Synthetic polypeptide
DEEEIRTTNPVATEQWGQSVSEENLQVPGGQR

SEQ ID NO: 41810 - protein, 31 aa, Artificial Sequence
  Description of Artificial Sequence: Synthetic polypeptide
DEEEIRTTNPVATEQYGSVSNNWLDNSLNDP

SEQ ID NO: 41811 - protein, 30 aa, Artificial Sequence
  Description of Artificial Sequence: Synthetic polypeptide
DEEEIACTNPVATEQYGCVATNLQVGDNEE

SEQ ID NO: 41812 - protein, 33 aa, Artificial Sequence
  Description of Artificial Sequence: Synthetic polypeptide
DEEAIRTTNPVATEQYGCVCSTMNLQRFGSNQT

SEQ ID NO: 41813 - protein, 32 aa, Artificial Sequence
  Description of Artificial Sequence: Synthetic polypeptide
DEEEIRTTNPVATEQWGQVSTNLSTRGGNNQC

SEQ ID NO: 41814 - protein, 32 aa, Artificial Sequence
  Description of Artificial Sequence: Synthetic polypeptide
DEEEIRTTNPVATEQYGCVCSNTNLQGGSIQI

SEQ ID NO: 41815 - protein, 34 aa, Artificial Sequence
  Description of Artificial Sequence: Synthetic polypeptide
DEEEIRTTNPVATEQYGCVCSNTNLQEHFGSNNR

SEQ ID NO: 41816 - protein, 30 aa, Artificial Sequence
  Description of Artificial Sequence: Synthetic polypeptide
DEEEIRTTNPVATEQWGSCCTNQQNGGNVW

SEQ ID NO: 41817 - protein, 32 aa, Artificial Sequence
  Description of Artificial Sequence: Synthetic polypeptide
DEEEIRTTNPVATEQYGCVCSNTNGNQRGSEQ

SEQ ID NO: 41818 - protein, 34 aa, Artificial Sequence
  Description of Artificial Sequence: Synthetic polypeptide
DEEEIRTTNPVATEQYGCVCSNTNDLQRFGSNII

SEQ ID NO: 41819 - protein, 33 aa, Artificial Sequence
  Description of Artificial Sequence: Synthetic polypeptide
DEEEIRTTNPVATEQYGCVCSNTNALQFFGSDR

SEQ ID NO: 41820 - protein, 33 aa, Artificial Sequence
  Description of Artificial Sequence: Synthetic polypeptide
DEEEIRTTNPVATEQYGCVCSNTMNLQFGSNQV

SEQ ID NO: 41821 - protein, 31 aa, Artificial Sequence
  Description of Artificial Sequence: Synthetic polypeptide
DEEEIRTTNPVATEQWGSISLPNMDQDRDNR

SEQ ID NO: 41822 - protein, 34 aa, Artificial Sequence
  Description of Artificial Sequence: Synthetic polypeptide
DEEEIRTTNPVATEQYGCVCSNTGNLQYFGSNRM

SEQ ID NO: 41823 - protein, 32 aa, Artificial Sequence
  Description of Artificial Sequence: Synthetic polypeptide
DEEEIRTTNPVATEQYGSVNSGTNGGQKFGKF

SEQ ID NO: 41824 - protein, 33 aa, Artificial Sequence
  Description of Artificial Sequence: Synthetic polypeptide
DEEEIRTTNPVATEQYGSVNSGTNGQGIGENEQ

SEQ ID NO: 41825 - protein, 31 aa, Artificial Sequence
  Description of Artificial Sequence: Synthetic polypeptide
DEEEIRTTNPVATEQYGCVCSNTPHQNGNQS

SEQ ID NO: 41826 - protein, 31 aa, Artificial Sequence
  Description of Artificial Sequence: Synthetic polypeptide
DEEEIRTTNPVATEQYGSVNSMKNEQSETDR

SEQ ID NO: 41827 - protein, 33 aa, Artificial Sequence
  Description of Artificial Sequence: Synthetic polypeptide
DEEEIRTTNPVATEQYGSVNSMTNGGQQRFGKF

SEQ ID NO: 41828 - protein, 33 aa, Artificial Sequence
  Description of Artificial Sequence: Synthetic polypeptide
DEEEIRTTNPVATEAYGTVSCTNELSHRGDNNR

SEQ ID NO: 41829 - protein, 29 aa, Artificial Sequence
  Description of Artificial Sequence: Synthetic peptide
DEEEIRTTNPVATECYGYHSTNEQPVNFV

SEQ ID NO: 41830 - protein, 32 aa, Artificial Sequence
  Description of Artificial Sequence: Synthetic polypeptide
DEEEIRTTNPVATEQYGSVNSPTDQRSGENEQ

SEQ ID NO: 41831 - protein, 30 aa, Artificial Sequence
  Description of Artificial Sequence: Synthetic polypeptide
DEEEIRTTNPVATECYGVMSTLNEQRENGF

SEQ ID NO: 41832 - protein, 31 aa, Artificial Sequence
  Description of Artificial Sequence: Synthetic polypeptide
DEEEIRTTNPVATEQYGSVSMNLVMTGVEDG

SEQ ID NO: 41833 - protein, 31 aa, Artificial Sequence
  Description of Artificial Sequence: Synthetic polypeptide
DEEEIRTTNPVATEAYGTVSSTNENQLGNNF

SEQ ID NO: 41834 - protein, 33 aa, Artificial Sequence
  Description of Artificial Sequence: Synthetic polypeptide
DEEEIRTTNPVATEQYGSVSNSNGLQTGGNGNG

SEQ ID NO: 41835 - protein, 32 aa, Artificial Sequence
  Description of Artificial Sequence: Synthetic polypeptide
DEEEIRTTNPVATEQYGSVSNSLGQIMGNPQI

SEQ ID NO: 41836 - protein, 33 aa, Artificial Sequence
  Description of Artificial Sequence: Synthetic polypeptide
DEEEIRTTNPVATEQYGSVISTNLQQASGPEQL

SEQ ID NO: 41837 - protein, 30 aa, Artificial Sequence
  Description of Artificial Sequence: Synthetic polypeptide
DEEEIRTTNPVATEAYGTVSSTNEQGNNDT

SEQ ID NO: 41838 - protein, 34 aa, Artificial Sequence
  Description of Artificial Sequence: Synthetic polypeptide
DEEEIRTTNPVATEQYGSVNSNTNLFQEEGGNQQ

SEQ ID NO: 41839 - protein, 34 aa, Artificial Sequence
  Description of Artificial Sequence: Synthetic polypeptide
DEEEIRTTNPVATEQYGSVQSFTNLQPQQINQRD

SEQ ID NO: 41840 - protein, 32 aa, Artificial Sequence
  Description of Artificial Sequence: Synthetic polypeptide
DEEEIRTTNPVATEQYGSVNSNTDEGQGGNED

SEQ ID NO: 41841 - protein, 30 aa, Artificial Sequence
  Description of Artificial Sequence: Synthetic polypeptide
DEEEIRTTNPVATECYGTHSTGNEQQRRNF

SEQ ID NO: 41842 - protein, 32 aa, Artificial Sequence
  Description of Artificial Sequence: Synthetic polypeptide
DEEEIACTNPVATEQYGSVATNLERPGDNPRD

SEQ ID NO: 41843 - protein, 31 aa, Artificial Sequence
  Description of Artificial Sequence: Synthetic polypeptide
DEEEIRTTNPVATEQYGCVCSSELQGFGNQV

SEQ ID NO: 41844 - protein, 33 aa, Artificial Sequence
  Description of Artificial Sequence: Synthetic polypeptide
DEEEIRTTNPVATEQWGKTVSTNALSQRGINNE

SEQ ID NO: 41845 - protein, 31 aa, Artificial Sequence
  Description of Artificial Sequence: Synthetic polypeptide
DEEEIRTTNPVATEQYGSVNSNPNEQVGQFE

SEQ ID NO: 41846 - protein, 33 aa, Artificial Sequence
  Description of Artificial Sequence: Synthetic polypeptide
DEEEIRTTNPVATEQYGSVSMNPLQGRPILEER

SEQ ID NO: 41847 - protein, 32 aa, Artificial Sequence
  Description of Artificial Sequence: Synthetic polypeptide
DEEEIRTTNPVATEQWGKVSQGNLSQTGGNQR

SEQ ID NO: 41848 - protein, 31 aa, Artificial Sequence
  Description of Artificial Sequence: Synthetic polypeptide
DEEEIRTTNPVATEQYGSVSNSDLQDTEIRD

SEQ ID NO: 41849 - protein, 30 aa, Artificial Sequence
  Description of Artificial Sequence: Synthetic polypeptide
DEEEIACTNPVATEQYGSVATNLEDQNGAE

SEQ ID NO: 41850 - protein, 33 aa, Artificial Sequence
  Description of Artificial Sequence: Synthetic polypeptide
DEEEIRTTNPVATEQYGSVISTNMVDQLGEGRD

SEQ ID NO: 41851 - protein, 32 aa, Artificial Sequence
  Description of Artificial Sequence: Synthetic polypeptide
DEEEIRTTNPVATEQYGSVSMPDALQARIGQE

SEQ ID NO: 41852 - protein, 34 aa, Artificial Sequence
  Description of Artificial Sequence: Synthetic polypeptide
DEEEIRTTNPVATEQYGCVCSNTVNLQERFGSNQ

SEQ ID NO: 41853 - protein, 32 aa, Artificial Sequence
  Description of Artificial Sequence: Synthetic polypeptide
DEEEIATTNPCATEQYGSVPTINLDQHDGNGR

SEQ ID NO: 41854 - protein, 33 aa, Artificial Sequence
  Description of Artificial Sequence: Synthetic polypeptide
DEEEIRTTNPVATEQYGSVISTLQEQPRGNEDE

SEQ ID NO: 41855 - protein, 31 aa, Artificial Sequence
  Description of Artificial Sequence: Synthetic polypeptide
DEEEIRTTNPVATEQYGSVPSPNLVVLMGLT

SEQ ID NO: 41856 - protein, 32 aa, Artificial Sequence
  Description of Artificial Sequence: Synthetic polypeptide
DEEAIRTTNPVATEQWGSVGNTNNLQHFGSNR

SEQ ID NO: 41857 - protein, 31 aa, Artificial Sequence
  Description of Artificial Sequence: Synthetic polypeptide
DEEEIRTTNPVATEQYGCVCSTEHQHFGQRV

SEQ ID NO: 41858 - protein, 31 aa, Artificial Sequence
  Description of Artificial Sequence: Synthetic polypeptide
DEEEIRTTNPVATEQYGCVCSTEHQEHGSNQ

SEQ ID NO: 41859 - protein, 30 aa, Artificial Sequence
  Description of Artificial Sequence: Synthetic polypeptide
DEEAIRTTNPVATEIYGCVFTNLQGFGSNQ

SEQ ID NO: 41860 - protein, 31 aa, Artificial Sequence
  Description of Artificial Sequence: Synthetic polypeptide
DEEAIRTTNPVATEIYGCVGTNLNQRFGSNQ

SEQ ID NO: 41861 - protein, 32 aa, Artificial Sequence
  Description of Artificial Sequence: Synthetic polypeptide
DEEEIRTTNPVATEQYGSVNSTNDDRNGDDVG

SEQ ID NO: 41862 - protein, 31 aa, Artificial Sequence
  Description of Artificial Sequence: Synthetic polypeptide
DEEAIRTTNPVATEIYGCVQTNLQRFGSNQA

SEQ ID NO: 41863 - protein, 33 aa, Artificial Sequence
  Description of Artificial Sequence: Synthetic polypeptide
DEEEIRTTNPVATEQYGSVISPTMLQRPIVNEI

SEQ ID NO: 41864 - protein, 31 aa, Artificial Sequence
  Description of Artificial Sequence: Synthetic polypeptide
DEEEIRTTNPVATEQYGCVCSTEHQEGGNQV

SEQ ID NO: 41865 - protein, 33 aa, Artificial Sequence
  Description of Artificial Sequence: Synthetic polypeptide
DEEEIRTTNPVATEQYGSVISPTNGQRQNNDVL

SEQ ID NO: 41866 - protein, 30 aa, Artificial Sequence
  Description of Artificial Sequence: Synthetic polypeptide
DEEEIRTTNPVATEQFGTSVSTYLLGGESN

SEQ ID NO: 41867 - protein, 31 aa, Artificial Sequence
  Description of Artificial Sequence: Synthetic polypeptide
DEEEIRTTNPVATEQYGCVCSTEHDQHGSNQ

SEQ ID NO: 41868 - protein, 31 aa, Artificial Sequence
  Description of Artificial Sequence: Synthetic polypeptide
DEEAIRTTNPVATEIYGCVCTTNDQRFGSNR

SEQ ID NO: 41869 - protein, 29 aa, Artificial Sequence
  Description of Artificial Sequence: Synthetic peptide
DEEAIRTTNPVATEIYGCVTTELQGGSNQ

SEQ ID NO: 41870 - protein, 33 aa, Artificial Sequence
  Description of Artificial Sequence: Synthetic polypeptide
DEEEIRTTNPVATEQYGSVSNTDNMTQDGENIP

SEQ ID NO: 41871 - protein, 32 aa, Artificial Sequence
  Description of Artificial Sequence: Synthetic polypeptide
DEEEIRTTNPVATEQYGCVCSTEEQRFGSNAS

SEQ ID NO: 41872 - protein, 31 aa, Artificial Sequence
  Description of Artificial Sequence: Synthetic polypeptide
DEEEIRTTNPVATEQFGTSVSTYLLRGEESP

SEQ ID NO: 41873 - protein, 32 aa, Artificial Sequence
  Description of Artificial Sequence: Synthetic polypeptide
DEEEIRTTNPVATEQFGTSVSTYLLRGNEDSL

SEQ ID NO: 41874 - protein, 32 aa, Artificial Sequence
  Description of Artificial Sequence: Synthetic polypeptide
DEEEIRTTNPVATEQYGSVQSTMNQQRIPIDY

SEQ ID NO: 41875 - protein, 29 aa, Artificial Sequence
  Description of Artificial Sequence: Synthetic peptide
DEEEIATTNPVATEQYGCVATALQPDNDQ

SEQ ID NO: 41876 - protein, 34 aa, Artificial Sequence
  Description of Artificial Sequence: Synthetic polypeptide
DEEEIRTTNPVATEAYGSVSYTLNALSQHGGNRC

SEQ ID NO: 41877 - protein, 32 aa, Artificial Sequence
  Description of Artificial Sequence: Synthetic polypeptide
DEEEIRTTNPVATEQYGSVISPTNLESVSNIE

SEQ ID NO: 41878 - protein, 34 aa, Artificial Sequence
  Description of Artificial Sequence: Synthetic polypeptide
DEEEIRTTNPVATEAYGSVSYTLNELSQNGGNRH

SEQ ID NO: 41879 - protein, 34 aa, Artificial Sequence
  Description of Artificial Sequence: Synthetic polypeptide
DEEEIRTTNPVATEQYGSVISPTNLMERIVNNRS

SEQ ID NO: 41880 - protein, 30 aa, Artificial Sequence
  Description of Artificial Sequence: Synthetic polypeptide
DEEEIACTNPVATEQYGSVATNLQDGGEDM

SEQ ID NO: 41881 - protein, 31 aa, Artificial Sequence
  Description of Artificial Sequence: Synthetic polypeptide
DEEEIRTTNPVATEQYGCVCSTEGLIFGSNQ

SEQ ID NO: 41882 - protein, 31 aa, Artificial Sequence
  Description of Artificial Sequence: Synthetic polypeptide
DEEEIRTTNPVATEQFGTSVSTSYLLNDGNS

SEQ ID NO: 41883 - protein, 32 aa, Artificial Sequence
  Description of Artificial Sequence: Synthetic polypeptide
DEEEIRTTNPVATEQYGSVISPTMLEQGNMVD

SEQ ID NO: 41884 - protein, 30 aa, Artificial Sequence
  Description of Artificial Sequence: Synthetic polypeptide
DEEEIRTTNPVATEQYGCVCSTEHQIISNQ

SEQ ID NO: 41885 - protein, 30 aa, Artificial Sequence
  Description of Artificial Sequence: Synthetic polypeptide
DEEEIACTNPVATEQYGSVATNLQDQGDFP

SEQ ID NO: 41886 - protein, 33 aa, Artificial Sequence
  Description of Artificial Sequence: Synthetic polypeptide
DEEEIRTTNPVATEQYGSVSNTDQLGQSEGGNA

SEQ ID NO: 41887 - protein, 32 aa, Artificial Sequence
  Description of Artificial Sequence: Synthetic polypeptide
DEEEIRTTNPVATEQYGSVISPTANLERMEEL

SEQ ID NO: 41888 - protein, 32 aa, Artificial Sequence
  Description of Artificial Sequence: Synthetic polypeptide
DEEEIRTTNPVATEQFGQSVSCTYMLSGRGNS

SEQ ID NO: 41889 - protein, 32 aa, Artificial Sequence
  Description of Artificial Sequence: Synthetic polypeptide
DEEEIRTTNPVATEQYGCVCSTELNQRGSQQP

SEQ ID NO: 41890 - protein, 32 aa, Artificial Sequence
  Description of Artificial Sequence: Synthetic polypeptide
DEEEIRTTNPVATEQYGCVCSTELNQEGNSNQ

SEQ ID NO: 41891 - protein, 32 aa, Artificial Sequence
  Description of Artificial Sequence: Synthetic polypeptide
DEEEIRTTNPVATEQFGQSVSTHLSGRGGNNS

SEQ ID NO: 41892 - protein, 31 aa, Artificial Sequence
  Description of Artificial Sequence: Synthetic polypeptide
DEEEIRTTNPVATEQFGQSVSTYGSTRGGNS

SEQ ID NO: 41893 - protein, 32 aa, Artificial Sequence
  Description of Artificial Sequence: Synthetic polypeptide
DEEEIRTTNPVATEQFGQSVSTYMLSTRGNNS

SEQ ID NO: 41894 - protein, 33 aa, Artificial Sequence
  Description of Artificial Sequence: Synthetic polypeptide
DEEEIRTTNPVATEQYGCVCSTELNQEGFGSNR

SEQ ID NO: 41895 - protein, 34 aa, Artificial Sequence
  Description of Artificial Sequence: Synthetic polypeptide
DEEEIRTTNPVATEQYGSVISPTLTLQRGLNLLS

SEQ ID NO: 41896 - protein, 33 aa, Artificial Sequence
  Description of Artificial Sequence: Synthetic polypeptide
DEEEIRTTNPVATEQYGCVCSTELHQRSGSERS

SEQ ID NO: 41897 - protein, 32 aa, Artificial Sequence
  Description of Artificial Sequence: Synthetic polypeptide
DEEAIRTTNPVATEGYGSVSVTGNLGELGSNR

SEQ ID NO: 41898 - protein, 34 aa, Artificial Sequence
  Description of Artificial Sequence: Synthetic polypeptide
DEEEIRTTNPVATEQYGCVCSTELHQRFGSNNRS

SEQ ID NO: 41899 - protein, 30 aa, Artificial Sequence
  Description of Artificial Sequence: Synthetic polypeptide
DEEEIRTTNPVATEQYGSVPSNIQQDDNVQ

SEQ ID NO: 41900 - protein, 33 aa, Artificial Sequence
  Description of Artificial Sequence: Synthetic polypeptide
DEEEIRTTNPVATEQYGCVCSTELEQRSGSNAT

SEQ ID NO: 41901 - protein, 31 aa, Artificial Sequence
  Description of Artificial Sequence: Synthetic polypeptide
DEEEIRTTNPVATEQFGTCVSMTYLLRGSNA

SEQ ID NO: 41902 - protein, 31 aa, Artificial Sequence
  Description of Artificial Sequence: Synthetic polypeptide
DEEEIRTTNPVATEQFGTSTVSTELLRVENS

SEQ ID NO: 41903 - protein, 31 aa, Artificial Sequence
  Description of Artificial Sequence: Synthetic polypeptide
DEEEIRTTNPVATEQFGTSTVSTELLTGNPS

SEQ ID NO: 41904 - protein, 31 aa, Artificial Sequence
  Description of Artificial Sequence: Synthetic polypeptide
DEEEIRTTNPVATEQFGTSVSNTYLLHGSNA

SEQ ID NO: 41905 - protein, 32 aa, Artificial Sequence
  Description of Artificial Sequence: Synthetic polypeptide
DEEEIRTTNPVATEQYGSVNSTNDDRNGQDDP

SEQ ID NO: 41906 - protein, 31 aa, Artificial Sequence
  Description of Artificial Sequence: Synthetic polypeptide
DEEEIRTTNPVATEQFGTSVSTGYLLHGSNI

SEQ ID NO: 41907 - protein, 33 aa, Artificial Sequence
  Description of Artificial Sequence: Synthetic polypeptide
DEEEIRTTNPVATEQYGSVSNTDNNQGQNEGNT

SEQ ID NO: 41908 - protein, 32 aa, Artificial Sequence
  Description of Artificial Sequence: Synthetic polypeptide
DEEEIRTTNPVATEQYGSVSMNLQLVGETPQA

SEQ ID NO: 41909 - protein, 31 aa, Artificial Sequence
  Description of Artificial Sequence: Synthetic polypeptide
DEEEIRTTNPVATEQYGCVCSTEHQNGENQS

SEQ ID NO: 41910 - protein, 32 aa, Artificial Sequence
  Description of Artificial Sequence: Synthetic polypeptide
DEEEIRTTNPVATEQYGSVISPTNLQGLAIDN

SEQ ID NO: 41911 - protein, 30 aa, Artificial Sequence
  Description of Artificial Sequence: Synthetic polypeptide
DEEEIASVNPVATEQYGSVSSTDAGQRGNQ

SEQ ID NO: 41912 - protein, 32 aa, Artificial Sequence
  Description of Artificial Sequence: Synthetic polypeptide
DEEEIRTTNPVATEFYGIVVSTVNLEDRNVNR

SEQ ID NO: 41913 - protein, 33 aa, Artificial Sequence
  Description of Artificial Sequence: Synthetic polypeptide
DEEEIRTTNPVATEQYGSVISQTSLQRMIENVT

SEQ ID NO: 41914 - protein, 30 aa, Artificial Sequence
  Description of Artificial Sequence: Synthetic polypeptide
DEEAIRTTNPVATEQWGCVGTNELQHGSNA

SEQ ID NO: 41915 - protein, 33 aa, Artificial Sequence
  Description of Artificial Sequence: Synthetic polypeptide
DEEEIRTTNPVATEQYGSVNSTMVIEQRGDIRG

SEQ ID NO: 41916 - protein, 32 aa, Artificial Sequence
  Description of Artificial Sequence: Synthetic polypeptide
DEEEIRTTNPVATEQYGCVCSTEEHQNGSNRA

SEQ ID NO: 41917 - protein, 30 aa, Artificial Sequence
  Description of Artificial Sequence: Synthetic polypeptide
DEEAIRTTNPVATEQWGCVGTNNLQHNSNR

SEQ ID NO: 41918 - protein, 33 aa, Artificial Sequence
  Description of Artificial Sequence: Synthetic polypeptide
DEEEIRTTNPVATEQYGSVNSTMNLDGFEGENG

SEQ ID NO: 41919 - protein, 33 aa, Artificial Sequence
  Description of Artificial Sequence: Synthetic polypeptide
DEEEIRTTNPVATEQYGSVNSTMNLDEFGNNGN

SEQ ID NO: 41920 - protein, 33 aa, Artificial Sequence
  Description of Artificial Sequence: Synthetic polypeptide
DEEEIRTTNPVATEQYGSVNSTMNGQGEFGNGG

SEQ ID NO: 41921 - protein, 31 aa, Artificial Sequence
  Description of Artificial Sequence: Synthetic polypeptide
DEEEIRTTNPVATEEYGSVSTELQSFGSEDS

SEQ ID NO: 41922 - protein, 30 aa, Artificial Sequence
  Description of Artificial Sequence: Synthetic polypeptide
DEEEIATTNPVATEQYGCVAATNDQDGNDN

SEQ ID NO: 41923 - protein, 33 aa, Artificial Sequence
  Description of Artificial Sequence: Synthetic polypeptide
DEEEIRTTNPVATEQYGSVPSPNLDQRPLMNVE

SEQ ID NO: 41924 - protein, 31 aa, Artificial Sequence
  Description of Artificial Sequence: Synthetic polypeptide
DEEEIRTTNPVATEEYGSVSNFENLQELNSE

SEQ ID NO: 41925 - protein, 30 aa, Artificial Sequence
  Description of Artificial Sequence: Synthetic polypeptide
DEEAIRTTNPVATEQWGSVATNNLQLDVNL

SEQ ID NO: 41926 - protein, 33 aa, Artificial Sequence
  Description of Artificial Sequence: Synthetic polypeptide
DEEEIRTTNPVATEQYGSVNSTMNGFGQNGGNV

SEQ ID NO: 41927 - protein, 32 aa, Artificial Sequence
  Description of Artificial Sequence: Synthetic polypeptide
DEEEIRTTNPVATEQYGSVNSTMGQGEFGNGE

SEQ ID NO: 41928 - protein, 33 aa, Artificial Sequence
  Description of Artificial Sequence: Synthetic polypeptide
DEEEIRTTNPVATEAYGSVVSWNLSQRGGNNQC

SEQ ID NO: 41929 - protein, 31 aa, Artificial Sequence
  Description of Artificial Sequence: Synthetic polypeptide
DEEEIRTTNPVATEQYGCVCSTEDQRGSELA

SEQ ID NO: 41930 - protein, 33 aa, Artificial Sequence
  Description of Artificial Sequence: Synthetic polypeptide
DEEEIRTTNPVATEQYGSVNSTMGLQIIGNGNI

SEQ ID NO: 41931 - protein, 33 aa, Artificial Sequence
  Description of Artificial Sequence: Synthetic polypeptide
DEEEIRTTNPVATEQYGSVNSTMGLQEVGENGG

SEQ ID NO: 41932 - protein, 32 aa, Artificial Sequence
  Description of Artificial Sequence: Synthetic polypeptide
DEEEIRTTNPVATEEYGSVCFTNLTRFGSNQA

SEQ ID NO: 41933 - protein, 32 aa, Artificial Sequence
  Description of Artificial Sequence: Synthetic polypeptide
DEEEIRTTNPVATEQYGSVSNTDDMQHPGNQE

SEQ ID NO: 41934 - protein, 31 aa, Artificial Sequence
  Description of Artificial Sequence: Synthetic polypeptide
DEEEIRTTNPVATEEYGSVCFTNHTRGGSNQ

SEQ ID NO: 41935 - protein, 31 aa, Artificial Sequence
  Description of Artificial Sequence: Synthetic polypeptide
DEEEIRTTNPVATEQYGSVQSSEELDNGERI

SEQ ID NO: 41936 - protein, 31 aa, Artificial Sequence
  Description of Artificial Sequence: Synthetic polypeptide
DEEAIRTTNPVATEQWGSVCQTNNLQHGSER

SEQ ID NO: 41937 - protein, 31 aa, Artificial Sequence
  Description of Artificial Sequence: Synthetic polypeptide
DEEAIRTTNPVATEQWGSVCQWNNLQGGSNR

SEQ ID NO: 41938 - protein, 29 aa, Artificial Sequence
  Description of Artificial Sequence: Synthetic peptide
DEEEIASVNPVCTEQYGVVSDNLPQRGNQ

SEQ ID NO: 41939 - protein, 34 aa, Artificial Sequence
  Description of Artificial Sequence: Synthetic polypeptide
DEEEIRTTNPVATEAYGSVVSCTLNALSQNGNRC

SEQ ID NO: 41940 - protein, 30 aa, Artificial Sequence
  Description of Artificial Sequence: Synthetic polypeptide
DEEEIRTTNPVATEQFGICVSTYLLHGSNA

SEQ ID NO: 41941 - protein, 36 aa, Artificial Sequence
  Description of Artificial Sequence: Synthetic polypeptide
DEEEIRTTNPVATEQYGSVISSTNELEQRVGENNRS

SEQ ID NO: 41942 - protein, 33 aa, Artificial Sequence
  Description of Artificial Sequence: Synthetic polypeptide
DEEEIRTTNPVATEQYGSVISSTDNEGQTGGNE

SEQ ID NO: 41943 - protein, 30 aa, Artificial Sequence
  Description of Artificial Sequence: Synthetic polypeptide
DEEEIASVNPVATEQYGSVSSTDAGQRGNV

SEQ ID NO: 41944 - protein, 33 aa, Artificial Sequence
  Description of Artificial Sequence: Synthetic polypeptide
DEEEIRTTNPVATEQYGSVISSNLDIEGQGGNI

SEQ ID NO: 41945 - protein, 32 aa, Artificial Sequence
  Description of Artificial Sequence: Synthetic polypeptide
DEEEIRTTNPVATEQYGSVQSTGNGLMRDMEM

SEQ ID NO: 41946 - protein, 33 aa, Artificial Sequence
  Description of Artificial Sequence: Synthetic polypeptide
DEEEIRTTNPVATEQYGSVSNTDNGQGEFGEND

SEQ ID NO: 41947 - protein, 33 aa, Artificial Sequence
  Description of Artificial Sequence: Synthetic polypeptide
DEEEIRTTNPVATEQYGSVSNTDNGQEEFGNNS

SEQ ID NO: 41948 - protein, 32 aa, Artificial Sequence
  Description of Artificial Sequence: Synthetic polypeptide
DEEEIRTTNPVATEQYGSVSNTDNEMNINGND

SEQ ID NO: 41949 - protein, 33 aa, Artificial Sequence
  Description of Artificial Sequence: Synthetic polypeptide
DEEEIRTTNPVATEQYGSVNSTNDDQRENEDDN

SEQ ID NO: 41950 - protein, 33 aa, Artificial Sequence
  Description of Artificial Sequence: Synthetic polypeptide
DEEEIRTTNPVATEQYGSVSNTDLQSEGGNIQE

SEQ ID NO: 41951 - protein, 33 aa, Artificial Sequence
  Description of Artificial Sequence: Synthetic polypeptide
DEEEIRTTNPVATEAYGSVVACTPLSQRTGGNR

SEQ ID NO: 41952 - protein, 34 aa, Artificial Sequence
  Description of Artificial Sequence: Synthetic polypeptide
DEEEIRTTNPVATEAYGSVVASTVNLSQRVGEYR

SEQ ID NO: 41953 - protein, 32 aa, Artificial Sequence
  Description of Artificial Sequence: Synthetic polypeptide
DEEEIRTTNPVATEQYGCVCSTEEHQSGSNRS

SEQ ID NO: 41954 - protein, 31 aa, Artificial Sequence
  Description of Artificial Sequence: Synthetic polypeptide
DEEEIASVNPVATEQYGSVSTDNGQMRGNPQ

SEQ ID NO: 41955 - protein, 32 aa, Artificial Sequence
  Description of Artificial Sequence: Synthetic polypeptide
DEEEIRTTNPVATEQYGCVCSTEEHQRGNTQS

SEQ ID NO: 41956 - protein, 33 aa, Artificial Sequence
  Description of Artificial Sequence: Synthetic polypeptide
DEEEIRTTNPVATEQYGSVSNTDLQNSGVNEGD

SEQ ID NO: 41957 - protein, 31 aa, Artificial Sequence
  Description of Artificial Sequence: Synthetic polypeptide
DEEEIATTNPVATEQYGCVAATNLQAEGNES

SEQ ID NO: 41958 - protein, 34 aa, Artificial Sequence
  Description of Artificial Sequence: Synthetic polypeptide
DEEEIRTTNPVATEAYGSVVPSTESLSQRGGNPR

SEQ ID NO: 41959 - protein, 34 aa, Artificial Sequence
  Description of Artificial Sequence: Synthetic polypeptide
DEEEIRTTNPVATEQYGSVNSTNDDQRDGNHEGE

SEQ ID NO: 41960 - protein, 34 aa, Artificial Sequence
  Description of Artificial Sequence: Synthetic polypeptide
DEEEIRTTNPVATEQYGSVNSTNDDQRDGNESIA

SEQ ID NO: 41961 - protein, 33 aa, Artificial Sequence
  Description of Artificial Sequence: Synthetic polypeptide
DEEEIRTTNPVATEQYGSVSNTDLQNSGGNGGN

SEQ ID NO: 41962 - protein, 28 aa, Artificial Sequence
  Description of Artificial Sequence: Synthetic peptide
DEEEIASVNPVATEQYGVVSDAGQRGNQ

SEQ ID NO: 41963 - protein, 33 aa, Artificial Sequence
  Description of Artificial Sequence: Synthetic polypeptide
DEEEIRTTNPVATEQYGSVNSTNDDQNGNEEIF

SEQ ID NO: 41964 - protein, 34 aa, Artificial Sequence
  Description of Artificial Sequence: Synthetic polypeptide
DEEEIRTTNPVATEAYGSVVSCANALQRTGGNRC

SEQ ID NO: 41965 - protein, 34 aa, Artificial Sequence
  Description of Artificial Sequence: Synthetic polypeptide
DEEEIRTTNPVATEQYGSVNSTNDDQIRGNIEIW

SEQ ID NO: 41966 - protein, 31 aa, Artificial Sequence
  Description of Artificial Sequence: Synthetic polypeptide
DEEEIRTTNPVATEQYGSVNSTNDDLNGDEV

SEQ ID NO: 41967 - protein, 32 aa, Artificial Sequence
  Description of Artificial Sequence: Synthetic polypeptide
DEEEIRTTNPVATEEYGSVVSTTIQNQRGNGA

SEQ ID NO: 41968 - protein, 33 aa, Artificial Sequence
  Description of Artificial Sequence: Synthetic polypeptide
DEEEIRTTNPVATEQYGSVNSTNDDERGNQEGE

SEQ ID NO: 41969 - protein, 32 aa, Artificial Sequence
  Description of Artificial Sequence: Synthetic polypeptide
DEEEIRTTNPVATEQYGCVCSTELQHIGSNTD

SEQ ID NO: 41970 - protein, 32 aa, Artificial Sequence
  Description of Artificial Sequence: Synthetic polypeptide
DEEEINTTNPVATEQYGSFVQTNSLEQVRGEF

SEQ ID NO: 41971 - protein, 33 aa, Artificial Sequence
  Description of Artificial Sequence: Synthetic polypeptide
DEEEIRTTNPVATEQYGCVCSTNDQRFGSNTQA

SEQ ID NO: 41972 - protein, 32 aa, Artificial Sequence
  Description of Artificial Sequence: Synthetic polypeptide
DEEEIRTTNPVATEQYGKVFCTNLSFDVGNQR

SEQ ID NO: 41973 - protein, 29 aa, Artificial Sequence
  Description of Artificial Sequence: Synthetic peptide
DEEEIRTTNPCATAQYGVVVTEDLQRGPF

SEQ ID NO: 41974 - protein, 30 aa, Artificial Sequence
  Description of Artificial Sequence: Synthetic polypeptide
DEEEIRTTNPCATAQYGQVPTPLQRGVNQF

SEQ ID NO: 41975 - protein, 31 aa, Artificial Sequence
  Description of Artificial Sequence: Synthetic polypeptide
DEEEIRTTNPVATEQYGSVCATNLEDPQNAQ

SEQ ID NO: 41976 - protein, 34 aa, Artificial Sequence
  Description of Artificial Sequence: Synthetic polypeptide
DEEEIRTTNPVATEQYGKVSCWTNELSNRGTNNR

SEQ ID NO: 41977 - protein, 31 aa, Artificial Sequence
  Description of Artificial Sequence: Synthetic polypeptide
DEEEIRTTNPAATEQYGSVSTNLDTDIGIAN

SEQ ID NO: 41978 - protein, 31 aa, Artificial Sequence
  Description of Artificial Sequence: Synthetic polypeptide
DEEEIRTTNPVATEQYGKVATTALSQRVGML

SEQ ID NO: 41979 - protein, 33 aa, Artificial Sequence
  Description of Artificial Sequence: Synthetic polypeptide
DEEEIRTTNPVATEQYGKVSTGNGSQTGGNNRQ

SEQ ID NO: 41980 - protein, 30 aa, Artificial Sequence
  Description of Artificial Sequence: Synthetic polypeptide
DEEEIRTTNPAATEQYGSVSGNIFDGNEFQ

SEQ ID NO: 41981 - protein, 30 aa, Artificial Sequence
  Description of Artificial Sequence: Synthetic polypeptide
DEEEIRTTNPAATEQYGSVSGNIFDGGNEI

SEQ ID NO: 41982 - protein, 30 aa, Artificial Sequence
  Description of Artificial Sequence: Synthetic polypeptide
DEEEIRTTNPAATEQYGSVSGNDIGDGNDQ

SEQ ID NO: 41983 - protein, 30 aa, Artificial Sequence
  Description of Artificial Sequence: Synthetic polypeptide
DEEEIRTTNPAATEQYGSVSGGNGGDGGND

SEQ ID NO: 41984 - protein, 30 aa, Artificial Sequence
  Description of Artificial Sequence: Synthetic polypeptide
DEEEIRTTNPAATEQYGSVQTDLARGGGEQ

SEQ ID NO: 41985 - protein, 33 aa, Artificial Sequence
  Description of Artificial Sequence: Synthetic polypeptide
DEEEIRTTNPVATEQYGSVSGTDNGQEEGGNNE

SEQ ID NO: 41986 - protein, 30 aa, Artificial Sequence
  Description of Artificial Sequence: Synthetic polypeptide
DEEEIRTTNPAATEQYGSVSGNIFDGNNDD

SEQ ID NO: 41987 - protein, 28 aa, Artificial Sequence
  Description of Artificial Sequence: Synthetic peptide
DEEEIRTTNPCATDQYGTVATDEQQGNT

SEQ ID NO: 41988 - protein, 29 aa, Artificial Sequence
  Description of Artificial Sequence: Synthetic peptide
DEEEIRTTNPCATDQYGTVATNDEQMGNE

SEQ ID NO: 41989 - protein, 33 aa, Artificial Sequence
  Description of Artificial Sequence: Synthetic polypeptide
DEEEIRTTNPVATEQYGSVSGTDNGQNDEGNEQ

SEQ ID NO: 41990 - protein, 31 aa, Artificial Sequence
  Description of Artificial Sequence: Synthetic polypeptide
DEEEIATTNPVAYEQYGSVATNLQRPGEGLN

SEQ ID NO: 41991 - protein, 31 aa, Artificial Sequence
  Description of Artificial Sequence: Synthetic polypeptide
DEEEIATTNPVAYEQYGSVATNLQRQDNTEQ

SEQ ID NO: 41992 - protein, 34 aa, Artificial Sequence
  Description of Artificial Sequence: Synthetic polypeptide
DEEEIRTTNPVATEQYGSVSGTENLQNEMGNNGT

SEQ ID NO: 41993 - protein, 32 aa, Artificial Sequence
  Description of Artificial Sequence: Synthetic polypeptide
DEEEIRTTNPVATEQYGSVSEMNLQAVGEQQE

SEQ ID NO: 41994 - protein, 31 aa, Artificial Sequence
  Description of Artificial Sequence: Synthetic polypeptide
DEEEIATTNPVAYEQYGSVATNLQVGNTAME

SEQ ID NO: 41995 - protein, 30 aa, Artificial Sequence
  Description of Artificial Sequence: Synthetic polypeptide
DEEEIATTNPVAYEQYGSVATNLQVPGETP

SEQ ID NO: 41996 - protein, 33 aa, Artificial Sequence
  Description of Artificial Sequence: Synthetic polypeptide
DEEEIRTTNPVATEQYGSVSGTDNGQNSGNEQP

SEQ ID NO: 41997 - protein, 28 aa, Artificial Sequence
  Description of Artificial Sequence: Synthetic peptide
DEEEIRTTNPCATEAYGSCATNLAPMNQ

SEQ ID NO: 41998 - protein, 33 aa, Artificial Sequence
  Description of Artificial Sequence: Synthetic polypeptide
DEEEIRTTNPVATEQYGSVCATNLQRDGDGTDA

SEQ ID NO: 41999 - protein, 34 aa, Artificial Sequence
  Description of Artificial Sequence: Synthetic polypeptide
DEEEIRTTNPVATEQYGKTVSYTNALSQRGGNFE

SEQ ID NO: 42000 - protein, 31 aa, Artificial Sequence
  Description of Artificial Sequence: Synthetic polypeptide
DEEEIRTTNPVATEQYGSVSENDEQGGGQEI

SEQ ID NO: 42001 - protein, 28 aa, Artificial Sequence
  Description of Artificial Sequence: Synthetic peptide
DEEEIRTTNPCATDQYGTVTTVEQMGNF

SEQ ID NO: 42002 - protein, 32 aa, Artificial Sequence
  Description of Artificial Sequence: Synthetic polypeptide
DEEEIRTTNPVATEQYGSVCATNLQGDLNDDI

SEQ ID NO: 42003 - protein, 29 aa, Artificial Sequence
  Description of Artificial Sequence: Synthetic peptide
DEEEIRTTNPCATDQYGTVTTNDTQMGNF

SEQ ID NO: 42004 - protein, 28 aa, Artificial Sequence
  Description of Artificial Sequence: Synthetic peptide
DEEEIRTTNPCATDQYGTVTTDNQQGNF

SEQ ID NO: 42005 - protein, 32 aa, Artificial Sequence
  Description of Artificial Sequence: Synthetic polypeptide
DEEEIRTTNPVATEQYGSVCATNDEQDDTNDR

SEQ ID NO: 42006 - protein, 30 aa, Artificial Sequence
  Description of Artificial Sequence: Synthetic polypeptide
DEEEIRTTNPAATEQYGSVPTILAIAGNGE

SEQ ID NO: 42007 - protein, 32 aa, Artificial Sequence
  Description of Artificial Sequence: Synthetic polypeptide
DEEEIRTTNPVATEQYGSVCATNDEQDDGNEH

SEQ ID NO: 42008 - protein, 31 aa, Artificial Sequence
  Description of Artificial Sequence: Synthetic polypeptide
DEEEIRTTNPVATEQYGSVCATGLDTQAGDD

SEQ ID NO: 42009 - protein, 34 aa, Artificial Sequence
  Description of Artificial Sequence: Synthetic polypeptide
DEEEIRTTNPVATEQYGSVATPNQLQFRAQSNVR

SEQ ID NO: 42010 - protein, 32 aa, Artificial Sequence
  Description of Artificial Sequence: Synthetic polypeptide
DEEEIRTTNPVATEQYGSVSGSVFLQRNEDNV

SEQ ID NO: 42011 - protein, 32 aa, Artificial Sequence
  Description of Artificial Sequence: Synthetic polypeptide
DEEEIRTTNPAATEGYGSVCTSTNLAREGNDD

SEQ ID NO: 42012 - protein, 33 aa, Artificial Sequence
  Description of Artificial Sequence: Synthetic polypeptide
DEEEIATTNPVAYEQYGSVSITNALSQRGGDDR

SEQ ID NO: 42013 - protein, 32 aa, Artificial Sequence
  Description of Artificial Sequence: Synthetic polypeptide
DEEEIRTTNPAATEGYGSVCSTNLARGGANDD

SEQ ID NO: 42014 - protein, 32 aa, Artificial Sequence
  Description of Artificial Sequence: Synthetic polypeptide
DEEEIATTNPVAYEQYGSVSQQNMLSQSGGNR

SEQ ID NO: 42015 - protein, 33 aa, Artificial Sequence
  Description of Artificial Sequence: Synthetic polypeptide
DEEEIRTTNPVATEQYGSVSENGPMMRNGMNPR

SEQ ID NO: 42016 - protein, 33 aa, Artificial Sequence
  Description of Artificial Sequence: Synthetic polypeptide
DEEEIRTTNPVATEQYGSVSGSTDNGQTGGNEG

SEQ ID NO: 42017 - protein, 29 aa, Artificial Sequence
  Description of Artificial Sequence: Synthetic peptide
DEEEIRTTNPAATEFYGSVNTNTGGNGNA

SEQ ID NO: 42018 - protein, 32 aa, Artificial Sequence
  Description of Artificial Sequence: Synthetic polypeptide
DEEEIRTTNPAATEFYGSVNSTNLAREGENGD

SEQ ID NO: 42019 - protein, 30 aa, Artificial Sequence
  Description of Artificial Sequence: Synthetic polypeptide
DEEEIATTNPVAYEQYGSVSTGDLPDGDNI

SEQ ID NO: 42020 - protein, 32 aa, Artificial Sequence
  Description of Artificial Sequence: Synthetic polypeptide
DEEEIRTTNPVATEQYGLVSTPAMQRSNNFRD

SEQ ID NO: 42021 - protein, 33 aa, Artificial Sequence
  Description of Artificial Sequence: Synthetic polypeptide
DEEEIRTTNPVATEQYGSVSGQTNLDVFGNEGG

SEQ ID NO: 42022 - protein, 31 aa, Artificial Sequence
  Description of Artificial Sequence: Synthetic polypeptide
DEEEIATTNPVAYEQYGSVSTGDLQNDGDTR

SEQ ID NO: 42023 - protein, 29 aa, Artificial Sequence
  Description of Artificial Sequence: Synthetic peptide
DEEEIRTTNPAATEAYGSVGATNMGNGNA

SEQ ID NO: 42024 - protein, 33 aa, Artificial Sequence
  Description of Artificial Sequence: Synthetic polypeptide
DEEEIATTNPVAYEQYGSVPSYTGNMLSQSGNR

SEQ ID NO: 42025 - protein, 31 aa, Artificial Sequence
  Description of Artificial Sequence: Synthetic polypeptide
DEEEIATTNPVAYEQYGSVATNLQRPGEETM

SEQ ID NO: 42026 - protein, 31 aa, Artificial Sequence
  Description of Artificial Sequence: Synthetic polypeptide
DEEEIRTTNPAATEQYGSVGSGGNGQGDGND

SEQ ID NO: 42027 - protein, 30 aa, Artificial Sequence
  Description of Artificial Sequence: Synthetic polypeptide
DEEEIRTTNPVATEQYGSVATTDGASQDNR

SEQ ID NO: 42028 - protein, 29 aa, Artificial Sequence
  Description of Artificial Sequence: Synthetic peptide
DEEEIRTTNPAATEQYGSVPTDLATGPED

SEQ ID NO: 42029 - protein, 32 aa, Artificial Sequence
  Description of Artificial Sequence: Synthetic polypeptide
DEEEIRTTNPVATEQYGSVCAMIDLQDHGENR

SEQ ID NO: 42030 - protein, 29 aa, Artificial Sequence
  Description of Artificial Sequence: Synthetic peptide
DEEEIRTTNPAATEQYGSVPTDLAEGPGE

SEQ ID NO: 42031 - protein, 31 aa, Artificial Sequence
  Description of Artificial Sequence: Synthetic polypeptide
DEEEIRTTNPVATEQYGSVCAGEGNLQNDNE

SEQ ID NO: 42032 - protein, 30 aa, Artificial Sequence
  Description of Artificial Sequence: Synthetic polypeptide
DEEEIRTTNPAATEQYGSVPTDAANGQGNE

SEQ ID NO: 42033 - protein, 30 aa, Artificial Sequence
  Description of Artificial Sequence: Synthetic polypeptide
DEEEIRTTNPAATEQYGSVPTALIRGQGEE

SEQ ID NO: 42034 - protein, 33 aa, Artificial Sequence
  Description of Artificial Sequence: Synthetic polypeptide
DEEEIRTTNPVATEQYGSVCADTWGLAQREQNR

SEQ ID NO: 42035 - protein, 31 aa, Artificial Sequence
  Description of Artificial Sequence: Synthetic polypeptide
DEEEIRTTNPVATEQYGSVSENDLQQSLEEI

SEQ ID NO: 42036 - protein, 31 aa, Artificial Sequence
  Description of Artificial Sequence: Synthetic polypeptide
DEEEIATTNPVAYEQYGSVCCTTLSQRVNQR

SEQ ID NO: 42037 - protein, 33 aa, Artificial Sequence
  Description of Artificial Sequence: Synthetic polypeptide
DEEEIRTTNPAATEQYGSVINTQNLQREGGNGG

SEQ ID NO: 42038 - protein, 32 aa, Artificial Sequence
  Description of Artificial Sequence: Synthetic polypeptide
DEEEIRTTNPVATEQYGSVCAANNLQDGMPRM

SEQ ID NO: 42039 - protein, 32 aa, Artificial Sequence
  Description of Artificial Sequence: Synthetic polypeptide
DEEEIRTTNPAATEQYGSVIMTNLQGGGNGDE

SEQ ID NO: 42040 - protein, 33 aa, Artificial Sequence
  Description of Artificial Sequence: Synthetic polypeptide
DEEEIRTTNPAATEQYGSVIITNLQPREGGNGG

SEQ ID NO: 42041 - protein, 29 aa, Artificial Sequence
  Description of Artificial Sequence: Synthetic peptide
DEEEIRTTNPVATEQYGSVAYVLHDGEEM

SEQ ID NO: 42042 - protein, 32 aa, Artificial Sequence
  Description of Artificial Sequence: Synthetic polypeptide
DEEEIRTTNPVATEQYGSVAVMTNLIQPELRN

SEQ ID NO: 42043 - protein, 31 aa, Artificial Sequence
  Description of Artificial Sequence: Synthetic polypeptide
DEEEIRTTNPAATEQYGSVIAPENLQRGEEA

SEQ ID NO: 42044 - protein, 33 aa, Artificial Sequence
  Description of Artificial Sequence: Synthetic polypeptide
DEEEIRTTNPVATEQYGKTVSYTNALQPGGNTE

SEQ ID NO: 42045 - protein, 30 aa, Artificial Sequence
  Description of Artificial Sequence: Synthetic polypeptide
DEECISTTNPVATEGYGSVCNTNADQRGNQ

SEQ ID NO: 42046 - protein, 32 aa, Artificial Sequence
  Description of Artificial Sequence: Synthetic polypeptide
DEEEIRTTNPVATEQYGSVSGTFNVEGGGGNI

SEQ ID NO: 42047 - protein, 31 aa, Artificial Sequence
  Description of Artificial Sequence: Synthetic polypeptide
DEEEIATTNPVAYEQYGSVATNLQAPGENLH

SEQ ID NO: 42048 - protein, 31 aa, Artificial Sequence
  Description of Artificial Sequence: Synthetic polypeptide
DEEEIRTTNPVATEQYGSVCFTDAMQGGNEM

SEQ ID NO: 42049 - protein, 31 aa, Artificial Sequence
  Description of Artificial Sequence: Synthetic polypeptide
DEEEIRTTNPVATEQYGICVSTNHQGFGSEQ

SEQ ID NO: 42050 - protein, 30 aa, Artificial Sequence
  Description of Artificial Sequence: Synthetic polypeptide
DEECISTTNPVATEGYGSVNTNALQHGSNQ

SEQ ID NO: 42051 - protein, 32 aa, Artificial Sequence
  Description of Artificial Sequence: Synthetic polypeptide
DEEEIATTNPVAYEQYGSVATNLQDADGNDRH

SEQ ID NO: 42052 - protein, 30 aa, Artificial Sequence
  Description of Artificial Sequence: Synthetic polypeptide
DEEEIRTTNPCATEAYGSVTVTNLLAGGNT

SEQ ID NO: 42053 - protein, 33 aa, Artificial Sequence
  Description of Artificial Sequence: Synthetic polypeptide
DEEEIRTTNPVATEQYGSVCFMTGLNQRGNMES

SEQ ID NO: 42054 - protein, 35 aa, Artificial Sequence
  Description of Artificial Sequence: Synthetic polypeptide
DEEEIRTTNPVATEQYGISVPSGTNLSQAGGSNRQ

SEQ ID NO: 42055 - protein, 34 aa, Artificial Sequence
  Description of Artificial Sequence: Synthetic polypeptide
DEEEIRTTNPVATEQYGISVSCTGNMESQSGGNR

SEQ ID NO: 42056 - protein, 30 aa, Artificial Sequence
  Description of Artificial Sequence: Synthetic polypeptide
DEEEIRTTNPCATEAYGSVTTTNLLAGGNT

SEQ ID NO: 42057 - protein, 31 aa, Artificial Sequence
  Description of Artificial Sequence: Synthetic polypeptide
DEEEIATTNPVAYEQYGSVATNLQDAGPQAR

SEQ ID NO: 42058 - protein, 30 aa, Artificial Sequence
  Description of Artificial Sequence: Synthetic polypeptide
DEEEIATTNPVAYEQYGSVATNLQDDGDTE

SEQ ID NO: 42059 - protein, 31 aa, Artificial Sequence
  Description of Artificial Sequence: Synthetic polypeptide
DEECIRTTNPVAYEQWDYSVSIDNLQRGDNR

SEQ ID NO: 42060 - protein, 33 aa, Artificial Sequence
  Description of Artificial Sequence: Synthetic polypeptide
DEEEIRTTNPVATEQYGSVCETMNLVQQRMEPR

SEQ ID NO: 42061 - protein, 32 aa, Artificial Sequence
  Description of Artificial Sequence: Synthetic polypeptide
DEEEIRTTNPCATEAYGSVTSTNLQAGTTNGT

SEQ ID NO: 42062 - protein, 30 aa, Artificial Sequence
  Description of Artificial Sequence: Synthetic polypeptide
DEEEIATTNPVAYEQYGSVATNLQANPGMT

SEQ ID NO: 42063 - protein, 33 aa, Artificial Sequence
  Description of Artificial Sequence: Synthetic polypeptide
DEEEIRTTNPVATEQYGSVCETMNLVQQPMMNR

SEQ ID NO: 42064 - protein, 30 aa, Artificial Sequence
  Description of Artificial Sequence: Synthetic polypeptide
DEEEIATTNPVAYEQYGSVATNLQANGTED

SEQ ID NO: 42065 - protein, 31 aa, Artificial Sequence
  Description of Artificial Sequence: Synthetic polypeptide
DEEEIRTTNPVATEQYGSVSELIQPIENERQ

SEQ ID NO: 42066 - protein, 32 aa, Artificial Sequence
  Description of Artificial Sequence: Synthetic polypeptide
DEEEIRTTNPVATEQYGSVSGTNDIQGEGGQG

SEQ ID NO: 42067 - protein, 32 aa, Artificial Sequence
  Description of Artificial Sequence: Synthetic polypeptide
DEEEIRTTNPVATEQYGSVCIETNDLNRNENQ

SEQ ID NO: 42068 - protein, 29 aa, Artificial Sequence
  Description of Artificial Sequence: Synthetic peptide
DEEEIRTTNPVATEQYGSVSEILMNAEDA

SEQ ID NO: 42069 - protein, 32 aa, Artificial Sequence
  Description of Artificial Sequence: Synthetic polypeptide
DEEEIRTTNPVATEQYGSVSEINLQHVLEGQD

SEQ ID NO: 42070 - protein, 33 aa, Artificial Sequence
  Description of Artificial Sequence: Synthetic polypeptide
DEEEIRTTNPVATEQYGSVSGTNDEGQGGENTS

SEQ ID NO: 42071 - protein, 31 aa, Artificial Sequence
  Description of Artificial Sequence: Synthetic polypeptide
DEEEIATTNPVAYEQYGSVATNLDQNGDNDQ

SEQ ID NO: 42072 - protein, 32 aa, Artificial Sequence
  Description of Artificial Sequence: Synthetic polypeptide
DEEEIRTTNPVATEQYGSVSEINLQTVPEGQI

SEQ ID NO: 42073 - protein, 32 aa, Artificial Sequence
  Description of Artificial Sequence: Synthetic polypeptide
DEEEIRTTNPVATEQYGSVCGTNLQNIGSEQG

SEQ ID NO: 42074 - protein, 31 aa, Artificial Sequence
  Description of Artificial Sequence: Synthetic polypeptide
DEECIRTTNPVAYEPYGQVQACTNLQRGGNR

SEQ ID NO: 42075 - protein, 30 aa, Artificial Sequence
  Description of Artificial Sequence: Synthetic polypeptide
DEEEIATTNPVAYEQYGSVATNLETEGNEN

SEQ ID NO: 42076 - protein, 32 aa, Artificial Sequence
  Description of Artificial Sequence: Synthetic polypeptide
DEEEIRTTNPVATEQYGSVSELIIQRGENEVQ

SEQ ID NO: 42077 - protein, 30 aa, Artificial Sequence
  Description of Artificial Sequence: Synthetic polypeptide
DEEEIRTTNPVATEQYGSVSELIQEGEEEG

SEQ ID NO: 42078 - protein, 30 aa, Artificial Sequence
  Description of Artificial Sequence: Synthetic polypeptide
DEEEIATTNPVAYEQYGSVATNLQAANTEK

SEQ ID NO: 42079 - protein, 33 aa, Artificial Sequence
  Description of Artificial Sequence: Synthetic polypeptide
DEEEIRTTNPVATEQYGSVSGTNAEQVEGGNAT

SEQ ID NO: 42080 - protein, 31 aa, Artificial Sequence
  Description of Artificial Sequence: Synthetic polypeptide
DEEEIRTTNPVATEQYGSVSELIQPGEIENQ

SEQ ID NO: 42081 - protein, 33 aa, Artificial Sequence
  Description of Artificial Sequence: Synthetic polypeptide
DEEEIRTTNPVATEQYGSVCGMTNHQRFGSNAL

SEQ ID NO: 42082 - protein, 31 aa, Artificial Sequence
  Description of Artificial Sequence: Synthetic polypeptide
DEECIRTTNPVAYEQWGESVCNNLQREGDNR

SEQ ID NO: 42083 - protein, 33 aa, Artificial Sequence
  Description of Artificial Sequence: Synthetic polypeptide
DEEEIRTTNPVATEQYGSVSGTMNDIQNEGGND

SEQ ID NO: 42084 - protein, 33 aa, Artificial Sequence
  Description of Artificial Sequence: Synthetic polypeptide
DEEEIRTTNPVATEQYGSVSGTLNNAQNGNGNM

SEQ ID NO: 42085 - protein, 29 aa, Artificial Sequence
  Description of Artificial Sequence: Synthetic peptide
DEEEIRTTNPCATEAYGSVATNGGNGNEA

SEQ ID NO: 42086 - protein, 30 aa, Artificial Sequence
  Description of Artificial Sequence: Synthetic polypeptide
DEEEIRTTNPCATEAYGSVATGNHGRGNNA

SEQ ID NO: 42087 - protein, 31 aa, Artificial Sequence
  Description of Artificial Sequence: Synthetic polypeptide
DEEEIRTTNPCATEAYGSVASTNPDLGGNHR

SEQ ID NO: 42088 - protein, 33 aa, Artificial Sequence
  Description of Artificial Sequence: Synthetic polypeptide
DEEEIRTTNPVATEQYGSVCCTGNALSTTRGTR

SEQ ID NO: 42089 - protein, 33 aa, Artificial Sequence
  Description of Artificial Sequence: Synthetic polypeptide
DEEEIRTTNPVATEQYGKTVSTNALSMRGGNDE

SEQ ID NO: 42090 - protein, 31 aa, Artificial Sequence
  Description of Artificial Sequence: Synthetic polypeptide
DEEEIATTNPVAYEQYGSVATNLQNNGDNDD

SEQ ID NO: 42091 - protein, 33 aa, Artificial Sequence
  Description of Artificial Sequence: Synthetic polypeptide
DEEEIRTTNPVATEQYGKTVSTNALSQPGGNLE

SEQ ID NO: 42092 - protein, 32 aa, Artificial Sequence
  Description of Artificial Sequence: Synthetic polypeptide
DEEEIRTTNPVATEQYGSVCAVNDEEQDDGNR

SEQ ID NO: 42093 - protein, 30 aa, Artificial Sequence
  Description of Artificial Sequence: Synthetic polypeptide
DEEEIRTTNPCATEAYGSTVATNEHGRGNA

SEQ ID NO: 42094 - protein, 31 aa, Artificial Sequence
  Description of Artificial Sequence: Synthetic polypeptide
DEEEIATTNPVAYEQYGSVATNLQQGGNNQM

SEQ ID NO: 42095 - protein, 29 aa, Artificial Sequence
  Description of Artificial Sequence: Synthetic peptide
DEEEIRTTNPCATEAYGSTSTSNNAGGNT

SEQ ID NO: 42096 - protein, 30 aa, Artificial Sequence
  Description of Artificial Sequence: Synthetic polypeptide
DEEEIATTNPVAYEQYGSVATNLQQMGDEL

SEQ ID NO: 42097 - protein, 31 aa, Artificial Sequence
  Description of Artificial Sequence: Synthetic polypeptide
DEEEIATTNPVAYEQYGSVATNLQQPDNDRH

SEQ ID NO: 42098 - protein, 33 aa, Artificial Sequence
  Description of Artificial Sequence: Synthetic polypeptide
DEEEIRTTNPVATEQYGSVSGTGNGDGQGEGNG

SEQ ID NO: 42099 - protein, 33 aa, Artificial Sequence
  Description of Artificial Sequence: Synthetic polypeptide
DEEEIRTTNPVATEQYGSVSGTGNDEQDGGNDG

SEQ ID NO: 42100 - protein, 33 aa, Artificial Sequence
  Description of Artificial Sequence: Synthetic polypeptide
DEEEIRTTNPVATEQYGSVCCTGNLSGIRGGTR

SEQ ID NO: 42101 - protein, 33 aa, Artificial Sequence
  Description of Artificial Sequence: Synthetic polypeptide
DEEEIRTTNPVATEQYGSVSGTMNDEQGGTNDD

SEQ ID NO: 42102 - protein, 34 aa, Artificial Sequence
  Description of Artificial Sequence: Synthetic polypeptide
DEEEIRTTNPVATEQYGKTVSCTNLTQDGGNNRV

SEQ ID NO: 42103 - protein, 34 aa, Artificial Sequence
  Description of Artificial Sequence: Synthetic polypeptide
DEEEIRTTNPVATEQYGKTVSCTNLSTRDGNNER

SEQ ID NO: 42104 - protein, 31 aa, Artificial Sequence
  Description of Artificial Sequence: Synthetic polypeptide
DEEEIRTTNPCATEAYGSVTSTNLEAGNNTE

SEQ ID NO: 42105 - protein, 30 aa, Artificial Sequence
  Description of Artificial Sequence: Synthetic polypeptide
DEEEIRTTNPCATEAYGSVTSTNLAGTNTT

SEQ ID NO: 42106 - protein, 30 aa, Artificial Sequence
  Description of Artificial Sequence: Synthetic polypeptide
DEEEIRTTNPCATEAYGSVTSTNLAGSNNT

SEQ ID NO: 42107 - protein, 30 aa, Artificial Sequence
  Description of Artificial Sequence: Synthetic polypeptide
DEEEIRTTNPCATEAYGSVTNSNNLAGGNT

SEQ ID NO: 42108 - protein, 33 aa, Artificial Sequence
  Description of Artificial Sequence: Synthetic polypeptide
DEEEIRTTNPVATEQYGSVSGTLNGLELEGGNE

SEQ ID NO: 42109 - protein, 35 aa, Artificial Sequence
  Description of Artificial Sequence: Synthetic polypeptide
DEEEIRTTNPVATEQYGISVVSTTNMLQATGGDNR

SEQ ID NO: 42110 - protein, 31 aa, Artificial Sequence
  Description of Artificial Sequence: Synthetic polypeptide
DEEEIATTNPVAYEQYGSVATNLQGGDNPDQ

SEQ ID NO: 42111 - protein, 30 aa, Artificial Sequence
  Description of Artificial Sequence: Synthetic polypeptide
DEEEIRTTNPCATEAYGSVPATNHSGRGNA

SEQ ID NO: 42112 - protein, 31 aa, Artificial Sequence
  Description of Artificial Sequence: Synthetic polypeptide
DEEEIRTTNPCATEAYGSVNTTNLQAGNGNT

SEQ ID NO: 42113 - protein, 28 aa, Artificial Sequence
  Description of Artificial Sequence: Synthetic peptide
DEEEIRTTNPCATEAYGSVATVGGVGNA

SEQ ID NO: 42114 - protein, 33 aa, Artificial Sequence
  Description of Artificial Sequence: Synthetic polypeptide
DEEEIRTTNPVATEQYGIVSSTTNGPNRNGNPR

SEQ ID NO: 42115 - protein, 29 aa, Artificial Sequence
  Description of Artificial Sequence: Synthetic peptide
DEEEIRTTNPVATEQYGIVTANLVAEANN

SEQ ID NO: 42116 - protein, 33 aa, Artificial Sequence
  Description of Artificial Sequence: Synthetic polypeptide
DEEEIRTTNPVATEQYGKTVQSTNALSTRGNNE

SEQ ID NO: 42117 - protein, 32 aa, Artificial Sequence
  Description of Artificial Sequence: Synthetic polypeptide
DEEEIRTTNPVATEQYGSVSGTLNGGEDEGNE

SEQ ID NO: 42118 - protein, 34 aa, Artificial Sequence
  Description of Artificial Sequence: Synthetic polypeptide
DEEEIRTTNPVATEQYGKTVSCTNELSQRNVNIR

SEQ ID NO: 42119 - protein, 29 aa, Artificial Sequence
  Description of Artificial Sequence: Synthetic peptide
DEEEIRTTNPCATEAYGSVATNQDGQENA

SEQ ID NO: 42120 - protein, 31 aa, Artificial Sequence
  Description of Artificial Sequence: Synthetic polypeptide
DEEEIRTTNPVATEQYGSVCITGLQVAGDDQ

SEQ ID NO: 42121 - protein, 32 aa, Artificial Sequence
  Description of Artificial Sequence: Synthetic polypeptide
DEEEIATTNPVAYEQYGSVSTGIMLSQQGGNR

SEQ ID NO: 42122 - protein, 32 aa, Artificial Sequence
  Description of Artificial Sequence: Synthetic polypeptide
DEEEIRTTNPVATEQYGSVSENLDQYMSEERQ

SEQ ID NO: 42123 - protein, 29 aa, Artificial Sequence
  Description of Artificial Sequence: Synthetic peptide
DEEEIATTNPVCTESYGCVSNNNLQDGNL

SEQ ID NO: 42124 - protein, 30 aa, Artificial Sequence
  Description of Artificial Sequence: Synthetic polypeptide
DEEEIATTNPVCTETYGSVSNNNLQDGNQL

SEQ ID NO: 42125 - protein, 32 aa, Artificial Sequence
  Description of Artificial Sequence: Synthetic polypeptide
DEEEIRTTNPVATEQYGSVSGNNDQENGENGI

SEQ ID NO: 42126 - protein, 30 aa, Artificial Sequence
  Description of Artificial Sequence: Synthetic polypeptide
DEEEIATTNPVCTETYGSVSNPNLQDGENM

SEQ ID NO: 42127 - protein, 30 aa, Artificial Sequence
  Description of Artificial Sequence: Synthetic polypeptide
DEEEIATTNPVGTEQYGSVSWNDLGTRGDP

SEQ ID NO: 42128 - protein, 33 aa, Artificial Sequence
  Description of Artificial Sequence: Synthetic polypeptide
DEEEIRTTNPVATEQYGNVSTDNLDQEMGNDII

SEQ ID NO: 42129 - protein, 31 aa, Artificial Sequence
  Description of Artificial Sequence: Synthetic polypeptide
DEEEIRTTNPVATEQYGSVATNLQAEAPDDD

SEQ ID NO: 42130 - protein, 30 aa, Artificial Sequence
  Description of Artificial Sequence: Synthetic polypeptide
DEEEIATTNPVSSEQYGSVSCNLPNRGMTR

SEQ ID NO: 42131 - protein, 30 aa, Artificial Sequence
  Description of Artificial Sequence: Synthetic polypeptide
DEEEIATTNPVSTEQYGSVTFNELQGGNQT

SEQ ID NO: 42132 - protein, 32 aa, Artificial Sequence
  Description of Artificial Sequence: Synthetic polypeptide
DEEEIRTTNPVATEQYGSVSGNLVNMVGENFE

SEQ ID NO: 42133 - protein, 32 aa, Artificial Sequence
  Description of Artificial Sequence: Synthetic polypeptide
DEEEIRTTNPVATEQYGNVSTSNLDIFGGNIQ

SEQ ID NO: 42134 - protein, 32 aa, Artificial Sequence
  Description of Artificial Sequence: Synthetic polypeptide
DEEEIRTTNPVATEQYGNVSTTLDQDEGGNES

SEQ ID NO: 42135 - protein, 33 aa, Artificial Sequence
  Description of Artificial Sequence: Synthetic polypeptide
DEEEIRTTNPVATEQYGNVSWTDLDNRQGMNDR

SEQ ID NO: 42136 - protein, 29 aa, Artificial Sequence
  Description of Artificial Sequence: Synthetic peptide
DEEEIATVNPVATEQYGSVATGLQSRNSE

SEQ ID NO: 42137 - protein, 29 aa, Artificial Sequence
  Description of Artificial Sequence: Synthetic peptide
DEEEIATTNPVSTEQWGSVAANLQGGNQT

SEQ ID NO: 42138 - protein, 30 aa, Artificial Sequence
  Description of Artificial Sequence: Synthetic polypeptide
DEEEIATTNPVCTEQYGSVSDNLQDSEGEQ

SEQ ID NO: 42139 - protein, 33 aa, Artificial Sequence
  Description of Artificial Sequence: Synthetic polypeptide
DEEEIRTTNPVATEQYGSVSGNNLQEIGFNETS

SEQ ID NO: 42140 - protein, 31 aa, Artificial Sequence
  Description of Artificial Sequence: Synthetic polypeptide
DEEEIRTTNPVATEQYGNTTIATNELQMGNH

SEQ ID NO: 42141 - protein, 32 aa, Artificial Sequence
  Description of Artificial Sequence: Synthetic polypeptide
DEEEIRTTNPVATEQYGMVSTQNGTQGMEGNE

SEQ ID NO: 42142 - protein, 32 aa, Artificial Sequence
  Description of Artificial Sequence: Synthetic polypeptide
DEEEIRTTNPVATEQYGMVSTTDNFTQNGNID

SEQ ID NO: 42143 - protein, 32 aa, Artificial Sequence
  Description of Artificial Sequence: Synthetic polypeptide
DEEEIRTTNPVATEQYGMVSTVNFTQGGGNQN

SEQ ID NO: 42144 - protein, 33 aa, Artificial Sequence
  Description of Artificial Sequence: Synthetic polypeptide
DEEEIRTTNPVATEQYGMVSTVNLNQNIGENGD

SEQ ID NO: 42145 - protein, 33 aa, Artificial Sequence
  Description of Artificial Sequence: Synthetic polypeptide
DEEEIRSTNPVATEQYGSVCSVNDQDRQGSNSR

SEQ ID NO: 42146 - protein, 33 aa, Artificial Sequence
  Description of Artificial Sequence: Synthetic polypeptide
DEEEIRTTNPVATEQYGSVSGNNNLQESGGNGQ

SEQ ID NO: 42147 - protein, 32 aa, Artificial Sequence
  Description of Artificial Sequence: Synthetic polypeptide
DEEEIRTTNPVATEQYGMVSTVNLVGVGNNGD

SEQ ID NO: 42148 - protein, 32 aa, Artificial Sequence
  Description of Artificial Sequence: Synthetic polypeptide
DEEEIRTTNPVATEQYGMVSVTNILNQNQGVN

SEQ ID NO: 42149 - protein, 33 aa, Artificial Sequence
  Description of Artificial Sequence: Synthetic polypeptide
DEEEIRTTNPVATEQYGMVTSTNNLQQEGGGNI

SEQ ID NO: 42150 - protein, 31 aa, Artificial Sequence
  Description of Artificial Sequence: Synthetic polypeptide
DEEEIRTTNPVATEQYGMVVTNLQLGVGMDP

SEQ ID NO: 42151 - protein, 30 aa, Artificial Sequence
  Description of Artificial Sequence: Synthetic polypeptide
DEEEIATTNPVCTEQYGSVSDNLQDSEGEL

SEQ ID NO: 42152 - protein, 31 aa, Artificial Sequence
  Description of Artificial Sequence: Synthetic polypeptide
DEEEIRTTNPVATEQYGNTIATAELQMEGNR

SEQ ID NO: 42153 - protein, 32 aa, Artificial Sequence
  Description of Artificial Sequence: Synthetic polypeptide
DEEEIRTTNPVATEQYGNTIATNEGLQQGPNR

SEQ ID NO: 42154 - protein, 32 aa, Artificial Sequence
  Description of Artificial Sequence: Synthetic polypeptide
DEEEIRTTNPVATEQYGNTIATNPLPQRDSNR

SEQ ID NO: 42155 - protein, 33 aa, Artificial Sequence
  Description of Artificial Sequence: Synthetic polypeptide
DEEEIRTTNPVATEQYGSVSGNNLQENGGENGE

SEQ ID NO: 42156 - protein, 29 aa, Artificial Sequence
  Description of Artificial Sequence: Synthetic peptide
DEEEIATVNPVATEQYGSVSDDLQSGEDL

SEQ ID NO: 42157 - protein, 31 aa, Artificial Sequence
  Description of Artificial Sequence: Synthetic polypeptide
DEEEIATVNPVATEQYGSVSSTDAGQRNGNV

SEQ ID NO: 42158 - protein, 31 aa, Artificial Sequence
  Description of Artificial Sequence: Synthetic polypeptide
DEEEIATVNPVATEQYGSVSTGLQSRDNQTE

SEQ ID NO: 42159 - protein, 31 aa, Artificial Sequence
  Description of Artificial Sequence: Synthetic polypeptide
DEEEIATVNPVATEQYGSVSTGLQSRNNQEQ

SEQ ID NO: 42160 - protein, 29 aa, Artificial Sequence
  Description of Artificial Sequence: Synthetic peptide
DEEEIRPTNPVASEQYGSVSCPALNSGTR

SEQ ID NO: 42161 - protein, 32 aa, Artificial Sequence
  Description of Artificial Sequence: Synthetic polypeptide
DEEEIRTTNPVATEQYGSVSENSGNVRGQNED

SEQ ID NO: 42162 - protein, 30 aa, Artificial Sequence
  Description of Artificial Sequence: Synthetic polypeptide
DEEEIRTTNPVATEQYGSVSENTLETLEDQ

SEQ ID NO: 42163 - protein, 30 aa, Artificial Sequence
  Description of Artificial Sequence: Synthetic polypeptide
DEEEIRTTNPVATEQYGSVATLDQAGPEDG

SEQ ID NO: 42164 - protein, 32 aa, Artificial Sequence
  Description of Artificial Sequence: Synthetic polypeptide
DEEEIRTTNPVATEQYGQCVCSSNLQGGSNAN

SEQ ID NO: 42165 - protein, 31 aa, Artificial Sequence
  Description of Artificial Sequence: Synthetic polypeptide
DEEEIRTTNPVATEQYGQCVCSSNLQNGSEA

SEQ ID NO: 42166 - protein, 32 aa, Artificial Sequence
  Description of Artificial Sequence: Synthetic polypeptide
DEEEIRTTNPVATEQYGQCVCSTELQFSNSNR

SEQ ID NO: 42167 - protein, 30 aa, Artificial Sequence
  Description of Artificial Sequence: Synthetic polypeptide
DEEEIRTTNPVATEQYGSVATIYIRAGLDP

SEQ ID NO: 42168 - protein, 32 aa, Artificial Sequence
  Description of Artificial Sequence: Synthetic polypeptide
DEEEIRTTNPVATEQYGQCVCSTEPQRGSNQG

SEQ ID NO: 42169 - protein, 32 aa, Artificial Sequence
  Description of Artificial Sequence: Synthetic polypeptide
DEEEIRTTNPVATEQYGQCVCSTNAHQFGSNQ

SEQ ID NO: 42170 - protein, 34 aa, Artificial Sequence
  Description of Artificial Sequence: Synthetic polypeptide
DEEEIRTTNPVATEQYGQCVCSTNDLQERGSNQG

SEQ ID NO: 42171 - protein, 32 aa, Artificial Sequence
  Description of Artificial Sequence: Synthetic polypeptide
DEEEIRTTNPVATEQYGQCVCSTNHQHNSNRT

SEQ ID NO: 42172 - protein, 33 aa, Artificial Sequence
  Description of Artificial Sequence: Synthetic polypeptide
DEEEIRTTNPVATEQYGQCVCSTNHQRGSNFQA

SEQ ID NO: 42173 - protein, 33 aa, Artificial Sequence
  Description of Artificial Sequence: Synthetic polypeptide
DEEEIRTTNPVATEQYGQCVCSTNHQRSGSNQF

SEQ ID NO: 42174 - protein, 31 aa, Artificial Sequence
  Description of Artificial Sequence: Synthetic polypeptide
DEEEIRTTNPVATEQYGQCVCSTNHQRVSEQ

SEQ ID NO: 42175 - protein, 32 aa, Artificial Sequence
  Description of Artificial Sequence: Synthetic polypeptide
DEEEIRTTNPVATEQYGQCVCSNTYLQRNSNQ

SEQ ID NO: 42176 - protein, 32 aa, Artificial Sequence
  Description of Artificial Sequence: Synthetic polypeptide
DEEEIRTTNPVATEQYGSVSGNTNEMNDGGNP

SEQ ID NO: 42177 - protein, 33 aa, Artificial Sequence
  Description of Artificial Sequence: Synthetic polypeptide
DEEEIRTTNPVATEQYGQCVCSNTNTQRGSNQM

SEQ ID NO: 42178 - protein, 32 aa, Artificial Sequence
  Description of Artificial Sequence: Synthetic polypeptide
DEEEIRTTNPVATEQYGQCTCSTNEHQRGSNQ

SEQ ID NO: 42179 - protein, 30 aa, Artificial Sequence
  Description of Artificial Sequence: Synthetic polypeptide
DEEEIATVNPVATEQYGVVSATDLQSEGNQ

SEQ ID NO: 42180 - protein, 31 aa, Artificial Sequence
  Description of Artificial Sequence: Synthetic polypeptide
DEEEIATVNPVATEQYGVVSCNLPQREGENQ

SEQ ID NO: 42181 - protein, 31 aa, Artificial Sequence
  Description of Artificial Sequence: Synthetic polypeptide
DEEEIRTTNPVATEQYGSVATNDLQTSFIFS

SEQ ID NO: 42182 - protein, 28 aa, Artificial Sequence
  Description of Artificial Sequence: Synthetic peptide
DEEEIATVNPVCTEQYGVVSDALQSGNQ

SEQ ID NO: 42183 - protein, 28 aa, Artificial Sequence
  Description of Artificial Sequence: Synthetic peptide
DEEEIATVNPVCTEQYGVVSDNIQSGNH

SEQ ID NO: 42184 - protein, 28 aa, Artificial Sequence
  Description of Artificial Sequence: Synthetic peptide
DEEEIATVNPVCTEQYGVVSDNIQSGNQ

SEQ ID NO: 42185 - protein, 31 aa, Artificial Sequence
  Description of Artificial Sequence: Synthetic polypeptide
DEEEIRPTNPVAYEAWGSVSTNMLSQRGGNA

SEQ ID NO: 42186 - protein, 32 aa, Artificial Sequence
  Description of Artificial Sequence: Synthetic polypeptide
DEEEIRTTNPVATEQYGNVTNTNLLQNQGEQR

SEQ ID NO: 42187 - protein, 32 aa, Artificial Sequence
  Description of Artificial Sequence: Synthetic polypeptide
DEEEIRPTNPVATEQYGSVVSVNQSDRGGNTR

SEQ ID NO: 42188 - protein, 32 aa, Artificial Sequence
  Description of Artificial Sequence: Synthetic polypeptide
DEEEIRPTNPVATEQYGSVVSVNQDRTGGNNR

SEQ ID NO: 42189 - protein, 32 aa, Artificial Sequence
  Description of Artificial Sequence: Synthetic polypeptide
DEEEIRPTNPVATEQYGSVSVGNQSDRGGNNR

SEQ ID NO: 42190 - protein, 33 aa, Artificial Sequence
  Description of Artificial Sequence: Synthetic polypeptide
DEEEIRTTNPVATEQYGSVSENNLGQRVGPVEL

SEQ ID NO: 42191 - protein, 33 aa, Artificial Sequence
  Description of Artificial Sequence: Synthetic polypeptide
DEEEIRTTNPVATEQYGSVSENNLQLVGENLFD

SEQ ID NO: 42192 - protein, 33 aa, Artificial Sequence
  Description of Artificial Sequence: Synthetic polypeptide
DEEEIRTTNPVATEQYGNVYSTNAQDQNCGYNR

SEQ ID NO: 42193 - protein, 31 aa, Artificial Sequence
  Description of Artificial Sequence: Synthetic polypeptide
DEEEIRTTNPVATEQYGSVSENNPQLVGEAG

SEQ ID NO: 42194 - protein, 33 aa, Artificial Sequence
  Description of Artificial Sequence: Synthetic polypeptide
DEEEIRTTNPVATEQYGQCVCSMTNHQYGSNRS

SEQ ID NO: 42195 - protein, 33 aa, Artificial Sequence
  Description of Artificial Sequence: Synthetic polypeptide
DEEEIRTTNPVATEQYGSVSGNTNLGNNFGNVP

SEQ ID NO: 42196 - protein, 33 aa, Artificial Sequence
  Description of Artificial Sequence: Synthetic polypeptide
DEEEIRTTNPVATEQYGSVSENLQMRIMMNNIT

SEQ ID NO: 42197 - protein, 33 aa, Artificial Sequence
  Description of Artificial Sequence: Synthetic polypeptide
DEEEIRTTNPVATEQYGMVSTNNLQENDGGNEI

SEQ ID NO: 42198 - protein, 32 aa, Artificial Sequence
  Description of Artificial Sequence: Synthetic polypeptide
DEEEIRTTNPVATEQYGSVSENLLQRMLIETP

SEQ ID NO: 42199 - protein, 31 aa, Artificial Sequence
  Description of Artificial Sequence: Synthetic polypeptide
DEEEIATTNPVAYEQYGSVSTNLQGQGDGDK

SEQ ID NO: 42200 - protein, 32 aa, Artificial Sequence
  Description of Artificial Sequence: Synthetic polypeptide
DEEEIRTTNPVATEQYGSVSGQNGGQNNGNGE

SEQ ID NO: 42201 - protein, 31 aa, Artificial Sequence
  Description of Artificial Sequence: Synthetic polypeptide
DEEEIATTNPVAYEQYGSVSTNLQNNGDDEN

SEQ ID NO: 42202 - protein, 30 aa, Artificial Sequence
  Description of Artificial Sequence: Synthetic polypeptide
DEEEIRTCNPVATEQYGSVSTGGQRNQQEE

SEQ ID NO: 42203 - protein, 30 aa, Artificial Sequence
  Description of Artificial Sequence: Synthetic polypeptide
DEEEIRTCNPVATEQYGSVSTGGQRNQEEG

SEQ ID NO: 42204 - protein, 31 aa, Artificial Sequence
  Description of Artificial Sequence: Synthetic polypeptide
DEEEIRTTNPVATEQYGSVATNLVAEGEDVQ

SEQ ID NO: 42205 - protein, 32 aa, Artificial Sequence
  Description of Artificial Sequence: Synthetic polypeptide
DEEEIRTTNPVATEQYGMVGSGNLNQEGGNIG

SEQ ID NO: 42206 - protein, 31 aa, Artificial Sequence
  Description of Artificial Sequence: Synthetic polypeptide
DEEEIRTCNPVATEQYGSVSTGGQGGNQGEF

SEQ ID NO: 42207 - protein, 31 aa, Artificial Sequence
  Description of Artificial Sequence: Synthetic polypeptide
DEEEIATTNPVAYEQYGSVSTNNQAQGGNDT

SEQ ID NO: 42208 - protein, 31 aa, Artificial Sequence
  Description of Artificial Sequence: Synthetic polypeptide
DEEEIATTNPVAYEQYGSVSTNNQHNGDNDG

SEQ ID NO: 42209 - protein, 31 aa, Artificial Sequence
  Description of Artificial Sequence: Synthetic polypeptide
DEEEIRTCNPVATEQYGSVSTGGQGGNQEFE

SEQ ID NO: 42210 - protein, 32 aa, Artificial Sequence
  Description of Artificial Sequence: Synthetic polypeptide
DEEEIRTCNPVATEQYGSVSTGGQGGNNQREE

SEQ ID NO: 42211 - protein, 30 aa, Artificial Sequence
  Description of Artificial Sequence: Synthetic polypeptide
DEEEIATTNPVAYEQYGSVSTTQQQGNDDP

SEQ ID NO: 42212 - protein, 30 aa, Artificial Sequence
  Description of Artificial Sequence: Synthetic polypeptide
DEEEIRTCNPVATEQYGSVSTGGQGGDDGE

SEQ ID NO: 42213 - protein, 31 aa, Artificial Sequence
  Description of Artificial Sequence: Synthetic polypeptide
DEEEIATTNPVAYEQYGSVSTNETSQDGGNV

SEQ ID NO: 42214 - protein, 30 aa, Artificial Sequence
  Description of Artificial Sequence: Synthetic polypeptide
DEEEIRTCNPVATEQYGSVSTGGQEGGDQE

SEQ ID NO: 42215 - protein, 31 aa, Artificial Sequence
  Description of Artificial Sequence: Synthetic polypeptide
DEEEIATTNPVAYEQYGSVSTNDQAGGVGNQ

SEQ ID NO: 42216 - protein, 31 aa, Artificial Sequence
  Description of Artificial Sequence: Synthetic polypeptide
DEEEIRTCNPVATEQYGSVSTRLQGNNQIEG

SEQ ID NO: 42217 - protein, 33 aa, Artificial Sequence
  Description of Artificial Sequence: Synthetic polypeptide
DEEEIRTTNPVATEQYGMSGSTNLQMEGEGENI

SEQ ID NO: 42218 - protein, 31 aa, Artificial Sequence
  Description of Artificial Sequence: Synthetic polypeptide
DEEEIATTNPVAYEQYGSVSTGNDQNDGDKR

SEQ ID NO: 42219 - protein, 31 aa, Artificial Sequence
  Description of Artificial Sequence: Synthetic polypeptide
DEEEIATTNPVAYEQYGSVSTGNGGLQGNAD

SEQ ID NO: 42220 - protein, 30 aa, Artificial Sequence
  Description of Artificial Sequence: Synthetic polypeptide
DEEEIRTCNPVATERYGSVTSTLLQGNMQG

SEQ ID NO: 42221 - protein, 31 aa, Artificial Sequence
  Description of Artificial Sequence: Synthetic polypeptide
DEEEIRTTNPVATEQYGMTISTNGGQGGNDG

SEQ ID NO: 42222 - protein, 31 aa, Artificial Sequence
  Description of Artificial Sequence: Synthetic polypeptide
DEEEIRTCNPVATEQYGSVVSTRGLQEDNQE

SEQ ID NO: 42223 - protein, 31 aa, Artificial Sequence
  Description of Artificial Sequence: Synthetic polypeptide
DEEEIRTCNPVATEQYGSVVSTGGQGGNQTE

SEQ ID NO: 42224 - protein, 31 aa, Artificial Sequence
  Description of Artificial Sequence: Synthetic polypeptide
DEEEIRTCNPVATEQYGSVVSTGGQGGNNQE

SEQ ID NO: 42225 - protein, 33 aa, Artificial Sequence
  Description of Artificial Sequence: Synthetic polypeptide
DEEEIRTTNPVATEQYGMTSMTENLSFERIGNR

SEQ ID NO: 42226 - protein, 31 aa, Artificial Sequence
  Description of Artificial Sequence: Synthetic polypeptide
DEEEIATTNPVAYEQYGSVSTGNGNQNDGDR

SEQ ID NO: 42227 - protein, 31 aa, Artificial Sequence
  Description of Artificial Sequence: Synthetic polypeptide
DEEEIATTNPVAYEQYGSVSTGNLGNDGDDR

SEQ ID NO: 42228 - protein, 31 aa, Artificial Sequence
  Description of Artificial Sequence: Synthetic polypeptide
DEEEIATTNPVAYEQYGSVSTGNLGPDGNTN

SEQ ID NO: 42229 - protein, 32 aa, Artificial Sequence
  Description of Artificial Sequence: Synthetic polypeptide
DEEEIATTNPVAYEQYGSVSTGNMLSQSGGNV

SEQ ID NO: 42230 - protein, 32 aa, Artificial Sequence
  Description of Artificial Sequence: Synthetic polypeptide
DEEEIATTNPVAYEQYGSVSTGNMLSQSGNEY

SEQ ID NO: 42231 - protein, 33 aa, Artificial Sequence
  Description of Artificial Sequence: Synthetic polypeptide
DEEEIATTNPVAYEQYGSVSTINMLSQSPGGNR

SEQ ID NO: 42232 - protein, 30 aa, Artificial Sequence
  Description of Artificial Sequence: Synthetic polypeptide
DEEEIATTNPVAYEQYGSVSTNDGNTGNND

SEQ ID NO: 42233 - protein, 32 aa, Artificial Sequence
  Description of Artificial Sequence: Synthetic polypeptide
DEEEIATTNPVAYEQYGSVSTGNDLQNDGDGR

SEQ ID NO: 42234 - protein, 32 aa, Artificial Sequence
  Description of Artificial Sequence: Synthetic polypeptide
DEEEIATTNPVAYEQYGSVVSTGNGQDAGNER

SEQ ID NO: 42235 - protein, 33 aa, Artificial Sequence
  Description of Artificial Sequence: Synthetic polypeptide
DEEEIATTNPVAYEQYGTSVSATNDLQQRGMER

SEQ ID NO: 42236 - protein, 29 aa, Artificial Sequence
  Description of Artificial Sequence: Synthetic peptide
DEEEIRSTNPVATEQYGSVYGTPSVGSNR

SEQ ID NO: 42237 - protein, 32 aa, Artificial Sequence
  Description of Artificial Sequence: Synthetic polypeptide
DEEEIRTTNPVATEQYGMVSTDNTQNNGNNID

SEQ ID NO: 42238 - protein, 31 aa, Artificial Sequence
  Description of Artificial Sequence: Synthetic polypeptide
DEEEIRSTNPVATEQYGSVSYSNLQNEIINM

SEQ ID NO: 42239 - protein, 32 aa, Artificial Sequence
  Description of Artificial Sequence: Synthetic polypeptide
DEEEIRSTNPVATEQYGSVSTTPAGQMRVGNV

SEQ ID NO: 42240 - protein, 33 aa, Artificial Sequence
  Description of Artificial Sequence: Synthetic polypeptide
DEEEIRSTNPVATEQYGSVSTNNLQEFTGGNEA

SEQ ID NO: 42241 - protein, 32 aa, Artificial Sequence
  Description of Artificial Sequence: Synthetic polypeptide
DEEEIRTTNPVATEQYGSVATNLQGEANPGDD

SEQ ID NO: 42242 - protein, 29 aa, Artificial Sequence
  Description of Artificial Sequence: Synthetic peptide
DEECISTTNPVATEGYGCVNTNGHQRGNQ

SEQ ID NO: 42243 - protein, 30 aa, Artificial Sequence
  Description of Artificial Sequence: Synthetic polypeptide
DEECISTTNPVATEGYGCVNTNALQERGNQ

SEQ ID NO: 42244 - protein, 33 aa, Artificial Sequence
  Description of Artificial Sequence: Synthetic polypeptide
DEEEIRTTNPVATEQYGMVSTNLQFDEGGNTNV

SEQ ID NO: 42245 - protein, 33 aa, Artificial Sequence
  Description of Artificial Sequence: Synthetic polypeptide
DEEEIRTTNPVATEQYGSVSGNTVNNEQGEGNQ

SEQ ID NO: 42246 - protein, 32 aa, Artificial Sequence
  Description of Artificial Sequence: Synthetic polypeptide
DEEEIATTNPVAYESYGSVSTNLSQHGGNQSR

SEQ ID NO: 42247 - protein, 31 aa, Artificial Sequence
  Description of Artificial Sequence: Synthetic polypeptide
DEEEIATTNPVAYESYGTVSTNLSQRVGNQS

SEQ ID NO: 42248 - protein, 32 aa, Artificial Sequence
  Description of Artificial Sequence: Synthetic polypeptide
DEEEIRTTNPVATEQYGMVSTNNLNQGEIINP

SEQ ID NO: 42249 - protein, 32 aa, Artificial Sequence
  Description of Artificial Sequence: Synthetic polypeptide
DEEEIRSTNPVATEQYGSVSDTSADQIPGNRF

SEQ ID NO: 42250 - protein, 33 aa, Artificial Sequence
  Description of Artificial Sequence: Synthetic polypeptide
DEEEIRTTNPVATEQYGMVSTNNLQEGGGNNIT

SEQ ID NO: 42251 - protein, 33 aa, Artificial Sequence
  Description of Artificial Sequence: Synthetic polypeptide
DEEEIRTTNPVATEQYGMVSTDNLTQNEGGNID

SEQ ID NO: 42252 - protein, 30 aa, Artificial Sequence
  Description of Artificial Sequence: Synthetic polypeptide
DEEEIATTNPVAYEQYGSVVSTNGGGDGDR

SEQ ID NO: 42253 - protein, 32 aa, Artificial Sequence
  Description of Artificial Sequence: Synthetic polypeptide
DEEEIRTTNPVATEQYGMVSTDNETQNQGNID

SEQ ID NO: 42254 - protein, 32 aa, Artificial Sequence
  Description of Artificial Sequence: Synthetic polypeptide
DEEEIRTTNPVATEQYGMVSTDLQMDGGNDQD

SEQ ID NO: 42255 - protein, 31 aa, Artificial Sequence
  Description of Artificial Sequence: Synthetic polypeptide
DEEEIATTNPVAYEQYGTVSTNLQQGGENEP

SEQ ID NO: 42256 - protein, 33 aa, Artificial Sequence
  Description of Artificial Sequence: Synthetic polypeptide
DEEEIRTTNPVATEQYGMVGSGTNLQDEGGNNA

SEQ ID NO: 42257 - protein, 32 aa, Artificial Sequence
  Description of Artificial Sequence: Synthetic polypeptide
DEEEIATTNPVAYEQYGVSVSANGLVQRGMGR

SEQ ID NO: 42258 - protein, 33 aa, Artificial Sequence
  Description of Artificial Sequence: Synthetic polypeptide
DEEEIRTTNPVATEQYGMVGSGTNLQFGGGNNA

SEQ ID NO: 42259 - protein, 31 aa, Artificial Sequence
  Description of Artificial Sequence: Synthetic polypeptide
DEEEIRTTNPVATEQYGMVGSNTNGQTGEEG

SEQ ID NO: 42260 - protein, 33 aa, Artificial Sequence
  Description of Artificial Sequence: Synthetic polypeptide
DEEEIRTTNPVATEQYGMVGSTGNLQEGNGNGG

SEQ ID NO: 42261 - protein, 32 aa, Artificial Sequence
  Description of Artificial Sequence: Synthetic polypeptide
DEEEIRTTNPVATEQYGMVGSTNDNQNEGGNV

SEQ ID NO: 42262 - protein, 32 aa, Artificial Sequence
  Description of Artificial Sequence: Synthetic polypeptide
DEEEIRTTNPVATEQYGMVGSTNLNINVGGNE

SEQ ID NO: 42263 - protein, 30 aa, Artificial Sequence
  Description of Artificial Sequence: Synthetic polypeptide
DEEEIRSTNPVCTEQYGVVSDINLQDSGNQ

SEQ ID NO: 42264 - protein, 33 aa, Artificial Sequence
  Description of Artificial Sequence: Synthetic polypeptide
DEEEIRTTNPVATEQYGMVGSTNNLNQNVGGNV

SEQ ID NO: 42265 - protein, 33 aa, Artificial Sequence
  Description of Artificial Sequence: Synthetic polypeptide
DEEEIRTTNPVATEQYGMVGSTVNLQFNGENLF

SEQ ID NO: 42266 - protein, 31 aa, Artificial Sequence
  Description of Artificial Sequence: Synthetic polypeptide
DEEEIRTTNPVATEQYGMVPVTNSNSEIGNR

SEQ ID NO: 42267 - protein, 32 aa, Artificial Sequence
  Description of Artificial Sequence: Synthetic polypeptide
DEEEIRTTNPVATEQYGMVSNTNGIQEQGGNI

SEQ ID NO: 42268 - protein, 32 aa, Artificial Sequence
  Description of Artificial Sequence: Synthetic polypeptide
DEEEIRTTNPVATEQYGMVSNTNIGQGQGGNI

SEQ ID NO: 42269 - protein, 32 aa, Artificial Sequence
  Description of Artificial Sequence: Synthetic polypeptide
DEEEIRTTNPVATEQYGMVSNTNNEQEGGGNI

SEQ ID NO: 42270 - protein, 28 aa, Artificial Sequence
  Description of Artificial Sequence: Synthetic peptide
DEEEIRSTNPVATEQYGVVSDIEMAGNQ

SEQ ID NO: 42271 - protein, 32 aa, Artificial Sequence
  Description of Artificial Sequence: Synthetic polypeptide
DEEEIRTTNPVATEQYGSVSGTNDIQGQGEDG

SEQ ID NO: 42272 - protein, 32 aa, Artificial Sequence
  Description of Artificial Sequence: Synthetic polypeptide
DEEEIRTTNPVATEQYGSVCITNDLNNRNENV

SEQ ID NO: 42273 - protein, 33 aa, Artificial Sequence
  Description of Artificial Sequence: Synthetic polypeptide
DEEEIRTTNPVATEQYGSVCITNDLNRNGNNVM

SEQ ID NO: 42274 - protein, 30 aa, Artificial Sequence
  Description of Artificial Sequence: Synthetic polypeptide
DEEEIRTTNPVATEQYGDVSECLQCHAGEQ

SEQ ID NO: 42275 - protein, 34 aa, Artificial Sequence
  Description of Artificial Sequence: Synthetic polypeptide
DEEEIRTTNPVATEQYGSVSGTNLQFEQGENEFE

SEQ ID NO: 42276 - protein, 33 aa, Artificial Sequence
  Description of Artificial Sequence: Synthetic polypeptide
DEEEIRTTNPCATEQYGSIVIATINLQRGENID

SEQ ID NO: 42277 - protein, 32 aa, Artificial Sequence
  Description of Artificial Sequence: Synthetic polypeptide
DEEEIRTTNPCATEQYGSGVIATINLERGNID

SEQ ID NO: 42278 - protein, 30 aa, Artificial Sequence
  Description of Artificial Sequence: Synthetic polypeptide
DEEEIATTNPVAYEQWGSVSTNLNGDNGNT

SEQ ID NO: 42279 - protein, 32 aa, Artificial Sequence
  Description of Artificial Sequence: Synthetic polypeptide
DEEEIRTTNPVATEQYGSVCSPTNLNRTEIDN

SEQ ID NO: 42280 - protein, 33 aa, Artificial Sequence
  Description of Artificial Sequence: Synthetic polypeptide
DEEEIRTTNPCATEQYGSVAATDNLDQDRGNHA

SEQ ID NO: 42281 - protein, 31 aa, Artificial Sequence
  Description of Artificial Sequence: Synthetic polypeptide
DEEEIATTNPVAYEQWGSVSTNLNGEDEGNR

SEQ ID NO: 42282 - protein, 31 aa, Artificial Sequence
  Description of Artificial Sequence: Synthetic polypeptide
DEEEIRTTNPCATEQYGSCAATNLQRDDNGA

SEQ ID NO: 42283 - protein, 33 aa, Artificial Sequence
  Description of Artificial Sequence: Synthetic polypeptide
DEEEIRTTNPVATEQYGSVCSPTNLERNNDQEI

SEQ ID NO: 42284 - protein, 32 aa, Artificial Sequence
  Description of Artificial Sequence: Synthetic polypeptide
DEEEIRTTNPVATEQYGSVCSPTNLERNEEII

SEQ ID NO: 42285 - protein, 32 aa, Artificial Sequence
  Description of Artificial Sequence: Synthetic polypeptide
DEEEIATTNPVAYEQWGSVSTNLNQGENGNTR

SEQ ID NO: 42286 - protein, 31 aa, Artificial Sequence
  Description of Artificial Sequence: Synthetic polypeptide
DEEEIATTNPVAYEQWGSVSTNLQAGGEGND

SEQ ID NO: 42287 - protein, 31 aa, Artificial Sequence
  Description of Artificial Sequence: Synthetic polypeptide
DEEEIATTNPVAYEQWGSVSTNLQAGGGDNT

SEQ ID NO: 42288 - protein, 31 aa, Artificial Sequence
  Description of Artificial Sequence: Synthetic polypeptide
DEEEIATTNPVAYEQWGSVSTNLNGEDGNAR

SEQ ID NO: 42289 - protein, 29 aa, Artificial Sequence
  Description of Artificial Sequence: Synthetic peptide
DEEEIRTTNPCATEQYGSVAATGLARDAE

SEQ ID NO: 42290 - protein, 32 aa, Artificial Sequence
  Description of Artificial Sequence: Synthetic polypeptide
DEEEIRTTNPVATEQYGDVNSVNLQFGTGNEN

SEQ ID NO: 42291 - protein, 32 aa, Artificial Sequence
  Description of Artificial Sequence: Synthetic polypeptide
DEEEIRTTNPVATEQYGSVCSPTPDNRENNRA

SEQ ID NO: 42292 - protein, 32 aa, Artificial Sequence
  Description of Artificial Sequence: Synthetic polypeptide
DEEEIRTTNPCATEQYGSVATNLQREADGGDD

SEQ ID NO: 42293 - protein, 32 aa, Artificial Sequence
  Description of Artificial Sequence: Synthetic polypeptide
DEEEIRTTNPVATEQYGSVCSTDDEQRVMSFR

SEQ ID NO: 42294 - protein, 32 aa, Artificial Sequence
  Description of Artificial Sequence: Synthetic polypeptide
DEEEIRTTNPVATEQYGSVCSTALQYFGSEQI

SEQ ID NO: 42295 - protein, 32 aa, Artificial Sequence
  Description of Artificial Sequence: Synthetic polypeptide
DEEEIRTTNPVATEQYGSVCSTALQHFNSEQL

SEQ ID NO: 42296 - protein, 32 aa, Artificial Sequence
  Description of Artificial Sequence: Synthetic polypeptide
DEEEIRTTNPVATEQYGSVCSTAHQRSGSDQP

SEQ ID NO: 42297 - protein, 29 aa, Artificial Sequence
  Description of Artificial Sequence: Synthetic peptide
DEEEIRTTNPCATEQYGSVATGLADGDES

SEQ ID NO: 42298 - protein, 31 aa, Artificial Sequence
  Description of Artificial Sequence: Synthetic polypeptide
DEEEIRTTNPVATEQYGSVCSSNLQFISEDY

SEQ ID NO: 42299 - protein, 32 aa, Artificial Sequence
  Description of Artificial Sequence: Synthetic polypeptide
DEEEIRTTNPVATEQYGSVCSSGNLQGGSDDG

SEQ ID NO: 42300 - protein, 32 aa, Artificial Sequence
  Description of Artificial Sequence: Synthetic polypeptide
DEEEIRTTNPCATEQYGSVATENDQENAGQNR

SEQ ID NO: 42301 - protein, 29 aa, Artificial Sequence
  Description of Artificial Sequence: Synthetic peptide
DEEEIRTTNPCATEQYGSVATALAQGTEA

SEQ ID NO: 42302 - protein, 32 aa, Artificial Sequence
  Description of Artificial Sequence: Synthetic polypeptide
DEEEIRTTNPVATEQYGSVCSSGNLAGFGSND

SEQ ID NO: 42303 - protein, 32 aa, Artificial Sequence
  Description of Artificial Sequence: Synthetic polypeptide
DEEEIRTTNPVATEQYGSVCSSELQYFGSDRS

SEQ ID NO: 42304 - protein, 31 aa, Artificial Sequence
  Description of Artificial Sequence: Synthetic polypeptide
DEEEIATTNPVAYEQWGSVSTNLNGAGGNDR

SEQ ID NO: 42305 - protein, 33 aa, Artificial Sequence
  Description of Artificial Sequence: Synthetic polypeptide
DEEEIRTTNPVATEQYGSVSDTGLINQGGEGNG

SEQ ID NO: 42306 - protein, 33 aa, Artificial Sequence
  Description of Artificial Sequence: Synthetic polypeptide
DEEEIRTTNPVATEQYGSVCSPTQLQRGEDEYI

SEQ ID NO: 42307 - protein, 32 aa, Artificial Sequence
  Description of Artificial Sequence: Synthetic polypeptide
DEEEIRTTNPVATEQYGDVSGNLGQNIGNGNI

SEQ ID NO: 42308 - protein, 33 aa, Artificial Sequence
  Description of Artificial Sequence: Synthetic polypeptide
DEEEIRTTNPVATEQYGDVSGTNLQGDGGGNNN

SEQ ID NO: 42309 - protein, 33 aa, Artificial Sequence
  Description of Artificial Sequence: Synthetic polypeptide
DEEEIRTTNPVATEQYGDVSGTNLQNNGEGNEE

SEQ ID NO: 42310 - protein, 33 aa, Artificial Sequence
  Description of Artificial Sequence: Synthetic polypeptide
DEEEIRTTNPVATEQYGDVSGTNNLQEIGGGNI

SEQ ID NO: 42311 - protein, 30 aa, Artificial Sequence
  Description of Artificial Sequence: Synthetic polypeptide
DEEEIATTNPVAYEQWGSVSTNQGQNGNLG

SEQ ID NO: 42312 - protein, 31 aa, Artificial Sequence
  Description of Artificial Sequence: Synthetic polypeptide
DEEEIRTTNPCATEQYGCVCVTNLQRGSDTA

SEQ ID NO: 42313 - protein, 30 aa, Artificial Sequence
  Description of Artificial Sequence: Synthetic polypeptide
DEECIRTTNPVAWEQYGAVSTINVQPGGNN

SEQ ID NO: 42314 - protein, 33 aa, Artificial Sequence
  Description of Artificial Sequence: Synthetic polypeptide
DEEEIATTNPVAYEQWGSVSTTGNELSQRGNPR

SEQ ID NO: 42315 - protein, 32 aa, Artificial Sequence
  Description of Artificial Sequence: Synthetic polypeptide
DEEEIRTTNPVATEQYGSVCSPENLERGEEFI

SEQ ID NO: 42316 - protein, 30 aa, Artificial Sequence
  Description of Artificial Sequence: Synthetic polypeptide
DEEEIRTTNPCATEQYGCVCSYNITRGSND

SEQ ID NO: 42317 - protein, 33 aa, Artificial Sequence
  Description of Artificial Sequence: Synthetic polypeptide
DEEEIRTTNPVATEQYGSVSGTNLQDTGGQEED

SEQ ID NO: 42318 - protein, 29 aa, Artificial Sequence
  Description of Artificial Sequence: Synthetic peptide
DEEEIRTTNPCATEQYGCVCSYNIANGNQ

SEQ ID NO: 42319 - protein, 33 aa, Artificial Sequence
  Description of Artificial Sequence: Synthetic polypeptide
DEEEIRTTNPVATEQYGDVSTNLPQGPGGNGNI

SEQ ID NO: 42320 - protein, 33 aa, Artificial Sequence
  Description of Artificial Sequence: Synthetic polypeptide
DEEEIRTTNPVATEQYGSVCSNTPELQRGSEQG

SEQ ID NO: 42321 - protein, 33 aa, Artificial Sequence
  Description of Artificial Sequence: Synthetic polypeptide
DEEEIRTTNPVATEQYGDVSTNLPQNDEGGGNQ

SEQ ID NO: 42322 - protein, 33 aa, Artificial Sequence
  Description of Artificial Sequence: Synthetic polypeptide
DEEEIRTTNPVATEQYGDVSTNLPQNEEGEGNG

SEQ ID NO: 42323 - protein, 33 aa, Artificial Sequence
  Description of Artificial Sequence: Synthetic polypeptide
DEEEIRTTNPVATEQYGDVSTNLPQNEGGGNED

SEQ ID NO: 42324 - protein, 29 aa, Artificial Sequence
  Description of Artificial Sequence: Synthetic peptide
DEEEIRTTNPCATEQYGCVCSWNIIYGND

SEQ ID NO: 42325 - protein, 34 aa, Artificial Sequence
  Description of Artificial Sequence: Synthetic polypeptide
DEEEIRTTNPVATEQYGSVCSNTNWLQRFGSEQN

SEQ ID NO: 42326 - protein, 31 aa, Artificial Sequence
  Description of Artificial Sequence: Synthetic polypeptide
DEEEIRTTNPVATEQYGSVCSPTDLEEENNQ

SEQ ID NO: 42327 - protein, 33 aa, Artificial Sequence
  Description of Artificial Sequence: Synthetic polypeptide
DEEEIRTTNPVATEQYGSVCSTEAHQRFGSDRS

SEQ ID NO: 42328 - protein, 31 aa, Artificial Sequence
  Description of Artificial Sequence: Synthetic polypeptide
DEECIRTTNPVATEVWDYSVSIINLQRGDNR

SEQ ID NO: 42329 - protein, 31 aa, Artificial Sequence
  Description of Artificial Sequence: Synthetic polypeptide
DEEEIATTNPVAYEQWGSVSTNLQHDGGDMR

SEQ ID NO: 42330 - protein, 32 aa, Artificial Sequence
  Description of Artificial Sequence: Synthetic polypeptide
DEEEIRTTNPVATEQYGDVSITNLVGVGNNGD

SEQ ID NO: 42331 - protein, 32 aa, Artificial Sequence
  Description of Artificial Sequence: Synthetic polypeptide
DEEEIRTTNPVATEQYGDVSNINALQHGPNNP

SEQ ID NO: 42332 - protein, 34 aa, Artificial Sequence
  Description of Artificial Sequence: Synthetic polypeptide
DEEEIRTTNPVATEQYGSVSGTNLQFEEGGENEG

SEQ ID NO: 42333 - protein, 30 aa, Artificial Sequence
  Description of Artificial Sequence: Synthetic polypeptide
DEECIRTTNPVATESYGQVTTNLQGDGSER

SEQ ID NO: 42334 - protein, 32 aa, Artificial Sequence
  Description of Artificial Sequence: Synthetic polypeptide
DEEEIRTTNPCATEQYGSAYATTNLQREGNID

SEQ ID NO: 42335 - protein, 32 aa, Artificial Sequence
  Description of Artificial Sequence: Synthetic polypeptide
DEECIRTTNPVATESYGSVSYTPNMQQYGGNR

SEQ ID NO: 42336 - protein, 33 aa, Artificial Sequence
  Description of Artificial Sequence: Synthetic polypeptide
DEEEIRTTNPVATEQYGSVCSPTNLEQGNEEFI

SEQ ID NO: 42337 - protein, 31 aa, Artificial Sequence
  Description of Artificial Sequence: Synthetic polypeptide
DEEEIATTNPVAYEQWGSVSTNLQEGGVDND

SEQ ID NO: 42338 - protein, 31 aa, Artificial Sequence
  Description of Artificial Sequence: Synthetic polypeptide
DEEEIATTNPVAYEQWGSVSTNLQGDHGNDP

SEQ ID NO: 42339 - protein, 33 aa, Artificial Sequence
  Description of Artificial Sequence: Synthetic polypeptide
DEEEIRTTNPVATEQYGSVCSPTNLEGGENEHI

SEQ ID NO: 42340 - protein, 32 aa, Artificial Sequence
  Description of Artificial Sequence: Synthetic polypeptide
DEEEIRTTNPVATEQYGDVSTDNGQDEGGNNT

SEQ ID NO: 42341 - protein, 32 aa, Artificial Sequence
  Description of Artificial Sequence: Synthetic polypeptide
DEEEIRTTNPVATEQYGDVSTGLGQGEGGGNG

SEQ ID NO: 42342 - protein, 31 aa, Artificial Sequence
  Description of Artificial Sequence: Synthetic polypeptide
DEEEIRTTNPVATEQYGSVCSPTNLEGEETI

SEQ ID NO: 42343 - protein, 31 aa, Artificial Sequence
  Description of Artificial Sequence: Synthetic polypeptide
DEEEIATTNPVAYEQWGSVSTNLQGNEGNTT

SEQ ID NO: 42344 - protein, 31 aa, Artificial Sequence
  Description of Artificial Sequence: Synthetic polypeptide
DEEEIATTNPVAYEQWGSVSTNLQGNGNTTD

SEQ ID NO: 42345 - protein, 32 aa, Artificial Sequence
  Description of Artificial Sequence: Synthetic polypeptide
DEEEIRTTNPCATEQYGIVSTCPALQRNGTPR

SEQ ID NO: 42346 - protein, 32 aa, Artificial Sequence
  Description of Artificial Sequence: Synthetic polypeptide
DEEEIRTTNPVATEQYGSVCSTEDLQHGSDDE

SEQ ID NO: 42347 - protein, 32 aa, Artificial Sequence
  Description of Artificial Sequence: Synthetic polypeptide
DEEEIRTTNPVATEQYGSVCSTEDLQHSNSEQ

SEQ ID NO: 42348 - protein, 33 aa, Artificial Sequence
  Description of Artificial Sequence: Synthetic polypeptide
DEEEIRTTNPVATEQYGSVCSTEDLQNFGSNAN

SEQ ID NO: 42349 - protein, 32 aa, Artificial Sequence
  Description of Artificial Sequence: Synthetic polypeptide
DEECIRTTNPVATEQYSAEVCSTNLQIGSNTR

SEQ ID NO: 42350 - protein, 32 aa, Artificial Sequence
  Description of Artificial Sequence: Synthetic polypeptide
DEEEIRTTNPVATEQYGSVCSTENEQNGSEDS

SEQ ID NO: 42351 - protein, 33 aa, Artificial Sequence
  Description of Artificial Sequence: Synthetic polypeptide
DEEEIRTTNPVATEQYGSVCSTENEQHFGSNDI

SEQ ID NO: 42352 - protein, 31 aa, Artificial Sequence
  Description of Artificial Sequence: Synthetic polypeptide
DEEEIRTTNPVATEQYGCWSTGNPHQRESNQ

SEQ ID NO: 42353 - protein, 34 aa, Artificial Sequence
  Description of Artificial Sequence: Synthetic polypeptide
DEEEIRTTNPVATEQYGSVCSTENEQERFGSNQA

SEQ ID NO: 42354 - protein, 31 aa, Artificial Sequence
  Description of Artificial Sequence: Synthetic polypeptide
DEEEIRTTNPVATEQYGCWSTINPLERENNN

SEQ ID NO: 42355 - protein, 31 aa, Artificial Sequence
  Description of Artificial Sequence: Synthetic polypeptide
DEEEIRTTNPVATEQYGCWSTINPLQNISNQ

SEQ ID NO: 42356 - protein, 33 aa, Artificial Sequence
  Description of Artificial Sequence: Synthetic polypeptide
DEEEIRTTNPVATEQYGSVCSTELQNFGSNTQM

SEQ ID NO: 42357 - protein, 33 aa, Artificial Sequence
  Description of Artificial Sequence: Synthetic polypeptide
DEEEIRTTNPVATEQYGSVCSTELQNFGSNFIS

SEQ ID NO: 42358 - protein, 33 aa, Artificial Sequence
  Description of Artificial Sequence: Synthetic polypeptide
DEEEIRTTNPVATEQYGSVCSTELQNFGSNDAV

SEQ ID NO: 42359 - protein, 33 aa, Artificial Sequence
  Description of Artificial Sequence: Synthetic polypeptide
DEEEIRTTNPVATEQYGSVCSTELQHIGSENQS

SEQ ID NO: 42360 - protein, 32 aa, Artificial Sequence
  Description of Artificial Sequence: Synthetic polypeptide
DEEEIRTTNPCATEQYGSVCATNLQSGDNQAD

SEQ ID NO: 42361 - protein, 32 aa, Artificial Sequence
  Description of Artificial Sequence: Synthetic polypeptide
DEEEIRTTNPVATEQYGSVCSTELQFIISNDY

SEQ ID NO: 42362 - protein, 33 aa, Artificial Sequence
  Description of Artificial Sequence: Synthetic polypeptide
DEEEIRTTNPCATEQYGSVCATNLQDRGDNHAD

SEQ ID NO: 42363 - protein, 33 aa, Artificial Sequence
  Description of Artificial Sequence: Synthetic polypeptide
DEEEIRTTNPCATEQYGSVCATNLQARGDNSAA

SEQ ID NO: 42364 - protein, 34 aa, Artificial Sequence
  Description of Artificial Sequence: Synthetic polypeptide
DEEEIRTTNPVATEQYGSVCSTENHNQHFGSNRV

SEQ ID NO: 42365 - protein, 32 aa, Artificial Sequence
  Description of Artificial Sequence: Synthetic polypeptide
DEEEIRTTNPVATEQYGSVCSTELNQGGSEQG

SEQ ID NO: 42366 - protein, 33 aa, Artificial Sequence
  Description of Artificial Sequence: Synthetic polypeptide
DEEEIRTTNPVATEQYGSVCSTENHQYFGSDRV

SEQ ID NO: 42367 - protein, 33 aa, Artificial Sequence
  Description of Artificial Sequence: Synthetic polypeptide
DEEEIRTTNPVATEQYGSVCSTENHQYFGSNQS

SEQ ID NO: 42368 - protein, 34 aa, Artificial Sequence
  Description of Artificial Sequence: Synthetic polypeptide
DEEEIRTTNPVATEQYGSVSDTDLIQRGIQNGGG

SEQ ID NO: 42369 - protein, 32 aa, Artificial Sequence
  Description of Artificial Sequence: Synthetic polypeptide
DEEEIRTTNPVATEQYGCVYSTNDHQENGNQM

SEQ ID NO: 42370 - protein, 31 aa, Artificial Sequence
  Description of Artificial Sequence: Synthetic polypeptide
DEEEIRTTNPCATEQYGSVEAPNIQREGNID

SEQ ID NO: 42371 - protein, 32 aa, Artificial Sequence
  Description of Artificial Sequence: Synthetic polypeptide
DEEEIRTTNPVATEQYGSVCSTEPLEYFGSNA

SEQ ID NO: 42372 - protein, 32 aa, Artificial Sequence
  Description of Artificial Sequence: Synthetic polypeptide
DEEEIRTTNPVATEQYGSVCSTENQYFGSNQS

SEQ ID NO: 42373 - protein, 30 aa, Artificial Sequence
  Description of Artificial Sequence: Synthetic polypeptide
DEEEIATTNPVAYEPYGSVATNLQDGDNDA

SEQ ID NO: 42374 - protein, 30 aa, Artificial Sequence
  Description of Artificial Sequence: Synthetic polypeptide
DEEEIATTNPVAYEPYGSVATNLQDGNDDH

SEQ ID NO: 42375 - protein, 29 aa, Artificial Sequence
  Description of Artificial Sequence: Synthetic peptide
DEEEIATTNPVAYEPYGSVATNLQDNGTD

SEQ ID NO: 42376 - protein, 30 aa, Artificial Sequence
  Description of Artificial Sequence: Synthetic polypeptide
DEEEIATTNPVAYEPYGSVATNLQDSGNDM

SEQ ID NO: 42377 - protein, 30 aa, Artificial Sequence
  Description of Artificial Sequence: Synthetic polypeptide
DEEEIRTTNPCATEQYGSVCYNIERDGNDM

SEQ ID NO: 42378 - protein, 32 aa, Artificial Sequence
  Description of Artificial Sequence: Synthetic polypeptide
DEEEIRTTNPVATEQYGCVYSTNLQYFGSDQS

SEQ ID NO: 42379 - protein, 30 aa, Artificial Sequence
  Description of Artificial Sequence: Synthetic polypeptide
DEEEIATTNPVAYEPYGSVATNLQQGNQDE

SEQ ID NO: 42380 - protein, 31 aa, Artificial Sequence
  Description of Artificial Sequence: Synthetic polypeptide
DEEEIRTTNPVATEQYGCWSEINPLQNRENN

SEQ ID NO: 42381 - protein, 34 aa, Artificial Sequence
  Description of Artificial Sequence: Synthetic polypeptide
DEEEIRTTNPVATEQYGSVCSTENPQERFGSNQS

SEQ ID NO: 42382 - protein, 35 aa, Artificial Sequence
  Description of Artificial Sequence: Synthetic polypeptide
DEEEIRTTNPVATEQYGSVCSTENLQNHAGDNNRN

SEQ ID NO: 42383 - protein, 32 aa, Artificial Sequence
  Description of Artificial Sequence: Synthetic polypeptide
DEEEIRTTNPVATEQYGSVSDTDLQQQQVQER

SEQ ID NO: 42384 - protein, 34 aa, Artificial Sequence
  Description of Artificial Sequence: Synthetic polypeptide
DEEEIRTTNPVATEQYGSVCSNTNQLGPIGENER

SEQ ID NO: 42385 - protein, 32 aa, Artificial Sequence
  Description of Artificial Sequence: Synthetic polypeptide
DEEEIRTTNPCATEQYGSVCATNLARGDNEAM

SEQ ID NO: 42386 - protein, 33 aa, Artificial Sequence
  Description of Artificial Sequence: Synthetic polypeptide
DEEEIRTTNPVATEQYGSVCSTELHQNFGSNQD

SEQ ID NO: 42387 - protein, 33 aa, Artificial Sequence
  Description of Artificial Sequence: Synthetic polypeptide
DEEEIRTTNPVATEQYGSVCSTEELQHLGSNQS

SEQ ID NO: 42388 - protein, 32 aa, Artificial Sequence
  Description of Artificial Sequence: Synthetic polypeptide
DEEEIRTTNPVATEQYGDVMETNILNRGGNGD

SEQ ID NO: 42389 - protein, 31 aa, Artificial Sequence
  Description of Artificial Sequence: Synthetic polypeptide
DEEEIRTTNPVATEQYGDVMETNLNGGMNEG

SEQ ID NO: 42390 - protein, 31 aa, Artificial Sequence
  Description of Artificial Sequence: Synthetic polypeptide
DEEEIRTTNPVATEQYGDVMETNLNRGMEGE

SEQ ID NO: 42391 - protein, 32 aa, Artificial Sequence
  Description of Artificial Sequence: Synthetic polypeptide
DEEEIRTTNPVATEQYGSVCSTEELQASGSDQ

SEQ ID NO: 42392 - protein, 33 aa, Artificial Sequence
  Description of Artificial Sequence: Synthetic polypeptide
DEEEIRTTNPVATEQYGSVCSTEEHQRGSNTAS

SEQ ID NO: 42393 - protein, 30 aa, Artificial Sequence
  Description of Artificial Sequence: Synthetic polypeptide
DEEEIRTTNPCATEQYGSVATTVLAQGNQE

SEQ ID NO: 42394 - protein, 31 aa, Artificial Sequence
  Description of Artificial Sequence: Synthetic polypeptide
DEEEIRTTNPVATEQYGSVCSTEEHQNGSVQ

SEQ ID NO: 42395 - protein, 33 aa, Artificial Sequence
  Description of Artificial Sequence: Synthetic polypeptide
DEEEIRTTNPVATEQYGSVCSTEEHQNFGSNRS

SEQ ID NO: 42396 - protein, 29 aa, Artificial Sequence
  Description of Artificial Sequence: Synthetic peptide
DEEEIRTTNPCATEQYGSVATQLAAGDET

SEQ ID NO: 42397 - protein, 33 aa, Artificial Sequence
  Description of Artificial Sequence: Synthetic polypeptide
DEEEIRTTNPVATEQYGSVCSTEEEQRFGSNQI

SEQ ID NO: 42398 - protein, 33 aa, Artificial Sequence
  Description of Artificial Sequence: Synthetic polypeptide
DEEEIRTTNPVATEQYGSVSDTELNQNFSQNRQ

SEQ ID NO: 42399 - protein, 32 aa, Artificial Sequence
  Description of Artificial Sequence: Synthetic polypeptide
DEEEIRTTNPVATEQYGSVCSTEEEQHGSNQS

SEQ ID NO: 42400 - protein, 35 aa, Artificial Sequence
  Description of Artificial Sequence: Synthetic polypeptide
DEEEIRTTNPVATEQYGSVCSTEEDLQRFGSNNRP

SEQ ID NO: 42401 - protein, 32 aa, Artificial Sequence
  Description of Artificial Sequence: Synthetic polypeptide
DEEEIRTTNPVATEQYGSVCSTEDQGIGSNQE

SEQ ID NO: 42402 - protein, 31 aa, Artificial Sequence
  Description of Artificial Sequence: Synthetic polypeptide
DEEEIRTTNPVATEQYGSVCSTEHANFLSNR

SEQ ID NO: 42403 - protein, 30 aa, Artificial Sequence
  Description of Artificial Sequence: Synthetic polypeptide
DEEEIRTTNPCATEQYGSVAYNDIFRGEND

SEQ ID NO: 42404 - protein, 32 aa, Artificial Sequence
  Description of Artificial Sequence: Synthetic polypeptide
DEEEIRTTNPVATEQYGDVGSTTLGQGGGGNE

SEQ ID NO: 42405 - protein, 33 aa, Artificial Sequence
  Description of Artificial Sequence: Synthetic polypeptide
DEEEIRTTNPVATEQYGDVGSTMNLGQNEGGNT

SEQ ID NO: 42406 - protein, 33 aa, Artificial Sequence
  Description of Artificial Sequence: Synthetic polypeptide
DEEEIRTTNPVATEQYGSVCSTELHQHFGSNAS

SEQ ID NO: 42407 - protein, 32 aa, Artificial Sequence
  Description of Artificial Sequence: Synthetic polypeptide
DEEEIRTTNPVATEQYGCYCSWPNMLQRDNRS

SEQ ID NO: 42408 - protein, 29 aa, Artificial Sequence
  Description of Artificial Sequence: Synthetic peptide
DEEEIRTTNPCATEQYGSVATWLADGDGH

SEQ ID NO: 42409 - protein, 30 aa, Artificial Sequence
  Description of Artificial Sequence: Synthetic polypeptide
DEEEIRTTNPCATEQYGSVATWDLDREGKE

SEQ ID NO: 42410 - protein, 32 aa, Artificial Sequence
  Description of Artificial Sequence: Synthetic polypeptide
DEEEIRTTNPVATEQYGSVCSTELDQNFGSDD

SEQ ID NO: 42411 - protein, 31 aa, Artificial Sequence
  Description of Artificial Sequence: Synthetic polypeptide
DEEEIRTTNPVATEQYGCYSVTNNLIRGELI

SEQ ID NO: 42412 - protein, 32 aa, Artificial Sequence
  Description of Artificial Sequence: Synthetic polypeptide
DEEEIRTTNPVATEQYGSVCSTELDQNFGEQG

SEQ ID NO: 42413 - protein, 31 aa, Artificial Sequence
  Description of Artificial Sequence: Synthetic polypeptide
DEEEIATTNPVAYEQWGSVCCTNLSQRGNQQ

SEQ ID NO: 42414 - protein, 32 aa, Artificial Sequence
  Description of Artificial Sequence: Synthetic polypeptide
DEEEIRTTNPVATEQYGSVCSTEHQRSGSEQD

SEQ ID NO: 42415 - protein, 33 aa, Artificial Sequence
  Description of Artificial Sequence: Synthetic polypeptide
DEEEIRTTNPVATEQYGSVCSTEHQRIGSNTQE

SEQ ID NO: 42416 - protein, 30 aa, Artificial Sequence
  Description of Artificial Sequence: Synthetic polypeptide
DEEEIRTTNPCATEQYGSVATVTLEQGNQE

SEQ ID NO: 42417 - protein, 33 aa, Artificial Sequence
  Description of Artificial Sequence: Synthetic polypeptide
DEEEIRTTNPVATEQYGDSVSTNNTDQSIGGNN

SEQ ID NO: 42418 - protein, 33 aa, Artificial Sequence
  Description of Artificial Sequence: Synthetic polypeptide
DEEEIRTTNPVATEQYGSVCSTEHQNSGSDNRP

SEQ ID NO: 42419 - protein, 32 aa, Artificial Sequence
  Description of Artificial Sequence: Synthetic polypeptide
DEECIRTTNPVATEQYSECVCSTNLQHGSNTR

SEQ ID NO: 42420 - protein, 32 aa, Artificial Sequence
  Description of Artificial Sequence: Synthetic polypeptide
DEEEIRTTNPVATEQYGDVCSTQHQRPENGRS

SEQ ID NO: 42421 - protein, 31 aa, Artificial Sequence
  Description of Artificial Sequence: Synthetic polypeptide
DEECIRTTNPVATEQYSECVCSWNLQNGSNR

SEQ ID NO: 42422 - protein, 33 aa, Artificial Sequence
  Description of Artificial Sequence: Synthetic polypeptide
DEEEIRTTNPVATEQYGSVCSNTNPQHFNSNRA

SEQ ID NO: 42423 - protein, 33 aa, Artificial Sequence
  Description of Artificial Sequence: Synthetic polypeptide
DEEEIRTTNPVATEQYGDVSTNLQQNEMGNNED

SEQ ID NO: 42424 - protein, 31 aa, Artificial Sequence
  Description of Artificial Sequence: Synthetic polypeptide
DEEEIRTTNPVATEQYGDVSTNNFGMGENNQ

SEQ ID NO: 42425 - protein, 31 aa, Artificial Sequence
  Description of Artificial Sequence: Synthetic polypeptide
DEEEIRTTNPCATEGYGSCSCTNLSTRGGNS

SEQ ID NO: 42426 - protein, 29 aa, Artificial Sequence
  Description of Artificial Sequence: Synthetic peptide
DEEEIRTTNPCATEGYGSCCSWNLAYGNQ

SEQ ID NO: 42427 - protein, 29 aa, Artificial Sequence
  Description of Artificial Sequence: Synthetic peptide
DEEEIATTNPVAYEQYGSVAANLQDGDDI

SEQ ID NO: 42428 - protein, 31 aa, Artificial Sequence
  Description of Artificial Sequence: Synthetic polypeptide
DEEEIRTTNPVATEQYGEVSSTPAGNMRGNK

SEQ ID NO: 42429 - protein, 30 aa, Artificial Sequence
  Description of Artificial Sequence: Synthetic polypeptide
DEEEIATTNPVAYEQYGSVAANLQDPGDRN

SEQ ID NO: 42430 - protein, 32 aa, Artificial Sequence
  Description of Artificial Sequence: Synthetic polypeptide
DEEEIRTTNPVATEQYGEVSSTTLQGGGGNGG

SEQ ID NO: 42431 - protein, 32 aa, Artificial Sequence
  Description of Artificial Sequence: Synthetic polypeptide
DEEEIRTTNPVATEQYGEVSSTTNGNRNGMNV

SEQ ID NO: 42432 - protein, 29 aa, Artificial Sequence
  Description of Artificial Sequence: Synthetic peptide
DEEEIATTNPVAYEQYGSVAATNDTQGND

SEQ ID NO: 42433 - protein, 31 aa, Artificial Sequence
  Description of Artificial Sequence: Synthetic polypeptide
DEEEIRTTNPVATEQYGEVSTGGQHGGFERE

SEQ ID NO: 42434 - protein, 32 aa, Artificial Sequence
  Description of Artificial Sequence: Synthetic polypeptide
DEEEIRTTNPVATEQYGEVSTGNFGQGEGNEG

SEQ ID NO: 42435 - protein, 31 aa, Artificial Sequence
  Description of Artificial Sequence: Synthetic polypeptide
DEEEIATTNPVAYEQYGSVAATNLETGNDRM

SEQ ID NO: 42436 - protein, 30 aa, Artificial Sequence
  Description of Artificial Sequence: Synthetic polypeptide
DEEEIRTTNPCATEGYGCCSTNLARGGNQM

SEQ ID NO: 42437 - protein, 29 aa, Artificial Sequence
  Description of Artificial Sequence: Synthetic peptide
DEEEIATTNPVAYEQYGSVAGNDQDTGNQ

SEQ ID NO: 42438 - protein, 32 aa, Artificial Sequence
  Description of Artificial Sequence: Synthetic polypeptide
DEEEIRTTNPVATEQYGSVCNTFNLEGRGDTQ

SEQ ID NO: 42439 - protein, 33 aa, Artificial Sequence
  Description of Artificial Sequence: Synthetic polypeptide
DEEEIRTTNPVATEQYGSVSGTNGDGQNEGNGE

SEQ ID NO: 42440 - protein, 33 aa, Artificial Sequence
  Description of Artificial Sequence: Synthetic polypeptide
DEEEIRTTNPVATEQYGSVSDTWLYQLRSQQDR

SEQ ID NO: 42441 - protein, 30 aa, Artificial Sequence
  Description of Artificial Sequence: Synthetic polypeptide
DEEEIATTNPVAYEQYGSVAIENLQERDNN

SEQ ID NO: 42442 - protein, 32 aa, Artificial Sequence
  Description of Artificial Sequence: Synthetic polypeptide
DEEEIRTTNPVATEQYGSVCNTGNLFGDGETR

SEQ ID NO: 42443 - protein, 33 aa, Artificial Sequence
  Description of Artificial Sequence: Synthetic polypeptide
DEEEIATTNPVAYEQYGSTVVSCTNLSHRGNNR

SEQ ID NO: 42444 - protein, 33 aa, Artificial Sequence
  Description of Artificial Sequence: Synthetic polypeptide
DEEEIRTTNPVATEQYGSVSDTVGLERGLQNTQ

SEQ ID NO: 42445 - protein, 33 aa, Artificial Sequence
  Description of Artificial Sequence: Synthetic polypeptide
DEEEIRTTNPVATEQYGSVSGTNGQQGGGGNEM

SEQ ID NO: 42446 - protein, 32 aa, Artificial Sequence
  Description of Artificial Sequence: Synthetic polypeptide
DEEEIRTTNPVATEQYGSVSDTVLVQAHSQNQ

SEQ ID NO: 42447 - protein, 31 aa, Artificial Sequence
  Description of Artificial Sequence: Synthetic polypeptide
DEEEIRTTNPVATEQYGSVCNTNNLNGTGTT

SEQ ID NO: 42448 - protein, 31 aa, Artificial Sequence
  Description of Artificial Sequence: Synthetic polypeptide
DEEEIRTTNPCATEGYGSVCSTNDHEHRGNW

SEQ ID NO: 42449 - protein, 33 aa, Artificial Sequence
  Description of Artificial Sequence: Synthetic polypeptide
DEEEIRTTNPVATEQYGSVSDTWLLQQEFSQNR

SEQ ID NO: 42450 - protein, 30 aa, Artificial Sequence
  Description of Artificial Sequence: Synthetic polypeptide
DEEEIRTTNPCATEGYGSVCSTNDADGNDW

SEQ ID NO: 42451 - protein, 31 aa, Artificial Sequence
  Description of Artificial Sequence: Synthetic polypeptide
DEEEIRTTNPVATEQYGSVCNTNGELTEENS

SEQ ID NO: 42452 - protein, 31 aa, Artificial Sequence
  Description of Artificial Sequence: Synthetic polypeptide
DEEEIRTTNPCATEGYGSTCSCTNLSARGND

SEQ ID NO: 42453 - protein, 33 aa, Artificial Sequence
  Description of Artificial Sequence: Synthetic polypeptide
DEEEIRTTNPVATEQYGSVSGTNGQQEGGGNQG

SEQ ID NO: 42454 - protein, 32 aa, Artificial Sequence
  Description of Artificial Sequence: Synthetic polypeptide
DEEEIATTNPVAYEQYGSTVCCTNLSQRENNR

SEQ ID NO: 42455 - protein, 30 aa, Artificial Sequence
  Description of Artificial Sequence: Synthetic polypeptide
DEEEIRTTNPCATEGYGSCSWNLNARGSNQ

SEQ ID NO: 42456 - protein, 31 aa, Artificial Sequence
  Description of Artificial Sequence: Synthetic polypeptide
DEEEIRTTNPVATEQYGSVCNTNAQLMGLEA

SEQ ID NO: 42457 - protein, 31 aa, Artificial Sequence
  Description of Artificial Sequence: Synthetic polypeptide
DEEEIRTTNPVATEQYGSVCNTGNLMGRMTD

SEQ ID NO: 42458 - protein, 33 aa, Artificial Sequence
  Description of Artificial Sequence: Synthetic polypeptide
DEEEIRTTNPVATEQYGSVSGTNGQGEMGNGEE

SEQ ID NO: 42459 - protein, 30 aa, Artificial Sequence
  Description of Artificial Sequence: Synthetic polypeptide
DEEEIRTTNPCATEGYGSCSTNLNAYFGNQ

SEQ ID NO: 42460 - protein, 32 aa, Artificial Sequence
  Description of Artificial Sequence: Synthetic polypeptide
DEEEIRTTNPVATEQYGEVSGTNNDQGGENNE

SEQ ID NO: 42461 - protein, 31 aa, Artificial Sequence
  Description of Artificial Sequence: Synthetic polypeptide
DEEEIRTTNPVATEQYGSVCNTFNLEGGGTD

SEQ ID NO: 42462 - protein, 33 aa, Artificial Sequence
  Description of Artificial Sequence: Synthetic polypeptide
DEEEIRTTNPVATEQYGSVSGTNGDGQNEGNEQ

SEQ ID NO: 42463 - protein, 29 aa, Artificial Sequence
  Description of Artificial Sequence: Synthetic peptide
DEEEIRTTNPCATEEYGSVATNHGEGDNA

SEQ ID NO: 42464 - protein, 31 aa, Artificial Sequence
  Description of Artificial Sequence: Synthetic polypeptide
DEEEIRTTNPVATEQYGSVCNTANLMGRDTG

SEQ ID NO: 42465 - protein, 30 aa, Artificial Sequence
  Description of Artificial Sequence: Synthetic polypeptide
DEEEIRTTNPCATEEYGSVATNGGNQQGNA

SEQ ID NO: 42466 - protein, 29 aa, Artificial Sequence
  Description of Artificial Sequence: Synthetic peptide
DEEEIRTTNPCATEEYGSVATNDTGEGNA

SEQ ID NO: 42467 - protein, 32 aa, Artificial Sequence
  Description of Artificial Sequence: Synthetic polypeptide
DEEEIATTNPVAYEQYGSVATALQREGPNERD

SEQ ID NO: 42468 - protein, 31 aa, Artificial Sequence
  Description of Artificial Sequence: Synthetic polypeptide
DEEEIRTTNPVATEQYGSVCMPNLPRGEVIE

SEQ ID NO: 42469 - protein, 32 aa, Artificial Sequence
  Description of Artificial Sequence: Synthetic polypeptide
DEEEIRTTNPVATEQYGSVCMNLQQENKGNQT

SEQ ID NO: 42470 - protein, 32 aa, Artificial Sequence
  Description of Artificial Sequence: Synthetic polypeptide
DEEEIRTTNPVATEQYGFVSSDGNLQDNGNDD

SEQ ID NO: 42471 - protein, 33 aa, Artificial Sequence
  Description of Artificial Sequence: Synthetic polypeptide
DEEEIRTTNPVATEQYGFVSTFNLIQEHGSVNE

SEQ ID NO: 42472 - protein, 33 aa, Artificial Sequence
  Description of Artificial Sequence: Synthetic polypeptide
DEEEIRTTNPVATEQYGSVSGTNDQGQNGGGNT

SEQ ID NO: 42473 - protein, 31 aa, Artificial Sequence
  Description of Artificial Sequence: Synthetic polypeptide
DEEEIRTTNPVATEQYGSVSEDQLTVTGNHG

SEQ ID NO: 42474 - protein, 32 aa, Artificial Sequence
  Description of Artificial Sequence: Synthetic polypeptide
DEEEIRTTNPVATEQYGSVSEEDIQTGENERQ

SEQ ID NO: 42475 - protein, 32 aa, Artificial Sequence
  Description of Artificial Sequence: Synthetic polypeptide
DEEEIRTTNPVATEQYGFVYSENVLNQRTNIL

SEQ ID NO: 42476 - protein, 34 aa, Artificial Sequence
  Description of Artificial Sequence: Synthetic polypeptide
DEEEIRTTNPVATEQYGSVCITNLDQLRGDNDQV

SEQ ID NO: 42477 - protein, 31 aa, Artificial Sequence
  Description of Artificial Sequence: Synthetic polypeptide
DEEEIATTNPVAYEQYGSVATNDQTPGNDRH

SEQ ID NO: 42478 - protein, 29 aa, Artificial Sequence
  Description of Artificial Sequence: Synthetic peptide
DEEEIRTTNPCATEEYGSVATNHGGLGNA

SEQ ID NO: 42479 - protein, 32 aa, Artificial Sequence
  Description of Artificial Sequence: Synthetic polypeptide
DEEEIRTTNPVATEQYGSVCNTFNLEGEGQTR

SEQ ID NO: 42480 - protein, 28 aa, Artificial Sequence
  Description of Artificial Sequence: Synthetic peptide
DEEEIRTTNPCATEEYGSVATNHGNGDA

SEQ ID NO: 42481 - protein, 32 aa, Artificial Sequence
  Description of Artificial Sequence: Synthetic polypeptide
DEEEIRTTNPVATEQYGSVCNTDNLAGRDDTR

SEQ ID NO: 42482 - protein, 31 aa, Artificial Sequence
  Description of Artificial Sequence: Synthetic polypeptide
DEEEIRTTNPVATEQYGSVSDVSEDLQRLDQ

SEQ ID NO: 42483 - protein, 32 aa, Artificial Sequence
  Description of Artificial Sequence: Synthetic polypeptide
DEEEIRTTNPVATEQYGSVCNTFNLDDGRGTH

SEQ ID NO: 42484 - protein, 29 aa, Artificial Sequence
  Description of Artificial Sequence: Synthetic peptide
DEEEIRTTNPCATEEYGSVETNHGNGSNA

SEQ ID NO: 42485 - protein, 31 aa, Artificial Sequence
  Description of Artificial Sequence: Synthetic polypeptide
DEEEIRTTNPVATEQYGSVCNTFNGDGGGTR

SEQ ID NO: 42486 - protein, 33 aa, Artificial Sequence
  Description of Artificial Sequence: Synthetic polypeptide
DEEEIRTTNPVATEQYGEVVPSCTNALSGRGND

SEQ ID NO: 42487 - protein, 34 aa, Artificial Sequence
  Description of Artificial Sequence: Synthetic polypeptide
DEEEIRTTNPVATEQYGSVSDYNLIHERQGGENR

SEQ ID NO: 42488 - protein, 32 aa, Artificial Sequence
  Description of Artificial Sequence: Synthetic polypeptide
DEEEIRTTNPVATEQYGSVCNTFNDQYGEGTR

SEQ ID NO: 42489 - protein, 31 aa, Artificial Sequence
  Description of Artificial Sequence: Synthetic polypeptide
DEEEIRTTNPVATEQYGSVCNTFDLYGRGTD

SEQ ID NO: 42490 - protein, 33 aa, Artificial Sequence
  Description of Artificial Sequence: Synthetic polypeptide
DEEEIRTTNPVATEQYGSVSDYNNLNQRGEDDK

SEQ ID NO: 42491 - protein, 31 aa, Artificial Sequence
  Description of Artificial Sequence: Synthetic polypeptide
DEEEIATTNPVAYEQYGSVAPTNLDRTNDRE

SEQ ID NO: 42492 - protein, 28 aa, Artificial Sequence
  Description of Artificial Sequence: Synthetic peptide
DEEEIRTTNPCATEEYGSVATQGGNGNA

SEQ ID NO: 42493 - protein, 32 aa, Artificial Sequence
  Description of Artificial Sequence: Synthetic polypeptide
DEEEIRTTNPVATEQYGSVCNTENDLYGEGTR

SEQ ID NO: 42494 - protein, 33 aa, Artificial Sequence
  Description of Artificial Sequence: Synthetic polypeptide
DEEEIRTTNPVATEQYGSVSEANLQERGEDTDM

SEQ ID NO: 42495 - protein, 29 aa, Artificial Sequence
  Description of Artificial Sequence: Synthetic peptide
DEEEIRTTNPCATEEYGSVATNNGGQGNA

SEQ ID NO: 42496 - protein, 30 aa, Artificial Sequence
  Description of Artificial Sequence: Synthetic polypeptide
DEEEIRTTNPCATEEYGSVATNLGGNGNAG

SEQ ID NO: 42497 - protein, 32 aa, Artificial Sequence
  Description of Artificial Sequence: Synthetic polypeptide
DEEEIRTTNPVATEQYGSVSEDGLQRMVIERP

SEQ ID NO: 42498 - protein, 33 aa, Artificial Sequence
  Description of Artificial Sequence: Synthetic polypeptide
DEEEIRTTNPVATEQYGQCVCSTNLDQNFGSNQ

SEQ ID NO: 42499 - protein, 31 aa, Artificial Sequence
  Description of Artificial Sequence: Synthetic polypeptide
DEEEIRTTNPVATEQYGSVSDTSEDLQEEIQ

SEQ ID NO: 42500 - protein, 33 aa, Artificial Sequence
  Description of Artificial Sequence: Synthetic polypeptide
DEEEIRTTNPVATEQYGSVCPTPMLDQRGDNNE

SEQ ID NO: 42501 - protein, 34 aa, Artificial Sequence
  Description of Artificial Sequence: Synthetic polypeptide
DEEEIRTTNPVATEQYGSVCSNTGNLEQRFGSDQ

SEQ ID NO: 42502 - protein, 31 aa, Artificial Sequence
  Description of Artificial Sequence: Synthetic polypeptide
DEEEIRTTNPCATEQYGCVCQTNDQRGSNTA

SEQ ID NO: 42503 - protein, 34 aa, Artificial Sequence
  Description of Artificial Sequence: Synthetic polypeptide
DEEEIRTTNPVATEQYGSVCSNTENLQAFGSNAA

SEQ ID NO: 42504 - protein, 33 aa, Artificial Sequence
  Description of Artificial Sequence: Synthetic polypeptide
DEEEIRTTNPVATEQYGDVSTPNLQSDGGNNQQ

SEQ ID NO: 42505 - protein, 32 aa, Artificial Sequence
  Description of Artificial Sequence: Synthetic polypeptide
DEEEIRTTNPVATEQYGSVCSNTELQYNSNQY

SEQ ID NO: 42506 - protein, 32 aa, Artificial Sequence
  Description of Artificial Sequence: Synthetic polypeptide
DEEEIRTTNPVATEQYGSVCSNTELQYGSDQT

SEQ ID NO: 42507 - protein, 30 aa, Artificial Sequence
  Description of Artificial Sequence: Synthetic polypeptide
DEECIRTTNPVAWEQYGQVSTINDGQTGNN

SEQ ID NO: 42508 - protein, 33 aa, Artificial Sequence
  Description of Artificial Sequence: Synthetic polypeptide
DEEEIRTTNPVATEQYGDVSTQNLQGSGGNNNE

SEQ ID NO: 42509 - protein, 33 aa, Artificial Sequence
  Description of Artificial Sequence: Synthetic polypeptide
DEEEIRTTNPVATEQYGSVCSNTELQENGSNNQ

SEQ ID NO: 42510 - protein, 32 aa, Artificial Sequence
  Description of Artificial Sequence: Synthetic polypeptide
DEEEIRTTNPVATEQYGSVCSNTEGQNGSNQS

SEQ ID NO: 42511 - protein, 33 aa, Artificial Sequence
  Description of Artificial Sequence: Synthetic polypeptide
DEEEIRTTNPVATEQYGDVSTSNLQGFEGNGDG

SEQ ID NO: 42512 - protein, 33 aa, Artificial Sequence
  Description of Artificial Sequence: Synthetic polypeptide
DEEEIRTTNPVATEQYGDVSTSNLQVEMGGNIQ

SEQ ID NO: 42513 - protein, 32 aa, Artificial Sequence
  Description of Artificial Sequence: Synthetic polypeptide
DEEEIRTTNPVATEQYGDVSTSNLVGMGGNIG

SEQ ID NO: 42514 - protein, 31 aa, Artificial Sequence
  Description of Artificial Sequence: Synthetic polypeptide
DEEEIRTTNPVATEQYGSVCSNNPLIPNGEQ

SEQ ID NO: 42515 - protein, 32 aa, Artificial Sequence
  Description of Artificial Sequence: Synthetic polypeptide
DEEEIRTTNPVATEQYGSVCSNNLQDEGMVEE

SEQ ID NO: 42516 - protein, 33 aa, Artificial Sequence
  Description of Artificial Sequence: Synthetic polypeptide
DEEEIRTTNPVATEQYGSVCSNTGNLQAFNSDD

SEQ ID NO: 42517 - protein, 31 aa, Artificial Sequence
  Description of Artificial Sequence: Synthetic polypeptide
DEEEIRTTNPCATEQYGCVCFWNLQRGSNTA

SEQ ID NO: 42518 - protein, 34 aa, Artificial Sequence
  Description of Artificial Sequence: Synthetic polypeptide
DEEEIRTTNPVATEQYGSVCSNTGNLQGFGSNDQ

SEQ ID NO: 42519 - protein, 33 aa, Artificial Sequence
  Description of Artificial Sequence: Synthetic polypeptide
DEEEIRTTNPVATEQYGDVSTPNLQGSGGNGQQ

SEQ ID NO: 42520 - protein, 33 aa, Artificial Sequence
  Description of Artificial Sequence: Synthetic polypeptide
DEEEIRTTNPVATEQYGSVCSNTNLQNGSDTQA

SEQ ID NO: 42521 - protein, 33 aa, Artificial Sequence
  Description of Artificial Sequence: Synthetic polypeptide
DEEEIRTTNPVATEQYGDVSTNNLPQNEGGNGN

SEQ ID NO: 42522 - protein, 33 aa, Artificial Sequence
  Description of Artificial Sequence: Synthetic polypeptide
DEEEIRTTNPVATEQYGSVSDTNLQFFGSETQP

SEQ ID NO: 42523 - protein, 33 aa, Artificial Sequence
  Description of Artificial Sequence: Synthetic polypeptide
DEEEIRTTNPVATEQYGSVCSNTNLQHFNSQQA

SEQ ID NO: 42524 - protein, 35 aa, Artificial Sequence
  Description of Artificial Sequence: Synthetic polypeptide
DEEEIRTTNPVATEQYGSVCSNTNLQERFGSNNQS

SEQ ID NO: 42525 - protein, 33 aa, Artificial Sequence
  Description of Artificial Sequence: Synthetic polypeptide
DEEEIRTTNPVATEQYGSVCSNTNLQEHFNSDQ

SEQ ID NO: 42526 - protein, 34 aa, Artificial Sequence
  Description of Artificial Sequence: Synthetic polypeptide
DEEEIRTTNPVATEQYGSVCSNTNLNQNFGSNQI

SEQ ID NO: 42527 - protein, 31 aa, Artificial Sequence
  Description of Artificial Sequence: Synthetic polypeptide
DEEEIRTTNPVATEQYGSVCSNTNHQANSDD

SEQ ID NO: 42528 - protein, 31 aa, Artificial Sequence
  Description of Artificial Sequence: Synthetic polypeptide
DEEEIRTTNPVATEQYGSVCSNTNHENFGDQ

SEQ ID NO: 42529 - protein, 31 aa, Artificial Sequence
  Description of Artificial Sequence: Synthetic polypeptide
DEEEIRTTNPVATEQYGDVSTPIGNMANGNV

SEQ ID NO: 42530 - protein, 33 aa, Artificial Sequence
  Description of Artificial Sequence: Synthetic polypeptide
DEEEIRTTNPVATEQYGSVCSNTNDQRFGSDQT

SEQ ID NO: 42531 - protein, 34 aa, Artificial Sequence
  Description of Artificial Sequence: Synthetic polypeptide
DEEEIRTTNPVATEQYGSVCSNTNDLQRFGSEPQ

SEQ ID NO: 42532 - protein, 31 aa, Artificial Sequence
  Description of Artificial Sequence: Synthetic polypeptide
DEEEIRTTNPVATEQYGDVSTPIGNNANGNA

SEQ ID NO: 42533 - protein, 34 aa, Artificial Sequence
  Description of Artificial Sequence: Synthetic polypeptide
DEEEIRTTNPVATEQYGSVCSNTMNHQRFGSNQT

SEQ ID NO: 42534 - protein, 33 aa, Artificial Sequence
  Description of Artificial Sequence: Synthetic polypeptide
DEEEIRTTNPVATEQYGDVSTPNLPQGPGGGNN

SEQ ID NO: 42535 - protein, 33 aa, Artificial Sequence
  Description of Artificial Sequence: Synthetic polypeptide
DEEEIRTTNPVATEQYGDVSTPNLQLNGGNGQQ

SEQ ID NO: 42536 - protein, 33 aa, Artificial Sequence
  Description of Artificial Sequence: Synthetic polypeptide
DEEEIRTTNPVATEQYGSVSGTNGQSEGGENED

SEQ ID NO: 42537 - protein, 31 aa, Artificial Sequence
  Description of Artificial Sequence: Synthetic polypeptide
DEEEIRTTNPVATEQYGDVVDTNLNREGMDQ

SEQ ID NO: 42538 - protein, 31 aa, Artificial Sequence
  Description of Artificial Sequence: Synthetic polypeptide
DEEEIRTTNPCATEQWGSVYCTDNDQRGNGA

SEQ ID NO: 42539 - protein, 30 aa, Artificial Sequence
  Description of Artificial Sequence: Synthetic polypeptide
DEEEIRTTNPCATEPYGSCSTNLAPGDNQM

SEQ ID NO: 42540 - protein, 33 aa, Artificial Sequence
  Description of Artificial Sequence: Synthetic polypeptide
DEEEIRTTNPVATEQYGSVCSENPDQRFENNRA

SEQ ID NO: 42541 - protein, 29 aa, Artificial Sequence
  Description of Artificial Sequence: Synthetic peptide
DEEEIRTTNPCATEPYGSCATNLAPGDNA

SEQ ID NO: 42542 - protein, 33 aa, Artificial Sequence
  Description of Artificial Sequence: Synthetic polypeptide
DEEEIRTTNPVATEQYGSVCSDTWDGQRSQNER

SEQ ID NO: 42543 - protein, 29 aa, Artificial Sequence
  Description of Artificial Sequence: Synthetic peptide
DEEEIRTTNPCATEPYGSCATNLAAGNVM

SEQ ID NO: 42544 - protein, 29 aa, Artificial Sequence
  Description of Artificial Sequence: Synthetic peptide
DEEEIRTTNPCATEPYGSCATNLAAEGNN

SEQ ID NO: 42545 - protein, 33 aa, Artificial Sequence
  Description of Artificial Sequence: Synthetic polypeptide
DEEEIRTTNPVATEQYGSVCSDTDQDGQRSQNR

SEQ ID NO: 42546 - protein, 33 aa, Artificial Sequence
  Description of Artificial Sequence: Synthetic polypeptide
DEEEIRTTNPVATEQYGSVSDTNPLQPFQQNDA

SEQ ID NO: 42547 - protein, 31 aa, Artificial Sequence
  Description of Artificial Sequence: Synthetic polypeptide
DEEEIRTTNPVATEQYGETISSNEEQRQQNR

SEQ ID NO: 42548 - protein, 33 aa, Artificial Sequence
  Description of Artificial Sequence: Synthetic polypeptide
DEEEIRTTNPVATEQYGSVSGTNLIGPGGNGTE

SEQ ID NO: 42549 - protein, 33 aa, Artificial Sequence
  Description of Artificial Sequence: Synthetic polypeptide
DEEEIRTTNPVATEQYGSVCSATDESQARIMNR

SEQ ID NO: 42550 - protein, 32 aa, Artificial Sequence
  Description of Artificial Sequence: Synthetic polypeptide
DEEEIRTTNPVATEQYGSVCQTNLQSFGSDQT

SEQ ID NO: 42551 - protein, 32 aa, Artificial Sequence
  Description of Artificial Sequence: Synthetic polypeptide
DEEEIRTTNPVATEQYGSVSDTPNGVQRYTEE

SEQ ID NO: 42552 - protein, 31 aa, Artificial Sequence
  Description of Artificial Sequence: Synthetic polypeptide
DEEEIRTTNPVATEQYGSVSDTPNPAQQNFA

SEQ ID NO: 42553 - protein, 31 aa, Artificial Sequence
  Description of Artificial Sequence: Synthetic polypeptide
DEEEIRTTNPVATEQYGSVCPTVSLERNGED

SEQ ID NO: 42554 - protein, 33 aa, Artificial Sequence
  Description of Artificial Sequence: Synthetic polypeptide
DEEEIATTNPVAYEQYGQSVSTNGLLQRGMGDR

SEQ ID NO: 42555 - protein, 32 aa, Artificial Sequence
  Description of Artificial Sequence: Synthetic polypeptide
DEEEIRTTNPVATEQYGDVVDTNLNREGMNGD

SEQ ID NO: 42556 - protein, 32 aa, Artificial Sequence
  Description of Artificial Sequence: Synthetic polypeptide
DEEEIATTNPVAYEQYGQSVSENDLLQRGIPR

SEQ ID NO: 42557 - protein, 32 aa, Artificial Sequence
  Description of Artificial Sequence: Synthetic polypeptide
DEEEIRTTNPVATEQYGSVCSLLLERGQEDRN

SEQ ID NO: 42558 - protein, 34 aa, Artificial Sequence
  Description of Artificial Sequence: Synthetic polypeptide
DEEEIRTTNPVATEQYGSVCSMTNLQERFGSETD

SEQ ID NO: 42559 - protein, 33 aa, Artificial Sequence
  Description of Artificial Sequence: Synthetic polypeptide
DEEEIRTTNPVATEQYGSVCSMTNGLQNGSEQS

SEQ ID NO: 42560 - protein, 33 aa, Artificial Sequence
  Description of Artificial Sequence: Synthetic polypeptide
DEEEIRTTNPVATEQYGSVCSMTNDLQNGSETQ

SEQ ID NO: 42561 - protein, 30 aa, Artificial Sequence
  Description of Artificial Sequence: Synthetic polypeptide
DEEEIRTTNPCATEPYGSVATNHGRGNEAL

SEQ ID NO: 42562 - protein, 33 aa, Artificial Sequence
  Description of Artificial Sequence: Synthetic polypeptide
DEEEIRTTNPVATEQYGSVCSMNNLDQDHGNDA

SEQ ID NO: 42563 - protein, 29 aa, Artificial Sequence
  Description of Artificial Sequence: Synthetic peptide
DEEEIRTTNPCATEPYGSVATNHGRGMAM

SEQ ID NO: 42564 - protein, 31 aa, Artificial Sequence
  Description of Artificial Sequence: Synthetic polypeptide
DEEEIRTTNPVATEQYGSVCSLVLETGNDQS

SEQ ID NO: 42565 - protein, 29 aa, Artificial Sequence
  Description of Artificial Sequence: Synthetic peptide
DEEEIRTTNPCATEPYGSVATNHGRGGPA

SEQ ID NO: 42566 - protein, 30 aa, Artificial Sequence
  Description of Artificial Sequence: Synthetic polypeptide
DEECIRTTNPVAWEQYGQVSTINVQQGNAN

SEQ ID NO: 42567 - protein, 30 aa, Artificial Sequence
  Description of Artificial Sequence: Synthetic polypeptide
DEEEIRTTNPCATEPYGSVATNHGRGDNLA

SEQ ID NO: 42568 - protein, 28 aa, Artificial Sequence
  Description of Artificial Sequence: Synthetic peptide
DEEEIRTTNPCATEPYGSVATNHGGGDA

SEQ ID NO: 42569 - protein, 30 aa, Artificial Sequence
  Description of Artificial Sequence: Synthetic polypeptide
DEEEIRTTNPCATEPYGSVATNEHGRGNNA

SEQ ID NO: 42570 - protein, 33 aa, Artificial Sequence
  Description of Artificial Sequence: Synthetic polypeptide
DEEEIRTTNPVATEQYGDVVSTNLQQGVGGNND

SEQ ID NO: 42571 - protein, 31 aa, Artificial Sequence
  Description of Artificial Sequence: Synthetic polypeptide
DEEEIRTTNPVATEQYGSVCSLNLETNIERI

SEQ ID NO: 42572 - protein, 33 aa, Artificial Sequence
  Description of Artificial Sequence: Synthetic polypeptide
DEEEIRTTNPVATEQYGDVVSTSNLQVEMGNLD

SEQ ID NO: 42573 - protein, 32 aa, Artificial Sequence
  Description of Artificial Sequence: Synthetic polypeptide
DEEEIATTNPVAYEQYGQSVGTNDLLQRGIDR

SEQ ID NO: 42574 - protein, 33 aa, Artificial Sequence
  Description of Artificial Sequence: Synthetic polypeptide
DEEEIRTTNPVATEQYGQCVCSTNLDQRGSEQT

SEQ ID NO: 42575 - protein, 33 aa, Artificial Sequence
  Description of Artificial Sequence: Synthetic polypeptide
DEEEIRTTNPVATEQYGQCVCSTNLERFGSDND

SEQ ID NO: 42576 - protein, 33 aa, Artificial Sequence
  Description of Artificial Sequence: Synthetic polypeptide
DEEEIRTTNPVATEQYGQCVCSTNLQHFGSNLN

SEQ ID NO: 42577 - protein, 32 aa, Artificial Sequence
  Description of Artificial Sequence: Synthetic polypeptide
DEEEIGTTNPLATEQYGSVSTGNLQRGQDQAE

SEQ ID NO: 42578 - protein, 29 aa, Artificial Sequence
  Description of Artificial Sequence: Synthetic peptide
DEEEIGTTNPNATEEYGSVIATNQGRGNS

SEQ ID NO: 42579 - protein, 30 aa, Artificial Sequence
  Description of Artificial Sequence: Synthetic polypeptide
DEEEIRTTNPVATEQYGSCSTNPMNRVDDF

SEQ ID NO: 42580 - protein, 33 aa, Artificial Sequence
  Description of Artificial Sequence: Synthetic polypeptide
DEEEIRTTNPVATEQYGSTSMTNNDLPQMIGNN

SEQ ID NO: 42581 - protein, 29 aa, Artificial Sequence
  Description of Artificial Sequence: Synthetic peptide
DEEEIRTTNPVATEQYGSCSTNPPTNSQY

SEQ ID NO: 42582 - protein, 32 aa, Artificial Sequence
  Description of Artificial Sequence: Synthetic polypeptide
DEEEIRTTNPVATEQYGSTSMTENTSQEIGER

SEQ ID NO: 42583 - protein, 33 aa, Artificial Sequence
  Description of Artificial Sequence: Synthetic polypeptide
DEEEIGTTNPDATEQYGSVTSTPNQLQERMGNL

SEQ ID NO: 42584 - protein, 33 aa, Artificial Sequence
  Description of Artificial Sequence: Synthetic polypeptide
DEEEIRATNPVATEQYGSVSTTDNLQDTGNGNG

SEQ ID NO: 42585 - protein, 34 aa, Artificial Sequence
  Description of Artificial Sequence: Synthetic polypeptide
DEEEIRTTNPVATEQYGSVSETPLLQGREGNQLG

SEQ ID NO: 42586 - protein, 34 aa, Artificial Sequence
  Description of Artificial Sequence: Synthetic polypeptide
DEEEIRTTNPVATEQYGSTSMTENLNQHIGSNTR

SEQ ID NO: 42587 - protein, 34 aa, Artificial Sequence
  Description of Artificial Sequence: Synthetic polypeptide
DEEEIRTTNPVATEQYGSTSMTENLNQEGIGSNR

SEQ ID NO: 42588 - protein, 30 aa, Artificial Sequence
  Description of Artificial Sequence: Synthetic polypeptide
DEECIRTTNPVAYEQYGCVSTVNDQRGSQQ

SEQ ID NO: 42589 - protein, 34 aa, Artificial Sequence
  Description of Artificial Sequence: Synthetic polypeptide
DEEEIRTTNPVATEQYGSTSMTENDLSQRIGSNA

SEQ ID NO: 42590 - protein, 34 aa, Artificial Sequence
  Description of Artificial Sequence: Synthetic polypeptide
DEEEIRTTNPVATEQYGSTPSCTENLSQPTGGNR

SEQ ID NO: 42591 - protein, 33 aa, Artificial Sequence
  Description of Artificial Sequence: Synthetic polypeptide
DEEEIRTTNPVATEQYGSTSMTENLSTNIGSNR

SEQ ID NO: 42592 - protein, 31 aa, Artificial Sequence
  Description of Artificial Sequence: Synthetic polypeptide
DEEEIGTTNPAATEQYGSVPANQQHRQGNGR

SEQ ID NO: 42593 - protein, 31 aa, Artificial Sequence
  Description of Artificial Sequence: Synthetic polypeptide
DEEEIRATNPVATEQYGSVSVNNQDGGSNNG

SEQ ID NO: 42594 - protein, 30 aa, Artificial Sequence
  Description of Artificial Sequence: Synthetic polypeptide
DEEEIRATNPVATEQYGSVSVNQDLGINST

SEQ ID NO: 42595 - protein, 32 aa, Artificial Sequence
  Description of Artificial Sequence: Synthetic polypeptide
DEEEIRTTNPVATEQYGSVSGDGNGQNTGENN

SEQ ID NO: 42596 - protein, 29 aa, Artificial Sequence
  Description of Artificial Sequence: Synthetic peptide
DEEEICTTNPVSTEQYGSVSTFLLQGDQT

SEQ ID NO: 42597 - protein, 32 aa, Artificial Sequence
  Description of Artificial Sequence: Synthetic polypeptide
DEEEIRATNPVATEQYGTVSHTNDFQQGGGNR

SEQ ID NO: 42598 - protein, 31 aa, Artificial Sequence
  Description of Artificial Sequence: Synthetic polypeptide
DEEEIRATNPVATEQYGTVSHTNDFQGMGER

SEQ ID NO: 42599 - protein, 30 aa, Artificial Sequence
  Description of Artificial Sequence: Synthetic polypeptide
DEEEICTTNPVSTEQYGSVSTNLNLQGEQT

SEQ ID NO: 42600 - protein, 29 aa, Artificial Sequence
  Description of Artificial Sequence: Synthetic peptide
DEEEICTTNPVTTEQYGSVSTNQNGEGGP

SEQ ID NO: 42601 - protein, 29 aa, Artificial Sequence
  Description of Artificial Sequence: Synthetic peptide
DEEEICTVNPVATEQYGSVSTALGQQNQE

SEQ ID NO: 42602 - protein, 31 aa, Artificial Sequence
  Description of Artificial Sequence: Synthetic polypeptide
DEEEIRATNPVATEQYGTVSHTNDFQGEGNQ

SEQ ID NO: 42603 - protein, 30 aa, Artificial Sequence
  Description of Artificial Sequence: Synthetic polypeptide
DEEEIETTNPVATETYGSVTTNLQESGISG

SEQ ID NO: 42604 - protein, 32 aa, Artificial Sequence
  Description of Artificial Sequence: Synthetic polypeptide
DEEEIRTTNPVATEQYGSCSTNLQQNRSIDDG

SEQ ID NO: 42605 - protein, 30 aa, Artificial Sequence
  Description of Artificial Sequence: Synthetic polypeptide
DEEEIRATNPVATEQYGSVVVNQDTGSNNR

SEQ ID NO: 42606 - protein, 31 aa, Artificial Sequence
  Description of Artificial Sequence: Synthetic polypeptide
DEEEIRATNPVATEQYGSVSVVNTDGGSNNR

SEQ ID NO: 42607 - protein, 30 aa, Artificial Sequence
  Description of Artificial Sequence: Synthetic polypeptide
DEEEIRATNPVATEQYGSVSVNTDTGSNNQ

SEQ ID NO: 42608 - protein, 31 aa, Artificial Sequence
  Description of Artificial Sequence: Synthetic polypeptide
DEEEIRATNPVATEQYGSVSVNQDRQGSNEI

SEQ ID NO: 42609 - protein, 30 aa, Artificial Sequence
  Description of Artificial Sequence: Synthetic polypeptide
DEEEIRATNPVATEQYGSVSVNQDQGSNNP

SEQ ID NO: 42610 - protein, 31 aa, Artificial Sequence
  Description of Artificial Sequence: Synthetic polypeptide
DEEEIRTTNPVATEQYGSTNSTVEQRGEEEN

SEQ ID NO: 42611 - protein, 32 aa, Artificial Sequence
  Description of Artificial Sequence: Synthetic polypeptide
DEEEIRTTNPVATEQYGSTISTGNLSQWVGPE

SEQ ID NO: 42612 - protein, 33 aa, Artificial Sequence
  Description of Artificial Sequence: Synthetic polypeptide
DEEEIRTTNPVATEQYGSTCSMTEELNQSIGNR

SEQ ID NO: 42613 - protein, 34 aa, Artificial Sequence
  Description of Artificial Sequence: Synthetic polypeptide
DEEEIRTTNPVATEQYGSTCSCTGNLSQRGGNAV

SEQ ID NO: 42614 - protein, 33 aa, Artificial Sequence
  Description of Artificial Sequence: Synthetic polypeptide
DEEEIRATNPVATEQYGSVSANNDQDRGSNSRE

SEQ ID NO: 42615 - protein, 31 aa, Artificial Sequence
  Description of Artificial Sequence: Synthetic polypeptide
DEEEIRATNPVATEQYGSVSANLQDQNNDSV

SEQ ID NO: 42616 - protein, 32 aa, Artificial Sequence
  Description of Artificial Sequence: Synthetic polypeptide
DEEEIRATNPVATEQYGSVSANDNDRGSNSRY

SEQ ID NO: 42617 - protein, 31 aa, Artificial Sequence
  Description of Artificial Sequence: Synthetic polypeptide
DEEEIRTTNPVATEQYGSCSTVDLENGENPQ

SEQ ID NO: 42618 - protein, 32 aa, Artificial Sequence
  Description of Artificial Sequence: Synthetic polypeptide
DEEEIRTTNPVATEQYGSCSTVYLQQGQDMRG

SEQ ID NO: 42619 - protein, 33 aa, Artificial Sequence
  Description of Artificial Sequence: Synthetic polypeptide
DEEEIRTTNPVATEQYGSSCSSTNLERGNQIEP

SEQ ID NO: 42620 - protein, 33 aa, Artificial Sequence
  Description of Artificial Sequence: Synthetic polypeptide
DEEEIRATNPVATEQYGSVHSVDNQDQRGGNSR

SEQ ID NO: 42621 - protein, 32 aa, Artificial Sequence
  Description of Artificial Sequence: Synthetic polypeptide
DEEEIGTTNPVATEQYGSVCSTDLQRFGSEQP

SEQ ID NO: 42622 - protein, 31 aa, Artificial Sequence
  Description of Artificial Sequence: Synthetic polypeptide
DEEEIRTTNPVATEQYGSCSVTDNQEGENPQ

SEQ ID NO: 42623 - protein, 32 aa, Artificial Sequence
  Description of Artificial Sequence: Synthetic polypeptide
DEEEIGTTNPVATEQYGSVCSTEELQNNSNRD

SEQ ID NO: 42624 - protein, 33 aa, Artificial Sequence
  Description of Artificial Sequence: Synthetic polypeptide
DEEEIGTTNPVATEQYGSVCSTNDLQEGMGSNQ

SEQ ID NO: 42625 - protein, 33 aa, Artificial Sequence
  Description of Artificial Sequence: Synthetic polypeptide
DEEEIRTTNPVATEQYGSQVVSVTNELDRTGEI

SEQ ID NO: 42626 - protein, 34 aa, Artificial Sequence
  Description of Artificial Sequence: Synthetic polypeptide
DEEEIGTTNPVATEQYGSVCSTNDLQERFGSNLM

SEQ ID NO: 42627 - protein, 33 aa, Artificial Sequence
  Description of Artificial Sequence: Synthetic polypeptide
DEEEIGTTNPVATEQYGSVCSTNDLQERMISNL

SEQ ID NO: 42628 - protein, 32 aa, Artificial Sequence
  Description of Artificial Sequence: Synthetic polypeptide
DEEEIGTTNPVATEQYGSVCSTNELQNGSEQP

SEQ ID NO: 42629 - protein, 31 aa, Artificial Sequence
  Description of Artificial Sequence: Synthetic polypeptide
DEEEIRATNPVATEQYGSVSANNDRGSNSDQ

SEQ ID NO: 42630 - protein, 32 aa, Artificial Sequence
  Description of Artificial Sequence: Synthetic polypeptide
DEEEIRATNPVATEQYGTVSHTNNDFQGGGNR

SEQ ID NO: 42631 - protein, 30 aa, Artificial Sequence
  Description of Artificial Sequence: Synthetic polypeptide
DEEEIGTTNPVATEQYGEVEMTYNLEYGER

SEQ ID NO: 42632 - protein, 31 aa, Artificial Sequence
  Description of Artificial Sequence: Synthetic polypeptide
DEEEIRATNPVATEQYGSVSANQDRGSNSLM

SEQ ID NO: 42633 - protein, 34 aa, Artificial Sequence
  Description of Artificial Sequence: Synthetic polypeptide
DEEEIRTTNPVATEQYGSTCSCTGNLSQNKGGNR

SEQ ID NO: 42634 - protein, 33 aa, Artificial Sequence
  Description of Artificial Sequence: Synthetic polypeptide
DEEEIRTTNPVATEQYGSTCSCTGNLSQNGGNH

SEQ ID NO: 42635 - protein, 34 aa, Artificial Sequence
  Description of Artificial Sequence: Synthetic polypeptide
DEEEIRTTNPVATEQYGSTCSCTGNLSQMGGNRS

SEQ ID NO: 42636 - protein, 32 aa, Artificial Sequence
  Description of Artificial Sequence: Synthetic polypeptide
DEEEIRATNPVATEQYGSVSTGNLQPDNQNDT

SEQ ID NO: 42637 - protein, 34 aa, Artificial Sequence
  Description of Artificial Sequence: Synthetic polypeptide
DEEEIRTTNPVATEQYGSTCSCTGNDSQRGGNRM

SEQ ID NO: 42638 - protein, 33 aa, Artificial Sequence
  Description of Artificial Sequence: Synthetic polypeptide
DEEEIRTTNPVATEQYGSVSETQLQRFTQNVVD

SEQ ID NO: 42639 - protein, 33 aa, Artificial Sequence
  Description of Artificial Sequence: Synthetic polypeptide
DEEEIRTTNPVATEQYGSTCSCTGGLSQSGGNR

SEQ ID NO: 42640 - protein, 33 aa, Artificial Sequence
  Description of Artificial Sequence: Synthetic polypeptide
DEEEIRTTNPVATEQYGSTCSCQGNLSQEGGNR

SEQ ID NO: 42641 - protein, 32 aa, Artificial Sequence
  Description of Artificial Sequence: Synthetic polypeptide
DEEEIRATNPVATEQYGSVSTENLQRESPEAN

SEQ ID NO: 42642 - protein, 34 aa, Artificial Sequence
  Description of Artificial Sequence: Synthetic polypeptide
DEEEIRTTNPVATEQYGSTCQSCTGNLSQRGGNL

SEQ ID NO: 42643 - protein, 33 aa, Artificial Sequence
  Description of Artificial Sequence: Synthetic polypeptide
DEEEIRTTNPVATEQYGSTAMTNNLPQRIGQRD

SEQ ID NO: 42644 - protein, 31 aa, Artificial Sequence
  Description of Artificial Sequence: Synthetic polypeptide
DEEEIGTTNPVATEQYGCVCSTNHQNFGNNQ

SEQ ID NO: 42645 - protein, 33 aa, Artificial Sequence
  Description of Artificial Sequence: Synthetic polypeptide
DEEEIGTTNPVATEQYGCVCSTNLLQERFGNLS

SEQ ID NO: 42646 - protein, 33 aa, Artificial Sequence
  Description of Artificial Sequence: Synthetic polypeptide
DEEEIRTTNPVATEQYGSSVCSDHLQGNGGNRD

SEQ ID NO: 42647 - protein, 33 aa, Artificial Sequence
  Description of Artificial Sequence: Synthetic polypeptide
DEEEIRTTNPVATEQYGSSTSMEENLSERIGNR

SEQ ID NO: 42648 - protein, 30 aa, Artificial Sequence
  Description of Artificial Sequence: Synthetic polypeptide
DEEEIRATNPVATEQYGSVSANQDNGSNSD

SEQ ID NO: 42649 - protein, 29 aa, Artificial Sequence
  Description of Artificial Sequence: Synthetic peptide
DEEEIRTTNPVATEQYGSTSTQTDDTMNF

SEQ ID NO: 42650 - protein, 32 aa, Artificial Sequence
  Description of Artificial Sequence: Synthetic polypeptide
DEEEIRTTNPVATEQYGSTSTTENLGNNIGNI

SEQ ID NO: 42651 - protein, 33 aa, Artificial Sequence
  Description of Artificial Sequence: Synthetic polypeptide
DEEEIRTTNPVATEQYGSTSTTNNLNQRDPSNQ

SEQ ID NO: 42652 - protein, 33 aa, Artificial Sequence
  Description of Artificial Sequence: Synthetic polypeptide
DEEEIRTTNPVATEQYGSTVSCTNLSQSSGASF

SEQ ID NO: 42653 - protein, 32 aa, Artificial Sequence
  Description of Artificial Sequence: Synthetic polypeptide
DEEEICTTNPVAYEAYGSVSTNMLQRTGGNES

SEQ ID NO: 42654 - protein, 31 aa, Artificial Sequence
  Description of Artificial Sequence: Synthetic polypeptide
DEEEIRATNPVATETYGSVSTDLQGGGNNGE

SEQ ID NO: 42655 - protein, 32 aa, Artificial Sequence
  Description of Artificial Sequence: Synthetic polypeptide
DEEEICTTNPVAYEAYGSVSTNMLSQRGGNYS

SEQ ID NO: 42656 - protein, 32 aa, Artificial Sequence
  Description of Artificial Sequence: Synthetic polypeptide
DEEEIRATNPVATESYGSVSTNLQNGGNENGD

SEQ ID NO: 42657 - protein, 32 aa, Artificial Sequence
  Description of Artificial Sequence: Synthetic polypeptide
DEEEIRTTNPVATEQYGSCSTMDNQESGNDRQ

SEQ ID NO: 42658 - protein, 32 aa, Artificial Sequence
  Description of Artificial Sequence: Synthetic polypeptide
DEEEIRTTNPVATEQYGSCSTMDNQRDGDDRQ

SEQ ID NO: 42659 - protein, 31 aa, Artificial Sequence
  Description of Artificial Sequence: Synthetic polypeptide
DEEEICTTNPVAYEHYGSVPCTNLSQRGNNT

SEQ ID NO: 42660 - protein, 32 aa, Artificial Sequence
  Description of Artificial Sequence: Synthetic polypeptide
DEEEIRTTNPVATEQYGSCSTMLDVRSTNDRI

SEQ ID NO: 42661 - protein, 32 aa, Artificial Sequence
  Description of Artificial Sequence: Synthetic polypeptide
DEECIRTTNPVAYEQYGQSVSQNDLLQRGHMR

SEQ ID NO: 42662 - protein, 32 aa, Artificial Sequence
  Description of Artificial Sequence: Synthetic polypeptide
DEEEIRTTNPVATEQYGSCSTNDLDQRNMIED

SEQ ID NO: 42663 - protein, 34 aa, Artificial Sequence
  Description of Artificial Sequence: Synthetic polypeptide
DEEEIRTTNPVATEQYGSTVSCTGNALDRTGNNS

SEQ ID NO: 42664 - protein, 33 aa, Artificial Sequence
  Description of Artificial Sequence: Synthetic polypeptide
DEEEIRTTNPVATEQYGSTVQCCTTLSQRGGNQ

SEQ ID NO: 42665 - protein, 33 aa, Artificial Sequence
  Description of Artificial Sequence: Synthetic polypeptide
DEEEIRTTNPVATEQYGSTVPWTALSQEVGNNR

SEQ ID NO: 42666 - protein, 33 aa, Artificial Sequence
  Description of Artificial Sequence: Synthetic polypeptide
DEECIRTTNPVAYEQYGQSVSNTNDLLQRGIER

SEQ ID NO: 42667 - protein, 32 aa, Artificial Sequence
  Description of Artificial Sequence: Synthetic polypeptide
DEEEIRATNPVATETYGSVSTNLQGGGNGNGN

SEQ ID NO: 42668 - protein, 32 aa, Artificial Sequence
  Description of Artificial Sequence: Synthetic polypeptide
DEEEICTTNPVAYEQWGSVCCTNLSQRTGNQR

SEQ ID NO: 42669 - protein, 32 aa, Artificial Sequence
  Description of Artificial Sequence: Synthetic polypeptide
DEEEIRATNPVATETYGSVSTNLQGGNENEGQ

SEQ ID NO: 42670 - protein, 31 aa, Artificial Sequence
  Description of Artificial Sequence: Synthetic polypeptide
DEEEICTTNPVAYEAYGSVSCTNLQQGGNSS

SEQ ID NO: 42671 - protein, 31 aa, Artificial Sequence
  Description of Artificial Sequence: Synthetic polypeptide
DEECIRTTNPVAYEQYGQVSCTINEVQRGNQ

SEQ ID NO: 42672 - protein, 31 aa, Artificial Sequence
  Description of Artificial Sequence: Synthetic polypeptide
DEEEICTTNPVATEYYGSVSTTNNLQENNNG

SEQ ID NO: 42673 - protein, 31 aa, Artificial Sequence
  Description of Artificial Sequence: Synthetic polypeptide
DEEEIRATNPVAYEQYGQVSCTNSSQGGGNR

SEQ ID NO: 42674 - protein, 33 aa, Artificial Sequence
  Description of Artificial Sequence: Synthetic polypeptide
DEEEIRATNPVAYEQYGQSVSTNDLDQRGIGRE

SEQ ID NO: 42675 - protein, 31 aa, Artificial Sequence
  Description of Artificial Sequence: Synthetic polypeptide
DEEEICTTNPVAYEAWGSVSTNMLSQRGDNS

SEQ ID NO: 42676 - protein, 32 aa, Artificial Sequence
  Description of Artificial Sequence: Synthetic polypeptide
DEEEICTTNPVAYEAYGISVSCTNLSQRGDNS

SEQ ID NO: 42677 - protein, 32 aa, Artificial Sequence
  Description of Artificial Sequence: Synthetic polypeptide
DEEEICTTNPVAYEAYGQSVSTNLSQRGDNNS

SEQ ID NO: 42678 - protein, 33 aa, Artificial Sequence
  Description of Artificial Sequence: Synthetic polypeptide
DEEEIRTTNPVATEQYGSCSTDPLQDRTGINQE

SEQ ID NO: 42679 - protein, 32 aa, Artificial Sequence
  Description of Artificial Sequence: Synthetic polypeptide
DEEEIRTTNPVATEQYGSCSTEDLGNRVGLND

SEQ ID NO: 42680 - protein, 31 aa, Artificial Sequence
  Description of Artificial Sequence: Synthetic polypeptide
DEEEICTTNPVAYEAYGSTVSCTNLQRGTDS

SEQ ID NO: 42681 - protein, 30 aa, Artificial Sequence
  Description of Artificial Sequence: Synthetic polypeptide
DEEEIRTTNPVATEQYGSCSTGVYQLGEQQ

SEQ ID NO: 42682 - protein, 30 aa, Artificial Sequence
  Description of Artificial Sequence: Synthetic polypeptide
DEEEIRTTNPVATEQYGSCSTILDAGSEEF

SEQ ID NO: 42683 - protein, 31 aa, Artificial Sequence
  Description of Artificial Sequence: Synthetic polypeptide
DEEEICTTNPVAYEAYGSTVSTNHSQRGDNS

SEQ ID NO: 42684 - protein, 31 aa, Artificial Sequence
  Description of Artificial Sequence: Synthetic polypeptide
DEEEICTTNPVAYEAYGSVPSTNLSQDGGNS

SEQ ID NO: 42685 - protein, 32 aa, Artificial Sequence
  Description of Artificial Sequence: Synthetic polypeptide
DEEEIRTTNPVATEQYGSCSTLDWLQNGENPQ

SEQ ID NO: 42686 - protein, 30 aa, Artificial Sequence
  Description of Artificial Sequence: Synthetic polypeptide
DEECIRTTNPVAYEQYGQVSATINVQDGNN

SEQ ID NO: 42687 - protein, 31 aa, Artificial Sequence
  Description of Artificial Sequence: Synthetic polypeptide
DEEEIGTTNPVATEQYGSVCSTNHQHNSNQL

SEQ ID NO: 42688 - protein, 36 aa, Artificial Sequence
  Description of Artificial Sequence: Synthetic polypeptide
DEEEIRTTNPVATEQYGSTVPSYTNLPQRTGGNNRD

SEQ ID NO: 42689 - protein, 35 aa, Artificial Sequence
  Description of Artificial Sequence: Synthetic polypeptide
DEEEIRTTNPVATEQYGSTVPSTNALPTRTGGNRP

SEQ ID NO: 42690 - protein, 31 aa, Artificial Sequence
  Description of Artificial Sequence: Synthetic polypeptide
DEEEIRTTNPVATEQYGSCSTNLESSNEESI

SEQ ID NO: 42691 - protein, 32 aa, Artificial Sequence
  Description of Artificial Sequence: Synthetic polypeptide
DEEEIRTTNPVATEQYGSCSTNLHEEGGNNFD

SEQ ID NO: 42692 - protein, 32 aa, Artificial Sequence
  Description of Artificial Sequence: Synthetic polypeptide
DEEEIRATNPVATEQYGVVSTTNLQQEGGNGF

SEQ ID NO: 42693 - protein, 30 aa, Artificial Sequence
  Description of Artificial Sequence: Synthetic polypeptide
DEEEIRTTNPVATEQYGSVSGLPEPRPDNG

SEQ ID NO: 42694 - protein, 32 aa, Artificial Sequence
  Description of Artificial Sequence: Synthetic polypeptide
DEEEIRATNPVATEQYGVVSTTNLLQGGTNIF

SEQ ID NO: 42695 - protein, 32 aa, Artificial Sequence
  Description of Artificial Sequence: Synthetic polypeptide
DEEEICTTNPVAYEQYGSVSDNALSQPGGNNR

SEQ ID NO: 42696 - protein, 31 aa, Artificial Sequence
  Description of Artificial Sequence: Synthetic polypeptide
DEECIRTTNPVAYEQWGSVSCQGNLQTGGNR

SEQ ID NO: 42697 - protein, 33 aa, Artificial Sequence
  Description of Artificial Sequence: Synthetic polypeptide
DEEEIRTTNPVATEQYGSVSGDTGNGQTGGNTT

SEQ ID NO: 42698 - protein, 31 aa, Artificial Sequence
  Description of Artificial Sequence: Synthetic polypeptide
DEECIRTTNPVAYEQWGSVWSLDNDLQRDNR

SEQ ID NO: 42699 - protein, 32 aa, Artificial Sequence
  Description of Artificial Sequence: Synthetic polypeptide
DEEEIRTTNPVATEQYGSVSGDNLQNTGDEGE

SEQ ID NO: 42700 - protein, 32 aa, Artificial Sequence
  Description of Artificial Sequence: Synthetic polypeptide
DEEEIRTTNPVATEQYGSVSGDNLNQNTGEGG

SEQ ID NO: 42701 - protein, 33 aa, Artificial Sequence
  Description of Artificial Sequence: Synthetic polypeptide
DEEEICTTNPVAYEQYGSVVSCTNALSGRGGNR

SEQ ID NO: 42702 - protein, 32 aa, Artificial Sequence
  Description of Artificial Sequence: Synthetic polypeptide
DEEEIRATNPVATEQYGVVSMTNLFQGGGNTE

SEQ ID NO: 42703 - protein, 32 aa, Artificial Sequence
  Description of Artificial Sequence: Synthetic polypeptide
DEEEIRATNPVATEQYGVVSMTNLFQGGGGNG

SEQ ID NO: 42704 - protein, 32 aa, Artificial Sequence
  Description of Artificial Sequence: Synthetic polypeptide
DEEEICTTNPVAYEQYGSVVSLNALSQPGGNR

SEQ ID NO: 42705 - protein, 32 aa, Artificial Sequence
  Description of Artificial Sequence: Synthetic polypeptide
DEEEICTTNPVAYEQYGSVSCTNELSQVRGEF

SEQ ID NO: 42706 - protein, 32 aa, Artificial Sequence
  Description of Artificial Sequence: Synthetic polypeptide
DEEEIRATNPVATEQYGVVSTTTNLQQGGNTF

SEQ ID NO: 42707 - protein, 32 aa, Artificial Sequence
  Description of Artificial Sequence: Synthetic polypeptide
DEEEIRATNPVATEQYGVVSTTNNLQQGQGNF

SEQ ID NO: 42708 - protein, 33 aa, Artificial Sequence
  Description of Artificial Sequence: Synthetic polypeptide
DEEEIRTTNPVATEQYGSTVCCTGNLTYRGGTR

SEQ ID NO: 42709 - protein, 31 aa, Artificial Sequence
  Description of Artificial Sequence: Synthetic polypeptide
DEEEIRTTNPVATEQYGSVSGNLDTYMQNGQ

SEQ ID NO: 42710 - protein, 29 aa, Artificial Sequence
  Description of Artificial Sequence: Synthetic peptide
DEEEIRTTNPVATEQYGSCSTNEMIVDDD

SEQ ID NO: 42711 - protein, 32 aa, Artificial Sequence
  Description of Artificial Sequence: Synthetic polypeptide
DEEEIRATNPVATEQYGVVSTTNQLQQNGGNF

SEQ ID NO: 42712 - protein, 35 aa, Artificial Sequence
  Description of Artificial Sequence: Synthetic polypeptide
DEEEIRTTNPVATEQYGSTVPSCTNLPQSTGNNRP

SEQ ID NO: 42713 - protein, 32 aa, Artificial Sequence
  Description of Artificial Sequence: Synthetic polypeptide
DEEEIRTTNPVATEQYGSCSTNGHQERDMIRD

SEQ ID NO: 42714 - protein, 32 aa, Artificial Sequence
  Description of Artificial Sequence: Synthetic polypeptide
DEEEIRTTNPVATEQYGSCSTNGPGPRGNNIQ

SEQ ID NO: 42715 - protein, 33 aa, Artificial Sequence
  Description of Artificial Sequence: Synthetic polypeptide
DEEEIRTTNPVATEQYGSTVPSCTNALDRTVNS

SEQ ID NO: 42716 - protein, 35 aa, Artificial Sequence
  Description of Artificial Sequence: Synthetic polypeptide
DEEEIRTTNPVATEQYGSTVPHCTNLPQRTGGNRP

SEQ ID NO: 42717 - protein, 31 aa, Artificial Sequence
  Description of Artificial Sequence: Synthetic polypeptide
DEEEIRTTNPVATEQYGSCSTNLDAGEEEFA

SEQ ID NO: 42718 - protein, 33 aa, Artificial Sequence
  Description of Artificial Sequence: Synthetic polypeptide
DEEEICTTNPVAYEQYGSTVSTNFSQDRVGNRT

SEQ ID NO: 42719 - protein, 34 aa, Artificial Sequence
  Description of Artificial Sequence: Synthetic polypeptide
DEEEIRTTNPVATEQYGSVSETNLQSRDGVTQEA

SEQ ID NO: 42720 - protein, 32 aa, Artificial Sequence
  Description of Artificial Sequence: Synthetic polypeptide
DEEEIRTTNPVATEQYGSCSTNLDPRNSEEER

SEQ ID NO: 42721 - protein, 31 aa, Artificial Sequence
  Description of Artificial Sequence: Synthetic polypeptide
DEEEIRTTNPVATEQYGSCSTNLDQTEIAQQ

SEQ ID NO: 42722 - protein, 31 aa, Artificial Sequence
  Description of Artificial Sequence: Synthetic polypeptide
DEEEICTTNPVAYEQYGSVCCTNQSQRVNNR

SEQ ID NO: 42723 - protein, 33 aa, Artificial Sequence
  Description of Artificial Sequence: Synthetic polypeptide
DEEEIRTTNPVATEQYGSTVFCTNLAQSGGNNK

SEQ ID NO: 42724 - protein, 33 aa, Artificial Sequence
  Description of Artificial Sequence: Synthetic polypeptide
DEEEICTTNPVAYEQYGSVSCTNELQERTGGNL

SEQ ID NO: 42725 - protein, 32 aa, Artificial Sequence
  Description of Artificial Sequence: Synthetic polypeptide
DEEEIRTTNPVATEQYGSCSWNLESGNENQRI

SEQ ID NO: 42726 - protein, 32 aa, Artificial Sequence
  Description of Artificial Sequence: Synthetic polypeptide
DEEEIGTTNPVATEQYGSVCSTNHQNMGSNQI

SEQ ID NO: 42727 - protein, 29 aa, Artificial Sequence
  Description of Artificial Sequence: Synthetic peptide
DEEEIRTTNPVATEQYGSCSWPPQSGTEE

SEQ ID NO: 42728 - protein, 32 aa, Artificial Sequence
  Description of Artificial Sequence: Synthetic polypeptide
DEEEIRTTNPVATEQYGSVSFLNELGQEQNSE

SEQ ID NO: 42729 - protein, 30 aa, Artificial Sequence
  Description of Artificial Sequence: Synthetic polypeptide
DEEEIRTTNPVATEQYGSINSPDGEQRGEE

SEQ ID NO: 42730 - protein, 32 aa, Artificial Sequence
  Description of Artificial Sequence: Synthetic polypeptide
DEEEIRTTNPVATEQYGSIQSSTMNEQTEGNV

SEQ ID NO: 42731 - protein, 32 aa, Artificial Sequence
  Description of Artificial Sequence: Synthetic polypeptide
DEEEIRTTNPVATEQYGSISDTNDLQGVENDS

SEQ ID NO: 42732 - protein, 32 aa, Artificial Sequence
  Description of Artificial Sequence: Synthetic polypeptide
DEEEIRTTNPVATEQYGSISELMNMLQIDNMR

SEQ ID NO: 42733 - protein, 31 aa, Artificial Sequence
  Description of Artificial Sequence: Synthetic polypeptide
DEEEIRTTNPVATEQYGSISETNLEVVENDS

SEQ ID NO: 42734 - protein, 30 aa, Artificial Sequence
  Description of Artificial Sequence: Synthetic polypeptide
DEEEIRTTNPVATEQYGSISLMPMHQINNR

SEQ ID NO: 42735 - protein, 31 aa, Artificial Sequence
  Description of Artificial Sequence: Synthetic polypeptide
DEEEIRTTNPVATEQYGSISLMPMLQIDTNR

SEQ ID NO: 42736 - protein, 29 aa, Artificial Sequence
  Description of Artificial Sequence: Synthetic peptide
DEEEIKTTNPVATEQYGCVSWHLQTNLND

SEQ ID NO: 42737 - protein, 34 aa, Artificial Sequence
  Description of Artificial Sequence: Synthetic polypeptide
DEEEIRTTNPVATEQYGSMVSTGQGLEQSGFNNR

SEQ ID NO: 42738 - protein, 32 aa, Artificial Sequence
  Description of Artificial Sequence: Synthetic polypeptide
DEEEIRATNPVATEPYGSVSTNLQNGGNGNGG

SEQ ID NO: 42739 - protein, 32 aa, Artificial Sequence
  Description of Artificial Sequence: Synthetic polypeptide
DEEEIRATNPVATEPYGISVSTVNLQDRIADR

SEQ ID NO: 42740 - protein, 33 aa, Artificial Sequence
  Description of Artificial Sequence: Synthetic polypeptide
DEEEIRTTNPVATEQYGSISLPNMLSQGVGNNR

SEQ ID NO: 42741 - protein, 32 aa, Artificial Sequence
  Description of Artificial Sequence: Synthetic polypeptide
DEEEIKTTNPVATEQYGSVDTANQLQEIMGNL

SEQ ID NO: 42742 - protein, 31 aa, Artificial Sequence
  Description of Artificial Sequence: Synthetic polypeptide
DEEEIRTTNPVATEQYGSMSTDADQTGNQSM

SEQ ID NO: 42743 - protein, 34 aa, Artificial Sequence
  Description of Artificial Sequence: Synthetic polypeptide
DEEEIRTTNPVATEQYGSVSFTNLELQIEMVNRY

SEQ ID NO: 42744 - protein, 30 aa, Artificial Sequence
  Description of Artificial Sequence: Synthetic polypeptide
DEEEIKTTNPVATEQYGSVNSNEDQFELNR

SEQ ID NO: 42745 - protein, 31 aa, Artificial Sequence
  Description of Artificial Sequence: Synthetic polypeptide
DEEEIRTTNPVATEQYGSIISTYLQILENDM

SEQ ID NO: 42746 - protein, 30 aa, Artificial Sequence
  Description of Artificial Sequence: Synthetic polypeptide
DEEEIKTTNPVATEFYGSVSTMDIQHFGNQ

SEQ ID NO: 42747 - protein, 30 aa, Artificial Sequence
  Description of Artificial Sequence: Synthetic polypeptide
DEEEIRATNPVATEQYGCVAITHLEQGGNE

SEQ ID NO: 42748 - protein, 32 aa, Artificial Sequence
  Description of Artificial Sequence: Synthetic polypeptide
DEEEIRATNPVATEQYGCVAATNLDQMGGENR

SEQ ID NO: 42749 - protein, 31 aa, Artificial Sequence
  Description of Artificial Sequence: Synthetic polypeptide
DEEEIRATNPVATEQYGCVAATNLDEGGNQR

SEQ ID NO: 42750 - protein, 31 aa, Artificial Sequence
  Description of Artificial Sequence: Synthetic polypeptide
DEEEIRTTNPVATEQYGSGSVNLQYIGSESS

SEQ ID NO: 42751 - protein, 31 aa, Artificial Sequence
  Description of Artificial Sequence: Synthetic polypeptide
DEEEIKTTNPAATEQYGSVPTSNLQHIGNGD

SEQ ID NO: 42752 - protein, 34 aa, Artificial Sequence
  Description of Artificial Sequence: Synthetic polypeptide
DEEEIRTTNPVATEQYGSGVSPTNLGQEQGNPEL

SEQ ID NO: 42753 - protein, 31 aa, Artificial Sequence
  Description of Artificial Sequence: Synthetic polypeptide
DEEEIKTTNPCATEQYGSVPTNLQHFGNGGT

SEQ ID NO: 42754 - protein, 32 aa, Artificial Sequence
  Description of Artificial Sequence: Synthetic polypeptide
DEEEIRTTNPVATEQYGSNVGTNHHQGRNNID

SEQ ID NO: 42755 - protein, 30 aa, Artificial Sequence
  Description of Artificial Sequence: Synthetic polypeptide
DEEEIKTTNPVAIEQYGCVSWNHQHGNIRP

SEQ ID NO: 42756 - protein, 34 aa, Artificial Sequence
  Description of Artificial Sequence: Synthetic polypeptide
DEEEIKTTNPVATEAYGSTVSTNALSQRTGENRM

SEQ ID NO: 42757 - protein, 34 aa, Artificial Sequence
  Description of Artificial Sequence: Synthetic polypeptide
DEEEIKTTNPVATEAYGSVPSTGNALSQRGENRM

SEQ ID NO: 42758 - protein, 32 aa, Artificial Sequence
  Description of Artificial Sequence: Synthetic polypeptide
DEEEIRTTNPVATEQYGSVSFLGTLQRNENQD

SEQ ID NO: 42759 - protein, 31 aa, Artificial Sequence
  Description of Artificial Sequence: Synthetic polypeptide
DEEEIRATNPVATEQWGSVSENLQHNNDNQR

SEQ ID NO: 42760 - protein, 30 aa, Artificial Sequence
  Description of Artificial Sequence: Synthetic polypeptide
DEEEIRATNPVATEQWGSVIPNNLQQGNDS

SEQ ID NO: 42761 - protein, 34 aa, Artificial Sequence
  Description of Artificial Sequence: Synthetic polypeptide
DEEEIKTTNPVATEAYGSVSTNALSQTRGGENRM

SEQ ID NO: 42762 - protein, 32 aa, Artificial Sequence
  Description of Artificial Sequence: Synthetic polypeptide
DEEEIRTTNPVATEQYGSNRWTEDLQNRGEDR

SEQ ID NO: 42763 - protein, 30 aa, Artificial Sequence
  Description of Artificial Sequence: Synthetic polypeptide
DEEEIRATNPVATEQYGCVAITNDEQGGNH

SEQ ID NO: 42764 - protein, 31 aa, Artificial Sequence
  Description of Artificial Sequence: Synthetic polypeptide
DEEEIRATNPVATEAYGKVSCTNLSQGGGNT

SEQ ID NO: 42765 - protein, 32 aa, Artificial Sequence
  Description of Artificial Sequence: Synthetic polypeptide
DEEEIRTTNPVATEQYGSISPGNLQIGLVERI

SEQ ID NO: 42766 - protein, 31 aa, Artificial Sequence
  Description of Artificial Sequence: Synthetic polypeptide
DEEEINTTNPVATEQYGSVSTNSLFQVTEEF

SEQ ID NO: 42767 - protein, 32 aa, Artificial Sequence
  Description of Artificial Sequence: Synthetic polypeptide
DEEEINTTNPVATEQYGSVSTNSLFQVRNSEF

SEQ ID NO: 42768 - protein, 33 aa, Artificial Sequence
  Description of Artificial Sequence: Synthetic polypeptide
DEEEINTTNPVATEQYGSVSTNSLFQVRGLEGF

SEQ ID NO: 42769 - protein, 32 aa, Artificial Sequence
  Description of Artificial Sequence: Synthetic polypeptide
DEEEIMTTNPVATEPYGISVSTVNQQDGIQNR

SEQ ID NO: 42770 - protein, 33 aa, Artificial Sequence
  Description of Artificial Sequence: Synthetic polypeptide
DEEEIRTTNPVATEQYGSIVSTPGLQRGEVFEF

SEQ ID NO: 42771 - protein, 32 aa, Artificial Sequence
  Description of Artificial Sequence: Synthetic polypeptide
DEEEINTTNPVATEQYGSVSTNSLFQVEGEFD

SEQ ID NO: 42772 - protein, 32 aa, Artificial Sequence
  Description of Artificial Sequence: Synthetic polypeptide
DEEEIRTTNPVATEQYGSVSFSNDQMVEGVLR

SEQ ID NO: 42773 - protein, 33 aa, Artificial Sequence
  Description of Artificial Sequence: Synthetic polypeptide
DEEEINTTNPVATEPYGSVSTNSLSQNRGGENQ

SEQ ID NO: 42774 - protein, 33 aa, Artificial Sequence
  Description of Artificial Sequence: Synthetic polypeptide
DEEEIRTTNPVATEQYGSIVSPANLEQRLVGRS

SEQ ID NO: 42775 - protein, 31 aa, Artificial Sequence
  Description of Artificial Sequence: Synthetic polypeptide
DEECIRTTNPVAYEQYDYTSISINLQRGDNR

SEQ ID NO: 42776 - protein, 32 aa, Artificial Sequence
  Description of Artificial Sequence: Synthetic polypeptide
DEEEINTTNPVATEQYGSVSTESLFQERGSEF

SEQ ID NO: 42777 - protein, 29 aa, Artificial Sequence
  Description of Artificial Sequence: Synthetic peptide
DEEEIRTTNPVATEQYGSITTNLVEEEVD

SEQ ID NO: 42778 - protein, 32 aa, Artificial Sequence
  Description of Artificial Sequence: Synthetic polypeptide
DEEEINTTNPVATEQYGSVSTDNGGDQVRGEH

SEQ ID NO: 42779 - protein, 32 aa, Artificial Sequence
  Description of Artificial Sequence: Synthetic polypeptide
DEEEINTTNPVATEQYGKVVSTNLDPRGGNLW

SEQ ID NO: 42780 - protein, 32 aa, Artificial Sequence
  Description of Artificial Sequence: Synthetic polypeptide
DEEEIRTTNPVATEQYGSISTSLIRNDVNERE

SEQ ID NO: 42781 - protein, 32 aa, Artificial Sequence
  Description of Artificial Sequence: Synthetic polypeptide
DEEEIKTTNPVAYERYGSTVSTNLSQRGGNYF

SEQ ID NO: 42782 - protein, 31 aa, Artificial Sequence
  Description of Artificial Sequence: Synthetic polypeptide
DEEEIRTTNPVATEQYGSISPAPNLQVDMFR

SEQ ID NO: 42783 - protein, 32 aa, Artificial Sequence
  Description of Artificial Sequence: Synthetic polypeptide
DEEEIKTTNPVAYERYGSTVSCTNLSQRGTNM

SEQ ID NO: 42784 - protein, 31 aa, Artificial Sequence
  Description of Artificial Sequence: Synthetic polypeptide
DEEEIRTTNPVATEQYGSVSFNNLQSTEESQ

SEQ ID NO: 42785 - protein, 30 aa, Artificial Sequence
  Description of Artificial Sequence: Synthetic polypeptide
DEEEIRTTNPVATEQYGSMNTVNPQVDNNP

SEQ ID NO: 42786 - protein, 32 aa, Artificial Sequence
  Description of Artificial Sequence: Synthetic polypeptide
DEEEIKTTNPVATEQYGSVQTNNLIQRAENVD

SEQ ID NO: 42787 - protein, 32 aa, Artificial Sequence
  Description of Artificial Sequence: Synthetic polypeptide
DEEEIKTTNPVATEQYGSVSNTNQDQEEMGNL

SEQ ID NO: 42788 - protein, 32 aa, Artificial Sequence
  Description of Artificial Sequence: Synthetic polypeptide
DEEEIRTTNPVATEQYGSISSNTNTLGAGNEP

SEQ ID NO: 42789 - protein, 33 aa, Artificial Sequence
  Description of Artificial Sequence: Synthetic polypeptide
DEEEIKTTNPVATEQYGSVSTDGNLQEEMGNLD

SEQ ID NO: 42790 - protein, 31 aa, Artificial Sequence
  Description of Artificial Sequence: Synthetic polypeptide
DEEEIRTTNPVATEQYGSVSFNLQTEQEAEI

SEQ ID NO: 42791 - protein, 33 aa, Artificial Sequence
  Description of Artificial Sequence: Synthetic polypeptide
DEEEIKTTNPVATEQYGSVSTNLQFQVREGEEF

SEQ ID NO: 42792 - protein, 31 aa, Artificial Sequence
  Description of Artificial Sequence: Synthetic polypeptide
DEEEIRTTNPVATEQYGSLSTNELNNFDNFT

SEQ ID NO: 42793 - protein, 32 aa, Artificial Sequence
  Description of Artificial Sequence: Synthetic polypeptide
DEEEIKTTNPVATERWGSTVSCTNLSQRGNNF

SEQ ID NO: 42794 - protein, 31 aa, Artificial Sequence
  Description of Artificial Sequence: Synthetic polypeptide
DEEEINTTNPVCTEQYGSVQTNSLNQVRGEQ

SEQ ID NO: 42795 - protein, 33 aa, Artificial Sequence
  Description of Artificial Sequence: Synthetic polypeptide
DEEEIRTTNPVATEQYGSVSFNNLDTFEGQNRK

SEQ ID NO: 42796 - protein, 33 aa, Artificial Sequence
  Description of Artificial Sequence: Synthetic polypeptide
DEEEINTTNPVAYEQWGSVSCTNLSQRNGTNNR

SEQ ID NO: 42797 - protein, 32 aa, Artificial Sequence
  Description of Artificial Sequence: Synthetic polypeptide
DEEEIKTTNPVAYEAYGSVSTNALSQDGENRM

SEQ ID NO: 42798 - protein, 33 aa, Artificial Sequence
  Description of Artificial Sequence: Synthetic polypeptide
DEEEINTTNPVATEWYGSVSTSNSLFQVRGENF

SEQ ID NO: 42799 - protein, 31 aa, Artificial Sequence
  Description of Artificial Sequence: Synthetic polypeptide
DEEEIKTTNPVAYEAYGVTVSCTNLSQRGNS

SEQ ID NO: 42800 - protein, 31 aa, Artificial Sequence
  Description of Artificial Sequence: Synthetic polypeptide
DEEEIRTTNPVATEQYGSVSFNNNVSIGNEE

SEQ ID NO: 42801 - protein, 31 aa, Artificial Sequence
  Description of Artificial Sequence: Synthetic polypeptide
DEEEIRATNPVAYEQYGSVSANNDDRGSNSR

SEQ ID NO: 42802 - protein, 30 aa, Artificial Sequence
  Description of Artificial Sequence: Synthetic polypeptide
DEEEIKTTNPAATEQYGSVPTNLIHGGNGD

SEQ ID NO: 42803 - protein, 32 aa, Artificial Sequence
  Description of Artificial Sequence: Synthetic polypeptide
DEEEIRTTNPVATEQYGSNVSTVNLTENNSDN

SEQ ID NO: 42804 - protein, 32 aa, Artificial Sequence
  Description of Artificial Sequence: Synthetic polypeptide
DEEEIRATNPVATEQYGSVCAANLQDSDGNDR

SEQ ID NO: 42805 - protein, 33 aa, Artificial Sequence
  Description of Artificial Sequence: Synthetic polypeptide
DEEEIGTTNPVATEQYGSVSTDNQGQERMGNAS

SEQ ID NO: 42806 - protein, 29 aa, Artificial Sequence
  Description of Artificial Sequence: Synthetic peptide
DEEEIRATNPVATEQYGSVCAAEDQQGDR

SEQ ID NO: 42807 - protein, 30 aa, Artificial Sequence
  Description of Artificial Sequence: Synthetic polypeptide
DEEEIRATNPVATEQYGSVAVNWDEGSNSR

SEQ ID NO: 42808 - protein, 30 aa, Artificial Sequence
  Description of Artificial Sequence: Synthetic polypeptide
DEECIRTTNPVAYEQYGCVSTGNDQHGNQA

SEQ ID NO: 42809 - protein, 31 aa, Artificial Sequence
  Description of Artificial Sequence: Synthetic polypeptide
DEEEIRATNPVATEQYGSVATNLQQAGPEAD

SEQ ID NO: 42810 - protein, 33 aa, Artificial Sequence
  Description of Artificial Sequence: Synthetic polypeptide
DEEEIGTTNPVATEQYGSVSTENQYQERMGNEL

SEQ ID NO: 42811 - protein, 31 aa, Artificial Sequence
  Description of Artificial Sequence: Synthetic polypeptide
DEEEIGTTNPVATEQYGSVSTGATMLGSNFR

SEQ ID NO: 42812 - protein, 32 aa, Artificial Sequence
  Description of Artificial Sequence: Synthetic polypeptide
DEEEIGTTNPVATEQYGSVSTGDQLQENMGNL

SEQ ID NO: 42813 - protein, 29 aa, Artificial Sequence
  Description of Artificial Sequence: Synthetic peptide
DEECIRTTNPVAYEQYGCVSTGEDQNGNQ

SEQ ID NO: 42814 - protein, 33 aa, Artificial Sequence
  Description of Artificial Sequence: Synthetic polypeptide
DEEEIGTTNPVATEQYGSVSTGNQLGERMGNLQ

SEQ ID NO: 42815 - protein, 31 aa, Artificial Sequence
  Description of Artificial Sequence: Synthetic polypeptide
DEEEIRTTNPVATEQYGSVSFTVLSNGEDPG

SEQ ID NO: 42816 - protein, 30 aa, Artificial Sequence
  Description of Artificial Sequence: Synthetic polypeptide
DEECIRTTNPVAYEQYGCVSTENDQNGNQG

SEQ ID NO: 42817 - protein, 31 aa, Artificial Sequence
  Description of Artificial Sequence: Synthetic polypeptide
DEEEIRATNPVATEQYGSVATNLQDGGPEQD

SEQ ID NO: 42818 - protein, 31 aa, Artificial Sequence
  Description of Artificial Sequence: Synthetic polypeptide
DEEEIGTTNPVATEQYGSVSTGQPVRTGNNE

SEQ ID NO: 42819 - protein, 31 aa, Artificial Sequence
  Description of Artificial Sequence: Synthetic polypeptide
DEEEIGTTNPVATEQYGSVSPNQLQEQMQNL

SEQ ID NO: 42820 - protein, 32 aa, Artificial Sequence
  Description of Artificial Sequence: Synthetic polypeptide
DEEEIRTTNPVATEQYGSVSEWLNQRMLIERP

SEQ ID NO: 42821 - protein, 32 aa, Artificial Sequence
  Description of Artificial Sequence: Synthetic polypeptide
DEEEIGTTNPVATEQYGSVSNTSLVGIAAGNR

SEQ ID NO: 42822 - protein, 32 aa, Artificial Sequence
  Description of Artificial Sequence: Synthetic polypeptide
DEEEIGTTNPVATEQYGSVSMWNQEQERMGNL

SEQ ID NO: 42823 - protein, 32 aa, Artificial Sequence
  Description of Artificial Sequence: Synthetic polypeptide
DEEEIRTTNPVATEQYGSCTSCTPLQNEENNR

SEQ ID NO: 42824 - protein, 32 aa, Artificial Sequence
  Description of Artificial Sequence: Synthetic polypeptide
DEEEIGTTNPVATEQYGSVCSTNLQNSGSEQS

SEQ ID NO: 42825 - protein, 30 aa, Artificial Sequence
  Description of Artificial Sequence: Synthetic polypeptide
DEECIRTTNPVAYEQYGCVSTINHQNGNQN

SEQ ID NO: 42826 - protein, 33 aa, Artificial Sequence
  Description of Artificial Sequence: Synthetic polypeptide
DEEEIRTTNPVATEQYGSCTSLTNLQLIGENQV

SEQ ID NO: 42827 - protein, 32 aa, Artificial Sequence
  Description of Artificial Sequence: Synthetic polypeptide
DEEEIRATNPVATEQYGSVCATNLERGENGTL

SEQ ID NO: 42828 - protein, 31 aa, Artificial Sequence
  Description of Artificial Sequence: Synthetic polypeptide
DEEEIRATNPVATEQYGSVCATNLERDENEA

SEQ ID NO: 42829 - protein, 33 aa, Artificial Sequence
  Description of Artificial Sequence: Synthetic polypeptide
DEEEIGTTNPVATEQYGSVCSTNNLQNFGSNAP

SEQ ID NO: 42830 - protein, 32 aa, Artificial Sequence
  Description of Artificial Sequence: Synthetic polypeptide
DEEEIRATNPVATEQYGSVCAATNEQDRGNEQ

SEQ ID NO: 42831 - protein, 34 aa, Artificial Sequence
  Description of Artificial Sequence: Synthetic polypeptide
DEEEIGTTNPVATEQYGSVPSTNELSQERTGGNL

SEQ ID NO: 42832 - protein, 34 aa, Artificial Sequence
  Description of Artificial Sequence: Synthetic polypeptide
DEEEIRTTNPVATEQYGSQVSTNNQLAHLGSNRA

SEQ ID NO: 42833 - protein, 32 aa, Artificial Sequence
  Description of Artificial Sequence: Synthetic polypeptide
DEEEIGTTNPVATEQYGSVSALNQLQERMGEL

SEQ ID NO: 42834 - protein, 32 aa, Artificial Sequence
  Description of Artificial Sequence: Synthetic polypeptide
DEEEIRTTNPVATEQYGSCWTFVLQNRQGNHI

SEQ ID NO: 42835 - protein, 30 aa, Artificial Sequence
  Description of Artificial Sequence: Synthetic polypeptide
DEEEIRTTNPVATEQYGSCYNTNDERGDVD

SEQ ID NO: 42836 - protein, 32 aa, Artificial Sequence
  Description of Artificial Sequence: Synthetic polypeptide
DEEEIRTTNPVATEQYGSCYSENLQMGENENE

SEQ ID NO: 42837 - protein, 33 aa, Artificial Sequence
  Description of Artificial Sequence: Synthetic polypeptide
DEEEIRTTNPVATEQYGSCYSLTNLQIGEAENE

SEQ ID NO: 42838 - protein, 31 aa, Artificial Sequence
  Description of Artificial Sequence: Synthetic polypeptide
DEEEIRTTNPVATEQYGSCYSTTDERGTDRI

SEQ ID NO: 42839 - protein, 33 aa, Artificial Sequence
  Description of Artificial Sequence: Synthetic polypeptide
DEEEIRATNPVATEQYGCVCSMTNLFQGMGNRS

SEQ ID NO: 42840 - protein, 32 aa, Artificial Sequence
  Description of Artificial Sequence: Synthetic polypeptide
DEEEIGTTNPVATEQYGSVSTMNQGQERMGDL

SEQ ID NO: 42841 - protein, 33 aa, Artificial Sequence
  Description of Artificial Sequence: Synthetic polypeptide
DEEEIGTTNPVATEQYGSVSTNDLQERMGSELG

SEQ ID NO: 42842 - protein, 30 aa, Artificial Sequence
  Description of Artificial Sequence: Synthetic polypeptide
DEEEIRATNPVATEQYGMVSMTNGFQGGDN

SEQ ID NO: 42843 - protein, 33 aa, Artificial Sequence
  Description of Artificial Sequence: Synthetic polypeptide
DEEEIGTTNPVAYEAYGSVSTNALSQRTGENRP

SEQ ID NO: 42844 - protein, 34 aa, Artificial Sequence
  Description of Artificial Sequence: Synthetic polypeptide
DEEEIRTTNPVATEQYGSQTSMTDNLQSEGENQR

SEQ ID NO: 42845 - protein, 31 aa, Artificial Sequence
  Description of Artificial Sequence: Synthetic polypeptide
DEEEIRTTNPVATEQYGSQSTYSLGQSGDTS

SEQ ID NO: 42846 - protein, 32 aa, Artificial Sequence
  Description of Artificial Sequence: Synthetic polypeptide
DEEEIRTTNPVATEQYGSQSTTNLQTGEEEMI

SEQ ID NO: 42847 - protein, 30 aa, Artificial Sequence
  Description of Artificial Sequence: Synthetic polypeptide
DEEEIRTTNPVATEQYGSVSFHDEQRSEDG

SEQ ID NO: 42848 - protein, 32 aa, Artificial Sequence
  Description of Artificial Sequence: Synthetic polypeptide
DEEEIGTTNPVAYEQYGSTVPSITNNLQAQNR

SEQ ID NO: 42849 - protein, 30 aa, Artificial Sequence
  Description of Artificial Sequence: Synthetic polypeptide
DEEEIRATNPVATEQYGFVGMTNLFQGGQE

SEQ ID NO: 42850 - protein, 33 aa, Artificial Sequence
  Description of Artificial Sequence: Synthetic polypeptide
DEEEIGTTNPVAYEQYGSVSTNELSQERTGGND

SEQ ID NO: 42851 - protein, 32 aa, Artificial Sequence
  Description of Artificial Sequence: Synthetic polypeptide
DEEEIRTTNPVATEQYGSFVSTSNPLNVHGEL

SEQ ID NO: 42852 - protein, 32 aa, Artificial Sequence
  Description of Artificial Sequence: Synthetic polypeptide
DEEEIRTTNPVATEQYGSFVSYNLNQNNGEQD

SEQ ID NO: 42853 - protein, 32 aa, Artificial Sequence
  Description of Artificial Sequence: Synthetic polypeptide
DEEEIRATNPVATEQYGDVSITNLFQGGGNGQ

SEQ ID NO: 42854 - protein, 35 aa, Artificial Sequence
  Description of Artificial Sequence: Synthetic polypeptide
DEEEIRTTNPVATEQYGSFYSPTNVLSQREGNVER

SEQ ID NO: 42855 - protein, 31 aa, Artificial Sequence
  Description of Artificial Sequence: Synthetic polypeptide
DEEEIRATNPVATEQYGCVSTNVEQAGKDRM

SEQ ID NO: 42856 - protein, 31 aa, Artificial Sequence
  Description of Artificial Sequence: Synthetic polypeptide
DEEEIRATNPVATEQYGCVSMTNDFQGISNR

SEQ ID NO: 42857 - protein, 31 aa, Artificial Sequence
  Description of Artificial Sequence: Synthetic polypeptide
DEEEIRATNPVATEQYGMVSMTNGFQGGNEA

SEQ ID NO: 42858 - protein, 32 aa, Artificial Sequence
  Description of Artificial Sequence: Synthetic polypeptide
DEEEIRATNPVATEQYGSVATNLERPGPDPRT

SEQ ID NO: 42859 - protein, 32 aa, Artificial Sequence
  Description of Artificial Sequence: Synthetic polypeptide
DEEEIRATNPVATEQYGNVSGTNVLVQGINRI

SEQ ID NO: 42860 - protein, 31 aa, Artificial Sequence
  Description of Artificial Sequence: Synthetic polypeptide
DEEEIRATNPVATEQYGNVSMTNEVQVENNR

SEQ ID NO: 42861 - protein, 33 aa, Artificial Sequence
  Description of Artificial Sequence: Synthetic polypeptide
DEEEIRTTNPVATEQYGSVSEYMDLNQRGEDDR

SEQ ID NO: 42862 - protein, 32 aa, Artificial Sequence
  Description of Artificial Sequence: Synthetic polypeptide
DEEEIGTTNPVATEQYGSVSTNLLQEKMENQE

SEQ ID NO: 42863 - protein, 30 aa, Artificial Sequence
  Description of Artificial Sequence: Synthetic polypeptide
DEEEIRATNPVATEQYGSVATNLDDGDTLI

SEQ ID NO: 42864 - protein, 30 aa, Artificial Sequence
  Description of Artificial Sequence: Synthetic polypeptide
DEEEIRATNPVATEQYGSVATNDERNNPEQ

SEQ ID NO: 42865 - protein, 32 aa, Artificial Sequence
  Description of Artificial Sequence: Synthetic polypeptide
DEEEIRTTNPVATEQYGSFSSETFTLGNVGNR

SEQ ID NO: 42866 - protein, 32 aa, Artificial Sequence
  Description of Artificial Sequence: Synthetic polypeptide
DEEEIRTTNPVATEQYGSFSTVLQRVTEEERS

SEQ ID NO: 42867 - protein, 32 aa, Artificial Sequence
  Description of Artificial Sequence: Synthetic polypeptide
DEEEIRTTNPVATEQYGSFVCITTDQCGNQPR

SEQ ID NO: 42868 - protein, 33 aa, Artificial Sequence
  Description of Artificial Sequence: Synthetic polypeptide
DEEEIRTTNPVATEQYGSFVNSTNFEQNSGENS

SEQ ID NO: 42869 - protein, 33 aa, Artificial Sequence
  Description of Artificial Sequence: Synthetic polypeptide
DEEEIGTTNPVATEQYGSVSTPNQGQERMGNTD

SEQ ID NO: 42870 - protein, 33 aa, Artificial Sequence
  Description of Artificial Sequence: Synthetic polypeptide
DEEEIGTTNPVATEQYGSVSTTNQQQERMGNLF

SEQ ID NO: 42871 - protein, 33 aa, Artificial Sequence
  Description of Artificial Sequence: Synthetic polypeptide
DEEEIRATNPVATEQYGQVSCTNLSQGNGGNNR

SEQ ID NO: 42872 - protein, 31 aa, Artificial Sequence
  Description of Artificial Sequence: Synthetic polypeptide
DEEEIRATNPVATEQYGNVSMTVLFQVGNQE

SEQ ID NO: 42873 - protein, 31 aa, Artificial Sequence
  Description of Artificial Sequence: Synthetic polypeptide
DEEEIRATNPVATEQYGNVSMTNQGQQQQNR

SEQ ID NO: 42874 - protein, 31 aa, Artificial Sequence
  Description of Artificial Sequence: Synthetic polypeptide
DEEEIRATNPVATEQYGNVSMTNQFLQQNER

SEQ ID NO: 42875 - protein, 31 aa, Artificial Sequence
  Description of Artificial Sequence: Synthetic polypeptide
DEEEIRTTNPVATEQYGSQVSGNEETRGVLD

SEQ ID NO: 42876 - protein, 32 aa, Artificial Sequence
  Description of Artificial Sequence: Synthetic polypeptide
DEEEIGTTNPVATEYYGSVWTGNLEQRNGNLT

SEQ ID NO: 42877 - protein, 34 aa, Artificial Sequence
  Description of Artificial Sequence: Synthetic polypeptide
DEEEIRTTNPCATEQYGSVHCTNALSDQRPGNNR

SEQ ID NO: 42878 - protein, 30 aa, Artificial Sequence
  Description of Artificial Sequence: Synthetic polypeptide
DEEEICTTNPVATESYGSVSTVNHQCGEVP

SEQ ID NO: 42879 - protein, 31 aa, Artificial Sequence
  Description of Artificial Sequence: Synthetic polypeptide
DEEEIRTTNPVATEQYGSCSSPNMLQEDNDT

SEQ ID NO: 42880 - protein, 31 aa, Artificial Sequence
  Description of Artificial Sequence: Synthetic polypeptide
DEEEICTTNPVATECYGSVSTGNDQNMGGDR

SEQ ID NO: 42881 - protein, 34 aa, Artificial Sequence
  Description of Artificial Sequence: Synthetic polypeptide
DEEEIRTTNPVATEQYGQSVSVSGNLSQRVGNNI

SEQ ID NO: 42882 - protein, 32 aa, Artificial Sequence
  Description of Artificial Sequence: Synthetic polypeptide
DEEEIRTTNPVATEQYGQSVSWELQNFGSERQ

SEQ ID NO: 42883 - protein, 31 aa, Artificial Sequence
  Description of Artificial Sequence: Synthetic polypeptide
DEEEIRTTNPVATEQYGSVANTNQEQELVND

SEQ ID NO: 42884 - protein, 31 aa, Artificial Sequence
  Description of Artificial Sequence: Synthetic polypeptide
DEEEIRTTNPVATEQYGSVANTMGLQNTVNL

SEQ ID NO: 42885 - protein, 32 aa, Artificial Sequence
  Description of Artificial Sequence: Synthetic polypeptide
DEEEIRTTNPVATEQYGSVANTGNLDTGAATR

SEQ ID NO: 42886 - protein, 32 aa, Artificial Sequence
  Description of Artificial Sequence: Synthetic polypeptide
DEEEIRTTNPVATEQYGSVSETGLQFGMTDVD

SEQ ID NO: 42887 - protein, 32 aa, Artificial Sequence
  Description of Artificial Sequence: Synthetic polypeptide
DEEEIRTTNPVATEQYGSVANTFNLDGGGGTR

SEQ ID NO: 42888 - protein, 29 aa, Artificial Sequence
  Description of Artificial Sequence: Synthetic peptide
DEEEIRCTNPVSTEPYGTISMNIQQRGNR

SEQ ID NO: 42889 - protein, 31 aa, Artificial Sequence
  Description of Artificial Sequence: Synthetic polypeptide
DEEEIRTTNPVATEQYGQVSFTNDNEGTNFI

SEQ ID NO: 42890 - protein, 31 aa, Artificial Sequence
  Description of Artificial Sequence: Synthetic polypeptide
DEEEICTTNPVATECYGSVSTGNGQGGDNND

SEQ ID NO: 42891 - protein, 32 aa, Artificial Sequence
  Description of Artificial Sequence: Synthetic polypeptide
DEEEIRTTNPVATEQYGSVSETGNMITRGELI

SEQ ID NO: 42892 - protein, 29 aa, Artificial Sequence
  Description of Artificial Sequence: Synthetic peptide
DEEEIRTTNPVATEQYGSVAIPLQNMEEM

SEQ ID NO: 42893 - protein, 30 aa, Artificial Sequence
  Description of Artificial Sequence: Synthetic polypeptide
DEEEIRTTNPVATEQYGSVAGTQDMDGNTN

SEQ ID NO: 42894 - protein, 32 aa, Artificial Sequence
  Description of Artificial Sequence: Synthetic polypeptide
DEEEIRTTNPVATEQYGSVSETGNLIRSTVIN

SEQ ID NO: 42895 - protein, 33 aa, Artificial Sequence
  Description of Artificial Sequence: Synthetic polypeptide
DEEEIRTTNPVATEQYGSVSETGLEQRQMQVRE

SEQ ID NO: 42896 - protein, 30 aa, Artificial Sequence
  Description of Artificial Sequence: Synthetic polypeptide
DEEEIRTTNPVATEQYGSVAPNDQGSENYD

SEQ ID NO: 42897 - protein, 33 aa, Artificial Sequence
  Description of Artificial Sequence: Synthetic polypeptide
DEEEIRTTNPVATEQYGQSVSTNLQGFGSETQA

SEQ ID NO: 42898 - protein, 32 aa, Artificial Sequence
  Description of Artificial Sequence: Synthetic polypeptide
DEEEIRTTNPVATEQYGQSVCSWNDQHFGSND

SEQ ID NO: 42899 - protein, 31 aa, Artificial Sequence
  Description of Artificial Sequence: Synthetic polypeptide
DEEEIRGTNPVATEQWGSVVSTLLIRGGNEG

SEQ ID NO: 42900 - protein, 32 aa, Artificial Sequence
  Description of Artificial Sequence: Synthetic polypeptide
DEEEIRTTNPVATEQYGQSVPAVNPIQSEGNR

SEQ ID NO: 42901 - protein, 33 aa, Artificial Sequence
  Description of Artificial Sequence: Synthetic polypeptide
DEEEIRTTNPVATEQYGQSVSMTEELQNGSNQV

SEQ ID NO: 42902 - protein, 33 aa, Artificial Sequence
  Description of Artificial Sequence: Synthetic polypeptide
DEEEIRTTNPVATEQYGQSVSNPNEQSQYGLNR

SEQ ID NO: 42903 - protein, 32 aa, Artificial Sequence
  Description of Artificial Sequence: Synthetic polypeptide
DEEEIRTTNPVATEQYGQSVSTEHQNGGSNQF

SEQ ID NO: 42904 - protein, 31 aa, Artificial Sequence
  Description of Artificial Sequence: Synthetic polypeptide
DEEEICTTNPVATEAYGSVNCTNLSQAGSNF

SEQ ID NO: 42905 - protein, 33 aa, Artificial Sequence
  Description of Artificial Sequence: Synthetic polypeptide
DEEEICTTNPVATEAYGSVSTGNLSARGGNNRN

SEQ ID NO: 42906 - protein, 32 aa, Artificial Sequence
  Description of Artificial Sequence: Synthetic polypeptide
DEEEIRTTNPVATEQYGSVASPNLQENTSNDI

SEQ ID NO: 42907 - protein, 29 aa, Artificial Sequence
  Description of Artificial Sequence: Synthetic peptide
DEEEIRTTNPVATEQYGSVASGLERSELI

SEQ ID NO: 42908 - protein, 32 aa, Artificial Sequence
  Description of Artificial Sequence: Synthetic polypeptide
DEEEIRTTNPVATEQYGSVAQTNLQQPVNQMG

SEQ ID NO: 42909 - protein, 32 aa, Artificial Sequence
  Description of Artificial Sequence: Synthetic polypeptide
DEEEIRTTNPVATEQYGQSVSTNHQGSGSDQP

SEQ ID NO: 42910 - protein, 34 aa, Artificial Sequence
  Description of Artificial Sequence: Synthetic polypeptide
DEEEIRTTNPVATEQYGSVSETENLQMRQPVNDE

SEQ ID NO: 42911 - protein, 31 aa, Artificial Sequence
  Description of Artificial Sequence: Synthetic polypeptide
DEEEIRTTNPVATEQYGSVAPTMGLQNTNNL

SEQ ID NO: 42912 - protein, 33 aa, Artificial Sequence
  Description of Artificial Sequence: Synthetic polypeptide
DEEEIRTTNPVATEQYGQSVSTNLQFFNSNNQD

SEQ ID NO: 42913 - protein, 31 aa, Artificial Sequence
  Description of Artificial Sequence: Synthetic polypeptide
DEEEICTTNPVATECYGSVSTNDGNQGGDSR

SEQ ID NO: 42914 - protein, 32 aa, Artificial Sequence
  Description of Artificial Sequence: Synthetic polypeptide
DEEEIRTTNPVATEQYGSVAETSMLAQTAGND

SEQ ID NO: 42915 - protein, 35 aa, Artificial Sequence
  Description of Artificial Sequence: Synthetic polypeptide
DEEEIRTTNPVATEQYGSVSETGNSLDQRIGNIMQ

SEQ ID NO: 42916 - protein, 31 aa, Artificial Sequence
  Description of Artificial Sequence: Synthetic polypeptide
DEEEIRTTNPVATEQYGQVSTTWGQRNTLNT

SEQ ID NO: 42917 - protein, 32 aa, Artificial Sequence
  Description of Artificial Sequence: Synthetic polypeptide
DEEEIRCTNPVATEQYGSVSSTENGNRNGNPV

SEQ ID NO: 42918 - protein, 33 aa, Artificial Sequence
  Description of Artificial Sequence: Synthetic polypeptide
DEEEIRCTNPVATEQYGSVSSTALMMRNGMNPR

SEQ ID NO: 42919 - protein, 33 aa, Artificial Sequence
  Description of Artificial Sequence: Synthetic polypeptide
DEEEIRTTNPVATEQYGSVSETNGLDQRPSETV

SEQ ID NO: 42920 - protein, 31 aa, Artificial Sequence
  Description of Artificial Sequence: Synthetic polypeptide
DEEEIRCTNPVATEQYGSVSSNEDRFGSNSQ

SEQ ID NO: 42921 - protein, 32 aa, Artificial Sequence
  Description of Artificial Sequence: Synthetic polypeptide
DEEEICTTNPVATEQYGEVSTGNNQNGGENER

SEQ ID NO: 42922 - protein, 30 aa, Artificial Sequence
  Description of Artificial Sequence: Synthetic polypeptide
DEEEIRCTNPVATEQYGSVSSNEDNGSNTQ

SEQ ID NO: 42923 - protein, 31 aa, Artificial Sequence
  Description of Artificial Sequence: Synthetic polypeptide
DEEEIRTTNPVATEQYGSAFTGNLQVNILDR

SEQ ID NO: 42924 - protein, 32 aa, Artificial Sequence
  Description of Artificial Sequence: Synthetic polypeptide
DEEEIRTTNPVATEQYGSAGDTQNLQGNGNPD

SEQ ID NO: 42925 - protein, 31 aa, Artificial Sequence
  Description of Artificial Sequence: Synthetic polypeptide
DEEEIRTTNPVATEQYGSAHHTNLVRINELT

SEQ ID NO: 42926 - protein, 30 aa, Artificial Sequence
  Description of Artificial Sequence: Synthetic polypeptide
DEEEIRCTNPVATEQYGSVSGNQDGGENST

SEQ ID NO: 42927 - protein, 32 aa, Artificial Sequence
  Description of Artificial Sequence: Synthetic polypeptide
DEEEIRTTNPVATEQYGSAITTNLEQPENERE

SEQ ID NO: 42928 - protein, 31 aa, Artificial Sequence
  Description of Artificial Sequence: Synthetic polypeptide
DEEEICTTNPVATEQYGKVSCINGSQRGGNP

SEQ ID NO: 42929 - protein, 29 aa, Artificial Sequence
  Description of Artificial Sequence: Synthetic peptide
DEEEIRCTNPVATEQYGSVSEILMAAEDR

SEQ ID NO: 42930 - protein, 31 aa, Artificial Sequence
  Description of Artificial Sequence: Synthetic polypeptide
DEEEIRTTNPVATEQYGSVAANLQDAGPPDE

SEQ ID NO: 42931 - protein, 32 aa, Artificial Sequence
  Description of Artificial Sequence: Synthetic polypeptide
DEEEIRCTNPVATEQYGSVSCNEPQDREGENG

SEQ ID NO: 42932 - protein, 32 aa, Artificial Sequence
  Description of Artificial Sequence: Synthetic polypeptide
DEEEIRTTNPVATEQYGSAEPTTNLNQTGNEL

SEQ ID NO: 42933 - protein, 32 aa, Artificial Sequence
  Description of Artificial Sequence: Synthetic polypeptide
DEEEIRTTNPVATEQYGSVASTGNGDGNGNTQ

SEQ ID NO: 42934 - protein, 32 aa, Artificial Sequence
  Description of Artificial Sequence: Synthetic polypeptide
DEEEIRCTNPVATEQYGSVSSTPALMMRGMNV

SEQ ID NO: 42935 - protein, 32 aa, Artificial Sequence
  Description of Artificial Sequence: Synthetic polypeptide
DEEEIRTTNPVATEQYGSACTNLQQRPMNLLD

SEQ ID NO: 42936 - protein, 33 aa, Artificial Sequence
  Description of Artificial Sequence: Synthetic polypeptide
DEEEIRTTNPVATEQYGSVAEPTGNLQPDVNRQ

SEQ ID NO: 42937 - protein, 31 aa, Artificial Sequence
  Description of Artificial Sequence: Synthetic polypeptide
DEEEIRTTNPVATEQYGSVADTWLPQDSQGR

SEQ ID NO: 42938 - protein, 32 aa, Artificial Sequence
  Description of Artificial Sequence: Synthetic polypeptide
DEEEIRTTNPVATEQYGSVADTWELAQPSENR

SEQ ID NO: 42939 - protein, 29 aa, Artificial Sequence
  Description of Artificial Sequence: Synthetic peptide
DEEEICTTNPVATEGYGSVSTNNEMNPNL

SEQ ID NO: 42940 - protein, 32 aa, Artificial Sequence
  Description of Artificial Sequence: Synthetic polypeptide
DEEEIRTTNPVATEQYGSVACTPLSQRTVTSR

SEQ ID NO: 42941 - protein, 33 aa, Artificial Sequence
  Description of Artificial Sequence: Synthetic polypeptide
DEEEIRTTNPVATEQYGSVACTPLSQGTGLNNR

SEQ ID NO: 42942 - protein, 32 aa, Artificial Sequence
  Description of Artificial Sequence: Synthetic polypeptide
DEEEIRTTNPVATEQYGQVVCSNTNLQSGSDQ

SEQ ID NO: 42943 - protein, 32 aa, Artificial Sequence
  Description of Artificial Sequence: Synthetic polypeptide
DEEEIRTTNPVATEQYGQVVCSTELQGNSNRM

SEQ ID NO: 42944 - protein, 30 aa, Artificial Sequence
  Description of Artificial Sequence: Synthetic polypeptide
DEEEIRCTNPVATEQYGSVSWNPDNGSDNQ

SEQ ID NO: 42945 - protein, 29 aa, Artificial Sequence
  Description of Artificial Sequence: Synthetic peptide
DEEEIRTTNPVATEQYGQVVINLSNEGTV

SEQ ID NO: 42946 - protein, 32 aa, Artificial Sequence
  Description of Artificial Sequence: Synthetic polypeptide
DEEEIRCTNPVATEQYGSVSVTSLQDNGTVRF

SEQ ID NO: 42947 - protein, 30 aa, Artificial Sequence
  Description of Artificial Sequence: Synthetic polypeptide
DEEEIRCTNPVATEQYGSVSVNQDIGSNQD

SEQ ID NO: 42948 - protein, 34 aa, Artificial Sequence
  Description of Artificial Sequence: Synthetic polypeptide
DEEEIRTTNPVATEQYGSVACTHALGDQREGNRD

SEQ ID NO: 42949 - protein, 31 aa, Artificial Sequence
  Description of Artificial Sequence: Synthetic polypeptide
DEEEIRTTNPVATEQYGSVACFMLQRLENPL

SEQ ID NO: 42950 - protein, 32 aa, Artificial Sequence
  Description of Artificial Sequence: Synthetic polypeptide
DEEEIRTTNPVATEQYGSACFTYNLQDDGNDI

SEQ ID NO: 42951 - protein, 32 aa, Artificial Sequence
  Description of Artificial Sequence: Synthetic polypeptide
DEEEIRTTNPVATEQYGSAEPTNLEQNRMGMV

SEQ ID NO: 42952 - protein, 32 aa, Artificial Sequence
  Description of Artificial Sequence: Synthetic polypeptide
DEEEIRTTNPVATEQYGQSVCSTNLQHNSEQL

SEQ ID NO: 42953 - protein, 33 aa, Artificial Sequence
  Description of Artificial Sequence: Synthetic polypeptide
DEEEICTTNPTATEQYGSVPTNLVQPRQGQNGR

SEQ ID NO: 42954 - protein, 30 aa, Artificial Sequence
  Description of Artificial Sequence: Synthetic polypeptide
DEEEICTTNPQATEQYGSVPTVLQHRGEGQ

SEQ ID NO: 42955 - protein, 32 aa, Artificial Sequence
  Description of Artificial Sequence: Synthetic polypeptide
DEEEIRTTNPVATEQYGQCVSSNLQNSGSNQG

SEQ ID NO: 42956 - protein, 31 aa, Artificial Sequence
  Description of Artificial Sequence: Synthetic polypeptide
DEEEIRTTNPVATEQYGQCVSTEHQNFGNQM

SEQ ID NO: 42957 - protein, 31 aa, Artificial Sequence
  Description of Artificial Sequence: Synthetic polypeptide
DEEEIRTTNPVATEQYGQCVSTEHQRGSDQG

SEQ ID NO: 42958 - protein, 30 aa, Artificial Sequence
  Description of Artificial Sequence: Synthetic polypeptide
DEEEIRGTNPVATEQYGSVSVNQDRGSLSP

SEQ ID NO: 42959 - protein, 33 aa, Artificial Sequence
  Description of Artificial Sequence: Synthetic polypeptide
DEEEICTTNPCATEQYGSVVPTNLSQHRGGNNR

SEQ ID NO: 42960 - protein, 30 aa, Artificial Sequence
  Description of Artificial Sequence: Synthetic polypeptide
DEEEIRGTNPVATEQYGSVSVNDDRGSLIE

SEQ ID NO: 42961 - protein, 31 aa, Artificial Sequence
  Description of Artificial Sequence: Synthetic polypeptide
DEEEICTTNPCATEQYGVVPTNLQHDGGNGR

SEQ ID NO: 42962 - protein, 32 aa, Artificial Sequence
  Description of Artificial Sequence: Synthetic polypeptide
DEEEIRTTNPVATEQYGQCVSTELQENGSNQG

SEQ ID NO: 42963 - protein, 31 aa, Artificial Sequence
  Description of Artificial Sequence: Synthetic polypeptide
DEEEIRTTNPVATEQYGSVATDLIREVENTS

SEQ ID NO: 42964 - protein, 31 aa, Artificial Sequence
  Description of Artificial Sequence: Synthetic polypeptide
DEEEIRTTNPVATEQYGQCVSTELQNSGEQP

SEQ ID NO: 42965 - protein, 28 aa, Artificial Sequence
  Description of Artificial Sequence: Synthetic peptide
DEEEICTTNPEATAQYGQVPTDLQDGNA

SEQ ID NO: 42966 - protein, 31 aa, Artificial Sequence
  Description of Artificial Sequence: Synthetic polypeptide
DEEEIRTTNPVATEQYGQCVSTETQGGSNQM

SEQ ID NO: 42967 - protein, 33 aa, Artificial Sequence
  Description of Artificial Sequence: Synthetic polypeptide
DEEEIRTTNPVATEQYGQCVSTGNTQNFGSNRT

SEQ ID NO: 42968 - protein, 33 aa, Artificial Sequence
  Description of Artificial Sequence: Synthetic polypeptide
DEEEIRTTNPVATEQYGQCVSTMNLQNFGSNQG

SEQ ID NO: 42969 - protein, 32 aa, Artificial Sequence
  Description of Artificial Sequence: Synthetic polypeptide
DEEEICTTNPEATEQYGSVCPTNLQERGNTQA

SEQ ID NO: 42970 - protein, 31 aa, Artificial Sequence
  Description of Artificial Sequence: Synthetic polypeptide
DEEEIRGTNPVATEQYGSVSVVQDRGNESRN

SEQ ID NO: 42971 - protein, 31 aa, Artificial Sequence
  Description of Artificial Sequence: Synthetic polypeptide
DEEEIRTTNPVATEQYGSVSEQNNLVTGEEE

SEQ ID NO: 42972 - protein, 31 aa, Artificial Sequence
  Description of Artificial Sequence: Synthetic polypeptide
DEEEIRTTNPVATEQYGSVSEPVLQNLVNDL

SEQ ID NO: 42973 - protein, 31 aa, Artificial Sequence
  Description of Artificial Sequence: Synthetic polypeptide
DEEEICTTNPCATEQYGSVPTNLQENGNGQS

SEQ ID NO: 42974 - protein, 32 aa, Artificial Sequence
  Description of Artificial Sequence: Synthetic polypeptide
DEEEIRTTNPVATEQYGQCVCSTNLQNGSDQN

SEQ ID NO: 42975 - protein, 31 aa, Artificial Sequence
  Description of Artificial Sequence: Synthetic polypeptide
DEECISTTNPVATECYGSVNTNELQRGGNNM

SEQ ID NO: 42976 - protein, 31 aa, Artificial Sequence
  Description of Artificial Sequence: Synthetic polypeptide
DEECISTTNPVATECYGSVCNTNELQRGSNA

SEQ ID NO: 42977 - protein, 32 aa, Artificial Sequence
  Description of Artificial Sequence: Synthetic polypeptide
DEEEIRTTNPVATEQYGQCVCSTNLQNGSEII

SEQ ID NO: 42978 - protein, 32 aa, Artificial Sequence
  Description of Artificial Sequence: Synthetic polypeptide
DEEEIRTTNPVATEQYGQCVCSTNLQSFGSDQ

SEQ ID NO: 42979 - protein, 30 aa, Artificial Sequence
  Description of Artificial Sequence: Synthetic polypeptide
DEEEICTTNPAATEQYGSVPVNLTVRGEGR

SEQ ID NO: 42980 - protein, 31 aa, Artificial Sequence
  Description of Artificial Sequence: Synthetic polypeptide
DEEEIRGTNPVATEQYGSVVDETNSQIDNSR

SEQ ID NO: 42981 - protein, 33 aa, Artificial Sequence
  Description of Artificial Sequence: Synthetic polypeptide
DEEEIRTTNPVATEQYGQCVCSTNPLQFGSNQA

SEQ ID NO: 42982 - protein, 33 aa, Artificial Sequence
  Description of Artificial Sequence: Synthetic polypeptide
DEEEIRTTNPVATEQYGQCVCSTNPQRMGSNQL

SEQ ID NO: 42983 - protein, 32 aa, Artificial Sequence
  Description of Artificial Sequence: Synthetic polypeptide
DEEEIRTTNPVATEQYGQCVCSTVLQNGSNNQ

SEQ ID NO: 42984 - protein, 31 aa, Artificial Sequence
  Description of Artificial Sequence: Synthetic polypeptide
DEEEICTTNPCATEQYGCVPTNLQERGNNQS

SEQ ID NO: 42985 - protein, 32 aa, Artificial Sequence
  Description of Artificial Sequence: Synthetic polypeptide
DEEEIRTTNPVATEQYGQCVCSTYDQFGSNRS

SEQ ID NO: 42986 - protein, 34 aa, Artificial Sequence
  Description of Artificial Sequence: Synthetic polypeptide
DEEEIRTTNPVATEQYGQCVSMTEELQRFGSNRV

SEQ ID NO: 42987 - protein, 32 aa, Artificial Sequence
  Description of Artificial Sequence: Synthetic polypeptide
DEEEIRTTNPVATEQYGQCVSMTNHQNIGSNQ

SEQ ID NO: 42988 - protein, 32 aa, Artificial Sequence
  Description of Artificial Sequence: Synthetic polypeptide
DEEEIRTTNPVATEQYGSVSEPQVLARGVNDL

SEQ ID NO: 42989 - protein, 31 aa, Artificial Sequence
  Description of Artificial Sequence: Synthetic polypeptide
DEEEIRGTNPVATEQYGSVSVVQDRGVNSRV

SEQ ID NO: 42990 - protein, 32 aa, Artificial Sequence
  Description of Artificial Sequence: Synthetic polypeptide
DEEEIRCTNPVATEQYGSVSCINEPMDREGNR

SEQ ID NO: 42991 - protein, 33 aa, Artificial Sequence
  Description of Artificial Sequence: Synthetic polypeptide
DEEEIRTTNPVATEQYGQCVSTMNLQSFGSNQT

SEQ ID NO: 42992 - protein, 31 aa, Artificial Sequence
  Description of Artificial Sequence: Synthetic polypeptide
DEEEIRGTNPVATEQYGSVSMVEDRGSNSRN

SEQ ID NO: 42993 - protein, 33 aa, Artificial Sequence
  Description of Artificial Sequence: Synthetic polypeptide
DEEEIRTTNPVATEQYGSVASTNLVQGTGGGGG

SEQ ID NO: 42994 - protein, 31 aa, Artificial Sequence
  Description of Artificial Sequence: Synthetic polypeptide
DEEEICTTNPMATETYGSVPTNLDQHRGNAE

SEQ ID NO: 42995 - protein, 32 aa, Artificial Sequence
  Description of Artificial Sequence: Synthetic polypeptide
DEEEIRGTNPVATEQYGNVSMTNQFQQEGVNR

SEQ ID NO: 42996 - protein, 34 aa, Artificial Sequence
  Description of Artificial Sequence: Synthetic polypeptide
DEEEIRTTNPVATEQYGQSVCSTGNLQGIGSNDA

SEQ ID NO: 42997 - protein, 35 aa, Artificial Sequence
  Description of Artificial Sequence: Synthetic polypeptide
DEEEIRTTNPVATEQYGQSVCSTMNLQRFGSNNQP

SEQ ID NO: 42998 - protein, 33 aa, Artificial Sequence
  Description of Artificial Sequence: Synthetic polypeptide
DEEEIRTTNPVATEQYGQSVCSTNHNQNFGSNI

SEQ ID NO: 42999 - protein, 33 aa, Artificial Sequence
  Description of Artificial Sequence: Synthetic polypeptide
DEEEIRTTNPVATEQYGQSVCSTNHQHFGSNDA

SEQ ID NO: 43000 - protein, 32 aa, Artificial Sequence
  Description of Artificial Sequence: Synthetic polypeptide
DEEEICTTNPMAYEQYGSVATNALSQTRGNNR

SEQ ID NO: 43001 - protein, 32 aa, Artificial Sequence
  Description of Artificial Sequence: Synthetic polypeptide
DEEEICTTNPMAYEQYGSVPCTNLQNRGGSNR

SEQ ID NO: 43002 - protein, 34 aa, Artificial Sequence
  Description of Artificial Sequence: Synthetic polypeptide
DEEEIRTTNPVATEQYGSVASTMNLGQNGGNGND

SEQ ID NO: 43003 - protein, 33 aa, Artificial Sequence
  Description of Artificial Sequence: Synthetic polypeptide
DEEEIRTTNPVATEQYGSVASTLNDGQGEMGNG

SEQ ID NO: 43004 - protein, 31 aa, Artificial Sequence
  Description of Artificial Sequence: Synthetic polypeptide
DEEEIRGTNPVATEQYGCVSMTNLFQGFGDQ

SEQ ID NO: 43005 - protein, 35 aa, Artificial Sequence
  Description of Artificial Sequence: Synthetic polypeptide
DEEEIRTTNPVATEQYGSVSETENGLMQRQGENAA

SEQ ID NO: 43006 - protein, 32 aa, Artificial Sequence
  Description of Artificial Sequence: Synthetic polypeptide
DEEEICTTNPMAYEQYGSVPVTNLSQNRGNNR

SEQ ID NO: 43007 - protein, 32 aa, Artificial Sequence
  Description of Artificial Sequence: Synthetic polypeptide
DEEEIRTTNPVATEQYGQSVCSTNHQYLGSED

SEQ ID NO: 43008 - protein, 32 aa, Artificial Sequence
  Description of Artificial Sequence: Synthetic polypeptide
DEEEIRTTNPVATEQYGQSVCSTELERFGSDD

SEQ ID NO: 43009 - protein, 32 aa, Artificial Sequence
  Description of Artificial Sequence: Synthetic polypeptide
DEEEIRTTNPVATEQYGQCVSTNDQAFGSNQG

SEQ ID NO: 43010 - protein, 30 aa, Artificial Sequence
  Description of Artificial Sequence: Synthetic polypeptide
DEEEICTTNPMATEQYGSVYTNLQHAVTGR

SEQ ID NO: 43011 - protein, 31 aa, Artificial Sequence
  Description of Artificial Sequence: Synthetic polypeptide
DEEEICTTNPMATEQYGSVPTPLMQHRGNGE

SEQ ID NO: 43012 - protein, 34 aa, Artificial Sequence
  Description of Artificial Sequence: Synthetic polypeptide
DEEEIRTTNPVATEQYGSVASVTNLQQEGVNQND

SEQ ID NO: 43013 - protein, 33 aa, Artificial Sequence
  Description of Artificial Sequence: Synthetic polypeptide
DEEEIRTTNPVATEQYGSVASTVNLDEEAGGNG

SEQ ID NO: 43014 - protein, 30 aa, Artificial Sequence
  Description of Artificial Sequence: Synthetic polypeptide
DEEEIRGTNPVATEQYGSVSINQDGGSNSD

SEQ ID NO: 43015 - protein, 32 aa, Artificial Sequence
  Description of Artificial Sequence: Synthetic polypeptide
DEEEIRTTNPVATEQYGQCVSTNHQRFTSNQI

SEQ ID NO: 43016 - protein, 30 aa, Artificial Sequence
  Description of Artificial Sequence: Synthetic polypeptide
DEEEIRTTNPVATEQYGSVSESILDDNGEI

SEQ ID NO: 43017 - protein, 31 aa, Artificial Sequence
  Description of Artificial Sequence: Synthetic polypeptide
DEEEICTTNPMATEQYGAVPTNQQHRGNGRD

SEQ ID NO: 43018 - protein, 32 aa, Artificial Sequence
  Description of Artificial Sequence: Synthetic polypeptide
DEEEICTTNPMATEQYGSVPCTNLSQNRGNND

SEQ ID NO: 43019 - protein, 33 aa, Artificial Sequence
  Description of Artificial Sequence: Synthetic polypeptide
DEEEIRTTNPVATEQYGQCVSTNLQEHFGSNQG

SEQ ID NO: 43020 - protein, 33 aa, Artificial Sequence
  Description of Artificial Sequence: Synthetic polypeptide
DEEEIRTTNPVATEQYGSVASTTDELQEGGNNQ

SEQ ID NO: 43021 - protein, 32 aa, Artificial Sequence
  Description of Artificial Sequence: Synthetic polypeptide
DEEEIRTTNPVATEQYGQCVSTNLQFSNSNAS

SEQ ID NO: 43022 - protein, 33 aa, Artificial Sequence
  Description of Artificial Sequence: Synthetic polypeptide
DEEEIRTTNPVATEQYGQCVSTNLQRFNSEPQG

SEQ ID NO: 43023 - protein, 31 aa, Artificial Sequence
  Description of Artificial Sequence: Synthetic polypeptide
DEEEIRTTNPVATEQYGQCVSTNPQNGSEQA

SEQ ID NO: 43024 - protein, 31 aa, Artificial Sequence
  Description of Artificial Sequence: Synthetic polypeptide
DEEEIRTTNPVATEQYGQCVSTNPQNGSQQG

SEQ ID NO: 43025 - protein, 35 aa, Artificial Sequence
  Description of Artificial Sequence: Synthetic polypeptide
DEEEIRTTNPVATEQYGQSVCSDTNLQRFGSNFQP

SEQ ID NO: 43026 - protein, 31 aa, Artificial Sequence
  Description of Artificial Sequence: Synthetic polypeptide
DEEEICTTNPMATEQYGSVPTPLMQHAGNFR

SEQ ID NO: 43027 - protein, 34 aa, Artificial Sequence
  Description of Artificial Sequence: Synthetic polypeptide
DEEEIRTTNPVATEQYGQSVCSSNLQERFGSNAS

SEQ ID NO: 43028 - protein, 31 aa, Artificial Sequence
  Description of Artificial Sequence: Synthetic polypeptide
DEEEIRTTNPVATEQYGSVSETNINFNGVEN

SEQ ID NO: 43029 - protein, 31 aa, Artificial Sequence
  Description of Artificial Sequence: Synthetic polypeptide
DEEEIRCTNPVATEQYGSVISVDQDRGSNSR

SEQ ID NO: 43030 - protein, 32 aa, Artificial Sequence
  Description of Artificial Sequence: Synthetic polypeptide
DEEEIRTTNPVATEQYGSASDTQLNNQMGNMI

SEQ ID NO: 43031 - protein, 32 aa, Artificial Sequence
  Description of Artificial Sequence: Synthetic polypeptide
DEEEIRCTNPIATEQYGSVSTEPNLPNRNGNV

SEQ ID NO: 43032 - protein, 30 aa, Artificial Sequence
  Description of Artificial Sequence: Synthetic polypeptide
DEECIRTTNPVAYEQYGQVTWTINVQRGNN

SEQ ID NO: 43033 - protein, 33 aa, Artificial Sequence
  Description of Artificial Sequence: Synthetic polypeptide
DEEEIRTTNPVATEQYGSCSAVNPLDQHREPNR

SEQ ID NO: 43034 - protein, 31 aa, Artificial Sequence
  Description of Artificial Sequence: Synthetic polypeptide
DEECIRTTNPVAYEQYGQVSTQNVQRGGNND

SEQ ID NO: 43035 - protein, 31 aa, Artificial Sequence
  Description of Artificial Sequence: Synthetic polypeptide
DEEEIRTTNPVATEQYGSCSDDVLQNGENPQ

SEQ ID NO: 43036 - protein, 33 aa, Artificial Sequence
  Description of Artificial Sequence: Synthetic polypeptide
DEEEICTTNPVATEQYGSVSTNNGLQGGNGNPL

SEQ ID NO: 43037 - protein, 30 aa, Artificial Sequence
  Description of Artificial Sequence: Synthetic polypeptide
DEEEIRCTNPIATEQYGSVSENEPMRGENG

SEQ ID NO: 43038 - protein, 32 aa, Artificial Sequence
  Description of Artificial Sequence: Synthetic polypeptide
DEEEIRTTNPVATEQYGSCSDTDLEQNGENPQ

SEQ ID NO: 43039 - protein, 31 aa, Artificial Sequence
  Description of Artificial Sequence: Synthetic polypeptide
DEECIRTTNPVAYEQYGQVSTINVQRTGGNQ

SEQ ID NO: 43040 - protein, 29 aa, Artificial Sequence
  Description of Artificial Sequence: Synthetic peptide
DEEEIRCTNPIATEQYGSVSEDWMEPGNR

SEQ ID NO: 43041 - protein, 32 aa, Artificial Sequence
  Description of Artificial Sequence: Synthetic polypeptide
DEEEIRTTNPVATEQYGSVSETNLQLIVEAQV

SEQ ID NO: 43042 - protein, 29 aa, Artificial Sequence
  Description of Artificial Sequence: Synthetic peptide
DEEEIRCTNPIATEQYGSVSEDLMHEGNL

SEQ ID NO: 43043 - protein, 30 aa, Artificial Sequence
  Description of Artificial Sequence: Synthetic polypeptide
DEECIRTTNPVAYEQYGQVSTINVQRDNNQ

SEQ ID NO: 43044 - protein, 31 aa, Artificial Sequence
  Description of Artificial Sequence: Synthetic polypeptide
DEEEIRCTNPIATEQYGSVSATDLMREGNDL

SEQ ID NO: 43045 - protein, 32 aa, Artificial Sequence
  Description of Artificial Sequence: Synthetic polypeptide
DEEEICTTNPVATEQYGSVSTQNGNEQHRGEF

SEQ ID NO: 43046 - protein, 29 aa, Artificial Sequence
  Description of Artificial Sequence: Synthetic peptide
DEEEIRCTNPIATEQYGTISEENIQQGNR

SEQ ID NO: 43047 - protein, 31 aa, Artificial Sequence
  Description of Artificial Sequence: Synthetic polypeptide
DEECIRTTNPVAYEQYGQVSTINGQRGGNNN

SEQ ID NO: 43048 - protein, 31 aa, Artificial Sequence
  Description of Artificial Sequence: Synthetic polypeptide
DEEEIRTTNPVATEQYGSCSANINRSGSNED

SEQ ID NO: 43049 - protein, 33 aa, Artificial Sequence
  Description of Artificial Sequence: Synthetic polypeptide
DEEEICTTNPVATEQYGSVSTNLQNNGGNNDGD

SEQ ID NO: 43050 - protein, 29 aa, Artificial Sequence
  Description of Artificial Sequence: Synthetic peptide
DEEEIRCTNPVATEQWGDVSEIEMRAGNR

SEQ ID NO: 43051 - protein, 31 aa, Artificial Sequence
  Description of Artificial Sequence: Synthetic polypeptide
DEEEIRTTNPVATEQYGSCMSTTDDRGEDER

SEQ ID NO: 43052 - protein, 29 aa, Artificial Sequence
  Description of Artificial Sequence: Synthetic peptide
DEEEIRCTNPVATEPYGTVSMEDLMQGNR

SEQ ID NO: 43053 - protein, 32 aa, Artificial Sequence
  Description of Artificial Sequence: Synthetic polypeptide
DEECIRTTNPVAYEQYGSVVSCTNLQHGGNSQ

SEQ ID NO: 43054 - protein, 29 aa, Artificial Sequence
  Description of Artificial Sequence: Synthetic peptide
DEECIRTTNPVAYEQYGSVSTHESLPGNT

SEQ ID NO: 43055 - protein, 29 aa, Artificial Sequence
  Description of Artificial Sequence: Synthetic peptide
DEEEIRCTNPVATEPYGTISMEDLQQGNR

SEQ ID NO: 43056 - protein, 30 aa, Artificial Sequence
  Description of Artificial Sequence: Synthetic polypeptide
DEEEIRCTNPVATECYGCVSTNGQMGNAIA

SEQ ID NO: 43057 - protein, 32 aa, Artificial Sequence
  Description of Artificial Sequence: Synthetic polypeptide
DEEEIRTTNPVATEQYGSCQSPTNHHQETGNL

SEQ ID NO: 43058 - protein, 30 aa, Artificial Sequence
  Description of Artificial Sequence: Synthetic polypeptide
DEEEIRTTNPVATEQYGSCQTNDDRGEEHP

SEQ ID NO: 43059 - protein, 29 aa, Artificial Sequence
  Description of Artificial Sequence: Synthetic peptide
DEEEIRCTNPISTEQYGTVSMENLMRGNH

SEQ ID NO: 43060 - protein, 31 aa, Artificial Sequence
  Description of Artificial Sequence: Synthetic polypeptide
DEEEIRTTNPVATEQYGSCSAEANLQPPENL

SEQ ID NO: 43061 - protein, 32 aa, Artificial Sequence
  Description of Artificial Sequence: Synthetic polypeptide
DEEEIRTTNPVATEQYGSCSAGNALGQRDNNQ

SEQ ID NO: 43062 - protein, 31 aa, Artificial Sequence
  Description of Artificial Sequence: Synthetic polypeptide
DEEEIRCTNPIATEQYGTVSMEDLQQRNGNR

SEQ ID NO: 43063 - protein, 32 aa, Artificial Sequence
  Description of Artificial Sequence: Synthetic polypeptide
DEECIRTTNPVAYEQYGSTVHCTNMLSQRGNQ

SEQ ID NO: 43064 - protein, 31 aa, Artificial Sequence
  Description of Artificial Sequence: Synthetic polypeptide
DEECIRTTNPVAYEQYGSTVATNLSQTGNNQ

SEQ ID NO: 43065 - protein, 31 aa, Artificial Sequence
  Description of Artificial Sequence: Synthetic polypeptide
DEEEIRTTNPVATEQYGSCSAGNNLDRDMRH

SEQ ID NO: 43066 - protein, 31 aa, Artificial Sequence
  Description of Artificial Sequence: Synthetic polypeptide
DEEEIRCTNPVATEQWGSVSCNEMDREGENR

SEQ ID NO: 43067 - protein, 30 aa, Artificial Sequence
  Description of Artificial Sequence: Synthetic polypeptide
DEECIRTTNPVAYEQWGSVATNNLQLGDNM

SEQ ID NO: 43068 - protein, 31 aa, Artificial Sequence
  Description of Artificial Sequence: Synthetic polypeptide
DEECIRTTNPVAYEQWGSVATNNLQPGENRE

SEQ ID NO: 43069 - protein, 28 aa, Artificial Sequence
  Description of Artificial Sequence: Synthetic peptide
DEEEIRCTNPIATECYGAVSENLMPGNI

SEQ ID NO: 43070 - protein, 31 aa, Artificial Sequence
  Description of Artificial Sequence: Synthetic polypeptide
DEECIRTTNPVAYEQYGQVSCTQNVQRTGNN

SEQ ID NO: 43071 - protein, 31 aa, Artificial Sequence
  Description of Artificial Sequence: Synthetic polypeptide
DEEEIRTTNPVATEQYGSCSMNGDTQGGNVA

SEQ ID NO: 43072 - protein, 31 aa, Artificial Sequence
  Description of Artificial Sequence: Synthetic polypeptide
DEEEIRTTNPVATEQYGSCSMTNLERASDVD

SEQ ID NO: 43073 - protein, 29 aa, Artificial Sequence
  Description of Artificial Sequence: Synthetic peptide
DEEEIRCTNPEATAQYGQVPTDLQRGNEA

SEQ ID NO: 43074 - protein, 33 aa, Artificial Sequence
  Description of Artificial Sequence: Synthetic polypeptide
DEEEIRTTNPVATEQYGSCSNTENDHQRVENRD

SEQ ID NO: 43075 - protein, 32 aa, Artificial Sequence
  Description of Artificial Sequence: Synthetic polypeptide
DEEEICTTNPVATERYGSVSTGNDLQGGGDAR

SEQ ID NO: 43076 - protein, 35 aa, Artificial Sequence
  Description of Artificial Sequence: Synthetic polypeptide
DEEEIRTTNPVATEQYGSTVSTNEHQERTVGINRM

SEQ ID NO: 43077 - protein, 33 aa, Artificial Sequence
  Description of Artificial Sequence: Synthetic polypeptide
DEEEIRTTNPVATEQYGSCSPTGNLERGGNDFD

SEQ ID NO: 43078 - protein, 30 aa, Artificial Sequence
  Description of Artificial Sequence: Synthetic polypeptide
DEEEIRATNPVTTEQYGSVSTNLNGNNNQD

SEQ ID NO: 43079 - protein, 29 aa, Artificial Sequence
  Description of Artificial Sequence: Synthetic peptide
DEEEIRATNPVTTEQYGSVSTNATNEGGN

SEQ ID NO: 43080 - protein, 30 aa, Artificial Sequence
  Description of Artificial Sequence: Synthetic polypeptide
DEEEIRTTNPVATEQYGSCSPTHLFMDNDV

SEQ ID NO: 43081 - protein, 34 aa, Artificial Sequence
  Description of Artificial Sequence: Synthetic polypeptide
DEEEIRTTNPVATEQYGSCSPTNDQHRGSENSRI

SEQ ID NO: 43082 - protein, 33 aa, Artificial Sequence
  Description of Artificial Sequence: Synthetic polypeptide
DEEEIRTTNPVATEQYGSCSPTNLQQRPGEEAL

SEQ ID NO: 43083 - protein, 29 aa, Artificial Sequence
  Description of Artificial Sequence: Synthetic peptide
DEEEIRTTNPVATEQYGSCSSGLQVLDVG

SEQ ID NO: 43084 - protein, 32 aa, Artificial Sequence
  Description of Artificial Sequence: Synthetic polypeptide
DEEEIRTTNPVATEQYGSTVSTNHSGQFGGEE

SEQ ID NO: 43085 - protein, 30 aa, Artificial Sequence
  Description of Artificial Sequence: Synthetic polypeptide
DEEEIRCTNPIATEQYGSVSAEDLMRGNDL

SEQ ID NO: 43086 - protein, 29 aa, Artificial Sequence
  Description of Artificial Sequence: Synthetic peptide
DEEEICTTNPVATEQYGTVSANLDSHNLV

SEQ ID NO: 43087 - protein, 31 aa, Artificial Sequence
  Description of Artificial Sequence: Synthetic polypeptide
DEEEIRCTNPIATECYGSVSENEPQREGENR

SEQ ID NO: 43088 - protein, 32 aa, Artificial Sequence
  Description of Artificial Sequence: Synthetic polypeptide
DEEEIRTTNPVATEQYGSVSGNLNVIGGNGQE

SEQ ID NO: 43089 - protein, 32 aa, Artificial Sequence
  Description of Artificial Sequence: Synthetic polypeptide
DEEEICTTNPVATEQYGSVSTTNTLQQVTGEE

SEQ ID NO: 43090 - protein, 31 aa, Artificial Sequence
  Description of Artificial Sequence: Synthetic polypeptide
DEEEIRTTNPVATEQYGSCSENEDDDRGEDR

SEQ ID NO: 43091 - protein, 30 aa, Artificial Sequence
  Description of Artificial Sequence: Synthetic polypeptide
DEEEIRCTNPIATEQYGSTVSEDLMRKGPR

SEQ ID NO: 43092 - protein, 30 aa, Artificial Sequence
  Description of Artificial Sequence: Synthetic polypeptide
DEEEIRCTNPIATEQYGSTVAENLMPKGNR

SEQ ID NO: 43093 - protein, 30 aa, Artificial Sequence
  Description of Artificial Sequence: Synthetic polypeptide
DEEEIRCTNPIATEQYGSISEEDLQMQGNR

SEQ ID NO: 43094 - protein, 32 aa, Artificial Sequence
  Description of Artificial Sequence: Synthetic polypeptide
DEEEICTTNPVATEQYGSVSTVNSLNQVTGEN

SEQ ID NO: 43095 - protein, 29 aa, Artificial Sequence
  Description of Artificial Sequence: Synthetic peptide
DEEEIRCTNPIATEQWGSVSENLMNAGDR

SEQ ID NO: 43096 - protein, 30 aa, Artificial Sequence
  Description of Artificial Sequence: Synthetic polypeptide
DEEEIRCTNPIATEQWGSVSENEPQRGENG

SEQ ID NO: 43097 - protein, 31 aa, Artificial Sequence
  Description of Artificial Sequence: Synthetic polypeptide
DEECIRTTNPVAYEQYGQVSTGNVQRGGNNQ

SEQ ID NO: 43098 - protein, 30 aa, Artificial Sequence
  Description of Artificial Sequence: Synthetic polypeptide
DEEEIRCTNPIATEQWGSVAEENLMRGNYR

SEQ ID NO: 43099 - protein, 30 aa, Artificial Sequence
  Description of Artificial Sequence: Synthetic polypeptide
DEEEIRCTNPIATEQWGSVAAENLMRGNYR

SEQ ID NO: 43100 - protein, 31 aa, Artificial Sequence
  Description of Artificial Sequence: Synthetic polypeptide
DEECIRTTNPVAYEQYGQVSTENVQDRGGNN

SEQ ID NO: 43101 - protein, 32 aa, Artificial Sequence
  Description of Artificial Sequence: Synthetic polypeptide
DEEEIRTTNPVATEQYGSVSGNLENRIGPEQT

SEQ ID NO: 43102 - protein, 29 aa, Artificial Sequence
  Description of Artificial Sequence: Synthetic peptide
DEEEIRCTNPIATEQWGSTSEDLARGNYR

SEQ ID NO: 43103 - protein, 30 aa, Artificial Sequence
  Description of Artificial Sequence: Synthetic polypeptide
DEEEIRCTNPIATECYGSVSEINLPMRGNG

SEQ ID NO: 43104 - protein, 32 aa, Artificial Sequence
  Description of Artificial Sequence: Synthetic polypeptide
DEEEIRTTNPVATEQYGSCSSTNLERGGEDFA

SEQ ID NO: 43105 - protein, 31 aa, Artificial Sequence
  Description of Artificial Sequence: Synthetic polypeptide
DEECIRTTNPVAYEQWGSVATNNLQGAGENR

SEQ ID NO: 43106 - protein, 31 aa, Artificial Sequence
  Description of Artificial Sequence: Synthetic polypeptide
DEEEIRTTNPVATEQYGSCCAMNLDPRTPNR

SEQ ID NO: 43107 - protein, 33 aa, Artificial Sequence
  Description of Artificial Sequence: Synthetic polypeptide
DEEEIRTTNPVATEQYGSASPAGNHIQRIGNNR

SEQ ID NO: 43108 - protein, 32 aa, Artificial Sequence
  Description of Artificial Sequence: Synthetic polypeptide
DEEEIRTTNPVATEQYGSASPAPNLQGGLENG

SEQ ID NO: 43109 - protein, 32 aa, Artificial Sequence
  Description of Artificial Sequence: Synthetic polypeptide
DEEEIRTTNPVATEQYGSASPMPNPQQRGENN

SEQ ID NO: 43110 - protein, 33 aa, Artificial Sequence
  Description of Artificial Sequence: Synthetic polypeptide
DEEEIRTTNPVATEQYGSASPTENHIQRIGNVI

SEQ ID NO: 43111 - protein, 34 aa, Artificial Sequence
  Description of Artificial Sequence: Synthetic polypeptide
DEEEIRTTNPVATEQYGSASPTENHIQRIGPNNR

SEQ ID NO: 43112 - protein, 30 aa, Artificial Sequence
  Description of Artificial Sequence: Synthetic polypeptide
DEEEIRCTNPVATEQYGSASSEALQMRGGV

SEQ ID NO: 43113 - protein, 33 aa, Artificial Sequence
  Description of Artificial Sequence: Synthetic polypeptide
DEEEIRTTNPVATEQYGSASPTETEIQRIGNAR

SEQ ID NO: 43114 - protein, 33 aa, Artificial Sequence
  Description of Artificial Sequence: Synthetic polypeptide
DEEEIRTTNPVATEQYGSASPTINHIERIGNNR

SEQ ID NO: 43115 - protein, 33 aa, Artificial Sequence
  Description of Artificial Sequence: Synthetic polypeptide
DEEEIRTTNPVATEQYGSASPTNDQQRGEENQM

SEQ ID NO: 43116 - protein, 33 aa, Artificial Sequence
  Description of Artificial Sequence: Synthetic polypeptide
DEEEIRTTNPVATEQYGSASPTNLIQMAEGEAR

SEQ ID NO: 43117 - protein, 34 aa, Artificial Sequence
  Description of Artificial Sequence: Synthetic polypeptide
DEEEIRTTNPVATEQYGSASPTNLIQMRENVEDR

SEQ ID NO: 43118 - protein, 34 aa, Artificial Sequence
  Description of Artificial Sequence: Synthetic polypeptide
DEEEIRTTNPVATEQYGSASPTSNEIQRGENNRQ

SEQ ID NO: 43119 - protein, 33 aa, Artificial Sequence
  Description of Artificial Sequence: Synthetic polypeptide
DEEEIRTTNPVATEQYGSASPTTNHILRQGNNR

SEQ ID NO: 43120 - protein, 34 aa, Artificial Sequence
  Description of Artificial Sequence: Synthetic polypeptide
DEEEIRTTNPVATEQYGSASPTTNHIQRIGNAMR

SEQ ID NO: 43121 - protein, 30 aa, Artificial Sequence
  Description of Artificial Sequence: Synthetic polypeptide
DEECIRTTNPVAYEQYSEEVTTNLQPGNNR

SEQ ID NO: 43122 - protein, 32 aa, Artificial Sequence
  Description of Artificial Sequence: Synthetic polypeptide
DEEEIRCTNPVATEQYGSASTTNGNMRNGMNR

SEQ ID NO: 43123 - protein, 32 aa, Artificial Sequence
  Description of Artificial Sequence: Synthetic polypeptide
DEEEIRTTNPVATEQYGSASPTTNWLEQRIAN

SEQ ID NO: 43124 - protein, 32 aa, Artificial Sequence
  Description of Artificial Sequence: Synthetic polypeptide
DEEEIRCTNPVATEQYGSASTTNLNMRNGMGR

SEQ ID NO: 43125 - protein, 32 aa, Artificial Sequence
  Description of Artificial Sequence: Synthetic polypeptide
DEEEIRCTNPVATEQYGSVATGNLQDGGDNDS

SEQ ID NO: 43126 - protein, 33 aa, Artificial Sequence
  Description of Artificial Sequence: Synthetic polypeptide
DEEEIRCTNPVATEQYGSVHSDVNDQDRGSNSR

SEQ ID NO: 43127 - protein, 31 aa, Artificial Sequence
  Description of Artificial Sequence: Synthetic polypeptide
DEEEIRCTNPVATEQYGSVCVNLAFNGMNRQ

SEQ ID NO: 43128 - protein, 34 aa, Artificial Sequence
  Description of Artificial Sequence: Synthetic polypeptide
DEEEICTTNPVATEQYGSTVSTGNLSQDRVGDRW

SEQ ID NO: 43129 - protein, 32 aa, Artificial Sequence
  Description of Artificial Sequence: Synthetic polypeptide
DEEEIRCTNPVATEQYGSVCSTGELQNGSNQS

SEQ ID NO: 43130 - protein, 33 aa, Artificial Sequence
  Description of Artificial Sequence: Synthetic polypeptide
DEEEICTTNPVATEQYGSVACTPLSQRTGGNRH

SEQ ID NO: 43131 - protein, 31 aa, Artificial Sequence
  Description of Artificial Sequence: Synthetic polypeptide
DEEEIRCTNPVATEQYGSVCSEDGLMFEGNR

SEQ ID NO: 43132 - protein, 31 aa, Artificial Sequence
  Description of Artificial Sequence: Synthetic polypeptide
DEEEICTTNPVATEQYGSVASNLQNDGNTEM

SEQ ID NO: 43133 - protein, 31 aa, Artificial Sequence
  Description of Artificial Sequence: Synthetic polypeptide
DEEEICTTNPVATEQYGSVATNDQGNGNNGA

SEQ ID NO: 43134 - protein, 32 aa, Artificial Sequence
  Description of Artificial Sequence: Synthetic polypeptide
DEECIRTTNPVAYERYGSVVSTNLSQRGGNMK

SEQ ID NO: 43135 - protein, 31 aa, Artificial Sequence
  Description of Artificial Sequence: Synthetic polypeptide
DEEEICTTNPVATEQYGSVATNLDRGDIEDD

SEQ ID NO: 43136 - protein, 31 aa, Artificial Sequence
  Description of Artificial Sequence: Synthetic polypeptide
DEEEIRCTNPVATEQYGSVATNLQNSNNTHN

SEQ ID NO: 43137 - protein, 31 aa, Artificial Sequence
  Description of Artificial Sequence: Synthetic polypeptide
DEEEIRCTNPVATEQYGSVATNLQNMNNETL

SEQ ID NO: 43138 - protein, 32 aa, Artificial Sequence
  Description of Artificial Sequence: Synthetic polypeptide
DEECIRTTNPVAYERYGSVSCTNLSQRGGNDK

SEQ ID NO: 43139 - protein, 32 aa, Artificial Sequence
  Description of Artificial Sequence: Synthetic polypeptide
DEEEICTTNPVATEQYGSVATNLQDDGNNENM

SEQ ID NO: 43140 - protein, 31 aa, Artificial Sequence
  Description of Artificial Sequence: Synthetic polypeptide
DEEEIRCTNPVATEQYGSVATNLQENPGEDN

SEQ ID NO: 43141 - protein, 28 aa, Artificial Sequence
  Description of Artificial Sequence: Synthetic peptide
DEEEIRCTNPVATEQYGSSSTPPEQGPS

SEQ ID NO: 43142 - protein, 32 aa, Artificial Sequence
  Description of Artificial Sequence: Synthetic polypeptide
DEEEICTTNPVATEQYGSVSTNLLNQNNGQEF

SEQ ID NO: 43143 - protein, 34 aa, Artificial Sequence
  Description of Artificial Sequence: Synthetic polypeptide
DEEEIRTTNPVATEQYGSASTCGNLQRESENQRD

SEQ ID NO: 43144 - protein, 30 aa, Artificial Sequence
  Description of Artificial Sequence: Synthetic polypeptide
DEEEIRCTNPVATEQYGEVSEPAGNRNGNR

SEQ ID NO: 43145 - protein, 31 aa, Artificial Sequence
  Description of Artificial Sequence: Synthetic polypeptide
DEEEIRCTNPVATEQYGCVCSTNHQRGSELT

SEQ ID NO: 43146 - protein, 33 aa, Artificial Sequence
  Description of Artificial Sequence: Synthetic polypeptide
DEEEIRCTNPVATEQYGCVCSTMNLQRFGSNQA

SEQ ID NO: 43147 - protein, 32 aa, Artificial Sequence
  Description of Artificial Sequence: Synthetic polypeptide
DEEEICTTNPVATEQYGSVSINGLFIQRGDEF

SEQ ID NO: 43148 - protein, 33 aa, Artificial Sequence
  Description of Artificial Sequence: Synthetic polypeptide
DEEEICTTNPVATEQYGSVSTANADSQPPVGNR

SEQ ID NO: 43149 - protein, 34 aa, Artificial Sequence
  Description of Artificial Sequence: Synthetic polypeptide
DEEEIRTTNPVATEQYGSAVSSTPDPQRDEGNTR

SEQ ID NO: 43150 - protein, 30 aa, Artificial Sequence
  Description of Artificial Sequence: Synthetic polypeptide
DEECIRTTNPVAYEQYSEEVATNLQIAGNR

SEQ ID NO: 43151 - protein, 34 aa, Artificial Sequence
  Description of Artificial Sequence: Synthetic polypeptide
DEEEIRTTNPVATEQYGSAVSTNEDEQRGNDETG

SEQ ID NO: 43152 - protein, 31 aa, Artificial Sequence
  Description of Artificial Sequence: Synthetic polypeptide
DEEEIRTTNPVATEQYGSAVSTNEDQMNMEG

SEQ ID NO: 43153 - protein, 31 aa, Artificial Sequence
  Description of Artificial Sequence: Synthetic polypeptide
DEECIRTTNPVAYEQWGSVATNNLQDGENSR

SEQ ID NO: 43154 - protein, 32 aa, Artificial Sequence
  Description of Artificial Sequence: Synthetic polypeptide
DEEEICTTNPVATEQYGSVSTGNGNQGADNGR

SEQ ID NO: 43155 - protein, 32 aa, Artificial Sequence
  Description of Artificial Sequence: Synthetic polypeptide
DEEEICTTNPVATEQYGSVSTGNPLQERTHGE

SEQ ID NO: 43156 - protein, 33 aa, Artificial Sequence
  Description of Artificial Sequence: Synthetic polypeptide
DEEEIRTTNPVATEQYGSAYSTNNIQGCGENRN

SEQ ID NO: 43157 - protein, 30 aa, Artificial Sequence
  Description of Artificial Sequence: Synthetic polypeptide
DEEEIRTTNPVATEQYGSCAAGNNLDRDNG

SEQ ID NO: 43158 - protein, 32 aa, Artificial Sequence
  Description of Artificial Sequence: Synthetic polypeptide
DEEEIRTTNPVATEQYGSCAKTNDVQMGDNRD

SEQ ID NO: 43159 - protein, 31 aa, Artificial Sequence
  Description of Artificial Sequence: Synthetic polypeptide
DEEEIRTTNPVATEQYGSCALPNMLGQRDNN

SEQ ID NO: 43160 - protein, 32 aa, Artificial Sequence
  Description of Artificial Sequence: Synthetic polypeptide
DEEEIRCTNPVATEQYGCVCSTNLQNFGSENQ

SEQ ID NO: 43161 - protein, 31 aa, Artificial Sequence
  Description of Artificial Sequence: Synthetic polypeptide
DEEEIRTTNPVATEQYGSASTEIWLQLINDD

SEQ ID NO: 43162 - protein, 32 aa, Artificial Sequence
  Description of Artificial Sequence: Synthetic polypeptide
DEEEIRTTNPVATEQYGSTVTTTPNNETEGNR

SEQ ID NO: 43163 - protein, 33 aa, Artificial Sequence
  Description of Artificial Sequence: Synthetic polypeptide
DEEEIRTTNPVATEQYGSAVCSDTELQHFGSNQ

SEQ ID NO: 43164 - protein, 31 aa, Artificial Sequence
  Description of Artificial Sequence: Synthetic polypeptide
DEEEIRCTNPVATEQYGEASTTNLNMRGMGR

SEQ ID NO: 43165 - protein, 34 aa, Artificial Sequence
  Description of Artificial Sequence: Synthetic polypeptide
DEEEIRTTNPVATEQYGSASTLNDLQLEVGDNMR

SEQ ID NO: 43166 - protein, 31 aa, Artificial Sequence
  Description of Artificial Sequence: Synthetic polypeptide
DEEEICTTNPVATEQYGSVATNLTDIMGNEI

SEQ ID NO: 43167 - protein, 32 aa, Artificial Sequence
  Description of Artificial Sequence: Synthetic polypeptide
DEEEIRTTNPVATEQYGSVSETNLIVFLEGRE

SEQ ID NO: 43168 - protein, 32 aa, Artificial Sequence
  Description of Artificial Sequence: Synthetic polypeptide
DEEEIRTTNPVATEQYGSASTNGLIETGNLEE

SEQ ID NO: 43169 - protein, 32 aa, Artificial Sequence
  Description of Artificial Sequence: Synthetic polypeptide
DEEEIRTTNPVATEQYGSASTNLEQEGELVVD

SEQ ID NO: 43170 - protein, 30 aa, Artificial Sequence
  Description of Artificial Sequence: Synthetic polypeptide
DEEEIRCTNPVATEQYGDVSENEMNRAENR

SEQ ID NO: 43171 - protein, 31 aa, Artificial Sequence
  Description of Artificial Sequence: Synthetic polypeptide
DEEEIRTTNPVATEQYGSASTNLIQFEVSEE

SEQ ID NO: 43172 - protein, 33 aa, Artificial Sequence
  Description of Artificial Sequence: Synthetic polypeptide
DEEEICTTNPVATEQYGSVCAQNGLEQRGNVRL

SEQ ID NO: 43173 - protein, 33 aa, Artificial Sequence
  Description of Artificial Sequence: Synthetic polypeptide
DEEEIRTTNPVATEQYGSVSETNLQDNRASDDG

SEQ ID NO: 43174 - protein, 32 aa, Artificial Sequence
  Description of Artificial Sequence: Synthetic polypeptide
DEEEIRCTNPVATEQYGCVSMTGNLFQGGNVG

SEQ ID NO: 43175 - protein, 30 aa, Artificial Sequence
  Description of Artificial Sequence: Synthetic polypeptide
DEEEIRCTNPVATEQYGCVSMTADNQGGNQ

SEQ ID NO: 43176 - protein, 32 aa, Artificial Sequence
  Description of Artificial Sequence: Synthetic polypeptide
DEEEICTTNPVATEQYGSVCPQDNLSQRGNNG

SEQ ID NO: 43177 - protein, 32 aa, Artificial Sequence
  Description of Artificial Sequence: Synthetic polypeptide
DEEEIRTTNPVATEQYGSASTTAGNMRNGMNR

SEQ ID NO: 43178 - protein, 32 aa, Artificial Sequence
  Description of Artificial Sequence: Synthetic polypeptide
DEEEIRTTNPVATEQYGSASTTTTLPQNMVNR

SEQ ID NO: 43179 - protein, 34 aa, Artificial Sequence
  Description of Artificial Sequence: Synthetic polypeptide
DEEEICTTNPVATEQYGSVPSCTNISQRGGNPRQ

SEQ ID NO: 43180 - protein, 32 aa, Artificial Sequence
  Description of Artificial Sequence: Synthetic polypeptide
DEEEIRTTNPVATEQYGSVQTSLQTRGQDTSN

SEQ ID NO: 43181 - protein, 32 aa, Artificial Sequence
  Description of Artificial Sequence: Synthetic polypeptide
DEEEIRTTNPVATEQYGCVYSTELQRFGSDQM

SEQ ID NO: 43182 - protein, 33 aa, Artificial Sequence
  Description of Artificial Sequence: Synthetic polypeptide
DEEEIRTTNPCATEQYGSVIATDNLDQRGENHA

SEQ ID NO: 43183 - protein, 31 aa, Artificial Sequence
  Description of Artificial Sequence: Synthetic polypeptide
DEEEIRTTNPVATEQYGCVCSTYHQRFGEQD

SEQ ID NO: 43184 - protein, 32 aa, Artificial Sequence
  Description of Artificial Sequence: Synthetic polypeptide
DEEEIRTTNPVATEQYGCVCSVSMNHQRFNNI

SEQ ID NO: 43185 - protein, 32 aa, Artificial Sequence
  Description of Artificial Sequence: Synthetic polypeptide
DEEEIRTTNPVATEQYGSVSLCNNEQRLEEAR

SEQ ID NO: 43186 - protein, 30 aa, Artificial Sequence
  Description of Artificial Sequence: Synthetic polypeptide
DEEEIRTTNPVATEQYGCVCSWEHQNGNQE

SEQ ID NO: 43187 - protein, 31 aa, Artificial Sequence
  Description of Artificial Sequence: Synthetic polypeptide
DEEEIRTTNPVATEQYGSVSATATGGQRDAF

SEQ ID NO: 43188 - protein, 31 aa, Artificial Sequence
  Description of Artificial Sequence: Synthetic polypeptide
DEEEIRTTNPVATEQYGCVCSWEHQRFGNQV

SEQ ID NO: 43189 - protein, 33 aa, Artificial Sequence
  Description of Artificial Sequence: Synthetic polypeptide
DEEEIRTTNPVATEQYGCVCSTWNLQRFGSEQG

SEQ ID NO: 43190 - protein, 30 aa, Artificial Sequence
  Description of Artificial Sequence: Synthetic polypeptide
DEECLRTTNPTAYEQYGEVSTNLQGDGNER

SEQ ID NO: 43191 - protein, 31 aa, Artificial Sequence
  Description of Artificial Sequence: Synthetic polypeptide
DEECIRCTNPVATEQYGSVVSINMFQRGGNL

SEQ ID NO: 43192 - protein, 31 aa, Artificial Sequence
  Description of Artificial Sequence: Synthetic polypeptide
DEEEIRTTNPVATEQYGCVCSWELQRSGSEV

SEQ ID NO: 43193 - protein, 31 aa, Artificial Sequence
  Description of Artificial Sequence: Synthetic polypeptide
DEEEIRTTNPVATEQYGSVDTNHDQTDSENE

SEQ ID NO: 43194 - protein, 31 aa, Artificial Sequence
  Description of Artificial Sequence: Synthetic polypeptide
DEEEIRTTNPVATEQYGSVDTITLTQGSNIM

SEQ ID NO: 43195 - protein, 31 aa, Artificial Sequence
  Description of Artificial Sequence: Synthetic polypeptide
DEECLRTTNPIAYEQYGEVSTTNLSQRGGNR

SEQ ID NO: 43196 - protein, 33 aa, Artificial Sequence
  Description of Artificial Sequence: Synthetic polypeptide
DEEEIRTTNPVATEQYGSVDSTPTQDDDGINRL

SEQ ID NO: 43197 - protein, 31 aa, Artificial Sequence
  Description of Artificial Sequence: Synthetic polypeptide
DEEEIRTTNPVATEQYGCVCSWELDQNGSNQ

SEQ ID NO: 43198 - protein, 32 aa, Artificial Sequence
  Description of Artificial Sequence: Synthetic polypeptide
DEEEIRTTNPVATEQYGCVCSTVNLQGNSNQM

SEQ ID NO: 43199 - protein, 33 aa, Artificial Sequence
  Description of Artificial Sequence: Synthetic polypeptide
DEEEIRTTNPVATEQYGCVCSTVNLNQNFGSNQ

SEQ ID NO: 43200 - protein, 30 aa, Artificial Sequence
  Description of Artificial Sequence: Synthetic polypeptide
DEEEIRTTNPLAYEQYGSTVSANIGRGGND

SEQ ID NO: 43201 - protein, 31 aa, Artificial Sequence
  Description of Artificial Sequence: Synthetic polypeptide
DEEEIRTTNPVATEQYGSVSAPLQTSNEEQF

SEQ ID NO: 43202 - protein, 29 aa, Artificial Sequence
  Description of Artificial Sequence: Synthetic peptide
DEEEIRTTNPVATEQYGSVSAPNDILDEE

SEQ ID NO: 43203 - protein, 33 aa, Artificial Sequence
  Description of Artificial Sequence: Synthetic polypeptide
DEEEIRTTNPVATEQYGSVECTNDQRMLENERM

SEQ ID NO: 43204 - protein, 32 aa, Artificial Sequence
  Description of Artificial Sequence: Synthetic polypeptide
DEEEIRTTNPVATEQYGSVSLENLQANGPELL

SEQ ID NO: 43205 - protein, 30 aa, Artificial Sequence
  Description of Artificial Sequence: Synthetic polypeptide
DEECIRCTNPVATEQYGSVSWNEGQTGNLP

SEQ ID NO: 43206 - protein, 32 aa, Artificial Sequence
  Description of Artificial Sequence: Synthetic polypeptide
DEEEIRTTNPVATEQYGCVCSTTELQHSGSNV

SEQ ID NO: 43207 - protein, 28 aa, Artificial Sequence
  Description of Artificial Sequence: Synthetic peptide
DEECIRCTNPVATEQYGSVSWNFERDML

SEQ ID NO: 43208 - protein, 32 aa, Artificial Sequence
  Description of Artificial Sequence: Synthetic polypeptide
DEEEIRTTNPVATEQYGSVDVNQSVRMGQNRE

SEQ ID NO: 43209 - protein, 31 aa, Artificial Sequence
  Description of Artificial Sequence: Synthetic polypeptide
DEEEIRTTNPMATEAYGSCSTNELSARGGND

SEQ ID NO: 43210 - protein, 32 aa, Artificial Sequence
  Description of Artificial Sequence: Synthetic polypeptide
DEEEIRTTNPVATEQYGSVSLDLQRGLELLMS

SEQ ID NO: 43211 - protein, 32 aa, Artificial Sequence
  Description of Artificial Sequence: Synthetic polypeptide
DEEEIRTTNPVATEQYGCVCSTTELQNFGNQS

SEQ ID NO: 43212 - protein, 30 aa, Artificial Sequence
  Description of Artificial Sequence: Synthetic polypeptide
DEECIRCTNPVATEQYGSVSWNHQRGSDQS

SEQ ID NO: 43213 - protein, 32 aa, Artificial Sequence
  Description of Artificial Sequence: Synthetic polypeptide
DEEEIRTTNPVATEQYGCVCSTTNHQRNSDRT

SEQ ID NO: 43214 - protein, 33 aa, Artificial Sequence
  Description of Artificial Sequence: Synthetic polypeptide
DEEEIRTTNPVATEQYGCVCSTTNNHQFGSNRV

SEQ ID NO: 43215 - protein, 32 aa, Artificial Sequence
  Description of Artificial Sequence: Synthetic polypeptide
DEEEIRTTNPVATEQYGCVCSTVEHQRFGNQG

SEQ ID NO: 43216 - protein, 32 aa, Artificial Sequence
  Description of Artificial Sequence: Synthetic polypeptide
DEEEIRTTNPVATEQYGCVCSWENLQGGSNQI

SEQ ID NO: 43217 - protein, 33 aa, Artificial Sequence
  Description of Artificial Sequence: Synthetic polypeptide
DEEEIRTTNPVATEQYGSVDSTPTDQQRGNDIV

SEQ ID NO: 43218 - protein, 33 aa, Artificial Sequence
  Description of Artificial Sequence: Synthetic polypeptide
DEEEIRTTNPVATEQYGSVDSTPNLSQRVFVVD

SEQ ID NO: 43219 - protein, 33 aa, Artificial Sequence
  Description of Artificial Sequence: Synthetic polypeptide
DEEEIRTTNPVATEQYGSVDSTNYLVRSLEIRD

SEQ ID NO: 43220 - protein, 32 aa, Artificial Sequence
  Description of Artificial Sequence: Synthetic polypeptide
DEEEIRTTNPVATEQYGCVCSWNLQHSGSERP

SEQ ID NO: 43221 - protein, 30 aa, Artificial Sequence
  Description of Artificial Sequence: Synthetic polypeptide
DEEEIRTTNPIAYEAYGSCSTNLSARGGNS

SEQ ID NO: 43222 - protein, 31 aa, Artificial Sequence
  Description of Artificial Sequence: Synthetic polypeptide
DEEEIRTTNPVATEQYGCVCSWNLQNGSEIM

SEQ ID NO: 43223 - protein, 33 aa, Artificial Sequence
  Description of Artificial Sequence: Synthetic polypeptide
DEEEIRTTNPVATEQYGSVDSTENHQRFGSEQM

SEQ ID NO: 43224 - protein, 34 aa, Artificial Sequence
  Description of Artificial Sequence: Synthetic polypeptide
DEEEIRTTNPVATEQYGSVDSTENHQNFGSNNRA

SEQ ID NO: 43225 - protein, 32 aa, Artificial Sequence
  Description of Artificial Sequence: Synthetic polypeptide
DEEEIRTTNPVATEQYGSVDSTENHQNFGSDD

SEQ ID NO: 43226 - protein, 33 aa, Artificial Sequence
  Description of Artificial Sequence: Synthetic polypeptide
DEEEIRTTNPVATEQYGSVDSTENHQGFGSNAS

SEQ ID NO: 43227 - protein, 31 aa, Artificial Sequence
  Description of Artificial Sequence: Synthetic polypeptide
DEEEIRTTNPVATEQYGCVCSWNLQNNSNII

SEQ ID NO: 43228 - protein, 33 aa, Artificial Sequence
  Description of Artificial Sequence: Synthetic polypeptide
DEEEIRTTNPVATEQYGSVDSTELQNSGSNNQS

SEQ ID NO: 43229 - protein, 31 aa, Artificial Sequence
  Description of Artificial Sequence: Synthetic polypeptide
DEEEIRTTNPIATEQYGTVSATDNPEREGND

SEQ ID NO: 43230 - protein, 32 aa, Artificial Sequence
  Description of Artificial Sequence: Synthetic polypeptide
DEEEIRTTNPVATEQYGSVDSSMDQRGQNDEV

SEQ ID NO: 43231 - protein, 29 aa, Artificial Sequence
  Description of Artificial Sequence: Synthetic peptide
DEEEIRTTNPVATEQYGSVSKDDQASEEQ

SEQ ID NO: 43232 - protein, 31 aa, Artificial Sequence
  Description of Artificial Sequence: Synthetic polypeptide
DEEEIRTTNPVATEQYGCVCSWNLQYGSDQA

SEQ ID NO: 43233 - protein, 32 aa, Artificial Sequence
  Description of Artificial Sequence: Synthetic polypeptide
DEEEIRTTNPVATEQYGSVDSSMDEQPRGPLR

SEQ ID NO: 43234 - protein, 32 aa, Artificial Sequence
  Description of Artificial Sequence: Synthetic polypeptide
DEEEIRTTNPVATEQYGSVSIVNLEPRWFNDQ

SEQ ID NO: 43235 - protein, 29 aa, Artificial Sequence
  Description of Artificial Sequence: Synthetic peptide
DEECLRTTNPIAYEQYGCVSTNLQNGNAS

SEQ ID NO: 43236 - protein, 31 aa, Artificial Sequence
  Description of Artificial Sequence: Synthetic polypeptide
DEECIRCTNPVATEQYGSVSWNEGQNRGNTE

SEQ ID NO: 43237 - protein, 31 aa, Artificial Sequence
  Description of Artificial Sequence: Synthetic polypeptide
DEEEIRTTNPVATEQYGCVCSWNLQAGSDQS

SEQ ID NO: 43238 - protein, 31 aa, Artificial Sequence
  Description of Artificial Sequence: Synthetic polypeptide
DEEEIRTTNPVATEQYGCVCSWNLDQHGSEQ

SEQ ID NO: 43239 - protein, 32 aa, Artificial Sequence
  Description of Artificial Sequence: Synthetic polypeptide
DEEEIRTTNPVATEQYGCVCSWENLQNGSNQE

SEQ ID NO: 43240 - protein, 31 aa, Artificial Sequence
  Description of Artificial Sequence: Synthetic polypeptide
DEEEIRTTNPLATEQYGSVSANAISTRGGND

SEQ ID NO: 43241 - protein, 33 aa, Artificial Sequence
  Description of Artificial Sequence: Synthetic polypeptide
DEEEIRTTNPVATEQYGSVDSTNNLQDIITNNM

SEQ ID NO: 43242 - protein, 30 aa, Artificial Sequence
  Description of Artificial Sequence: Synthetic polypeptide
DEECLRTTNPIAYEQYGEVSTNLQGEGGNR

SEQ ID NO: 43243 - protein, 32 aa, Artificial Sequence
  Description of Artificial Sequence: Synthetic polypeptide
DEEEIRTTNPVATEQYGSVDSTNLTEREQEDI

SEQ ID NO: 43244 - protein, 33 aa, Artificial Sequence
  Description of Artificial Sequence: Synthetic polypeptide
DEEEIRTTNPLATEQYGQSVSANTEQRFGQNFR

SEQ ID NO: 43245 - protein, 32 aa, Artificial Sequence
  Description of Artificial Sequence: Synthetic polypeptide
DEEEIRTTNPVATEQYGCVCSWGNLQNFGSNV

SEQ ID NO: 43246 - protein, 32 aa, Artificial Sequence
  Description of Artificial Sequence: Synthetic polypeptide
DEEEIRTTNPVATEQYGCVCSWMNLINGSNRM

SEQ ID NO: 43247 - protein, 30 aa, Artificial Sequence
  Description of Artificial Sequence: Synthetic polypeptide
DEECLRTTNPIAYEQYGEVSTNLQGDGNNR

SEQ ID NO: 43248 - protein, 31 aa, Artificial Sequence
  Description of Artificial Sequence: Synthetic polypeptide
DEEEIRTTNPVATEQYGCVCSWNHQHNSNRS

SEQ ID NO: 43249 - protein, 32 aa, Artificial Sequence
  Description of Artificial Sequence: Synthetic polypeptide
DEEEIRTTNPVATEQYGCVCSWNHQNGSNNRG

SEQ ID NO: 43250 - protein, 33 aa, Artificial Sequence
  Description of Artificial Sequence: Synthetic polypeptide
DEEEIRTTNPVATEQYGSVSKTNNWPQIDGNGF

SEQ ID NO: 43251 - protein, 31 aa, Artificial Sequence
  Description of Artificial Sequence: Synthetic polypeptide
DEEEIRTTNPVATEQYGCVCSWNHQRSNSEQ

SEQ ID NO: 43252 - protein, 31 aa, Artificial Sequence
  Description of Artificial Sequence: Synthetic polypeptide
DEECLRTTNPIAYEQYGEVSTNELSQRGTNR

SEQ ID NO: 43253 - protein, 31 aa, Artificial Sequence
  Description of Artificial Sequence: Synthetic polypeptide
DEEEIRTTNPVATEQYGSVDSTMDGQEPILR

SEQ ID NO: 43254 - protein, 32 aa, Artificial Sequence
  Description of Artificial Sequence: Synthetic polypeptide
DEEEIRTTNPVATEQYGCVCSWNLNQNFGSNQ

SEQ ID NO: 43255 - protein, 32 aa, Artificial Sequence
  Description of Artificial Sequence: Synthetic polypeptide
DEEEIRTTNPVATEQYGSVSAPLQTESNEERQ

SEQ ID NO: 43256 - protein, 30 aa, Artificial Sequence
  Description of Artificial Sequence: Synthetic polypeptide
DEECIRCTNPVATEQYGSVSWNEGQMGDNL

SEQ ID NO: 43257 - protein, 30 aa, Artificial Sequence
  Description of Artificial Sequence: Synthetic polypeptide
DEEEIRTTNPVATEQYGSVSAPLQHTSIEQ

SEQ ID NO: 43258 - protein, 30 aa, Artificial Sequence
  Description of Artificial Sequence: Synthetic polypeptide
DEEEIRTTNPNATEEYGSVPATNQSGRGNA

SEQ ID NO: 43259 - protein, 30 aa, Artificial Sequence
  Description of Artificial Sequence: Synthetic polypeptide
DEEEIRTTNPVATEQYGSVSLGQTQHGEMA

SEQ ID NO: 43260 - protein, 33 aa, Artificial Sequence
  Description of Artificial Sequence: Synthetic polypeptide
DEEEIRTTNPVATEQYGCVCSTPALQRFGSNAA

SEQ ID NO: 43261 - protein, 30 aa, Artificial Sequence
  Description of Artificial Sequence: Synthetic polypeptide
DEECSRTTNPCAYEQYGCVSTNLQYFGSNR

SEQ ID NO: 43262 - protein, 30 aa, Artificial Sequence
  Description of Artificial Sequence: Synthetic polypeptide
DEEEIRTTNPNATEEYGSVATNHGRVGNDA

SEQ ID NO: 43263 - protein, 28 aa, Artificial Sequence
  Description of Artificial Sequence: Synthetic peptide
DEEEIRTTNPNATEEYGSVATNHGREEA

SEQ ID NO: 43264 - protein, 28 aa, Artificial Sequence
  Description of Artificial Sequence: Synthetic peptide
DEEEIRTTNPNATEEYGSVATNHGGNLA

SEQ ID NO: 43265 - protein, 29 aa, Artificial Sequence
  Description of Artificial Sequence: Synthetic peptide
DEEEIRTTNPNATEEYGSVATNHANFGNA

SEQ ID NO: 43266 - protein, 32 aa, Artificial Sequence
  Description of Artificial Sequence: Synthetic polypeptide
DEEEIRTTNPVATEQYGCVCSTPDQRFGSNPQ

SEQ ID NO: 43267 - protein, 32 aa, Artificial Sequence
  Description of Artificial Sequence: Synthetic polypeptide
DEEEIRTTNPVATEQYGCVCSTPHQERNSNRT

SEQ ID NO: 43268 - protein, 30 aa, Artificial Sequence
  Description of Artificial Sequence: Synthetic polypeptide
DEEEIRTTNPVATEQYGCVCSTPHQSTSNQ

SEQ ID NO: 43269 - protein, 32 aa, Artificial Sequence
  Description of Artificial Sequence: Synthetic polypeptide
DEEEIRTTNPMAYEQYGSVVPACTNLQRGNNA

SEQ ID NO: 43270 - protein, 32 aa, Artificial Sequence
  Description of Artificial Sequence: Synthetic polypeptide
DEEEIRTTNPVATEQYGCVCSTPLEGSGSNRM

SEQ ID NO: 43271 - protein, 31 aa, Artificial Sequence
  Description of Artificial Sequence: Synthetic polypeptide
DEEEIRTTNPVATEQYGCVCSTPLENFGNQY

SEQ ID NO: 43272 - protein, 29 aa, Artificial Sequence
  Description of Artificial Sequence: Synthetic peptide
DEECSATTNPIAYEQYGEVSTNLQRGNTS

SEQ ID NO: 43273 - protein, 29 aa, Artificial Sequence
  Description of Artificial Sequence: Synthetic peptide
DEEEIRTTNPNATEEYGSVVTNHGSGSNA

SEQ ID NO: 43274 - protein, 28 aa, Artificial Sequence
  Description of Artificial Sequence: Synthetic peptide
DEECSATTNPIAYEQYGEVSTNLQGGDR

SEQ ID NO: 43275 - protein, 31 aa, Artificial Sequence
  Description of Artificial Sequence: Synthetic polypeptide
DEEEIRTTNPVATEQYGSVSLGTLEGGNEPQ

SEQ ID NO: 43276 - protein, 33 aa, Artificial Sequence
  Description of Artificial Sequence: Synthetic polypeptide
DEEEIRTTNPVATEQYGSVESTPNDLQENIENT

SEQ ID NO: 43277 - protein, 31 aa, Artificial Sequence
  Description of Artificial Sequence: Synthetic polypeptide
DEEEIRTTNPSATEQYGSVPCTGLSARGKNE

SEQ ID NO: 43278 - protein, 32 aa, Artificial Sequence
  Description of Artificial Sequence: Synthetic polypeptide
DEEEIRTTNPSATEHYGQSVCSTPNPERLGNR

SEQ ID NO: 43279 - protein, 30 aa, Artificial Sequence
  Description of Artificial Sequence: Synthetic polypeptide
DEEEIRTTNPVATEQYGSVSLLLDDNQERN

SEQ ID NO: 43280 - protein, 30 aa, Artificial Sequence
  Description of Artificial Sequence: Synthetic polypeptide
DEEEIRTTNPSATDQYGQVPTDLSQRGGNQ

SEQ ID NO: 43281 - protein, 32 aa, Artificial Sequence
  Description of Artificial Sequence: Synthetic polypeptide
DEEEIRTTNPVATEQYGCVCSTNTQYFGSNLN

SEQ ID NO: 43282 - protein, 32 aa, Artificial Sequence
  Description of Artificial Sequence: Synthetic polypeptide
DEEEIRTTNPVATEQYGSVETGEVQMGLNPRD

SEQ ID NO: 43283 - protein, 29 aa, Artificial Sequence
  Description of Artificial Sequence: Synthetic peptide
DEECSRTTNPIAYEQYGEVSTNLEGGNRP

SEQ ID NO: 43284 - protein, 30 aa, Artificial Sequence
  Description of Artificial Sequence: Synthetic polypeptide
DEECSRTTNPIAYEQYGEVSITMNQQRGNR

SEQ ID NO: 43285 - protein, 28 aa, Artificial Sequence
  Description of Artificial Sequence: Synthetic peptide
DEECSRTTNPIAYEQYGEVSENLQRGTD

SEQ ID NO: 43286 - protein, 29 aa, Artificial Sequence
  Description of Artificial Sequence: Synthetic peptide
DEECSRTTNPIAYEQYGEVSENLQIGNRS

SEQ ID NO: 43287 - protein, 30 aa, Artificial Sequence
  Description of Artificial Sequence: Synthetic polypeptide
DEECSRTTNPIAYEQYGEVCSTNNLQRGNQ

SEQ ID NO: 43288 - protein, 33 aa, Artificial Sequence
  Description of Artificial Sequence: Synthetic polypeptide
DEEEIRTTNPVATEQYGSVESTWPGYQRGQVRP

SEQ ID NO: 43289 - protein, 33 aa, Artificial Sequence
  Description of Artificial Sequence: Synthetic polypeptide
DEEEIRTTNPVATEQYGSVSLINLQMGPEVDPR

SEQ ID NO: 43290 - protein, 33 aa, Artificial Sequence
  Description of Artificial Sequence: Synthetic polypeptide
DEEEIRTTNPVATEQYGSVSLINLQLIGPENQT

SEQ ID NO: 43291 - protein, 34 aa, Artificial Sequence
  Description of Artificial Sequence: Synthetic polypeptide
DEEEIRTTNPVATEQYGSVESTPNGLGRGEDHRS

SEQ ID NO: 43292 - protein, 29 aa, Artificial Sequence
  Description of Artificial Sequence: Synthetic peptide
DEECSRTTNPCAYEQYGEVSTNLQNGSNA

SEQ ID NO: 43293 - protein, 31 aa, Artificial Sequence
  Description of Artificial Sequence: Synthetic polypeptide
DEEEIRTTNPVATEQYGSVSIVGVGVRGELR

SEQ ID NO: 43294 - protein, 32 aa, Artificial Sequence
  Description of Artificial Sequence: Synthetic polypeptide
DEEEIRTTNPVATEQYGCVCSTPLNQRFNSNQ

SEQ ID NO: 43295 - protein, 31 aa, Artificial Sequence
  Description of Artificial Sequence: Synthetic polypeptide
DEEEIRTTNPVATEQYGCVCSTPLQNFNSQQ

SEQ ID NO: 43296 - protein, 32 aa, Artificial Sequence
  Description of Artificial Sequence: Synthetic polypeptide
DEEEIRTTNPVATEQYGSVEPNSLQTGQNQLM

SEQ ID NO: 43297 - protein, 32 aa, Artificial Sequence
  Description of Artificial Sequence: Synthetic polypeptide
DEEEIRTTNPVATEQYGSVEPMSNLQRGVEIE

SEQ ID NO: 43298 - protein, 32 aa, Artificial Sequence
  Description of Artificial Sequence: Synthetic polypeptide
DEEEIRTTNPVATEQYGSVEPLINLSQDIENR

SEQ ID NO: 43299 - protein, 31 aa, Artificial Sequence
  Description of Artificial Sequence: Synthetic polypeptide
DEEEIRTTNPVATEQYGSVSLGGLQELVLRP

SEQ ID NO: 43300 - protein, 32 aa, Artificial Sequence
  Description of Artificial Sequence: Synthetic polypeptide
DEEEIRTTNPVATEQYGSVEPFNLDQRGLQIE

SEQ ID NO: 43301 - protein, 33 aa, Artificial Sequence
  Description of Artificial Sequence: Synthetic polypeptide
DEEEIRTTNPVATEQYGSVENTWNGLQREGVTI

SEQ ID NO: 43302 - protein, 33 aa, Artificial Sequence
  Description of Artificial Sequence: Synthetic polypeptide
DEEEIRTTNPVATEQYGSVENTVDLQRGVNIVD

SEQ ID NO: 43303 - protein, 30 aa, Artificial Sequence
  Description of Artificial Sequence: Synthetic polypeptide
DEEEIRTTNPMATEQYGSVIATNMERINHQ

SEQ ID NO: 43304 - protein, 32 aa, Artificial Sequence
  Description of Artificial Sequence: Synthetic polypeptide
DEEEIRTTNPMATEQYGSVIATNLDERGSNHA

SEQ ID NO: 43305 - protein, 31 aa, Artificial Sequence
  Description of Artificial Sequence: Synthetic polypeptide
DEEEIRTTNPVATEQYGSVENTTNLYGNGTS

SEQ ID NO: 43306 - protein, 31 aa, Artificial Sequence
  Description of Artificial Sequence: Synthetic polypeptide
DEEEIRTTNPVATEQYGSVENTNVQDYGLEN

SEQ ID NO: 43307 - protein, 30 aa, Artificial Sequence
  Description of Artificial Sequence: Synthetic polypeptide
DEECIRCTNPVATEQYGSVSWNEGMQQGNL

SEQ ID NO: 43308 - protein, 32 aa, Artificial Sequence
  Description of Artificial Sequence: Synthetic polypeptide
DEEEIRTTNPMATEQYGSVCQTNLQNFGSNTA

SEQ ID NO: 43309 - protein, 32 aa, Artificial Sequence
  Description of Artificial Sequence: Synthetic polypeptide
DEEEIRTTNPVATEQYGSVENTFNEYPRQGTR

SEQ ID NO: 43310 - protein, 30 aa, Artificial Sequence
  Description of Artificial Sequence: Synthetic polypeptide
DEEEIRTTNPVATEQYGSVSAPANEQIIQP

SEQ ID NO: 43311 - protein, 32 aa, Artificial Sequence
  Description of Artificial Sequence: Synthetic polypeptide
DEEEIRTTNPVATEQYGSVEPTFLLYGRGERE

SEQ ID NO: 43312 - protein, 32 aa, Artificial Sequence
  Description of Artificial Sequence: Synthetic polypeptide
DEEEIRTTNPVATEQYGCVCSTPLQNFGNTQE

SEQ ID NO: 43313 - protein, 33 aa, Artificial Sequence
  Description of Artificial Sequence: Synthetic polypeptide
DEEEIRTTNPVATEQYGSVEPTHNQQQRGPNDN

SEQ ID NO: 43314 - protein, 33 aa, Artificial Sequence
  Description of Artificial Sequence: Synthetic polypeptide
DEEEIRTTNPVATEQYGSVEPTMNLTRMENERL

SEQ ID NO: 43315 - protein, 32 aa, Artificial Sequence
  Description of Artificial Sequence: Synthetic polypeptide
DEEEIRTTNPVATEQYGCVCSTPLQRFNSQQP

SEQ ID NO: 43316 - protein, 33 aa, Artificial Sequence
  Description of Artificial Sequence: Synthetic polypeptide
DEEEIRTTNPVATEQYGSVESGNLQGDEGGENI

SEQ ID NO: 43317 - protein, 32 aa, Artificial Sequence
  Description of Artificial Sequence: Synthetic polypeptide
DEEEIRTTNPVATEQYGSVEPTWLDQESQNGR

SEQ ID NO: 43318 - protein, 32 aa, Artificial Sequence
  Description of Artificial Sequence: Synthetic polypeptide
DEEEIRTTNPMAYEEYGQSVSTNDLEQRGMIR

SEQ ID NO: 43319 - protein, 32 aa, Artificial Sequence
  Description of Artificial Sequence: Synthetic polypeptide
DEEEIRTTNPVATEQYGSVEPTTLQHRDTNLE

SEQ ID NO: 43320 - protein, 28 aa, Artificial Sequence
  Description of Artificial Sequence: Synthetic peptide
DEECNATTNPIAYEQYGEVSTNDQRGNA

SEQ ID NO: 43321 - protein, 33 aa, Artificial Sequence
  Description of Artificial Sequence: Synthetic polypeptide
DEEEIRTTNPVATEQYGSVEPTSNLIQREENQN

SEQ ID NO: 43322 - protein, 34 aa, Artificial Sequence
  Description of Artificial Sequence: Synthetic polypeptide
DEEEIRTTNPVATEQYGSVEPTSMLQRMGPNDRE

SEQ ID NO: 43323 - protein, 31 aa, Artificial Sequence
  Description of Artificial Sequence: Synthetic polypeptide
DEEEIRTTNPMATEQYGSVVIATNLERGHHA

SEQ ID NO: 43324 - protein, 32 aa, Artificial Sequence
  Description of Artificial Sequence: Synthetic polypeptide
DEEEIATTNPVATEQYGSVCAANNLQSDGENR

SEQ ID NO: 43325 - protein, 30 aa, Artificial Sequence
  Description of Artificial Sequence: Synthetic polypeptide
DEEEIRTTNPVATEQYGSVEPTPVQVGEVT

SEQ ID NO: 43326 - protein, 32 aa, Artificial Sequence
  Description of Artificial Sequence: Synthetic polypeptide
DEEEIRTTNPVATEQYGSVEPTNLGQERQMTL

SEQ ID NO: 43327 - protein, 32 aa, Artificial Sequence
  Description of Artificial Sequence: Synthetic polypeptide
DEEEIRTTNPVATEQYGSVEPTNLGQELIGAE

SEQ ID NO: 43328 - protein, 32 aa, Artificial Sequence
  Description of Artificial Sequence: Synthetic polypeptide
DEEEIRTTNPVATEQYGSVEPTNLDIPRGLQI

SEQ ID NO: 43329 - protein, 32 aa, Artificial Sequence
  Description of Artificial Sequence: Synthetic polypeptide
DEEEIRTTNPVATEQYGSVSANLVNTEGVENG

SEQ ID NO: 43330 - protein, 30 aa, Artificial Sequence
  Description of Artificial Sequence: Synthetic polypeptide
DEEEIRTTNPVATEQYGSVSANNLENFIDT

SEQ ID NO: 43331 - protein, 30 aa, Artificial Sequence
  Description of Artificial Sequence: Synthetic polypeptide
DEEEIRTTNPSATEQYGSVPCTHLARGGSE

SEQ ID NO: 43332 - protein, 34 aa, Artificial Sequence
  Description of Artificial Sequence: Synthetic polypeptide
DEEEIRTTNPVATEQYGSVSITVNNEQVGENERL

SEQ ID NO: 43333 - protein, 33 aa, Artificial Sequence
  Description of Artificial Sequence: Synthetic polypeptide
DEEEIRTTNPVATEQYGSVDSPTNDLQQGVPML

SEQ ID NO: 43334 - protein, 33 aa, Artificial Sequence
  Description of Artificial Sequence: Synthetic polypeptide
DEEEIATTNPVATEQYGSVCATPNLQNQMGNDR

SEQ ID NO: 43335 - protein, 32 aa, Artificial Sequence
  Description of Artificial Sequence: Synthetic polypeptide
DEEEIRTTNPVATEQYGCVSNTALQGFGSNQS

SEQ ID NO: 43336 - protein, 32 aa, Artificial Sequence
  Description of Artificial Sequence: Synthetic polypeptide
DEEEIRTTNPVATEQYGCVSNTEDHQERGSNQ

SEQ ID NO: 43337 - protein, 31 aa, Artificial Sequence
  Description of Artificial Sequence: Synthetic polypeptide
DEEEIRTTNPVATEQYGCVSNTEDQNGSNAS

SEQ ID NO: 43338 - protein, 33 aa, Artificial Sequence
  Description of Artificial Sequence: Synthetic polypeptide
DEEEIRTTNPVATEQYGSVCTNALQVRLGDDVE

SEQ ID NO: 43339 - protein, 31 aa, Artificial Sequence
  Description of Artificial Sequence: Synthetic polypeptide
DEEEIATTNPVATEQYGSVCATVLQDGDNGD

SEQ ID NO: 43340 - protein, 32 aa, Artificial Sequence
  Description of Artificial Sequence: Synthetic polypeptide
DEEEIATTNPVATEQYGSVCATPNLQMQGNDQ

SEQ ID NO: 43341 - protein, 31 aa, Artificial Sequence
  Description of Artificial Sequence: Synthetic polypeptide
DEEEIRTTNPVATEQYGCVSNTEGNQRGSEF

SEQ ID NO: 43342 - protein, 32 aa, Artificial Sequence
  Description of Artificial Sequence: Synthetic polypeptide
DEEEIRTTNPVATEQYGCVSNTELQHSGSERF

SEQ ID NO: 43343 - protein, 28 aa, Artificial Sequence
  Description of Artificial Sequence: Synthetic peptide
DEEEIRTTNPIATAQYGQVPTDLQDGGF

SEQ ID NO: 43344 - protein, 33 aa, Artificial Sequence
  Description of Artificial Sequence: Synthetic polypeptide
DEEEIRTTNPVATEQYGCVSNTELQNFGSENRF

SEQ ID NO: 43345 - protein, 30 aa, Artificial Sequence
  Description of Artificial Sequence: Synthetic polypeptide
DEEEIATTNPVATEQYGSVCEQNGQRVGVN

SEQ ID NO: 43346 - protein, 31 aa, Artificial Sequence
  Description of Artificial Sequence: Synthetic polypeptide
DEECIRTTNPVATECYGQVTTNLQGDGSNSR

SEQ ID NO: 43347 - protein, 32 aa, Artificial Sequence
  Description of Artificial Sequence: Synthetic polypeptide
DEEEIATTNPVATEQYGSVCSATNDIQDNGNH

SEQ ID NO: 43348 - protein, 32 aa, Artificial Sequence
  Description of Artificial Sequence: Synthetic polypeptide
DEEEIRTTNPVATEQYGCVSNTELQEGGSERF

SEQ ID NO: 43349 - protein, 32 aa, Artificial Sequence
  Description of Artificial Sequence: Synthetic polypeptide
DEEEIRTTNPVATEQYGCVSMSNLQSFGSERT

SEQ ID NO: 43350 - protein, 30 aa, Artificial Sequence
  Description of Artificial Sequence: Synthetic polypeptide
DEEEIATTNPVATEQYGSVCATPLEMGEDR

SEQ ID NO: 43351 - protein, 33 aa, Artificial Sequence
  Description of Artificial Sequence: Synthetic polypeptide
DEEEIRTTNPVATEQYGCVSLTGNHQRFGSNQP

SEQ ID NO: 43352 - protein, 32 aa, Artificial Sequence
  Description of Artificial Sequence: Synthetic polypeptide
DEEEIATTNPVATEQYGSVCATNPLQDQMGNE

SEQ ID NO: 43353 - protein, 32 aa, Artificial Sequence
  Description of Artificial Sequence: Synthetic polypeptide
DEEEIRTTNPVATEQYGCVSDTYLDQRFSQNQ

SEQ ID NO: 43354 - protein, 31 aa, Artificial Sequence
  Description of Artificial Sequence: Synthetic polypeptide
DEEEIATTNPVATEQYGSVCATNPLTDQGND

SEQ ID NO: 43355 - protein, 32 aa, Artificial Sequence
  Description of Artificial Sequence: Synthetic polypeptide
DEEEIRTTNPVATEQYGSVSCLDLQRTDNQDG

SEQ ID NO: 43356 - protein, 32 aa, Artificial Sequence
  Description of Artificial Sequence: Synthetic polypeptide
DEEEIRTTNPVATEQYGSVSITNLTGGLFETD

SEQ ID NO: 43357 - protein, 30 aa, Artificial Sequence
  Description of Artificial Sequence: Synthetic polypeptide
DEEEIRTTNPVATEQYGCVSEVNDNREGDQ

SEQ ID NO: 43358 - protein, 33 aa, Artificial Sequence
  Description of Artificial Sequence: Synthetic polypeptide
DEEEIRTTNPVATEQYGSVSITNLSGVGNNQGQ

SEQ ID NO: 43359 - protein, 33 aa, Artificial Sequence
  Description of Artificial Sequence: Synthetic polypeptide
DEEEIRTTNPVATEQYGSVSITNLSGVGGENID

SEQ ID NO: 43360 - protein, 30 aa, Artificial Sequence
  Description of Artificial Sequence: Synthetic polypeptide
DEEEIRTTNPVATEQYGSVSCNDEVPLEER

SEQ ID NO: 43361 - protein, 29 aa, Artificial Sequence
  Description of Artificial Sequence: Synthetic peptide
DEEEIRTTNPVATEQYGCVSFNDQMSEGI

SEQ ID NO: 43362 - protein, 31 aa, Artificial Sequence
  Description of Artificial Sequence: Synthetic polypeptide
DEEEIRTTNPVATEQYGCVSFVNLDQRDDQQ

SEQ ID NO: 43363 - protein, 32 aa, Artificial Sequence
  Description of Artificial Sequence: Synthetic polypeptide
DEEEIRTTNPVATEQYGCVSGTNNHQERDMER

SEQ ID NO: 43364 - protein, 31 aa, Artificial Sequence
  Description of Artificial Sequence: Synthetic polypeptide
DEEEIRTTNPVATEQYGSVCTNINETTGNSD

SEQ ID NO: 43365 - protein, 32 aa, Artificial Sequence
  Description of Artificial Sequence: Synthetic polypeptide
DEEEIRTTNPVATEQYGCVSKTNNPQLREGPQ

SEQ ID NO: 43366 - protein, 33 aa, Artificial Sequence
  Description of Artificial Sequence: Synthetic polypeptide
DEECIRTTNPVATEAYGSTVSCTNMLQSDGNPR

SEQ ID NO: 43367 - protein, 34 aa, Artificial Sequence
  Description of Artificial Sequence: Synthetic polypeptide
DEEEIRTTNPVATEQYGSVCSWTNWLQLDVQNDR

SEQ ID NO: 43368 - protein, 33 aa, Artificial Sequence
  Description of Artificial Sequence: Synthetic polypeptide
DEEEIRTTNPVATEQYGCVSNTELQRFGSETRA

SEQ ID NO: 43369 - protein, 32 aa, Artificial Sequence
  Description of Artificial Sequence: Synthetic polypeptide
DEEEIRTTNPVATEQYGCVSNTGALQYFGSNQ

SEQ ID NO: 43370 - protein, 34 aa, Artificial Sequence
  Description of Artificial Sequence: Synthetic polypeptide
DEEEIATTNPVATEQYGSVCSKTNDLQDQRGNEK

SEQ ID NO: 43371 - protein, 30 aa, Artificial Sequence
  Description of Artificial Sequence: Synthetic polypeptide
DEEEIRTTNPVATEQYGSVCSWELERNSEQ

SEQ ID NO: 43372 - protein, 32 aa, Artificial Sequence
  Description of Artificial Sequence: Synthetic polypeptide
DEEEIRTTNPVATEQYGSVCSVTGLEDTRGDD

SEQ ID NO: 43373 - protein, 34 aa, Artificial Sequence
  Description of Artificial Sequence: Synthetic polypeptide
DEEEIRTTNPVATEQYGSVCSVTENLQRFGSEQT

SEQ ID NO: 43374 - protein, 33 aa, Artificial Sequence
  Description of Artificial Sequence: Synthetic polypeptide
DEEEIRTTNPVATEQYGSVSCNVLQRVEEEERS

SEQ ID NO: 43375 - protein, 30 aa, Artificial Sequence
  Description of Artificial Sequence: Synthetic polypeptide
DEEEIRTTNPFATEWYGSVCSYNIFREGND

SEQ ID NO: 43376 - protein, 31 aa, Artificial Sequence
  Description of Artificial Sequence: Synthetic polypeptide
DEEEIRTTNPVATEQYGSVCSVTDLERNPQF

SEQ ID NO: 43377 - protein, 32 aa, Artificial Sequence
  Description of Artificial Sequence: Synthetic polypeptide
DEEEIRTTNPVATEQYGSVSCPPIQQRGIVRL

SEQ ID NO: 43378 - protein, 31 aa, Artificial Sequence
  Description of Artificial Sequence: Synthetic polypeptide
DEEEIRTTNPVATEQYGSVCSVDGTEDGNER

SEQ ID NO: 43379 - protein, 31 aa, Artificial Sequence
  Description of Artificial Sequence: Synthetic polypeptide
DEEEIATTNPVATEQYGSVCSTNLEHGIEDQ

SEQ ID NO: 43380 - protein, 32 aa, Artificial Sequence
  Description of Artificial Sequence: Synthetic polypeptide
DEEEIATTNPVATEQYGSVCSTNLGERPNLIG

SEQ ID NO: 43381 - protein, 33 aa, Artificial Sequence
  Description of Artificial Sequence: Synthetic polypeptide
DEEEIATTNPVATEQYGSVCSTNLQEHFGSNQY

SEQ ID NO: 43382 - protein, 31 aa, Artificial Sequence
  Description of Artificial Sequence: Synthetic polypeptide
DEEEIRTTNPVATEQYGSVSCPPLARGVVED

SEQ ID NO: 43383 - protein, 33 aa, Artificial Sequence
  Description of Artificial Sequence: Synthetic polypeptide
DEEEIRTTNPVATEQYGSVSCPPSLQEREVNDR

SEQ ID NO: 43384 - protein, 32 aa, Artificial Sequence
  Description of Artificial Sequence: Synthetic polypeptide
DEEEIATTNPVATEQYGSVCSTNNDIQDNGNE

SEQ ID NO: 43385 - protein, 33 aa, Artificial Sequence
  Description of Artificial Sequence: Synthetic polypeptide
DEEEIATTNPVATEQYGSVCSTNNLNPDNGNRL

SEQ ID NO: 43386 - protein, 32 aa, Artificial Sequence
  Description of Artificial Sequence: Synthetic polypeptide
DEEEIRTTNPVATEQYGSVCSWELNQNGSNQS

SEQ ID NO: 43387 - protein, 32 aa, Artificial Sequence
  Description of Artificial Sequence: Synthetic polypeptide
DEEEIRTTNPVATEQYGCVSDTELQRFNSDQS

SEQ ID NO: 43388 - protein, 32 aa, Artificial Sequence
  Description of Artificial Sequence: Synthetic polypeptide
DEEEIATTNPVATEQYGSVCSPTNLPDNMNER

SEQ ID NO: 43389 - protein, 30 aa, Artificial Sequence
  Description of Artificial Sequence: Synthetic polypeptide
DEEEIRTTNPVATEQYGSVCSWETQNGSEQ

SEQ ID NO: 43390 - protein, 32 aa, Artificial Sequence
  Description of Artificial Sequence: Synthetic polypeptide
DEEEIRTTNPVATEQYGSVCSWNPNQNFGSNQ

SEQ ID NO: 43391 - protein, 32 aa, Artificial Sequence
  Description of Artificial Sequence: Synthetic polypeptide
DEEEIRTTNPVATEQYGSVCSWNLQYFGSETQ

SEQ ID NO: 43392 - protein, 32 aa, Artificial Sequence
  Description of Artificial Sequence: Synthetic polypeptide
DEEEIRTTNPVATEQYGSVCSWNLQNSGSQQP

SEQ ID NO: 43393 - protein, 32 aa, Artificial Sequence
  Description of Artificial Sequence: Synthetic polypeptide
DEEEIRTTNPVATEQYGSVCSWNLQNFNSEQS

SEQ ID NO: 43394 - protein, 32 aa, Artificial Sequence
  Description of Artificial Sequence: Synthetic polypeptide
DEEEIRTTNPVATEQYGSVCSWNLQGFGSVDM

SEQ ID NO: 43395 - protein, 31 aa, Artificial Sequence
  Description of Artificial Sequence: Synthetic polypeptide
DEEEIRTTNPVATEQYGSVCSWNLQFNSQDS

SEQ ID NO: 43396 - protein, 32 aa, Artificial Sequence
  Description of Artificial Sequence: Synthetic polypeptide
DEEEIRTTNPVATEQYGSVCSWNHQNGSNNAS

SEQ ID NO: 43397 - protein, 31 aa, Artificial Sequence
  Description of Artificial Sequence: Synthetic polypeptide
DEEEIRTTNPVATEQYGSVCSWNHQGGSQQP

SEQ ID NO: 43398 - protein, 32 aa, Artificial Sequence
  Description of Artificial Sequence: Synthetic polypeptide
DEEEIRTTNPVATEQYGSVCSWMLQAQPNDRP

SEQ ID NO: 43399 - protein, 32 aa, Artificial Sequence
  Description of Artificial Sequence: Synthetic polypeptide
DEEEIRTTNPVATEQYGSVCSWGNLQGFGSQQ

SEQ ID NO: 43400 - protein, 33 aa, Artificial Sequence
  Description of Artificial Sequence: Synthetic polypeptide
DEEEIRTTNPVATEQYGSVCSWGNLQGFGSNND

SEQ ID NO: 43401 - protein, 33 aa, Artificial Sequence
  Description of Artificial Sequence: Synthetic polypeptide
DEEEIRTTNPVATEQYGSVCSWGNLQEGGSNDS

SEQ ID NO: 43402 - protein, 32 aa, Artificial Sequence
  Description of Artificial Sequence: Synthetic polypeptide
DEEEIRTTNPVATEQYGSVCSWGNHQGGSNDM

SEQ ID NO: 43403 - protein, 31 aa, Artificial Sequence
  Description of Artificial Sequence: Synthetic polypeptide
DEEEIRTTNPVATEQYGSVCSWGNDQGGSED

SEQ ID NO: 43404 - protein, 32 aa, Artificial Sequence
  Description of Artificial Sequence: Synthetic polypeptide
DEEEIRTTNPVATEQYGSVCSWGEHQNGSNRY

SEQ ID NO: 43405 - protein, 33 aa, Artificial Sequence
  Description of Artificial Sequence: Synthetic polypeptide
DEEEIRTTNPVATEQYGSVCSWENHQNFGSNNR

SEQ ID NO: 43406 - protein, 31 aa, Artificial Sequence
  Description of Artificial Sequence: Synthetic polypeptide
DEEEIRTTNPVATEQYGCVSDTALDQNSQNQ

SEQ ID NO: 43407 - protein, 31 aa, Artificial Sequence
  Description of Artificial Sequence: Synthetic polypeptide
DEECIRTTNPVAGEQYGYQVSTINHQRGNAN

SEQ ID NO: 43408 - protein, 33 aa, Artificial Sequence
  Description of Artificial Sequence: Synthetic polypeptide
DEEEIRTTNPVATEQYGSVCTNLNQQRQSQEQR

SEQ ID NO: 43409 - protein, 30 aa, Artificial Sequence
  Description of Artificial Sequence: Synthetic polypeptide
DEEEIRTTNPVATEQYGSVDCDMDLCNGNC

SEQ ID NO: 43410 - protein, 33 aa, Artificial Sequence
  Description of Artificial Sequence: Synthetic polypeptide
DEEEIRTTNPVATEQYGSVSITPNQMQRVTVNE

SEQ ID NO: 43411 - protein, 31 aa, Artificial Sequence
  Description of Artificial Sequence: Synthetic polypeptide
DEEEIRTTNPIATEQYGSVSEALNMRNGNPV

SEQ ID NO: 43412 - protein, 31 aa, Artificial Sequence
  Description of Artificial Sequence: Synthetic polypeptide
DEEEIRTTNPVATEQYGSVCYNLQELVENNS

SEQ ID NO: 43413 - protein, 31 aa, Artificial Sequence
  Description of Artificial Sequence: Synthetic polypeptide
DEEEIRTTNPIATEQYGSVSCINHSFRGGND

SEQ ID NO: 43414 - protein, 31 aa, Artificial Sequence
  Description of Artificial Sequence: Synthetic polypeptide
DEEEIRTTNPIATEQYGSVSCINEISTRGND

SEQ ID NO: 43415 - protein, 32 aa, Artificial Sequence
  Description of Artificial Sequence: Synthetic polypeptide
DEEEIRTTNPVATEQYGSVSITPDGILQLMER

SEQ ID NO: 43416 - protein, 32 aa, Artificial Sequence
  Description of Artificial Sequence: Synthetic polypeptide
DEEEIRTTNPVATEQYGSVSITPDDQLSENRV

SEQ ID NO: 43417 - protein, 30 aa, Artificial Sequence
  Description of Artificial Sequence: Synthetic polypeptide
DEEEIRTTNPIATEQYGSVSAEDLEDRGEL

SEQ ID NO: 43418 - protein, 29 aa, Artificial Sequence
  Description of Artificial Sequence: Synthetic peptide
DEEEIRTTNPVATEQYGSVCTVNQTETQI

SEQ ID NO: 43419 - protein, 33 aa, Artificial Sequence
  Description of Artificial Sequence: Synthetic polypeptide
DEEEIRTTNPVATEQYGSVCTTPTLQREGNDLN

SEQ ID NO: 43420 - protein, 33 aa, Artificial Sequence
  Description of Artificial Sequence: Synthetic polypeptide
DEEEIRTTNPVATEQYGSVSITNVDQQGVGNED

SEQ ID NO: 43421 - protein, 32 aa, Artificial Sequence
  Description of Artificial Sequence: Synthetic polypeptide
DEEEIRTTNPVATEQYGCVETNLQEGFGSNQA

SEQ ID NO: 43422 - protein, 30 aa, Artificial Sequence
  Description of Artificial Sequence: Synthetic polypeptide
DEECIRTTNPVAAEQYGQVSTINVQNGNDD

SEQ ID NO: 43423 - protein, 30 aa, Artificial Sequence
  Description of Artificial Sequence: Synthetic polypeptide
DEEEIRTTNPIATEQYGSISEDIQQQNGNR

SEQ ID NO: 43424 - protein, 31 aa, Artificial Sequence
  Description of Artificial Sequence: Synthetic polypeptide
DEEEIRTTNPVATEQYGSVDCTSQQHQPDNR

SEQ ID NO: 43425 - protein, 32 aa, Artificial Sequence
  Description of Artificial Sequence: Synthetic polypeptide
DEEEIRTTNPVATEQYGSVSITNSNQSVGEQQ

SEQ ID NO: 43426 - protein, 32 aa, Artificial Sequence
  Description of Artificial Sequence: Synthetic polypeptide
DEEEIRTTNPVATEQYGSVDDPTFVLQRQNEN

SEQ ID NO: 43427 - protein, 32 aa, Artificial Sequence
  Description of Artificial Sequence: Synthetic polypeptide
DEEEIRTTNPVATEQYGSVDDPTNDQRGELVV

SEQ ID NO: 43428 - protein, 34 aa, Artificial Sequence
  Description of Artificial Sequence: Synthetic polypeptide
DEEEIRTTNPVATEQYGSVDSPTINLQRGEESQD

SEQ ID NO: 43429 - protein, 32 aa, Artificial Sequence
  Description of Artificial Sequence: Synthetic polypeptide
DEEEIRTTNPVATEQYGSVDSPEMNLQELANQ

SEQ ID NO: 43430 - protein, 32 aa, Artificial Sequence
  Description of Artificial Sequence: Synthetic polypeptide
DEEEIRTTNPIATEQYGSVSTTPAGPNRNGNR

SEQ ID NO: 43431 - protein, 32 aa, Artificial Sequence
  Description of Artificial Sequence: Synthetic polypeptide
DEEEIRTTNPVATEQYGSVDQTNEGQEEDNIR

SEQ ID NO: 43432 - protein, 32 aa, Artificial Sequence
  Description of Artificial Sequence: Synthetic polypeptide
DEEEIRTTNPVATEQYGSVDPTTLHQPGEEER

SEQ ID NO: 43433 - protein, 32 aa, Artificial Sequence
  Description of Artificial Sequence: Synthetic polypeptide
DEEEIRTTNPVATEQYGSVDPLNLQPLGELRT

SEQ ID NO: 43434 - protein, 32 aa, Artificial Sequence
  Description of Artificial Sequence: Synthetic polypeptide
DEEEIRTTNPIATEQYGSVSTEPAGPNRGNPR

SEQ ID NO: 43435 - protein, 32 aa, Artificial Sequence
  Description of Artificial Sequence: Synthetic polypeptide
DEEEIRTTNPIATEQYGSVSTEALNMRNGNPV

SEQ ID NO: 43436 - protein, 32 aa, Artificial Sequence
  Description of Artificial Sequence: Synthetic polypeptide
DEEEIRTTNPVATEQYGSVDNPTYLQQDVNRI

SEQ ID NO: 43437 - protein, 33 aa, Artificial Sequence
  Description of Artificial Sequence: Synthetic polypeptide
DEEEIRTTNPVATEQYGCVDSNTENHQRFGSND

SEQ ID NO: 43438 - protein, 32 aa, Artificial Sequence
  Description of Artificial Sequence: Synthetic polypeptide
DEEEIRTTNPVATEQYGSVSITSLQTEVNEYD

SEQ ID NO: 43439 - protein, 31 aa, Artificial Sequence
  Description of Artificial Sequence: Synthetic polypeptide
DEEEIRTTNPVATEQYGSVDGQMNLTGGNFE

SEQ ID NO: 43440 - protein, 32 aa, Artificial Sequence
  Description of Artificial Sequence: Synthetic polypeptide
DEEEIRTTNPVATEQYGSVDDYNLNQYGEDDR

SEQ ID NO: 43441 - protein, 31 aa, Artificial Sequence
  Description of Artificial Sequence: Synthetic polypeptide
DEEEIRTTNPVATEQYGSVDDTGLQQMVNTQ

SEQ ID NO: 43442 - protein, 30 aa, Artificial Sequence
  Description of Artificial Sequence: Synthetic polypeptide
DEECIRTTNPCATETYGQVTTNLQGDGSNR

SEQ ID NO: 43443 - protein, 31 aa, Artificial Sequence
  Description of Artificial Sequence: Synthetic polypeptide
DEEEIRTTNPIATEQYGSVSEPAGPNRGNPR

SEQ ID NO: 43444 - protein, 32 aa, Artificial Sequence
  Description of Artificial Sequence: Synthetic polypeptide
DEEEIRTTNPVATEQYGSVDSPTNLSTSGEEF

SEQ ID NO: 43445 - protein, 30 aa, Artificial Sequence
  Description of Artificial Sequence: Synthetic polypeptide
DEEEIRTTNPIATEQWGSVSENLMNRAEDR

SEQ ID NO: 43446 - protein, 32 aa, Artificial Sequence
  Description of Artificial Sequence: Synthetic polypeptide
DEEEIRTTNPVATEQYGSVCTPNLPRGVEGID

SEQ ID NO: 43447 - protein, 29 aa, Artificial Sequence
  Description of Artificial Sequence: Synthetic peptide
DEEEIRTTNPIATECYGSCSTNDAHGNAQ

SEQ ID NO: 43448 - protein, 32 aa, Artificial Sequence
  Description of Artificial Sequence: Synthetic polypeptide
DEEEIATTNPVATEQYGSVCATNLEPEEGDNR

SEQ ID NO: 43449 - protein, 30 aa, Artificial Sequence
  Description of Artificial Sequence: Synthetic polypeptide
DEEEIRTTNPIATECYGSCSTGNDDRGNGA

SEQ ID NO: 43450 - protein, 31 aa, Artificial Sequence
  Description of Artificial Sequence: Synthetic polypeptide
DEEEIATTNPVATEQYGSVCATNLQDQLGDE

SEQ ID NO: 43451 - protein, 31 aa, Artificial Sequence
  Description of Artificial Sequence: Synthetic polypeptide
DEEEIATTNPVATEQYGSVCATNLTQDLNDD

SEQ ID NO: 43452 - protein, 32 aa, Artificial Sequence
  Description of Artificial Sequence: Synthetic polypeptide
DEEEIRTTNPVATEQYGSVCTNLQDPGDTDPH

SEQ ID NO: 43453 - protein, 31 aa, Artificial Sequence
  Description of Artificial Sequence: Synthetic polypeptide
DEEEIATTNPVATEQYGSVCATNNLQDLNDE

SEQ ID NO: 43454 - protein, 31 aa, Artificial Sequence
  Description of Artificial Sequence: Synthetic polypeptide
DEECIRTTNPVAEEQYGEVSTINDQRDGNND

SEQ ID NO: 43455 - protein, 32 aa, Artificial Sequence
  Description of Artificial Sequence: Synthetic polypeptide
DEEEIRTTNPVATEQYGCVSCTNGNQRGSEQS

SEQ ID NO: 43456 - protein, 33 aa, Artificial Sequence
  Description of Artificial Sequence: Synthetic polypeptide
DEEEIRTTNPVATEQYGSVSCINEPQDREGENG

SEQ ID NO: 43457 - protein, 31 aa, Artificial Sequence
  Description of Artificial Sequence: Synthetic polypeptide
DEEEIRTTNPVATEQYGCVSCTNHNQNFGEF

SEQ ID NO: 43458 - protein, 30 aa, Artificial Sequence
  Description of Artificial Sequence: Synthetic polypeptide
DEECIRTTNPVAEEQYGQVSTINDGDRGNN

SEQ ID NO: 43459 - protein, 31 aa, Artificial Sequence
  Description of Artificial Sequence: Synthetic polypeptide
DEECIRTTNPVAEEQYGQVSTINEVQRGNNF

SEQ ID NO: 43460 - protein, 33 aa, Artificial Sequence
  Description of Artificial Sequence: Synthetic polypeptide
DEEEIRTTNPVATEQYGSVSCINGPQDRNGMNV

SEQ ID NO: 43461 - protein, 34 aa, Artificial Sequence
  Description of Artificial Sequence: Synthetic polypeptide
DEEEIRTTNPVATEQYGCVSCTQNLQDRSGEERN

SEQ ID NO: 43462 - protein, 28 aa, Artificial Sequence
  Description of Artificial Sequence: Synthetic peptide
DEECISTVNPVATEWYGCVSWNLEYGNR

SEQ ID NO: 43463 - protein, 31 aa, Artificial Sequence
  Description of Artificial Sequence: Synthetic polypeptide
DEEEIRTTNPVATEQYGSVSATNTYERSDMS

SEQ ID NO: 43464 - protein, 31 aa, Artificial Sequence
  Description of Artificial Sequence: Synthetic polypeptide
DEEEIATTNPVATEQYGSVCATNLAPDGNDQ

SEQ ID NO: 43465 - protein, 32 aa, Artificial Sequence
  Description of Artificial Sequence: Synthetic polypeptide
DEEEIRTTNPVATEQYGSVCTNLSDVIMNNRI

SEQ ID NO: 43466 - protein, 33 aa, Artificial Sequence
  Description of Artificial Sequence: Synthetic polypeptide
DEEEIRTTNPVATEQYGSVSITNQNQNNIGGNQ

SEQ ID NO: 43467 - protein, 33 aa, Artificial Sequence
  Description of Artificial Sequence: Synthetic polypeptide
DEEEIRTTNPVATEQYGSVSATPMGEQRQGVDR

SEQ ID NO: 43468 - protein, 32 aa, Artificial Sequence
  Description of Artificial Sequence: Synthetic polypeptide
DEEEIRTTNPVATEQYGSVSATPNFLQQFEEN

SEQ ID NO: 43469 - protein, 33 aa, Artificial Sequence
  Description of Artificial Sequence: Synthetic polypeptide
DEEEIRTTNPVATEQYGSVSATPNGGSQRINHE

SEQ ID NO: 43470 - protein, 30 aa, Artificial Sequence
  Description of Artificial Sequence: Synthetic polypeptide
DEEEIRTTNPIATEQWGSTSEEDLARGNYR

SEQ ID NO: 43471 - protein, 31 aa, Artificial Sequence
  Description of Artificial Sequence: Synthetic polypeptide
DEECIRTTNPVACEQYGQVSTINVQRDGNND

SEQ ID NO: 43472 - protein, 34 aa, Artificial Sequence
  Description of Artificial Sequence: Synthetic polypeptide
DEEEIRTTNPVATEQYGSVSATPNGLETRGNPEA

SEQ ID NO: 43473 - protein, 32 aa, Artificial Sequence
  Description of Artificial Sequence: Synthetic polypeptide
DEEEIRTTNPVATEQYGCVQNTGNLAERGDRG

SEQ ID NO: 43474 - protein, 32 aa, Artificial Sequence
  Description of Artificial Sequence: Synthetic polypeptide
DEEEIRTTNPVATEQYGCVQSSNLQNFGSNDG

SEQ ID NO: 43475 - protein, 32 aa, Artificial Sequence
  Description of Artificial Sequence: Synthetic polypeptide
DEEEIRTTNPVATEQYGCVQSTNPQSFGSNDA

SEQ ID NO: 43476 - protein, 31 aa, Artificial Sequence
  Description of Artificial Sequence: Synthetic polypeptide
DEEEIRTTNPVATEQYGSVCTNMQREPEEEY

SEQ ID NO: 43477 - protein, 33 aa, Artificial Sequence
  Description of Artificial Sequence: Synthetic polypeptide
DEEEIRTTNPVATEQYGSVSITNNDEQENGTNQ

SEQ ID NO: 43478 - protein, 33 aa, Artificial Sequence
  Description of Artificial Sequence: Synthetic polypeptide
DEEEIRTTNPVATEQYGSVCTNMLPQVRLGDVE

SEQ ID NO: 43479 - protein, 33 aa, Artificial Sequence
  Description of Artificial Sequence: Synthetic polypeptide
DEEEIRTTNPVATEQYGCVQSTTNHQRFGSNQA

SEQ ID NO: 43480 - protein, 28 aa, Artificial Sequence
  Description of Artificial Sequence: Synthetic peptide
DEECLRTTNPCAYEQWGEVSTNLQHGNA

SEQ ID NO: 43481 - protein, 32 aa, Artificial Sequence
  Description of Artificial Sequence: Synthetic polypeptide
DEEEIATTNPVATEQYGSVCATNGLQDSGNAE

SEQ ID NO: 43482 - protein, 33 aa, Artificial Sequence
  Description of Artificial Sequence: Synthetic polypeptide
DEEEIRTTNPVATEQYGCVCSTNTQEYFGSNRM

SEQ ID NO: 43483 - protein, 31 aa, Artificial Sequence
  Description of Artificial Sequence: Synthetic polypeptide
DEEEIRTTNPVATEQYGCVCSTNPQYFNSDQ

SEQ ID NO: 43484 - protein, 31 aa, Artificial Sequence
  Description of Artificial Sequence: Synthetic polypeptide
DEEEIATTNPVATEQYGSVCAANLQSMNDRT

SEQ ID NO: 43485 - protein, 33 aa, Artificial Sequence
  Description of Artificial Sequence: Synthetic polypeptide
DEEEIRTTNPVATEQYGSVSACPDLQRSGNEQN

SEQ ID NO: 43486 - protein, 31 aa, Artificial Sequence
  Description of Artificial Sequence: Synthetic polypeptide
DEEEIATTNPVATEQYGSVATNDQDQGEDNS

SEQ ID NO: 43487 - protein, 33 aa, Artificial Sequence
  Description of Artificial Sequence: Synthetic polypeptide
DEEEIRTTNPVATEQYGSVSLTNGLQLVVENQV

SEQ ID NO: 43488 - protein, 33 aa, Artificial Sequence
  Description of Artificial Sequence: Synthetic polypeptide
DEEEIRTTNPVATEQYGSVSLTNGGSQTGELRQ

SEQ ID NO: 43489 - protein, 31 aa, Artificial Sequence
  Description of Artificial Sequence: Synthetic polypeptide
DEEEIATTNPVATEQYGSVATNDQNNGDNET

SEQ ID NO: 43490 - protein, 31 aa, Artificial Sequence
  Description of Artificial Sequence: Synthetic polypeptide
DEEEIRTTNPVATEQYGSVSADLDSLGSEDR

SEQ ID NO: 43491 - protein, 32 aa, Artificial Sequence
  Description of Artificial Sequence: Synthetic polypeptide
DEEEIRTTNPVATEQYGSVSLTNHNTGDGDSR

SEQ ID NO: 43492 - protein, 29 aa, Artificial Sequence
  Description of Artificial Sequence: Synthetic peptide
DEEEIRTTNPVAHEQYGSVNTNEQGDDQG

SEQ ID NO: 43493 - protein, 31 aa, Artificial Sequence
  Description of Artificial Sequence: Synthetic polypeptide
DEEEIRTTNPVATEQYGSVSLTNEQVNSEIV

SEQ ID NO: 43494 - protein, 31 aa, Artificial Sequence
  Description of Artificial Sequence: Synthetic polypeptide
DEEEIRTTNPVATEQYGSVSLTNEHRIQEED

SEQ ID NO: 43495 - protein, 31 aa, Artificial Sequence
  Description of Artificial Sequence: Synthetic polypeptide
DEEEIAATNPVATEQYGSVSTNTVERGGNTD

SEQ ID NO: 43496 - protein, 31 aa, Artificial Sequence
  Description of Artificial Sequence: Synthetic polypeptide
DEEEIRTTNPVATEQYGCVCSTNHQFLSNAY

SEQ ID NO: 43497 - protein, 31 aa, Artificial Sequence
  Description of Artificial Sequence: Synthetic polypeptide
DEEEIRTTNPVATEQYGCVCSTNHQFNSNQM

SEQ ID NO: 43498 - protein, 31 aa, Artificial Sequence
  Description of Artificial Sequence: Synthetic polypeptide
DEEEIATTNPVATEQYGSVATNGLFQEAGEF

SEQ ID NO: 43499 - protein, 30 aa, Artificial Sequence
  Description of Artificial Sequence: Synthetic polypeptide
DEEEIATTNPVATEQYGSVATNDQRDDPDA

SEQ ID NO: 43500 - protein, 30 aa, Artificial Sequence
  Description of Artificial Sequence: Synthetic polypeptide
DEEEIATTNPVATEQYGSVATNDENRNNPV

SEQ ID NO: 43501 - protein, 33 aa, Artificial Sequence
  Description of Artificial Sequence: Synthetic polypeptide
DEEEIRTTNPVATEQYGSVSLTNLEGERGMPIE

SEQ ID NO: 43502 - protein, 30 aa, Artificial Sequence
  Description of Artificial Sequence: Synthetic polypeptide
DEEEIRTTNPVAHEQYGSVNTNLQNFDQGG

SEQ ID NO: 43503 - protein, 32 aa, Artificial Sequence
  Description of Artificial Sequence: Synthetic polypeptide
DEEEIRTTNPVATEQYGSVGNTGNLIERGEQS

SEQ ID NO: 43504 - protein, 29 aa, Artificial Sequence
  Description of Artificial Sequence: Synthetic peptide
DEEEIACTNPIATEQYGSVSTDLMHEGNL

SEQ ID NO: 43505 - protein, 31 aa, Artificial Sequence
  Description of Artificial Sequence: Synthetic polypeptide
DEEEIRTTNPVATEQYGSVQYNVDRGNEQFE

SEQ ID NO: 43506 - protein, 31 aa, Artificial Sequence
  Description of Artificial Sequence: Synthetic polypeptide
DEEEIRTTNPVATEQYGSVGNTGNLIEGGTQ

SEQ ID NO: 43507 - protein, 31 aa, Artificial Sequence
  Description of Artificial Sequence: Synthetic polypeptide
DEEEIRTTNPVATEQYGSVGNTGELIGRGDQ

SEQ ID NO: 43508 - protein, 32 aa, Artificial Sequence
  Description of Artificial Sequence: Synthetic polypeptide
DEEEIRTTNPVATEQYGCVCSTNHQFGGSNVQ

SEQ ID NO: 43509 - protein, 30 aa, Artificial Sequence
  Description of Artificial Sequence: Synthetic polypeptide
DEEEIATTNPVATEQYGSVASNLQAEPENH

SEQ ID NO: 43510 - protein, 34 aa, Artificial Sequence
  Description of Artificial Sequence: Synthetic polypeptide
DEEEIRTTNPVATEQYGSVSLTNLEQPEVGLEIR

SEQ ID NO: 43511 - protein, 32 aa, Artificial Sequence
  Description of Artificial Sequence: Synthetic polypeptide
DEEEIATTNPVATEQYGSVATGELDDRIGINR

SEQ ID NO: 43512 - protein, 31 aa, Artificial Sequence
  Description of Artificial Sequence: Synthetic polypeptide
DEEEIRTTNPVATEQYGSVSLTNLEMTLEFL

SEQ ID NO: 43513 - protein, 30 aa, Artificial Sequence
  Description of Artificial Sequence: Synthetic polypeptide
DEEEIRTTNPVATEQYGSVGMNLDNIGESI

SEQ ID NO: 43514 - protein, 31 aa, Artificial Sequence
  Description of Artificial Sequence: Synthetic polypeptide
DEEEIATTNPVATEQYGSVATGNLQSDDNGA

SEQ ID NO: 43515 - protein, 32 aa, Artificial Sequence
  Description of Artificial Sequence: Synthetic polypeptide
DEEEIRTTNPVAHEQYGSVPSTNLQPVFDVSR

SEQ ID NO: 43516 - protein, 33 aa, Artificial Sequence
  Description of Artificial Sequence: Synthetic polypeptide
DEEEIRTTNPVATEQYGSVGGTNLIQTGGNGGE

SEQ ID NO: 43517 - protein, 32 aa, Artificial Sequence
  Description of Artificial Sequence: Synthetic polypeptide
DEEEIRTTNPVATEQYGSVGENELDQGGNEDQ

SEQ ID NO: 43518 - protein, 31 aa, Artificial Sequence
  Description of Artificial Sequence: Synthetic polypeptide
DEEEIATTNPVATEQYGSVATNGQDAGDNDT

SEQ ID NO: 43519 - protein, 30 aa, Artificial Sequence
  Description of Artificial Sequence: Synthetic polypeptide
DEECIRCTNPVATEAYGSVSCNFSQRGNNL

SEQ ID NO: 43520 - protein, 28 aa, Artificial Sequence
  Description of Artificial Sequence: Synthetic peptide
DEECIRCTNPVATEAYGSVSWNFERGGP

SEQ ID NO: 43521 - protein, 31 aa, Artificial Sequence
  Description of Artificial Sequence: Synthetic polypeptide
DEEEIATTNPVATEQYGSVATNLADNQEGFP

SEQ ID NO: 43522 - protein, 32 aa, Artificial Sequence
  Description of Artificial Sequence: Synthetic polypeptide
DEEEIATTNPVATEQYGSVATNLERPGDNPQE

SEQ ID NO: 43523 - protein, 30 aa, Artificial Sequence
  Description of Artificial Sequence: Synthetic polypeptide
DEEEIRTTNPVAHEQYGCVWTNLQNFDSDR

SEQ ID NO: 43524 - protein, 32 aa, Artificial Sequence
  Description of Artificial Sequence: Synthetic polypeptide
DEEEIATTNPVATEQYGSVATNLERPGENPNH

SEQ ID NO: 43525 - protein, 32 aa, Artificial Sequence
  Description of Artificial Sequence: Synthetic polypeptide
DEEEIRTTNPVATEQYGSVSLPLQNIGENPVA

SEQ ID NO: 43526 - protein, 32 aa, Artificial Sequence
  Description of Artificial Sequence: Synthetic polypeptide
DEEEIRTTNPVATEQYGSVSLPLPQGLENPRV

SEQ ID NO: 43527 - protein, 32 aa, Artificial Sequence
  Description of Artificial Sequence: Synthetic polypeptide
DEEEIATTNPVATEQYGSVATNLERPGPDQRP

SEQ ID NO: 43528 - protein, 31 aa, Artificial Sequence
  Description of Artificial Sequence: Synthetic polypeptide
DEEEIATTNPVATEQYGSVATNLERPPNMAE

SEQ ID NO: 43529 - protein, 32 aa, Artificial Sequence
  Description of Artificial Sequence: Synthetic polypeptide
DEEEIRTTNPVATEQYGSVGCTNLQQRQMELE

SEQ ID NO: 43530 - protein, 31 aa, Artificial Sequence
  Description of Artificial Sequence: Synthetic polypeptide
DEEEIATTNPVATEQYGSVATNLNENTNDRE

SEQ ID NO: 43531 - protein, 31 aa, Artificial Sequence
  Description of Artificial Sequence: Synthetic polypeptide
DEEEIATTNPVATEQYGSVATNLNLGENDQE

SEQ ID NO: 43532 - protein, 33 aa, Artificial Sequence
  Description of Artificial Sequence: Synthetic polypeptide
DEEEIATTNPVATEQYGSVATNLQAAGEGENRD

SEQ ID NO: 43533 - protein, 32 aa, Artificial Sequence
  Description of Artificial Sequence: Synthetic polypeptide
DEEEIATTNPVATEQYGSVATNLQADGPGDNN

SEQ ID NO: 43534 - protein, 30 aa, Artificial Sequence
  Description of Artificial Sequence: Synthetic polypeptide
DEEEIATTNPVATEQYGSVATNLQAEAEAG

SEQ ID NO: 43535 - protein, 31 aa, Artificial Sequence
  Description of Artificial Sequence: Synthetic polypeptide
DEEEIATTNPVATEQYGSVATNLQAEAPNGE

SEQ ID NO: 43536 - protein, 31 aa, Artificial Sequence
  Description of Artificial Sequence: Synthetic polypeptide
DEEEIRTTNPVATEQYGSVGANMIRGEQDRD

SEQ ID NO: 43537 - protein, 32 aa, Artificial Sequence
  Description of Artificial Sequence: Synthetic polypeptide
DEEEIRTTNPVATEQYGSVSAEDLEDREGEDR

SEQ ID NO: 43538 - protein, 33 aa, Artificial Sequence
  Description of Artificial Sequence: Synthetic polypeptide
DEEEIRTTNPVATEQYGSVSLTNLIRPTQNVDT

SEQ ID NO: 43539 - protein, 30 aa, Artificial Sequence
  Description of Artificial Sequence: Synthetic polypeptide
DEEEIRTTNPVATEQYGSVSAEDGQGGEQS

SEQ ID NO: 43540 - protein, 33 aa, Artificial Sequence
  Description of Artificial Sequence: Synthetic polypeptide
DEEEIRTTNPVATEQYGSVSLQNSLEQRIGETN

SEQ ID NO: 43541 - protein, 32 aa, Artificial Sequence
  Description of Artificial Sequence: Synthetic polypeptide
DEEEIATTNPVATEQYGSVATNLADPQGENRD

SEQ ID NO: 43542 - protein, 32 aa, Artificial Sequence
  Description of Artificial Sequence: Synthetic polypeptide
DEEEIATTNPVATEQYGSVATNLADRGDNNED

SEQ ID NO: 43543 - protein, 30 aa, Artificial Sequence
  Description of Artificial Sequence: Synthetic polypeptide
DEEEIATTNPVATEQYGSVATNLAEDGGDQ

SEQ ID NO: 43544 - protein, 31 aa, Artificial Sequence
  Description of Artificial Sequence: Synthetic polypeptide
DEEEIATTNPVATEQYGSVATNLDDDGPNED

SEQ ID NO: 43545 - protein, 30 aa, Artificial Sequence
  Description of Artificial Sequence: Synthetic polypeptide
DEEEIATTNPVATEQYGSVATNLDDPANAE

SEQ ID NO: 43546 - protein, 33 aa, Artificial Sequence
  Description of Artificial Sequence: Synthetic polypeptide
DEEEIRTTNPVATEQYGSVSLTENQLQLGVLQL

SEQ ID NO: 43547 - protein, 33 aa, Artificial Sequence
  Description of Artificial Sequence: Synthetic polypeptide
DEEEIRTTNPVATEQYGSVSLTEMLQILEENRL

SEQ ID NO: 43548 - protein, 32 aa, Artificial Sequence
  Description of Artificial Sequence: Synthetic polypeptide
DEEEIRTTNPVATEQYGSVSLTDTLQIQENNI

SEQ ID NO: 43549 - protein, 30 aa, Artificial Sequence
  Description of Artificial Sequence: Synthetic polypeptide
DEEEIATTNPVATEQYGSVATNLEAGPPEQ

SEQ ID NO: 43550 - protein, 30 aa, Artificial Sequence
  Description of Artificial Sequence: Synthetic polypeptide
DEEEIATTNPVATEQYGSVATNLEDNPNVE

SEQ ID NO: 43551 - protein, 31 aa, Artificial Sequence
  Description of Artificial Sequence: Synthetic polypeptide
DEEEIRTTNPVATEQYGCVCSTNHQGFGEQV

SEQ ID NO: 43552 - protein, 32 aa, Artificial Sequence
  Description of Artificial Sequence: Synthetic polypeptide
DEEEIRTTNPVATEQYGSVGDTNMNQDGENIQ

SEQ ID NO: 43553 - protein, 32 aa, Artificial Sequence
  Description of Artificial Sequence: Synthetic polypeptide
DEEEIRTTNPVATEQYGSVGDGTNDQENIGNQ

SEQ ID NO: 43554 - protein, 33 aa, Artificial Sequence
  Description of Artificial Sequence: Synthetic polypeptide
DEEEIRTTNPVAHEQYGQSVSNQNDLDQRGIER

SEQ ID NO: 43555 - protein, 31 aa, Artificial Sequence
  Description of Artificial Sequence: Synthetic polypeptide
DEEEIATTNPVATEQYGSVATNLERDGPEDN

SEQ ID NO: 43556 - protein, 30 aa, Artificial Sequence
  Description of Artificial Sequence: Synthetic polypeptide
DEEEIATTNPVATEQYGSVATNLERDPEDA

SEQ ID NO: 43557 - protein, 30 aa, Artificial Sequence
  Description of Artificial Sequence: Synthetic polypeptide
DEEEIATTNPVATEQYGSVANNNQEQGNEE

SEQ ID NO: 43558 - protein, 34 aa, Artificial Sequence
  Description of Artificial Sequence: Synthetic polypeptide
DEEEIRTTNPVATEQYGSVSLTNLNQAENGVNPD

SEQ ID NO: 43559 - protein, 32 aa, Artificial Sequence
  Description of Artificial Sequence: Synthetic polypeptide
DEEEIRTTNPVATEQYGSVQWSNLENGSDNDR

SEQ ID NO: 43560 - protein, 32 aa, Artificial Sequence
  Description of Artificial Sequence: Synthetic polypeptide
DEEEIRTTNPVATEQYGSVGSNQNGQGGNNDE

SEQ ID NO: 43561 - protein, 32 aa, Artificial Sequence
  Description of Artificial Sequence: Synthetic polypeptide
DEEEIRTTNPVATEQYGCVCSTNHDQNGSNQM

SEQ ID NO: 43562 - protein, 32 aa, Artificial Sequence
  Description of Artificial Sequence: Synthetic polypeptide
DEEEIRTTNPVATEQYGSVGSNMNLINGGNEG

SEQ ID NO: 43563 - protein, 30 aa, Artificial Sequence
  Description of Artificial Sequence: Synthetic polypeptide
DEEEIRTTNPVATEQYGSVGSNLIQVEEEG

SEQ ID NO: 43564 - protein, 32 aa, Artificial Sequence
  Description of Artificial Sequence: Synthetic polypeptide
DEEEIRTTNPVATEQYGSVGSNGNGQGGNNNG

SEQ ID NO: 43565 - protein, 32 aa, Artificial Sequence
  Description of Artificial Sequence: Synthetic polypeptide
DEEEIRTTNPVATEQYGCVCSTNHERFGSNTQ

SEQ ID NO: 43566 - protein, 32 aa, Artificial Sequence
  Description of Artificial Sequence: Synthetic polypeptide
DEEEIRTTNPVATEQYGSVGSNGNGQGEGNNG

SEQ ID NO: 43567 - protein, 33 aa, Artificial Sequence
  Description of Artificial Sequence: Synthetic polypeptide
DEEEIRTTNPVATEQYGSVGSLTPNLVRSLERD

SEQ ID NO: 43568 - protein, 34 aa, Artificial Sequence
  Description of Artificial Sequence: Synthetic polypeptide
DEEEIRTTNPVATEQYGSVGSGTVNLQINEGGNG

SEQ ID NO: 43569 - protein, 34 aa, Artificial Sequence
  Description of Artificial Sequence: Synthetic polypeptide
DEEEIRTTNPVATEQYGSVGSGTNELDQGGNNGD

SEQ ID NO: 43570 - protein, 33 aa, Artificial Sequence
  Description of Artificial Sequence: Synthetic polypeptide
DEEEIRTTNPVATEQYGSVGSGTGNDQDGEGNS

SEQ ID NO: 43571 - protein, 31 aa, Artificial Sequence
  Description of Artificial Sequence: Synthetic polypeptide
DEEEIRTTNPVATEQYGSVQTTNLQTELAEI

SEQ ID NO: 43572 - protein, 31 aa, Artificial Sequence
  Description of Artificial Sequence: Synthetic polypeptide
DEEEIATTNPVATEQYGSVAGTNLQDDNDPQ

SEQ ID NO: 43573 - protein, 31 aa, Artificial Sequence
  Description of Artificial Sequence: Synthetic polypeptide
DEEEIRTTNPVATEQYGSVQTTNLQTELLDY

SEQ ID NO: 43574 - protein, 32 aa, Artificial Sequence
  Description of Artificial Sequence: Synthetic polypeptide
DEEEIRTTNPVATEQYGSVQTTNLQTHLPAER

SEQ ID NO: 43575 - protein, 31 aa, Artificial Sequence
  Description of Artificial Sequence: Synthetic polypeptide
DEEEIRTTNPVATEQYGCVCSTNHANFGNQE

SEQ ID NO: 43576 - protein, 32 aa, Artificial Sequence
  Description of Artificial Sequence: Synthetic polypeptide
DEEEIRTTNPVATEQYGSVGSDTNDQNNMNPV

SEQ ID NO: 43577 - protein, 32 aa, Artificial Sequence
  Description of Artificial Sequence: Synthetic polypeptide
DEEEIATTNPVATEQYGSVAATNLQDQGDNNM

SEQ ID NO: 43578 - protein, 29 aa, Artificial Sequence
  Description of Artificial Sequence: Synthetic peptide
DEEEIRTTNPVASEQYGECSEQLQQNGNQ

SEQ ID NO: 43579 - protein, 33 aa, Artificial Sequence
  Description of Artificial Sequence: Synthetic polypeptide
DEEEIRTTNPVATEQYGSVGSNTNLFNNGENED

SEQ ID NO: 43580 - protein, 33 aa, Artificial Sequence
  Description of Artificial Sequence: Synthetic polypeptide
DEEEIRTTNPVATEQYGSVGSNTNLFNDGNEDG

SEQ ID NO: 43581 - protein, 33 aa, Artificial Sequence
  Description of Artificial Sequence: Synthetic polypeptide
DEEEIRTTNPVATEQYGSVGSNTNDQGNGGNEG

SEQ ID NO: 43582 - protein, 33 aa, Artificial Sequence
  Description of Artificial Sequence: Synthetic polypeptide
DEEEIRTTNPVATEQYGSVGSNTMNDQGNGNGG

SEQ ID NO: 43583 - protein, 33 aa, Artificial Sequence
  Description of Artificial Sequence: Synthetic polypeptide
DEEEIRTTNPVATEQYGSVQTTMNLEQTGENIL

SEQ ID NO: 43584 - protein, 31 aa, Artificial Sequence
  Description of Artificial Sequence: Synthetic polypeptide
DEEEIRTTNPVATEQYGSVQTTNDQRSEEQI

SEQ ID NO: 43585 - protein, 34 aa, Artificial Sequence
  Description of Artificial Sequence: Synthetic polypeptide
DEEEIRTTNPVATEQYGSVGSNTGNLQFTGNGNQ

SEQ ID NO: 43586 - protein, 33 aa, Artificial Sequence
  Description of Artificial Sequence: Synthetic polypeptide
DEEEIRTTNPVATEQYGSVGSNTDNGQTGGNVT

SEQ ID NO: 43587 - protein, 33 aa, Artificial Sequence
  Description of Artificial Sequence: Synthetic polypeptide
DEEEIRTTNPVATEQYGCVCSTNELQFGSNNQA

SEQ ID NO: 43588 - protein, 34 aa, Artificial Sequence
  Description of Artificial Sequence: Synthetic polypeptide
DEEEIRTTNPVATEQYGSVQTTNLEQLPGENERQ

SEQ ID NO: 43589 - protein, 32 aa, Artificial Sequence
  Description of Artificial Sequence: Synthetic polypeptide
DEEEIATTNPVATEQYGSVAATNDQNRGNTVM

SEQ ID NO: 43590 - protein, 31 aa, Artificial Sequence
  Description of Artificial Sequence: Synthetic polypeptide
DEEEIRTTNPVASEQYGSVSCPALNMSNGNR

SEQ ID NO: 43591 - protein, 33 aa, Artificial Sequence
  Description of Artificial Sequence: Synthetic polypeptide
DEEEIRTTNPVATEQYGCVCSTNGLQFGSNNQG

SEQ ID NO: 43592 - protein, 30 aa, Artificial Sequence
  Description of Artificial Sequence: Synthetic polypeptide
DEEEIATTNPVATEQYGSVAATNDSTGEND

SEQ ID NO: 43593 - protein, 30 aa, Artificial Sequence
  Description of Artificial Sequence: Synthetic polypeptide
DEEEIATTNPVATEQYGSVAATNLDNNNNE

SEQ ID NO: 43594 - protein, 30 aa, Artificial Sequence
  Description of Artificial Sequence: Synthetic polypeptide
DEEEIACTNPVATEPYGSVATNLQDDGNLD

SEQ ID NO: 43595 - protein, 32 aa, Artificial Sequence
  Description of Artificial Sequence: Synthetic polypeptide
DEEEIRTTNPVATEQYGCVCSTNHQGMGSNFS

SEQ ID NO: 43596 - protein, 32 aa, Artificial Sequence
  Description of Artificial Sequence: Synthetic polypeptide
DEEEIRTTNPVATEQYGSVQTTNLQTPLAIRT

SEQ ID NO: 43597 - protein, 32 aa, Artificial Sequence
  Description of Artificial Sequence: Synthetic polypeptide
DEEEIATTNPVATEQYGSVAITNLNEREANRN

SEQ ID NO: 43598 - protein, 30 aa, Artificial Sequence
  Description of Artificial Sequence: Synthetic polypeptide
DEEEIRTTNPVAHEQYGSVWSNLQVFDSQR

SEQ ID NO: 43599 - protein, 32 aa, Artificial Sequence
  Description of Artificial Sequence: Synthetic polypeptide
DEEEIRTTNPVATEQYGCVCSTNHQENGNNQE

SEQ ID NO: 43600 - protein, 32 aa, Artificial Sequence
  Description of Artificial Sequence: Synthetic polypeptide
DEEEIRTTNPVATEQYGSVSLTNLQANPEEIL

SEQ ID NO: 43601 - protein, 31 aa, Artificial Sequence
  Description of Artificial Sequence: Synthetic polypeptide
DEEEIATTNPVATEQYGSVANANNLQDGNDD

SEQ ID NO: 43602 - protein, 32 aa, Artificial Sequence
  Description of Artificial Sequence: Synthetic polypeptide
DEEEIRTTNPVATEQYGSVQVTDVQREGIDRT

SEQ ID NO: 43603 - protein, 33 aa, Artificial Sequence
  Description of Artificial Sequence: Synthetic polypeptide
DEEEIRTTNPVATEQYGSVSLTNLQANIGPEQL

SEQ ID NO: 43604 - protein, 32 aa, Artificial Sequence
  Description of Artificial Sequence: Synthetic polypeptide
DEEEIRTTNPVATEQYGSVGNTNDQNEMGNQD

SEQ ID NO: 43605 - protein, 33 aa, Artificial Sequence
  Description of Artificial Sequence: Synthetic polypeptide
DEEEIRTTNPVATEQYGCVCSTNHQERIGSNQA

SEQ ID NO: 43606 - protein, 33 aa, Artificial Sequence
  Description of Artificial Sequence: Synthetic polypeptide
DEEEIRTTNPVATEQYGSVSLTNLQAENNQLPD

SEQ ID NO: 43607 - protein, 31 aa, Artificial Sequence
  Description of Artificial Sequence: Synthetic polypeptide
DEEEIRTTNPVATEQYGSVQVTNDQLEGEQI

SEQ ID NO: 43608 - protein, 33 aa, Artificial Sequence
  Description of Artificial Sequence: Synthetic polypeptide
DEEEIRTTNPVATEQYGSVQVTNDVQRNGNEEI

SEQ ID NO: 43609 - protein, 34 aa, Artificial Sequence
  Description of Artificial Sequence: Synthetic polypeptide
DEEEIRTTNPVATEQYGSVSLTNLNQNSGLENDD

SEQ ID NO: 43610 - protein, 33 aa, Artificial Sequence
  Description of Artificial Sequence: Synthetic polypeptide
DEEEIRTTNPVATEQYGSVQVTTNLAIRGMNDQ

SEQ ID NO: 43611 - protein, 29 aa, Artificial Sequence
  Description of Artificial Sequence: Synthetic peptide
DEEEIATTNPVATEQYGSVANNLTEDGTQ

SEQ ID NO: 43612 - protein, 32 aa, Artificial Sequence
  Description of Artificial Sequence: Synthetic polypeptide
DEEEIRTTNPVATEQYGSVQWPNELQSNGDER

SEQ ID NO: 43613 - protein, 30 aa, Artificial Sequence
  Description of Artificial Sequence: Synthetic polypeptide
DEEEIRTTNPVAHEQYGSVWTENLGVFDLR

SEQ ID NO: 43614 - protein, 32 aa, Artificial Sequence
  Description of Artificial Sequence: Synthetic polypeptide
DEEEIATTNPVATEQYGSVAITNDQDEGDNTR

SEQ ID NO: 43615 - protein, 31 aa, Artificial Sequence
  Description of Artificial Sequence: Synthetic polypeptide
DEEEIRTTNPVAHEQYGSVWTGNLQVFDSRG

SEQ ID NO: 43616 - protein, 30 aa, Artificial Sequence
  Description of Artificial Sequence: Synthetic polypeptide
DEEEIRTTNPVAHEQYGSVWTNLIVEDVSR

SEQ ID NO: 43617 - protein, 32 aa, Artificial Sequence
  Description of Artificial Sequence: Synthetic polypeptide
DEEEIATTNPVATEQYGSVAITNLQNSDGNTT

SEQ ID NO: 43618 - protein, 30 aa, Artificial Sequence
  Description of Artificial Sequence: Synthetic polypeptide
DEEEIATTNPVATEQYGSVAITNLQQPDTV

SEQ ID NO: 43619 - protein, 29 aa, Artificial Sequence
  Description of Artificial Sequence: Synthetic peptide
DEEEIATTNPVATEQYGSVAMNDNDGNDV

SEQ ID NO: 43620 - protein, 32 aa, Artificial Sequence
  Description of Artificial Sequence: Synthetic polypeptide
DEEEIRTTNPVAIEQYGSVSTMPLGQFGNTAN

SEQ ID NO: 43621 - protein, 32 aa, Artificial Sequence
  Description of Artificial Sequence: Synthetic polypeptide
DEEEIRTTNPVATEQYGCVCSTNHNQNFGSNA

SEQ ID NO: 43622 - protein, 33 aa, Artificial Sequence
  Description of Artificial Sequence: Synthetic polypeptide
DEEEIRTTNPVATEQYGCVCSTNHNQRGSNTQA

SEQ ID NO: 43623 - protein, 32 aa, Artificial Sequence
  Description of Artificial Sequence: Synthetic polypeptide
DEEEIRTTNPVATEQYGSVGPTNLQQQNVFVM

SEQ ID NO: 43624 - protein, 33 aa, Artificial Sequence
  Description of Artificial Sequence: Synthetic polypeptide
DEEEIRTTNPVATEQYGSVGPTNLIQNRMGMVV

SEQ ID NO: 43625 - protein, 33 aa, Artificial Sequence
  Description of Artificial Sequence: Synthetic polypeptide
DEEEIRTTNPVATEQYGCVCSTNHQEASGSNRQ

SEQ ID NO: 43626 - protein, 30 aa, Artificial Sequence
  Description of Artificial Sequence: Synthetic polypeptide
DEEEIRTTNPVAHEQYGSVWTQLQGVFDSR

SEQ ID NO: 43627 - protein, 31 aa, Artificial Sequence
  Description of Artificial Sequence: Synthetic polypeptide
DEEEIATTNPVATEQYGSVAMNLQEAGNSEE

SEQ ID NO: 43628 - protein, 32 aa, Artificial Sequence
  Description of Artificial Sequence: Synthetic polypeptide
DEEEIRTTNPVATEQYGSVQTWVWDQRGNESG

SEQ ID NO: 43629 - protein, 30 aa, Artificial Sequence
  Description of Artificial Sequence: Synthetic polypeptide
DEEEIRTTNPVATEQYGSVGPNDNGENDRD

SEQ ID NO: 43630 - protein, 30 aa, Artificial Sequence
  Description of Artificial Sequence: Synthetic polypeptide
DEEEIATTNPVATEQYGSVAMNLQEANNVD

SEQ ID NO: 43631 - protein, 30 aa, Artificial Sequence
  Description of Artificial Sequence: Synthetic polypeptide
DEEEIRTTNPVATEQYGSVGPGDQPMGESR

SEQ ID NO: 43632 - protein, 31 aa, Artificial Sequence
  Description of Artificial Sequence: Synthetic polypeptide
DEEEIRTTNPVAHEQYGSVWTNGLQVFDSRD

SEQ ID NO: 43633 - protein, 31 aa, Artificial Sequence
  Description of Artificial Sequence: Synthetic polypeptide
DEEEIATTNPVATEQYGSVATNLQAEDPTRN

SEQ ID NO: 43634 - protein, 31 aa, Artificial Sequence
  Description of Artificial Sequence: Synthetic polypeptide
DEEEIRTTNPVATEQYGCVCSTNHQGQSDNQ

SEQ ID NO: 43635 - protein, 31 aa, Artificial Sequence
  Description of Artificial Sequence: Synthetic polypeptide
DEEEIATTNPVATEQYGSVATNLQAGPEPGA

SEQ ID NO: 43636 - protein, 32 aa, Artificial Sequence
  Description of Artificial Sequence: Synthetic polypeptide
DEEEIRTTNPVACEQYGSVSTNNDLLQNGIIG

SEQ ID NO: 43637 - protein, 31 aa, Artificial Sequence
  Description of Artificial Sequence: Synthetic polypeptide
DEEEIRTTNPVATEQYGSVSLNDNDGNHNSE

SEQ ID NO: 43638 - protein, 31 aa, Artificial Sequence
  Description of Artificial Sequence: Synthetic polypeptide
DEEEIRTTNPVATEQYGSVFSGNLSGEANVW

SEQ ID NO: 43639 - protein, 29 aa, Artificial Sequence
  Description of Artificial Sequence: Synthetic peptide
DEEEIRTTNPVATEQYGSVFPNDTGGDES

SEQ ID NO: 43640 - protein, 31 aa, Artificial Sequence
  Description of Artificial Sequence: Synthetic polypeptide
DEEEIRTTNPVATEQYGSVSANLNDGVEMLQ

SEQ ID NO: 43641 - protein, 31 aa, Artificial Sequence
  Description of Artificial Sequence: Synthetic polypeptide
DEECIRCTNPVATEQYGSTVSCNMFSQRGNL

SEQ ID NO: 43642 - protein, 33 aa, Artificial Sequence
  Description of Artificial Sequence: Synthetic polypeptide
DEEEIRTTNPVATEQYGCVCSTNNHQFGSNTRS

SEQ ID NO: 43643 - protein, 30 aa, Artificial Sequence
  Description of Artificial Sequence: Synthetic polypeptide
DEEEIRTTNPVACEQYGSVPTENLQYISEL

SEQ ID NO: 43644 - protein, 33 aa, Artificial Sequence
  Description of Artificial Sequence: Synthetic polypeptide
DEEEIRTTNPVATEQYGSVFEPTNTQRNVNERN

SEQ ID NO: 43645 - protein, 31 aa, Artificial Sequence
  Description of Artificial Sequence: Synthetic polypeptide
DEEEIRTTNPVATEQYGSVEVTNEQVLTGQQ

SEQ ID NO: 43646 - protein, 32 aa, Artificial Sequence
  Description of Artificial Sequence: Synthetic polypeptide
DEEEIRTTNPVACEQYGAVVSSNDLLQRGIIR

SEQ ID NO: 43647 - protein, 30 aa, Artificial Sequence
  Description of Artificial Sequence: Synthetic polypeptide
DEEEIRTTNPVAAEQYGSVWTNQQVFDSER

SEQ ID NO: 43648 - protein, 33 aa, Artificial Sequence
  Description of Artificial Sequence: Synthetic polypeptide
DEEEIRTTNPVATEQYGCVCSTNNLQFFGSNQV

SEQ ID NO: 43649 - protein, 30 aa, Artificial Sequence
  Description of Artificial Sequence: Synthetic polypeptide
DEEEIRTTNPVATEQYGSVETTYQSSETER

SEQ ID NO: 43650 - protein, 33 aa, Artificial Sequence
  Description of Artificial Sequence: Synthetic polypeptide
DEEEIRTTNPVATEQYGCVCSTNNLQFFGSQRA

SEQ ID NO: 43651 - protein, 32 aa, Artificial Sequence
  Description of Artificial Sequence: Synthetic polypeptide
DEEEIRTTNPVACEQYGSVSTQNLLLQQGIGD

SEQ ID NO: 43652 - protein, 32 aa, Artificial Sequence
  Description of Artificial Sequence: Synthetic polypeptide
DEEEIRTTNPVATEQYGCVCSTNNLQFGSDAI

SEQ ID NO: 43653 - protein, 32 aa, Artificial Sequence
  Description of Artificial Sequence: Synthetic polypeptide
DEEEIRTTNPVATEQYGSVFSPENDQRNEERN

SEQ ID NO: 43654 - protein, 33 aa, Artificial Sequence
  Description of Artificial Sequence: Synthetic polypeptide
DEEEIRTTNPVATEQYGSVFSPTNLERNNQEDN

SEQ ID NO: 43655 - protein, 33 aa, Artificial Sequence
  Description of Artificial Sequence: Synthetic polypeptide
DEEEIATTNPVATEQYGSVATPNLQPRDGNDYD

SEQ ID NO: 43656 - protein, 32 aa, Artificial Sequence
  Description of Artificial Sequence: Synthetic polypeptide
DEEEIRTTNPVACEQYGVVVSTNGLLQRGIGE

SEQ ID NO: 43657 - protein, 30 aa, Artificial Sequence
  Description of Artificial Sequence: Synthetic polypeptide
DEEEIRTTNPVATEQYGSVFTDDPQRVEEI

SEQ ID NO: 43658 - protein, 32 aa, Artificial Sequence
  Description of Artificial Sequence: Synthetic polypeptide
DEEEIATTNPVATEQYGSVATPNPLQDQGGNQ

SEQ ID NO: 43659 - protein, 32 aa, Artificial Sequence
  Description of Artificial Sequence: Synthetic polypeptide
DEEEIRTTNPVACEQYGSVVVTNLLLQAGIRE

SEQ ID NO: 43660 - protein, 32 aa, Artificial Sequence
  Description of Artificial Sequence: Synthetic polypeptide
DEEEIRTTNPVACEQYGSVVVTNDLLQRGIVE

SEQ ID NO: 43661 - protein, 32 aa, Artificial Sequence
  Description of Artificial Sequence: Synthetic polypeptide
DEEEIRTTNPVACEQYGSVVVTNDLLQQGILR

SEQ ID NO: 43662 - protein, 32 aa, Artificial Sequence
  Description of Artificial Sequence: Synthetic polypeptide
DEEEIRTTNPVATEQYGCVCSTNLQYFNSDQP

SEQ ID NO: 43663 - protein, 32 aa, Artificial Sequence
  Description of Artificial Sequence: Synthetic polypeptide
DEEEIRTTNPVACEQYGSVVTTNQLLQRGTTD

SEQ ID NO: 43664 - protein, 33 aa, Artificial Sequence
  Description of Artificial Sequence: Synthetic polypeptide
DEEEIRTTNPVATEQYGSVSLNLQARDGEEEFL

SEQ ID NO: 43665 - protein, 33 aa, Artificial Sequence
  Description of Artificial Sequence: Synthetic polypeptide
DEEEIATTNPVATEQYGSVATTNLQPRDGNPQE

SEQ ID NO: 43666 - protein, 32 aa, Artificial Sequence
  Description of Artificial Sequence: Synthetic polypeptide
DEEEIRTTNPVACEQYGSVVTNNQLLQRGIGD

SEQ ID NO: 43667 - protein, 32 aa, Artificial Sequence
  Description of Artificial Sequence: Synthetic polypeptide
DEEEIRTTNPVACEQYGSVVTNNQLLQNGIIR

SEQ ID NO: 43668 - protein, 31 aa, Artificial Sequence
  Description of Artificial Sequence: Synthetic polypeptide
DEEEIRTTNPVATEQYGCVCSTNLQYMSDDY

SEQ ID NO: 43669 - protein, 33 aa, Artificial Sequence
  Description of Artificial Sequence: Synthetic polypeptide
DEEEIRTTNPVATEQYGSVFSTENNQQRGSQQE

SEQ ID NO: 43670 - protein, 34 aa, Artificial Sequence
  Description of Artificial Sequence: Synthetic polypeptide
DEEEIRTTNPVATEQYGSVFSPTNLEDRFNEERN

SEQ ID NO: 43671 - protein, 32 aa, Artificial Sequence
  Description of Artificial Sequence: Synthetic polypeptide
DEEEIRTTNPVACEQYGVVVVTNDLLQRGTER

SEQ ID NO: 43672 - protein, 33 aa, Artificial Sequence
  Description of Artificial Sequence: Synthetic polypeptide
DEEEIRTTNPVATEQYGCVCSTNNLQFMGSNQS

SEQ ID NO: 43673 - protein, 33 aa, Artificial Sequence
  Description of Artificial Sequence: Synthetic polypeptide
DEEEIRTTNPVATEQYGCVCSTNNLQFSGSNDV

SEQ ID NO: 43674 - protein, 31 aa, Artificial Sequence
  Description of Artificial Sequence: Synthetic polypeptide
DEEEIRTTNPVATEQYGSVETNLQQQEQADA

SEQ ID NO: 43675 - protein, 31 aa, Artificial Sequence
  Description of Artificial Sequence: Synthetic polypeptide
DEEEIRTTNPVATEQYGSVETNLQQIVLTES

SEQ ID NO: 43676 - protein, 30 aa, Artificial Sequence
  Description of Artificial Sequence: Synthetic polypeptide
DEEEIRTTNPTATEPYGSVSTDLEHAGNDK

SEQ ID NO: 43677 - protein, 32 aa, Artificial Sequence
  Description of Artificial Sequence: Synthetic polypeptide
DEEEIRTTNPTATEPYGSVPACTNLSQRGNNA

SEQ ID NO: 43678 - protein, 30 aa, Artificial Sequence
  Description of Artificial Sequence: Synthetic polypeptide
DEEEIRTTNPTATEEYGSVIACTNQTRGNA

SEQ ID NO: 43679 - protein, 30 aa, Artificial Sequence
  Description of Artificial Sequence: Synthetic polypeptide
DEEEIRTTNPVATEQYGSVSLMLQVIMDQD

SEQ ID NO: 43680 - protein, 29 aa, Artificial Sequence
  Description of Artificial Sequence: Synthetic peptide
DEEEIRTTNPTATEEYGSVATENDGNGNA

SEQ ID NO: 43681 - protein, 32 aa, Artificial Sequence
  Description of Artificial Sequence: Synthetic polypeptide
DEEEIRTTNPVATEQYGSVETMGLQPGVNENS

SEQ ID NO: 43682 - protein, 29 aa, Artificial Sequence
  Description of Artificial Sequence: Synthetic peptide
DEEEIRTTNPTATECWGSCSTNLAQGENA

SEQ ID NO: 43683 - protein, 33 aa, Artificial Sequence
  Description of Artificial Sequence: Synthetic polypeptide
DEEEIRTTNPVATEQYGSVETLNPLQDEGDEPR

SEQ ID NO: 43684 - protein, 30 aa, Artificial Sequence
  Description of Artificial Sequence: Synthetic polypeptide
DEEEIATTNPVATEQYGSVCAANLQDDVDR

SEQ ID NO: 43685 - protein, 30 aa, Artificial Sequence
  Description of Artificial Sequence: Synthetic polypeptide
DEECIRCTNPVATEQYGSVSWNEDQQEGNL

SEQ ID NO: 43686 - protein, 29 aa, Artificial Sequence
  Description of Artificial Sequence: Synthetic peptide
DEEEIRTTNPTATAQYGQVPTDLQDGNAD

SEQ ID NO: 43687 - protein, 32 aa, Artificial Sequence
  Description of Artificial Sequence: Synthetic polypeptide
DEEEIRTTNPVATEQYGCVCSTNPQHFGSNAE

SEQ ID NO: 43688 - protein, 31 aa, Artificial Sequence
  Description of Artificial Sequence: Synthetic polypeptide
DEEEIRTTNPVATEQYGCVCSTNPQNFGSDI

SEQ ID NO: 43689 - protein, 33 aa, Artificial Sequence
  Description of Artificial Sequence: Synthetic polypeptide
DEEEIRTTNPVATEQYGCVCSTNNQRSGSNNDP

SEQ ID NO: 43690 - protein, 32 aa, Artificial Sequence
  Description of Artificial Sequence: Synthetic polypeptide
DEEEIRTTNPVATEQYGCVCSTNNLQFNSNFV

SEQ ID NO: 43691 - protein, 33 aa, Artificial Sequence
  Description of Artificial Sequence: Synthetic polypeptide
DEEEIRTTNPVATEQYGCVCSTNNLQYFGSNQA

SEQ ID NO: 43692 - protein, 32 aa, Artificial Sequence
  Description of Artificial Sequence: Synthetic polypeptide
DEEEIRTTNPVATEQYGSVETNMQPRLTNGQD

SEQ ID NO: 43693 - protein, 30 aa, Artificial Sequence
  Description of Artificial Sequence: Synthetic polypeptide
DEECIRCTNPVATEQYGSVCSWNHQHGNQS

SEQ ID NO: 43694 - protein, 30 aa, Artificial Sequence
  Description of Artificial Sequence: Synthetic polypeptide
DEECIRCTNPVATEQYGSVCSWNNQNGSNQ

SEQ ID NO: 43695 - protein, 33 aa, Artificial Sequence
  Description of Artificial Sequence: Synthetic polypeptide
DEEEIRTTNPVATEQYGSVETTNLQPRGVGIDD

SEQ ID NO: 43696 - protein, 32 aa, Artificial Sequence
  Description of Artificial Sequence: Synthetic polypeptide
DEEEIRTTNPVATEQYGSVETTNLMIGNGIDD

SEQ ID NO: 43697 - protein, 31 aa, Artificial Sequence
  Description of Artificial Sequence: Synthetic polypeptide
DEEEIRTTNPVATEQYGSVETTLQPRMVAVE

SEQ ID NO: 43698 - protein, 28 aa, Artificial Sequence
  Description of Artificial Sequence: Synthetic peptide
DEEEIRTTNPTATEQYGSVSEGECNGDF

SEQ ID NO: 43699 - protein, 31 aa, Artificial Sequence
  Description of Artificial Sequence: Synthetic polypeptide
DEEEIRTTNPVATEQYGSVETTGQRNSNDVP

SEQ ID NO: 43700 - protein, 29 aa, Artificial Sequence
  Description of Artificial Sequence: Synthetic peptide
DEECSRTTNPIAYEQYGEVYTMNLQGGNR

SEQ ID NO: 43701 - protein, 30 aa, Artificial Sequence
  Description of Artificial Sequence: Synthetic polypeptide
DEEEIRTTNPTATEQYGSVPTWDLGDRGKE

SEQ ID NO: 43702 - protein, 29 aa, Artificial Sequence
  Description of Artificial Sequence: Synthetic peptide
DEEEIRTTNPTATEQYGSVPTWDGRGDKE

SEQ ID NO: 43703 - protein, 31 aa, Artificial Sequence
  Description of Artificial Sequence: Synthetic polypeptide
DEECIRCTNPVATEQYGSVSCCNAFSQRGNL

SEQ ID NO: 43704 - protein, 32 aa, Artificial Sequence
  Description of Artificial Sequence: Synthetic polypeptide
DEEEIRTTNPVATEQYGSVETNYLQLSGDLAI

SEQ ID NO: 43705 - protein, 31 aa, Artificial Sequence
  Description of Artificial Sequence: Synthetic polypeptide
DEEEIRTTNPVATEQYGSVETNQQRQEQADL

SEQ ID NO: 43706 - protein, 31 aa, Artificial Sequence
  Description of Artificial Sequence: Synthetic polypeptide
DEECIRCTNPVATEQYGSVSCNFQRTGGNNL

SEQ ID NO: 43707 - protein, 31 aa, Artificial Sequence
  Description of Artificial Sequence: Synthetic polypeptide
DEEEIRTTNPVATEQYGSVETNNLINDEERD

SEQ ID NO: 43708 - protein, 30 aa, Artificial Sequence
  Description of Artificial Sequence: Synthetic polypeptide
DEEEIRTTNPTATEQYGSVPCTGELARGKE

SEQ ID NO: 43709 - protein, 33 aa, Artificial Sequence
  Description of Artificial Sequence: Synthetic polypeptide
DEEEIRTTNPVATEQYGSVCSTWNDHQEGDMIR

SEQ ID NO: 43710 - protein, 32 aa, Artificial Sequence
  Description of Artificial Sequence: Synthetic polypeptide
DEEEIATTNPVATEQYGSVATPNLNRDGNDLD

SEQ ID NO: 43711 - protein, 29 aa, Artificial Sequence
  Description of Artificial Sequence: Synthetic peptide
DEEEIATTNPVATEQYGSVATPLQDNPEF

SEQ ID NO: 43712 - protein, 32 aa, Artificial Sequence
  Description of Artificial Sequence: Synthetic polypeptide
DEEEIRTTNPVATEQYGCVCSTNLEHSGSNVS

SEQ ID NO: 43713 - protein, 32 aa, Artificial Sequence
  Description of Artificial Sequence: Synthetic polypeptide
DEEEIRTTNPVATEQYGCVCSTNLEIFGSNTQ

SEQ ID NO: 43714 - protein, 29 aa, Artificial Sequence
  Description of Artificial Sequence: Synthetic peptide
DEECVRTTNPVASEQYGQVSTIVVQRGNN

SEQ ID NO: 43715 - protein, 32 aa, Artificial Sequence
  Description of Artificial Sequence: Synthetic polypeptide
DEEEIRTTNPVATEQYGCVCSTNLENFGSNVQ

SEQ ID NO: 43716 - protein, 31 aa, Artificial Sequence
  Description of Artificial Sequence: Synthetic polypeptide
DEEEIRTTNPVATEQYGCVCSTNLENFNSQV

SEQ ID NO: 43717 - protein, 30 aa, Artificial Sequence
  Description of Artificial Sequence: Synthetic polypeptide
DEEEIRTTNPVATEQYGSVSAGLTVFTNVV

SEQ ID NO: 43718 - protein, 30 aa, Artificial Sequence
  Description of Artificial Sequence: Synthetic polypeptide
DEEEIRTTNPVAFEQYGSVGTNDQVEDDRT

SEQ ID NO: 43719 - protein, 33 aa, Artificial Sequence
  Description of Artificial Sequence: Synthetic polypeptide
DEEEIRTTNPVAFEQYGQVVSTNDDLQRGDRGI

SEQ ID NO: 43720 - protein, 31 aa, Artificial Sequence
  Description of Artificial Sequence: Synthetic polypeptide
DEEEIATTNPVATEQYGSVATNLQGNQEGDD

SEQ ID NO: 43721 - protein, 32 aa, Artificial Sequence
  Description of Artificial Sequence: Synthetic polypeptide
DEEEIRTTNPVATEQYGCVCSTNLIGFGSNIT

SEQ ID NO: 43722 - protein, 32 aa, Artificial Sequence
  Description of Artificial Sequence: Synthetic polypeptide
DEEEIRTTNPVATEQYGCVCSTNLNQNFNSQQ

SEQ ID NO: 43723 - protein, 32 aa, Artificial Sequence
  Description of Artificial Sequence: Synthetic polypeptide
DEEEIRTTNPVATEQYGCVCSTNLNQRFMSEQ

SEQ ID NO: 43724 - protein, 33 aa, Artificial Sequence
  Description of Artificial Sequence: Synthetic polypeptide
DEEEIRTTNPVATEQYGCVCSTNLNQRFNSDQQ

SEQ ID NO: 43725 - protein, 32 aa, Artificial Sequence
  Description of Artificial Sequence: Synthetic polypeptide
DEEEIRTTNPVATEQYGCVCSTNLQEGQSEQS

SEQ ID NO: 43726 - protein, 32 aa, Artificial Sequence
  Description of Artificial Sequence: Synthetic polypeptide
DEEEIRTTNPVATEQYGCVCSTNLQEHNSEQS

SEQ ID NO: 43727 - protein, 29 aa, Artificial Sequence
  Description of Artificial Sequence: Synthetic peptide
DEEDIATTNPVATEQYGCVATNDQDGNSL

SEQ ID NO: 43728 - protein, 31 aa, Artificial Sequence
  Description of Artificial Sequence: Synthetic polypeptide
DEEEIATTNPVATEQYGSVATNLQNNNANPE

SEQ ID NO: 43729 - protein, 29 aa, Artificial Sequence
  Description of Artificial Sequence: Synthetic peptide
DEECIRCTNPVATEQYGCVSWEDQRGNQS

SEQ ID NO: 43730 - protein, 31 aa, Artificial Sequence
  Description of Artificial Sequence: Synthetic polypeptide
DEEEIATTNPVATEQYGSVATNLQEDGGEQA

SEQ ID NO: 43731 - protein, 32 aa, Artificial Sequence
  Description of Artificial Sequence: Synthetic polypeptide
DEEEIRTTNPVATEQYGCVCSTNHQHMNSNRE

SEQ ID NO: 43732 - protein, 31 aa, Artificial Sequence
  Description of Artificial Sequence: Synthetic polypeptide
DEEEIRTTNPVATEQYGCVCSTNHQHNSNLG

SEQ ID NO: 43733 - protein, 31 aa, Artificial Sequence
  Description of Artificial Sequence: Synthetic polypeptide
DEEEIRTTNPVATEQYGCVCSTNHQNFTSNA

SEQ ID NO: 43734 - protein, 31 aa, Artificial Sequence
  Description of Artificial Sequence: Synthetic polypeptide
DEEEIATTNPVATEQYGSVATNLQATANEDD

SEQ ID NO: 43735 - protein, 31 aa, Artificial Sequence
  Description of Artificial Sequence: Synthetic polypeptide
DEEEIATTNPVATEQYGSVATNLQDAVEGDN

SEQ ID NO: 43736 - protein, 31 aa, Artificial Sequence
  Description of Artificial Sequence: Synthetic polypeptide
DEEEIRTTNPVATEQYGCVCSTNHQNGSEQI

SEQ ID NO: 43737 - protein, 31 aa, Artificial Sequence
  Description of Artificial Sequence: Synthetic polypeptide
DEEEIRTTNPVATEQYGCVCSTNHQRNSEQA

SEQ ID NO: 43738 - protein, 31 aa, Artificial Sequence
  Description of Artificial Sequence: Synthetic polypeptide
DEEEIRTTNPVATEQYGCVCSTNHQSGETQS

SEQ ID NO: 43739 - protein, 31 aa, Artificial Sequence
  Description of Artificial Sequence: Synthetic polypeptide
DEEEIRTTNPVATEQYGCVCSTNHVQRNSEQ

SEQ ID NO: 43740 - protein, 32 aa, Artificial Sequence
  Description of Artificial Sequence: Synthetic polypeptide
DEEEIRTTNPVATEQYGCVCSTNLDQGFGSEQ

SEQ ID NO: 43741 - protein, 30 aa, Artificial Sequence
  Description of Artificial Sequence: Synthetic polypeptide
DEEEIATTNPVATEQYGSVATNLQDNQEGA

SEQ ID NO: 43742 - protein, 33 aa, Artificial Sequence
  Description of Artificial Sequence: Synthetic polypeptide
DEEEIRTTNPVATEQYGCVCSTNLDQHFGSNQN

SEQ ID NO: 43743 - protein, 31 aa, Artificial Sequence
  Description of Artificial Sequence: Synthetic polypeptide
DEEEIATTNPVATEQYGSVATNLQDPDNNHN

SEQ ID NO: 43744 - protein, 32 aa, Artificial Sequence
  Description of Artificial Sequence: Synthetic polypeptide
DEEEIRTTNPVATEQYGCVCSTNLDQNGSQQA

SEQ ID NO: 43745 - protein, 33 aa, Artificial Sequence
  Description of Artificial Sequence: Synthetic polypeptide
DEEEIRTTNPVATEQYGSVFWTWNDYQRDDQNR

SEQ ID NO: 43746 - protein, 31 aa, Artificial Sequence
  Description of Artificial Sequence: Synthetic polypeptide
DEEEIATTNPVATEQYGSVATNLQEDPGEQQ

SEQ ID NO: 43747 - protein, 31 aa, Artificial Sequence
  Description of Artificial Sequence: Synthetic polypeptide
DEEEIRTTNPVATEQYGCVCSTNLQVNSEQS

SEQ ID NO: 43748 - protein, 31 aa, Artificial Sequence
  Description of Artificial Sequence: Synthetic polypeptide
DEEEIATTNPVATEQYGSVATNLQPADGGPE

SEQ ID NO: 43749 - protein, 31 aa, Artificial Sequence
  Description of Artificial Sequence: Synthetic polypeptide
DEEEIATTNPVATEQYGSVATNLQQDGGEEY

SEQ ID NO: 43750 - protein, 33 aa, Artificial Sequence
  Description of Artificial Sequence: Synthetic polypeptide
DEEEIRTTNPVATEQYGCVCSTNLQHFGSENAM

SEQ ID NO: 43751 - protein, 32 aa, Artificial Sequence
  Description of Artificial Sequence: Synthetic polypeptide
DEEEIRTTNPVATEQYGCVCSTNLQHSGSDTQ

SEQ ID NO: 43752 - protein, 32 aa, Artificial Sequence
  Description of Artificial Sequence: Synthetic polypeptide
DEEEIRTTNPVATEQYGCVCSTNLQNFNSNQI

SEQ ID NO: 43753 - protein, 33 aa, Artificial Sequence
  Description of Artificial Sequence: Synthetic polypeptide
DEEEIRTTNPVATEQYGCVCSTNLQNGGSNTQS

SEQ ID NO: 43754 - protein, 32 aa, Artificial Sequence
  Description of Artificial Sequence: Synthetic polypeptide
DEEEIRTTNPVATEQYGCVCSTNLQNIGSQQI

SEQ ID NO: 43755 - protein, 31 aa, Artificial Sequence
  Description of Artificial Sequence: Synthetic polypeptide
DEEEIATTNPVATEQYGSVATNNLNQDGDTD

SEQ ID NO: 43756 - protein, 32 aa, Artificial Sequence
  Description of Artificial Sequence: Synthetic polypeptide
DEEEIRTTNPVATEQYGCVCSTNLQNSGSDFG

SEQ ID NO: 43757 - protein, 31 aa, Artificial Sequence
  Description of Artificial Sequence: Synthetic polypeptide
DEEEIATTNPVATEQYGSVATNPHQERDMIR

SEQ ID NO: 43758 - protein, 32 aa, Artificial Sequence
  Description of Artificial Sequence: Synthetic polypeptide
DEEEIATTNPVATEQYGSVATNPLNESEGNRN

SEQ ID NO: 43759 - protein, 31 aa, Artificial Sequence
  Description of Artificial Sequence: Synthetic polypeptide
DEEEIATTNPVATEQYGSVATNPPERGDNEL

SEQ ID NO: 43760 - protein, 33 aa, Artificial Sequence
  Description of Artificial Sequence: Synthetic polypeptide
DEEEIRTTNPVATEQYGSVSANDLDQLYGEMER

SEQ ID NO: 43761 - protein, 30 aa, Artificial Sequence
  Description of Artificial Sequence: Synthetic polypeptide
DEEEIATTNPVATEQYGSVATNPPREHNEE

SEQ ID NO: 43762 - protein, 30 aa, Artificial Sequence
  Description of Artificial Sequence: Synthetic polypeptide
DEEEIATTNPVATEQYGSVATNPPRENPEE

SEQ ID NO: 43763 - protein, 31 aa, Artificial Sequence
  Description of Artificial Sequence: Synthetic polypeptide
DEEEIATTNPVATEQYGSVATNSLDQSAGEF

SEQ ID NO: 43764 - protein, 32 aa, Artificial Sequence
  Description of Artificial Sequence: Synthetic polypeptide
DEEEIRTTNPVATEQYGCVCSTNLQSGSDPQS

SEQ ID NO: 43765 - protein, 31 aa, Artificial Sequence
  Description of Artificial Sequence: Synthetic polypeptide
DEEEIRTTNPVATEQYGCVCSTNLQGSQSDA

SEQ ID NO: 43766 - protein, 34 aa, Artificial Sequence
  Description of Artificial Sequence: Synthetic polypeptide
DEEEIRTTNPVAFEQYGQSVSTQNDLLQRGIREE

SEQ ID NO: 43767 - protein, 31 aa, Artificial Sequence
  Description of Artificial Sequence: Synthetic polypeptide
DEEEIRTTNPVATEQYGCVCSTNLQGQSQAS

SEQ ID NO: 43768 - protein, 32 aa, Artificial Sequence
  Description of Artificial Sequence: Synthetic polypeptide
DEEEIRTTNPVATEQYGCVCSTNLQGQSNTQI

SEQ ID NO: 43769 - protein, 31 aa, Artificial Sequence
  Description of Artificial Sequence: Synthetic polypeptide
DEEEIATTNPVATEQYGSVATNLQQDPQNEM

SEQ ID NO: 43770 - protein, 34 aa, Artificial Sequence
  Description of Artificial Sequence: Synthetic polypeptide
DEEEIRTTNPVAFEQYGQSVSTQNDLLQRGIERG

SEQ ID NO: 43771 - protein, 34 aa, Artificial Sequence
  Description of Artificial Sequence: Synthetic polypeptide
DEEEIRTTNPVAFEQYGQSVSTQNDLLQRGDRGD

SEQ ID NO: 43772 - protein, 30 aa, Artificial Sequence
  Description of Artificial Sequence: Synthetic polypeptide
DEECIRCTNPVATEQYGCVSWNDQRFGSNL

SEQ ID NO: 43773 - protein, 34 aa, Artificial Sequence
  Description of Artificial Sequence: Synthetic polypeptide
DEEEIRTTNPVAFEQYGQSVSTNNDGLQRGIRGD

SEQ ID NO: 43774 - protein, 31 aa, Artificial Sequence
  Description of Artificial Sequence: Synthetic polypeptide
DEEEIATTNPVATEQYGSVATNLQQDQGEAA

SEQ ID NO: 43775 - protein, 30 aa, Artificial Sequence
  Description of Artificial Sequence: Synthetic polypeptide
DEECVRTTNPIAYEQYGCVCSTNLQRFGNA

SEQ ID NO: 43776 - protein, 33 aa, Artificial Sequence
  Description of Artificial Sequence: Synthetic polypeptide
DEEEIATTNPVATEQYGSVATNLQQRGEEQNEM

SEQ ID NO: 43777 - protein, 32 aa, Artificial Sequence
  Description of Artificial Sequence: Synthetic polypeptide
DEEEIRTTNPVAFEQYGQSVSNNDLLQRGIQD

SEQ ID NO: 43778 - protein, 34 aa, Artificial Sequence
  Description of Artificial Sequence: Synthetic polypeptide
DEEEIRTTNPVAFEQYGQSVSGTNDDLQRGIRGG

SEQ ID NO: 43779 - protein, 34 aa, Artificial Sequence
  Description of Artificial Sequence: Synthetic polypeptide
DEEEIRTTNPVAFEQYGQSVSDTNDLLQRGIRGI

SEQ ID NO: 43780 - protein, 33 aa, Artificial Sequence
  Description of Artificial Sequence: Synthetic polypeptide
DEEEIRTTNPVAFEQYGQSVSDNDLLQRGIRED

SEQ ID NO: 43781 - protein, 32 aa, Artificial Sequence
  Description of Artificial Sequence: Synthetic polypeptide
DEEEIRTTNPVATEQYGCVCSTNLQFFNSEVE

SEQ ID NO: 43782 - protein, 32 aa, Artificial Sequence
  Description of Artificial Sequence: Synthetic polypeptide
DEEEIATTNPVATEQYGSVATNLQREADTTRV

SEQ ID NO: 43783 - protein, 29 aa, Artificial Sequence
  Description of Artificial Sequence: Synthetic peptide
DEEEIRTTNPVATEQYGSVSALDLNGDTI

SEQ ID NO: 43784 - protein, 32 aa, Artificial Sequence
  Description of Artificial Sequence: Synthetic polypeptide
DEEEIATTNPVATEQYGSVATNLQRPGDEGAE

SEQ ID NO: 43785 - protein, 34 aa, Artificial Sequence
  Description of Artificial Sequence: Synthetic polypeptide
DEEEIRTTNPVATEQYGSVCSTVNLQSFGSNNQS

SEQ ID NO: 43786 - protein, 30 aa, Artificial Sequence
  Description of Artificial Sequence: Synthetic polypeptide
DEEEIRTTNPFATEQYGSVSYNIFGWGNDN

SEQ ID NO: 43787 - protein, 33 aa, Artificial Sequence
  Description of Artificial Sequence: Synthetic polypeptide
DEEEIRTTNPVATEQYGSVCSTVNIQRNGVVSD

SEQ ID NO: 43788 - protein, 32 aa, Artificial Sequence
  Description of Artificial Sequence: Synthetic polypeptide
DEEEIRTTNPCATEQYGSVVTVTTNLQQGNGA

SEQ ID NO: 43789 - protein, 29 aa, Artificial Sequence
  Description of Artificial Sequence: Synthetic peptide
DEEEIRTTNPCATEQYGSVVTVLAQGQEG

SEQ ID NO: 43790 - protein, 32 aa, Artificial Sequence
  Description of Artificial Sequence: Synthetic polypeptide
DEEEIRTTNPCATEQYGSVVTNLQQNLGPNES

SEQ ID NO: 43791 - protein, 33 aa, Artificial Sequence
  Description of Artificial Sequence: Synthetic polypeptide
DEEEIRTTNPVATEQYGSVSGTQNNGQNSGNGQ

SEQ ID NO: 43792 - protein, 34 aa, Artificial Sequence
  Description of Artificial Sequence: Synthetic polypeptide
DEEEIRTTNPVATEQYGSVSGTQNLQFEIGGNNP

SEQ ID NO: 43793 - protein, 32 aa, Artificial Sequence
  Description of Artificial Sequence: Synthetic polypeptide
DEEEIRTTNPVATEQYGSVSGTQNDGGNGNVT

SEQ ID NO: 43794 - protein, 34 aa, Artificial Sequence
  Description of Artificial Sequence: Synthetic polypeptide
DEEEIRTTNPVATEQYGSVSGTSNLIQDGGGNQG

SEQ ID NO: 43795 - protein, 33 aa, Artificial Sequence
  Description of Artificial Sequence: Synthetic polypeptide
DEEEIRTTNPVATEQYGSVSGTNVIQEGGNDEI

SEQ ID NO: 43796 - protein, 31 aa, Artificial Sequence
  Description of Artificial Sequence: Synthetic polypeptide
DEEEIATTNPVATESWGSVSTNLQDSGGDNH

SEQ ID NO: 43797 - protein, 30 aa, Artificial Sequence
  Description of Artificial Sequence: Synthetic polypeptide
DEEEIRTTNPCATEQYGSVVPTPLARGGKE

SEQ ID NO: 43798 - protein, 31 aa, Artificial Sequence
  Description of Artificial Sequence: Synthetic polypeptide
DEEEIATTNPVATESWGSVSTNLQMEGNMGG

SEQ ID NO: 43799 - protein, 33 aa, Artificial Sequence
  Description of Artificial Sequence: Synthetic polypeptide
DEEEIRTTNPVATEQYGCVSTNNLNQNFGSNQE

SEQ ID NO: 43800 - protein, 32 aa, Artificial Sequence
  Description of Artificial Sequence: Synthetic polypeptide
DEEEIRTTNPCATEQYGSVTVTTNLQQQGNGA

SEQ ID NO: 43801 - protein, 31 aa, Artificial Sequence
  Description of Artificial Sequence: Synthetic polypeptide
DEEEIATTNPVATESWGSVSTNLQPGGDNDH

SEQ ID NO: 43802 - protein, 31 aa, Artificial Sequence
  Description of Artificial Sequence: Synthetic polypeptide
DEEEIATTNPVATESWGSVSTNLNQGGGDNH

SEQ ID NO: 43803 - protein, 30 aa, Artificial Sequence
  Description of Artificial Sequence: Synthetic polypeptide
DEEEIRTTNPVATEQYGCVSTNNDTDNNMG

SEQ ID NO: 43804 - protein, 34 aa, Artificial Sequence
  Description of Artificial Sequence: Synthetic polypeptide
DEEEIRTTNPVATEQYGSVSGTSNLQDGEGGNGQ

SEQ ID NO: 43805 - protein, 32 aa, Artificial Sequence
  Description of Artificial Sequence: Synthetic polypeptide
DEEEIRTTNPVATEQYGSVSDAVLERIGNIDS

SEQ ID NO: 43806 - protein, 31 aa, Artificial Sequence
  Description of Artificial Sequence: Synthetic polypeptide
DEEEIRTTNPVATEQYGCVSTNNDNREGDQC

SEQ ID NO: 43807 - protein, 32 aa, Artificial Sequence
  Description of Artificial Sequence: Synthetic polypeptide
DEEEIATTNPVATEQYGVVSTNLQGDPGGNAT

SEQ ID NO: 43808 - protein, 31 aa, Artificial Sequence
  Description of Artificial Sequence: Synthetic polypeptide
DEEEIRTTNPVATEQYGCVSTNNDNRGDQQE

SEQ ID NO: 43809 - protein, 33 aa, Artificial Sequence
  Description of Artificial Sequence: Synthetic polypeptide
DEEEIRTTNPVATEQYGSVSGTVNEQTGGNGNI

SEQ ID NO: 43810 - protein, 32 aa, Artificial Sequence
  Description of Artificial Sequence: Synthetic polypeptide
DEECIRTTNPVATEQYGEVSITNLQRIPEFRG

SEQ ID NO: 43811 - protein, 32 aa, Artificial Sequence
  Description of Artificial Sequence: Synthetic polypeptide
DEEEIRTTNPVATEQYGSVSGTTNTDGEGNNA

SEQ ID NO: 43812 - protein, 32 aa, Artificial Sequence
  Description of Artificial Sequence: Synthetic polypeptide
DEECIRTTNPVATEQYGEVYSIDNHQRGGDNR

SEQ ID NO: 43813 - protein, 31 aa, Artificial Sequence
  Description of Artificial Sequence: Synthetic polypeptide
DEEEIRTTNPVATEQYGCVSTNNDNRGEDDQ

SEQ ID NO: 43814 - protein, 31 aa, Artificial Sequence
  Description of Artificial Sequence: Synthetic polypeptide
DEEEIRTTNPVATEQYGCVSTNNDNRGGMDQ

SEQ ID NO: 43815 - protein, 30 aa, Artificial Sequence
  Description of Artificial Sequence: Synthetic polypeptide
DEEEIRTTNPVATEQYGCVSTNNDNRMMDQ

SEQ ID NO: 43816 - protein, 30 aa, Artificial Sequence
  Description of Artificial Sequence: Synthetic polypeptide
DEEEIRTTNPVATEQYGCVSTNNDNTNGDQ

SEQ ID NO: 43817 - protein, 32 aa, Artificial Sequence
  Description of Artificial Sequence: Synthetic polypeptide
DEEEIATTNPVATEQYGVVSTTNGHQNGNNER

SEQ ID NO: 43818 - protein, 33 aa, Artificial Sequence
  Description of Artificial Sequence: Synthetic polypeptide
DEEEIRTTNPVATEQYGSVSGTSNMQDGGGNEG

SEQ ID NO: 43819 - protein, 31 aa, Artificial Sequence
  Description of Artificial Sequence: Synthetic polypeptide
DEEEIRTTNPCATEQYGSVYCTDNDQRNNHA

SEQ ID NO: 43820 - protein, 32 aa, Artificial Sequence
  Description of Artificial Sequence: Synthetic polypeptide
DEEEIRTTNPCATEQYGSVYATDNHDQRGNHA

SEQ ID NO: 43821 - protein, 33 aa, Artificial Sequence
  Description of Artificial Sequence: Synthetic polypeptide
DEEEIRTTNPCATEQYGSVTVSTNLQQGTNSAN

SEQ ID NO: 43822 - protein, 32 aa, Artificial Sequence
  Description of Artificial Sequence: Synthetic polypeptide
DEEEIRTTNPVATEQYGSVCSTNDHQERDQIN

SEQ ID NO: 43823 - protein, 32 aa, Artificial Sequence
  Description of Artificial Sequence: Synthetic polypeptide
DEEEIRTTNPVATEQYGSVCSTNDHQERDMMP

SEQ ID NO: 43824 - protein, 33 aa, Artificial Sequence
  Description of Artificial Sequence: Synthetic polypeptide
DEEEIATTNPVATESYGISVVSTGNLQDQIGNR

SEQ ID NO: 43825 - protein, 33 aa, Artificial Sequence
  Description of Artificial Sequence: Synthetic polypeptide
DEECIRTTNPVATEQYGSTVGTTNQLQDQGNQR

SEQ ID NO: 43826 - protein, 33 aa, Artificial Sequence
  Description of Artificial Sequence: Synthetic polypeptide
DEECIRTTNPVATEQYGSTVSCTGNMPQRGGSR

SEQ ID NO: 43827 - protein, 33 aa, Artificial Sequence
  Description of Artificial Sequence: Synthetic polypeptide
DEECIRTTNPVATEQYGSTVSCTNMPSQRTGSR

SEQ ID NO: 43828 - protein, 33 aa, Artificial Sequence
  Description of Artificial Sequence: Synthetic polypeptide
DEEEIRTTNPCATEQYGSVSVVTNLQQGNNSAE

SEQ ID NO: 43829 - protein, 32 aa, Artificial Sequence
  Description of Artificial Sequence: Synthetic polypeptide
DEEEIATTNPVATESYGSVSTNLQHDQGGNDQ

SEQ ID NO: 43830 - protein, 31 aa, Artificial Sequence
  Description of Artificial Sequence: Synthetic polypeptide
DEEEIRTTNPCATEQYGSVSVVNIQEQGNND

SEQ ID NO: 43831 - protein, 30 aa, Artificial Sequence
  Description of Artificial Sequence: Synthetic polypeptide
DEEEIRTTNPVATEQYGCVSTPDQFGSDQP

SEQ ID NO: 43832 - protein, 33 aa, Artificial Sequence
  Description of Artificial Sequence: Synthetic polypeptide
DEEEIRTTNPCATEQYGSVSVTNLQQQGTNSAT

SEQ ID NO: 43833 - protein, 32 aa, Artificial Sequence
  Description of Artificial Sequence: Synthetic polypeptide
DEECIRTTNPVATEQYGSVCSHNDLQKPAENR

SEQ ID NO: 43834 - protein, 33 aa, Artificial Sequence
  Description of Artificial Sequence: Synthetic polypeptide
DEEEIRTTNPCATEQYGSVSVTNLQQQGTNSAE

SEQ ID NO: 43835 - protein, 32 aa, Artificial Sequence
  Description of Artificial Sequence: Synthetic polypeptide
DEECIRTTNPVATEQYGSVCSSNLQFFGSERL

SEQ ID NO: 43836 - protein, 31 aa, Artificial Sequence
  Description of Artificial Sequence: Synthetic polypeptide
DEEEIRTTNPCATEQYGSVSVTNIGFVGNDE

SEQ ID NO: 43837 - protein, 30 aa, Artificial Sequence
  Description of Artificial Sequence: Synthetic polypeptide
DEEEIRTTNPVATEQYGCVSTPHQGISNQV

SEQ ID NO: 43838 - protein, 32 aa, Artificial Sequence
  Description of Artificial Sequence: Synthetic polypeptide
DEEEIRTTNPCATEQYGSVSVTNDIGFRGNAD

SEQ ID NO: 43839 - protein, 31 aa, Artificial Sequence
  Description of Artificial Sequence: Synthetic polypeptide
DEEEIRTTNPVATEQYGCVSTPHQRFGSDPQ

SEQ ID NO: 43840 - protein, 32 aa, Artificial Sequence
  Description of Artificial Sequence: Synthetic polypeptide
DEEEIRTTNPVATEQYGCVSTNNQRGSEDTYF

SEQ ID NO: 43841 - protein, 31 aa, Artificial Sequence
  Description of Artificial Sequence: Synthetic polypeptide
DEEEIRTTNPVATEQYGCVSTNNDNRDGDQK

SEQ ID NO: 43842 - protein, 31 aa, Artificial Sequence
  Description of Artificial Sequence: Synthetic polypeptide
DEEEIATTNPVATESYGSVSTNLQGEGDMGG

SEQ ID NO: 43843 - protein, 32 aa, Artificial Sequence
  Description of Artificial Sequence: Synthetic polypeptide
DEEEIRTTNPCATEQYGSVSWTDNGGQDRGKF

SEQ ID NO: 43844 - protein, 32 aa, Artificial Sequence
  Description of Artificial Sequence: Synthetic polypeptide
DEEEIRTTNPVATEQYGSVSDENNDEQRNQER

SEQ ID NO: 43845 - protein, 31 aa, Artificial Sequence
  Description of Artificial Sequence: Synthetic polypeptide
DEECIRTTNPVATEQYGQCVCSTNDQFFGNQ

SEQ ID NO: 43846 - protein, 34 aa, Artificial Sequence
  Description of Artificial Sequence: Synthetic polypeptide
DEEEIRTTNPVATEQYGSVSGTNNLQVENGNANT

SEQ ID NO: 43847 - protein, 30 aa, Artificial Sequence
  Description of Artificial Sequence: Synthetic polypeptide
DEEEIATTNPVATESYGQSVSTALQHIGEL

SEQ ID NO: 43848 - protein, 33 aa, Artificial Sequence
  Description of Artificial Sequence: Synthetic polypeptide
DEEEIRTTNPVATEQYGSVCSTNDHQERDMDIR

SEQ ID NO: 43849 - protein, 33 aa, Artificial Sequence
  Description of Artificial Sequence: Synthetic polypeptide
DEEEIRTTNPVATEQYGSVCSTNDHQERDDITR

SEQ ID NO: 43850 - protein, 30 aa, Artificial Sequence
  Description of Artificial Sequence: Synthetic polypeptide
DEEEIRTTNPCATEQYGSVSYNISRVNLDE

SEQ ID NO: 43851 - protein, 33 aa, Artificial Sequence
  Description of Artificial Sequence: Synthetic polypeptide
DEEEIRTTNPVATEQYGSVSGTNNLQNVGEGEQ

SEQ ID NO: 43852 - protein, 33 aa, Artificial Sequence
  Description of Artificial Sequence: Synthetic polypeptide
DEECIRTTNPVATEQYGQTVFCTNMLSQRGNNR

SEQ ID NO: 43853 - protein, 32 aa, Artificial Sequence
  Description of Artificial Sequence: Synthetic polypeptide
DEEEIRTTNPVATEQYGSVCSTNDHQEQDMGR

SEQ ID NO: 43854 - protein, 30 aa, Artificial Sequence
  Description of Artificial Sequence: Synthetic polypeptide
DEEEIRTTNPVATEQYGCVSTNNNDNRNDQ

SEQ ID NO: 43855 - protein, 30 aa, Artificial Sequence
  Description of Artificial Sequence: Synthetic polypeptide
DEEEIATTNPVATESYGSVSANNQEQGNQN

SEQ ID NO: 43856 - protein, 32 aa, Artificial Sequence
  Description of Artificial Sequence: Synthetic polypeptide
DEEEIATTNPVATESYGSVSTNLNQGPDGNDQ

SEQ ID NO: 43857 - protein, 31 aa, Artificial Sequence
  Description of Artificial Sequence: Synthetic polypeptide
DEEEIRTTNPCATEQYGSVSYNIDFRNGDND

SEQ ID NO: 43858 - protein, 33 aa, Artificial Sequence
  Description of Artificial Sequence: Synthetic polypeptide
DEECIRTTNPVATEQYGSTCSCTGNLSQRGGND

SEQ ID NO: 43859 - protein, 32 aa, Artificial Sequence
  Description of Artificial Sequence: Synthetic polypeptide
DEEEIATTNPVATESYGSVSTNLQGEDGNNDQ

SEQ ID NO: 43860 - protein, 33 aa, Artificial Sequence
  Description of Artificial Sequence: Synthetic polypeptide
DEECIRTTNPVATEQYGESVSQIDNHQRGGDNR

SEQ ID NO: 43861 - protein, 30 aa, Artificial Sequence
  Description of Artificial Sequence: Synthetic polypeptide
DEEEIRTTNPVATEQYGCVSTNNDNMNDQE

SEQ ID NO: 43862 - protein, 32 aa, Artificial Sequence
  Description of Artificial Sequence: Synthetic polypeptide
DEEEIRTTNPVATEQYGCVSTNNDDHNGNERG

SEQ ID NO: 43863 - protein, 31 aa, Artificial Sequence
  Description of Artificial Sequence: Synthetic polypeptide
DEEEIRTTNPVATEQYGCVSTNLGGLFNDEI

SEQ ID NO: 43864 - protein, 30 aa, Artificial Sequence
  Description of Artificial Sequence: Synthetic polypeptide
DEEEIRTTNPCATESYGSVATVNHPRGENE

SEQ ID NO: 43865 - protein, 31 aa, Artificial Sequence
  Description of Artificial Sequence: Synthetic polypeptide
DEEEIATTNPVATEQYGSVVSTNGMGDGDQR

SEQ ID NO: 43866 - protein, 29 aa, Artificial Sequence
  Description of Artificial Sequence: Synthetic peptide
DEEEIRTTNPCATESYGSVATNHERTNQE

SEQ ID NO: 43867 - protein, 29 aa, Artificial Sequence
  Description of Artificial Sequence: Synthetic peptide
DEEEIRTTNPCATESYGSVATNDGGVGNA

SEQ ID NO: 43868 - protein, 32 aa, Artificial Sequence
  Description of Artificial Sequence: Synthetic polypeptide
DEEEIATTNPVATEQYGSVVSTNLQNGGDGLH

SEQ ID NO: 43869 - protein, 28 aa, Artificial Sequence
  Description of Artificial Sequence: Synthetic peptide
DEEEIRTTNPCATESYGSVATLHERTNL

SEQ ID NO: 43870 - protein, 31 aa, Artificial Sequence
  Description of Artificial Sequence: Synthetic polypeptide
DEEEIRTTNPVATEQYGCVSTNLLGMLNDEI

SEQ ID NO: 43871 - protein, 33 aa, Artificial Sequence
  Description of Artificial Sequence: Synthetic polypeptide
DEEEIATTNPVATEQYGSVVSTTGNHQDAGNHR

SEQ ID NO: 43872 - protein, 29 aa, Artificial Sequence
  Description of Artificial Sequence: Synthetic peptide
DEECIRTTNPVATEQYGCVCTIDQFGNAD

SEQ ID NO: 43873 - protein, 32 aa, Artificial Sequence
  Description of Artificial Sequence: Synthetic polypeptide
DEEEIRTTNPVATEQYGCVSTNLNQFFNSDQS

SEQ ID NO: 43874 - protein, 31 aa, Artificial Sequence
  Description of Artificial Sequence: Synthetic polypeptide
DEEEIATTNPVATEQYGSVVTGMDQGNDGNR

SEQ ID NO: 43875 - protein, 31 aa, Artificial Sequence
  Description of Artificial Sequence: Synthetic polypeptide
DEECIRTTNPVATEQYGCVSCTNHSQFGGNS

SEQ ID NO: 43876 - protein, 32 aa, Artificial Sequence
  Description of Artificial Sequence: Synthetic polypeptide
DEEEIRTTNPVATEQYGCVSTNLNQNFGSDTQ

SEQ ID NO: 43877 - protein, 31 aa, Artificial Sequence
  Description of Artificial Sequence: Synthetic polypeptide
DEEEIATTNPVATEQYGSVVTGMGDQNGNAR

SEQ ID NO: 43878 - protein, 30 aa, Artificial Sequence
  Description of Artificial Sequence: Synthetic polypeptide
DEEEIRTTNPCATESYGSVVATNHERGNDA

SEQ ID NO: 43879 - protein, 33 aa, Artificial Sequence
  Description of Artificial Sequence: Synthetic polypeptide
DEEEIRTTNPVATEQYGSVCSTNHANFGSNTRL

SEQ ID NO: 43880 - protein, 31 aa, Artificial Sequence
  Description of Artificial Sequence: Synthetic polypeptide
DEEEIATTNPVATEQYGSVVSTNGDDGMGDR

SEQ ID NO: 43881 - protein, 32 aa, Artificial Sequence
  Description of Artificial Sequence: Synthetic polypeptide
DEEEIRTTNPVATEQYGCVSTNLFPMGLNDEI

SEQ ID NO: 43882 - protein, 30 aa, Artificial Sequence
  Description of Artificial Sequence: Synthetic polypeptide
DEEEIRTTNPVATEQYGCVSTNHTSGSEQM

SEQ ID NO: 43883 - protein, 32 aa, Artificial Sequence
  Description of Artificial Sequence: Synthetic polypeptide
DEEEIRTTNPVATEQYGCVSTNISDRIGNNQS

SEQ ID NO: 43884 - protein, 32 aa, Artificial Sequence
  Description of Artificial Sequence: Synthetic polypeptide
DEEEIRTTNPVATEQYGCVSTNISDYGENNRG

SEQ ID NO: 43885 - protein, 32 aa, Artificial Sequence
  Description of Artificial Sequence: Synthetic polypeptide
DEEEIRTTNPVATEQYGSVCSTNHQFSSSNQY

SEQ ID NO: 43886 - protein, 30 aa, Artificial Sequence
  Description of Artificial Sequence: Synthetic polypeptide
DEEEIRTTNPVATEQYGCVSTNLDELEDEI

SEQ ID NO: 43887 - protein, 32 aa, Artificial Sequence
  Description of Artificial Sequence: Synthetic polypeptide
DEEEIRTTNPVATEQYGSVCSTNHQFGSIFQS

SEQ ID NO: 43888 - protein, 33 aa, Artificial Sequence
  Description of Artificial Sequence: Synthetic polypeptide
DEEEIRTTNPVATEQYGSVCSTNHQEYFGSERP

SEQ ID NO: 43889 - protein, 33 aa, Artificial Sequence
  Description of Artificial Sequence: Synthetic polypeptide
DEEEIATTNPVATEQYGSVVHCTNALSHRGGNR

SEQ ID NO: 43890 - protein, 32 aa, Artificial Sequence
  Description of Artificial Sequence: Synthetic polypeptide
DEEEIRTTNPVATEQYGCVSTNLENFGSNNVA

SEQ ID NO: 43891 - protein, 32 aa, Artificial Sequence
  Description of Artificial Sequence: Synthetic polypeptide
DEEEIRTTNPVATEQYGCVSTNLENFGSNTQS

SEQ ID NO: 43892 - protein, 33 aa, Artificial Sequence
  Description of Artificial Sequence: Synthetic polypeptide
DEEEIATTNPVATEQYGSVVPSCTNLSTRGMSR

SEQ ID NO: 43893 - protein, 34 aa, Artificial Sequence
  Description of Artificial Sequence: Synthetic polypeptide
DEEEIATTNPVATEQYGSVVSTGNLQQDADGNHR

SEQ ID NO: 43894 - protein, 34 aa, Artificial Sequence
  Description of Artificial Sequence: Synthetic polypeptide
DEEEIATTNPVATEQYGSVVSTGNNLQAGGDNHR

SEQ ID NO: 43895 - protein, 34 aa, Artificial Sequence
  Description of Artificial Sequence: Synthetic polypeptide
DEEEIATTNPVATEQYGSVVSTGNQLQDAEGNHR

SEQ ID NO: 43896 - protein, 32 aa, Artificial Sequence
  Description of Artificial Sequence: Synthetic polypeptide
DEEEIATTNPVATEQYGSVVSTNFSQDTGGNL

SEQ ID NO: 43897 - protein, 30 aa, Artificial Sequence
  Description of Artificial Sequence: Synthetic polypeptide
DEEEIRTTNPCATESYGVCSPTNLARGNEW

SEQ ID NO: 43898 - protein, 32 aa, Artificial Sequence
  Description of Artificial Sequence: Synthetic polypeptide
DEEEIRTTNPVATEQYGCVSTPLDQRSNEDHT

SEQ ID NO: 43899 - protein, 31 aa, Artificial Sequence
  Description of Artificial Sequence: Synthetic polypeptide
DEECIRTTNPVATEQYGCVSCTNQQSGGNND

SEQ ID NO: 43900 - protein, 31 aa, Artificial Sequence
  Description of Artificial Sequence: Synthetic polypeptide
DEECIRTTNPVATEQYGCVSTGNDQFGSNQI

SEQ ID NO: 43901 - protein, 31 aa, Artificial Sequence
  Description of Artificial Sequence: Synthetic polypeptide
DEECIRTTNPVATEQYGCVSTNLQFFNSDQE

SEQ ID NO: 43902 - protein, 29 aa, Artificial Sequence
  Description of Artificial Sequence: Synthetic peptide
DEEEIATTNPVATEQYGVVHMNVDQMGNM

SEQ ID NO: 43903 - protein, 30 aa, Artificial Sequence
  Description of Artificial Sequence: Synthetic polypeptide
DEEEIATTNPVATEQYGVVSATDLQDHGEL

SEQ ID NO: 43904 - protein, 29 aa, Artificial Sequence
  Description of Artificial Sequence: Synthetic peptide
DEEEIRTTNPCATEQYGVVPTWDLDRGKE

SEQ ID NO: 43905 - protein, 32 aa, Artificial Sequence
  Description of Artificial Sequence: Synthetic polypeptide
DEEEIRTTNPVATEQYGSVSGVNDQGGGGNED

SEQ ID NO: 43906 - protein, 31 aa, Artificial Sequence
  Description of Artificial Sequence: Synthetic polypeptide
DEEEIATTNPVATEQYGVVSSDNLQMSNGNQ

SEQ ID NO: 43907 - protein, 32 aa, Artificial Sequence
  Description of Artificial Sequence: Synthetic polypeptide
DEEEIRTTNPVATEQYGSVSCTWLEQEIGDQE

SEQ ID NO: 43908 - protein, 31 aa, Artificial Sequence
  Description of Artificial Sequence: Synthetic polypeptide
DEECIRTTNPVATEQYGCVSVTNHSQSGGND

SEQ ID NO: 43909 - protein, 32 aa, Artificial Sequence
  Description of Artificial Sequence: Synthetic polypeptide
DEEEIRTTNPVATEQYGSVSGVFNGQGGNEDD

SEQ ID NO: 43910 - protein, 32 aa, Artificial Sequence
  Description of Artificial Sequence: Synthetic polypeptide
DEEEIRTTNPVATEQYGSVSGTVNMQGEMGEL

SEQ ID NO: 43911 - protein, 32 aa, Artificial Sequence
  Description of Artificial Sequence: Synthetic polypeptide
DEEEIATTNPVATEQYGVVSTNLNQGGGDNDL

SEQ ID NO: 43912 - protein, 33 aa, Artificial Sequence
  Description of Artificial Sequence: Synthetic polypeptide
DEEEIRTTNPVATEQYGSVSGTVNGQGEAGNNT

SEQ ID NO: 43913 - protein, 32 aa, Artificial Sequence
  Description of Artificial Sequence: Synthetic polypeptide
DEEEIRTTNPVATEQYGSVSCVVNLNQNGEDD

SEQ ID NO: 43914 - protein, 32 aa, Artificial Sequence
  Description of Artificial Sequence: Synthetic polypeptide
DEECIRTTNPVATEQYGESVLIDNDHQRGDNR

SEQ ID NO: 43915 - protein, 32 aa, Artificial Sequence
  Description of Artificial Sequence: Synthetic polypeptide
DEECIRTTNPVATEQYGESVSGDNHQRGGDSR

SEQ ID NO: 43916 - protein, 33 aa, Artificial Sequence
  Description of Artificial Sequence: Synthetic polypeptide
DEEEIRTTNPVATEQYGSVCSTNDLQNFGSVQY

SEQ ID NO: 43917 - protein, 31 aa, Artificial Sequence
  Description of Artificial Sequence: Synthetic polypeptide
DEEEIRTTNPVATEQYGCVSTNLPANGSEEM

SEQ ID NO: 43918 - protein, 33 aa, Artificial Sequence
  Description of Artificial Sequence: Synthetic polypeptide
DEEEIRTTNPVATEQYGCVSTNLQPEEGTNDVE

SEQ ID NO: 43919 - protein, 32 aa, Artificial Sequence
  Description of Artificial Sequence: Synthetic polypeptide
DEEEIRTTNPVATEQYGSVSCTPPLIETDNRE

SEQ ID NO: 43920 - protein, 32 aa, Artificial Sequence
  Description of Artificial Sequence: Synthetic polypeptide
DEEEIRTTNPVATEQYGCVSTNLQFFNSDNAE

SEQ ID NO: 43921 - protein, 34 aa, Artificial Sequence
  Description of Artificial Sequence: Synthetic polypeptide
DEEEIRTTNPVATEQYGSVCSTNELHVRVGENNQ

SEQ ID NO: 43922 - protein, 32 aa, Artificial Sequence
  Description of Artificial Sequence: Synthetic polypeptide
DEEEIRTTNPVATEQYGCVSTNLQGFGSETLA

SEQ ID NO: 43923 - protein, 31 aa, Artificial Sequence
  Description of Artificial Sequence: Synthetic polypeptide
DEECIRTTNPVATEQYGCVSTNDPQFGSNQI

SEQ ID NO: 43924 - protein, 31 aa, Artificial Sequence
  Description of Artificial Sequence: Synthetic polypeptide
DEEEIRTTNPVATEQYGSVSCTNPGQTDSQF

SEQ ID NO: 43925 - protein, 31 aa, Artificial Sequence
  Description of Artificial Sequence: Synthetic polypeptide
DEEEIRTTNPVATEQYGCVSTNLQNFFSDQF

SEQ ID NO: 43926 - protein, 32 aa, Artificial Sequence
  Description of Artificial Sequence: Synthetic polypeptide
DEEEIRTTNPVATEQYGSVCSTNDQNFGSDQP

SEQ ID NO: 43927 - protein, 30 aa, Artificial Sequence
  Description of Artificial Sequence: Synthetic polypeptide
DEEEIATTNPVATEQYGTTSTINPLQDENN

SEQ ID NO: 43928 - protein, 32 aa, Artificial Sequence
  Description of Artificial Sequence: Synthetic polypeptide
DEEEIRTTNPVATEQYGCVSTNLQNFNGIQGE

SEQ ID NO: 43929 - protein, 30 aa, Artificial Sequence
  Description of Artificial Sequence: Synthetic polypeptide
DEEEIATTNPVATEQYGTVMTENTQDQGDR

SEQ ID NO: 43930 - protein, 33 aa, Artificial Sequence
  Description of Artificial Sequence: Synthetic polypeptide
DEEEIRTTNPVATEQYGSVSCTPNEQRQAVNDE

SEQ ID NO: 43931 - protein, 31 aa, Artificial Sequence
  Description of Artificial Sequence: Synthetic polypeptide
DEECIRTTNPVATEQYGCVSTNEHSQFGGNE

SEQ ID NO: 43932 - protein, 31 aa, Artificial Sequence
  Description of Artificial Sequence: Synthetic polypeptide
DEEEIATTNPVATEQYGTVSTNLQGDQGDEH

SEQ ID NO: 43933 - protein, 32 aa, Artificial Sequence
  Description of Artificial Sequence: Synthetic polypeptide
DEEEIATTNPVATEQYGTVSTNLQVGGGNNDG

SEQ ID NO: 43934 - protein, 31 aa, Artificial Sequence
  Description of Artificial Sequence: Synthetic polypeptide
DEEEIRTTNPCATEQYGVVSTVNIQEQGNTD

SEQ ID NO: 43935 - protein, 31 aa, Artificial Sequence
  Description of Artificial Sequence: Synthetic polypeptide
DEECIRTTNPVATEQYGCVSTNHSQFGGNND

SEQ ID NO: 43936 - protein, 32 aa, Artificial Sequence
  Description of Artificial Sequence: Synthetic polypeptide
DEEEIATTNPVATESYGTVSTNLQGEHGNNER

SEQ ID NO: 43937 - protein, 30 aa, Artificial Sequence
  Description of Artificial Sequence: Synthetic polypeptide
DEEEIRTTNPCATEQYGSVSVNTNFEGNDD

SEQ ID NO: 43938 - protein, 30 aa, Artificial Sequence
  Description of Artificial Sequence: Synthetic polypeptide
DEEEIRTTNPCATEQYGSVSVNNNFQGNTD

SEQ ID NO: 43939 - protein, 32 aa, Artificial Sequence
  Description of Artificial Sequence: Synthetic polypeptide
DEECIRTTNPVATEQYGSVSTNPLQMRNQMEE

SEQ ID NO: 43940 - protein, 34 aa, Artificial Sequence
  Description of Artificial Sequence: Synthetic polypeptide
DEEEIRTTNPVATEQYGSVSGTNLVDQGGGNDDD

SEQ ID NO: 43941 - protein, 34 aa, Artificial Sequence
  Description of Artificial Sequence: Synthetic polypeptide
DEEEIRTTNPVATEQYGSVCSTGNLQGFGSNTDM

SEQ ID NO: 43942 - protein, 33 aa, Artificial Sequence
  Description of Artificial Sequence: Synthetic polypeptide
DEEEIRTTNPVATEQYGSVSGTNLTFNDGDNGE

SEQ ID NO: 43943 - protein, 32 aa, Artificial Sequence
  Description of Artificial Sequence: Synthetic polypeptide
DEEEIRTTNPVATEQYGCVSWGNLQFFGSDRE

SEQ ID NO: 43944 - protein, 33 aa, Artificial Sequence
  Description of Artificial Sequence: Synthetic polypeptide
DEECIRTTNPVATEQYGSVVPSTNLSDNGGNNR

SEQ ID NO: 43945 - protein, 29 aa, Artificial Sequence
  Description of Artificial Sequence: Synthetic peptide
DEEEIRTTNPCATEQYGSVPELALARGEE

SEQ ID NO: 43946 - protein, 30 aa, Artificial Sequence
  Description of Artificial Sequence: Synthetic polypeptide
DEEEIRTTNPVATEQYGCVSWMNLTNGSQQ

SEQ ID NO: 43947 - protein, 31 aa, Artificial Sequence
  Description of Artificial Sequence: Synthetic polypeptide
DEECIRTTNPVATEQYGVVCSTELQGFNSNR

SEQ ID NO: 43948 - protein, 31 aa, Artificial Sequence
  Description of Artificial Sequence: Synthetic polypeptide
DEEEIRTTNPVATEQYGCVSWNLQGFNSNTQ

SEQ ID NO: 43949 - protein, 31 aa, Artificial Sequence
  Description of Artificial Sequence: Synthetic polypeptide
DEEEIRTTNPVATEQYGCVSWNLQHFGSEQY

SEQ ID NO: 43950 - protein, 32 aa, Artificial Sequence
  Description of Artificial Sequence: Synthetic polypeptide
DEEEIRTTNPVATEQYGCVSWNLQNFGSNTQL

SEQ ID NO: 43951 - protein, 30 aa, Artificial Sequence
  Description of Artificial Sequence: Synthetic polypeptide
DEEEIRTTNPCATEQYGSVPCTILSARGKE

SEQ ID NO: 43952 - protein, 29 aa, Artificial Sequence
  Description of Artificial Sequence: Synthetic peptide
DEEEIRTTNPCATEQYGSVNTVLAQGEEV

SEQ ID NO: 43953 - protein, 31 aa, Artificial Sequence
  Description of Artificial Sequence: Synthetic polypeptide
DEEEIRTTNPVATEQYGCVSWNPQERFGSEQ

SEQ ID NO: 43954 - protein, 29 aa, Artificial Sequence
  Description of Artificial Sequence: Synthetic peptide
DEEEIRTTNPCATEQYGSVPNDLARGDEL

SEQ ID NO: 43955 - protein, 31 aa, Artificial Sequence
  Description of Artificial Sequence: Synthetic polypeptide
DEEEIRTTNPCATEQYGSVNAENLERNGNID

SEQ ID NO: 43956 - protein, 30 aa, Artificial Sequence
  Description of Artificial Sequence: Synthetic polypeptide
DEEEIRTTNPVATEQYGCVSWELQNGSDQI

SEQ ID NO: 43957 - protein, 33 aa, Artificial Sequence
  Description of Artificial Sequence: Synthetic polypeptide
DEEEIRTTNPVATEQYGSVCSTGNLQGIGSQDS

SEQ ID NO: 43958 - protein, 33 aa, Artificial Sequence
  Description of Artificial Sequence: Synthetic polypeptide
DEEEIRTTNPVATEQYGSVCSTMALQYFGSNQT

SEQ ID NO: 43959 - protein, 31 aa, Artificial Sequence
  Description of Artificial Sequence: Synthetic polypeptide
DEEEIRTTNPVATEQYGCVSTYLQSMGEQGS

SEQ ID NO: 43960 - protein, 32 aa, Artificial Sequence
  Description of Artificial Sequence: Synthetic polypeptide
DEEEIRTTNPVATEQYGCVSVSMNLQRVSDQS

SEQ ID NO: 43961 - protein, 32 aa, Artificial Sequence
  Description of Artificial Sequence: Synthetic polypeptide
DEEEIRTTNPVATEQYGSVCSTGNTQGGSDDS

SEQ ID NO: 43962 - protein, 33 aa, Artificial Sequence
  Description of Artificial Sequence: Synthetic polypeptide
DEEEIRTTNPVATEQYGSVCSTGNNQFSGSNQS

SEQ ID NO: 43963 - protein, 30 aa, Artificial Sequence
  Description of Artificial Sequence: Synthetic polypeptide
DEEEIRTTNPCATEQYGSVPTWDQDRGGKE

SEQ ID NO: 43964 - protein, 30 aa, Artificial Sequence
  Description of Artificial Sequence: Synthetic polypeptide
DEEEIRTTNPCATEQYGSVPTWDLSDRGEE

SEQ ID NO: 43965 - protein, 32 aa, Artificial Sequence
  Description of Artificial Sequence: Synthetic polypeptide
DEEEIRTTNPVATEQYGSVCSTGNLTGFGSQD

SEQ ID NO: 43966 - protein, 30 aa, Artificial Sequence
  Description of Artificial Sequence: Synthetic polypeptide
DEEEIRTTNPCATEQYGSVPTVLAVRGEVE

SEQ ID NO: 43967 - protein, 30 aa, Artificial Sequence
  Description of Artificial Sequence: Synthetic polypeptide
DEEEIRTTNPCATEQYGSVPTVLARGEYEN

SEQ ID NO: 43968 - protein, 30 aa, Artificial Sequence
  Description of Artificial Sequence: Synthetic polypeptide
DEEEIRTTNPCATEQYGSVPTVLALRGGEN

SEQ ID NO: 43969 - protein, 31 aa, Artificial Sequence
  Description of Artificial Sequence: Synthetic polypeptide
DEEEIRTTNPVATEQYGCVSWELQFFGSNAG

SEQ ID NO: 43970 - protein, 32 aa, Artificial Sequence
  Description of Artificial Sequence: Synthetic polypeptide
DEEEIATTNPVAYEAYGSVCCTNALSQRGNQR

SEQ ID NO: 43971 - protein, 30 aa, Artificial Sequence
  Description of Artificial Sequence: Synthetic polypeptide
DEEEIRTTNPCATEQYGSVPTALVARGVEE

SEQ ID NO: 43972 - protein, 33 aa, Artificial Sequence
  Description of Artificial Sequence: Synthetic polypeptide
DEEEIRTTNPVATEQYGSVCSTGNLQGSGSDQS

SEQ ID NO: 43973 - protein, 34 aa, Artificial Sequence
  Description of Artificial Sequence: Synthetic polypeptide
DEEEIRTTNPCATEQYGSVPSYTGNLSQRTVTNR

SEQ ID NO: 43974 - protein, 30 aa, Artificial Sequence
  Description of Artificial Sequence: Synthetic polypeptide
DEEEIRTTNPVATEQYGCVSTYDQFNSNQV

SEQ ID NO: 43975 - protein, 32 aa, Artificial Sequence
  Description of Artificial Sequence: Synthetic polypeptide
DEEEIRTTNPVATEQYGSVCSTGNHEGGSNDP

SEQ ID NO: 43976 - protein, 33 aa, Artificial Sequence
  Description of Artificial Sequence: Synthetic polypeptide
DEEEIRTTNPVATEQYGSVCSTGNDQGGSNNDS

SEQ ID NO: 43977 - protein, 32 aa, Artificial Sequence
  Description of Artificial Sequence: Synthetic polypeptide
DEECIRTTNPVATEQYSACVCSTGNLQIGSNR

SEQ ID NO: 43978 - protein, 31 aa, Artificial Sequence
  Description of Artificial Sequence: Synthetic polypeptide
DEEEIATTNPVAYEHYGSVNQNMLSQRGGNR

SEQ ID NO: 43979 - protein, 32 aa, Artificial Sequence
  Description of Artificial Sequence: Synthetic polypeptide
DEEEIRTTNPVATEQYGSVCSTGELQNGSEQF

SEQ ID NO: 43980 - protein, 32 aa, Artificial Sequence
  Description of Artificial Sequence: Synthetic polypeptide
DEEEIRTTNPVATEQYGSVCSTGELQGGSEDS

SEQ ID NO: 43981 - protein, 32 aa, Artificial Sequence
  Description of Artificial Sequence: Synthetic polypeptide
DEEEIRTTNPVATEQYGSVCSTGELQFQSNDY

SEQ ID NO: 43982 - protein, 32 aa, Artificial Sequence
  Description of Artificial Sequence: Synthetic polypeptide
DEEEIRTTNPVATEQYGSVCSTGELQFNSNTQ

SEQ ID NO: 43983 - protein, 33 aa, Artificial Sequence
  Description of Artificial Sequence: Synthetic polypeptide
DEEEIRTTNPVATEQYGSVCSTGELHQGFGSNQ

SEQ ID NO: 43984 - protein, 33 aa, Artificial Sequence
  Description of Artificial Sequence: Synthetic polypeptide
DEEEIRTTNPVATEQYGSVCSTGELDQNGSERP

SEQ ID NO: 43985 - protein, 31 aa, Artificial Sequence
  Description of Artificial Sequence: Synthetic polypeptide
DEEEIRTTNPCATEQYGSVIECTELQRGVEA

SEQ ID NO: 43986 - protein, 31 aa, Artificial Sequence
  Description of Artificial Sequence: Synthetic polypeptide
DEEEIRTTNPVATEQYGSVCSTGEHQNFGEQ

SEQ ID NO: 43987 - protein, 31 aa, Artificial Sequence
  Description of Artificial Sequence: Synthetic polypeptide
DEEEIRTTNPVATEQYGSVCSTGEHQFGDQA

SEQ ID NO: 43988 - protein, 32 aa, Artificial Sequence
  Description of Artificial Sequence: Synthetic polypeptide
DEEEIRTTNPCATEQYGSVIATTNLDRGNIDP

SEQ ID NO: 43989 - protein, 32 aa, Artificial Sequence
  Description of Artificial Sequence: Synthetic polypeptide
DEEEIRTTNPVATEQYGSVCSTGEDQGSGSND

SEQ ID NO: 43990 - protein, 32 aa, Artificial Sequence
  Description of Artificial Sequence: Synthetic polypeptide
DEEEIRTTNPVATEQYGSVCSTGEDQGGSNNQ

SEQ ID NO: 43991 - protein, 32 aa, Artificial Sequence
  Description of Artificial Sequence: Synthetic polypeptide
DEEEIRTTNPVATEQYGSVCSTGAHQRFGSEQ

SEQ ID NO: 43992 - protein, 31 aa, Artificial Sequence
  Description of Artificial Sequence: Synthetic polypeptide
DEEEIRTTNPVATEQYGSVCSTGLDTRPQDN

SEQ ID NO: 43993 - protein, 33 aa, Artificial Sequence
  Description of Artificial Sequence: Synthetic polypeptide
DEEEIRTTNPCATEQYGSVIEWTENLQRGVNPD

SEQ ID NO: 43994 - protein, 33 aa, Artificial Sequence
  Description of Artificial Sequence: Synthetic polypeptide
DEEEIRTTNPCATEQYGSVIEPTDNLQRGVNPN

SEQ ID NO: 43995 - protein, 32 aa, Artificial Sequence
  Description of Artificial Sequence: Synthetic polypeptide
DEEEIRTTNPVATEQYGSVCSTGLQVGEPPQQ

SEQ ID NO: 43996 - protein, 32 aa, Artificial Sequence
  Description of Artificial Sequence: Synthetic polypeptide
DEEEIRTTNPVATEQYGSVCSTGNDQGGSDQA

SEQ ID NO: 43997 - protein, 33 aa, Artificial Sequence
  Description of Artificial Sequence: Synthetic polypeptide
DEEEIRTTNPVATEQYGSVCSTGNDQEGGSNDA

SEQ ID NO: 43998 - protein, 31 aa, Artificial Sequence
  Description of Artificial Sequence: Synthetic polypeptide
DEEEIRTTNPVATEQYGCVSWPSLQRIGSQI

SEQ ID NO: 43999 - protein, 34 aa, Artificial Sequence
  Description of Artificial Sequence: Synthetic polypeptide
DEEEIRTTNPVATEQYGSVCSTGNDLQGFGSNDA

SEQ ID NO: 44000 - protein, 33 aa, Artificial Sequence
  Description of Artificial Sequence: Synthetic polypeptide
DEEEIRTTNPVATEQYGCVSWTNLENRDGMGDR

SEQ ID NO: 44001 - protein, 31 aa, Artificial Sequence
  Description of Artificial Sequence: Synthetic polypeptide
DEEEIRTTNPVATEQYGCVSYDLVQNGEDRV

SEQ ID NO: 44002 - protein, 32 aa, Artificial Sequence
  Description of Artificial Sequence: Synthetic polypeptide
DEEEIRTTNPCATEQYGSVIEPTTLQRGVNPA

SEQ ID NO: 44003 - protein, 33 aa, Artificial Sequence
  Description of Artificial Sequence: Synthetic polypeptide
DEEEIRTTNPVATEQYGCVTSNTGNHQRFGSNQ

SEQ ID NO: 44004 - protein, 32 aa, Artificial Sequence
  Description of Artificial Sequence: Synthetic polypeptide
DEEEIRTTNPVATEQYGSVCSTGLQVLFENIT

SEQ ID NO: 44005 - protein, 34 aa, Artificial Sequence
  Description of Artificial Sequence: Synthetic polypeptide
DEEEIRTTNPVATEQYGSVSGTNLQSEMGNGGEE

SEQ ID NO: 44006 - protein, 32 aa, Artificial Sequence
  Description of Artificial Sequence: Synthetic polypeptide
DEEEIRTTNPVATEQYGCVTSTGNLQFFNSNQ

SEQ ID NO: 44007 - protein, 33 aa, Artificial Sequence
  Description of Artificial Sequence: Synthetic polypeptide
DEEEIRTTNPVATEQYGCVTSTMNLQNFGSNQE

SEQ ID NO: 44008 - protein, 32 aa, Artificial Sequence
  Description of Artificial Sequence: Synthetic polypeptide
DEEEIRTTNPVATEQYGCVTSTNHQGFGSNQS

SEQ ID NO: 44009 - protein, 32 aa, Artificial Sequence
  Description of Artificial Sequence: Synthetic polypeptide
DEEEIRTTNPVATEQYGCVTSTNHQHFGSNAE

SEQ ID NO: 44010 - protein, 32 aa, Artificial Sequence
  Description of Artificial Sequence: Synthetic polypeptide
DEEEIRTTNPVATEQYGCVTSTNHQNFGSDRP

SEQ ID NO: 44011 - protein, 33 aa, Artificial Sequence
  Description of Artificial Sequence: Synthetic polypeptide
DEEEIRTTNPVATEQYGCVTSVSGNLNQRNSNQ

SEQ ID NO: 44012 - protein, 31 aa, Artificial Sequence
  Description of Artificial Sequence: Synthetic polypeptide
DEEEIRTTNPVATEQYGCVSTNHQSSNSNFT

SEQ ID NO: 44013 - protein, 31 aa, Artificial Sequence
  Description of Artificial Sequence: Synthetic polypeptide
DEEEIRTTNPCATEQYGSVSCLNEITRGGND

SEQ ID NO: 44014 - protein, 31 aa, Artificial Sequence
  Description of Artificial Sequence: Synthetic polypeptide
DEEEIRTTNPCATEQYGSVSCNGEQRVVERY

SEQ ID NO: 44015 - protein, 32 aa, Artificial Sequence
  Description of Artificial Sequence: Synthetic polypeptide
DEEEIRTTNPVATEQYGCVSTPNLQAFGSDQS

SEQ ID NO: 44016 - protein, 32 aa, Artificial Sequence
  Description of Artificial Sequence: Synthetic polypeptide
DEEEIATTNPVATETYGTVSTNLGQGNGDNTR

SEQ ID NO: 44017 - protein, 32 aa, Artificial Sequence
  Description of Artificial Sequence: Synthetic polypeptide
DEEEIATTNPVATETYGTVSTNLQGDGGDNQR

SEQ ID NO: 44018 - protein, 34 aa, Artificial Sequence
  Description of Artificial Sequence: Synthetic polypeptide
DEEEIRTTNPVATEQYGSVSGTNNELGQDEGGNG

SEQ ID NO: 44019 - protein, 31 aa, Artificial Sequence
  Description of Artificial Sequence: Synthetic polypeptide
DEEEIRTTNPVATEQYGCVSTPYLLDTGNEK

SEQ ID NO: 44020 - protein, 32 aa, Artificial Sequence
  Description of Artificial Sequence: Synthetic polypeptide
DEEEIRTTNPCATEQYGSVSTVNNIQEQGNDT

SEQ ID NO: 44021 - protein, 31 aa, Artificial Sequence
  Description of Artificial Sequence: Synthetic polypeptide
DEEEIRTTNPVATEQYGCVSTTDLQGENNVV

SEQ ID NO: 44022 - protein, 31 aa, Artificial Sequence
  Description of Artificial Sequence: Synthetic polypeptide
DEEEIATTNPVATETYGVVSTNLQGDGGNAT

SEQ ID NO: 44023 - protein, 32 aa, Artificial Sequence
  Description of Artificial Sequence: Synthetic polypeptide
DEEEIRTTNPCATEQYGSVSTVNIQEQGGNED

SEQ ID NO: 44024 - protein, 33 aa, Artificial Sequence
  Description of Artificial Sequence: Synthetic polypeptide
DEEEIRTTNPVATEQYGSVSGTNMTQGDGGNGT

SEQ ID NO: 44025 - protein, 32 aa, Artificial Sequence
  Description of Artificial Sequence: Synthetic polypeptide
DEEEIRTTNPCATEQYGSVSTVNGQEQGTNTD

SEQ ID NO: 44026 - protein, 32 aa, Artificial Sequence
  Description of Artificial Sequence: Synthetic polypeptide
DEEEIRTTNPVATEQYGCVSTTEDQHFGSNRS

SEQ ID NO: 44027 - protein, 31 aa, Artificial Sequence
  Description of Artificial Sequence: Synthetic polypeptide
DEECIRTTNPVATEQYGSVSKTLEDTRGGNT

SEQ ID NO: 44028 - protein, 32 aa, Artificial Sequence
  Description of Artificial Sequence: Synthetic polypeptide
DEEEIRTTNPCATEQYGSVSTTQGRPGVNVRD

SEQ ID NO: 44029 - protein, 31 aa, Artificial Sequence
  Description of Artificial Sequence: Synthetic polypeptide
DEEEIATTNPVATEVYGSVSTNLNPGGNDNH

SEQ ID NO: 44030 - protein, 31 aa, Artificial Sequence
  Description of Artificial Sequence: Synthetic polypeptide
DEECIRTTNPVATEQYGSVGTGNTQAEGDDR

SEQ ID NO: 44031 - protein, 33 aa, Artificial Sequence
  Description of Artificial Sequence: Synthetic polypeptide
DEEEIRTTNPCATEQYGSVSTTPALPNRNGNPR

SEQ ID NO: 44032 - protein, 33 aa, Artificial Sequence
  Description of Artificial Sequence: Synthetic polypeptide
DEEEIRTTNPVATEQYGSVSGTNNGQIGEGGNN

SEQ ID NO: 44033 - protein, 31 aa, Artificial Sequence
  Description of Artificial Sequence: Synthetic polypeptide
DEEEIATTNPVATETYGCVSTNLQLNGGDNQ

SEQ ID NO: 44034 - protein, 30 aa, Artificial Sequence
  Description of Artificial Sequence: Synthetic polypeptide
DEEEIATTNPVATETWGAVSTNLQPGGDNH

SEQ ID NO: 44035 - protein, 30 aa, Artificial Sequence
  Description of Artificial Sequence: Synthetic polypeptide
DEEEIRTTNPCATEQYGSVSVNIPREVNFQ

SEQ ID NO: 44036 - protein, 29 aa, Artificial Sequence
  Description of Artificial Sequence: Synthetic peptide
DEEEIRTTNPCATEQYGSVSVNIPIPNDI

SEQ ID NO: 44037 - protein, 33 aa, Artificial Sequence
  Description of Artificial Sequence: Synthetic polypeptide
DEEEIRTTNPVATEQYGSVCSTNASDRVGDDQR

SEQ ID NO: 44038 - protein, 31 aa, Artificial Sequence
  Description of Artificial Sequence: Synthetic polypeptide
DEECIRTTNPVATEQYGSVCSTEELRFGNTS

SEQ ID NO: 44039 - protein, 30 aa, Artificial Sequence
  Description of Artificial Sequence: Synthetic polypeptide
DEEEIRTTNPCATEQYGSVSVNIGFRGDED

SEQ ID NO: 44040 - protein, 31 aa, Artificial Sequence
  Description of Artificial Sequence: Synthetic polypeptide
DEECIRTTNPVATEQYGSVCSTEENLNGSNQ

SEQ ID NO: 44041 - protein, 31 aa, Artificial Sequence
  Description of Artificial Sequence: Synthetic polypeptide
DEEEIATTNPVATETWGTVSTNLQGDTGDNR

SEQ ID NO: 44042 - protein, 33 aa, Artificial Sequence
  Description of Artificial Sequence: Synthetic polypeptide
DEEEIRTTNPVATEQYGSVCSTNAHQERFMDNQ

SEQ ID NO: 44043 - protein, 33 aa, Artificial Sequence
  Description of Artificial Sequence: Synthetic polypeptide
DEEEIRTTNPVATEQYGSVSGTNNLIQGIGGGQ

SEQ ID NO: 44044 - protein, 31 aa, Artificial Sequence
  Description of Artificial Sequence: Synthetic polypeptide
DEEEIRTTNPCATEQYGSVSVNDIIRGMNDQ

SEQ ID NO: 44045 - protein, 30 aa, Artificial Sequence
  Description of Artificial Sequence: Synthetic polypeptide
DEEEIRTTNPCATEQYGSVSVNDIARGDED

SEQ ID NO: 44046 - protein, 29 aa, Artificial Sequence
  Description of Artificial Sequence: Synthetic peptide
DEEEIRTTNPCATEQYGSVSVMIFRVNDE

SEQ ID NO: 44047 - protein, 31 aa, Artificial Sequence
  Description of Artificial Sequence: Synthetic polypeptide
DEEEIATTNPVATETYGCVSTNLQGGGDNNH

SEQ ID NO: 44048 - protein, 33 aa, Artificial Sequence
  Description of Artificial Sequence: Synthetic polypeptide
DEEEIRTTNPVATEQYGSVSGTNNLDFEGGNEG

SEQ ID NO: 44049 - protein, 32 aa, Artificial Sequence
  Description of Artificial Sequence: Synthetic polypeptide
DEEEIRTTNPVATEQYGSVCSTMNTQFFGSEA

SEQ ID NO: 44050 - protein, 31 aa, Artificial Sequence
  Description of Artificial Sequence: Synthetic polypeptide
DEEEIRTTNPVATEQYGCVSTYDQFFGSNIA

SEQ ID NO: 44051 - protein, 33 aa, Artificial Sequence
  Description of Artificial Sequence: Synthetic polypeptide
DEEEIRTTNPCATEQYGSVSTTNLQINQGNGGG

SEQ ID NO: 44052 - protein, 32 aa, Artificial Sequence
  Description of Artificial Sequence: Synthetic polypeptide
DEEEIATTNPVATEVYGSVSTNLQGTGGNGNH

SEQ ID NO: 44053 - protein, 31 aa, Artificial Sequence
  Description of Artificial Sequence: Synthetic polypeptide
DEEEIRTTNPVATEQYGCVSTVLDDRGIQHL

SEQ ID NO: 44054 - protein, 30 aa, Artificial Sequence
  Description of Artificial Sequence: Synthetic polypeptide
DEEEIRTTNPVATEQYGCVSTVLDFDGESF

SEQ ID NO: 44055 - protein, 32 aa, Artificial Sequence
  Description of Artificial Sequence: Synthetic polypeptide
DEEEIRTTNPVATEQYGSVSDQDLIQRISNGQ

SEQ ID NO: 44056 - protein, 31 aa, Artificial Sequence
  Description of Artificial Sequence: Synthetic polypeptide
DEEEIRTTNPVATEQYGCVSTVLQMNGSEDE

SEQ ID NO: 44057 - protein, 30 aa, Artificial Sequence
  Description of Artificial Sequence: Synthetic polypeptide
DEEEIRTTNPVATEQYGCVSTVLSFNGEQF

SEQ ID NO: 44058 - protein, 30 aa, Artificial Sequence
  Description of Artificial Sequence: Synthetic polypeptide
DEEEIRTTNPVATEQYGCVSTVNDDQLDDQ

SEQ ID NO: 44059 - protein, 32 aa, Artificial Sequence
  Description of Artificial Sequence: Synthetic polypeptide
DEEEIRTTNPVATEQYGCVSTVNQIGMNQQRI

SEQ ID NO: 44060 - protein, 32 aa, Artificial Sequence
  Description of Artificial Sequence: Synthetic polypeptide
DEEEIRTTNPCATEQYGSVSPCNGEQRGENEE

SEQ ID NO: 44061 - protein, 30 aa, Artificial Sequence
  Description of Artificial Sequence: Synthetic polypeptide
DEEEIRTTNPCATEQYGSVSNNIFHGNADD

SEQ ID NO: 44062 - protein, 30 aa, Artificial Sequence
  Description of Artificial Sequence: Synthetic polypeptide
DEEEIRTTNPCATEQYGSVSNLNLQSNSAP

SEQ ID NO: 44063 - protein, 30 aa, Artificial Sequence
  Description of Artificial Sequence: Synthetic polypeptide
DEEEIRTTNPVATEQYGCVSTVVQLGSEQD

SEQ ID NO: 44064 - protein, 33 aa, Artificial Sequence
  Description of Artificial Sequence: Synthetic polypeptide
DEEEIRTTNPVATEQYGSVCSTMELQRFISNQT

SEQ ID NO: 44065 - protein, 31 aa, Artificial Sequence
  Description of Artificial Sequence: Synthetic polypeptide
DEEEIRTTNPCATEQYGSVSGNIDFSRGNDS

SEQ ID NO: 44066 - protein, 32 aa, Artificial Sequence
  Description of Artificial Sequence: Synthetic polypeptide
DEEEIRTTNPVATEQYGCVSTYDQERFGSNQV

SEQ ID NO: 44067 - protein, 33 aa, Artificial Sequence
  Description of Artificial Sequence: Synthetic polypeptide
DEEEIRTTNPVATEQYGSVCSTMELQNFGSNQA

SEQ ID NO: 44068 - protein, 31 aa, Artificial Sequence
  Description of Artificial Sequence: Synthetic polypeptide
DEEEIRTTNPVATEQYGCVSTVDQPGGGENS

SEQ ID NO: 44069 - protein, 32 aa, Artificial Sequence
  Description of Artificial Sequence: Synthetic polypeptide
DEEEIATTNPVATEVYGSVSTNLQGNMGGNNH

SEQ ID NO: 44070 - protein, 30 aa, Artificial Sequence
  Description of Artificial Sequence: Synthetic polypeptide
DEEEIRTTNPVATEQYGCVSTVDGQDGEQS

SEQ ID NO: 44071 - protein, 32 aa, Artificial Sequence
  Description of Artificial Sequence: Synthetic polypeptide
DEEEIRTTNPVATEQYGSVSDQDLIQRIDNEF

SEQ ID NO: 44072 - protein, 32 aa, Artificial Sequence
  Description of Artificial Sequence: Synthetic polypeptide
DEEEIATTNPVATEVYGSVSTNLQNQGGNDNH

SEQ ID NO: 44073 - protein, 33 aa, Artificial Sequence
  Description of Artificial Sequence: Synthetic polypeptide
DEEEIRTTNPVATEQYGSVSGTNLVENDGGNEL

SEQ ID NO: 44074 - protein, 32 aa, Artificial Sequence
  Description of Artificial Sequence: Synthetic polypeptide
DEEEIATTNPVATEWYGSVSTTNGLGQDNGNE

SEQ ID NO: 44075 - protein, 32 aa, Artificial Sequence
  Description of Artificial Sequence: Synthetic polypeptide
DEEEIRTTNPCATEQYGSVSTNLQQGAEEEDN

SEQ ID NO: 44076 - protein, 33 aa, Artificial Sequence
  Description of Artificial Sequence: Synthetic polypeptide
DEEEIRTTNPCATEQYGSVSTNLQINQGENGET

SEQ ID NO: 44077 - protein, 31 aa, Artificial Sequence
  Description of Artificial Sequence: Synthetic polypeptide
DEEEIRTTNPCATEQYGSVSTNLQGPEPSTV

SEQ ID NO: 44078 - protein, 33 aa, Artificial Sequence
  Description of Artificial Sequence: Synthetic polypeptide
DEEEIRTTNPVATEQYGSVCSTMNLQHFNSNQA

SEQ ID NO: 44079 - protein, 32 aa, Artificial Sequence
  Description of Artificial Sequence: Synthetic polypeptide
DEEEIRTTNPVATEQYGSVCSTMNLQFNSDQN

SEQ ID NO: 44080 - protein, 30 aa, Artificial Sequence
  Description of Artificial Sequence: Synthetic polypeptide
DEEEIRTTNPCATEQYGSVSTIPNERNNDQ

SEQ ID NO: 44081 - protein, 31 aa, Artificial Sequence
  Description of Artificial Sequence: Synthetic polypeptide
DEEEIRTTNPCATEQYGSVSTEHQNSGSNQS

SEQ ID NO: 44082 - protein, 30 aa, Artificial Sequence
  Description of Artificial Sequence: Synthetic polypeptide
DEEEIATTNPVAWEGYGSVSTETQASGNRF

SEQ ID NO: 44083 - protein, 33 aa, Artificial Sequence
  Description of Artificial Sequence: Synthetic polypeptide
DEEEIRTTNPVATEQYGSVCSTMNLIRFGSEQT

SEQ ID NO: 44084 - protein, 31 aa, Artificial Sequence
  Description of Artificial Sequence: Synthetic polypeptide
DEECIRTTNPVATEQYGSVSTEELYFGSNTA

SEQ ID NO: 44085 - protein, 31 aa, Artificial Sequence
  Description of Artificial Sequence: Synthetic polypeptide
DEECIRTTNPVATEQYGSVSTEHQSFGSNDG

SEQ ID NO: 44086 - protein, 34 aa, Artificial Sequence
  Description of Artificial Sequence: Synthetic polypeptide
DEEEIRTTNPVATEQYGSVCSTMNHQRFGSNPQP

SEQ ID NO: 44087 - protein, 31 aa, Artificial Sequence
  Description of Artificial Sequence: Synthetic polypeptide
DEEEIRTTNPVATEQYGCVSTVDDRGINQHT

SEQ ID NO: 44088 - protein, 34 aa, Artificial Sequence
  Description of Artificial Sequence: Synthetic polypeptide
DEEEIRTTNPVATEQYGSVSGTNLQMEMGNGEIE

SEQ ID NO: 44089 - protein, 32 aa, Artificial Sequence
  Description of Artificial Sequence: Synthetic polypeptide
DEEEIATTNPVATEQYGSVSVSGNGLQRVNEI

SEQ ID NO: 44090 - protein, 32 aa, Artificial Sequence
  Description of Artificial Sequence: Synthetic polypeptide
DEEEIRTTNPVATEQYGSVSHTEGLQGFGIMD

SEQ ID NO: 44091 - protein, 33 aa, Artificial Sequence
  Description of Artificial Sequence: Synthetic polypeptide
DEEEIRTTNPVATEQYGSVCSTNLINFGSDNQY

SEQ ID NO: 44092 - protein, 33 aa, Artificial Sequence
  Description of Artificial Sequence: Synthetic polypeptide
DEEEIRTTNPVATEQYGSVCSTNLHQNFGSQDA

SEQ ID NO: 44093 - protein, 34 aa, Artificial Sequence
  Description of Artificial Sequence: Synthetic polypeptide
DEEEIRTTNPVATEQYGSVCSTNLHQGFGSNNQS

SEQ ID NO: 44094 - protein, 32 aa, Artificial Sequence
  Description of Artificial Sequence: Synthetic polypeptide
DEEEIRTTNPVATEQYGCVSSGNHQRFNSNRT

SEQ ID NO: 44095 - protein, 32 aa, Artificial Sequence
  Description of Artificial Sequence: Synthetic polypeptide
DEEEIATTNPVATEQYGSVSTALNPGQGNNDR

SEQ ID NO: 44096 - protein, 33 aa, Artificial Sequence
  Description of Artificial Sequence: Synthetic polypeptide
DEEEIATTNPVATEQYGSVSTANGMDERNGDNR

SEQ ID NO: 44097 - protein, 33 aa, Artificial Sequence
  Description of Artificial Sequence: Synthetic polypeptide
DEEEIRTTNPVATEQYGSVCSTNLLQENGSEDA

SEQ ID NO: 44098 - protein, 29 aa, Artificial Sequence
  Description of Artificial Sequence: Synthetic peptide
DEEEIRTTNPEATEQYGSVPTWNARDGKE

SEQ ID NO: 44099 - protein, 30 aa, Artificial Sequence
  Description of Artificial Sequence: Synthetic polypeptide
DEEEIATTNPVATEQYGSVSTDLEHEGEDL

SEQ ID NO: 44100 - protein, 29 aa, Artificial Sequence
  Description of Artificial Sequence: Synthetic peptide
DEEEIRTTNPEATEQYGSVPTWLESGEKE

SEQ ID NO: 44101 - protein, 30 aa, Artificial Sequence
  Description of Artificial Sequence: Synthetic polypeptide
DEEEIRTTNPEATEQYGSVPTWLARTGKEN

SEQ ID NO: 44102 - protein, 30 aa, Artificial Sequence
  Description of Artificial Sequence: Synthetic polypeptide
DEEEIRTTNPVATEQYGCVSSNHQGFGEDG

SEQ ID NO: 44103 - protein, 31 aa, Artificial Sequence
  Description of Artificial Sequence: Synthetic polypeptide
DEEEIRTTNPVATEQYGCVSSNHQHFGSNAG

SEQ ID NO: 44104 - protein, 31 aa, Artificial Sequence
  Description of Artificial Sequence: Synthetic polypeptide
DEEEIRTTNPVATEQYGCVSSNHQNFNSNRS

SEQ ID NO: 44105 - protein, 30 aa, Artificial Sequence
  Description of Artificial Sequence: Synthetic polypeptide
DEEEIATTNPVATEQYGSVSTDLEDHEGEL

SEQ ID NO: 44106 - protein, 33 aa, Artificial Sequence
  Description of Artificial Sequence: Synthetic polypeptide
DEEEIRTTNPVATEQYGSVCSTNLNQHFGSDDY

SEQ ID NO: 44107 - protein, 33 aa, Artificial Sequence
  Description of Artificial Sequence: Synthetic polypeptide
DEEEIRTTNPVATEQYGSVCSTNLNQNFGSDQA

SEQ ID NO: 44108 - protein, 33 aa, Artificial Sequence
  Description of Artificial Sequence: Synthetic polypeptide
DEEEIRTTNPVATEQYGSVCSTNLNQNFGSEIS

SEQ ID NO: 44109 - protein, 32 aa, Artificial Sequence
  Description of Artificial Sequence: Synthetic polypeptide
DEEEIRTTNPVATEQYGCVSPNLDQDIGDPRI

SEQ ID NO: 44110 - protein, 33 aa, Artificial Sequence
  Description of Artificial Sequence: Synthetic polypeptide
DEEEIRTTNPVATEQYGSVSITNDDQGEGGGNS

SEQ ID NO: 44111 - protein, 31 aa, Artificial Sequence
  Description of Artificial Sequence: Synthetic polypeptide
DEEEIRTTNPVATEQYGCVSPPLLERGNEEF

SEQ ID NO: 44112 - protein, 29 aa, Artificial Sequence
  Description of Artificial Sequence: Synthetic peptide
DEEEIRTTNPEATQQYGCVPTIDIQRGNF

SEQ ID NO: 44113 - protein, 32 aa, Artificial Sequence
  Description of Artificial Sequence: Synthetic polypeptide
DEEEIRTTNPEATNQYGSVSTMNAHQRGNIQY

SEQ ID NO: 44114 - protein, 32 aa, Artificial Sequence
  Description of Artificial Sequence: Synthetic polypeptide
DEEEIRTTNPVATEQYGCVSSELDQRFGSNQG

SEQ ID NO: 44115 - protein, 33 aa, Artificial Sequence
  Description of Artificial Sequence: Synthetic polypeptide
DEEEIRTTNPVATEQYGSVSITMMQEGGDNDRN

SEQ ID NO: 44116 - protein, 29 aa, Artificial Sequence
  Description of Artificial Sequence: Synthetic peptide
DEEEIRTTNPEATEQYGTVPITVLARGKE

SEQ ID NO: 44117 - protein, 33 aa, Artificial Sequence
  Description of Artificial Sequence: Synthetic polypeptide
DEEEIRTTNPVATEQYGSVCSTNLQFFGSVTQY

SEQ ID NO: 44118 - protein, 33 aa, Artificial Sequence
  Description of Artificial Sequence: Synthetic polypeptide
DEEEIRTTNPVATEQYGSVCSTNLQESFGSVDS

SEQ ID NO: 44119 - protein, 33 aa, Artificial Sequence
  Description of Artificial Sequence: Synthetic polypeptide
DEEEIRTTNPVATEQYGSVCSTNLQEHFNSVQL

SEQ ID NO: 44120 - protein, 33 aa, Artificial Sequence
  Description of Artificial Sequence: Synthetic polypeptide
DEEEIRTTNPVATEQYGSVCSTNLQEFFNSNVE

SEQ ID NO: 44121 - protein, 33 aa, Artificial Sequence
  Description of Artificial Sequence: Synthetic polypeptide
DEEEIRTTNPVATEQYGSVSCTNALSDIVENNR

SEQ ID NO: 44122 - protein, 33 aa, Artificial Sequence
  Description of Artificial Sequence: Synthetic polypeptide
DEEEIRTTNPVATEQYGSVCSTNLQASGSETQS

SEQ ID NO: 44123 - protein, 32 aa, Artificial Sequence
  Description of Artificial Sequence: Synthetic polypeptide
DEEEIRTTNPVATEQYGSVCSTNLPFLQEEIT

SEQ ID NO: 44124 - protein, 30 aa, Artificial Sequence
  Description of Artificial Sequence: Synthetic polypeptide
DEEEIRTTNPEATEQYGSVPTWILARGKEQ

SEQ ID NO: 44125 - protein, 29 aa, Artificial Sequence
  Description of Artificial Sequence: Synthetic peptide
DEEEIRTTNPEATEQYGSVPTWDARGGEL

SEQ ID NO: 44126 - protein, 30 aa, Artificial Sequence
  Description of Artificial Sequence: Synthetic polypeptide
DEEEIRTTNPEATEQYGSVPTVLAARSGKE

SEQ ID NO: 44127 - protein, 30 aa, Artificial Sequence
  Description of Artificial Sequence: Synthetic polypeptide
DEEEIRTTNPEATEQYGSVPTMHLARGKES

SEQ ID NO: 44128 - protein, 30 aa, Artificial Sequence
  Description of Artificial Sequence: Synthetic polypeptide
DEEEIRTTNPVATEQYGCVSTALQMNIDEI

SEQ ID NO: 44129 - protein, 31 aa, Artificial Sequence
  Description of Artificial Sequence: Synthetic polypeptide
DEECIRTTNPVATEQWGSVATDNLQLDVNLR

SEQ ID NO: 44130 - protein, 32 aa, Artificial Sequence
  Description of Artificial Sequence: Synthetic polypeptide
DEECIRTTNPVATEQWGSVATLNELSQFGGNR

SEQ ID NO: 44131 - protein, 33 aa, Artificial Sequence
  Description of Artificial Sequence: Synthetic polypeptide
DEEEIATTNPVATEQYGSVSTNLNGDAGGNNTR

SEQ ID NO: 44132 - protein, 30 aa, Artificial Sequence
  Description of Artificial Sequence: Synthetic polypeptide
DEEEIRTTNPEATEQYGCVCSSNIFRGSNQ

SEQ ID NO: 44133 - protein, 31 aa, Artificial Sequence
  Description of Artificial Sequence: Synthetic polypeptide
DEEEIRTTNPVATEQYGCVSTDDLQGENNGM

SEQ ID NO: 44134 - protein, 32 aa, Artificial Sequence
  Description of Artificial Sequence: Synthetic polypeptide
DEEEIRTTNPVATEQYGCVSTDDLQQRPEDRI

SEQ ID NO: 44135 - protein, 31 aa, Artificial Sequence
  Description of Artificial Sequence: Synthetic polypeptide
DEEEIRTTNPVATEQYGCVSTDDLQTENNFQ

SEQ ID NO: 44136 - protein, 32 aa, Artificial Sequence
  Description of Artificial Sequence: Synthetic polypeptide
DEEEIRTTNPVATEQYGCVSTDLDQQRSEERN

SEQ ID NO: 44137 - protein, 32 aa, Artificial Sequence
  Description of Artificial Sequence: Synthetic polypeptide
DEEEIRTTNPVATEQYGSVSCTNGGDRGEKQF

SEQ ID NO: 44138 - protein, 33 aa, Artificial Sequence
  Description of Artificial Sequence: Synthetic polypeptide
DEEEIRTTNPVATEQYGCVSTDLQQHGTNEDRI

SEQ ID NO: 44139 - protein, 31 aa, Artificial Sequence
  Description of Artificial Sequence: Synthetic polypeptide
DEEEIATTNPVATEQYGSVSTNLNGNANDAS

SEQ ID NO: 44140 - protein, 32 aa, Artificial Sequence
  Description of Artificial Sequence: Synthetic polypeptide
DEECIRTTNPVATEQWGSVATNNLSQPGGNTR

SEQ ID NO: 44141 - protein, 32 aa, Artificial Sequence
  Description of Artificial Sequence: Synthetic polypeptide
DEECIRTTNPVATEQWGSVATNNMLSQHGGNR

SEQ ID NO: 44142 - protein, 32 aa, Artificial Sequence
  Description of Artificial Sequence: Synthetic polypeptide
DEEEIATTNPVATEQYGSVSTNLNGNMGGDMR

SEQ ID NO: 44143 - protein, 32 aa, Artificial Sequence
  Description of Artificial Sequence: Synthetic polypeptide
DEECIRTTNPVATEQWGSVACTNNALQGGGNR

SEQ ID NO: 44144 - protein, 30 aa, Artificial Sequence
  Description of Artificial Sequence: Synthetic polypeptide
DEEEIRTTNPEATQQYGEVCTIDLQRGQNF

SEQ ID NO: 44145 - protein, 32 aa, Artificial Sequence
  Description of Artificial Sequence: Synthetic polypeptide
DEEEIRTTNPVATEQYGCVSTALQFFGSNNQP

SEQ ID NO: 44146 - protein, 31 aa, Artificial Sequence
  Description of Artificial Sequence: Synthetic polypeptide
DEEEIATTNPVATEQYGSVSTNHGNNGGNNV

SEQ ID NO: 44147 - protein, 32 aa, Artificial Sequence
  Description of Artificial Sequence: Synthetic polypeptide
DEEEIRTTNPVATEQYGCVSSNLQERFGSDQY

SEQ ID NO: 44148 - protein, 33 aa, Artificial Sequence
  Description of Artificial Sequence: Synthetic polypeptide
DEEEIRTTNPVATEQYGSVSITGNLQAEEGEPL

SEQ ID NO: 44149 - protein, 30 aa, Artificial Sequence
  Description of Artificial Sequence: Synthetic polypeptide
DEEEIRTTNPEATEQYGSVPTEELARGSDQ

SEQ ID NO: 44150 - protein, 29 aa, Artificial Sequence
  Description of Artificial Sequence: Synthetic peptide
DEEEIRTTNPEATEQYGSVPTALAYGSEQ

SEQ ID NO: 44151 - protein, 31 aa, Artificial Sequence
  Description of Artificial Sequence: Synthetic polypeptide
DEEEIRTTNPVATEQYGCVSSYLQFFGSNQP

SEQ ID NO: 44152 - protein, 31 aa, Artificial Sequence
  Description of Artificial Sequence: Synthetic polypeptide
DEEEIRTTNPVATEQYGCVSTADLQHFNSND

SEQ ID NO: 44153 - protein, 31 aa, Artificial Sequence
  Description of Artificial Sequence: Synthetic polypeptide
DEEEIRTTNPVATEQYGCVSTAHQEYGSNQS

SEQ ID NO: 44154 - protein, 30 aa, Artificial Sequence
  Description of Artificial Sequence: Synthetic polypeptide
DEEEIRTTNPEATEQYGSVHTEVLAERGKE

SEQ ID NO: 44155 - protein, 31 aa, Artificial Sequence
  Description of Artificial Sequence: Synthetic polypeptide
DEEEIATTNPVATEQYGSVSTGNMGNTGNNV

SEQ ID NO: 44156 - protein, 32 aa, Artificial Sequence
  Description of Artificial Sequence: Synthetic polypeptide
DEEEIATTNPVATEQYGSVSTMNSGQGGQPRG

SEQ ID NO: 44157 - protein, 30 aa, Artificial Sequence
  Description of Artificial Sequence: Synthetic polypeptide
DEEEIRTTNPEATEQYGSVCPTYLARGEQA

SEQ ID NO: 44158 - protein, 30 aa, Artificial Sequence
  Description of Artificial Sequence: Synthetic polypeptide
DEEEIRTTNPEATEQYGSVCPTELAERGEQ

SEQ ID NO: 44159 - protein, 33 aa, Artificial Sequence
  Description of Artificial Sequence: Synthetic polypeptide
DEEEIRTTNPVATEQYGSVSITGNGTQGGGNQD

SEQ ID NO: 44160 - protein, 31 aa, Artificial Sequence
  Description of Artificial Sequence: Synthetic polypeptide
DEEEIATTNPVATEQYGSVSTNGAGNTGNNV

SEQ ID NO: 44161 - protein, 29 aa, Artificial Sequence
  Description of Artificial Sequence: Synthetic peptide
DEEEIRTTNPEATEQYGSVCPTEHARGVQ

SEQ ID NO: 44162 - protein, 32 aa, Artificial Sequence
  Description of Artificial Sequence: Synthetic polypeptide
DEEEIRTTNPVATEQYGCVSTALQEYFGSNQM

SEQ ID NO: 44163 - protein, 32 aa, Artificial Sequence
  Description of Artificial Sequence: Synthetic polypeptide
DEEEIRTTNPVATEQYGCVSPNLDQDGQDPNP

SEQ ID NO: 44164 - protein, 32 aa, Artificial Sequence
  Description of Artificial Sequence: Synthetic polypeptide
DEEEIRTTNPVATEQYGCVSNTPLQENGSNQQ

SEQ ID NO: 44165 - protein, 32 aa, Artificial Sequence
  Description of Artificial Sequence: Synthetic polypeptide
DEEEIRTTNPVATEQYGCVSNTNTQRFGSEAF

SEQ ID NO: 44166 - protein, 32 aa, Artificial Sequence
  Description of Artificial Sequence: Synthetic polypeptide
DEEEIRTTNPVATEQYGSVCSTPEHQHGGSNA

SEQ ID NO: 44167 - protein, 32 aa, Artificial Sequence
  Description of Artificial Sequence: Synthetic polypeptide
DEEEIRTTNPVATEQYGSVSITNLQGLLFEMP

SEQ ID NO: 44168 - protein, 33 aa, Artificial Sequence
  Description of Artificial Sequence: Synthetic polypeptide
DEEEIATTNPVATEQYGSVPSCTNSLSQVRGSF

SEQ ID NO: 44169 - protein, 34 aa, Artificial Sequence
  Description of Artificial Sequence: Synthetic polypeptide
DEEEIRTTNPVATEQYGSVSITNLQFGSGNQEQG

SEQ ID NO: 44170 - protein, 32 aa, Artificial Sequence
  Description of Artificial Sequence: Synthetic polypeptide
DEEEIRTTNPVATEQYGSVCSTNTQYFGSVDS

SEQ ID NO: 44171 - protein, 30 aa, Artificial Sequence
  Description of Artificial Sequence: Synthetic polypeptide
DEEEIATTNPVATEQYGSVSADDLQSGEDL

SEQ ID NO: 44172 - protein, 33 aa, Artificial Sequence
  Description of Artificial Sequence: Synthetic polypeptide
DEEEIRTTNPFATEQYGSVPSETNNLFREGMND

SEQ ID NO: 44173 - protein, 33 aa, Artificial Sequence
  Description of Artificial Sequence: Synthetic polypeptide
DEEEIRTTNPVATEQYGSVSITNLPGSGGNGQE

SEQ ID NO: 44174 - protein, 31 aa, Artificial Sequence
  Description of Artificial Sequence: Synthetic polypeptide
DEEEIATTNPVATEQYGSVSANNQEQGGNDQ

SEQ ID NO: 44175 - protein, 32 aa, Artificial Sequence
  Description of Artificial Sequence: Synthetic polypeptide
DEEEIRTTNPVATEQYGSVSCTDNGGHRGGKF

SEQ ID NO: 44176 - protein, 33 aa, Artificial Sequence
  Description of Artificial Sequence: Synthetic polypeptide
DEEEIRTTNPVATEQYGSVSCTDNLQFDGSQDI

SEQ ID NO: 44177 - protein, 32 aa, Artificial Sequence
  Description of Artificial Sequence: Synthetic polypeptide
DEEEIRTTNPVATEQYGSVCSTNPQNIGSDQA

SEQ ID NO: 44178 - protein, 30 aa, Artificial Sequence
  Description of Artificial Sequence: Synthetic polypeptide
DEEEIRTTNPFATEQYGSVCYNNEDRGNDH

SEQ ID NO: 44179 - protein, 33 aa, Artificial Sequence
  Description of Artificial Sequence: Synthetic polypeptide
DEEEIRTTNPVATEQYGSVSITNLISGVGENDP

SEQ ID NO: 44180 - protein, 32 aa, Artificial Sequence
  Description of Artificial Sequence: Synthetic polypeptide
DEEEIRTTNPVATEQYGSVCSTNPQGGSEDQS

SEQ ID NO: 44181 - protein, 31 aa, Artificial Sequence
  Description of Artificial Sequence: Synthetic polypeptide
DEEEIRTTNPVATEQYGSVCSTPLQFNSDIA

SEQ ID NO: 44182 - protein, 33 aa, Artificial Sequence
  Description of Artificial Sequence: Synthetic polypeptide
DEEEIRTTNPVATEQYGSVSITNLIQVEMNPDA

SEQ ID NO: 44183 - protein, 33 aa, Artificial Sequence
  Description of Artificial Sequence: Synthetic polypeptide
DEEEIRTTNPVATEQYGSVCSTPLQRANDNGDP

SEQ ID NO: 44184 - protein, 32 aa, Artificial Sequence
  Description of Artificial Sequence: Synthetic polypeptide
DEEEIRTTNPVATEQYGSVCSTPNLQHNSDQL

SEQ ID NO: 44185 - protein, 32 aa, Artificial Sequence
  Description of Artificial Sequence: Synthetic polypeptide
DEEEIRTTNPVATEQYGSVCSTVLQTYGDQID

SEQ ID NO: 44186 - protein, 32 aa, Artificial Sequence
  Description of Artificial Sequence: Synthetic polypeptide
DEEEIRTTNPVATEQYGSVCSTVHQNFGSNTQ

SEQ ID NO: 44187 - protein, 32 aa, Artificial Sequence
  Description of Artificial Sequence: Synthetic polypeptide
DEEEIATTNPVATEQYGSVCSTTPQDRSGNED

SEQ ID NO: 44188 - protein, 30 aa, Artificial Sequence
  Description of Artificial Sequence: Synthetic polypeptide
DEEEIRTTNPVATEQYGSVSCSELEGTNDI

SEQ ID NO: 44189 - protein, 32 aa, Artificial Sequence
  Description of Artificial Sequence: Synthetic polypeptide
DEEEIRTTNPVATEQYGSVCSTTNDHQGGSDQ

SEQ ID NO: 44190 - protein, 34 aa, Artificial Sequence
  Description of Artificial Sequence: Synthetic polypeptide
DEEEIRTTNPVATEQYGSVSITNLQQINIGGNQG

SEQ ID NO: 44191 - protein, 34 aa, Artificial Sequence
  Description of Artificial Sequence: Synthetic polypeptide
DEEEIRTTNPVATEQYGSVCSTTMNLQSFGSNQT

SEQ ID NO: 44192 - protein, 33 aa, Artificial Sequence
  Description of Artificial Sequence: Synthetic polypeptide
DEEEIRTTNPVATEQYGSVCSTTGNDQLGNDNQ

SEQ ID NO: 44193 - protein, 30 aa, Artificial Sequence
  Description of Artificial Sequence: Synthetic polypeptide
DEEEIRTTNPVATEQYGSVSCSLLQETEDI

SEQ ID NO: 44194 - protein, 33 aa, Artificial Sequence
  Description of Artificial Sequence: Synthetic polypeptide
DEEEIRTTNPVATEQYGSVCSTTEPLERFGSNQ

SEQ ID NO: 44195 - protein, 32 aa, Artificial Sequence
  Description of Artificial Sequence: Synthetic polypeptide
DEEEIATTNPVATEQYGSVCTAANGLQMDENR

SEQ ID NO: 44196 - protein, 32 aa, Artificial Sequence
  Description of Artificial Sequence: Synthetic polypeptide
DEEEIATTNPVATEQYGSVCTDNLQDHGDNPV

SEQ ID NO: 44197 - protein, 31 aa, Artificial Sequence
  Description of Artificial Sequence: Synthetic polypeptide
DEEEIATTNPVATEQYGSVCTNLEEARDGEE

SEQ ID NO: 44198 - protein, 30 aa, Artificial Sequence
  Description of Artificial Sequence: Synthetic polypeptide
DEECISTVNPVATEAYGSTVSDNLSERGNR

SEQ ID NO: 44199 - protein, 32 aa, Artificial Sequence
  Description of Artificial Sequence: Synthetic polypeptide
DEEEIATTNPVATEQYGSVCTNPLQAEMGDNL

SEQ ID NO: 44200 - protein, 31 aa, Artificial Sequence
  Description of Artificial Sequence: Synthetic polypeptide
DEEEIRTTNPVATEQYGSVSCTDGGERGSKF

SEQ ID NO: 44201 - protein, 31 aa, Artificial Sequence
  Description of Artificial Sequence: Synthetic polypeptide
DEEEIRTTNPVATEQYGCVSTDNQQRTEDHI

SEQ ID NO: 44202 - protein, 32 aa, Artificial Sequence
  Description of Artificial Sequence: Synthetic polypeptide
DEEEIRTTNPVATEQYGSVCSTNPNQNGSEQI

SEQ ID NO: 44203 - protein, 33 aa, Artificial Sequence
  Description of Artificial Sequence: Synthetic polypeptide
DEEEIRTTNPVATEQYGSVCSTNPLQVNTGSQN

SEQ ID NO: 44204 - protein, 33 aa, Artificial Sequence
  Description of Artificial Sequence: Synthetic polypeptide
DEEEIRTTNPVATEQYGSVSCTGNGGQRGGIFM

SEQ ID NO: 44205 - protein, 31 aa, Artificial Sequence
  Description of Artificial Sequence: Synthetic polypeptide
DEEEIATTNPVATEQYGSVSDINEPQSEGNQ

SEQ ID NO: 44206 - protein, 33 aa, Artificial Sequence
  Description of Artificial Sequence: Synthetic polypeptide
DEEEIRTTNPVATEQYGSVCSTNNDQFFGSNAA

SEQ ID NO: 44207 - protein, 33 aa, Artificial Sequence
  Description of Artificial Sequence: Synthetic polypeptide
DEEEIRTTNPVATEQYGSVCSTNLVQRAEQEHI

SEQ ID NO: 44208 - protein, 32 aa, Artificial Sequence
  Description of Artificial Sequence: Synthetic polypeptide
DEEEIRTTNPVATEQYGSVCSTNLQYNSETQM

SEQ ID NO: 44209 - protein, 29 aa, Artificial Sequence
  Description of Artificial Sequence: Synthetic peptide
DEEEIRTTNPEATRQYGCVPTVDLQRGEF

SEQ ID NO: 44210 - protein, 30 aa, Artificial Sequence
  Description of Artificial Sequence: Synthetic polypeptide
DEEEIRTTNPEATQQYGTVPTIDGLQRGNF

SEQ ID NO: 44211 - protein, 31 aa, Artificial Sequence
  Description of Artificial Sequence: Synthetic polypeptide
DEEEIATTNPVATEQYGSVSHTNDGGQRQKF

SEQ ID NO: 44212 - protein, 32 aa, Artificial Sequence
  Description of Artificial Sequence: Synthetic polypeptide
DEEEIATTNPVATEQYGSVSKTNDLNQQGGEK

SEQ ID NO: 44213 - protein, 33 aa, Artificial Sequence
  Description of Artificial Sequence: Synthetic polypeptide
DEEEIATTNPVATEQYGSVSKTNDLPQDRDGEK

SEQ ID NO: 44214 - protein, 33 aa, Artificial Sequence
  Description of Artificial Sequence: Synthetic polypeptide
DEEEIATTNPVATEQYGSVSKTNDLQDQRGGEK

SEQ ID NO: 44215 - protein, 31 aa, Artificial Sequence
  Description of Artificial Sequence: Synthetic polypeptide
DEEEIATTNPVATEQYGSVSMANGGQSRGPF

SEQ ID NO: 44216 - protein, 31 aa, Artificial Sequence
  Description of Artificial Sequence: Synthetic polypeptide
DEECIRTTNPVATEIYGQVTTNLQANGDNDR

SEQ ID NO: 44217 - protein, 31 aa, Artificial Sequence
  Description of Artificial Sequence: Synthetic polypeptide
DEECIRTTNPVATEIYGQVTTNLQGGDGSNR

SEQ ID NO: 44218 - protein, 30 aa, Artificial Sequence
  Description of Artificial Sequence: Synthetic polypeptide
DEEEIATTNPVATEQYGSVSMSNGGERGPF

SEQ ID NO: 44219 - protein, 33 aa, Artificial Sequence
  Description of Artificial Sequence: Synthetic polypeptide
DEEEIATTNPVATEQYGSVSCTNSLSQVRGGED

SEQ ID NO: 44220 - protein, 31 aa, Artificial Sequence
  Description of Artificial Sequence: Synthetic polypeptide
DEEEIATTNPVATEQYGSVSATDLQDHEGEL

SEQ ID NO: 44221 - protein, 29 aa, Artificial Sequence
  Description of Artificial Sequence: Synthetic peptide
DEEEIRTTNPEATRQYGQVPTDLQGGGNA

SEQ ID NO: 44222 - protein, 29 aa, Artificial Sequence
  Description of Artificial Sequence: Synthetic peptide
DEEEIRTTNPEATRQYGQVPTDLQRGDQF

SEQ ID NO: 44223 - protein, 29 aa, Artificial Sequence
  Description of Artificial Sequence: Synthetic peptide
DEEEIRTTNPFATDQYGSVSYPIFRSGND

SEQ ID NO: 44224 - protein, 33 aa, Artificial Sequence
  Description of Artificial Sequence: Synthetic polypeptide
DEEEIRTTNPVATEQYGSVCSTNPLQNFGSEQS

SEQ ID NO: 44225 - protein, 33 aa, Artificial Sequence
  Description of Artificial Sequence: Synthetic polypeptide
DEEEIRTTNPVATEQYGSVCSTNPLQHADNGDP

SEQ ID NO: 44226 - protein, 33 aa, Artificial Sequence
  Description of Artificial Sequence: Synthetic polypeptide
DEEEIRTTNPVATEQYGSVCSTNPHVRVGDDQR

SEQ ID NO: 44227 - protein, 30 aa, Artificial Sequence
  Description of Artificial Sequence: Synthetic polypeptide
DEECIRTTNPVATEIYGCVTTDLQRGSNQQ

SEQ ID NO: 44228 - protein, 33 aa, Artificial Sequence
  Description of Artificial Sequence: Synthetic polypeptide
DEEEIRTTNPVATEQYGSVCSTNNQNFGSNTQA

SEQ ID NO: 44229 - protein, 32 aa, Artificial Sequence
  Description of Artificial Sequence: Synthetic polypeptide
DEEEIRTTNPVATEQYGSVCSTNNPQDGPDQH

SEQ ID NO: 44230 - protein, 31 aa, Artificial Sequence
  Description of Artificial Sequence: Synthetic polypeptide
DEEEIATTNPVATEQYGSVSCALPNRNGMNV

SEQ ID NO: 44231 - protein, 30 aa, Artificial Sequence
  Description of Artificial Sequence: Synthetic polypeptide
DEEEIRTTNPEATWQYGQVPTDLQLRGSNF

SEQ ID NO: 44232 - protein, 32 aa, Artificial Sequence
  Description of Artificial Sequence: Synthetic polypeptide
DEEEIRTTNPVATEQYGSVSITNLAGGLVEMD

SEQ ID NO: 44233 - protein, 31 aa, Artificial Sequence
  Description of Artificial Sequence: Synthetic polypeptide
DEEEIATTNPVATEQYGSVSCINEPQSEGNQ

SEQ ID NO: 44234 - protein, 30 aa, Artificial Sequence
  Description of Artificial Sequence: Synthetic polypeptide
DEEEIRTTNPEATRQYGQVPTDSLQRGNNF

SEQ ID NO: 44235 - protein, 33 aa, Artificial Sequence
  Description of Artificial Sequence: Synthetic polypeptide
DEEEIRTTNPVATEQYGSVCSTNNLQFFGSDFV

SEQ ID NO: 44236 - protein, 32 aa, Artificial Sequence
  Description of Artificial Sequence: Synthetic polypeptide
DEEEIRTTNPVATEQYGSVSCTENGGLRGVQF

SEQ ID NO: 44237 - protein, 34 aa, Artificial Sequence
  Description of Artificial Sequence: Synthetic polypeptide
DEEEIATTNPVATEQYGSVSCTINMLSQSTGNNR

SEQ ID NO: 44238 - protein, 32 aa, Artificial Sequence
  Description of Artificial Sequence: Synthetic polypeptide
DEEEIRTTNPVATEQYGCVSNTNLQEFGSQQE

SEQ ID NO: 44239 - protein, 30 aa, Artificial Sequence
  Description of Artificial Sequence: Synthetic polypeptide
DEECIRTTNPVATEQWGSVATNSLQLDDNQ

SEQ ID NO: 44240 - protein, 31 aa, Artificial Sequence
  Description of Artificial Sequence: Synthetic polypeptide
DEEEIRTTNPVATEQYGCVSTDQQDDGNQFE

SEQ ID NO: 44241 - protein, 32 aa, Artificial Sequence
  Description of Artificial Sequence: Synthetic polypeptide
DEECIRTTNPVATEQWGSVATPNLSQLTGGNR

SEQ ID NO: 44242 - protein, 32 aa, Artificial Sequence
  Description of Artificial Sequence: Synthetic polypeptide
DEEEIRTTNPVATEQYGSVCSTNIQNFFSNQA

SEQ ID NO: 44243 - protein, 32 aa, Artificial Sequence
  Description of Artificial Sequence: Synthetic polypeptide
DEEEIRTTNPVATEQYGCVSTMALQHFGSNQS

SEQ ID NO: 44244 - protein, 31 aa, Artificial Sequence
  Description of Artificial Sequence: Synthetic polypeptide
DEEEIRTTNPVATEQYGSVSIGTLEGGNEQA

SEQ ID NO: 44245 - protein, 32 aa, Artificial Sequence
  Description of Artificial Sequence: Synthetic polypeptide
DEEEIRTTNPVATEQYGCVSTMDMTRGNEDRN

SEQ ID NO: 44246 - protein, 32 aa, Artificial Sequence
  Description of Artificial Sequence: Synthetic polypeptide
DEEEIRTTNPVATEQYGCVSTMELERFGSNDG

SEQ ID NO: 44247 - protein, 32 aa, Artificial Sequence
  Description of Artificial Sequence: Synthetic polypeptide
DEEEIRTTNPVATEQYGSVCSTNHQYSGSDQA

SEQ ID NO: 44248 - protein, 32 aa, Artificial Sequence
  Description of Artificial Sequence: Synthetic polypeptide
DEEEIRTTNPVATEQYGCVSTMNLQAFGSEQT

SEQ ID NO: 44249 - protein, 33 aa, Artificial Sequence
  Description of Artificial Sequence: Synthetic polypeptide
DEEEIRTTNPVATEQYGSVCSTNHQSSGSNNQG

SEQ ID NO: 44250 - protein, 32 aa, Artificial Sequence
  Description of Artificial Sequence: Synthetic polypeptide
DEEEIRTTNPVATEQYGCVSTMNLQEFFGSDQ

SEQ ID NO: 44251 - protein, 32 aa, Artificial Sequence
  Description of Artificial Sequence: Synthetic polypeptide
DEEEIATTNPVATEQYGSVSTTDLNDRNGNPV

SEQ ID NO: 44252 - protein, 33 aa, Artificial Sequence
  Description of Artificial Sequence: Synthetic polypeptide
DEEEIATTNPVATEQYGSVSTTGNDDQRNGQNM

SEQ ID NO: 44253 - protein, 32 aa, Artificial Sequence
  Description of Artificial Sequence: Synthetic polypeptide
DEEEIRTTNPVATEQYGCVSTMNLQNFGSDQA

SEQ ID NO: 44254 - protein, 32 aa, Artificial Sequence
  Description of Artificial Sequence: Synthetic polypeptide
DEEEIRTTNPVATEQYGCVSTNAHQEGFMSIR

SEQ ID NO: 44255 - protein, 31 aa, Artificial Sequence
  Description of Artificial Sequence: Synthetic polypeptide
DEEEIRTTNPVATEQYGCVSTNAHQERFMEV

SEQ ID NO: 44256 - protein, 32 aa, Artificial Sequence
  Description of Artificial Sequence: Synthetic polypeptide
DEECIRTTNPVATEQYGCVCSTGNLQGGSNDF

SEQ ID NO: 44257 - protein, 32 aa, Artificial Sequence
  Description of Artificial Sequence: Synthetic polypeptide
DEEEIRTTNPVATEQYGSVSILNDLTQRDQIM

SEQ ID NO: 44258 - protein, 30 aa, Artificial Sequence
  Description of Artificial Sequence: Synthetic polypeptide
DEEEIRTTNPCAYEGYGSCSTNLSARVGNQ

SEQ ID NO: 44259 - protein, 29 aa, Artificial Sequence
  Description of Artificial Sequence: Synthetic peptide
DEEEIRTTNPCAYEPYGSVPATNHGRGNA

SEQ ID NO: 44260 - protein, 33 aa, Artificial Sequence
  Description of Artificial Sequence: Synthetic polypeptide
DEEEIRTTNPVATEQYGSVSIMPNHDQGRNNNR

SEQ ID NO: 44261 - protein, 31 aa, Artificial Sequence
  Description of Artificial Sequence: Synthetic polypeptide
DEEEIRTTNPVATEQYGCVSTGETQRFTSNQ

SEQ ID NO: 44262 - protein, 31 aa, Artificial Sequence
  Description of Artificial Sequence: Synthetic polypeptide
DEEEIRTTNPVATEQYGSVSINHQRELPPAG

SEQ ID NO: 44263 - protein, 32 aa, Artificial Sequence
  Description of Artificial Sequence: Synthetic polypeptide
DEEEIATTNPVATEQYGSVSTNSGNNDAGNNR

SEQ ID NO: 44264 - protein, 32 aa, Artificial Sequence
  Description of Artificial Sequence: Synthetic polypeptide
DEEEIRTTNPVATEQYGCVSTGNHQFFGSNLE

SEQ ID NO: 44265 - protein, 31 aa, Artificial Sequence
  Description of Artificial Sequence: Synthetic polypeptide
DEEEIRTTNPVATEQYGCVSTGNHQSNSNIT

SEQ ID NO: 44266 - protein, 32 aa, Artificial Sequence
  Description of Artificial Sequence: Synthetic polypeptide
DEEEIATTNPVATEQYGSVSTNSLEQVRIFEF

SEQ ID NO: 44267 - protein, 33 aa, Artificial Sequence
  Description of Artificial Sequence: Synthetic polypeptide
DEEEIRTTNPVATEQYGCVSTGNLQEFFGSNVE

SEQ ID NO: 44268 - protein, 32 aa, Artificial Sequence
  Description of Artificial Sequence: Synthetic polypeptide
DEEEIRTTNPVATEQYGCVSTGNLQGFGSDPQ

SEQ ID NO: 44269 - protein, 33 aa, Artificial Sequence
  Description of Artificial Sequence: Synthetic polypeptide
DEEEIRTTNPVATEQYGCVSTGNLQYFGSNNQE

SEQ ID NO: 44270 - protein, 32 aa, Artificial Sequence
  Description of Artificial Sequence: Synthetic polypeptide
DEEEIRTTNPVATEQYGCVSTGNTQNFGSNAA

SEQ ID NO: 44271 - protein, 32 aa, Artificial Sequence
  Description of Artificial Sequence: Synthetic polypeptide
DEEEIRTTNPVATEQYGSVCSTNLAGFGSVDA

SEQ ID NO: 44272 - protein, 32 aa, Artificial Sequence
  Description of Artificial Sequence: Synthetic polypeptide
DEEEIRTTNPVATEQYGCVSTGPLQFFGSNQA

SEQ ID NO: 44273 - protein, 31 aa, Artificial Sequence
  Description of Artificial Sequence: Synthetic polypeptide
DEECIRTTNPVATEQYGCVCSTELQNFGNQS

SEQ ID NO: 44274 - protein, 32 aa, Artificial Sequence
  Description of Artificial Sequence: Synthetic polypeptide
DEEEIRTTNPVATEQYGCVSTIELQEFFGSNQ

SEQ ID NO: 44275 - protein, 32 aa, Artificial Sequence
  Description of Artificial Sequence: Synthetic polypeptide
DEEEIRTTNPVATEQYGCVSTIELQFFGSNQS

SEQ ID NO: 44276 - protein, 33 aa, Artificial Sequence
  Description of Artificial Sequence: Synthetic polypeptide
DEEEIRTTNPVATEQYGCVSTINLQFFGSNTQS

SEQ ID NO: 44277 - protein, 32 aa, Artificial Sequence
  Description of Artificial Sequence: Synthetic polypeptide
DEEEIRTTNPVATEQYGCVSTGELQRFSSNQL

SEQ ID NO: 44278 - protein, 32 aa, Artificial Sequence
  Description of Artificial Sequence: Synthetic polypeptide
DEEEIATTNPVATEQYGSVSTTNHSQPGGNNE

SEQ ID NO: 44279 - protein, 32 aa, Artificial Sequence
  Description of Artificial Sequence: Synthetic polypeptide
DEECIRTTNPVATEQYGCVCSTNDLQNGSNQG

SEQ ID NO: 44280 - protein, 31 aa, Artificial Sequence
  Description of Artificial Sequence: Synthetic polypeptide
DEEEIRTTNPVATEQYGCVSTNHIERNSNQP

SEQ ID NO: 44281 - protein, 32 aa, Artificial Sequence
  Description of Artificial Sequence: Synthetic polypeptide
DEEEIATTNPVATEQYGSVSTVNDGQNGGDSR

SEQ ID NO: 44282 - protein, 31 aa, Artificial Sequence
  Description of Artificial Sequence: Synthetic polypeptide
DEEEIRTTNPVATEQYGCVSTNHQERNSDAS

SEQ ID NO: 44283 - protein, 33 aa, Artificial Sequence
  Description of Artificial Sequence: Synthetic polypeptide
DEEEIRTTNPVATEQYGSVSIANLQGRFGPHIL

SEQ ID NO: 44284 - protein, 33 aa, Artificial Sequence
  Description of Artificial Sequence: Synthetic polypeptide
DEEEIATTNPVATEQYGSVSVADNLGQRGVNQN

SEQ ID NO: 44285 - protein, 31 aa, Artificial Sequence
  Description of Artificial Sequence: Synthetic polypeptide
DEEEIRTTNPVATEQYGCVSTNHQGSGSELS

SEQ ID NO: 44286 - protein, 31 aa, Artificial Sequence
  Description of Artificial Sequence: Synthetic polypeptide
DEEEIATTNPVATEQYGSVSVAENMDRGVNQ

SEQ ID NO: 44287 - protein, 32 aa, Artificial Sequence
  Description of Artificial Sequence: Synthetic polypeptide
DEEEIRTTNPVATEQYGCVSTNHQHFGSNNQI

SEQ ID NO: 44288 - protein, 31 aa, Artificial Sequence
  Description of Artificial Sequence: Synthetic polypeptide
DEEEIRTTNPVATEQYGCVSTNHQHFNSNAS

SEQ ID NO: 44289 - protein, 30 aa, Artificial Sequence
  Description of Artificial Sequence: Synthetic polypeptide
DEEEIRTTNPVATEQYGCVSTNHQHNSDLT

SEQ ID NO: 44290 - protein, 32 aa, Artificial Sequence
  Description of Artificial Sequence: Synthetic polypeptide
DEEEIATTNPVATEQYGSVSVAGNLGQDGVNQ

SEQ ID NO: 44291 - protein, 31 aa, Artificial Sequence
  Description of Artificial Sequence: Synthetic polypeptide
DEEEIATTNPVATEQYGSVSVANNQEAGNVE

SEQ ID NO: 44292 - protein, 31 aa, Artificial Sequence
  Description of Artificial Sequence: Synthetic polypeptide
DEEEIATTNPVATEQYGSVSVSGNDQRVNEQ

SEQ ID NO: 44293 - protein, 31 aa, Artificial Sequence
  Description of Artificial Sequence: Synthetic polypeptide
DEEEIRTTNPVATEQYGCVSTNHQNNSNNQS

SEQ ID NO: 44294 - protein, 32 aa, Artificial Sequence
  Description of Artificial Sequence: Synthetic polypeptide
DEEEIRTTNPVATEQYGCVSTNHQRFMSNNQI

SEQ ID NO: 44295 - protein, 29 aa, Artificial Sequence
  Description of Artificial Sequence: Synthetic peptide
DEEEIATTNPVATEQYGSVSTVLEDHEEK

SEQ ID NO: 44296 - protein, 32 aa, Artificial Sequence
  Description of Artificial Sequence: Synthetic polypeptide
DEEEIRTTNPVATEQYGCVSTNDHQYFNSERT

SEQ ID NO: 44297 - protein, 29 aa, Artificial Sequence
  Description of Artificial Sequence: Synthetic peptide
DEEEIATTNPVATEQYGSVSTVCQDHEEK

SEQ ID NO: 44298 - protein, 32 aa, Artificial Sequence
  Description of Artificial Sequence: Synthetic polypeptide
DEEEIRTTNPVATEQYGSVSIEKNDGQPGNHW

SEQ ID NO: 44299 - protein, 32 aa, Artificial Sequence
  Description of Artificial Sequence: Synthetic polypeptide
DEEEIRTTNPVATEQYGSVCSTNHQRFQSEDQ

SEQ ID NO: 44300 - protein, 30 aa, Artificial Sequence
  Description of Artificial Sequence: Synthetic polypeptide
DEECIRTTNPVATEQYGCVCSTNDQFSGEQ

SEQ ID NO: 44301 - protein, 32 aa, Artificial Sequence
  Description of Artificial Sequence: Synthetic polypeptide
DEEEIRTTNPVATEQYGSVCSTNHQNMNSDQI

SEQ ID NO: 44302 - protein, 31 aa, Artificial Sequence
  Description of Artificial Sequence: Synthetic polypeptide
DEEEIRTTNPVATEQYGCVSTNDQFFNSNVE

SEQ ID NO: 44303 - protein, 31 aa, Artificial Sequence
  Description of Artificial Sequence: Synthetic polypeptide
DEEEIRTTNPVATEQYGCVSTNDQPGGGEDG

SEQ ID NO: 44304 - protein, 32 aa, Artificial Sequence
  Description of Artificial Sequence: Synthetic polypeptide
DEEEIRTTNPVATEQYGCVSTNDQPGPNQQEI

SEQ ID NO: 44305 - protein, 33 aa, Artificial Sequence
  Description of Artificial Sequence: Synthetic polypeptide
DEEEIRTTNPVATEQYGSVCSTNHQNFGSNFEM

SEQ ID NO: 44306 - protein, 31 aa, Artificial Sequence
  Description of Artificial Sequence: Synthetic polypeptide
DEECIRTTNPVATEQYGCVCSTNHQNGSNQA

SEQ ID NO: 44307 - protein, 32 aa, Artificial Sequence
  Description of Artificial Sequence: Synthetic polypeptide
DEEEIRTTNPVATEQYGSVCSTNHQHNSNTAL

SEQ ID NO: 44308 - protein, 31 aa, Artificial Sequence
  Description of Artificial Sequence: Synthetic polypeptide
DEEEIRTTNPVATEQYGCVSTNEHGERDMIR

SEQ ID NO: 44309 - protein, 32 aa, Artificial Sequence
  Description of Artificial Sequence: Synthetic polypeptide
DEEEIRTTNPVATEQYGSVCSTNHQHFQSNNA

SEQ ID NO: 44310 - protein, 32 aa, Artificial Sequence
  Description of Artificial Sequence: Synthetic polypeptide
DEECIRTTNPVATEQYGCVCSTNLQNGSNTQS

SEQ ID NO: 44311 - protein, 33 aa, Artificial Sequence
  Description of Artificial Sequence: Synthetic polypeptide
DEEEIRTTNPVATEQYGSVSIELLPQMRGVDRD

SEQ ID NO: 44312 - protein, 32 aa, Artificial Sequence
  Description of Artificial Sequence: Synthetic polypeptide
DEEEIRTTNPVATEQYGCVSTNFLERGGDEDQ

SEQ ID NO: 44313 - protein, 32 aa, Artificial Sequence
  Description of Artificial Sequence: Synthetic polypeptide
DEEEIRTTNPVATEQYGSVCSTNHQGSGSQQV

SEQ ID NO: 44314 - protein, 32 aa, Artificial Sequence
  Description of Artificial Sequence: Synthetic polypeptide
DEEEIRTTNPVATEQYGSVCSTNHQGIISNQE

SEQ ID NO: 44315 - protein, 31 aa, Artificial Sequence
  Description of Artificial Sequence: Synthetic polypeptide
DEEEIRTTNPVATEQYGCVSTNHQRFTSEQN

SEQ ID NO: 44316 - protein, 32 aa, Artificial Sequence
  Description of Artificial Sequence: Synthetic polypeptide
DEEEIRTTNPVATEQYGCVSTGELQHGSNNAS

SEQ ID NO: 44317 - protein, 32 aa, Artificial Sequence
  Description of Artificial Sequence: Synthetic polypeptide
DEEEIRTTNPVATEQYGCVSTGALQGSGSNQN

SEQ ID NO: 44318 - protein, 31 aa, Artificial Sequence
  Description of Artificial Sequence: Synthetic polypeptide
DEEEIRTTNPVATEQYGCVSTEGHQRNSNQT

SEQ ID NO: 44319 - protein, 31 aa, Artificial Sequence
  Description of Artificial Sequence: Synthetic polypeptide
DEEEIRTTNPVATEQYGCVSTEHQGNSNTRT

SEQ ID NO: 44320 - protein, 29 aa, Artificial Sequence
  Description of Artificial Sequence: Synthetic peptide
DEEEIRTTNPEATAQWGQVCPTDLQRGNF

SEQ ID NO: 44321 - protein, 32 aa, Artificial Sequence
  Description of Artificial Sequence: Synthetic polypeptide
DEEEIATTNPVATEQYGSVSTNLQGDQQNEEQ

SEQ ID NO: 44322 - protein, 31 aa, Artificial Sequence
  Description of Artificial Sequence: Synthetic polypeptide
DEEEIRTTNPVATEQYGCVSTEHQRFGSQVV

SEQ ID NO: 44323 - protein, 32 aa, Artificial Sequence
  Description of Artificial Sequence: Synthetic polypeptide
DEEEIATTNPVATEQYGSVSTNLQGNAGGDQK

SEQ ID NO: 44324 - protein, 32 aa, Artificial Sequence
  Description of Artificial Sequence: Synthetic polypeptide
DEEEIATTNPVATEQYGSVSTNLQGNEGGDKA

SEQ ID NO: 44325 - protein, 30 aa, Artificial Sequence
  Description of Artificial Sequence: Synthetic polypeptide
DEECIRTTNPVATEQYGCPATNLQRNPDRN

SEQ ID NO: 44326 - protein, 28 aa, Artificial Sequence
  Description of Artificial Sequence: Synthetic peptide
DEEEIRTTNPDATEGYGSCSTPLARDED

SEQ ID NO: 44327 - protein, 29 aa, Artificial Sequence
  Description of Artificial Sequence: Synthetic peptide
DEEEIRTTNPDATEGYGSCSTNLARTEGP

SEQ ID NO: 44328 - protein, 31 aa, Artificial Sequence
  Description of Artificial Sequence: Synthetic polypeptide
DEEEIRTTNPVATEQYGSVSIQNELYWENQA

SEQ ID NO: 44329 - protein, 30 aa, Artificial Sequence
  Description of Artificial Sequence: Synthetic polypeptide
DEEEIRTTNPVATEQYGSVSIPTLQNMIEE

SEQ ID NO: 44330 - protein, 32 aa, Artificial Sequence
  Description of Artificial Sequence: Synthetic polypeptide
DEEEIRTTNPVATEQYGSVSIPNLQQGEIPST

SEQ ID NO: 44331 - protein, 33 aa, Artificial Sequence
  Description of Artificial Sequence: Synthetic polypeptide
DEEEIRTTNPVATEQYGSVSIPNLQPREAEERG

SEQ ID NO: 44332 - protein, 29 aa, Artificial Sequence
  Description of Artificial Sequence: Synthetic peptide
DEEEIRTTNPVATEQYGSVSIPLWNSMEE

SEQ ID NO: 44333 - protein, 30 aa, Artificial Sequence
  Description of Artificial Sequence: Synthetic polypeptide
DEECIRTTNPVATEQWGVVATNNLQLDDNR

SEQ ID NO: 44334 - protein, 32 aa, Artificial Sequence
  Description of Artificial Sequence: Synthetic polypeptide
DEEEIATTNPVATEQYGSVSTNLQHNNGGDGK

SEQ ID NO: 44335 - protein, 31 aa, Artificial Sequence
  Description of Artificial Sequence: Synthetic polypeptide
DEECIRTTNPVATEQWGSVWTNNALQLGVNE

SEQ ID NO: 44336 - protein, 31 aa, Artificial Sequence
  Description of Artificial Sequence: Synthetic polypeptide
DEEEIRTTNPVATEQYGCVSTEEHQSGSNQP

SEQ ID NO: 44337 - protein, 32 aa, Artificial Sequence
  Description of Artificial Sequence: Synthetic polypeptide
DEECIRTTNPVATEQWGSVATTNNLQGGVNDR

SEQ ID NO: 44338 - protein, 31 aa, Artificial Sequence
  Description of Artificial Sequence: Synthetic polypeptide
DEEEIRTTNPVATEQYGSVSCTNGGQPESEF

SEQ ID NO: 44339 - protein, 31 aa, Artificial Sequence
  Description of Artificial Sequence: Synthetic polypeptide
DEEEIRTTNPVATEQYGCVSTDVLQIDGSQQ

SEQ ID NO: 44340 - protein, 32 aa, Artificial Sequence
  Description of Artificial Sequence: Synthetic polypeptide
DEEEIRTTNPVATEQYGCVSTEAHQEGFGSNR

SEQ ID NO: 44341 - protein, 32 aa, Artificial Sequence
  Description of Artificial Sequence: Synthetic polypeptide
DEEEIRTTNPVATEQYGCVSTEDHQRFGSERN

SEQ ID NO: 44342 - protein, 32 aa, Artificial Sequence
  Description of Artificial Sequence: Synthetic polypeptide
DEEEIRTTNPVATEQYGCVSTEDLQHFGSERS

SEQ ID NO: 44343 - protein, 31 aa, Artificial Sequence
  Description of Artificial Sequence: Synthetic polypeptide
DEEEIRTTNPVATEQYGCVSTEDLQRFISEQ

SEQ ID NO: 44344 - protein, 31 aa, Artificial Sequence
  Description of Artificial Sequence: Synthetic polypeptide
DEEEIRTTNPVATEQYGCVSTEDPQGGSERS

SEQ ID NO: 44345 - protein, 29 aa, Artificial Sequence
  Description of Artificial Sequence: Synthetic peptide
DEEEIRTTNPEATCQYGCVPTGDHQRGNF

SEQ ID NO: 44346 - protein, 29 aa, Artificial Sequence
  Description of Artificial Sequence: Synthetic peptide
DEEEIRTTNPEATCQYGCVPTELQSGSNF

SEQ ID NO: 44347 - protein, 31 aa, Artificial Sequence
  Description of Artificial Sequence: Synthetic polypeptide
DEEEIRTTNPVATEQYGCVSTEEHQRISNQN

SEQ ID NO: 44348 - protein, 32 aa, Artificial Sequence
  Description of Artificial Sequence: Synthetic polypeptide
DEECIRTTNPVATEQWGSVSTNLSTRGGNNQN

SEQ ID NO: 44349 - protein, 29 aa, Artificial Sequence
  Description of Artificial Sequence: Synthetic peptide
DEEEIRTTNPEATCQYGCVPTEHQRGNFS

SEQ ID NO: 44350 - protein, 30 aa, Artificial Sequence
  Description of Artificial Sequence: Synthetic polypeptide
DEEEIRTTNPVATEQYGCVSTEEHQRNSDQ

SEQ ID NO: 44351 - protein, 33 aa, Artificial Sequence
  Description of Artificial Sequence: Synthetic polypeptide
DEEEIRTTNPVATEQYGSVSITDMLQEGGDNVN

SEQ ID NO: 44352 - protein, 32 aa, Artificial Sequence
  Description of Artificial Sequence: Synthetic polypeptide
DEEEIATTNPVATEQYGSVSTNLQAGQGQGDQ

SEQ ID NO: 44353 - protein, 31 aa, Artificial Sequence
  Description of Artificial Sequence: Synthetic polypeptide
DEEEIRTTNPVATEQYGCVSTGEHQHNSNRT

SEQ ID NO: 44354 - protein, 29 aa, Artificial Sequence
  Description of Artificial Sequence: Synthetic peptide
DEEEIRTTNPVATEQYGSVSIPLDNMEFE

SEQ ID NO: 44355 - protein, 31 aa, Artificial Sequence
  Description of Artificial Sequence: Synthetic polypeptide
DEEEIRTTNPVATEQYGSVSINQIENVGNEE

SEQ ID NO: 44356 - protein, 32 aa, Artificial Sequence
  Description of Artificial Sequence: Synthetic polypeptide
DEEEIRTTNPVATEQYGCVSTEPLEGFGSNRA

SEQ ID NO: 44357 - protein, 32 aa, Artificial Sequence
  Description of Artificial Sequence: Synthetic polypeptide
DEEEIRTTNPVATEQYGCVSTEPQERFGSERA

SEQ ID NO: 44358 - protein, 30 aa, Artificial Sequence
  Description of Artificial Sequence: Synthetic polypeptide
DEEEIRTTNPVATEQYGCVSTEPQGGSEVA

SEQ ID NO: 44359 - protein, 31 aa, Artificial Sequence
  Description of Artificial Sequence: Synthetic polypeptide
DEEEIRTTNPVATEQYGCVSTEPQNGSENQL

SEQ ID NO: 44360 - protein, 30 aa, Artificial Sequence
  Description of Artificial Sequence: Synthetic polypeptide
DEEEIRTTNPVATEQYGCVSTEPQRNSEQT

SEQ ID NO: 44361 - protein, 28 aa, Artificial Sequence
  Description of Artificial Sequence: Synthetic peptide
DEEEIRTTNPCAYEQYGSVATWLADGDE

SEQ ID NO: 44362 - protein, 33 aa, Artificial Sequence
  Description of Artificial Sequence: Synthetic polypeptide
DEEEIRTTNPVATEQYGSVSCTNHSQITVENNR

SEQ ID NO: 44363 - protein, 31 aa, Artificial Sequence
  Description of Artificial Sequence: Synthetic polypeptide
DEEEIRTTNPCAYEQYGSVATNLQRNDNDQY

SEQ ID NO: 44364 - protein, 31 aa, Artificial Sequence
  Description of Artificial Sequence: Synthetic polypeptide
DEEEIRTTNPCAYEQYGSVATNLQRGGMPDN

SEQ ID NO: 44365 - protein, 32 aa, Artificial Sequence
  Description of Artificial Sequence: Synthetic polypeptide
DEEEIATTNPVATEQYGSVSTNNELRTGDGRP

SEQ ID NO: 44366 - protein, 31 aa, Artificial Sequence
  Description of Artificial Sequence: Synthetic polypeptide
DEEEIATTNPVATEQYGSVSTNNHQENDMMR

SEQ ID NO: 44367 - protein, 31 aa, Artificial Sequence
  Description of Artificial Sequence: Synthetic polypeptide
DEEEIRTTNPCAYEQYGSVATNLQATENGRE

SEQ ID NO: 44368 - protein, 31 aa, Artificial Sequence
  Description of Artificial Sequence: Synthetic polypeptide
DEEEIATTNPVATEQYGSVSTNNQHNDNDGS

SEQ ID NO: 44369 - protein, 30 aa, Artificial Sequence
  Description of Artificial Sequence: Synthetic polypeptide
DEEEIRTTNPVATEQYGCVSTEPQSGSEQD

SEQ ID NO: 44370 - protein, 30 aa, Artificial Sequence
  Description of Artificial Sequence: Synthetic polypeptide
DEEEIRTTNPVATEQYGCVSTEPQYFISER

SEQ ID NO: 44371 - protein, 33 aa, Artificial Sequence
  Description of Artificial Sequence: Synthetic polypeptide
DEEEIRTTNPVATEQYGCVSTENTQEHFGSNRT

SEQ ID NO: 44372 - protein, 29 aa, Artificial Sequence
  Description of Artificial Sequence: Synthetic peptide
DEEEIRTTNPVATEQYGSVSIPDQNQEVE

SEQ ID NO: 44373 - protein, 33 aa, Artificial Sequence
  Description of Artificial Sequence: Synthetic polypeptide
DEEEIRTTNPVATEQYGSVSCTNHSQETGLNNQ

SEQ ID NO: 44374 - protein, 33 aa, Artificial Sequence
  Description of Artificial Sequence: Synthetic polypeptide
DEEEIRTTNPVATEQYGCVSTENLQHFGSNNAS

SEQ ID NO: 44375 - protein, 31 aa, Artificial Sequence
  Description of Artificial Sequence: Synthetic polypeptide
DEEEIRTTNPDATECYGSVCSTNDGADRGNW

SEQ ID NO: 44376 - protein, 30 aa, Artificial Sequence
  Description of Artificial Sequence: Synthetic polypeptide
DEEEIRTTNPVATEQYGCVSTELERNSEQG

SEQ ID NO: 44377 - protein, 32 aa, Artificial Sequence
  Description of Artificial Sequence: Synthetic polypeptide
DEEEIRTTNPVATEQYGCVSTELNQNFGSNIQ

SEQ ID NO: 44378 - protein, 31 aa, Artificial Sequence
  Description of Artificial Sequence: Synthetic polypeptide
DEEEIRTTNPVATEQYGCVSTELQEHNSNQQ

SEQ ID NO: 44379 - protein, 32 aa, Artificial Sequence
  Description of Artificial Sequence: Synthetic polypeptide
DEEEIATTNPVATEQYGSVSTNLQPGGAQGEE

SEQ ID NO: 44380 - protein, 31 aa, Artificial Sequence
  Description of Artificial Sequence: Synthetic polypeptide
DEEEIRTTNPVATEQYGCVSTELQENGSQQS

SEQ ID NO: 44381 - protein, 32 aa, Artificial Sequence
  Description of Artificial Sequence: Synthetic polypeptide
DEEEIRTTNPVATEQYGSVSINPNQMQRNVNE

SEQ ID NO: 44382 - protein, 32 aa, Artificial Sequence
  Description of Artificial Sequence: Synthetic polypeptide
DEEEIRTTNPVATEQYGCVSTELQERFGSQQI

SEQ ID NO: 44383 - protein, 32 aa, Artificial Sequence
  Description of Artificial Sequence: Synthetic polypeptide
DEEEIRTTNPVATEQYGSVSINNLQPFENENM

SEQ ID NO: 44384 - protein, 32 aa, Artificial Sequence
  Description of Artificial Sequence: Synthetic polypeptide
DEEEIATTNPVATEQYGSVSTNLQPGGGQDEV

SEQ ID NO: 44385 - protein, 32 aa, Artificial Sequence
  Description of Artificial Sequence: Synthetic polypeptide
DEEEIRTTNPVATEQYGCVSTELQHFGSNFQL

SEQ ID NO: 44386 - protein, 31 aa, Artificial Sequence
  Description of Artificial Sequence: Synthetic polypeptide
DEEEIRTTNPVATEQYGCVSTELQYFNSDQE

SEQ ID NO: 44387 - protein, 33 aa, Artificial Sequence
  Description of Artificial Sequence: Synthetic polypeptide
DEEEIRTTNPVATEQYGCVSTENLEQHFGSNQY

SEQ ID NO: 44388 - protein, 33 aa, Artificial Sequence
  Description of Artificial Sequence: Synthetic polypeptide
DEEEIRTTNPVATEQYGCVSTENLNQNFGSNIA

SEQ ID NO: 44389 - protein, 32 aa, Artificial Sequence
  Description of Artificial Sequence: Synthetic polypeptide
DEEEIRTTNPVATEQYGCVSTENLQFFPSNQY

SEQ ID NO: 44390 - protein, 31 aa, Artificial Sequence
  Description of Artificial Sequence: Synthetic polypeptide
DEEEIRTTNPVATEQYGCVSTENQYFGSNQM

SEQ ID NO: 44391 - protein, 31 aa, Artificial Sequence
  Description of Artificial Sequence: Synthetic polypeptide
DEEEIRTTNPVATEQYGSVNVPTLDLQANNE

SEQ ID NO: 44392 - protein, 32 aa, Artificial Sequence
  Description of Artificial Sequence: Synthetic polypeptide
DEEEIRTTNPVATEGYGSVSNDNLQSDGNNIQ

SEQ ID NO: 44393 - protein, 28 aa, Artificial Sequence
  Description of Artificial Sequence: Synthetic peptide
DEDVIRTTNPVANEQYGCVETNPQGGNN

SEQ ID NO: 44394 - protein, 31 aa, Artificial Sequence
  Description of Artificial Sequence: Synthetic polypeptide
DEETIRTTNPVATEQYGSVPTHELIRQGNNT

SEQ ID NO: 44395 - protein, 33 aa, Artificial Sequence
  Description of Artificial Sequence: Synthetic polypeptide
AEEEIRTTNPVATEQYGSVSVTVNLQVGEGNNL

SEQ ID NO: 44396 - protein, 32 aa, Artificial Sequence
  Description of Artificial Sequence: Synthetic polypeptide
DEETIRTTNPVATEQYGSVSLVTELFRQGNDT

SEQ ID NO: 44397 - protein, 32 aa, Artificial Sequence
  Description of Artificial Sequence: Synthetic polypeptide
AEEEIRTTNPVATEQYGSVSTTGNNQEQGNND

SEQ ID NO: 44398 - protein, 33 aa, Artificial Sequence
  Description of Artificial Sequence: Synthetic polypeptide
SEEEIRTTNPVATEQYGSVSGGNGEVQRGENDR

SEQ ID NO: 44399 - protein, 32 aa, Artificial Sequence
  Description of Artificial Sequence: Synthetic polypeptide
DEETIRTTNPVATEQYGSVSSTNLDQLQPNNF

SEQ ID NO: 44400 - protein, 30 aa, Artificial Sequence
  Description of Artificial Sequence: Synthetic polypeptide
DDEEIRTTNPVATTQWGSVSTNGDGNGNHR

SEQ ID NO: 44401 - protein, 31 aa, Artificial Sequence
  Description of Artificial Sequence: Synthetic polypeptide
DEETIRTTNPVATEQYGSVSTDQNELGGNTE

SEQ ID NO: 44402 - protein, 31 aa, Artificial Sequence
  Description of Artificial Sequence: Synthetic polypeptide
DEETIRTTNPVATEQYGSVSTNLEDYYGMEA

SEQ ID NO: 44403 - protein, 32 aa, Artificial Sequence
  Description of Artificial Sequence: Synthetic polypeptide
DEETIRTTNPVATEQYGSVSTNLNDNQGQNVE

SEQ ID NO: 44404 - protein, 33 aa, Artificial Sequence
  Description of Artificial Sequence: Synthetic polypeptide
DEETIRTTNPVATEQYGSVSTNLQDENNGQNQT

SEQ ID NO: 44405 - protein, 32 aa, Artificial Sequence
  Description of Artificial Sequence: Synthetic polypeptide
DEETIRTTNPVATEQYGSVSTNLQDNNEQNNQ

SEQ ID NO: 44406 - protein, 32 aa, Artificial Sequence
  Description of Artificial Sequence: Synthetic polypeptide
DDEEIRTTNPVATEQYGVVSTGELQRFGSNQD

SEQ ID NO: 44407 - protein, 31 aa, Artificial Sequence
  Description of Artificial Sequence: Synthetic polypeptide
DEETIRTTNPVATEQYGSVSTNQDELGGNQT

SEQ ID NO: 44408 - protein, 32 aa, Artificial Sequence
  Description of Artificial Sequence: Synthetic polypeptide
SEEEIRTTNPVATEQYGSVSEPALPNRNGNPR

SEQ ID NO: 44409 - protein, 33 aa, Artificial Sequence
  Description of Artificial Sequence: Synthetic polypeptide
DEETIRTTNPVATEQYGSVIVTNLQREGVNTEA

SEQ ID NO: 44410 - protein, 32 aa, Artificial Sequence
  Description of Artificial Sequence: Synthetic polypeptide
AEEEIRTTNPVATEQYGSVSTTGNLQQTNENS

SEQ ID NO: 44411 - protein, 32 aa, Artificial Sequence
  Description of Artificial Sequence: Synthetic polypeptide
SEEEIRTTNPVATEQYGSVSPTNEVDTYGNDR

SEQ ID NO: 44412 - protein, 32 aa, Artificial Sequence
  Description of Artificial Sequence: Synthetic polypeptide
DEETIRTTNPVATEQYGQYSVSINGLQRMDNM

SEQ ID NO: 44413 - protein, 31 aa, Artificial Sequence
  Description of Artificial Sequence: Synthetic polypeptide
DEETIRTTNPVATEQYGCVSTTNQQFGENEN

SEQ ID NO: 44414 - protein, 30 aa, Artificial Sequence
  Description of Artificial Sequence: Synthetic polypeptide
DEETIRTTNPVATEQYGCVSTTNQQFNNEE

SEQ ID NO: 44415 - protein, 32 aa, Artificial Sequence
  Description of Artificial Sequence: Synthetic polypeptide
SEEEIRTTNPVATEQYGSVSSTEPNGNMRGNV

SEQ ID NO: 44416 - protein, 31 aa, Artificial Sequence
  Description of Artificial Sequence: Synthetic polypeptide
DEETIRTTNPVATEQYGCVSTTNQQQFGTNE

SEQ ID NO: 44417 - protein, 31 aa, Artificial Sequence
  Description of Artificial Sequence: Synthetic polypeptide
DQEEIATTNPVATTQYGSVSTNGDQNGGNHR

SEQ ID NO: 44418 - protein, 31 aa, Artificial Sequence
  Description of Artificial Sequence: Synthetic polypeptide
DQEEIATTNPVATSQYGSVSTNGVQDNGNHR

SEQ ID NO: 44419 - protein, 31 aa, Artificial Sequence
  Description of Artificial Sequence: Synthetic polypeptide
DEETIRTTNPVATEQYGDVSTDNGQGGGNGQ

SEQ ID NO: 44420 - protein, 30 aa, Artificial Sequence
  Description of Artificial Sequence: Synthetic polypeptide
DEETIRTTNPVATEQYGSVSTQQELGGNNT

SEQ ID NO: 44421 - protein, 30 aa, Artificial Sequence
  Description of Artificial Sequence: Synthetic polypeptide
DEETIRTTNPVATEQYGDVSTGGGQGGNQG

SEQ ID NO: 44422 - protein, 31 aa, Artificial Sequence
  Description of Artificial Sequence: Synthetic polypeptide
DQEEIATTNPVATHQYGSVSTNGVQNGNHRA

SEQ ID NO: 44423 - protein, 32 aa, Artificial Sequence
  Description of Artificial Sequence: Synthetic polypeptide
DEETIRTTNPVATEQYGDVSVSINGQRGDNGI

SEQ ID NO: 44424 - protein, 28 aa, Artificial Sequence
  Description of Artificial Sequence: Synthetic peptide
QEEEIRCTNPVATEQYGEASENLMRGEK

SEQ ID NO: 44425 - protein, 31 aa, Artificial Sequence
  Description of Artificial Sequence: Synthetic polypeptide
DEETIRTTNPVATEQYGDVVSINIQRGDNNI

SEQ ID NO: 44426 - protein, 30 aa, Artificial Sequence
  Description of Artificial Sequence: Synthetic polypeptide
DEETIRTTNPVATEQYGQSVSINGMGGDND

SEQ ID NO: 44427 - protein, 32 aa, Artificial Sequence
  Description of Artificial Sequence: Synthetic polypeptide
SEEEIRTTNPVATEQYGSVSSTEALMRNGMNV

SEQ ID NO: 44428 - protein, 32 aa, Artificial Sequence
  Description of Artificial Sequence: Synthetic polypeptide
AEEEIRTTNPVATEQYGSVSVTVNNEQQGNNS

SEQ ID NO: 44429 - protein, 31 aa, Artificial Sequence
  Description of Artificial Sequence: Synthetic polypeptide
DEETIRTTNPVATEQYGDVSVDINGQRGDNF

SEQ ID NO: 44430 - protein, 31 aa, Artificial Sequence
  Description of Artificial Sequence: Synthetic polypeptide
DEETIRTTNPVATEQYGCVSTTNNQQFGGNE

SEQ ID NO: 44431 - protein, 32 aa, Artificial Sequence
  Description of Artificial Sequence: Synthetic polypeptide
SEEEIRTTNPVATEQYGSVSEPALPMRNGNPR

SEQ ID NO: 44432 - protein, 30 aa, Artificial Sequence
  Description of Artificial Sequence: Synthetic polypeptide
DEETIRTTNPVATEQYGSVSTSTELGGNET

SEQ ID NO: 44433 - protein, 33 aa, Artificial Sequence
  Description of Artificial Sequence: Synthetic polypeptide
AEEEIRTTNPVATEQYGSVSVTVNLQSNEGNND

SEQ ID NO: 44434 - protein, 33 aa, Artificial Sequence
  Description of Artificial Sequence: Synthetic polypeptide
SEEEIRTTNPVATEQYGSVNTSNLDQDGENYRF

SEQ ID NO: 44435 - protein, 28 aa, Artificial Sequence
  Description of Artificial Sequence: Synthetic peptide
QEEEIRCTNPVATEQYGSASEVLQREEK

SEQ ID NO: 44436 - protein, 31 aa, Artificial Sequence
  Description of Artificial Sequence: Synthetic polypeptide
DEETIRTTNPVATEQYGSVSTVVNELGGNET

SEQ ID NO: 44437 - protein, 32 aa, Artificial Sequence
  Description of Artificial Sequence: Synthetic polypeptide
DEETIRTTNPVATEQYGSVSVSNGNLQIGDNA

SEQ ID NO: 44438 - protein, 32 aa, Artificial Sequence
  Description of Artificial Sequence: Synthetic polypeptide
DEETIRTTNPVATEQYGSVSVSNNLQIGDNED

SEQ ID NO: 44439 - protein, 32 aa, Artificial Sequence
  Description of Artificial Sequence: Synthetic polypeptide
DEETIRTTNPVATEQYGSVSVSNNLQQIGDNS

SEQ ID NO: 44440 - protein, 33 aa, Artificial Sequence
  Description of Artificial Sequence: Synthetic polypeptide
SEEEIRTTNPVATEQYGSVNTSNELDQRGENIE

SEQ ID NO: 44441 - protein, 33 aa, Artificial Sequence
  Description of Artificial Sequence: Synthetic polypeptide
DEETIRTTNPVATEQYGSVSVTSNNQLQIGDNS

SEQ ID NO: 44442 - protein, 33 aa, Artificial Sequence
  Description of Artificial Sequence: Synthetic polypeptide
DEETIRTTNPVATEQYGSVSVTSVNNLQIGDNE

SEQ ID NO: 44443 - protein, 32 aa, Artificial Sequence
  Description of Artificial Sequence: Synthetic polypeptide
SEEEIRTTNPVATEQYGSVNTSMLEQRGENYE

SEQ ID NO: 44444 - protein, 28 aa, Artificial Sequence
  Description of Artificial Sequence: Synthetic peptide
DQAEIRTTNPVATEQYGCCSTVLQHGDL

SEQ ID NO: 44445 - protein, 29 aa, Artificial Sequence
  Description of Artificial Sequence: Synthetic peptide
DQAEIRTTNPVATEQYGCCSTVLQHDNNR

SEQ ID NO: 44446 - protein, 29 aa, Artificial Sequence
  Description of Artificial Sequence: Synthetic peptide
DQAEIRTTNPVATEQYGCCSTVLIHGDNR

SEQ ID NO: 44447 - protein, 28 aa, Artificial Sequence
  Description of Artificial Sequence: Synthetic peptide
AENEIACTNPVATEQYGEASENLQFGNR

SEQ ID NO: 44448 - protein, 32 aa, Artificial Sequence
  Description of Artificial Sequence: Synthetic polypeptide
SEEEIRTTNPVATEQYGSVNTSNLDQGGENYD

SEQ ID NO: 44449 - protein, 33 aa, Artificial Sequence
  Description of Artificial Sequence: Synthetic polypeptide
SEEEIRTTNPVATEQYGSVNTSNLDQRSENYRG

SEQ ID NO: 44450 - protein, 30 aa, Artificial Sequence
  Description of Artificial Sequence: Synthetic polypeptide
DEETIRTTNPVATEQYGSVSTTVELGGNTQ

SEQ ID NO: 44451 - protein, 28 aa, Artificial Sequence
  Description of Artificial Sequence: Synthetic peptide
DQAEIRTTNPVATEQYGCCSTVLSHGNQ

SEQ ID NO: 44452 - protein, 32 aa, Artificial Sequence
  Description of Artificial Sequence: Synthetic polypeptide
AEEEIRTTNPVATEQYGSVSTTLNQQNDEGND

SEQ ID NO: 44453 - protein, 32 aa, Artificial Sequence
  Description of Artificial Sequence: Synthetic polypeptide
AEEEIRTTNPVATEQYGSVSTTLNQQQNGNVE

SEQ ID NO: 44454 - protein, 29 aa, Artificial Sequence
  Description of Artificial Sequence: Synthetic peptide
DQAEIRTTNPVATEQYGTCSTVLQHGNQA

SEQ ID NO: 44455 - protein, 30 aa, Artificial Sequence
  Description of Artificial Sequence: Synthetic polypeptide
DQAEIRTTNPVATEQYGTCSTVLQHGENDR

SEQ ID NO: 44456 - protein, 33 aa, Artificial Sequence
  Description of Artificial Sequence: Synthetic polypeptide
DEETIRTTNPVATEQYGSVSTTNLQDNNGQNQE

SEQ ID NO: 44457 - protein, 29 aa, Artificial Sequence
  Description of Artificial Sequence: Synthetic peptide
DQAEIRTTNPVATEQYGTCSTVDQHGNNR

SEQ ID NO: 44458 - protein, 33 aa, Artificial Sequence
  Description of Artificial Sequence: Synthetic polypeptide
DEETIRTTNPVATEQYGSVSTTNLQDNNNGQNS

SEQ ID NO: 44459 - protein, 32 aa, Artificial Sequence
  Description of Artificial Sequence: Synthetic polypeptide
AEEEIRTTNPVATEQYGSVSTTLLQQEGTNNN

SEQ ID NO: 44460 - protein, 33 aa, Artificial Sequence
  Description of Artificial Sequence: Synthetic polypeptide
DEETIRTTNPVATEQYGSVSTTNLQDQNGNNSE

SEQ ID NO: 44461 - protein, 30 aa, Artificial Sequence
  Description of Artificial Sequence: Synthetic polypeptide
DQAEIRTTNPVATEQYGCTCSTVLQTGGNR

SEQ ID NO: 44462 - protein, 31 aa, Artificial Sequence
  Description of Artificial Sequence: Synthetic polypeptide
SEEEIRTTNPVATEQYGSVSDTDGGQGGENG

SEQ ID NO: 44463 - protein, 32 aa, Artificial Sequence
  Description of Artificial Sequence: Synthetic polypeptide
DEETIRTTNPVATEQYGSVSTTNQELNGGNQT

SEQ ID NO: 44464 - protein, 33 aa, Artificial Sequence
  Description of Artificial Sequence: Synthetic polypeptide
AEEEIRTTNPVATEQYGSVSVTVNLQTGNGNGT

SEQ ID NO: 44465 - protein, 31 aa, Artificial Sequence
  Description of Artificial Sequence: Synthetic polypeptide
SEEEIRTTNPVATEQYGSVSCNLLRQHENDL

SEQ ID NO: 44466 - protein, 31 aa, Artificial Sequence
  Description of Artificial Sequence: Synthetic polypeptide
AEEEIRTTNPVATEQYGSVSTTLQNQNIENQ

SEQ ID NO: 44467 - protein, 32 aa, Artificial Sequence
  Description of Artificial Sequence: Synthetic polypeptide
DEETIRTTNPVATEQYGSVSTTQELQGNGNTE

SEQ ID NO: 44468 - protein, 30 aa, Artificial Sequence
  Description of Artificial Sequence: Synthetic polypeptide
DQAEIRTTNPVATEQYGCVCSTVLQHGQDR

SEQ ID NO: 44469 - protein, 31 aa, Artificial Sequence
  Description of Artificial Sequence: Synthetic polypeptide
DEETIRTTNPVATEQYGCVSTNNQQFGNEET

SEQ ID NO: 44470 - protein, 30 aa, Artificial Sequence
  Description of Artificial Sequence: Synthetic polypeptide
DEETIRTTNPVATEQYGAVSTNQQNFQGTC

SEQ ID NO: 44471 - protein, 31 aa, Artificial Sequence
  Description of Artificial Sequence: Synthetic polypeptide
SEEEIRTTNPVATEQYGSVSSTNSNTRSNNI

SEQ ID NO: 44472 - protein, 31 aa, Artificial Sequence
  Description of Artificial Sequence: Synthetic polypeptide
AEEEIRTTNPVATEQYGSVSTSNSNGTVGNI

SEQ ID NO: 44473 - protein, 31 aa, Artificial Sequence
  Description of Artificial Sequence: Synthetic polypeptide
SEEEIRTTNPVATEQYGSVSTPNDQGGGEEI

SEQ ID NO: 44474 - protein, 30 aa, Artificial Sequence
  Description of Artificial Sequence: Synthetic polypeptide
DQEEIATTNPVAYQQYGSVSTNGVQAGNHR

SEQ ID NO: 44475 - protein, 31 aa, Artificial Sequence
  Description of Artificial Sequence: Synthetic polypeptide
DEETIRATNPVATEQYGSVSTMNNQQLGGNL

SEQ ID NO: 44476 - protein, 31 aa, Artificial Sequence
  Description of Artificial Sequence: Synthetic polypeptide
DEETIRATNPVATEQYGSVSTMNNQQQLGNL

SEQ ID NO: 44477 - protein, 32 aa, Artificial Sequence
  Description of Artificial Sequence: Synthetic polypeptide
SEEEIRTTNPVATEQYGSVSTPAGPNRNGNPR

SEQ ID NO: 44478 - protein, 31 aa, Artificial Sequence
  Description of Artificial Sequence: Synthetic polypeptide
AEEEIRTTNPVATEQYGSVSTSQGEQAGNQT

SEQ ID NO: 44479 - protein, 32 aa, Artificial Sequence
  Description of Artificial Sequence: Synthetic polypeptide
SEEEIRTTNPVATEQYGSVSTNLQVENMDNIQ

SEQ ID NO: 44480 - protein, 31 aa, Artificial Sequence
  Description of Artificial Sequence: Synthetic polypeptide
DEETIRATNPVATEQYGSVSTMNQQLGNNQD

SEQ ID NO: 44481 - protein, 32 aa, Artificial Sequence
  Description of Artificial Sequence: Synthetic polypeptide
AEEEIRTTNPVATEQYGSVSTSTNEQAGNDNI

SEQ ID NO: 44482 - protein, 33 aa, Artificial Sequence
  Description of Artificial Sequence: Synthetic polypeptide
AEEEIRTTNPVATEQYGSVSTSTNLQMGENNGG

SEQ ID NO: 44483 - protein, 31 aa, Artificial Sequence
  Description of Artificial Sequence: Synthetic polypeptide
DEETIRATNPVATEQYGSVSTMNQQQNLGNL

SEQ ID NO: 44484 - protein, 32 aa, Artificial Sequence
  Description of Artificial Sequence: Synthetic polypeptide
AEEEIRTTNPVATEQYGSVSTSTNLQNMENNT

SEQ ID NO: 44485 - protein, 32 aa, Artificial Sequence
  Description of Artificial Sequence: Synthetic polypeptide
AEEEIRTTNPVATEQYGSVSTSTNLQNQSTNQ

SEQ ID NO: 44486 - protein, 32 aa, Artificial Sequence
  Description of Artificial Sequence: Synthetic polypeptide
AEEEIRTTNPVATEQYGSVSTSTNNLIENGNI

SEQ ID NO: 44487 - protein, 30 aa, Artificial Sequence
  Description of Artificial Sequence: Synthetic polypeptide
DEETIRATNPVATEQYGSVSNVNNEQAGNL

SEQ ID NO: 44488 - protein, 32 aa, Artificial Sequence
  Description of Artificial Sequence: Synthetic polypeptide
AEEEIRTTNPVATEQYGSVSTSNQQQEDEGNN

SEQ ID NO: 44489 - protein, 30 aa, Artificial Sequence
  Description of Artificial Sequence: Synthetic polypeptide
DEETIRATNPVATEQYGSVSILNGQGGGNE

SEQ ID NO: 44490 - protein, 29 aa, Artificial Sequence
  Description of Artificial Sequence: Synthetic peptide
DEETIRATNPVATEFYGSVINENFQRGNL

SEQ ID NO: 44491 - protein, 31 aa, Artificial Sequence
  Description of Artificial Sequence: Synthetic polypeptide
DEETIATTNPVATESYGSVLLTNTLQRGNMT

SEQ ID NO: 44492 - protein, 30 aa, Artificial Sequence
  Description of Artificial Sequence: Synthetic polypeptide
DEETIATTNPVATESYGSVNLTNTLQAGNM

SEQ ID NO: 44493 - protein, 31 aa, Artificial Sequence
  Description of Artificial Sequence: Synthetic polypeptide
DEETIATTNPVATESYGSVNLTVNTLQRGNL

SEQ ID NO: 44494 - protein, 30 aa, Artificial Sequence
  Description of Artificial Sequence: Synthetic polypeptide
DQEEICTTNPVATYQYGSVSTNGVQNGNEN

SEQ ID NO: 44495 - protein, 33 aa, Artificial Sequence
  Description of Artificial Sequence: Synthetic polypeptide
AEEEIRTTNPVATEQYGSVSVTVNNQLQQGNNE

SEQ ID NO: 44496 - protein, 32 aa, Artificial Sequence
  Description of Artificial Sequence: Synthetic polypeptide
AEEEIRTTNPVATEQYGSVSTSNQLEQEGTEG

SEQ ID NO: 44497 - protein, 31 aa, Artificial Sequence
  Description of Artificial Sequence: Synthetic polypeptide
DEETICTTNPVATECYGSVNGTNGLEQRGND

SEQ ID NO: 44498 - protein, 31 aa, Artificial Sequence
  Description of Artificial Sequence: Synthetic polypeptide
DEETIRGTNPVATEQYGSVVSINGQGRGNGG

SEQ ID NO: 44499 - protein, 31 aa, Artificial Sequence
  Description of Artificial Sequence: Synthetic polypeptide
AEEEIRTTNPVATEQYGSVSTSNQLGEGGGI

SEQ ID NO: 44500 - protein, 30 aa, Artificial Sequence
  Description of Artificial Sequence: Synthetic polypeptide
DEETICTTNPVATEFYGSVNTNTGGQRGND

SEQ ID NO: 44501 - protein, 33 aa, Artificial Sequence
  Description of Artificial Sequence: Synthetic polypeptide
AEEEIRTTNPVATEQYGSVSTSNQLQTGEQGNM

SEQ ID NO: 44502 - protein, 30 aa, Artificial Sequence
  Description of Artificial Sequence: Synthetic polypeptide
DEETICTTNPVATEFYGSVNTNTGQRGNTM

SEQ ID NO: 44503 - protein, 30 aa, Artificial Sequence
  Description of Artificial Sequence: Synthetic polypeptide
DDEEISTTNPVATCQYGSVSTNPIRFGNAS

SEQ ID NO: 44504 - protein, 32 aa, Artificial Sequence
  Description of Artificial Sequence: Synthetic polypeptide
AEEEIRTTNPVATEQYGSVSTSNQNQEQGNSN

SEQ ID NO: 44505 - protein, 29 aa, Artificial Sequence
  Description of Artificial Sequence: Synthetic peptide
DDEEISTTNPVATCQYGSVSTNPARGSEA

SEQ ID NO: 44506 - protein, 31 aa, Artificial Sequence
  Description of Artificial Sequence: Synthetic polypeptide
DEETIITTNPVATEQYGSVSTNLEDYGMERP

SEQ ID NO: 44507 - protein, 29 aa, Artificial Sequence
  Description of Artificial Sequence: Synthetic peptide
DEETICTTNPVATEFYGSVNTDTGQRGNI

SEQ ID NO: 44508 - protein, 30 aa, Artificial Sequence
  Description of Artificial Sequence: Synthetic polypeptide
DEETIRTTNPVACEQYGQISTINVVQRGNN

SEQ ID NO: 44509 - protein, 32 aa, Artificial Sequence
  Description of Artificial Sequence: Synthetic polypeptide
AEEEIRTTNPVATEQYGSVSTSTNNLIENGNN

SEQ ID NO: 44510 - protein, 32 aa, Artificial Sequence
  Description of Artificial Sequence: Synthetic polypeptide
SEEEIRTTNPVATEQYGSVSTNLQNPGEDTAS

SEQ ID NO: 44511 - protein, 31 aa, Artificial Sequence
  Description of Artificial Sequence: Synthetic polypeptide
DEETIRTTNPVATEQWGAVETENLQVGVNDR

SEQ ID NO: 44512 - protein, 32 aa, Artificial Sequence
  Description of Artificial Sequence: Synthetic polypeptide
DEETIRTTNPVATEQWGSVATENLQLLGVNRV

SEQ ID NO: 44513 - protein, 31 aa, Artificial Sequence
  Description of Artificial Sequence: Synthetic polypeptide
DEETIRTTNPVATEQWGSVATNNLQLGNNGQ

SEQ ID NO: 44514 - protein, 31 aa, Artificial Sequence
  Description of Artificial Sequence: Synthetic polypeptide
DEETIRTTNPVATEQWGSVATNNLQQGVNGE

SEQ ID NO: 44515 - protein, 31 aa, Artificial Sequence
  Description of Artificial Sequence: Synthetic polypeptide
DEETIRTTNPVATEQWGSVATNNNLQLGNNN

SEQ ID NO: 44516 - protein, 31 aa, Artificial Sequence
  Description of Artificial Sequence: Synthetic polypeptide
SEEEIRTTNPVATEQYGSVSTDLQNNSEDRI

SEQ ID NO: 44517 - protein, 31 aa, Artificial Sequence
  Description of Artificial Sequence: Synthetic polypeptide
DEETIRTTNPVATEQWGSVATTNNLQAGVNM

SEQ ID NO: 44518 - protein, 31 aa, Artificial Sequence
  Description of Artificial Sequence: Synthetic polypeptide
DEETIRTTNPVATEQWGAVETENLQPLGVNR

SEQ ID NO: 44519 - protein, 31 aa, Artificial Sequence
  Description of Artificial Sequence: Synthetic polypeptide
SEEEIRTTNPVATEQYGSVSTDLEDREGEDL

SEQ ID NO: 44520 - protein, 32 aa, Artificial Sequence
  Description of Artificial Sequence: Synthetic polypeptide
AEEEIRTTNPVATEQYGSVSTTDNGNQNTTNR

SEQ ID NO: 44521 - protein, 31 aa, Artificial Sequence
  Description of Artificial Sequence: Synthetic polypeptide
AEEEIRTTNPVATEQYGSVSTTDNGQTTNQE

SEQ ID NO: 44522 - protein, 31 aa, Artificial Sequence
  Description of Artificial Sequence: Synthetic polypeptide
DDEEIRYTNPVATEQYGSIVCSTNLQNFGQQ

SEQ ID NO: 44523 - protein, 30 aa, Artificial Sequence
  Description of Artificial Sequence: Synthetic polypeptide
DDEEIRYTNPVATEQYGCVVSTNLETGTQR

SEQ ID NO: 44524 - protein, 30 aa, Artificial Sequence
  Description of Artificial Sequence: Synthetic polypeptide
DDEEIRTTNPVGTEQWGCVSTNLQRFGSVQ

SEQ ID NO: 44525 - protein, 30 aa, Artificial Sequence
  Description of Artificial Sequence: Synthetic polypeptide
DEETIRTTNPVATEQYGAVSTNDQFQVNCP

SEQ ID NO: 44526 - protein, 30 aa, Artificial Sequence
  Description of Artificial Sequence: Synthetic polypeptide
DEETIRTTNPVATEQYGAVSTNDQIFEVNC

SEQ ID NO: 44527 - protein, 32 aa, Artificial Sequence
  Description of Artificial Sequence: Synthetic polypeptide
SEEEIRTTNPVATEQYGSVSTDGEGQTGENIR

SEQ ID NO: 44528 - protein, 29 aa, Artificial Sequence
  Description of Artificial Sequence: Synthetic peptide
SEEEIRTTNPVATEQYGSVGTATQNFGDQ

SEQ ID NO: 44529 - protein, 32 aa, Artificial Sequence
  Description of Artificial Sequence: Synthetic polypeptide
SEEEIRTTNPVATEQYGSVSTGNLQNNSNFAG

SEQ ID NO: 44530 - protein, 32 aa, Artificial Sequence
  Description of Artificial Sequence: Synthetic polypeptide
SEEEIRTTNPVATEQYGSVSTNDLQNNGEDSI

SEQ ID NO: 44531 - protein, 30 aa, Artificial Sequence
  Description of Artificial Sequence: Synthetic polypeptide
DEETIRTTNPVACEQYGTVSTIGTVQRGNN

SEQ ID NO: 44532 - protein, 29 aa, Artificial Sequence
  Description of Artificial Sequence: Synthetic peptide
DEETIRTTNPVACEQYGVVSTIGVQAGNN

SEQ ID NO: 44533 - protein, 32 aa, Artificial Sequence
  Description of Artificial Sequence: Synthetic polypeptide
AEEEIRTTNPVATEQYGSVSTSTNNQQGGNGS

SEQ ID NO: 44534 - protein, 31 aa, Artificial Sequence
  Description of Artificial Sequence: Synthetic polypeptide
AEEEIRTTNPVATEQYGSVSTSTQLQTIGGN

SEQ ID NO: 44535 - protein, 33 aa, Artificial Sequence
  Description of Artificial Sequence: Synthetic polypeptide
AEEEIRTTNPVATEQYGSVSTSTTNLQLGGNDT

SEQ ID NO: 44536 - protein, 30 aa, Artificial Sequence
  Description of Artificial Sequence: Synthetic polypeptide
DEETIRTTNPVAGEQYGVVSTINVQRVENG

SEQ ID NO: 44537 - protein, 30 aa, Artificial Sequence
  Description of Artificial Sequence: Synthetic polypeptide
DEETIRTTNPVAGEQYGVVSTINVQRVNHP

SEQ ID NO: 44538 - protein, 32 aa, Artificial Sequence
  Description of Artificial Sequence: Synthetic polypeptide
SEEEIRTTNPVATEQYGSVSTNDIQRDNDNQN

SEQ ID NO: 44539 - protein, 30 aa, Artificial Sequence
  Description of Artificial Sequence: Synthetic polypeptide
DEETIRTTNPVATEIYGVVTTNLQLGSNGQ

SEQ ID NO: 44540 - protein, 28 aa, Artificial Sequence
  Description of Artificial Sequence: Synthetic peptide
QEEEIRCTNPIATEQYGSVSETLMRGDI

SEQ ID NO: 44541 - protein, 30 aa, Artificial Sequence
  Description of Artificial Sequence: Synthetic polypeptide
DEETIRTTNPVATEIYGVVTTTNLQFGSNQ

SEQ ID NO: 44542 - protein, 31 aa, Artificial Sequence
  Description of Artificial Sequence: Synthetic polypeptide
DEETIRTTNPVATEPYGMQVTTNLPRGSNRI

SEQ ID NO: 44543 - protein, 31 aa, Artificial Sequence
  Description of Artificial Sequence: Synthetic polypeptide
DDEEISSTNPVATEQYGSVCSTNLQARSGQQ

SEQ ID NO: 44544 - protein, 31 aa, Artificial Sequence
  Description of Artificial Sequence: Synthetic polypeptide
SEEEIRTTNPVATEQYGSVSTNDQQSSGEEH

SEQ ID NO: 44545 - protein, 31 aa, Artificial Sequence
  Description of Artificial Sequence: Synthetic polypeptide
DEETIRTTNPVATEQWGAVATGNLQLGVNRI

SEQ ID NO: 44546 - protein, 31 aa, Artificial Sequence
  Description of Artificial Sequence: Synthetic polypeptide
DEETIRTTNPVATEQWGAVATNNLQMGVNVR

SEQ ID NO: 44547 - protein, 30 aa, Artificial Sequence
  Description of Artificial Sequence: Synthetic polypeptide
DEETIRTTNPVATEIYGVVTTNLQLGSNGV

SEQ ID NO: 44548 - protein, 29 aa, Artificial Sequence
  Description of Artificial Sequence: Synthetic peptide
DQAEIRTTNPVATEQYGCCSTVLEGGSNR

SEQ ID NO: 44549 - protein, 33 aa, Artificial Sequence
  Description of Artificial Sequence: Synthetic polypeptide
SEEEIRTTNPVATEQYGSVFHTDNEKQRGENHR

SEQ ID NO: 44550 - protein, 33 aa, Artificial Sequence
  Description of Artificial Sequence: Synthetic polypeptide
DEETIRTTNPVATEQYGTVSVNSTNLQIGNNDE

SEQ ID NO: 44551 - protein, 31 aa, Artificial Sequence
  Description of Artificial Sequence: Synthetic polypeptide
SEEEIRTTNPVATEQYGSVAMNDNRNGNERP

SEQ ID NO: 44552 - protein, 33 aa, Artificial Sequence
  Description of Artificial Sequence: Synthetic polypeptide
DEEVIRTTNPVATEQYGSVVPSTGNLSDNGGNR

SEQ ID NO: 44553 - protein, 32 aa, Artificial Sequence
  Description of Artificial Sequence: Synthetic polypeptide
DEEVIRTTNPVATEQYGSVVSTNHSDNGGNNR

SEQ ID NO: 44554 - protein, 32 aa, Artificial Sequence
  Description of Artificial Sequence: Synthetic polypeptide
DEEVIRTTNPVATERYGSVVSTNLSDNGGSNR

SEQ ID NO: 44555 - protein, 33 aa, Artificial Sequence
  Description of Artificial Sequence: Synthetic polypeptide
SEEEIRTTNPVATEQYGSVAGTSNLNQDGENGR

SEQ ID NO: 44556 - protein, 32 aa, Artificial Sequence
  Description of Artificial Sequence: Synthetic polypeptide
AEEEIRTTNPVATEQYGSVSVTVNDQIGNGNQ

SEQ ID NO: 44557 - protein, 31 aa, Artificial Sequence
  Description of Artificial Sequence: Synthetic polypeptide
DEEVIRTTNPVAYEQYGSVSANLQDNGDNAM

SEQ ID NO: 44558 - protein, 32 aa, Artificial Sequence
  Description of Artificial Sequence: Synthetic polypeptide
DEEVIRTTNPVAYEQYGSVSTINLSDNVGNNR

SEQ ID NO: 44559 - protein, 30 aa, Artificial Sequence
  Description of Artificial Sequence: Synthetic polypeptide
SEEEIRTTNPVATEQYGSVAATNLQPAEPP

SEQ ID NO: 44560 - protein, 33 aa, Artificial Sequence
  Description of Artificial Sequence: Synthetic polypeptide
SEEEIRTTNPVATEQYGSICSTHELSQRVGGNR

SEQ ID NO: 44561 - protein, 33 aa, Artificial Sequence
  Description of Artificial Sequence: Synthetic polypeptide
SEEEIRTTNPVATEQYGSCNSTLNLNQRGNEDI

SEQ ID NO: 44562 - protein, 32 aa, Artificial Sequence
  Description of Artificial Sequence: Synthetic polypeptide
AEEEIRTTNPVATEQYGSVSTTNILGNLGNND

SEQ ID NO: 44563 - protein, 31 aa, Artificial Sequence
  Description of Artificial Sequence: Synthetic polypeptide
DEEVIRTTNPVVTEQYGSVSTNLIDNGQEDR

SEQ ID NO: 44564 - protein, 31 aa, Artificial Sequence
  Description of Artificial Sequence: Synthetic polypeptide
DEEWIRTTNPVATEQWGSVCITNNLELGVNR

SEQ ID NO: 44565 - protein, 32 aa, Artificial Sequence
  Description of Artificial Sequence: Synthetic polypeptide
SEEEIRTTNPVATEQYGKVVSCTNALQNVNNR

SEQ ID NO: 44566 - protein, 30 aa, Artificial Sequence
  Description of Artificial Sequence: Synthetic polypeptide
SEEEIRTTNPVATEQYGSVAPALQNGEFSR

SEQ ID NO: 44567 - protein, 30 aa, Artificial Sequence
  Description of Artificial Sequence: Synthetic polypeptide
SEEEIRTTNPVATEQYGSVATADQNMGDFR

SEQ ID NO: 44568 - protein, 32 aa, Artificial Sequence
  Description of Artificial Sequence: Synthetic polypeptide
AEEEIRTTNPVATEQYGSVSVTVNENQQGNTE

SEQ ID NO: 44569 - protein, 31 aa, Artificial Sequence
  Description of Artificial Sequence: Synthetic polypeptide
DEEVIRTTNPVATEQYGSVSTNLTPNNLQNQ

SEQ ID NO: 44570 - protein, 31 aa, Artificial Sequence
  Description of Artificial Sequence: Synthetic polypeptide
SEEEIRTTNPVATEQYGSVATALQGNGDFDR

SEQ ID NO: 44571 - protein, 31 aa, Artificial Sequence
  Description of Artificial Sequence: Synthetic polypeptide
DDEEIRTTNPVATEQYGSVSNTNMPQNGSDQ

SEQ ID NO: 44572 - protein, 29 aa, Artificial Sequence
  Description of Artificial Sequence: Synthetic peptide
DQAEIATTNPVATEQYGCSSTVLQHGNRM

SEQ ID NO: 44573 - protein, 32 aa, Artificial Sequence
  Description of Artificial Sequence: Synthetic polypeptide
DEEVIRTTNPVATEQYGSVSSTNLTDTNGQNE

SEQ ID NO: 44574 - protein, 31 aa, Artificial Sequence
  Description of Artificial Sequence: Synthetic polypeptide
DEEVIRTTNPVATEQYGSVSTELNDENGSNQ

SEQ ID NO: 44575 - protein, 32 aa, Artificial Sequence
  Description of Artificial Sequence: Synthetic polypeptide
DEEVIRTTNPVATEQYGSVSTGNGLRDNGQER

SEQ ID NO: 44576 - protein, 32 aa, Artificial Sequence
  Description of Artificial Sequence: Synthetic polypeptide
DEEVIRTTNPVATEQYGSVSTGPLRDNGGQNR

SEQ ID NO: 44577 - protein, 29 aa, Artificial Sequence
  Description of Artificial Sequence: Synthetic peptide
DEFCIGTTNPVATEQWGSVSTDGLQYGNQ

SEQ ID NO: 44578 - protein, 31 aa, Artificial Sequence
  Description of Artificial Sequence: Synthetic polypeptide
DEEVIRTTNPVATEQYGSVSTHEERGNNDTS

SEQ ID NO: 44579 - protein, 30 aa, Artificial Sequence
  Description of Artificial Sequence: Synthetic polypeptide
DEEVIRTTNPVATEQYGSVSTHYERENNTD

SEQ ID NO: 44580 - protein, 32 aa, Artificial Sequence
  Description of Artificial Sequence: Synthetic polypeptide
DEEVIRTTNPVATEQYGSVSTMNLGDNGQNDH

SEQ ID NO: 44581 - protein, 31 aa, Artificial Sequence
  Description of Artificial Sequence: Synthetic polypeptide
DEEVIRTTNPVATEQYGSVSTNHNDNGSNQA

SEQ ID NO: 44582 - protein, 32 aa, Artificial Sequence
  Description of Artificial Sequence: Synthetic polypeptide
DEEVIRTTNPVATEQYGSVSTNLGDNSSQNRL

SEQ ID NO: 44583 - protein, 31 aa, Artificial Sequence
  Description of Artificial Sequence: Synthetic polypeptide
SEEEIRTTNPVATEQYGSVATALLQEGQFDR

SEQ ID NO: 44584 - protein, 31 aa, Artificial Sequence
  Description of Artificial Sequence: Synthetic polypeptide
DEEVIRTTNPVATEQYGSVSTNLNDNGSDQI

SEQ ID NO: 44585 - protein, 30 aa, Artificial Sequence
  Description of Artificial Sequence: Synthetic polypeptide
DDEEIRTTNPVATEQYGSVMNDNNQFEGNQ

SEQ ID NO: 44586 - protein, 30 aa, Artificial Sequence
  Description of Artificial Sequence: Synthetic polypeptide
DEEVIRTTNPVATEQYGSVSTHELRSNNDT

SEQ ID NO: 44587 - protein, 30 aa, Artificial Sequence
  Description of Artificial Sequence: Synthetic polypeptide
DEFCIRTTNPVATEQYGCVCETNPQRGNQG

SEQ ID NO: 44588 - protein, 30 aa, Artificial Sequence
  Description of Artificial Sequence: Synthetic polypeptide
DEFCIRTTNPVATEQYGCVCETNPQYGSNR

SEQ ID NO: 44589 - protein, 32 aa, Artificial Sequence
  Description of Artificial Sequence: Synthetic polypeptide
DEFEIATTNPVATEQYGSVSVTNDLHFDGNRE

SEQ ID NO: 44590 - protein, 30 aa, Artificial Sequence
  Description of Artificial Sequence: Synthetic polypeptide
DNEEISTTNPVATWQYGSVSLVLPEVRGNR

SEQ ID NO: 44591 - protein, 30 aa, Artificial Sequence
  Description of Artificial Sequence: Synthetic polypeptide
DEFEICTVNPVATEQYGSVSTNELSTEGNE

SEQ ID NO: 44592 - protein, 29 aa, Artificial Sequence
  Description of Artificial Sequence: Synthetic peptide
SEEEIRTTNPVATEQYGDVSENLMAAEDR

SEQ ID NO: 44593 - protein, 33 aa, Artificial Sequence
  Description of Artificial Sequence: Synthetic polypeptide
DDEEIRTTNPVATEQYGQCVCSTNLQGSGSNRA

SEQ ID NO: 44594 - protein, 29 aa, Artificial Sequence
  Description of Artificial Sequence: Synthetic peptide
DEFEICTVNPVATEQYGSVSTNLFEENEI

SEQ ID NO: 44595 - protein, 30 aa, Artificial Sequence
  Description of Artificial Sequence: Synthetic polypeptide
DEFEICTVNPVATEQYGSVSTNLFEGMNQE

SEQ ID NO: 44596 - protein, 29 aa, Artificial Sequence
  Description of Artificial Sequence: Synthetic peptide
DEFEICTVNPVATEQYGSVSTNLFELNHE

SEQ ID NO: 44597 - protein, 32 aa, Artificial Sequence
  Description of Artificial Sequence: Synthetic polypeptide
AEEEIRTTNPVATEQYGSVSTTNLGEDGGNAT

SEQ ID NO: 44598 - protein, 29 aa, Artificial Sequence
  Description of Artificial Sequence: Synthetic peptide
DEFEICTVNPVATEQYGSVSTNLFPEGDH

SEQ ID NO: 44599 - protein, 33 aa, Artificial Sequence
  Description of Artificial Sequence: Synthetic polypeptide
AEEEIRTTNPVATEQYGSVSTTNLGQEEGNNQN

SEQ ID NO: 44600 - protein, 33 aa, Artificial Sequence
  Description of Artificial Sequence: Synthetic polypeptide
AEEEIRTTNPVATEQYGSVSTTNLGQENGTNSE

SEQ ID NO: 44601 - protein, 30 aa, Artificial Sequence
  Description of Artificial Sequence: Synthetic polypeptide
DEFEICTVNPVATEQYGSVSTNLQFEGEHM

SEQ ID NO: 44602 - protein, 33 aa, Artificial Sequence
  Description of Artificial Sequence: Synthetic polypeptide
AEEEIRTTNPVATEQYGSVSTTNLGQNLGNIET

SEQ ID NO: 44603 - protein, 33 aa, Artificial Sequence
  Description of Artificial Sequence: Synthetic polypeptide
AEEEIRTTNPVATEQYGSVSTTNLGQQNGTTNA

SEQ ID NO: 44604 - protein, 31 aa, Artificial Sequence
  Description of Artificial Sequence: Synthetic polypeptide
AEEEIRTTNPVATEQYGSVSTTNLIGNEQNG

SEQ ID NO: 44605 - protein, 30 aa, Artificial Sequence
  Description of Artificial Sequence: Synthetic polypeptide
DEFEICTVNPVATEQYGSVSTTMNLFGGNH

SEQ ID NO: 44606 - protein, 30 aa, Artificial Sequence
  Description of Artificial Sequence: Synthetic polypeptide
DEFEICTVNPVATEQYGSVSTNLNFEGNTT

SEQ ID NO: 44607 - protein, 31 aa, Artificial Sequence
  Description of Artificial Sequence: Synthetic polypeptide
DEEVIRTTNPVATEQYGSCSTNLTPNGQNHD

SEQ ID NO: 44608 - protein, 32 aa, Artificial Sequence
  Description of Artificial Sequence: Synthetic polypeptide
AEEEIRTTNPVATEQYGSVSTTNLEVTGTNAT

SEQ ID NO: 44609 - protein, 30 aa, Artificial Sequence
  Description of Artificial Sequence: Synthetic polypeptide
DEFEICTVNPVATEQYGSVSCTNLEEGGNH

SEQ ID NO: 44610 - protein, 32 aa, Artificial Sequence
  Description of Artificial Sequence: Synthetic polypeptide
DDEEIRTTNPVATEQYGSVCSWNLQNFGSNQG

SEQ ID NO: 44611 - protein, 29 aa, Artificial Sequence
  Description of Artificial Sequence: Synthetic peptide
DEFEIATVNPVATEQYGSVSTNDEHEGNH

SEQ ID NO: 44612 - protein, 30 aa, Artificial Sequence
  Description of Artificial Sequence: Synthetic polypeptide
DEFEIATVNPVATEQYGSVSTNDLGMEGNH

SEQ ID NO: 44613 - protein, 33 aa, Artificial Sequence
  Description of Artificial Sequence: Synthetic polypeptide
DDEEIRTTNPVATEQYGSVCSTGNLQRFGSEFA

SEQ ID NO: 44614 - protein, 33 aa, Artificial Sequence
  Description of Artificial Sequence: Synthetic polypeptide
DDEEIRTTNPVATEQYGSVCSTGNLQHFGSNQM

SEQ ID NO: 44615 - protein, 30 aa, Artificial Sequence
  Description of Artificial Sequence: Synthetic polypeptide
DEFEIATVNPVATEQYGSVSTNGLFEEGNH

SEQ ID NO: 44616 - protein, 33 aa, Artificial Sequence
  Description of Artificial Sequence: Synthetic polypeptide
AEEEIRTTNPVATEQYGSVSTTNLENQEEGNNE

SEQ ID NO: 44617 - protein, 32 aa, Artificial Sequence
  Description of Artificial Sequence: Synthetic polypeptide
AEEEIRTTNPVATEQYGSVSTTNLESGVNGTT

SEQ ID NO: 44618 - protein, 33 aa, Artificial Sequence
  Description of Artificial Sequence: Synthetic polypeptide
DDEEIRTTNPVATEQYGSVCSTENLNQFFGSND

SEQ ID NO: 44619 - protein, 33 aa, Artificial Sequence
  Description of Artificial Sequence: Synthetic polypeptide
SEEEIRTTNPVATEQYGKVSCTNMLSQHGGNQR

SEQ ID NO: 44620 - protein, 33 aa, Artificial Sequence
  Description of Artificial Sequence: Synthetic polypeptide
AEEEIRTTNPVATEQYGSVSTTNLENQESGNNN

SEQ ID NO: 44621 - protein, 29 aa, Artificial Sequence
  Description of Artificial Sequence: Synthetic peptide
DEFEICTVNPVATEGYGSVSTNLVEGNDH

SEQ ID NO: 44622 - protein, 32 aa, Artificial Sequence
  Description of Artificial Sequence: Synthetic polypeptide
QEEEIRSTNPVAYEQYGSTVSTDNMLQRGENA

SEQ ID NO: 44623 - protein, 29 aa, Artificial Sequence
  Description of Artificial Sequence: Synthetic peptide
DNEEISVTNPVATWQYGSVSTNQMNGNER

SEQ ID NO: 44624 - protein, 29 aa, Artificial Sequence
  Description of Artificial Sequence: Synthetic peptide
DEFEICTVNPVATEQYGCVSTNLINGNNQ

SEQ ID NO: 44625 - protein, 30 aa, Artificial Sequence
  Description of Artificial Sequence: Synthetic polypeptide
DNEEISTTNPVATWQYGSVSTNIVRAGVRI

SEQ ID NO: 44626 - protein, 33 aa, Artificial Sequence
  Description of Artificial Sequence: Synthetic polypeptide
DDEEIRTTNPVATEQYGSVCSTENDLQFFGSNQ

SEQ ID NO: 44627 - protein, 31 aa, Artificial Sequence
  Description of Artificial Sequence: Synthetic polypeptide
AEEEIRTTNPVATEQYGSVSTSNNQQQTANL

SEQ ID NO: 44628 - protein, 31 aa, Artificial Sequence
  Description of Artificial Sequence: Synthetic polypeptide
DEEVIRTTNPVATEQYGMVSTNLGDNIQNDR

SEQ ID NO: 44629 - protein, 30 aa, Artificial Sequence
  Description of Artificial Sequence: Synthetic polypeptide
SEEEIRTTNPVATEQYGSVATDALQETQFR

SEQ ID NO: 44630 - protein, 29 aa, Artificial Sequence
  Description of Artificial Sequence: Synthetic peptide
DQAEIRTTNPVATEQYGCCSTPLQHGNQT

SEQ ID NO: 44631 - protein, 30 aa, Artificial Sequence
  Description of Artificial Sequence: Synthetic polypeptide
DEETIRTTNPVAVEQYGQVSTINTTQSGNN

SEQ ID NO: 44632 - protein, 29 aa, Artificial Sequence
  Description of Artificial Sequence: Synthetic peptide
DEETIRTTNPVAVEQYGQVSTNNVESGNN

SEQ ID NO: 44633 - protein, 30 aa, Artificial Sequence
  Description of Artificial Sequence: Synthetic polypeptide
DEETIRTTNPVAVEQYGQVSTQNGVQSGNN

SEQ ID NO: 44634 - protein, 33 aa, Artificial Sequence
  Description of Artificial Sequence: Synthetic polypeptide
SEEEIRTTNPVATEQYGSVCSTMELDQRGSNNQ

SEQ ID NO: 44635 - protein, 29 aa, Artificial Sequence
  Description of Artificial Sequence: Synthetic peptide
DEETIRVTNPVATEQYGSVSSNEQREEGE

SEQ ID NO: 44636 - protein, 29 aa, Artificial Sequence
  Description of Artificial Sequence: Synthetic peptide
DEETIRVTNPVATEQYGSVSSNQQHGELI

SEQ ID NO: 44637 - protein, 29 aa, Artificial Sequence
  Description of Artificial Sequence: Synthetic peptide
DEETIRVTNPVATEQYGSVSSPQQRGEEY

SEQ ID NO: 44638 - protein, 30 aa, Artificial Sequence
  Description of Artificial Sequence: Synthetic polypeptide
DEETISTTNPVATECYGSVNTNTGQRGVNN

SEQ ID NO: 44639 - protein, 32 aa, Artificial Sequence
  Description of Artificial Sequence: Synthetic polypeptide
SEEEIRTTNPVATEQYGSVCSTGNPQRNSNFA

SEQ ID NO: 44640 - protein, 29 aa, Artificial Sequence
  Description of Artificial Sequence: Synthetic peptide
DQAEIRTTNPVATEQYGCCSTMDDQHGNR

SEQ ID NO: 44641 - protein, 33 aa, Artificial Sequence
  Description of Artificial Sequence: Synthetic polypeptide
SEEEIRTTNPVATEQYGSVCSTENLDQSGSNYQ

SEQ ID NO: 44642 - protein, 33 aa, Artificial Sequence
  Description of Artificial Sequence: Synthetic polypeptide
AEEEIRTTNPVATEQYGSVSVTVNLQAGSNGNE

SEQ ID NO: 44643 - protein, 30 aa, Artificial Sequence
  Description of Artificial Sequence: Synthetic polypeptide
DEEVIACTNPVATEQYGCVSTNLQDNGDNA

SEQ ID NO: 44644 - protein, 30 aa, Artificial Sequence
  Description of Artificial Sequence: Synthetic polypeptide
DEEVIATTNPVATEPYSEEVSTNLQHGENR

SEQ ID NO: 44645 - protein, 30 aa, Artificial Sequence
  Description of Artificial Sequence: Synthetic polypeptide
DQAEIRTTNPVATEQYGCCSTSLSQHTGNR

SEQ ID NO: 44646 - protein, 30 aa, Artificial Sequence
  Description of Artificial Sequence: Synthetic polypeptide
DEETIRTTNPVAVEQYGQVSTIGNVQSGNN

SEQ ID NO: 44647 - protein, 33 aa, Artificial Sequence
  Description of Artificial Sequence: Synthetic polypeptide
AEEEIRTTNPVATEQYGSVSVTVNLQQGDEGNG

SEQ ID NO: 44648 - protein, 33 aa, Artificial Sequence
  Description of Artificial Sequence: Synthetic polypeptide
AEEEIRTTNPVATEQYGSVSVTVNLQQNEGNLE

SEQ ID NO: 44649 - protein, 32 aa, Artificial Sequence
  Description of Artificial Sequence: Synthetic polypeptide
SEEEIRTTNPVATEQYGSVESTLVNDNERGFR

SEQ ID NO: 44650 - protein, 32 aa, Artificial Sequence
  Description of Artificial Sequence: Synthetic polypeptide
DEETIRTTNPVATEQYGTVTVSTNLQQIGNQE

SEQ ID NO: 44651 - protein, 32 aa, Artificial Sequence
  Description of Artificial Sequence: Synthetic polypeptide
AEEEIRTTNPVATEQYGSVSVTVNLQQQVENL

SEQ ID NO: 44652 - protein, 32 aa, Artificial Sequence
  Description of Artificial Sequence: Synthetic polypeptide
DEETIRTTNPVATEQYGTVTVSTTNLQIGNEE

SEQ ID NO: 44653 - protein, 29 aa, Artificial Sequence
  Description of Artificial Sequence: Synthetic peptide
DQAEIRTTNPVATEQYGCCSTVLDHGNRD

SEQ ID NO: 44654 - protein, 31 aa, Artificial Sequence
  Description of Artificial Sequence: Synthetic polypeptide
AEEEIRTTNPVATEQYGSVSTTNDVQGENDG

SEQ ID NO: 44655 - protein, 32 aa, Artificial Sequence
  Description of Artificial Sequence: Synthetic polypeptide
DEETIRTTNPVATEQYGTVVTVSTNLQIGNQG

SEQ ID NO: 44656 - protein, 30 aa, Artificial Sequence
  Description of Artificial Sequence: Synthetic polypeptide
DQAEIRTTNPVATEQYGCCSTGELQHGNRS

SEQ ID NO: 44657 - protein, 31 aa, Artificial Sequence
  Description of Artificial Sequence: Synthetic polypeptide
AEEEIRTTNPVATEQYGSVSTTNDVQQETND

SEQ ID NO: 44658 - protein, 32 aa, Artificial Sequence
  Description of Artificial Sequence: Synthetic polypeptide
AEEEIRTTNPVATEQYGSVSTTNDVQQGENDT

SEQ ID NO: 44659 - protein, 33 aa, Artificial Sequence
  Description of Artificial Sequence: Synthetic polypeptide
AEEEIRTTNPVATEQYGSVSTTNELQGNTGGNQ

SEQ ID NO: 44660 - protein, 31 aa, Artificial Sequence
  Description of Artificial Sequence: Synthetic polypeptide
AEEEIRTTNPVATEQYGSVSTTNENNEGNQS

SEQ ID NO: 44661 - protein, 32 aa, Artificial Sequence
  Description of Artificial Sequence: Synthetic polypeptide
AEEEIRTTNPVATEQYGSVSTTNEQENGNTNN

SEQ ID NO: 44662 - protein, 31 aa, Artificial Sequence
  Description of Artificial Sequence: Synthetic polypeptide
AEEEIRTTNPVATEQYGSVSTTNEQENNANN

SEQ ID NO: 44663 - protein, 31 aa, Artificial Sequence
  Description of Artificial Sequence: Synthetic polypeptide
SEEEIRTTNPVATEQYGSVCSTNLEGDEDRI

SEQ ID NO: 44664 - protein, 32 aa, Artificial Sequence
  Description of Artificial Sequence: Synthetic polypeptide
DEETIRTTNPVATEQYGVVSVSNNLQIGDNGV

SEQ ID NO: 44665 - protein, 32 aa, Artificial Sequence
  Description of Artificial Sequence: Synthetic polypeptide
DEETIRTTNPVATEQYGTVVVTSTNLNQIGNE

SEQ ID NO: 44666 - protein, 30 aa, Artificial Sequence
  Description of Artificial Sequence: Synthetic polypeptide
DQAEIRTTNPVATEQYGCCSTELQHFGNRG

SEQ ID NO: 44667 - protein, 28 aa, Artificial Sequence
  Description of Artificial Sequence: Synthetic peptide
DEEVIATTNPVATEQYGCVATNDQDGPS

SEQ ID NO: 44668 - protein, 33 aa, Artificial Sequence
  Description of Artificial Sequence: Synthetic polypeptide
AEEEIRTTNPVATEQYGSVSVTVNLNQQGENLE

SEQ ID NO: 44669 - protein, 31 aa, Artificial Sequence
  Description of Artificial Sequence: Synthetic polypeptide
SEEEIRTTNPVATEQYGSVATNLQAEPGDQD

SEQ ID NO: 44670 - protein, 31 aa, Artificial Sequence
  Description of Artificial Sequence: Synthetic polypeptide
SEEEIRTTNPVATEQYGSVATNLQAENPNED

SEQ ID NO: 44671 - protein, 32 aa, Artificial Sequence
  Description of Artificial Sequence: Synthetic polypeptide
AEEEIRTTNPVATEQYGSVSVTVNEQENGNNN

SEQ ID NO: 44672 - protein, 31 aa, Artificial Sequence
  Description of Artificial Sequence: Synthetic polypeptide
SEEEIRTTNPVATEQYGSVATNLQADPNDGA

SEQ ID NO: 44673 - protein, 31 aa, Artificial Sequence
  Description of Artificial Sequence: Synthetic polypeptide
DEEVIRTTNPVATEPYGTVTTNLPQRGSTRE

SEQ ID NO: 44674 - protein, 31 aa, Artificial Sequence
  Description of Artificial Sequence: Synthetic polypeptide
DEEVIRTTNPVATEQWGSTATNNLQVGDNRE

SEQ ID NO: 44675 - protein, 30 aa, Artificial Sequence
  Description of Artificial Sequence: Synthetic polypeptide
DEEVIRTTNPVATEQWGSVAANNLQVGDNA

SEQ ID NO: 44676 - protein, 32 aa, Artificial Sequence
  Description of Artificial Sequence: Synthetic polypeptide
SEEEIRTTNPVATEQYGSVATNLQANGDNNDD

SEQ ID NO: 44677 - protein, 32 aa, Artificial Sequence
  Description of Artificial Sequence: Synthetic polypeptide
DEEVIRTTNPVATEQWGSVAATNNLQPGVNPR

SEQ ID NO: 44678 - protein, 31 aa, Artificial Sequence
  Description of Artificial Sequence: Synthetic polypeptide
SEEEIRTTNPVATEQYGSVATNLNRNLNEAQ

SEQ ID NO: 44679 - protein, 32 aa, Artificial Sequence
  Description of Artificial Sequence: Synthetic polypeptide
DDEEIRTTNPVATEQYGSVSTGELQNFGSERA

SEQ ID NO: 44680 - protein, 32 aa, Artificial Sequence
  Description of Artificial Sequence: Synthetic polypeptide
SEEEIRTTNPVATEQYGSVATNLNRNGNEMDT

SEQ ID NO: 44681 - protein, 31 aa, Artificial Sequence
  Description of Artificial Sequence: Synthetic polypeptide
DEEVIRTTNPVATEQYGCVSTNLNDNGSDNQ

SEQ ID NO: 44682 - protein, 29 aa, Artificial Sequence
  Description of Artificial Sequence: Synthetic peptide
SEEEIRTTNPVATEQYGSVATNDQENPEV

SEQ ID NO: 44683 - protein, 30 aa, Artificial Sequence
  Description of Artificial Sequence: Synthetic polypeptide
DEEVIRTTNPVATEQYGCVSTNLNDNSSNQ

SEQ ID NO: 44684 - protein, 31 aa, Artificial Sequence
  Description of Artificial Sequence: Synthetic polypeptide
DEEVIRTTNPVATEQYGCVTSTNLNDNGSER

SEQ ID NO: 44685 - protein, 31 aa, Artificial Sequence
  Description of Artificial Sequence: Synthetic polypeptide
DEEVIRTTNPVATEQYGCVCSTNHQFGSNQS

SEQ ID NO: 44686 - protein, 31 aa, Artificial Sequence
  Description of Artificial Sequence: Synthetic polypeptide
DEEVIRTTNPVATEQYGEVSTNLGDNGQFDR

SEQ ID NO: 44687 - protein, 32 aa, Artificial Sequence
  Description of Artificial Sequence: Synthetic polypeptide
SEEEIRTTNPVATEQYGSVATNLQANGVNDNV

SEQ ID NO: 44688 - protein, 29 aa, Artificial Sequence
  Description of Artificial Sequence: Synthetic peptide
DEEVIRATNPVATEQYGCVAATNDQMGNY

SEQ ID NO: 44689 - protein, 33 aa, Artificial Sequence
  Description of Artificial Sequence: Synthetic polypeptide
AEEEIRTTNPVATEQYGSVSVTVNLEQNNGNII

SEQ ID NO: 44690 - protein, 31 aa, Artificial Sequence
  Description of Artificial Sequence: Synthetic polypeptide
SEEEIRTTNPVATEQYGSVATVALQEGQFSR

SEQ ID NO: 44691 - protein, 30 aa, Artificial Sequence
  Description of Artificial Sequence: Synthetic polypeptide
DEEVIATTNPVATEQYGSVSTDDRDNGQNR

SEQ ID NO: 44692 - protein, 29 aa, Artificial Sequence
  Description of Artificial Sequence: Synthetic peptide
DEEVIATTNPVAYEQYGQVSTINVQRDNN

SEQ ID NO: 44693 - protein, 33 aa, Artificial Sequence
  Description of Artificial Sequence: Synthetic polypeptide
SEEEIRTTNPVATEQYGSVATPNGNMQRGENDR

SEQ ID NO: 44694 - protein, 31 aa, Artificial Sequence
  Description of Artificial Sequence: Synthetic polypeptide
DEEVIATTNPVAYEQYGSVSTNLQDNPGENN

SEQ ID NO: 44695 - protein, 28 aa, Artificial Sequence
  Description of Artificial Sequence: Synthetic peptide
QEEEIRCTNPVGTEQYGVVSSTLMRGDR

SEQ ID NO: 44696 - protein, 29 aa, Artificial Sequence
  Description of Artificial Sequence: Synthetic peptide
DEEVIRATNPVATEQYGSVSTHEPLRENT

SEQ ID NO: 44697 - protein, 31 aa, Artificial Sequence
  Description of Artificial Sequence: Synthetic polypeptide
SEEEIRTTNPVATEQYGSVATNLTANGSNMD

SEQ ID NO: 44698 - protein, 32 aa, Artificial Sequence
  Description of Artificial Sequence: Synthetic polypeptide
SEEEIRTTNPVATEQYGSVATNLQQPGENAIE

SEQ ID NO: 44699 - protein, 29 aa, Artificial Sequence
  Description of Artificial Sequence: Synthetic peptide
DEEVIATTNPVAYMQYSEEVSTNLQHGNR

SEQ ID NO: 44700 - protein, 31 aa, Artificial Sequence
  Description of Artificial Sequence: Synthetic polypeptide
SEEEIRTTNPVATEQYGSVATNLQDNPNENH

SEQ ID NO: 44701 - protein, 32 aa, Artificial Sequence
  Description of Artificial Sequence: Synthetic polypeptide
AEEEIRTTNPVATEQYGSVSVTVNGQNGNNAQ

SEQ ID NO: 44702 - protein, 32 aa, Artificial Sequence
  Description of Artificial Sequence: Synthetic polypeptide
DDEEIRTTNPVATEQYGSVSTTPNVFRSGNQY

SEQ ID NO: 44703 - protein, 31 aa, Artificial Sequence
  Description of Artificial Sequence: Synthetic polypeptide
DEEVIGTTNPVAYEQYGCVSTNDQERGDNLR

SEQ ID NO: 44704 - protein, 31 aa, Artificial Sequence
  Description of Artificial Sequence: Synthetic polypeptide
SEEEIRTTNPVATEQYGSVATNLQATEDNDD

SEQ ID NO: 44705 - protein, 30 aa, Artificial Sequence
  Description of Artificial Sequence: Synthetic polypeptide
DEEVIATTNPVAYEQYSEEVSTNLQNGNMR

SEQ ID NO: 44706 - protein, 29 aa, Artificial Sequence
  Description of Artificial Sequence: Synthetic peptide
DEFEICTVNPVATEQYGTVSTNLEEGNEH

SEQ ID NO: 44707 - protein, 31 aa, Artificial Sequence
  Description of Artificial Sequence: Synthetic polypeptide
DEETIATTNPVATECYGSVNTNNGLEQRGNM

SEQ ID NO: 44708 - protein, 30 aa, Artificial Sequence
  Description of Artificial Sequence: Synthetic polypeptide
DEESISTTNPVATECYGSVNTNTLQSGNNM

SEQ ID NO: 44709 - protein, 32 aa, Artificial Sequence
  Description of Artificial Sequence: Synthetic polypeptide
AEEEIRTTNPVATEQYGSVSTNNQLQANNQEN

SEQ ID NO: 44710 - protein, 30 aa, Artificial Sequence
  Description of Artificial Sequence: Synthetic polypeptide
DDETIRTTNPVATEQYGMVSTNHQQVRPNN

SEQ ID NO: 44711 - protein, 30 aa, Artificial Sequence
  Description of Artificial Sequence: Synthetic polypeptide
DDETIRTTNPVATEQYGKVSTNHEQVRNNL

SEQ ID NO: 44712 - protein, 33 aa, Artificial Sequence
  Description of Artificial Sequence: Synthetic polypeptide
AEEEIRTTNPVATEQYGSVSTNNQLQVENGNNA

SEQ ID NO: 44713 - protein, 31 aa, Artificial Sequence
  Description of Artificial Sequence: Synthetic polypeptide
SEEEIRTTNPVAYEQYGSVATNLQNPGENDD

SEQ ID NO: 44714 - protein, 30 aa, Artificial Sequence
  Description of Artificial Sequence: Synthetic polypeptide
DEENIRTTNPVATEIYGQVTTNDLQRGSED

SEQ ID NO: 44715 - protein, 31 aa, Artificial Sequence
  Description of Artificial Sequence: Synthetic polypeptide
DQEEIRTTNPVATHQYGSVSTNGVQNGNHSN

SEQ ID NO: 44716 - protein, 29 aa, Artificial Sequence
  Description of Artificial Sequence: Synthetic peptide
DEENIRTTNPVATEIYGQVTTNLQRTSEQ

SEQ ID NO: 44717 - protein, 28 aa, Artificial Sequence
  Description of Artificial Sequence: Synthetic peptide
AENEIACTNPVATEQYGEASCNLQRGGR

SEQ ID NO: 44718 - protein, 31 aa, Artificial Sequence
  Description of Artificial Sequence: Synthetic polypeptide
DQEEIRTTNPVATHQYGSVSTNGVQENGQHR

SEQ ID NO: 44719 - protein, 32 aa, Artificial Sequence
  Description of Artificial Sequence: Synthetic polypeptide
AEEEIRTTNPVATEQYGSVSTNNQQLNGNEQV

SEQ ID NO: 44720 - protein, 28 aa, Artificial Sequence
  Description of Artificial Sequence: Synthetic peptide
AENEIACTNPVATEQYGEASDNLQRGGR

SEQ ID NO: 44721 - protein, 29 aa, Artificial Sequence
  Description of Artificial Sequence: Synthetic peptide
DDETIRTTNPVATEQYGAVSTNHQTVNLT

SEQ ID NO: 44722 - protein, 33 aa, Artificial Sequence
  Description of Artificial Sequence: Synthetic polypeptide
AEEEIRTTNPVATEQYGSVSTNNVLGNQQGNNN

SEQ ID NO: 44723 - protein, 33 aa, Artificial Sequence
  Description of Artificial Sequence: Synthetic polypeptide
DEENIRTTNPVATEQYGSTPSMTENLPQRIGER

SEQ ID NO: 44724 - protein, 30 aa, Artificial Sequence
  Description of Artificial Sequence: Synthetic polypeptide
DEENIRTTNPIATEQYGSVPTNNLQSMSND

SEQ ID NO: 44725 - protein, 32 aa, Artificial Sequence
  Description of Artificial Sequence: Synthetic polypeptide
DQEEIRTTNPVATHQYGSVSTNGVTQNGNHRT

SEQ ID NO: 44726 - protein, 30 aa, Artificial Sequence
  Description of Artificial Sequence: Synthetic polypeptide
DDETIRTTNPVATEQYGSVSTGGQGGGNTQ

SEQ ID NO: 44727 - protein, 30 aa, Artificial Sequence
  Description of Artificial Sequence: Synthetic polypeptide
DDETIRTTNPVATEQYGSVSTNGEGGGGNT

SEQ ID NO: 44728 - protein, 31 aa, Artificial Sequence
  Description of Artificial Sequence: Synthetic polypeptide
DQEEIRTTNPVAYEQYGQVPSCTNLSGSGNR

SEQ ID NO: 44729 - protein, 30 aa, Artificial Sequence
  Description of Artificial Sequence: Synthetic polypeptide
DEEKIRTTNPVAWEQYGQVSTINVDQGGNN

SEQ ID NO: 44730 - protein, 32 aa, Artificial Sequence
  Description of Artificial Sequence: Synthetic polypeptide
AEEEIRTTNPVATEQYGSVSTNNNTQENIGNE

SEQ ID NO: 44731 - protein, 28 aa, Artificial Sequence
  Description of Artificial Sequence: Synthetic peptide
DEELIRPTNPVATEQYGSVSWHFEGGNL

SEQ ID NO: 44732 - protein, 31 aa, Artificial Sequence
  Description of Artificial Sequence: Synthetic polypeptide
QEEEICTTNPVATEQYGSVSTNLQHQGGEDD

SEQ ID NO: 44733 - protein, 29 aa, Artificial Sequence
  Description of Artificial Sequence: Synthetic peptide
SEEEIRTTNPVGTEQWGSVSTNELGRDPM

SEQ ID NO: 44734 - protein, 30 aa, Artificial Sequence
  Description of Artificial Sequence: Synthetic polypeptide
DQEEIRTTNPVATHQYGSVSTPGVENGNDR

SEQ ID NO: 44735 - protein, 31 aa, Artificial Sequence
  Description of Artificial Sequence: Synthetic polypeptide
DQEEIRTTNPVATHQYGSVSTNGVEQNGEDR

SEQ ID NO: 44736 - protein, 32 aa, Artificial Sequence
  Description of Artificial Sequence: Synthetic polypeptide
AEEEIRTTNPVATEQYGSVSTNNQEQQGNGSG

SEQ ID NO: 44737 - protein, 33 aa, Artificial Sequence
  Description of Artificial Sequence: Synthetic polypeptide
AEEEIRTTNPVATEQYGSVSTNNQLGNQQGNNN

SEQ ID NO: 44738 - protein, 32 aa, Artificial Sequence
  Description of Artificial Sequence: Synthetic polypeptide
SEEEIRTTNPVAYESYGSVPSCTNLHRGGDNR

SEQ ID NO: 44739 - protein, 30 aa, Artificial Sequence
  Description of Artificial Sequence: Synthetic polypeptide
DEENICTTNPVATESYGQVSTTNLQAGSNG

SEQ ID NO: 44740 - protein, 30 aa, Artificial Sequence
  Description of Artificial Sequence: Synthetic polypeptide
DEENICTVNPVATEQYGSVSTALQAGNQED

SEQ ID NO: 44741 - protein, 29 aa, Artificial Sequence
  Description of Artificial Sequence: Synthetic peptide
DEENICTVNPVATEQYGSVSTALQLQNQE

SEQ ID NO: 44742 - protein, 32 aa, Artificial Sequence
  Description of Artificial Sequence: Synthetic polypeptide
DQEEIRTTNPVATHQYGSVSTNMQSQNGGNNR

SEQ ID NO: 44743 - protein, 30 aa, Artificial Sequence
  Description of Artificial Sequence: Synthetic polypeptide
DEENICTVNPVATEQYGSVSTALQQGNQEE

SEQ ID NO: 44744 - protein, 28 aa, Artificial Sequence
  Description of Artificial Sequence: Synthetic peptide
AENEIACTNPVATEQYGEASANLQRGGR

SEQ ID NO: 44745 - protein, 30 aa, Artificial Sequence
  Description of Artificial Sequence: Synthetic polypeptide
DEEKIETVNPVATEWYGSVSVNLEERQGNR

SEQ ID NO: 44746 - protein, 31 aa, Artificial Sequence
  Description of Artificial Sequence: Synthetic polypeptide
DDETIRTTNPVATEQYGAVSTNGQRGVNNLF

SEQ ID NO: 44747 - protein, 31 aa, Artificial Sequence
  Description of Artificial Sequence: Synthetic polypeptide
DDETIRTTNPVATEQYGAVSTDNGQRNVGNQ

SEQ ID NO: 44748 - protein, 33 aa, Artificial Sequence
  Description of Artificial Sequence: Synthetic polypeptide
AEEEIRTTNPVATEQYGSVSTNQQQLQQGTNEQ

SEQ ID NO: 44749 - protein, 31 aa, Artificial Sequence
  Description of Artificial Sequence: Synthetic polypeptide
DEEPIRTTNPVATEQYGCVSTNDGQAGNGNA

SEQ ID NO: 44750 - protein, 31 aa, Artificial Sequence
  Description of Artificial Sequence: Synthetic polypeptide
DEEPIRTTNPVATEQYGCVSTNDGQSGGMNA

SEQ ID NO: 44751 - protein, 30 aa, Artificial Sequence
  Description of Artificial Sequence: Synthetic polypeptide
DEEPIRTTNPVATEQYGCVSTNGDFNGNES

SEQ ID NO: 44752 - protein, 30 aa, Artificial Sequence
  Description of Artificial Sequence: Synthetic polypeptide
DEEPIRTTNPVATEQYGCVSTNSQFPENQG

SEQ ID NO: 44753 - protein, 33 aa, Artificial Sequence
  Description of Artificial Sequence: Synthetic polypeptide
DEEPIRTTNPVATEQYGSVVSCQPNLQRQENNR

SEQ ID NO: 44754 - protein, 31 aa, Artificial Sequence
  Description of Artificial Sequence: Synthetic polypeptide
AEEEIRTTNPVATEQYGSVSTNQQQQQGTDN

SEQ ID NO: 44755 - protein, 32 aa, Artificial Sequence
  Description of Artificial Sequence: Synthetic polypeptide
AEEEIRTTNPVATEQYGSVSTNQQQQTGNSTT

SEQ ID NO: 44756 - protein, 32 aa, Artificial Sequence
  Description of Artificial Sequence: Synthetic polypeptide
DEEPIRTTNPVAYEQYGEVPSCTNLSQEGENR

SEQ ID NO: 44757 - protein, 31 aa, Artificial Sequence
  Description of Artificial Sequence: Synthetic polypeptide
DEEPIRTTNPVAYEQYGTVSCTNLSQEGENQ

SEQ ID NO: 44758 - protein, 31 aa, Artificial Sequence
  Description of Artificial Sequence: Synthetic polypeptide
DEEPIRTTNPVAYEQYRWETVSTNLSQGGNR

SEQ ID NO: 44759 - protein, 29 aa, Artificial Sequence
  Description of Artificial Sequence: Synthetic peptide
DEEPIRTTNPVAYEQYSEEVTTNMQGGNR

SEQ ID NO: 44760 - protein, 30 aa, Artificial Sequence
  Description of Artificial Sequence: Synthetic polypeptide
DEEPIRTTNPVAYEQYSETVSTNLQIGGER

SEQ ID NO: 44761 - protein, 30 aa, Artificial Sequence
  Description of Artificial Sequence: Synthetic polypeptide
DEEPISTTNPTAYEQYGSVSTTNLSQNGNQ

SEQ ID NO: 44762 - protein, 32 aa, Artificial Sequence
  Description of Artificial Sequence: Synthetic polypeptide
AEEEIRTTNPVATEQYGSVSTNSNLDEFGNNA

SEQ ID NO: 44763 - protein, 31 aa, Artificial Sequence
  Description of Artificial Sequence: Synthetic polypeptide
AEEEIRTTNPVATEQYGSVSTNQQQLEGEGE

SEQ ID NO: 44764 - protein, 29 aa, Artificial Sequence
  Description of Artificial Sequence: Synthetic peptide
DDEEIVTTNPVATEQYGTVSTVPTDSGNR

SEQ ID NO: 44765 - protein, 31 aa, Artificial Sequence
  Description of Artificial Sequence: Synthetic polypeptide
DEEPIRTTNPVATEPYRWEVSTNLSQPGGNR

SEQ ID NO: 44766 - protein, 32 aa, Artificial Sequence
  Description of Artificial Sequence: Synthetic polypeptide
AEEEIRTTNPVATEQYGSVSTNQQQGNVTNVD

SEQ ID NO: 44767 - protein, 31 aa, Artificial Sequence
  Description of Artificial Sequence: Synthetic polypeptide
AEEEIRTTNPVATEQYGSVSTNQGSNNGNQS

SEQ ID NO: 44768 - protein, 30 aa, Artificial Sequence
  Description of Artificial Sequence: Synthetic polypeptide
DEENIRTTNPVATEQYGTSVGTETERFGNL

SEQ ID NO: 44769 - protein, 29 aa, Artificial Sequence
  Description of Artificial Sequence: Synthetic peptide
DDEQIRTTNPVATEQYGCVSTEHQRVSNL

SEQ ID NO: 44770 - protein, 30 aa, Artificial Sequence
  Description of Artificial Sequence: Synthetic polypeptide
DEENIRTTNPVATEWYGQVTTELQRASNNR

SEQ ID NO: 44771 - protein, 33 aa, Artificial Sequence
  Description of Artificial Sequence: Synthetic polypeptide
AEEEIRTTNPVATEQYGSVSVVTNNLQNIGNND

SEQ ID NO: 44772 - protein, 29 aa, Artificial Sequence
  Description of Artificial Sequence: Synthetic peptide
DDENIRTTNPVATEQYGSVSTGEGGGNET

SEQ ID NO: 44773 - protein, 30 aa, Artificial Sequence
  Description of Artificial Sequence: Synthetic polypeptide
DQEEIRTTNPVATHQYGSVSTNGVENGNIN

SEQ ID NO: 44774 - protein, 32 aa, Artificial Sequence
  Description of Artificial Sequence: Synthetic polypeptide
DEENIRTTNPVATEQYGSVQTDNVNLNAGDNR

SEQ ID NO: 44775 - protein, 31 aa, Artificial Sequence
  Description of Artificial Sequence: Synthetic polypeptide
DEENIRYTNPVATEQYGSVSVNQDRIGSNSR

SEQ ID NO: 44776 - protein, 30 aa, Artificial Sequence
  Description of Artificial Sequence: Synthetic polypeptide
DQEEIRTTNPVATHQYGSVSTNGHQNGDTA

SEQ ID NO: 44777 - protein, 31 aa, Artificial Sequence
  Description of Artificial Sequence: Synthetic polypeptide
SEEEIRTTNPVATESYGSVSVTNLAGGDQRD

SEQ ID NO: 44778 - protein, 30 aa, Artificial Sequence
  Description of Artificial Sequence: Synthetic polypeptide
DDENIRTTNPVATEQYGAVSTNGQRVENGL

SEQ ID NO: 44779 - protein, 31 aa, Artificial Sequence
  Description of Artificial Sequence: Synthetic polypeptide
DDENIRTTNPVATEQYGAVSTNGQRGVNGDQ

SEQ ID NO: 44780 - protein, 30 aa, Artificial Sequence
  Description of Artificial Sequence: Synthetic polypeptide
DEEPIATTNPVAYTEPYSSEVSTNLQNGNT

SEQ ID NO: 44781 - protein, 31 aa, Artificial Sequence
  Description of Artificial Sequence: Synthetic polypeptide
DEEPICTTNPVATEQYGSVASTSPQNAGNNR

SEQ ID NO: 44782 - protein, 29 aa, Artificial Sequence
  Description of Artificial Sequence: Synthetic peptide
DDENIATTNPVATEQYGEVSTPNHQRDNL

SEQ ID NO: 44783 - protein, 30 aa, Artificial Sequence
  Description of Artificial Sequence: Synthetic polypeptide
DDENIRTTNPVATEQYGAVSVNGQRGVNDL

SEQ ID NO: 44784 - protein, 31 aa, Artificial Sequence
  Description of Artificial Sequence: Synthetic polypeptide
AEEEIRTTNPVATEQYGSVSTNNNTDTGGNY

SEQ ID NO: 44785 - protein, 30 aa, Artificial Sequence
  Description of Artificial Sequence: Synthetic polypeptide
DEEIIRTTNPVATEQYGSCVSTYCEFGNCF

SEQ ID NO: 44786 - protein, 30 aa, Artificial Sequence
  Description of Artificial Sequence: Synthetic polypeptide
DEEIIRTTNPVATEQYGCVSTNSQFPENNQ

SEQ ID NO: 44787 - protein, 32 aa, Artificial Sequence
  Description of Artificial Sequence: Synthetic polypeptide
AEEEIRTTNPVATEQYGSVSTNNNQNEGNEQV

SEQ ID NO: 44788 - protein, 31 aa, Artificial Sequence
  Description of Artificial Sequence: Synthetic polypeptide
DEEEIVTTNPVATEQYGTVCSATNLVESGNQ

SEQ ID NO: 44789 - protein, 32 aa, Artificial Sequence
  Description of Artificial Sequence: Synthetic polypeptide
AEEEIRTTNPVATEQYGSVSTNNNQQAIGNGT

SEQ ID NO: 44790 - protein, 31 aa, Artificial Sequence
  Description of Artificial Sequence: Synthetic polypeptide
DEEEIVTTNPVATEQYGTVCSTDNLVEFGND

SEQ ID NO: 44791 - protein, 32 aa, Artificial Sequence
  Description of Artificial Sequence: Synthetic polypeptide
AEEEIRTTNPVATEQYGSVSTNNNQQEIGNQT

SEQ ID NO: 44792 - protein, 30 aa, Artificial Sequence
  Description of Artificial Sequence: Synthetic polypeptide
DEEEIVTTNPVAYEQYGCNCSYTPLQRGNQ

SEQ ID NO: 44793 - protein, 30 aa, Artificial Sequence
  Description of Artificial Sequence: Synthetic polypeptide
DEEEIVTTNPVCTEQYGVVCSDNLVQSGNQ

SEQ ID NO: 44794 - protein, 32 aa, Artificial Sequence
  Description of Artificial Sequence: Synthetic polypeptide
AEEEIRTTNPVATEQYGSVSTNNNQQGIGTNQ

SEQ ID NO: 44795 - protein, 30 aa, Artificial Sequence
  Description of Artificial Sequence: Synthetic polypeptide
SEEEISTTNPVATEQYGCVSVTELQGGNQM

SEQ ID NO: 44796 - protein, 30 aa, Artificial Sequence
  Description of Artificial Sequence: Synthetic polypeptide
DDNEIRTTNPVATERYGVVSNTNLQHLGNQ

SEQ ID NO: 44797 - protein, 29 aa, Artificial Sequence
  Description of Artificial Sequence: Synthetic peptide
DSAEIRTTNPVATEQYGCCSCTVHQHGNR

SEQ ID NO: 44798 - protein, 28 aa, Artificial Sequence
  Description of Artificial Sequence: Synthetic peptide
DEEEVASTNPVCTEQYGVVSDNLQSGNQ

SEQ ID NO: 44799 - protein, 28 aa, Artificial Sequence
  Description of Artificial Sequence: Synthetic peptide
DEEEVATTNPVATEQYGEVPETCQRGER

SEQ ID NO: 44800 - protein, 29 aa, Artificial Sequence
  Description of Artificial Sequence: Synthetic peptide
SEEEISCTNPIATEQYGSVSSNLMRGSNQ

SEQ ID NO: 44801 - protein, 32 aa, Artificial Sequence
  Description of Artificial Sequence: Synthetic polypeptide
AEEEIRTTNPVATEQYGSVSTNNNQQGSNLQT

SEQ ID NO: 44802 - protein, 31 aa, Artificial Sequence
  Description of Artificial Sequence: Synthetic polypeptide
AEEEIRTTNPVATEQYGSVTITENLLQRVIQ

SEQ ID NO: 44803 - protein, 30 aa, Artificial Sequence
  Description of Artificial Sequence: Synthetic polypeptide
DSAEIRTTNPVATEQYGCCSTVELQTGGNR

SEQ ID NO: 44804 - protein, 32 aa, Artificial Sequence
  Description of Artificial Sequence: Synthetic polypeptide
AEEEIRTTNPVATEQYGSVSTNNNQLNIGNDE

SEQ ID NO: 44805 - protein, 31 aa, Artificial Sequence
  Description of Artificial Sequence: Synthetic polypeptide
DEEEIVTTNPVATEQYGSVSTNGLFNVTGEF

SEQ ID NO: 44806 - protein, 31 aa, Artificial Sequence
  Description of Artificial Sequence: Synthetic polypeptide
AEEEIRTTNPVATEQYGSVTSTNNQNVENND

SEQ ID NO: 44807 - protein, 35 aa, Artificial Sequence
  Description of Artificial Sequence: Synthetic polypeptide
DEEEIVRTTNPVATEQYGSVVSCTNAFQRGGNNRW

SEQ ID NO: 44808 - protein, 31 aa, Artificial Sequence
  Description of Artificial Sequence: Synthetic polypeptide
NEEEIRTTNPVAYEQYGSTCSCTHLQRVGGR

SEQ ID NO: 44809 - protein, 30 aa, Artificial Sequence
  Description of Artificial Sequence: Synthetic polypeptide
DEEEIVTTNPVATEQYGEVSTDLDQGDTRD

SEQ ID NO: 44810 - protein, 30 aa, Artificial Sequence
  Description of Artificial Sequence: Synthetic polypeptide
DDQEIRTTNPVATEQYGCVSTNPLQLGGMD

SEQ ID NO: 44811 - protein, 32 aa, Artificial Sequence
  Description of Artificial Sequence: Synthetic polypeptide
DEEEIVTTNPVATEQYGSVCSTSLQTEGNQFA

SEQ ID NO: 44812 - protein, 32 aa, Artificial Sequence
  Description of Artificial Sequence: Synthetic polypeptide
SEEEIVTTNPVATEQYGSVCSATDNLMFEGNR

SEQ ID NO: 44813 - protein, 32 aa, Artificial Sequence
  Description of Artificial Sequence: Synthetic polypeptide
AEEEIRTTNPVATEQYGSVSTNNNQQGVNVES

SEQ ID NO: 44814 - protein, 30 aa, Artificial Sequence
  Description of Artificial Sequence: Synthetic polypeptide
SEEEIVTTNPIATEQYGSVSAEGLVMRGNR

SEQ ID NO: 44815 - protein, 32 aa, Artificial Sequence
  Description of Artificial Sequence: Synthetic polypeptide
SEEEIVTTNPIATEQYGSVCSATDNLMREGNR

SEQ ID NO: 44816 - protein, 32 aa, Artificial Sequence
  Description of Artificial Sequence: Synthetic polypeptide
AEEEIRTTNPVATEQYGSVSTNNNQEQIGNDG

SEQ ID NO: 44817 - protein, 32 aa, Artificial Sequence
  Description of Artificial Sequence: Synthetic polypeptide
AEEEIRTTNPVATEQYGSVTSTNLNQNQENNN

SEQ ID NO: 44818 - protein, 28 aa, Artificial Sequence
  Description of Artificial Sequence: Synthetic peptide
DSECIRTTNPVATEAYGKVSTNHQKVNL

SEQ ID NO: 44819 - protein, 32 aa, Artificial Sequence
  Description of Artificial Sequence: Synthetic polypeptide
DSDEIRTTNPVAYEQYGSVPSCTNLQTGGNRM

SEQ ID NO: 44820 - protein, 31 aa, Artificial Sequence
  Description of Artificial Sequence: Synthetic polypeptide
SEEEIVCTNPIATEQYGSVCSATNLMREGNR

SEQ ID NO: 44821 - protein, 31 aa, Artificial Sequence
  Description of Artificial Sequence: Synthetic polypeptide
DEEEIVTTNPVATEQYGSVSNNGLFQEGGEN

SEQ ID NO: 44822 - protein, 32 aa, Artificial Sequence
  Description of Artificial Sequence: Synthetic polypeptide
AEEEIRTTNPVATEQYGSVSTNNNQEIGNQQN

SEQ ID NO: 44823 - protein, 28 aa, Artificial Sequence
  Description of Artificial Sequence: Synthetic peptide
DDNEIACTNPVATEQYGEASENLQRGGR

SEQ ID NO: 44824 - protein, 31 aa, Artificial Sequence
  Description of Artificial Sequence: Synthetic polypeptide
DEEGIRTTNPVATEQYGCVSTQNEGQGGGNI

SEQ ID NO: 44825 - protein, 31 aa, Artificial Sequence
  Description of Artificial Sequence: Synthetic polypeptide
DEEGIRTTNPVATEQYGDVSTNTGQGEGGNQ

SEQ ID NO: 44826 - protein, 30 aa, Artificial Sequence
  Description of Artificial Sequence: Synthetic polypeptide
QEEEICTTNPVATEQYGSVSTNLQAPPETP

SEQ ID NO: 44827 - protein, 31 aa, Artificial Sequence
  Description of Artificial Sequence: Synthetic polypeptide
DQGEIRTTNPVATEQYGSVSTNLLEIGSMPR

SEQ ID NO: 44828 - protein, 30 aa, Artificial Sequence
  Description of Artificial Sequence: Synthetic polypeptide
DQGEIRTTNPVATEQYGCVSTNPLQLGPMD

SEQ ID NO: 44829 - protein, 30 aa, Artificial Sequence
  Description of Artificial Sequence: Synthetic polypeptide
DEEHIRTTNPVATEMWGSVTTNNLQLGVER

SEQ ID NO: 44830 - protein, 31 aa, Artificial Sequence
  Description of Artificial Sequence: Synthetic polypeptide
DEEHIRTTNPVATEQWGNSVATNNLQHGVGR

SEQ ID NO: 44831 - protein, 30 aa, Artificial Sequence
  Description of Artificial Sequence: Synthetic polypeptide
DEEHIRTTNPVATEQWGSVATNNLVLGVND

SEQ ID NO: 44832 - protein, 30 aa, Artificial Sequence
  Description of Artificial Sequence: Synthetic polypeptide
DQEEISTTNPVATCQYGSVSTNPIRSGSNQ

SEQ ID NO: 44833 - protein, 32 aa, Artificial Sequence
  Description of Artificial Sequence: Synthetic polypeptide
DSAEIRTTNPVATEAYGSVSATNMLQRTGGRN

SEQ ID NO: 44834 - protein, 32 aa, Artificial Sequence
  Description of Artificial Sequence: Synthetic polypeptide
AEEEIRTTNPVATEQYGSVSTNNNQQQQGNEF

SEQ ID NO: 44835 - protein, 30 aa, Artificial Sequence
  Description of Artificial Sequence: Synthetic polypeptide
DEEHISTTNPVATEQWGSVATNNLQEGVER

SEQ ID NO: 44836 - protein, 28 aa, Artificial Sequence
  Description of Artificial Sequence: Synthetic peptide
DEEIIACTNPVATEQYGCVATNDQFGNS

SEQ ID NO: 44837 - protein, 29 aa, Artificial Sequence
  Description of Artificial Sequence: Synthetic peptide
DEEIIATTNPVATEQYGCVATNDQDGNNP

SEQ ID NO: 44838 - protein, 28 aa, Artificial Sequence
  Description of Artificial Sequence: Synthetic peptide
SEEEIRTTNPVSTEPYGSVSEDLMQGNH

SEQ ID NO: 44839 - protein, 31 aa, Artificial Sequence
  Description of Artificial Sequence: Synthetic polypeptide
DQEEIRTTNPVAYQQYGSVSTNGVQNGDNHR

SEQ ID NO: 44840 - protein, 31 aa, Artificial Sequence
  Description of Artificial Sequence: Synthetic polypeptide
DEEIIRTTNPVATEQYGAVSTNDQQFGVNVI

SEQ ID NO: 44841 - protein, 31 aa, Artificial Sequence
  Description of Artificial Sequence: Synthetic polypeptide
DEEIIRTTNPVATEQYGCVSTNIQQFEGNNC

SEQ ID NO: 44842 - protein, 31 aa, Artificial Sequence
  Description of Artificial Sequence: Synthetic polypeptide
DEEHIRTTNPVATEQYGSVSTPHELRGENQE

SEQ ID NO: 44843 - protein, 32 aa, Artificial Sequence
  Description of Artificial Sequence: Synthetic polypeptide
AEEEIRTTNPVATEQYGSVSTNSNQQNQGGNV

SEQ ID NO: 44844 - protein, 33 aa, Artificial Sequence
  Description of Artificial Sequence: Synthetic polypeptide
DSAEIRTTNPVATECYGSVVSTNELSQRGGNNR

SEQ ID NO: 44845 - protein, 32 aa, Artificial Sequence
  Description of Artificial Sequence: Synthetic polypeptide
DEEGIRTTNPVATEQYGSVVSTNGEGQGGGNI

SEQ ID NO: 44846 - protein, 32 aa, Artificial Sequence
  Description of Artificial Sequence: Synthetic polypeptide
AEEEIRTTNPVATEQYGSVSTNNNQQIGTNGQ

SEQ ID NO: 44847 - protein, 32 aa, Artificial Sequence
  Description of Artificial Sequence: Synthetic polypeptide
AEEEIRTTNPVATEQYGSVSTNNNQQLQGNEN

SEQ ID NO: 44848 - protein, 32 aa, Artificial Sequence
  Description of Artificial Sequence: Synthetic polypeptide
DEEGIRTTNPVATEQYGSVSATTLQLGDSRHD

SEQ ID NO: 44849 - protein, 30 aa, Artificial Sequence
  Description of Artificial Sequence: Synthetic polypeptide
DEEGIRTTNPVATEQYGSVSTGLGDNGQED

SEQ ID NO: 44850 - protein, 31 aa, Artificial Sequence
  Description of Artificial Sequence: Synthetic polypeptide
DEEGIRTTNPVATEQYGSVSTNADDGNGQGG

SEQ ID NO: 44851 - protein, 32 aa, Artificial Sequence
  Description of Artificial Sequence: Synthetic polypeptide
DEEGIRTTNPVATEQYGSVSTNLDDGNGQENT

SEQ ID NO: 44852 - protein, 32 aa, Artificial Sequence
  Description of Artificial Sequence: Synthetic polypeptide
DEEGIRTTNPVATEQYGSVSTNLDDGNGQGEN

SEQ ID NO: 44853 - protein, 31 aa, Artificial Sequence
  Description of Artificial Sequence: Synthetic polypeptide
DEEGIRTTNPVATEQYGVVSVTNEGQGGGNI

SEQ ID NO: 44854 - protein, 31 aa, Artificial Sequence
  Description of Artificial Sequence: Synthetic polypeptide
DEEGIRTTNPVATEQYGSVSTNMGDNGGQNV

SEQ ID NO: 44855 - protein, 31 aa, Artificial Sequence
  Description of Artificial Sequence: Synthetic polypeptide
DDMEIRTTNPVATEQYGSVSTNDLQESGSDQ

SEQ ID NO: 44856 - protein, 31 aa, Artificial Sequence
  Description of Artificial Sequence: Synthetic polypeptide
DDMEIRTTNPVATEQYGSVSTGNELQNGSDQ

SEQ ID NO: 44857 - protein, 32 aa, Artificial Sequence
  Description of Artificial Sequence: Synthetic polypeptide
DEEGIRTTNPVATEQYGSVSTVNDLGDNGQNE

SEQ ID NO: 44858 - protein, 32 aa, Artificial Sequence
  Description of Artificial Sequence: Synthetic polypeptide
DEEGIRTTNPVATEQYGSVSTVNLDDGNGQGN

SEQ ID NO: 44859 - protein, 32 aa, Artificial Sequence
  Description of Artificial Sequence: Synthetic polypeptide
AEEEIRTTNPVATEQYGSVSVWNSDQARFGNL

SEQ ID NO: 44860 - protein, 32 aa, Artificial Sequence
  Description of Artificial Sequence: Synthetic polypeptide
DEEGIRTTNPVATEQYGSVSTVNLGDNGQNGE

SEQ ID NO: 44861 - protein, 30 aa, Artificial Sequence
  Description of Artificial Sequence: Synthetic polypeptide
SEEEIRTTNPVSTEQYGSVSMNIQQQNGNH

SEQ ID NO: 44862 - protein, 31 aa, Artificial Sequence
  Description of Artificial Sequence: Synthetic polypeptide
DDMEIRTTNPVATEQYGSVSTNGLQHQGMGQ

SEQ ID NO: 44863 - protein, 32 aa, Artificial Sequence
  Description of Artificial Sequence: Synthetic polypeptide
AEEEIRTTNPVATEQYGSVSTNSNQQQGNEVE

SEQ ID NO: 44864 - protein, 30 aa, Artificial Sequence
  Description of Artificial Sequence: Synthetic polypeptide
DEEQIATTNPVATEIYGCVATNLQDGENRQ

SEQ ID NO: 44865 - protein, 30 aa, Artificial Sequence
  Description of Artificial Sequence: Synthetic polypeptide
DEEQIATTNPVATEIYGCVATNLQDQGPNR

SEQ ID NO: 44866 - protein, 32 aa, Artificial Sequence
  Description of Artificial Sequence: Synthetic polypeptide
AEEEIRTTNPVATEQYGSVSTSNEQAGNNQQT

SEQ ID NO: 44867 - protein, 32 aa, Artificial Sequence
  Description of Artificial Sequence: Synthetic polypeptide
AEEEIRTTNPVATEQYGSVSTSNGNQQQGNSN

SEQ ID NO: 44868 - protein, 32 aa, Artificial Sequence
  Description of Artificial Sequence: Synthetic polypeptide
AEEEIRTTNPVATEQYGSVSTSNGNQQTGNSE

SEQ ID NO: 44869 - protein, 32 aa, Artificial Sequence
  Description of Artificial Sequence: Synthetic polypeptide
SEEEIRTTNPVATESYGMSVSNTNLERGDQRM

SEQ ID NO: 44870 - protein, 30 aa, Artificial Sequence
  Description of Artificial Sequence: Synthetic polypeptide
DEESIATTNPVAYEAYGSVNTGNELQRGNM

SEQ ID NO: 44871 - protein, 28 aa, Artificial Sequence
  Description of Artificial Sequence: Synthetic peptide
SEEEIRTTNPVATESYGCIANNLQDGND

SEQ ID NO: 44872 - protein, 31 aa, Artificial Sequence
  Description of Artificial Sequence: Synthetic polypeptide
DQEEIRTTNPVATDQYGSVSTNGEQNTQNER

SEQ ID NO: 44873 - protein, 30 aa, Artificial Sequence
  Description of Artificial Sequence: Synthetic polypeptide
DEESIATTNPVAYEPYGSVVNTNELQRGNM

SEQ ID NO: 44874 - protein, 29 aa, Artificial Sequence
  Description of Artificial Sequence: Synthetic peptide
DEESIATTNPVAYEQYSEEVSTNLQHGNV

SEQ ID NO: 44875 - protein, 30 aa, Artificial Sequence
  Description of Artificial Sequence: Synthetic polypeptide
DEESIATTNPVAYERYGSVNTNSLSQRGNM

SEQ ID NO: 44876 - protein, 30 aa, Artificial Sequence
  Description of Artificial Sequence: Synthetic polypeptide
DEESIATVNPVATEPYGSVSANLDERDGNR

SEQ ID NO: 44877 - protein, 30 aa, Artificial Sequence
  Description of Artificial Sequence: Synthetic polypeptide
SEEEIRTTNPVATEQYGYFSTNPNDRGENE

SEQ ID NO: 44878 - protein, 28 aa, Artificial Sequence
  Description of Artificial Sequence: Synthetic peptide
DEESIATVNPVATEPYGSVSANLDRGDS

SEQ ID NO: 44879 - protein, 31 aa, Artificial Sequence
  Description of Artificial Sequence: Synthetic polypeptide
SEEEIRTTNPVATEQYGVVSTNNLYLDINNR

SEQ ID NO: 44880 - protein, 29 aa, Artificial Sequence
  Description of Artificial Sequence: Synthetic peptide
DEESIATVNPVATEPYGSVSANLERGNVS

SEQ ID NO: 44881 - protein, 32 aa, Artificial Sequence
  Description of Artificial Sequence: Synthetic polypeptide
AEEEIRTTNPVATEQYGSVSTSNENQQTGNTD

SEQ ID NO: 44882 - protein, 31 aa, Artificial Sequence
  Description of Artificial Sequence: Synthetic polypeptide
AEEEIRTTNPVATEQYGSVSVTVTGQGGNND

SEQ ID NO: 44883 - protein, 29 aa, Artificial Sequence
  Description of Artificial Sequence: Synthetic peptide
DEESIATTNPVATEMWGSVATNTLQQGNM

SEQ ID NO: 44884 - protein, 32 aa, Artificial Sequence
  Description of Artificial Sequence: Synthetic polypeptide
DQEEIRTTNPVATEQYGCVCSTELQRSGSNQS

SEQ ID NO: 44885 - protein, 32 aa, Artificial Sequence
  Description of Artificial Sequence: Synthetic polypeptide
AEEEIRTTNPVATEQYGSVSTSGNEQAGENND

SEQ ID NO: 44886 - protein, 29 aa, Artificial Sequence
  Description of Artificial Sequence: Synthetic peptide
DEESIATTNPVATECYGSVNTDTLQGGNM

SEQ ID NO: 44887 - protein, 32 aa, Artificial Sequence
  Description of Artificial Sequence: Synthetic polypeptide
AEEEIRTTNPVATEQYGSVSTSGNEQAGGNNI

SEQ ID NO: 44888 - protein, 32 aa, Artificial Sequence
  Description of Artificial Sequence: Synthetic polypeptide
SEEEIRTTNPVATESYGSVCSNTNLAERGDQR

SEQ ID NO: 44889 - protein, 29 aa, Artificial Sequence
  Description of Artificial Sequence: Synthetic peptide
DEESIATTNPVATECYGSVNTNDGQMGNM

SEQ ID NO: 44890 - protein, 30 aa, Artificial Sequence
  Description of Artificial Sequence: Synthetic polypeptide
DEESIATTNPVATECYGSVNTNDLQGGNDM

SEQ ID NO: 44891 - protein, 32 aa, Artificial Sequence
  Description of Artificial Sequence: Synthetic polypeptide
AEEEIRTTNPVATEQYGSVSTSGNLQTNNNSE

SEQ ID NO: 44892 - protein, 32 aa, Artificial Sequence
  Description of Artificial Sequence: Synthetic polypeptide
DQEEIRTTNPVATDQYGSVSTNEHQNTGGNNR

SEQ ID NO: 44893 - protein, 30 aa, Artificial Sequence
  Description of Artificial Sequence: Synthetic polypeptide
DEESIATTNPVATECYGSVNTNTGDQRGNM

SEQ ID NO: 44894 - protein, 29 aa, Artificial Sequence
  Description of Artificial Sequence: Synthetic peptide
DEESIATTNPVATECYGSVNTNTLQGTNM

SEQ ID NO: 44895 - protein, 30 aa, Artificial Sequence
  Description of Artificial Sequence: Synthetic polypeptide
SEEEIRTTNPVATESYGSVANTNLEQGDQR

SEQ ID NO: 44896 - protein, 32 aa, Artificial Sequence
  Description of Artificial Sequence: Synthetic polypeptide
AEEEIRTTNPVATEQYGSVSTSNATNQQTGNT

SEQ ID NO: 44897 - protein, 30 aa, Artificial Sequence
  Description of Artificial Sequence: Synthetic polypeptide
DEESIATTNPVATECYGSVNTNTLQVGNNM

SEQ ID NO: 44898 - protein, 32 aa, Artificial Sequence
  Description of Artificial Sequence: Synthetic polypeptide
AEEEIRTTNPVATEQYGSVSTSNENQGTGNGN

SEQ ID NO: 44899 - protein, 29 aa, Artificial Sequence
  Description of Artificial Sequence: Synthetic peptide
DEESIATTNPVATECYGSVNTNTQQQGNM

SEQ ID NO: 44900 - protein, 32 aa, Artificial Sequence
  Description of Artificial Sequence: Synthetic polypeptide
AEEEIRTTNPVATEQYGSVSTSNENQQQTGNN

SEQ ID NO: 44901 - protein, 31 aa, Artificial Sequence
  Description of Artificial Sequence: Synthetic polypeptide
AEEEIRTTNPVATEQYGSVSVTVTGQGGNQE

SEQ ID NO: 44902 - protein, 32 aa, Artificial Sequence
  Description of Artificial Sequence: Synthetic polypeptide
SEEEIRTTNPVATEQYGVVSTGNLQRFNSNFA

SEQ ID NO: 44903 - protein, 30 aa, Artificial Sequence
  Description of Artificial Sequence: Synthetic polypeptide
DQEEIRTTNPVATDQYGSVSTLGEQNNNQR

SEQ ID NO: 44904 - protein, 33 aa, Artificial Sequence
  Description of Artificial Sequence: Synthetic polypeptide
AEEEIRTTNPVATEQYGSVSTSNLQQQGNGTGQ

SEQ ID NO: 44905 - protein, 29 aa, Artificial Sequence
  Description of Artificial Sequence: Synthetic peptide
DEESIMTTNPVATECYGSVNTNTLQRNIM

SEQ ID NO: 44906 - protein, 31 aa, Artificial Sequence
  Description of Artificial Sequence: Synthetic polypeptide
DEESIMTTNPVATECYGSVNTVNTLQRGNME

SEQ ID NO: 44907 - protein, 32 aa, Artificial Sequence
  Description of Artificial Sequence: Synthetic polypeptide
SEEEIRTTNPVATEQYGSVSWTDNQQRNANGA

SEQ ID NO: 44908 - protein, 32 aa, Artificial Sequence
  Description of Artificial Sequence: Synthetic polypeptide
AEEEIRTTNPVATEQYGSVSTSNNNQNIGNEQ

SEQ ID NO: 44909 - protein, 30 aa, Artificial Sequence
  Description of Artificial Sequence: Synthetic polypeptide
DEESIMTTNPVATECYGSVYTNTLQQRGEM

SEQ ID NO: 44910 - protein, 33 aa, Artificial Sequence
  Description of Artificial Sequence: Synthetic polypeptide
SEEEIRTTNPVATEQYGSVSVTTNNLQSGNDQN

SEQ ID NO: 44911 - protein, 32 aa, Artificial Sequence
  Description of Artificial Sequence: Synthetic polypeptide
AEEEIRTTNPVATEQYGSVSTSNNNQQGNNSN

SEQ ID NO: 44912 - protein, 31 aa, Artificial Sequence
  Description of Artificial Sequence: Synthetic polypeptide
DEESIMTTNPVATECYGSVNTNTLQRGQNEG

SEQ ID NO: 44913 - protein, 32 aa, Artificial Sequence
  Description of Artificial Sequence: Synthetic polypeptide
AEEEIRTTNPVATEQYGSVSTSNNNQSIGNQT

SEQ ID NO: 44914 - protein, 30 aa, Artificial Sequence
  Description of Artificial Sequence: Synthetic polypeptide
DQEEIRSTNPVATEQYGQSSSTNMQGSGNN

SEQ ID NO: 44915 - protein, 34 aa, Artificial Sequence
  Description of Artificial Sequence: Synthetic polypeptide
SEEEIRTTNPVATEQYGSVSVTGNLSQTTGGNQR

SEQ ID NO: 44916 - protein, 32 aa, Artificial Sequence
  Description of Artificial Sequence: Synthetic polypeptide
AEEEIRTTNPVATEQYGSVSTSNNQQQEGNSQ

SEQ ID NO: 44917 - protein, 35 aa, Artificial Sequence
  Description of Artificial Sequence: Synthetic polypeptide
DEESIRTTNPVATEQYGSVPSCTNALPQRTVTGNR

SEQ ID NO: 44918 - protein, 32 aa, Artificial Sequence
  Description of Artificial Sequence: Synthetic polypeptide
DEESIRTTNPVAWEQYGSVCSNWNLRQFNGNR

SEQ ID NO: 44919 - protein, 28 aa, Artificial Sequence
  Description of Artificial Sequence: Synthetic peptide
QEEEIRCTNPIATEQYGSASENLMRGEK

SEQ ID NO: 44920 - protein, 30 aa, Artificial Sequence
  Description of Artificial Sequence: Synthetic polypeptide
DEESIRTTNPVAYEQYSEEVTTNLQIGENR

SEQ ID NO: 44921 - protein, 32 aa, Artificial Sequence
  Description of Artificial Sequence: Synthetic polypeptide
DEESIRTTNPVATEQWGSVAATNNLQPGVNRN

SEQ ID NO: 44922 - protein, 30 aa, Artificial Sequence
  Description of Artificial Sequence: Synthetic polypeptide
QEEEIRATNPVAYEQYGSVSTELQNGNDPE

SEQ ID NO: 44923 - protein, 33 aa, Artificial Sequence
  Description of Artificial Sequence: Synthetic polypeptide
SEEEIRTTNPVATEQYGSVSWTHNLEQRTEGYE

SEQ ID NO: 44924 - protein, 32 aa, Artificial Sequence
  Description of Artificial Sequence: Synthetic polypeptide
SEEEIRTTNPVATEQYGSVSWVDLDQHGMNQR

SEQ ID NO: 44925 - protein, 33 aa, Artificial Sequence
  Description of Artificial Sequence: Synthetic polypeptide
AEEEIRTTNPVATEQYGSVSTSNLQQQQGNGIG

SEQ ID NO: 44926 - protein, 33 aa, Artificial Sequence
  Description of Artificial Sequence: Synthetic polypeptide
AEEEIRTTNPVATEQYGSVSTSNLTQQGENYTT

SEQ ID NO: 44927 - protein, 31 aa, Artificial Sequence
  Description of Artificial Sequence: Synthetic polypeptide
SEEEIRTTNPVATEQYGTVCSTDNLVEFGND

SEQ ID NO: 44928 - protein, 32 aa, Artificial Sequence
  Description of Artificial Sequence: Synthetic polypeptide
SEEEIRTTNPVATEQYGTVASATNLQEAGNDQ

SEQ ID NO: 44929 - protein, 32 aa, Artificial Sequence
  Description of Artificial Sequence: Synthetic polypeptide
AEEEIRTTNPVATEQYGSVSTSNNEQAGNANI

SEQ ID NO: 44930 - protein, 31 aa, Artificial Sequence
  Description of Artificial Sequence: Synthetic polypeptide
DQEEIRTTNPVATDQYGSVSTLGEQNGNVRS

SEQ ID NO: 44931 - protein, 31 aa, Artificial Sequence
  Description of Artificial Sequence: Synthetic polypeptide
AEEEIRTTNPVATEQYGSVSTSNNLGNEGED

SEQ ID NO: 44932 - protein, 30 aa, Artificial Sequence
  Description of Artificial Sequence: Synthetic polypeptide
DEESIMTTNPVATECYGSVNNTNTLERGNM

SEQ ID NO: 44933 - protein, 31 aa, Artificial Sequence
  Description of Artificial Sequence: Synthetic polypeptide
DEESICTTNPVATECYGSVSNTNTLQAGNMT

SEQ ID NO: 44934 - protein, 32 aa, Artificial Sequence
  Description of Artificial Sequence: Synthetic polypeptide
DQEEIRTTNPVATCQYGSVSTNGVQNGSNNRG

SEQ ID NO: 44935 - protein, 32 aa, Artificial Sequence
  Description of Artificial Sequence: Synthetic polypeptide
DQEEIRTTNPVATCQYGSVSTNGVQNFGSNHR

SEQ ID NO: 44936 - protein, 31 aa, Artificial Sequence
  Description of Artificial Sequence: Synthetic polypeptide
DQEEIRTTNPVATCQYGCVSTNGDQNGSNNR

SEQ ID NO: 44937 - protein, 32 aa, Artificial Sequence
  Description of Artificial Sequence: Synthetic polypeptide
SEEEIRTTNPVATEQYGSVVTANLQYLQGNTM

SEQ ID NO: 44938 - protein, 34 aa, Artificial Sequence
  Description of Artificial Sequence: Synthetic polypeptide
SEEEIRTTNPVATEQYGSVVSVTNMLSQHGGNNR

SEQ ID NO: 44939 - protein, 31 aa, Artificial Sequence
  Description of Artificial Sequence: Synthetic polypeptide
SEEEIRTTNPVATEQYGSVVSSNILNTNNAR

SEQ ID NO: 44940 - protein, 31 aa, Artificial Sequence
  Description of Artificial Sequence: Synthetic polypeptide
SEEEIRTTNPVATEQYGSVTPTNLERTENNQ

SEQ ID NO: 44941 - protein, 30 aa, Artificial Sequence
  Description of Artificial Sequence: Synthetic polypeptide
DEESICTTNPVATESYGSVNTSNTLQQGNM

SEQ ID NO: 44942 - protein, 30 aa, Artificial Sequence
  Description of Artificial Sequence: Synthetic polypeptide
DEETIATTNPVATECYGSVETNTQIVRGNM

SEQ ID NO: 44943 - protein, 30 aa, Artificial Sequence
  Description of Artificial Sequence: Synthetic polypeptide
DEESIATTNPVATECYGSVATNTLQNQGNM

SEQ ID NO: 44944 - protein, 32 aa, Artificial Sequence
  Description of Artificial Sequence: Synthetic polypeptide
AEEEIRTTNPVATEQYGSVSTQNQQQDEGNNS

SEQ ID NO: 44945 - protein, 30 aa, Artificial Sequence
  Description of Artificial Sequence: Synthetic polypeptide
SEEEIRTTNPVATESYGSVSNTNLIREDQE

SEQ ID NO: 44946 - protein, 30 aa, Artificial Sequence
  Description of Artificial Sequence: Synthetic polypeptide
DEEQIRTTNPVATEAYGSVSTHESGRVGNT

SEQ ID NO: 44947 - protein, 29 aa, Artificial Sequence
  Description of Artificial Sequence: Synthetic peptide
DEEQIRTTNPVATEQWGSVSATHELNGNT

SEQ ID NO: 44948 - protein, 30 aa, Artificial Sequence
  Description of Artificial Sequence: Synthetic polypeptide
DEEQIRTTNPVATEQYGCVCSTEEIRFGNQ

SEQ ID NO: 44949 - protein, 33 aa, Artificial Sequence
  Description of Artificial Sequence: Synthetic polypeptide
AEEEIRTTNPVATEQYGSVSTNTNQLQEGNQEN

SEQ ID NO: 44950 - protein, 30 aa, Artificial Sequence
  Description of Artificial Sequence: Synthetic polypeptide
DEEQIRTTNPVATEQYGSIVSTDELRGEDT

SEQ ID NO: 44951 - protein, 31 aa, Artificial Sequence
  Description of Artificial Sequence: Synthetic polypeptide
DEEQIRTTNPVATEQYGSTVSTHEHTRGGNT

SEQ ID NO: 44952 - protein, 31 aa, Artificial Sequence
  Description of Artificial Sequence: Synthetic polypeptide
DEEQIRTTNPVATEQYGSTVSTHHSTRGTNT

SEQ ID NO: 44953 - protein, 31 aa, Artificial Sequence
  Description of Artificial Sequence: Synthetic polypeptide
DEEQIRTTNPVATEQYGSVCSTEEARGSNTQ

SEQ ID NO: 44954 - protein, 30 aa, Artificial Sequence
  Description of Artificial Sequence: Synthetic polypeptide
DEEQIRTTNPVATEQYGSVCSTEELNGNQS

SEQ ID NO: 44955 - protein, 31 aa, Artificial Sequence
  Description of Artificial Sequence: Synthetic polypeptide
DEEQIRTTNPVATEQYGSVCSTEELRGSNQM

SEQ ID NO: 44956 - protein, 31 aa, Artificial Sequence
  Description of Artificial Sequence: Synthetic polypeptide
SEEEIRTTNPVATESYGSVSNTNLHRSEDQR

SEQ ID NO: 44957 - protein, 31 aa, Artificial Sequence
  Description of Artificial Sequence: Synthetic polypeptide
SEEEIRTTNPVATESYGSVSNTNLHRNGDQQ

SEQ ID NO: 44958 - protein, 30 aa, Artificial Sequence
  Description of Artificial Sequence: Synthetic polypeptide
DEEQIRTTNPVATEQYGSVSPTVELTGNPT

SEQ ID NO: 44959 - protein, 31 aa, Artificial Sequence
  Description of Artificial Sequence: Synthetic polypeptide
DEEQIRTTNPVATEQYGSVSTGEGDRNGNTH

SEQ ID NO: 44960 - protein, 30 aa, Artificial Sequence
  Description of Artificial Sequence: Synthetic polypeptide
QEEEICTTNPVAYEQYGSVSTNLQQGDTEM

SEQ ID NO: 44961 - protein, 30 aa, Artificial Sequence
  Description of Artificial Sequence: Synthetic polypeptide
SEEEIRTTNPVATESYGSVSNTNLMGGDQQ

SEQ ID NO: 44962 - protein, 29 aa, Artificial Sequence
  Description of Artificial Sequence: Synthetic peptide
DEEQIRCTNPVATEQYGSVSTHELTENNT

SEQ ID NO: 44963 - protein, 31 aa, Artificial Sequence
  Description of Artificial Sequence: Synthetic polypeptide
SEEEIRTTNPVATESYGSVSNTNLTRGGDDD

SEQ ID NO: 44964 - protein, 32 aa, Artificial Sequence
  Description of Artificial Sequence: Synthetic polypeptide
AEEEIRTTNPVATEQYGSVSTNSNQQQNGNVT

SEQ ID NO: 44965 - protein, 31 aa, Artificial Sequence
  Description of Artificial Sequence: Synthetic polypeptide
SEEEIRTTNPVATESYGSVSPTVNEHRGMQR

SEQ ID NO: 44966 - protein, 30 aa, Artificial Sequence
  Description of Artificial Sequence: Synthetic polypeptide
DQEEIRTTNPVATHQYGSVSSNGVQNGNHD

SEQ ID NO: 44967 - protein, 30 aa, Artificial Sequence
  Description of Artificial Sequence: Synthetic polypeptide
DEEQIATTNPVATEQWGSVATNNDQLGDNR

SEQ ID NO: 44968 - protein, 31 aa, Artificial Sequence
  Description of Artificial Sequence: Synthetic polypeptide
AEEEIRTTNPVATEQYGSVSTNTLGGEGGGG

SEQ ID NO: 44969 - protein, 30 aa, Artificial Sequence
  Description of Artificial Sequence: Synthetic polypeptide
QEEEICTTNPVAYEQYGSVATNLQNDGNMF

SEQ ID NO: 44970 - protein, 32 aa, Artificial Sequence
  Description of Artificial Sequence: Synthetic polypeptide
AEEEIRTTNPVATEQYGSVSTNTNLGNGNGNG

SEQ ID NO: 44971 - protein, 32 aa, Artificial Sequence
  Description of Artificial Sequence: Synthetic polypeptide
SEEEIRTTNPVATESYGSVSNTNLHRMGDQRT

SEQ ID NO: 44972 - protein, 29 aa, Artificial Sequence
  Description of Artificial Sequence: Synthetic peptide
DEEQIATTNPVATESYGCVATNLQDGVNM

SEQ ID NO: 44973 - protein, 32 aa, Artificial Sequence
  Description of Artificial Sequence: Synthetic polypeptide
SEEEIRTTNPVATESYGSVSNTNNLHRFGDQR

SEQ ID NO: 44974 - protein, 30 aa, Artificial Sequence
  Description of Artificial Sequence: Synthetic polypeptide
DEEQIATTNPVATESYGCVATNLQDSGSNR

SEQ ID NO: 44975 - protein, 31 aa, Artificial Sequence
  Description of Artificial Sequence: Synthetic polypeptide
DEEQIATTNPVAWEQYGSVCSVTNLSQSGNY

SEQ ID NO: 44976 - protein, 28 aa, Artificial Sequence
  Description of Artificial Sequence: Synthetic peptide
QEEEICTTNPVAYEQYGSVATNLTDGDM

SEQ ID NO: 44977 - protein, 30 aa, Artificial Sequence
  Description of Artificial Sequence: Synthetic polypeptide
SEEEIRTTNPVATESYGSVSNTNMHRGDQG

SEQ ID NO: 44978 - protein, 30 aa, Artificial Sequence
  Description of Artificial Sequence: Synthetic polypeptide
DEEQIGTTNPVATEQYGSVSTPGELEGGNT

SEQ ID NO: 44979 - protein, 31 aa, Artificial Sequence
  Description of Artificial Sequence: Synthetic polypeptide
SEEEIRTTNPVATESYGSVSNTNLTRGVDQD

SEQ ID NO: 44980 - protein, 31 aa, Artificial Sequence
  Description of Artificial Sequence: Synthetic polypeptide
QEEEICTTNPVAYEQYGSVATNLQRNGEPRD

SEQ ID NO: 44981 - protein, 31 aa, Artificial Sequence
  Description of Artificial Sequence: Synthetic polypeptide
SEEEIRTTNPVATESYGSVSNTNLHHGSDTR

SEQ ID NO: 44982 - protein, 30 aa, Artificial Sequence
  Description of Artificial Sequence: Synthetic polypeptide
DEEQIRTTNPVATEQYGSVSTGGEGGGNGT

SEQ ID NO: 44983 - protein, 31 aa, Artificial Sequence
  Description of Artificial Sequence: Synthetic polypeptide
DEEQIRTTNPVATEQYGSVSTGHEGDRKGNT

SEQ ID NO: 44984 - protein, 31 aa, Artificial Sequence
  Description of Artificial Sequence: Synthetic polypeptide
AEEEIRTTNPVATEQYGSVSTQNNLQGQIQN

SEQ ID NO: 44985 - protein, 33 aa, Artificial Sequence
  Description of Artificial Sequence: Synthetic polypeptide
DQEEIRTTNPVATEQYGTVPSCTNLSARGGNNR

SEQ ID NO: 44986 - protein, 30 aa, Artificial Sequence
  Description of Artificial Sequence: Synthetic polypeptide
SEEEIRTTNPVATESYGSVSNTDLHDGDQR

SEQ ID NO: 44987 - protein, 32 aa, Artificial Sequence
  Description of Artificial Sequence: Synthetic polypeptide
AEEEIRTTNPVATEQYGSVSTQNNNQQIGNEG

SEQ ID NO: 44988 - protein, 32 aa, Artificial Sequence
  Description of Artificial Sequence: Synthetic polypeptide
AEEEIRTTNPVATEQYGSVSTQNNNQQNIGNG

SEQ ID NO: 44989 - protein, 29 aa, Artificial Sequence
  Description of Artificial Sequence: Synthetic peptide
DEESIACTNPVATEPYGQVATNLQDGSNR

SEQ ID NO: 44990 - protein, 30 aa, Artificial Sequence
  Description of Artificial Sequence: Synthetic polypeptide
DQEEIRTTNPVATEQYGSVSTDLHPGDEDG

SEQ ID NO: 44991 - protein, 32 aa, Artificial Sequence
  Description of Artificial Sequence: Synthetic polypeptide
AEEEIRTTNPVATEQYGSVSTQNLQQQEEGGG

SEQ ID NO: 44992 - protein, 33 aa, Artificial Sequence
  Description of Artificial Sequence: Synthetic polypeptide
DQEEIRTTNPVATEQYGQSVCSTNLQNFGSNDE

SEQ ID NO: 44993 - protein, 28 aa, Artificial Sequence
  Description of Artificial Sequence: Synthetic peptide
DEESIACTNPVATEQYGSVAMNDQPGNV

SEQ ID NO: 44994 - protein, 28 aa, Artificial Sequence
  Description of Artificial Sequence: Synthetic peptide
DEESIACTNPVATEQYGSVANNFQRVNL

SEQ ID NO: 44995 - protein, 29 aa, Artificial Sequence
  Description of Artificial Sequence: Synthetic peptide
DEESIACTNPVATEQYGSVSTHELENGNT

SEQ ID NO: 44996 - protein, 33 aa, Artificial Sequence
  Description of Artificial Sequence: Synthetic polypeptide
DQEEIRTTNPVATEQYGNVPSTNELSGRGGNNR

SEQ ID NO: 44997 - protein, 32 aa, Artificial Sequence
  Description of Artificial Sequence: Synthetic polypeptide
DQEEIRTTNPVATEQYGKVPSTNLSARGGNNS

SEQ ID NO: 44998 - protein, 29 aa, Artificial Sequence
  Description of Artificial Sequence: Synthetic peptide
DEESIACTNPVATETYGSVATNTLARGNM

SEQ ID NO: 44999 - protein, 31 aa, Artificial Sequence
  Description of Artificial Sequence: Synthetic polypeptide
DEESIATTNPVATEAYGSTVNTNELQRGTNM

SEQ ID NO: 45000 - protein, 32 aa, Artificial Sequence
  Description of Artificial Sequence: Synthetic polypeptide
AEEEIRTTNPVATEQYGSVSTQNNQQQTGNNE

SEQ ID NO: 45001 - protein, 30 aa, Artificial Sequence
  Description of Artificial Sequence: Synthetic polypeptide
DEESIATTNPVATECYGSVATNTLGQNGNM

SEQ ID NO: 45002 - protein, 30 aa, Artificial Sequence
  Description of Artificial Sequence: Synthetic polypeptide
DEEQIRTTNPVAYEQYGSVSTHAHSTRGNT

SEQ ID NO: 45003 - protein, 31 aa, Artificial Sequence
  Description of Artificial Sequence: Synthetic polypeptide
SEEEIRTTNPVATESYGSVSNTNGHRGGQRQ

SEQ ID NO: 45004 - protein, 31 aa, Artificial Sequence
  Description of Artificial Sequence: Synthetic polypeptide
DEEQIRTTNPVATEQYGSVSTGHENDRGNTE

SEQ ID NO: 45005 - protein, 31 aa, Artificial Sequence
  Description of Artificial Sequence: Synthetic polypeptide
SEEEIRTTNPVATESYGSVSNTNLGDTGDQR

SEQ ID NO: 45006 - protein, 30 aa, Artificial Sequence
  Description of Artificial Sequence: Synthetic polypeptide
DEEQIRTTNPVATEQYGSVSTHEAIVGVNT

SEQ ID NO: 45007 - protein, 31 aa, Artificial Sequence
  Description of Artificial Sequence: Synthetic polypeptide
AEEEIRTTNPVATEQYGSVSTNTNSEQGNNS

SEQ ID NO: 45008 - protein, 32 aa, Artificial Sequence
  Description of Artificial Sequence: Synthetic polypeptide
AEEEIRTTNPVATEQYGSVSTNTNTQGGILNE

SEQ ID NO: 45009 - protein, 31 aa, Artificial Sequence
  Description of Artificial Sequence: Synthetic polypeptide
DEEQIRTTNPVATEQYGSVSTHELTREELNT

SEQ ID NO: 45010 - protein, 30 aa, Artificial Sequence
  Description of Artificial Sequence: Synthetic polypeptide
DEEQIRTTNPVATEQYGSVSTLEELRQVNT

SEQ ID NO: 45011 - protein, 32 aa, Artificial Sequence
  Description of Artificial Sequence: Synthetic polypeptide
AEEEIRTTNPVATEQYGSVSTQNGEQNEGGNT

SEQ ID NO: 45012 - protein, 30 aa, Artificial Sequence
  Description of Artificial Sequence: Synthetic polypeptide
DEEQIRTTNPVATEQYGSVSTTGGETGGNT

SEQ ID NO: 45013 - protein, 32 aa, Artificial Sequence
  Description of Artificial Sequence: Synthetic polypeptide
SEEEIRTTNPVATESYGSVSNTNLGDRGTDQR

SEQ ID NO: 45014 - protein, 32 aa, Artificial Sequence
  Description of Artificial Sequence: Synthetic polypeptide
SEEEIRTTNPVATESYGSVSNTNLERGGDYRQ

SEQ ID NO: 45015 - protein, 28 aa, Artificial Sequence
  Description of Artificial Sequence: Synthetic peptide
DEEQIRTTNPVATEQYGSVSTVELTVLT

SEQ ID NO: 45016 - protein, 32 aa, Artificial Sequence
  Description of Artificial Sequence: Synthetic polypeptide
AEEEIRTTNPVATEQYGSVSTNVNQNTNGNEG

SEQ ID NO: 45017 - protein, 31 aa, Artificial Sequence
  Description of Artificial Sequence: Synthetic polypeptide
DEEQIRTTNPVATEQYGSVSYWEDLGRGGNT

SEQ ID NO: 45018 - protein, 31 aa, Artificial Sequence
  Description of Artificial Sequence: Synthetic polypeptide
SEEEIRTTNPVATESYGSVSNTNLEQGDQRD

SEQ ID NO: 45019 - protein, 30 aa, Artificial Sequence
  Description of Artificial Sequence: Synthetic polypeptide
AEEEIRTTNPVATEQYGSVSTPTQQQTNVE

SEQ ID NO: 45020 - protein, 29 aa, Artificial Sequence
  Description of Artificial Sequence: Synthetic peptide
DEEQIRTTNPVATEQYGSVSTVELTGPET

SEQ ID NO: 45021 - protein, 29 aa, Artificial Sequence
  Description of Artificial Sequence: Synthetic peptide
DEFEICTVNPVATEQYGYSVETNLEEGNH

SEQ ID NO: 45022 - protein, 32 aa, Artificial Sequence
  Description of Artificial Sequence: Synthetic polypeptide
AEEEIRTTNPVATEQYGSVSTTNLLEQGNNEN

SEQ ID NO: 45023 - protein, 31 aa, Artificial Sequence
  Description of Artificial Sequence: Synthetic polypeptide
SEEEIRTTNPVATEQYGCVSTELQEYFGSNQ

SEQ ID NO: 45024 - protein, 32 aa, Artificial Sequence
  Description of Artificial Sequence: Synthetic polypeptide
AEEEIRTTNPVATEQYGSVSVTTNQLNTEGNA

SEQ ID NO: 45025 - protein, 30 aa, Artificial Sequence
  Description of Artificial Sequence: Synthetic polypeptide
DEHEIATTNPVAYEQYGSISTNHSQREGSR

SEQ ID NO: 45026 - protein, 32 aa, Artificial Sequence
  Description of Artificial Sequence: Synthetic polypeptide
AEEEIRTTNPVATEQYGSVSTTNNLLQEQNND

SEQ ID NO: 45027 - protein, 33 aa, Artificial Sequence
  Description of Artificial Sequence: Synthetic polypeptide
AEEEIRTTNPVATEQYGSVSTTNNLLQQNGTNA

SEQ ID NO: 45028 - protein, 31 aa, Artificial Sequence
  Description of Artificial Sequence: Synthetic polypeptide
SEEEIRTTNPIATEQYGSVSATNLEDRGEDL

SEQ ID NO: 45029 - protein, 32 aa, Artificial Sequence
  Description of Artificial Sequence: Synthetic polypeptide
AEEEIRTTNPVATEQYGSVSTTNNLNQGEGGI

SEQ ID NO: 45030 - protein, 30 aa, Artificial Sequence
  Description of Artificial Sequence: Synthetic polypeptide
DGEEIRTTNPVATEQWGSVMSTLLQGEGTG

SEQ ID NO: 45031 - protein, 31 aa, Artificial Sequence
  Description of Artificial Sequence: Synthetic polypeptide
DGEEIRTTNPVATEQWGSSVTSTTLQGEGTR

SEQ ID NO: 45032 - protein, 31 aa, Artificial Sequence
  Description of Artificial Sequence: Synthetic polypeptide
DEHEIATTNPVAYEQYGTVSTNLQMGDEGNR

SEQ ID NO: 45033 - protein, 30 aa, Artificial Sequence
  Description of Artificial Sequence: Synthetic polypeptide
DEHEIATTNPVAYEQYGTVSTNLQNGDEDR

SEQ ID NO: 45034 - protein, 28 aa, Artificial Sequence
  Description of Artificial Sequence: Synthetic peptide
SEEEIRTTNPIATEQYGSAPENLQREEK

SEQ ID NO: 45035 - protein, 31 aa, Artificial Sequence
  Description of Artificial Sequence: Synthetic polypeptide
DEHEIATTNPVSTEQYGSVATNLQRDGNTVD

SEQ ID NO: 45036 - protein, 30 aa, Artificial Sequence
  Description of Artificial Sequence: Synthetic polypeptide
QEEEIRTTNPVATEPYGSVVSTNVSQGGSF

SEQ ID NO: 45037 - protein, 28 aa, Artificial Sequence
  Description of Artificial Sequence: Synthetic peptide
SEEEIRTTNPIATEQYGEVSENCMREER

SEQ ID NO: 45038 - protein, 30 aa, Artificial Sequence
  Description of Artificial Sequence: Synthetic polypeptide
DEHEIRMTNPVATEQYGSISNTNIQGEGLR

SEQ ID NO: 45039 - protein, 30 aa, Artificial Sequence
  Description of Artificial Sequence: Synthetic polypeptide
DEHEIATTNPVAYEQWGSVSTNLQGNNGNT

SEQ ID NO: 45040 - protein, 32 aa, Artificial Sequence
  Description of Artificial Sequence: Synthetic polypeptide
AEEEIRTTNPVATEQYGSVSTTNNLLGNGGNG

SEQ ID NO: 45041 - protein, 33 aa, Artificial Sequence
  Description of Artificial Sequence: Synthetic polypeptide
AEEEIRTTNPVATEQYGSVSTTNNLIQNNGTNM

SEQ ID NO: 45042 - protein, 33 aa, Artificial Sequence
  Description of Artificial Sequence: Synthetic polypeptide
AEEEIRTTNPVATEQYGSVSVTTNQLQQQIGNN

SEQ ID NO: 45043 - protein, 31 aa, Artificial Sequence
  Description of Artificial Sequence: Synthetic polypeptide
DEHEIATTNPVATEQYGSVSTNAQGQDGNEP

SEQ ID NO: 45044 - protein, 32 aa, Artificial Sequence
  Description of Artificial Sequence: Synthetic polypeptide
DEHEIATTNPVATEQYGSVSTNLNGNMGGNQR

SEQ ID NO: 45045 - protein, 31 aa, Artificial Sequence
  Description of Artificial Sequence: Synthetic polypeptide
DEHEIATTNPVATEQYGSVSTNLQGEHNDQQ

SEQ ID NO: 45046 - protein, 32 aa, Artificial Sequence
  Description of Artificial Sequence: Synthetic polypeptide
DEHEIATTNPVATEQYGSVSTNLQGNGQNEDG

SEQ ID NO: 45047 - protein, 32 aa, Artificial Sequence
  Description of Artificial Sequence: Synthetic polypeptide
DEHEIATTNPVATEQYGSVSTNLQGQMGDNEG

SEQ ID NO: 45048 - protein, 32 aa, Artificial Sequence
  Description of Artificial Sequence: Synthetic polypeptide
DDEEIGTTNPVATEQYGSVSTGNQLQETMGNL

SEQ ID NO: 45049 - protein, 31 aa, Artificial Sequence
  Description of Artificial Sequence: Synthetic polypeptide
DEHEIATTNPVATEQYGSVSTTNGNQQGNHQ

SEQ ID NO: 45050 - protein, 31 aa, Artificial Sequence
  Description of Artificial Sequence: Synthetic polypeptide
DEHEIRTTNPCATECYGSVSTNLQGDGGMQR

SEQ ID NO: 45051 - protein, 32 aa, Artificial Sequence
  Description of Artificial Sequence: Synthetic polypeptide
AEEEIRTTNPVATEQYGSVSTTNNLDQGTNVE

SEQ ID NO: 45052 - protein, 32 aa, Artificial Sequence
  Description of Artificial Sequence: Synthetic polypeptide
DEHEIATTNPVATEQYGVVSTNLQGNQGNPNR

SEQ ID NO: 45053 - protein, 32 aa, Artificial Sequence
  Description of Artificial Sequence: Synthetic polypeptide
DGEEIRTTNPVATEQWGSVTSWTLLQRGTQRM
